United States Patent 11,078,247 (RNA ENCODING A THERAPEUTIC PROTEIN) - sequence listing, part 30

SEQ ID NO: 51627 - RNA, 3201 nt, Artificial Sequence
  derived and/or modified sequence opt2 from VCL__Homo_sapiens__NP_003364
augcccgucuuccacacccgcaccaucgaguccauccucgagcccgucgcccagcagaucucccaccucgucaucaugcacgaggagggcgaggucgacggcaaggccauccccgaccucaccgcccccgucgccgccguccaggccgccgucuccaaccucguccgcgucggcaaggagaccguccagaccaccgaggaccagauccucaagcgcgacaugccccccgccuucaucaaggucgagaacgccugcaccaagcucguccaggccgcccagaugcuccaguccgaccccuacuccguccccgcccgcgacuaccucaucgacggcucccgcggcauccucuccggcaccuccgaccuccuccucaccuucgacgaggccgagguccgcaagaucauccgcgucugcaagggcauccucgaguaccucaccgucgccgaggucgucgagaccauggaggaccucgucaccuacaccaagaaccucggccccggcaugaccaagauggccaagaugaucgacgagcgccagcaggagcucacccaccaggagcaccgcgucaugcucgucaacuccaugaacaccgucaaggagcuccuccccguccucaucuccgccaugaagaucuucgucaccaccaagaacuccaagaaccagggcaucgaggaggcccucaagaaccgcaacuucaccgucgagaagauguccgccgagaucaacgagaucauccgcguccuccagcucaccuccugggacgaggacgccugggccuccaaggacaccgaggccaugaagcgcgcccucgccuccaucgacuccaagcucaaccaggccaagggcuggcuccgcgaccccuccgccucccccggcgacgccggcgagcaggccauccgccagauccucgacgaggccggcaaggucggcgagcucugcgccggcaaggagcgccgcgagauccucggcaccugcaagaugcucggccagaugaccgaccaggucgccgaccuccgcgcccgcggccagggcuccucccccgucgccaugcagaaggcccagcaggucucccagggccucgacguccucaccgccaaggucgagaacgccgcccgcaagcucgaggccaugaccaacuccaagcaguccaucgccaagaagaucgacgccgcccagaacuggcucgccgaccccaacggcggccccgagggcgaggagcagauccgcggcgcccucgccgaggcccgcaagaucgccgagcucugcgacgaccccaaggagcgcgacgacauccuccgcucccucggcgagaucuccgcccucaccuccaagcucgccgaccuccgccgccagggcaagggcgacucccccgaggcccgcgcccucgccaagcaggucgccaccgcccuccagaaccuccagaccaagaccaaccgcgccgucgccaacucccgccccgccaaggccgccguccaccucgagggcaagaucgagcaggcccagcgcuggaucgacaaccccaccgucgacgaccgcggcgucggccaggccgccauccgcggccucgucgccgagggccaccgccucgccaacgucaugaugggccccuaccgccaggaccuccucgccaagugcgaccgcgucgaccagcucaccgcccagcucgccgaccucgccgcccgcggcgagggcgaguccccccaggcccgcgcccucgccucccagcuccaggacucccucaaggaccucaaggcccgcaugcaggaggccaugacccaggaggucuccgacgucuucuccgacaccaccacccccaucaagcuccucgccgucgccgccaccgccccccccgacgcccccaaccgcgaggaggucuucgacgagcgcgccgccaacuucgagaaccacuccggcaagcucggcgccaccgccgagaaggccgccgccgucggcaccgccaacaaguccaccgucgagggcauccaggccuccgucaagaccgcccgcgagcucaccccccaggucgucuccgccgcccgcauccuccuccgcaaccccggcaaccaggccgccuacgagcacuucgagaccaugaagaaccaguggaucgacaacgucgagaagaugaccggccucgucgacgaggccaucgacaccaagucccuccucgacgccuccgaggaggccaucaagaaggaccucgacaagugcaaggucgccauggccaacauccagccccagaugcucgucgccggcgccaccuccaucgcccgccgcgccaaccgcauccuccucgucgccaagcgcgaggucgagaacuccgaggaccccaaguuccgcgaggccgucaaggccgccuccgacgagcucuccaagaccaucucccccauggucauggacgccaaggccgucgccggcaacaucuccgaccccggccuccagaaguccuuccucgacuccggcuaccgcauccucggcgccgucgccaagguccgcgaggccuuccagccccaggagcccgacuuccccccccccccccccgaccucgagcagcuccgccucaccgacgagcucgccccccccaagcccccccuccccgagggcgaggucccccccccccgcccccccccccccgaggagaaggacgaggaguuccccgagcagaaggccggcgaggucaucaaccagcccaugaugauggccgcccgccagcuccacgacgaggcccgcaagugguccuccaagggcaacgacaucaucgccgccgccaagcgcauggcccuccucauggccgagaugucccgccucguccgcggcggcuccggcaccaagcgcgcccucauccagugcgccaaggacaucgccaaggccuccgacgaggucacccgccucgccaaggaggucgccaagcagugcaccgacaagcgcauccgcaccaaccuccuccaggucugcgagcgcauccccaccaucuccacccagcucaagauccucuccaccgucaaggccaccaugcucggccgcaccaacaucuccgacgaggaguccgagcaggccaccgagaugcucguccacaacgcccagaaccucaugcaguccgucaaggagaccguccgcgaggccgaggccgccuccaucaagauccgcaccgacgccggcuucacccuccgcuggguccgcaagacccccugguaccaguga

SEQ ID NO: 51628 - RNA, 2421 nt, Artificial Sequence
  derived and/or modified sequence opt2 from VCP__Homo_sapiens__NP_009057
auggccuccggcgccgacuccaagggcgacgaccucuccaccgccauccucaagcagaagaaccgccccaaccgccucaucgucgacgaggccaucaacgaggacaacuccgucgucucccucucccagcccaagauggacgagcuccagcucuuccgcggcgacaccguccuccucaagggcaagaagcgccgcgaggccgucugcaucguccucuccgacgacaccugcuccgacgagaagauccgcaugaaccgcgucguccgcaacaaccuccgcguccgccucggcgacgucaucuccauccagcccugccccgacgucaaguacggcaagcgcauccacguccuccccaucgacgacaccgucgagggcaucaccggcaaccucuucgaggucuaccucaagcccuacuuccucgaggccuaccgccccauccgcaagggcgacaucuuccucguccgcggcggcaugcgcgccgucgaguucaaggucgucgagaccgaccccucccccuacugcaucgucgcccccgacaccgucauccacugcgagggcgagcccaucaagcgcgaggacgaggaggagucccucaacgaggucggcuacgacgacaucggcggcugccgcaagcagcucgcccagaucaaggagauggucgagcucccccuccgccaccccgcccucuucaaggccaucggcgucaagcccccccgcggcauccuccucuacggcccccccggcaccggcaagacccucaucgcccgcgccgucgccaacgagaccggcgccuucuucuuccucaucaacggccccgagaucauguccaagcucgccggcgaguccgaguccaaccuccgcaaggccuucgaggaggccgagaagaacgcccccgccaucaucuucaucgacgagcucgacgccaucgcccccaagcgcgagaagacccacggcgaggucgagcgccgcaucgucucccagcuccucacccucauggacggccucaagcagcgcgcccacgucaucgucauggccgccaccaaccgccccaacuccaucgaccccgcccuccgccgcuucggccgcuucgaccgcgaggucgacaucggcauccccgacgccaccggccgccucgagauccuccagauccacaccaagaacaugaagcucgccgacgacgucgaccucgagcaggucgccaacgagacccacggccacgucggcgccgaccucgccgcccucugcuccgaggccgcccuccaggccauccgcaagaagauggaccucaucgaccucgaggacgagaccaucgacgccgaggucaugaacucccucgccgucaccauggacgacuuccgcugggcccucucccaguccaaccccuccgcccuccgcgagaccgucgucgaggucccccaggucaccugggaggacaucggcggccucgaggacgucaagcgcgagcuccaggagcucguccaguaccccgucgagcaccccgacaaguuccucaaguucggcaugacccccuccaagggcguccucuucuacggcccccccggcugcggcaagacccuccucgccaaggccaucgccaacgagugccaggccaacuucaucuccaucaagggccccgagcuccucaccaugugguucggcgaguccgaggccaacguccgcgagaucuucgacaaggcccgccaggccgcccccugcguccucuucuucgacgagcucgacuccaucgccaaggcccgcggcggcaacaucggcgacggcggcggcgccgccgaccgcgucaucaaccagauccucaccgagauggacggcauguccaccaagaagaacgucuucaucaucggcgccaccaaccgccccgacaucaucgaccccgccauccuccgccccggccgccucgaccagcucaucuacaucccccuccccgacgagaagucccgcgucgccauccucaaggccaaccuccgcaagucccccgucgccaaggacgucgaccucgaguuccucgccaagaugaccaacggcuucuccggcgccgaccucaccgagaucugccagcgcgccugcaagcucgccauccgcgaguccaucgaguccgagauccgccgcgagcgcgagcgccagaccaaccccuccgccauggaggucgaggaggacgaccccguccccgagauccgccgcgaccacuucgaggaggccaugcgcuucgcccgccgcuccgucuccgacaacgacauccgcaaguacgagauguucgcccagacccuccagcagucccgcggcuucggcuccuuccgcuuccccuccggcaaccagggcggcgccggccccucccagggcuccggcggcggcaccggcggcuccgucuacaccgaggacaacgacgacgaccucuacggcuga

SEQ ID NO: 51629 - RNA, 420 nt, Artificial Sequence
  derived and/or modified sequence opt2 from VCX2__Homo_sapiens__NP_057462
augucccccaagccccgcgccuccggcccccccgccaaggccaccgaggccggcaagcgcaaguccuccucccagcccucccccuccgaccccaagaagaagaccaccaaggucgccaagaagggcaaggccguccgccgcggccgccgcggcaagaagggcgccgccaccaagauggccgccgucaccgcccccgaggccgaguccgcccccgccgcccccggccccuccgaccagcccucccaggagcucccccagcacgagcucccccccgaggagcccgucuccgagggcacccagcacgacccccucucccaggaguccgaggucgaggagccccucucccaggaguccgaggucgaggagccccucaccgucuggauggccuccuucucccccgucuccgaguccaccgacuga

SEQ ID NO: 51630 - RNA, 561 nt, Artificial Sequence
  derived and/or modified sequence opt2 from VCX3A__Homo_sapiens__NP_057463
augucccccaagccccgcgccuccggcccccccgccaaggccaccgaggccggcaagcgcaaguccuccucccagcccucccccuccgaccccaagaagaagaccaccaaggucgccaagaagggcaaggccguccgccgcggccgccgcggcaagaagggcgccgccaccaagauggccgccgucaccgcccccgaggccgaguccggccccgccgcccccggccccuccgaccagcccucccaggagcucccccagcacgagcucccccccgaggagcccgucuccgagggcacccagcacgacccccucucccaggaguccgagcucgaggagccccucucccaggaguccgaggucgaggagccccucucccaggagucccaggucgaggagccccucucccaggaguccgaggucgaggagccccucucccaggagucccaggucgaggagccccucucccaggaguccgaggucgaggagccccucucccaggagucccaggucgaggagccccucucccaggaguccgagauggaggagcuccccuccgucuga

SEQ ID NO: 51631 - RNA, 741 nt, Artificial Sequence
  derived and/or modified sequence opt2 from VCX3B__Homo_sapiens__NP_001001888
augucccccaagccccgcgccuccggcccccccgccaaggccaaggaggccggcaagcgcaaguccuccucccagcccucccccuccgaccccaagaagaagaccaccaaggucgccaagaagggcaaggccguccgccgcggccgccgcggcaagaagggcgccgccaccaagauggccgccgucaccgcccccgaggccgaguccggccccgccgcccccggccccuccgaccagcccucccaggagcucccccagcacgagcucccccccgaggagcccgucuccgagggcacccagcacgacccccucucccaggaguccgagcucgaggagccccucucccaggaguccgaggucgaggagccccucucccaggagucccaggucgaggagccccucucccaggaguccgaggucgaggagccccucucccaggagucccaggucgaggagccccucucccaggaguccgaggucgaggagccccucucccaggaguccgaggucgaggagccccucucccaggagucccaggucgaggagccccucucccaggaguccgaggucgaggagccccucucccaggagucccaggucgaggagccccucucccaggaguccgagauggaggagccccucucccaggagucccaggucgaggagccccucucccaggaguccgagauggaggagccccucucccaggaguccgagauggaggagcuccccuccgucuga

SEQ ID NO: 51632 - RNA, 621 nt, Artificial Sequence
  derived and/or modified sequence opt2 from VCX__Homo_sapiens__NP_038480
augucccccaagccccgcgccuccggcccccccgccaaggccaccgaggccggcaagcgcaaguccuccucccagcccucccccuccgaccccaagaagaagaccaccaaggucgccaagaagggcaaggccguccgccgcggccgccgcggcaagaagggcgccgccaccaagauggccgccgucaccgcccccgaggccgaguccgcccccgccgcccccggccccuccgaccagcccucccaggagcucccccagcacgagcucccccccgaggagcccgucuccgagggcacccagcacgacccccucucccaggaggccgagcucgaggagccccucucccaggaguccgaggucgaggagccccucucccaggagucccaggucgaggagccccucucccaggaguccgaggucgaggagccccucucccaggagucccaggucgaggagccccucucccaggaguccgaggucgaggagccccucucccaggagucccaggucgaggagccccucucccaggaguccgagauggaggagccccucucccaggagucccaggucgaggagccccccucccaggaguccgagauggaggagcuccccuccgucuga

SEQ ID NO: 51633 - RNA, 378 nt, Artificial Sequence
  derived and/or modified sequence opt2 from VCY__Homo_sapiens__NP_004670
augucccccaagccccgcgccuccggcccccccgccaaggccaaggagaccggcaagcgcaaguccuccucccagcccucccccuccggccccaagaagaagaccaccaaggucgccgagaagggcgaggccguccgcggcggccgccgcggcaagaagggcgccgccaccaagauggccgccgucaccgcccccgaggccgaguccggccccgccgcccccggccccuccgaccagcccucccaggagcucccccagcacgagcucccccccgaggagcccgucuccgagggcacccagcacgacccccucucccaggaguccgagcucgaggagccccucuccaagggccgccccuccaccccccucucccccuga

SEQ ID NO: 51634 - RNA, 852 nt, Artificial Sequence
  derived and/or modified sequence opt2 from VDAC1__Homo_sapiens__XP_005272132
auggccgucccccccaccuacgccgaccucggcaaguccgcccgcgacgucuucaccaagggcuacggcuucggccucaucaagcucgaccucaagaccaaguccgagaacggccucgaguucaccuccuccggcuccgccaacaccgagaccaccaaggucaccggcucccucgagaccaaguaccgcuggaccgaguacggccucaccuucaccgagaaguggaacaccgacaacacccucggcaccgagaucaccgucgaggaccagcucgcccgcggccucaagcucaccuucgacuccuccuucucccccaacaccggcaagaagaacgccaagaucaagaccggcuacaagcgcgagcacaucaaccucggcugcgacauggacuucgacaucgccggccccuccauccgcggcgcccucguccucggcuacgagggcuggcucgccggcuaccagaugaacuucgagaccgccaagucccgcgucacccaguccaacuucgccgucggcuacaagaccgacgaguuccagcuccacaccaacgucaacgacggcaccgaguucggcggcuccaucuaccagaaggucaacaagaagcucgagaccgccgucaaccucgccuggaccgccggcaacuccaacacccgcuucggcaucgccgccaaguaccagaucgaccccgacgccugcuucuccgccaaggucaacaacuccucccucaucggccucggcuacacccagacccucaagcccggcaucaagcucacccucuccgcccuccucgacggcaagaacgucaacgccggcggccacaagcucggccucggccucgaguuccaggccuga

SEQ ID NO: 51635 - RNA, 930 nt, Artificial Sequence
  derived and/or modified sequence opt2 from VDAC2__Homo_sapiens__NP_001171712
auguccuggugcaacgagcuccgccuccccgcccucaagcagcacuccaucggccgcggccucgagucccacaucaccaugugcaucccccccuccuacgccgaccucggcaaggccgcccgcgacaucuucaacaagggcuucggcuucggccucgucaagcucgacgucaagaccaaguccugcuccggcgucgaguucuccaccuccggcuccuccaacaccgacaccggcaaggucaccggcacccucgagaccaaguacaaguggugcgaguacggccucaccuucaccgagaaguggaacaccgacaacacccucggcaccgagaucgccaucgaggaccagaucugccagggccucaagcucaccuucgacaccaccuucucccccaacaccggcaagaaguccggcaagaucaaguccuccuacaagcgcgagugcaucaaccucggcugcgacgucgacuucgacuucgccggccccgccauccacggcuccgccgucuucggcuacgagggcuggcucgccggcuaccagaugaccuucgacuccgccaaguccaagcucacccgcaacaacuucgccgucggcuaccgcaccggcgacuuccagcuccacaccaacgucaacgacggcaccgaguucggcggcuccaucuaccagaaggucugcgaggaccucgacaccuccgucaaccucgccuggaccuccggcaccaacugcacccgcuucggcaucgccgccaaguaccagcucgaccccaccgccuccaucuccgccaaggucaacaacuccucccucaucggcgucggcuacacccagacccuccgccccggcgucaagcucacccucuccgcccucgucgacggcaaguccaucaacgccggcggccacaaggucggccucgcccucgagcucgaggccuga

SEQ ID NO: 51636 - RNA, 1284 nt, Artificial Sequence
  derived and/or modified sequence opt2 from VDR__Homo_sapiens__NP_000367
auggaggccauggccgccuccaccucccuccccgaccccggcgacuucgaccgcaacgucccccgcaucugcggcgucugcggcgaccgcgccaccggcuuccacuucaacgccaugaccugcgagggcugcaagggcuucuuccgccgcuccaugaagcgcaaggcccucuucaccugccccuucaacggcgacugccgcaucaccaaggacaaccgccgccacugccaggccugccgccucaagcgcugcgucgacaucggcaugaugaaggaguucauccucaccgacgaggagguccagcgcaagcgcgagaugauccucaagcgcaaggaggaggaggcccucaaggacucccuccgccccaagcucuccgaggagcagcagcgcaucaucgccauccuccucgacgcccaccacaagaccuacgaccccaccuacuccgacuucugccaguuccgcccccccguccgcgucaacgacggcggcggcucccaccccucccgccccaacucccgccacacccccuccuucuccggcgacuccuccuccuccugcuccgaccacugcaucaccuccuccgacaugauggacuccuccuccuucuccaaccucgaccucuccgaggaggacuccgacgaccccuccgucacccucgagcucucccagcucuccaugcucccccaccucgccgaccucgucuccuacuccauccagaaggucaucggcuucgccaagaugauccccggcuuccgcgaccucaccuccgaggaccagaucguccuccucaaguccuccgccaucgaggucaucaugcuccgcuccaacgaguccuucaccauggacgacauguccuggaccugcggcaaccaggacuacaaguaccgcgucuccgacgucaccaaggccggccacucccucgagcucaucgagccccucaucaaguuccaggucggccucaagaagcucaaccuccacgaggaggagcacguccuccucauggccaucugcaucgucucccccgaccgccccggcguccaggacgccgcccucaucgaggccauccaggaccgccucuccaacacccuccagaccuacauccgcugccgccaccccccccccggcucccaccuccucuacgccaagaugauccagaagcucgccgaccuccgcucccucaacgaggagcacuccaagcaguaccgcugccucuccuuccagcccgagugcuccaugaagcucaccccccucguccucgaggucuucggcaacgagaucuccuga

SEQ ID NO: 51637 - RNA, 1239 nt, Artificial Sequence
  derived and/or modified sequence opt2 from VEGFA__Homo_sapiens__NP_001020537
augaccgaccgccagaccgacaccgcccccucccccuccuaccaccuccuccccggccgccgccgcaccgucgacgccgccgccucccgcggccagggccccgagcccgcccccggcggcggcgucgagggcgucggcgcccgcggcgucgcccucaagcucuucguccagcuccucggcugcucccgcuucggcggcgccgucguccgcgccggcgaggccgagcccuccggcgccgcccgcuccgccuccuccggccgcgaggagccccagcccgaggagggcgaggaggaggaggagaaggaggaggagcgcggcccccaguggcgccucggcgcccgcaagcccggcuccuggaccggcgaggccgccgucugcgccgacuccgcccccgccgcccgcgccccccaggcccucgcccgcgccuccggccgcggcggccgcgucgcccgccgcggcgccgaggaguccggccccccccacucccccucccgccgcggcuccgccucccgcgccggccccggccgcgccuccgagaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcuga

SEQ ID NO: 51638 - RNA, 567 nt, Artificial Sequence
  derived and/or modified sequence opt2 from VEGFB__Homo_sapiens__NP_001230662
auguccccccuccuccgccgccuccuccucgccgcccuccuccagcucgcccccgcccaggcccccgucucccagcccgacgcccccggccaccagcgcaaggucgucuccuggaucgacgucuacacccgcgccaccugccagccccgcgaggucgucgucccccucaccgucgagcucaugggcaccgucgccaagcagcucguccccuccugcgucaccguccagcgcugcggcggcugcugccccgacgacggccucgagugcguccccaccggccagcaccagguccgcaugcagauccucaugauccgcuaccccuccucccagcucggcgagaugucccucgaggagcacucccagugcgagugccgccccaagaagaaggacuccgccgucaagcccgacuccccccgcccccucugcccccgcugcacccagcaccaccagcgccccgacccccgcaccugccgcugccgcugccgccgccgcuccuuccuccgcugccagggccgcggccucgagcucaaccccgacaccugccgcugccgcaagcuccgccgcuga

SEQ ID NO: 51639 - RNA, 1260 nt, Artificial Sequence
  derived and/or modified sequence opt2 from VEGFC__Homo_sapiens__NP_005420
augcaccuccucggcuucuucuccgucgccugcucccuccucgccgccgcccuccuccccggcccccgcgaggcccccgccgccgccgccgccuucgaguccggccucgaccucuccgacgccgagcccgacgccggcgaggccaccgccuacgccuccaaggaccucgaggagcagcuccgcuccgucuccuccgucgacgagcucaugaccguccucuaccccgaguacuggaagauguacaagugccagcuccgcaagggcggcuggcagcacaaccgcgagcaggccaaccucaacucccgcaccgaggagaccaucaaguucgccgccgcccacuacaacaccgagauccucaaguccaucgacaacgaguggcgcaagacccagugcaugccccgcgaggucugcaucgacgucggcaaggaguucggcgucgccaccaacaccuucuucaagccccccugcgucuccgucuaccgcugcggcggcugcugcaacuccgagggccuccagugcaugaacaccuccaccuccuaccucuccaagacccucuucgagaucaccgucccccucucccagggccccaagcccgucaccaucuccuucgccaaccacaccuccugccgcugcauguccaagcucgacgucuaccgccagguccacuccaucauccgccgcucccuccccgccacccucccccagugccaggccgccaacaagaccugccccaccaacuacauguggaacaaccacaucugccgcugccucgcccaggaggacuucauguucuccuccgacgccggcgacgacuccaccgacggcuuccacgacaucugcggccccaacaaggagcucgacgaggagaccugccagugcgucugccgcgccggccuccgccccgccuccugcggcccccacaaggagcucgaccgcaacuccugccagugcgucugcaagaacaagcucuuccccucccagugcggcgccaaccgcgaguucgacgagaacaccugccagugcgucugcaagcgcaccugcccccgcaaccagccccucaaccccggcaagugcgccugcgagugcaccgaguccccccagaagugccuccucaagggcaagaaguuccaccaccagaccugcuccugcuaccgccgccccugcaccaaccgccagaaggccugcgagcccggcuucuccuacuccgaggaggucugccgcugcguccccuccuacuggaagcgcccccagauguccuga

SEQ ID NO: 51640 - RNA, 777 nt, Artificial Sequence
  derived and/or modified sequence opt2 from VENTX__Homo_sapiens__NP_055283
augcgccucuccuccucccccccccgcggcccccagcagcucuccuccuucggcuccgucgacuggcucucccaguccuccugcuccggccccacccacaccccccgccccgccgacuucucccucggcucccuccccggccccggccagaccuccggcgcccgcgagcccccccaggccgucuccaucaaggaggccgccggcuccuccaaccuccccgcccccgagcgcaccauggccggccucuccaaggagcccaacacccuccgcgccccccgcguccgcaccgccuucaccauggagcagguccgcacccucgagggcgucuuccagcaccaccaguaccucuccccccucgagcgcaagcgccucgcccgcgagaugcagcucuccgagguccagaucaagaccugguuccagaaccgccgcaugaagcacaagcgccagaugcaggacccccagcuccacucccccuucuccggcucccuccacgccccccccgccuucuacuccaccuccuccggccucgccaacggccuccagcuccucugccccugggccccccucuccggcccccaggcccucaugcucccccccggcuccuucuggggccucugccaggucgcccaggaggcccucgccuccgccggcgccuccugcugcggccagccccucgccucccacccccccacccccggccgccccucccucggccccgcccucuccaccggcccccgcggccucugcgccaugccccagaccggcgacgccuucuga

SEQ ID NO: 51641 - RNA, 2367 nt, Artificial Sequence
  derived and/or modified sequence opt2 from VEPH1__Homo_sapiens__NP_001161383
augcaccagcucuuccgccucguccucggccagaaggaccucucccgcgccggcgaccucuucucccucgacgacuccgagaucgaggacucccucaccgaggcccucgagcagaucaagaucaucuccuccuccuccgacuaccagaccaacaacaacgaccaggccgucgucgagaucugcaucacccgcaucaccaccgccauccgcgagaccgaguccaucgagaagcacgccaaggcccucgucggccucugggacuccugccucgagcacaaccuccgccccuucggcaaggacgaggacaccccccacgccaagaucgccuccgacaucauguccugcauccuccagaacuacaaccgcccccccgucauggcccucgccauccccaucgccgucaaguuccuccaccgcggcaacaaggagcucugccgcaacauguccaacuaccucucccucgccgccaucaccaaggccgaccuccucgccgaccacaccgaggucaucgucaaguccauccuccagggcaacaccaugcuccuccgcguccuccccgccgucuacgagaagcagccccagcccaucaaccgccaccucaccgagcuccucgcccucaugucccagcucgagcagcccgagcaguaccaccuccuccgccuccuccacgucgccgccaagaagaagcagcucgaggucguccagaagugcauccccuuccucaucggccaccucaaggacuccacccacaacgacaucauccucaacauccucaucgagaucgccgucuacgagcccgucgcccucaacuccuuccuccccaugcucaaggagaucggcgagcgcuuccccuaccucaccggccagauggcccgcaucuacggcgccgucggccacgucgacgaggagcgcgcccgcuccugccucaccuaccucgucucccagcucgccaacauggagcacuccuuccaccacauccuccuccucgagaucaaguccaucaccgacaccuucuccuccauccucggcccccagucccgcgacaucuuccgcauguccaacuccuucaccgccaucgccaagcuccucacccgccagcucgagaacaccaaggccggcuccggccgccgcaagaucuccaccgagaucgaguuccccgagaagcucgaggagaccaagcucaucgucaccgagaacgaggaccacgagaagcuccaggucaagauccaggccuucgaggacaagaucaacgccggcuccaacacccccggcuccauccgccgcuacucccucggccaggucuccaaggaggagcgcaagaacauccgcuucaaccgcuccaagucccucgccuuccacaccaugcucaccaagggcgucggcuccgacgacggcgaggacgagaaccgcggcgacauccccgccuccaucucccucuccgagaucgacccccucggccagggcaacgacaagcuccccuucaagaccgacaccgagcgcucccagcucggcgaguccuccgucuccuaccccaacaucauccacaucgacuccgagaaccucuccgagaccgucaaggagaacucccaggaggagacccccgagaccaccgccucccccaucgaguaccaggacaagcucuaccuccaccucaagaagaaccucuccaaggucaaggccuacgccauggagaucggcaagaagauccccguccccgaccagugcaccaucgaggacaccguccgcuccugcgucgccaagcucuucuucaccugcucccucaagggccacuacugccucuacuccaaguccuccuucauccucaucucccaggagccccagcccuggauccagaucauguuccucuuccagcaggaccucgaccagguccagcuccaccucgaggagguccgcuucuucgacgucuucggcuucuccgagaccgccggcgccuggcagugcuucaugugcaacaaccccgagaaggccaccgucgucaaccaggacggccagccccucaucgagggcaagcucaaggagaagcagguccgcuggaaguucaucaagcgcuggaagacccgcuacuucacccucgccggcaaccagcuccucuuccagaagggcaaguccaaggacgaccccgacgacugccccaucgagcucuccaagguccaguccgucaaggccgucgccaagaagcgccgcgaccgcucccucccccgcgccuucgagaucuucaccgacaacaagaccuacgucuucaaggccaaggacgagaagaacgccgaggaguggcuccagugcaucaacgucgccgucgcccaggccaaggagcgcgagucccgcgaggucaccaccuaccucuga

SEQ ID NO: 51642 - RNA, 2340 nt, Artificial Sequence
  derived and/or modified sequence opt2 from VEZT__Homo_sapiens__NP_060069
augacccccgaguucgacgaggaggucgucuucgagaacuccccccucuaccaguaccuccaggaccucggccacaccgacuucgagaucugcuccucccucucccccaagaccgagaagugcaccaccgagggccagcagaagccccccacccgcguccuccccaagcagggcauccuccucaaggucgccgagaccaucaaguccuggaucuucuucucccagugcaacaagaaggacgaccuccuccacaagcucgacaucggcuuccgccucgacucccuccacaccauccuccagcaggagguccuccuccaggaggacgucgagcucaucgagcuccucgaccccuccauccucuccgccggccagucccagcagcaggagaacggccaccuccccacccucugcucccucgccacccccaacaucugggaccucuccaugcucuucgccuucaucucccuccucgucaugcuccccaccugguggaucgucuccuccuggcucgucuggggcgucauccucuucgucuaccucgucauccgcgcccuccgccucuggcgcaccgccaagcuccaggucacccucaagaaguacuccguccaccucgaggacauggccaccaacucccgcgccuucaccaaccucguccgcaaggcccuccgccucauccaggagaccgaggucaucucccgcggcuucacccucgucuccgccgccugccccuucaacaaggccggccagcaccccucccagcaccucaucggccuccgcaaggccgucuaccgcacccuccgcgccaacuuccaggccgcccgccucgccacccucuacaugcucaagaacuacccccucaacuccgaguccgacaacgucaccaacuacaucugcgucguccccuucaaggagcucggccucggccucuccgaggagcagaucuccgaggaggaggcccacaacuucaccgacggcuucucccuccccgcccucaagguccucuuccagcucugggucgcccaguccuccgaguucuuccgccgccucgcccuccuccucuccaccgccaacuccccccccggcccccuccucacccccgcccuccucccccaccgcauccucuccgacgucacccagggccucccccacgcccacuccgccugccucgaggagcucaagcgcuccuacgaguucuaccgcuacuucgagacccagcaccaguccgucccccagugccucuccaagacccagcagaagucccgcgagcucaacaacguccacaccgccguccgcucccuccagcuccaccucaaggcccuccucaacgaggucaucauccucgaggacgagcucgagaagcucgucugcaccaaggagacccaggagcucgucuccgaggccuaccccauccucgagcagaagcucaagcucauccagccccacguccaggccuccaacaacugcugggaggaggccaucucccaggucgacaagcuccuccgccgcaacaccgacaagaagggcaagcccgagaucgccugcgagaacccccacugcaccgucgucccccucaagcagcccacccuccacaucgccgacaaggaccccauccccgaggagcaggagcucgaggccuacgucgacgacaucgacaucgacuccgacuuccgcaaggacgacuucuacuaccucucccaggaggacaaggagcgccagaagcgcgagcacgaggaguccaagcgcguccuccaggagcucaaguccguccucggcuucaaggccuccgaggccgagcgccagaaguggaagcagcuccucuucuccgaccacgccguccucaagucccucucccccgucgaccccgucgagcccaucuccaacuccgagcccuccaugaacuccgacaugggcaaggucuccaagaacgacaccgaggaggaguccaacaaguccgccaccaccgacaacgagaucucccgcaccgaguaccucugcgagaacucccucgagggcaagaacaaggacaacuccuccaacgaggucuucccccagggcgccgaggagcgcaugugcuaccagugcgaguccgaggacgagccccaggccgacggcuccggccucaccaccgccccccccaccccccgcgacucccuccagcccuccaucaagcagcgccucgcccgccuccagcucucccccgacuucaccuucaccgccggccucgccgccgaggucgccgcccgcucccucuccuucaccaccaugcaggagcagaccuucggcggcgaggaggaggagcagaucaucgaggagaacaagaacgagaucgaggagaaguga

SEQ ID NO: 51643 - RNA, 1848 nt, Artificial Sequence
  derived and/or modified sequence opt2 from VGF__Homo_sapiens__XP_011514851
augaaggcccuccgccucuccgccuccgcccucuucugccuccuccucaucaacggccucggcgccgccccccccggccgccccgaggcccagccccccccccucuccuccgagcacaaggagcccgucgccggcgacgccguccccggccccaaggacggcuccgcccccgagguccgcggcgcccgcaacuccgagccccaggacgagggcgagcucuuccagggcgucgacccccgcgcccucgccgccguccuccuccaggcccucgaccgccccgccuccccccccgcccccuccggcucccagcagggccccgaggaggaggccgccgaggcccuccucaccgagaccguccgcucccagacccacucccuccccgcccccgagucccccgagcccgccgcccccccccgcccccagacccccgagaacggccccgaggccuccgaccccuccgaggagcucgaggcccucgccucccuccuccaggagcuccgcgacuucucccccuccuccgccaagcgccagcaggagaccgccgccgccgagaccgagacccgcacccacacccucacccgcgucaaccucgagucccccggccccgagcgcgucuggcgcgccuccuggggcgaguuccaggcccgcguccccgagcgcgccccccuccccccccccgcccccucccaguuccaggcccgcaugcccgacuccggcccccuccccgagacccacaaguucggcgagggcgucuccucccccaagacccaccucggcgaggcccucgccccccucuccaaggccuaccagggcgucgccgcccccuuccccaaggcccgccgccccgaguccgcccuccucggcggcuccgaggccggcgagcgccuccuccagcagggccucgcccaggucgaggccggccgccgccaggccgaggccacccgccaggccgccgcccaggaggagcgccucgccgaccucgccuccgaccuccuccuccaguaccuccuccagggcggcgcccgccagcgcggccucggcggccgcggccuccaggaggccgccgaggagcgcgaguccgcccgcgaggaggaggaggccgagcaggagcgccgcggcggcgaggagcgcgucggcgaggaggacgaggaggccgccgaggccgaggccgaggccgaggaggccgagcgcgcccgccagaacgcccuccucuucgccgaggaggaggacggcgaggccggcgccgaggacaagcgcucccaggaggagacccccggccaccgccgcaaggaggccgagggcaccgaggagggcggcgaggaggaggacgacgaggagauggacccccagaccaucgacucccucaucgagcucuccaccaagcuccaccuccccgccgacgacgucgucuccaucaucgaggaggucgaggagaagcgcaagcgcaagaagaacgccccccccgagcccgucccccccccccgcgccgcccccgcccccacccacguccgcuccccccagccccccccccccgcccccgcccccgcccgcgacgagcuccccgacuggaacgagguccucccccccugggaccgcgaggaggacgaggucuacccccccggccccuaccaccccuuccccaacuacauccgcccccgcacccuccagccccccuccgcccuccgccgccgccacuaccaccacgcccucccccccucccgccacuaccccggccgcgaggcccaggcccgccgcgcccaggaggaggccgaggccgaggagcgccgccuccaggagcaggaggagcucgagaacuacaucgagcacguccuccuccgccgccccuga

SEQ ID NO: 51644 - RNA, 777 nt, Artificial Sequence
  derived and/or modified sequence opt2 from VGLL1__Homo_sapiens__NP_057351
auggaggagaugaagaagaccgccauccgccuccccaagggcaagcagaagcccaucaagaccgaguggaacucccgcugcguccucuucaccuacuuccagggcgacaucuccuccgucgucgacgagcacuucucccgcgcccucuccaacaucaaguccccccaggagcucacccccuccucccaguccgagggcgucaugcucaagaacgacgacuccaugucccccaaccaguggcgcuacuccucccccuggaccaagccccagcccgagguccccgucaccaaccgcgccgccaacugcaaccuccacguccccggccccauggccgucaaccaguucucccccucccucgcccgccgcgccuccguccgccccggcgagcucuggcacuucuccucccucgccggcaccuccucccucgagcccggcuacucccaccccuuccccgcccgccaccucguccccgagccccagcccgacggcaagcgcgagccccuccucucccuccuccagcaggaccgcugccucgcccgcccccaggaguccgccgcccgcgagaacggcaaccccggccagaucgccggcuccaccggccuccucuucaaccucccccccggcuccguccacuacaagaagcucuacgucucccgcggcuccgccuccaccucccuccccaacgagacccucuccgagcucgagacccccggcaaguacucccucaccccccccaaccacuggggccacccccaccgcuaccuccagcaccucuga

SEQ ID NO: 51645 - RNA, 432 nt, Artificial Sequence
  derived and/or modified sequence opt2 from VGLL2__Homo_sapiens__NP_703154
auguccugccucgacgucauguaccaggucuacggccccccccagcccuacuucgccgccgccuacacccccuaccaccagaagcucgccuacuacuccaagaugcaggaggcccaggagugcaacgccucccccuccuccuccggcuccggcuccuccuccuucuccucccagacccccgccuccaucaaggaggaggagggcucccccgagaaggagcgcccccccgaggccgaguacaucaacucccgcugcguccucuucaccuacuuccagggcgacaucuccuccgucgucgacgagcacuucucccgcgcccucucccagcccuccuccuacucccccuccugcaccuccuccaaggccccccgcuccuccggccccuggcgcgcccgccgcuacucccucugcggcgccucccuccucuccuga

SEQ ID NO: 51646 - RNA, 981 nt, Artificial Sequence
  derived and/or modified sequence opt2 from VGLL3__Homo_sapiens__NP_057290
auguccugcgccgaggucauguaccacccccagcccuacggcgccucccaguaccuccccaaccccauggccgccaccaccugccccaccgccuacuaccagcccgccccccagcccggccagcagaagaagcucgccgucuucuccaagaugcaggacucccucgaggucacccuccccuccaagcaggaggaggaggacgaggaggaggaggaggaggagaaggaccagcccgccgagauggaguaccucaacucccgcugcguccucuucaccuacuuccagggcgacaucggcuccgucgucgacgagcacuucucccgcgcccucggccaggccaucacccuccaccccgaguccgccaucuccaaguccaagaugggccucaccccccucuggcgcgacuccuccgcccucuccucccagcgcaacuccuuccccaccuccuucuggaccuccuccuaccagcccccccccgcccccugccucggcggcguccaccccgacuuccaggucaccggcccccccggcaccuucuccgccgccgaccccucccccuggcccggccacaaccuccaccagaccggccccgcccccccccccgccgucuccgaguccuggcccuacccccucaccucccaggucucccccuccuacucccacaugcacgacgucuacaugcgccaccaccacccccacgcccacaugcaccaccgccaccgccaccaccaccaccaccaccacccccccgccggcuccgcccucgaccccuccuacggcccccuccucaugcccuccguccacgccgcccgcauccccgccccccagugcgacaucaccaagaccgagcccaccaccgucaccuccgccaccuccgccugggccggcgccuuccacggcaccgucgacaucguccccuccgucggcuucgacaccggccuccagcaccaggacaaguccaaggagucccccugguacuga

SEQ ID NO: 51647 - RNA, 891 nt, Artificial Sequence
  derived and/or modified sequence opt2 from VGLL4__Homo_sapiens__NP_001121691
augcucuucaugaagauggaccuccucaacuaccaguaccucgacaagaugaacaacaacaucggcauccucugcuacgagggcgaggccgcccuccgcggcgagccccgcauccagacccuccccgucgccuccgcccucuccucccaccgcaccggccccccccccaucucccccuccaagcgcaaguucuccauggagcccggcgacgaggaccucgacugcgacaacgaccacgucuccaagaugucccgcaucuucaacccccaccucaacaagaccgccaacggcgacugccgccgcgacccccgcgagcgcucccgcucccccaucgagcgcgccgucgcccccaccaugucccuccacggcucccaccucuacaccucccuccccucccucggccucgagcagccccucgcccucaccaagaacucccucgacgccucccgccccgccggccucucccccacccucacccccggcgagcgccagcagaaccgccccuccgucaucaccugcgccuccgccggcgcccgcaacugcaaccucucccacugccccaucgcccacuccggcugcgccgcccccggccccgccuccuaccgccgcccccccuccgccgccaccaccugcgaccccgucgucgaggagcacuuccgccgcucccucggcaagaacuacaaggagcccgagcccgcccccaacuccgucuccaucaccggcuccgucgacgaccacuucgccaaggcccucggcgacaccuggcuccagaucaaggccgccaaggacggcgccuccuccucccccgaguccgccucccgccgcggccagcccgccucccccuccgcccacauggucucccacucccacucccccuccgucgucuccuga

SEQ ID NO: 51648 - RNA, 642 nt, Artificial Sequence
  derived and/or modified sequence opt2 from VHL__Homo_sapiens__NP_000542
augccccgccgcgccgagaacugggacgaggccgaggucggcgccgaggaggccggcgucgaggaguacggccccgaggaggacggcggcgaggaguccggcgccgaggaguccggccccgaggaguccggccccgaggagcucggcgccgaggaggagauggaggccggccgcccccgccccguccuccgcuccgucaacucccgcgagcccucccaggucaucuucugcaaccgcuccccccgcgucguccuccccgucuggcucaacuucgacggcgagccccagcccuaccccacccucccccccggcaccggccgccgcauccacuccuaccgcggccaccucuggcucuuccgcgacgccggcacccacgacggccuccucgucaaccagaccgagcucuucguccccucccucaacgucgacggccagcccaucuucgccaacaucacccuccccgucuacacccucaaggagcgcugccuccaggucguccgcucccucgucaagcccgagaacuaccgccgccucgacaucguccgcucccucuacgaggaccucgaggaccaccccaacguccagaaggaccucgagcgccucacccaggagcgcaucgcccaccagcgcaugggcgacuga

SEQ ID NO: 51649 - RNA, 420 nt, Artificial Sequence
  derived and/or modified sequence opt2 from VHLL__Homo_sapiens__NP_001004319
augcccuggcgcgccggcaacggcgucggccucgaggcccaggccggcacccaggaggccggccccgaggaguacugccaggaggagcucggcgccgaggaggagauggccgcccgcgccgccuggcccguccuccgcuccgucaacucccgcgagcucucccgcaucaucaucugcaaccacuccccccgcaucguccuccccgucuggcucaacuacuacggcaagcuccuccccuaccucacccuccuccccggccgcgacuuccgcauccacaacuuccgcucccaccccuggcucuuccgcgacgcccgcacccacgacaagcuccucgucaaccagaccgagcucuucguccccuccuccaacgucaacggccagcccgucuucgccaacaucacccuccagugcauccccuga

SEQ ID NO: 51650 - RNA, 2484 nt, Artificial Sequence
  derived and/or modified sequence opt2 from VIL1__Homo_sapiens__NP_009058
augaccaagcucuccgcccaggucaagggcucccucaacaucaccacccccggccuccagaucuggcgcaucgaggccaugcagaugguccccguccccuccuccaccuucggcuccuucuucgacggcgacugcuacaucauccucgccauccacaagaccgccuccucccucuccuacgacauccacuacuggaucggccaggacuccucccucgacgagcagggcgccgccgccaucuacaccacccagauggacgacuuccucaagggccgcgccguccagcaccgcgagguccagggcaacgaguccgaggccuuccgcggcuacuucaagcagggccucgucauccgcaagggcggcgucgccuccggcaugaagcacgucgagaccaacuccuacgacguccagcgccuccuccacgucaagggcaagcgcaacgucgucgccggcgaggucgagauguccuggaaguccuucaaccgcggcgacgucuuccuccucgaccucggcaagcucaucauccaguggaacggccccgaguccacccgcauggagcgccuccgcggcaugacccucgccaaggagauccgcgaccaggagcgcggcggccgcaccuacgucggcgucgucgacggcgagaacgagcucgccucccccaagcucauggaggucaugaaccacguccucggcaagcgccgcgagcucaaggccgccguccccgacaccgucgucgagcccgcccucaaggccgcccucaagcucuaccacgucuccgacuccgagggcaaccucgucguccgcgaggucgccacccgcccccucacccaggaccuccucucccacgaggacugcuacauccucgaccagggcggccucaagaucuacgucuggaagggcaagaaggccaacgagcaggagaagaagggcgccaugucccacgcccucaacuucaucaaggccaagcaguacccccccuccacccaggucgagguccagaacgacggcgccgaguccgccgucuuccagcagcucuuccagaaguggaccgccuccaaccgcaccuccggccucggcaagacccacaccgucggcuccgucgccaaggucgagcaggucaaguucgacgccaccuccaugcacgucaagccccaggucgccgcccagcagaagauggucgacgacggcuccggcgagguccaggucuggcgcaucgagaaccucgagcucguccccgucgacuccaaguggcucggccacuucuacggcggcgacugcuaccuccuccucuacaccuaccucaucggcgagaagcagcacuaccuccucuacgucuggcagggcucccaggccucccaggacgagaucaccgccuccgccuaccaggccgucauccucgaccagaaguacaacggcgagcccguccagauccgcguccccaugggcaaggagcccccccaccucauguccaucuucaagggccgcauggucgucuaccagggcggcaccucccgcaccaacaaccucgagaccggccccuccacccgccucuuccagguccagggcaccggcgccaacaacaccaaggccuucgagguccccgcccgcgccaacuuccucaacuccaacgacgucuucguccucaagacccaguccugcugcuaccucuggugcggcaagggcugcuccggcgacgagcgcgagauggccaagauggucgccgacaccaucucccgcaccgagaagcaggucgucgucgagggccaggagcccgccaacuucuggauggcccucggcggcaaggcccccuacgccaacaccaagcgccuccaggaggagaaccucgucaucaccccccgccucuucgagugcuccaacaagaccggccgcuuccucgccaccgagauccccgacuucaaccaggacgaccucgaggaggacgacgucuuccuccucgacgucugggaccaggucuucuucuggaucggcaagcacgccaacgaggaggagaagaaggccgccgccaccaccgcccaggaguaccucaagacccaccccuccggccgcgaccccgagacccccaucaucgucgucaagcagggccacgagccccccaccuucaccggcugguuccucgccugggaccccuucaagugguccaacaccaaguccuacgaggaccucaaggccgagcucggcaacucccgcgacuggucccagaucaccgccgaggucaccucccccaaggucgacgucuucaacgccaacuccaaccucuccuccggcccccuccccaucuucccccucgagcagcucgucaacaagcccgucgaggagcuccccgagggcgucgaccccucccgcaaggaggagcaccucuccaucgaggacuucacccaggccuucggcaugacccccgccgccuucuccgcccucccccgcuggaagcagcagaaccucaagaaggagaagggccucuucuga

SEQ ID NO: 51651 - RNA, 1401 nt, Artificial Sequence
  derived and/or modified sequence opt2 from VIM__Homo_sapiens__XP_011517951
auguccacccgcuccgucuccuccuccuccuaccgccgcauguucggcggccccggcaccgccucccgccccuccuccucccgcuccuacgucaccaccuccacccgcaccuacucccucggcuccgcccuccgccccuccaccucccgcucccucuacgccuccucccccggcggcgucuacgccacccgcuccuccgccguccgccuccgcuccuccguccccggcguccgccuccuccaggacuccgucgacuucucccucgccgacgccaucaacaccgaguucaagaacacccgcaccaacgagaaggucgagcuccaggagcucaacgaccgcuucgccaacuacaucgacaagguccgcuuccucgagcagcagaacaagauccuccucgccgagcucgagcagcucaagggccagggcaagucccgccucggcgaccucuacgaggaggagaugcgcgagcuccgccgccaggucgaccagcucaccaacgacaaggcccgcgucgaggucgagcgcgacaaccucgccgaggacaucaugcgccuccgcgagaagcuccaggaggagaugcuccagcgcgaggaggccgagaacacccuccaguccuuccgccaggacgucgacaacgccucccucgcccgccucgaccucgagcgcaaggucgagucccuccaggaggagaucgccuuccucaagaagcuccacgaggaggagauccaggagcuccaggcccagauccaggagcagcacguccagaucgacgucgacgucuccaagcccgaccucaccgccgcccuccgcgacguccgccagcaguacgaguccgucgccgccaagaaccuccaggaggccgaggagugguacaaguccaaguucgccgaccucuccgaggccgccaaccgcaacaacgacgcccuccgccaggccaagcaggaguccaccgaguaccgccgccagguccagucccucaccugcgaggucgacgcccucaagggcaccaacgagucccucgagcgccagaugcgcgagauggaggagaacuucgccgucgaggccgccaacuaccaggacaccaucggccgccuccaggacgagauccagaacaugaaggaggagauggcccgccaccuccgcgaguaccaggaccuccucaacgucaagauggcccucgacaucgagaucgccaccuaccgcaagcuccucgagggcgaggagucccgcaucucccucccccuccccaacuucuccucccucaaccuccgcgagaccaaccucgacucccucccccucgucgacacccacuccaagcgcacccuccucaucaagaccgucgagacccgcgacggccaggucaucaacgagaccucccagcaccacgacgaccucgaguga

SEQ ID NO: 51652 - RNA, 1482 nt, Artificial Sequence
  derived and/or modified sequence opt2 from VIPAS39__Homo_sapiens__NP_001180244
augaaccgcaccaagggcgacgaggaggaguacuggaacuccuccaaguucaaggccuucaccuucgacgacgaggacgacgagcucucccagcucaaggaguccaagcgcgccgucaacucccuccgcgacuucgucgacgacgacgacgacgacgaccucgagcgcgucuccugguccggcgagcccgucggcuccaucuccugguccauccgcgagaccgccggcaacuccggcuccacccacgagggccgcgagcagcucaagucccgcaacuccuucuccuccuacgcccagcuccccaagcccaccuccaccuacucccucuccuccuucuuccgcggccgcacccgccccggcuccuuccagucccucuccgacgcccucuccgacacccccgccaaguccuacgcccccgagcucggccgccccaagggcgaguaccgcgacuacuccaacgacuggucccccuccgacaccguccgccgccuccgcaagggcaaggucugcucccucgagcgcuuccgcucccuccaggacaagcuccagcuccucgaggaggccgucuccaugcacgacggcaacgucaucaccgccguccucaucuuccucaagcgcacccucuccaaggagauccucuuccgcgagcucgagguccgccaggucgcccuccgccaccucauccacuuccucaaggagaucggcgaccagaagcuccuccucgaccucuuccgcuuccucgaccgcaccgaggagcucgcccucucccacuaccgcgagcaccucaacauccaggaccccgacaagcgcaaggaguuccucaagaccugcgucggccuccccuucuccgccgaggacuccgcccacauccaggaccacuacacccuccucgagcgccagaucaucaucgaggccaacgaccgccaccucgaguccgccggccagaccgagaucuuccgcaagcacccccgcaaggccuccauccucaacaugccccucgucaccacccucuucuacuccugcuucuaccacuacaccgaggccgagggcaccuucuccucccccgucaaccucaagaagaccuucaagauccccgacaagcaguacguccucaccgcccucgccgcccgcgccaagcuccgcgccuggaacgacgucgacgcccucuucaccaccaagaacuggcucggcuacaccaagaagcgcgcccccaucggcuuccaccgcgucgucgagauccuccacaagaacaacgcccccguccagauccuccaggaguacgucaaccucgucgaggacgucgacaccaagcucaaccucgccaccaaguucaagugccacgacgucgucaucgacaccuaccgcgaccucaaggaccgccagcagcuccucgccuaccgcuccaaggucgacaagggcuccgccgaggaggagaagaucgacgcccuccucuccuccucccagauccgcuggaagaacuga

SEQ ID NO: 51653 - RNA, 513 nt, Artificial Sequence
  derived and/or modified sequence opt2 from VIP__Homo_sapiens__NP_003372
auggacacccgcaacaaggcccagcuccucguccuccucacccuccucuccguccucuucucccagaccuccgccuggccccucuaccgcgcccccuccgcccuccgccucggcgaccgcauccccuucgagggcgccaacgagcccgaccaggucucccucaaggaggacaucgacaugcuccagaacgcccucgccgagaacgacacccccuacuacgacgucucccgcaacgcccgccacgccgacggcgucuucaccuccgacuucuccaagcuccucggccagcucuccgccaagaaguaccucgagucccucaugggcaagcgcgucuccuccaacaucuccgaggaccccguccccgucaagcgccacuccgacgccgucuucaccgacaacuacacccgccuccgcaagcagauggccgucaagaaguaccucaacuccauccucaacggcaagcgcuccuccgagggcgagucccccgacuuccccgaggagcucgagaaguga

SEQ ID NO: 51654 - RNA, 1251 nt, Artificial Sequence
  derived and/or modified sequence opt2 from VIPR1__Homo_sapiens__NP_001238811
augaucgagguccagcacaagcagugccucgaggaggcccagcucgagaacgagaccaucggcugcuccaagaugugggacaaccucaccugcuggcccgccaccccccgcggccaggucgucguccucgccugcccccucaucuucaagcucuucuccuccauccagggccgcaacgucucccgcuccugcaccgacgagggcuggacccaccucgagcccggccccuaccccaucgccugcggccucgacgacaaggccgccucccucgacgagcagcagaccauguucuacggcuccgucaagaccggcuacaccaucggcuacggccucucccucgccacccuccucgucgccaccgccauccucucccucuuccgcaagcuccacugcacccgcaacuacauccacaugcaccucuucaucuccuucauccuccgcgccgccgccgucuucaucaaggaccucgcccucuucgacuccggcgaguccgaccagugcuccgagggcuccgucggcugcaaggccgccauggucuucuuccaguacugcgucauggccaacuucuucuggcuccucgucgagggccucuaccucuacacccuccucgccgucuccuucuucuccgagcgcaaguacuucuggggcuacauccucaucggcuggggcguccccuccaccuucaccauggucuggaccaucgcccgcauccacuucgaggacuacggcugcugggacaccaucaacuccucccucugguggaucaucaagggccccauccucaccuccauccucgucaacuucauccucuucaucugcaucauccgcauccuccuccagaagcuccgcccccccgacauccgcaaguccgacuccucccccuacucccgccucgcccgcuccacccuccuccucaucccccucuucggcguccacuacaucauguucgccuucuuccccgacaacuucaagcccgaggucaagauggucuucgagcucgucgucggcuccuuccagggcuucgucgucgccauccucuacugcuuccucaacggcgagguccaggccgagcuccgccgcaaguggcgccgcuggcaccuccagggcguccucggcuggaaccccaaguaccgccaccccuccggcggcuccaacggcgccaccugcuccacccaggucuccaugcucacccgcgucucccccggcgcccgccgcuccuccuccuuccaggccgaggucucccucgucuga

SEQ ID NO: 51655 - RNA, 1077 nt, Artificial Sequence
  derived and/or modified sequence opt2 from VIPR2__Homo_sapiens__NP_001291451
augcgcacccuccucccccccgcccuccucaccugcuggcuccucgcccccgucaacuccauccaccccgagugccgcuuccaccucgagauccaggaggaggagaccaagugcgccgagcuccuccgcucccagaccgagaagcacaaggccugcuccggcgucugggacaacaucaccugcuggcgccccgccaacgucggcgagaccgucaccguccccugccccaaggucuucuccaacuucuacuccaaggccggcaacaucuccaagaacugcaccuccgacggcugguccgagaccuuccccgacuucgucgacgccugcggcuacuccgaccccgaggacgaguccaaggucggcugcaagcucucccucgucuuccuccaguacugcaucauggccaacuucuucuggcuccucgucgagggccucuaccuccacacccuccucgucgccaugcuccccccccgccgcugcuuccucgccuaccuccucaucggcuggggccuccccaccgucugcaucggcgccuggaccgccgcccgccucuaccucgaggacaccggcugcugggacaccaacgaccacuccguccccuggugggucauccgcauccccauccucaucuccaucaucgucaacuucguccucuucaucuccaucauccgcauccuccuccagaagcucaccucccccgacgucggcggcaacgaccagucccaguacaagcgccucgccaaguccacccuccuccucaucccccucuucggcguccacuacauggucuucgccgucuuccccaucuccaucuccuccaaguaccagauccucuucgagcucugccucggcuccuuccagggccucgucgucgccguccucuacugcuuccucaacuccgagguccagugcgagcucaagcgcaaguggcgcucccgcugccccacccccuccgccucccgcgacuaccgcgucugcggcuccuccuucucccgcaacggcuccgagggcgcccuccaguuccaccgcggcucccgcgcccaguccuuccuccagaccgagaccuccgucaucuga

SEQ ID NO: 51656 - RNA, 2037 nt, Artificial Sequence
  derived and/or modified sequence opt2 from VIT__Homo_sapiens__NP_001171440
augcgcaccgucguccucaccaugaaggccuccgucaucgagauguuccucguccuccucgucaccggcguccacuccaacaaggagaccgccaagaagaucaagcgccccaaguucaccgucccccagaucaacugcgacgucaaggccggcaagaucaucgaccccgaguucaucgucaagugccccgccggcugccaggaccccaaguaccacgucuacggcaccgacgucuacgccuccuacuccuccgucugcggcgccgccguccacuccggcguccucgacaacuccggcggcaagauccucguccgcaaggucgccggccaguccggcuacaagggcuccuacuccaacggcguccagucccucucccucccccgcuggcgcgaguccuucaucguccucgaguccaagcccaagaagggcgucaccuaccccuccgcccucaccuacuccuccuccaagucccccgccgcccaggccggcgagaccaccaaggccuaccagcgcccccccauccccggcaccaccgcccagcccgucacccucaugcagcuccucgccgucaccgucgccgucgccacccccaccacccucccccgccccucccccuccgccgccuccaccaccuccaucccccgcccccaguccgucggccaccgcucccaggagauggaccucugguccaccgccaccuacaccuccucccagaaccgcccccgcgccgaccccggcauccagcgccaggaccccuccggcgccgccuuccagaagcccgucggcgccgacgucucccucggccucguccccaaggaggagcucuccacccagucccucgagcccgucucccucggcgaccccaacugcaagaucgaccucuccuuccucaucgacggcuccaccuccaucggcaagcgccgcuuccgcauccagaagcagcuccucgccgacgucgcccaggcccucgacaucggccccgccggcccccucaugggcgucguccaguacggcgacaaccccgccacccacuucaaccucaagacccacaccaacucccgcgaccucaagaccgccaucgagaagaucacccagcgcggcggccucuccaacgucggccgcgccaucuccuucgucaccaagaacuucuucuccaaggccaacggcaaccgcuccggcgcccccaacgucgucgucgucauggucgacggcuggcccaccgacaaggucgaggaggccucccgccucgcccgcgaguccggcaucaacaucuucuucaucaccaucgagggcgccgccgagaacgagaagcaguacgucgucgagcccaacuucgccaacaaggccgucugccgcaccaacggcuucuacucccuccacguccaguccugguucggccuccacaagacccuccagccccucgucaagcgcgucugcgacaccgaccgccucgccugcuccaagaccugccucaacuccgccgacaucggcuucgucaucgacggcuccuccuccgucggcaccggcaacuuccgcaccguccuccaguucgucaccaaccucaccaaggaguucgagaucuccgacaccgacacccgcaucggcgccguccaguacaccuacgagcagcgccucgaguucggcuucgacaaguacuccuccaagcccgacauccucaacgccaucaagcgcgucggcuacugguccggcggcaccuccaccggcgccgccaucaacuucgcccucgagcagcucuucaagaaguccaagcccaacaagcgcaagcucaugauccucaucaccgacggccgcuccuacgacgacguccgcauccccgccauggccgcccaccucaagggcgucaucaccuacgccaucggcgucgccugggccgcccaggaggagcucgaggucaucgccacccaccccgcccgcgaccacuccuucuucgucgacgaguucgacaaccuccaccaguacgucccccgcaucauccagaacaucugcaccgaguucaacucccagccccgcaacuga

SEQ ID NO: 51657 - RNA, 492 nt, Artificial Sequence
  derived and/or modified sequence opt2 from VKORC1__Homo_sapiens__NP_076869
augggcuccaccuggggcucccccggcuggguccgccucgcccucugccucaccggccucguccucucccucuacgcccuccacgucaaggccgcccgcgcccgcgaccgcgacuaccgcgcccucugcgacgucggcaccgccaucuccugcucccgcgucuucuccucccgcuggggccgcggcuucggccucgucgagcacguccucggccaggacuccauccucaaccaguccaacuccaucuucggcugcaucuucuacacccuccagcuccuccucggcugccuccgcacccgcugggccuccguccucaugcuccucuccucccucgucucccucgccggcuccgucuaccucgccuggauccucuucuucguccucuacgacuucugcaucgucugcaucaccaccuacgccaucaacgucucccucauguggcucuccuuccgcaagguccaggagccccagggcaaggccaagcgccacuga

SEQ ID NO: 51658 - RNA, 2538 nt, Artificial Sequence
  derived and/or modified sequence opt2 from VLDLR__Homo_sapiens__NP_001018066
augggcaccuccgcccucugggcccucuggcuccuccucgcccucugcugggccccccgcgaguccggcgccaccggcaccggccgcaaggccaagugcgagcccucccaguuccagugcaccaacggccgcugcaucacccuccucuggaagugcgacggcgacgaggacugcgucgacggcuccgacgagaagaacugcgucaagaagaccugcgccgaguccgacuucgucugcaacaacggccagugcguccccucccgcuggaagugcgacggcgaccccgacugcgaggacggcuccgacgagucccccgagcagugccacaugcgcaccugccgcauccacgagaucuccugcggcgcccacuccacccagugcauccccgucuccuggcgcugcgacggcgagaacgacugcgacuccggcgaggacgaggagaacugcggcaacaucaccugcucccccgacgaguucaccugcuccuccggccgcugcaucucccgcaacuucgucugcaacggccaggacgacugcuccgacggcuccgacgagcucgacugcgccccccccaccugcggcgcccacgaguuccagugcuccaccuccuccugcauccccaucuccugggucugcgacgacgacgccgacugcuccgaccaguccgacgagucccucgagcagugcggccgccagcccgucauccacaccaagugccccgccuccgagauccagugcggcuccggcgagugcauccacaagaaguggcgcugcgacggcgaccccgacugcaaggacggcuccgacgaggucaacugccccucccgcaccugccgccccgaccaguucgagugcgaggacggcuccugcauccacggcucccgccagugcaacggcauccgcgacugcgucgacggcuccgacgaggucaacugcaagaacgucaaccagugccucggccccggcaaguucaagugccgcuccggcgagugcaucgacaucuccaaggucugcaaccaggagcaggacugccgcgacugguccgacgagccccucaaggagugccacaucaacgagugccucgucaacaacggcggcugcucccacaucugcaaggaccucgucaucggcuacgagugcgacugcgccgccggcuucgagcucaucgaccgcaagaccugcggcgacaucgacgagugccagaaccccggcaucugcucccagaucugcaucaaccucaagggcggcuacaagugcgagugcucccgcggcuaccagauggaccucgccaccggcgucugcaaggccgucggcaaggagcccucccucaucuucaccaaccgccgcgacauccgcaagaucggccucgagcgcaaggaguacauccagcucgucgagcagcuccgcaacaccgucgcccucgacgccgacaucgccgcccagaagcucuucugggccgaccucucccagaaggccaucuucuccgccuccaucgacgacaaggucggccgccacgucaagaugaucgacaacgucuacaaccccgccgccaucgccgucgacugggucuacaagaccaucuacuggaccgacgccgccuccaagaccaucuccgucgccacccucgacggcaccaagcgcaaguuccucuucaacuccgaccuccgcgagcccgccuccaucgccgucgacccccucuccggcuucgucuacugguccgacuggggcgagcccgccaagaucgagaaggccggcaugaacggcuucgaccgccgcccccucgucaccgccgacauccaguggcccaacggcaucacccucgaccucaucaagucccgccucuacuggcucgacuccaagcuccacaugcucuccuccgucgaccucaacggccaggaccgccgcaucguccucaagucccucgaguuccucgcccacccccucgcccucaccaucuucgaggaccgcgucuacuggaucgacggcgagaacgaggccgucuacggcgccaacaaguucaccggcuccgagcucgccacccucgucaacaaccucaacgacgcccaggacaucaucgucuaccacgagcucguccagcccuccggcaagaacuggugcgaggaggacauggagaacggcggcugcgaguaccucugccuccccgccccccagaucaacgaccacucccccaaguacaccugcuccugccccuccggcuacaacgucgaggagaacggccgcgacugccagcgcaucaacgucaccaccgccgucuccgaggucuccgucccccccaagggcaccuccgccgccugggccauccucccccuccuccuccucgucauggccgccgucggcggcuaccucauguggcgcaacuggcagcacaagaacaugaaguccaugaacuucgacaaccccgucuaccucaagaccaccgaggaggaccucuccaucgacaucggccgccacuccgccuccgucggccacaccuaccccgccaucuccgucgucuccaccgacgacgaccucgccuga

SEQ ID NO: 51659 - RNA, 306 nt, Artificial Sequence
  derived and/or modified sequence opt2 from VMA21__Homo_sapiens__NP_001017980
auggagcgccccgacaaggccgcccucaacgcccuccagccccccgaguuccgcaacgaguccucccucgccuccacccucaagacccuccucuucuucaccgcccucaugaucaccguccccaucggccucuacuucaccaccaaguccuacaucuucgagggcgcccucggcauguccaaccgcgacuccuacuucuacgccgccaucgucgccgucgucgccguccacgucguccucgcccucuucgucuacgucgccuggaacgagggcucccgccaguggcgcgagggcaagcaggacuga

SEQ ID NO: 51660 - RNA, 345 nt, Artificial Sequence
  derived and/or modified sequence opt2 from VMO1__Homo_sapiens__NP_001138411
auggagcgcggcgccggcgccaagcuccucccccuccuccuccuccuccgcgccaccggcuucaccugcgcccagaccgacggccgcaacggcuacaccgccgucaucgaggucaccuccggcggccccuggggcgacugggccuggcccgagaugugccccgacggcuucuucgccuccggcuucucccucaaggucgagcccccccagggcauccccggcgacgacaccgcccucaacggcauccgccuccacugcgcccgcggcaacguccucggcaacacccacgucgucgagucccaguccggccgcuggggcgccggcgucgaggacccccucggcuga

SEQ ID NO: 51661 - RNA, 1221 nt, Artificial Sequence
  derived and/or modified sequence opt2 from VMP1__Homo_sapiens__NP_112200
auggccgagaacggcaagaacugcgaccagcgccgcgucgccaugaacaaggagcaccacaacggcaacuucaccgaccccuccuccgucaacgagaagaagcgccgcgagcgcgaggagcgccagaacaucguccucuggcgccagccccucaucacccuccaguacuucucccucgagauccucgucauccucaaggaguggaccuccaagcucuggcaccgccaguccaucgucgucuccuuccuccuccuccucgccguccucaucgccaccuacuacgucgagggcguccaccagcaguacguccagcgcaucgagaagcaguuccuccucuacgccuacuggaucggccucggcauccucuccuccgucggccucggcaccggccuccacaccuuccuccucuaccucggcccccacaucgccuccgucacccucgccgccuacgagugcaacuccgucaacuuccccgagccccccuaccccgaccagaucaucugccccgacgaggagggcaccgagggcaccaucucccucugguccaucaucuccaagguccgcaucgaggccugcauguggggcaucggcaccgccaucggcgagcucccccccuacuucauggcccgcgccgcccgccucuccggcgccgagcccgacgacgaggaguaccaggaguucgaggagaugcucgagcacgccgaguccgcccaggacuucgccucccgcgccaagcucgccguccagaagcucguccagaaggucggcuucuucggcauccucgccugcgccuccauccccaacccccucuucgaccucgccggcaucaccugcggccacuuccucguccccuucuggaccuucuucggcgccacccucaucggcaaggccaucaucaagaugcacauccagaagaucuucgucaucaucaccuucuccaagcacaucgucgagcagauggucgccuucaucggcgccguccccggcaucggccccucccuccagaagcccuuccaggaguaccucgaggcccagcgccagaagcuccaccacaaguccgagaugggcaccccccagggcgagaacuggcucuccuggauguucgagaagcucgucgucgucauggucugcuacuucauccucuccaucaucaacuccauggcccaguccuacgccaagcgcauccagcagcgccucaacuccgaggagaagaccaaguga

SEQ ID NO: 51662 - RNA, 1188 nt, Artificial Sequence
  derived and/or modified sequence opt2 from VN1R2__Homo_sapiens__NP_776255
augacccacacccucuaccccacccccuucgcccucuaccccaucaacaucuccgccgccuggcaccucggcccccuccccgucuccugcuucgucuccaacaaguaccagugcucccucgccuucggcgccaccaccggccuccgcguccucgucgucgucgucccccagacccagcucuccuuccucuccucccucugccucgucucccucuuccuccacucccucgucuccgcccacggcgagaagcccaccaagcccgucggccucgaccccacccucuuccaggucgucgucggcauccucggcaacuucucccuccucuacuacuacauguuccucuacuuccgcggcuacaagccccgcuccaccgaccucauccuccgccaccucaccgucgccgacucccucgucauccucuccaagcgcauccccgagaccauggccaccuucggccucaagcacuucgacaacuacuucggcugcaaguuccuccucuacgcccaccgcgucggccgcggcgucuccaucggcuccaccugccuccucuccgucuuccaggucaucaccaucaacccccgcaacucccgcugggccgagaugaaggucaaggcccccaccuacaucggccucuccaacauccucugcugggccuuccacaugcucgucaacgccaucuuccccaucuacaccaccggcaagugguccaacaacaacaucaccaagaagggcgaccucggcuacugcuccgccccccucuccgacgaggucaccaaguccgucuacgccgcccucaccuccuuccacgacguccucugccucggccucaugcucugggccuccuccuccaucguccucguccucuaccgccacaagcagcagguccagcacaucugccgcaacaaccucuaccccaacuccucccccggcaaccgcgccauccaguccauccucgcccucgucuccaccuucgcccucugcuacgcccucuccuucaucaccuacgucuaccucgcccucuucgacaacuccuccugguggcucgucaacaccgccgcccucaucaucgccugcuuccccaccaucucccccuucguccucaugugccgcgaccccucccgcucccgccucugcuccaucugcugccgccgcaaccgccgcuucuuccacgacuuccgcaagauguga

SEQ ID NO: 51663 - RNA, 906 nt, Artificial Sequence
  derived and/or modified sequence opt2 from VN1R4__Homo_sapiens__NP_776256
auggccucccgcuacgucgccgucggcaugauccucucccagaccgucgucggcguccucggcuccuucuccguccuccuccacuaccucuccuucuacugcaccggcugccgccuccgcuccaccgaccucaucgucaagcaccucaucgucgccaacuuccucgcccuccgcugcaagggcgucccccagaccauggccgccuucggcguccgcuacuuccucaacgcccucggcugcaagcucgucuucuaccuccaccgcgucggccgcggcgucuccaucggcaccaccugccuccucuccgucuuccaggucaucaccgucuccucccgcaagucccgcugggccaagcucaaggagaaggcccccaagcacgucggcuucuccguccuccucugcuggaucgucugcaugcucgucaacaucaucuuccccauguacgucaccggcaaguggaacuacaccaacaucaccgucaacgaggaccucggcuacugcuccggcggcggcaacaacaagaucgcccagacccuccgcgccaugcuccucuccuuccccgacguccucugccucggccucaugcucugggucuccuccuccauggucugcauccuccaccgccacaagcagcgcguccagcacaucgaccgcuccaaccucuccccccgcgccucccccgagaaccgcgccacccaguccauccucauccucgucuccaccuucgucuccuccuacacccucuccugccucuuccaggucugcauggcccuccucgacaaccccaacucccuccucgucaacaccuccgcccucauguccgucugcuuccccacccucucccccuucguccucauguccugcgaccccuccgucuaccgcuucugcuucgccuggaagcgcuga

SEQ ID NO: 51664 - RNA, 1542 nt, Artificial Sequence
  derived and/or modified sequence opt2 from VNN1__Homo_sapiens__NP_004657
augaccacccagcuccccgccuacgucgccauccuccucuucuacgucucccgcgccuccugccaggacaccuucaccgccgccgucuacgagcacgccgccauccuccccaacgccacccucacccccgucucccgcgaggaggcccucgcccucaugaaccgcaaccucgacauccucgagggcgccaucaccuccgccgccgaccagggcgcccacaucaucgucacccccgaggacgccaucuacggcuggaacuucaaccgcgacucccucuaccccuaccucgaggacauccccgaccccgaggucaacuggauccccugcaacaaccgcaaccgcuucggccagacccccguccaggagcgccucuccugccucgccaagaacaacuccaucuacgucgucgccaacaucggcgacaagaagcccugcgacaccuccgacccccagugcccccccgacggccgcuaccaguacaacaccgacgucgucuucgacucccagggcaagcucgucgcccgcuaccacaagcagaaccucuucaugggcgagaaccaguucaacguccccaaggagcccgagaucgucaccuucaacaccaccuucggcuccuucggcaucuucaccugcuucgacauccucuuccacgaccccgccgucacccucgucaaggacuuccacgucgacaccaucgucuuccccaccgccuggaugaacguccucccccaccucuccgccgucgaguuccacuccgccugggccaugggcaugcgcgucaacuuccucgccuccaacauccacuaccccuccaagaagaugaccggcuccggcaucuacgcccccaacuccucccgcgccuuccacuacgacaugaagaccgaggagggcaagcuccuccucucccagcucgacucccaccccucccacuccgccgucgucaacuggaccuccuacgccuccuccaucgaggcccucuccuccggcaacaaggaguucaagggcaccgucuucuucgacgaguucaccuucgucaagcucaccggcgucgccggcaacuacaccgucugccagaaggaccucugcugccaccucuccuacaagauguccgagaacauccccaacgaggucuacgcccucggcgccuucgacggccuccacaccgucgagggccgcuacuaccuccagaucugcacccuccucaagugcaagaccaccaaccucaacaccugcggcgacuccgccgagaccgccuccacccgcuucgagauguucucccucuccggcaccuucggcacccaguacgucuuccccgagguccuccucuccgagaaccagcucgcccccggcgaguuccaggucuccaccgacggccgccucuucucccucaagcccaccuccggccccguccucaccgucacccucuucggccgccucuacgagaaggacugggccuccaacgccuccuccggccucaccgcccaggcccgcaucaucaugcucaucgucaucgcccccaucgucugcucccucuccugguga

SEQ ID NO: 51665 - RNA, 900 nt, Artificial Sequence
  derived and/or modified sequence opt2 from VNN2__Homo_sapiens__NP_001229279
auggucaccuccuccuuccccaucuccgucgccgucuucgcccucaucacccuccaggucggcacccaggacuccuucaucgccgccgucuacgagcacgccgucauccuccccaacaagaccgagacccccgucucccaggaggacgcccucaaccucaugaacgagaacaucgacauccucgagaccgccaucaagcaggccgccgagcagggcgcccgcaucaucgucacccccgaggacgcccucuacggcuggaaguucacccgcgagaccgucuuccccuaccucgaggacauccccgacccccaggucaacuggauccccugccaggacccccaccgcuucggccacacccccguccaggcccgccucuccugccucgccaaggacaacuccaucuacguccucgccaaccucggcgacaagaagcccugcaacucccgcgacuccaccugcccccccaacggcuacuuccaguacaacaccaacgucgucuacaacaccgagggcaagcucgucgcccgcuaccacaaggucugcaccaugcucaagugcaagaccaccaaccucaccaccugcggccgccccgucgagaccgccuccacccgcuucgagauguucucccucuccggcaccuucggcaccgaguacgucuuccccgagguccuccucaccgagauccaccucucccccggcaaguucgagguccucaaggacggccgccucgucaacaagaacggcuccuccggccccauccucaccgucucccucuucggccgcugguacaccaaggacucccucuacuccuccugcggcaccuccaacuccgccaucaccuaccuccucaucuucauccuccucaugaucaucgcccuccagaacaucgucaugcucuga

SEQ ID NO: 51666 - RNA, 732 nt, Artificial Sequence
  derived and/or modified sequence opt2 from VNN3__Homo_sapiens__NP_001278632
augggcgucaaccuccucgccgccaacacccacaacaccuccaugcacaugaccggcuccggcaucuacgcccccgaggccgucaaggucuaccacuacgacauggagaccgaguccggccagcuccuccucuccgagcucaagucccgcccccgccgcgagcccaccuaccccgccgccgucgacuggcacgccuacgccuccuccgucaagcccuucuccuccgagcaguccgacuuccucggcaugaucuacuucgacgaguucaccuucaccaagcucaagcgcaacaccggcaacuacaccgccugccagaaggaccucugcugccaccucaccuacaagauguccgagaagcgcaccgacgagaucuacgcccucggcgccuucgacggccuccacaccgucgagggccaguacuaccuccagaucugcgcccuccucaagugccagaccaccgaccucgagaccugcggcgagcccgucggcuccgccuucaccaaguucgaggacuucucccucuccggcaccuucggcacccgcuacgucuucccccagaucauccucuccggcucccagcucgcccccgagcgccacuacgagaucucccgcgacggccgccuccgcucccgcuccggcgccccccuccccguccucgucauggcccucuacggccgcgucuucgagaaggaccccccccgccucggccagggcuccggcaaguuccaguga

SEQ ID NO: 51667 - RNA, 510 nt, Artificial Sequence
  derived and/or modified sequence opt2 from VOPP1__Homo_sapiens__NP_001271212
augcucuccgagacccucggcuaccucuccuccguccuccuccagugcaccgaggccaagaagcacugcugguacuucgagggccucuaccccaccuacuacaucugccgcuccuacgaggacugcugcggcucccgcugcugcguccgcgcccucuccauccagcgccucugguacuucugguuccuccucaugaugggcguccucuucugcugcggcgccggcuucuucauccgccgccgcauguacccccccccccucaucgaggagcccgccuucaacgucuccuacacccgccagccccccaaccccggccccggcgcccagcagcccggcccccccuacuacaccgaccccggcggccccggcaugaaccccgucggcaacuccauggccauggccuuccaggucccccccaacuccccccagggcuccgucgccugcccccccccccccgccuacugcaacaccccccccccccccuacgagcaggucgucaaggccaaguga

SEQ ID NO: 51668 - RNA, 4524 nt, Artificial Sequence
  derived and/or modified sequence opt2 from VPRBP__Homo_sapiens__NP_055518
augaccaccgucgucguccacgucgacuccaaggccgagcucaccacccuccucgagcagugggagaaggagcacggcuccggccaggacaugguccccauccucacccgcaugucccagcucaucgagaaggagaccgaggaguaccgcaagggcgaccccgaccccuucgacgaccgccaccccggccgcgccgaccccgagugcaugcucggccaccuccuccgcauccucuucaagaacgacgacuucaugaacgcccucgucaacgccuacgucaugaccucccgcgagcccccccucaacaccgccgccugccgccuccuccucgacaucaugcccggccucgagaccgccgucgucuuccaggagaaggagggcaucgucgagaaccucuucaagugggcccgcgaggccgaccagccccuccgcaccuacuccaccggccuccucggcggcgccauggagaaccaggacaucgccgccaacuaccgcgacgagaacucccagcucgucgccaucguccuccgccgccuccgcgagcuccagcuccaggaggucgcccuccgccaggagaacaagcgccccuccccccgcaagcucuccuccgagccccuccucccccucgacgaggaggccgucgacauggacuacggcgacauggccgucgacgucgucgacggcgaccaggaggaggccuccggcgacauggagaucuccuuccaccucgacuccggccacaagaccuccucccgcgucaacuccaccaccaagcccgaggacggcggccucaagaagaacaaguccgccaagcagggcgaccgcgagaacuuccgcaaggccaagcagaagcucggcuucuccuccuccgaccccgaccgcauguucgucgagcucuccaacuccuccugguccgagaugucccccugggucaucggcaccaacuacacccucuaccccaugacccccgccaucgagcagcgccucauccuccaguaccucaccccccucggcgaguaccaggagcuccuccccaucuucaugcagcucggcucccgcgagcucaugauguucuacaucgaccucaagcagaccaacgacguccuccucaccuucgaggcccucaagcaccucgccucccuccuccuccacaacaaguucgccaccgaguucgucgcccacggcggcguccagaagcuccucgagaucccccgccccuccauggccgccaccggcgucuccaugugccucuacuaccucuccuacaaccaggacgccauggagcgcgucugcaugcacccccacaacguccucuccgacgucgucaacuacacccucuggcucauggagugcucccacgccuccggcugcugccacgccaccauguucuucuccaucugcuucuccuuccgcgccguccucgagcucuucgaccgcuacgacggccuccgccgccucgucaaccucaucuccacccucgagauccucaaccucgaggaccagggcgcccuccucuccgacgacgagaucuucgccucccgccagaccggcaagcacaccugcauggcccuccgcaaguacuucgaggcccaccucgccaucaagcucgagcaggucaagcagucccuccagcgcaccgagggcggcauccucguccacccccagccccccuacaaggccugcuccuacacccacgagcagaucgucgagaugauggaguuccucaucgaguacggccccgcccagcucuacugggagcccgccgaggucuuccucaagcucuccugcguccagcuccuccuccagcucaucuccaucgccugcaacuggaagaccuacuacgcccgcaacgacaccguccgcuucgcccucgacguccucgccauccucaccgucguccccaagauccagcuccagcucgccgaguccgucgacguccucgacgaggccggcuccaccgucuccaccgucggcaucuccaucauccucggcgucgccgagggcgaguucuucauccacgacgccgagauccagaaguccgcccuccagaucaucaucaacugcgucugcggccccgacaaccgcaucuccuccaucggcaaguucaucuccggcaccccccgccgcaagcucccccagaaccccaaguccuccgagcacacccucgccaagauguggaacgucguccaguccaacaacggcaucaagguccuccucucccuccucuccaucaagaugcccaucaccgacgccgaccagauccgcgcccucgccugcaaggcccucgucggccucucccgcuccuccaccguccgccagaucaucuccaagcucccccucuucuccuccugccagauccagcagcucaugaaggagcccguccuccaggacaagcgcuccgaccacgucaaguucugcaaguacgccgccgagcucaucgagcgcgucuccggcaagccccuccucaucggcaccgacgucucccucgcccgccuccagaaggccgacgucgucgcccagucccgcaucuccuuccccgagaaggagcuccuccuccucauccgcaaccaccucaucuccaagggccucggcgagaccgccaccguccucaccaaggaggccgaccuccccaugaccgccgccucccacuccuccgccuucacccccgucaccgccgccgccucccccgucucccucccccgcaccccccgcaucgccaacggcaucgccacccgccucggcucccacgccgccgucggcgccuccgcccccuccgcccccaccgcccacccccagccccgccccccccagggcccccucgcccuccccggccccuccuacgccggcaacuccccccucaucggccgcaucuccuucauccgcgagcgccccucccccugcaacggccgcaagauccgcguccuccgccagaaguccgaccacggcgccuacucccagucccccgccaucaagaagcagcucgaccgccaccuccccuccccccccacccucgacuccaucaucaccgaguaccuccgcgagcagcacgcccgcugcaagaaccccgucgccaccugcccccccuucucccucuucaccccccaccagugccccgagcccaagcagcgccgccaggcccccaucaacuucaccucccgccucaaccgccgcgccuccuuccccaaguacggcggcgucgacggcggcugcuucgaccgccaccucaucuucucccgcuuccgccccaucuccgucuuccgcgaggccaacgaggacgaguccggcuucaccugcugcgccuucuccgcccgcgagcgcuuccucaugcucggcaccugcaccggccagcucaagcucuacaacgucuucuccggccaggaggaggccuccuacaacugccacaacuccgccaucacccaccucgagcccucccgcgacggcucccuccuccucaccuccgccaccuggucccagccccucuccgcccucuggggcaugaaguccgucuucgacaugaagcacuccuucaccgaggaccacuacgucgaguucuccaagcacucccaggaccgcgucaucggcaccaagggcgacaucgcccacaucuacgacauccagaccggcaacaagcuccucacccucuucaaccccgaccucgccaacaacuacaagcgcaacugcgccaccuucaaccccaccgacgaccucguccucaacgacggcguccucugggacguccgcuccgcccaggccauccacaaguucgacaaguucaacaugaacaucuccggcgucuuccaccccaacggccucgaggucaucaucaacaccgagaucugggaccuccgcaccuuccaccuccuccacaccguccccgcccucgaccagugccgcgucgucuucaaccacaccggcaccgucauguacggcgccaugcuccaggccgacgacgaggacgaccucauggaggagcgcaugaagucccccuucggcuccuccuuccgcaccuucaacgccaccgacuacaagcccaucgccaccaucgacgucaagcgcaacaucuucgaccucugcaccgacaccaaggacugcuaccucgccgucaucgagaaccagggcuccauggacgcccucaacauggacaccgucugccgccucuacgaggucggccgccagcgccucgccgaggacgaggacgaggaggaggaccaggaggaggaggagcaggaggaggaggacgacgacgaggacgacgacgacaccgacgaccucgacgagcucgacaccgaccagcuccucgaggccgagcucgaggaggacgacaacaacgagaacgccggcgaggacggcgacaacgacuucucccccuccgacgaggagcucgccaaccuccucgaggagggcgaggacggcgaggacgaggacuccgacgccgacgaggaggucgagcucauccucggcgacaccgacuccuccgacaacuccgaccucgaggacgacaucauccucucccucaacgaguga

SEQ ID NO: 51669 - RNA, 438 nt, Artificial Sequence
  derived and/or modified sequence opt2 from VPREB1__Homo_sapiens__NP_009059
auguccugggcccccguccuccucaugcucuucgucuacugcaccggcugcggcccccagcccguccuccaccagccccccgccauguccuccgcccucggcaccaccauccgccucaccugcacccuccgcaacgaccacgacaucggcgucuacuccgucuacugguaccagcagcgccccggccaccccccccgcuuccuccuccgcuacuucucccaguccgacaagucccagggcccccagguccccccccgcuucuccggcuccaaggacgucgcccgcaaccgcggcuaccucuccaucuccgagcuccagcccgaggacgaggccauguacuacugcgccaugggcgcccgcuccuccgagaaggaggagcgcgagcgcgagugggaggaggagauggagcccaccgccgcccgcacccgcguccccuga

SEQ ID NO: 51670 - RNA, 372 nt, Artificial Sequence
  derived and/or modified sequence opt2 from VPREB3__Homo_sapiens__NP_037510
auggccugccgcugccucuccuuccuccucaugggcaccuuccucuccgucucccagaccguccucgcccagcucgacgcccuccucgucuuccccggccaggucgcccagcucuccugcacccucuccccccagcacgucaccauccgcgacuacggcgucuccugguaccagcagcgcgccggcuccgccccccgcuaccuccucuacuaccgcuccgaggaggaccaccaccgccccgccgacauccccgaccgcuucuccgccgccaaggacgaggcccacaacgccugcguccucaccaucucccccguccagcccgaggacgacgccgacuacuacugcuccgucggcuacggcuucucccccuga

SEQ ID NO: 51671 - RNA, 1740 nt, Artificial Sequence
  derived and/or modified sequence opt2 from VPS11__Homo_sapiens__XP_011541201
augcucuucaagaagaaccucuucgagauggccaucaaccucgccaagucccagcaccucgacuccgacggccucgcccagaucuucaugcaguacggcgaccaccucuacuccaagggcaaccacgacggcgccguccagcaguacauccgcaccaucggcaagcucgagcccuccuacgucauccgcaaguuccucgacgcccagcgcauccacaaccucaccgccuaccuccagacccuccaccgccagucccucgccaacgccgaccacaccacccuccuccucaacugcuacaccaagcucaaggacuccuccaagcucgaggaguucaucaagaagaaguccgaguccgagguccacuucgacgucgagaccgccaucaagguccuccgccaggccggcuacuacucccacgcccucuaccucgccgagaaccacgcccaccacgagugguaccucaagauccagcucgaggacaucaagaacuaccaggaggcccuccgcuacaucggcaagcuccccuucgagcaggccgaguccaacaugaagcgcuacggcaagauccucaugcaccacauccccgagcagaccacccagcuccucaagggccucugcaccgacuaccgccccucccucgagggccgcuccgaccgcgaggcccccggcugccgcgccaacuccgaggaguucauccccaucuucgccaacaacccccgcgagcucaaggccuuccucgagcacauguccgagguccagcccgacuccccccagggcaucuacgacacccuccucgagcuccgccuccagaacugggcccacgagaaggacccccaggucaaggagaagcuccacgccgaggccaucucccuccucaaguccggccgcuucugcgacgucuucgacaaggcccucguccucugccagaugcacgacuuccaggacggcguccucuaccucuacgagcagggcaagcucuuccagcagaucaugcacuaccacaugcagcacgagcaguaccgccaggucaucuccgucugcgagcgccacggcgagcaggaccccucccucugggagcaggcccucuccuacuucgcccgcaaggaggaggacugcaaggaguacgucgccgccguccucaagcacaucgagaacaagaaccucaugcccccccuccucgucguccagacccucgcccacaacuccaccgccacccucuccgucauccgcgacuaccucguccagaagcuccagaagcagucccagcagaucgcccaggacgagcuccgcguccgccgcuaccgcgaggagaccacccgcauccgccaggagauccaggagcucaaggccucccccaagaucuuccagaagaccaagugcuccaucugcaacuccgcccucgagcuccccuccguccacuuccucugcggccacuccuuccaccagcacugcuucgaguccuacuccgaguccgacgccgacugccccaccugccuccccgagaaccgcaaggucauggacaugauccgcgcccaggagcagaagcgcgaccuccacgaccaguuccagcaccagcucaagugcuccaacgacuccuucuccgucaucgccgacuacuucggccgcggcgucuucaacaagcucacccuccucaccgacccccccaccgcccgccucaccuccucccucgaggccggccuccagcgcgaccuccucaugcacucccgccgcggcaccuga

SEQ ID NO: 51672 - RNA, 9408 nt, Artificial Sequence
  derived and/or modified sequence opt2 from VPS13A__Homo_sapiens__NP_001018047
auggucuucgaguccgucgucgucgacguccucaaccgcuuccucggcgacuacgucgucgaccucgacaccucccagcucucccucggcaucuggaagggcgccgucgcccucaagaaccuccagaucaaggagaacgcccucucccagcucgacguccccuucaaggucaaggucggccacaucggcaaccucaagcucaucauccccuggaagaaccucuacacccagcccgucgaggccguccucgaggagaucuaccuccucaucguccccuccucccgcaucaaguacgacccccucaaggaggagaagcagcucauggaggccaagcagcaggagcucaagcgcaucgaggaggccaagcagaaggucgucgaccaggagcagcaccuccccgagaagcaggacaccuucgccgagaagcucgucacccagaucaucaagaaccuccaggucaagaucuccuccauccacauccgcuacgaggacgacaucaccaaccgcgacaagccccucuccuucggcaucucccuccagaaccucuccaugcagaccaccgaccaguacuggguccccugccuccacgacgagaccgagaagcucguccgcaagcucauccgccucgacaaccucuucgccuacuggaacgucaagucccagauguucuaccucuccgacuacgacaacucccucgacgaccucaagaacggcaucgucaacgagaacaucguccccgagggcuacgacuucgucuuccgccccaucuccgccaacgccaagcucgucaugaaccgccgcuccgacuucgacuucuccgcccccaagaucaaccucgagaucgagcuccacaacaucgccaucgaguucaacaagccccaguacuucuccaucauggagcuccucgaguccgucgacaugauggcccagaaccuccccuaccgcaaguucaagcccgacgucccccuccaccaccacgcccgcgaguggugggccuacgccauccacggcguccucgaggucaacgucugcccccgccucuggaugugguccuggaagcacauccgcaagcaccgccagaaggucaagcaguacaaggagcucuacaagaagaagcucaccuccaagaagccccccggcgagcuccucgucucccucgaggagcucgagaagacccucgacgucuucaacaucaccaucgcccgccagaccgccgaggucgaggucaagaaggccggcuacaagaucuacaaggagggcgucaaggaccccgaggacaacaagggcugguucuccuggcucugguccugguccgagcagaacaccaacgagcagcagcccgacguccagcccgagacccucgaggagaugcucacccccgaggagaaggcccuccucuacgaggccaucggcuacuccgagaccgccgucgaccccacccuccucaagaccuucgaggcccucaaguucuucguccaccucaaguccauguccaucguccuccgcgagaaccaccagaagcccgagcucgucgacaucgucaucgaggaguucuccacccucaucguccagcgccccggcgcccaggccaucaaguucgagaccaagaucgacuccuuccacaucaccggccuccccgacaacuccgagaagccccgccuccucuccucccucgacgacgccaugucccucuuccagaucaccuucgagaucaacccccucgacgagaccgucucccagcgcugcaucaucgaggccgagccccucgagaucaucuacgacgcccgcaccgucaacuccaucgucgaguucuuccgcccccccaaggagguccaccucgcccagcucaccgccgccacccucaccaagcucgaggaguuccgcuccaagaccgccaccggccuccucuacaucaucgagacccagaagguccucgaccucaagaucaaccucaaggccuccuacaucaucgucccccaggacggcaucuucucccccaccuccaaccuccuccuccucgaccucggccaccucaaggucaccuccaagucccgcuccgagcuccccgacgucaagcagggcgaggccaaccucaaggagaucauggaccgcgccuacgacuccuucgacauccagcucaccuccguccagcuccucuacucccgcgucggcgacaacuggcgcgaggcccgcaagcucuccgucuccacccagcacauccucguccccaugcacuucaaccucgagcucuccaaggccauggucuucauggacguccgcaugcccaaguucaagaucuacggcaagcucccccucaucucccuccgcaucuccgacaagaagcuccagggcaucauggagcucaucgaguccauccccaagcccgagcccgucaccgaggucuccgcccccgucaaguccuuccagauccagaccuccaccucccucggcaccucccagaucucccagaagaucaucccccuccucgagcuccccuccgucuccgaggacgacuccgaggaggaguucuucgacgcccccugcuccccccucgaggagccccuccaguuccccaccggcgucaaguccauccgcacccgcaagcuccagaagcaggacugcuccgucaacaugaccaccuucaagauccgcuucgagguccccaagguccucaucgaguucuaccaccucgucggcgacugcgagcucuccgucgucgagauccucguccucggccucggcgccgagaucgagauccgcaccuacgaccucaaggccaacgccuuccucaaggaguucugccucaagugccccgaguaccucgacgagaacaagaagcccgucuaccucgucaccacccucgacaacaccauggaggaccuccucacccucgaguacgucaaggccgagaagaacguccccgaccucaaguccaccuacaacaacguccuccagcucaucaaggucaacuucuccucccucgacauccaccuccacaccgaggcccuccucaacaccaucaacuaccuccacaacauccucccccaguccgaggagaaguccgcccccgucuccaccaccgagaccgaggacaagggcgacgucaucaagaagcucggccucgacuccgagaugaucaugcgccccuccgagaccgagaucaacgccaagcuccgcaacaucaucguccucgacuccgacaucaccgccaucuacaagaaggccgucuacaucaccggcaaggaggucuucuccuucaagauggucuccuacauggacgccaccgccggcuccgccuacaccgacaugaacgucgucgacauccaggucaaccucaucgucggcugcaucgaggucgucuucgucaccaaguuccucuacuccauccucgccuucaucgacaacuuccaggccgccaagcaggcccucgccgaggccaccguccaggccgccggcauggccgccaccggcgucaaggagcucgcccagcgcuccucccgcauggcccucgacaucaacaucaaggcccccgucgucgucaucccccagucccccgucuccgagaacgucuucgucgccgacuucggccucaucaccaugaccaacaccuuccacaugaucaccgagucccaguccucccccccccccgucaucgaccucaucaccaucaagcucuccgagaugcgccucuaccgcucccgcuucaucaacgacgccuaccaggagguccucgaccuccuccucccccucaaccucgaggucgucgucgagcgcaaccucugcugggagugguaccaggagguccccugcuucaacgucaacgcccagcucaagcccauggaguucauccucucccaggaggacaucaccaccaucuucaagacccuccacggcaacaucugguacgagaaggacggcuccgccucccccgccgucaccaaggaccaguacuccgccaccuccggcgucaccaccaacgccucccaccacuccggcggcgccaccgucgucaccgccgccgucgucgagguccacucccgcgcccuccucgucaagaccacccucaacaucuccuucaagaccgacgaccucaccaugguccucuacucccccggccccaagcaggccuccuucaccgacguccgcgaccccucccucaagcucgccgaguucaagcucgagaacaucaucuccacccucaagauguacaccgacggcuccaccuucuccuccuucucccucaagaacugcauccucgacgacaagcgcccccacgucaagaaggccaccccccgcaugaucggccucaccgucggcuucgacaagaaggacaugauggacaucaaguaccgcaagguccgcgacggcugcgucaccgacgccgucuuccaggagauguacaucugcgccuccgucgaguuccuccagaccgucgccaacgucuuccucgaggccuacaccaccggcaccgccgucgagaccuccguccagaccuggaccgccaaggaggagguccccacccaggaguccgucaagugggagaucaacgucaucaucaagaaccccgagaucgucuucgucgccgacaugaccaagaacgacgcccccgcccucgucaucaccacccagugcgagaucugcuacaagggcaaccucgagaacuccaccaugaccgccgccaucaaggaccuccagguccgcgccugccccuuccuccccgucaagcgcaagggcaagaucaccaccguccuccagcccugcgaccucuucuaccagaccacccagaagggcaccgacccccaggucaucgacauguccgucaagucccucacccucaaggucucccccgucaucaucaacaccaugaucaccaucaccuccgcccucuacaccaccaaggagaccauccccgaggagaccgccuccuccaccgcccaccucugggagaagaaggacaccaagacccucaagaugugguuccucgaggaguccaacgagaccgagaagaucgcccccaccaccgagcucguccccaagggcgagaugaucaagaugaacaucgacuccaucuucaucguccucgaggccggcaucggccaccgcaccguccccaugcuccucgccaagucccgcuucuccggcgagggcaagaacugguccucccucaucaaccuccacugccagcucgagcucgagguccacuacuacaacgagauguucggcgucugggagccccuccucgagccccucgagaucgaccagaccgaggacuuccgccccuggaaccucggcaucaagaugaagaagaaggccaagauggccaucgucgaguccgaccccgaggaggagaacuacaagguccccgaguacaagaccgucaucuccuuccacuccaaggaccagcucaacaucacccucuccaagugcggccucgucaugcucaacaaccucgucaaggccuucaccgaggccgccaccggcuccuccgccgacuucgucaaggaccucgcccccuucaugauccucaacucccucggccucaccaucuccgucucccccuccgacuccuucuccguccucaacauccccauggccaaguccuacguccucaagaacggcgagucccucuccauggacuacauccgcaccaaggacaacgaccacuucaacgccaugaccucccucuccuccaagcucuucuucauccuccucacccccgucaaccacuccaccgccgacaagaucccccucaccaaggucggccgccgccucuacaccguccgccaccgcgaguccggcgucgagcgcuccaucgucugccagaucgacaccgucgagggcuccaagaaggucaccauccgcucccccguccagauccgcaaccacuucuccgucccccucuccgucuacgagggcgacacccuccucggcaccgccucccccgagaacgaguucaacaucccccucggcuccuaccgcuccuucaucuuccucaagcccgaggacgagaacuaccagaugugcgagggcaucgacuucgaggagaucaucaagaacgacggcgcccuccucaagaagaagugccgcuccaagaaccccuccaaggaguccuuccucaucaacaucguccccgagaaggacaaccucaccucccucuccgucuacuccgaggacggcugggaccuccccuacaucaugcaccucuggccccccauccuccuccgcaaccuccuccccuacaagaucgccuacuacaucgagggcaucgagaacuccgucuucacccucuccgagggccacuccgcccagaucugcaccgcccagcucggcaaggcccgccuccaccucaagcuccucgacuaccucaaccacgacuggaaguccgaguaccacaucaagcccaaccagcaggacaucuccuucgucuccuucaccugcgucaccgagauggagaagaccgaccucgacaucgccguccacaugaccuacaacaccggccagaccgucgucgccuuccacucccccuacuggauggucaacaagaccggccgcaugcuccaguacaaggccgacggcauccaccgcaagcacccccccaacuacaagaagcccguccucuucuccuuccagcccaaccacuucuucaacaacaacaagguccagcucauggucaccgacuccgagcucuccaaccaguucuccaucgacaccgucggcucccacggcgccgucaagugcaagggccucaagauggacuaccaggucggcgucaccaucgaccucuccuccuucaacaucacccgcaucgucaccuucacccccuucuacaugaucaagaacaaguccaaguaccacaucuccgucgccgaggagggcaacgacaaguggcucucccucgaccucgagcagugcauccccuucuggcccgaguacgccuccuccaagcuccucauccaggucgagcgcuccgaggacccccccaagcgcaucuacuucaacaagcaggagaacugcauccuccuccgccucgacaacgagcucggcggcaucaucgccgaggucaaccucgccgagcacuccaccgucaucaccuuccucgacuaccacgacggcgccgccaccuuccuccucaucaaccacaccaagaacgagcucguccaguacaaccaguccucccucuccgagaucgaggacucccucccccccggcaaggccgucuucuacaccugggccgaccccgucggcucccgccgccucaaguggcgcugccgcaagucccacggcgaggucacccagaaggacgacaugaugaugcccaucgaccucggcgagaagaccaucuaccucgucuccuucuucgagggccuccagcgcaucauccucuucaccgaggacccccgcgucuucaaggucaccuacgaguccgagaaggccgagcucgccgagcaggagaucgccgucgcccuccaggacgucggcaucucccucgucaacaacuacaccaagcaggaggucgccuacaucggcaucaccuccuccgacgucgucugggagaccaagcccaagaagaaggcccgcuggaagcccauguccgucaagcacaccgagaagcucgagcgcgaguucaaggaguacaccgaguccucccccuccgaggacaaggucauccagcucgacaccaacguccccguccgccucacccccaccggccacaacaugaagauccuccagccccacgucaucgcccuccgccgcaacuaccuccccgcccucaaggucgaguacaacaccuccgcccaccaguccuccuuccgcauccagaucuaccgcauccagauccagaaccagauccacggcgccgucuuccccuucgucuucuaccccgucaagccccccaaguccgucaccauggacuccgcccccaagcccuucaccgacgucuccaucgucaugcgcuccgccggccacucccagaucucccgcaucaaguacuucaagguccucauccaggagauggaccuccgccucgaccucggcuucaucuacgcccucaccgaccucaugaccgaggccgaggucaccgagaacaccgaggucgagcucuuccacaaggacaucgaggccuucaaggaggaguacaagaccgccucccucgucgaccagucccaggucucccucuacgaguacuuccacaucucccccaucaagcuccaccucuccgucucccucuccuccggccgcgaggaggccaaggacuccaagcagaacggcggccucauccccguccacucccucaaccuccuccucaaguccaucggcgccacccucaccgacguccaggacgucgucuucaagcucgccuucuucgagcucaacuaccaguuccacaccaccuccgaccuccaguccgaggucauccgccacuacuccaagcaggccaucaagcagauguacguccucauccucggccucgacguccucggcaaccccuucggccucauccgcgaguucuccgagggcgucgaggccuucuucuacgagcccuaccagggcgccauccagggccccgaggaguucgucgagggcauggcccucggccucaaggcccucgucggcggcgccgucggcggccucgccggcgccgccuccaagaucaccggcgccauggccaagggcgucgccgccaugaccauggacgaggacuaccagcagaagcgccgcgaggccaugaacaagcagcccgccggcuuccgcgagggcaucacccgcggcggcaagggccucgucuccggcuucgucuccggcaucaccggcaucgucaccaagcccaucaagggcgcccagaagggcggcgccgccggcuucuucaagggcgucggcaagggccucgucggcgccgucgcccgccccaccggcggcaucaucgacauggccuccuccaccuuccagggcaucaagcgcgccaccgagaccuccgaggucgagucccuccgccccccccgcuucuucaacgaggacggcgucauccgccccuaccgccuccgcgacggcaccggcaaccagaugcuccaggucauggagaacggccgcuucgccaaguacaaguacuucacccacgucaugaucaacaagaccgacaugcucaugaucacccgccgcggcguccucuucgucaccaagggcaccuucggccagcucaccugcgaguggcaguacuccuucgacgaguucaccaaggagcccuucaucguccacggccgccgccuccgcaucgaggccaaggagcgcgucaaguccgucuuccacgcccgcgaguucggcaagaucaucaacuucaagacccccgaggacgcccgcuggauccucaccaagcuccaggaggcccgcgagcccucccccucccucuga

SEQ ID NO: 51673 - RNA, 2592 nt, Artificial Sequence
  derived and/or modified sequence opt2 from VPS13B__Homo_sapiens__NP_056058
augcucgaguccuacgucacccccauccucauguccuacgucaaccgcuacaucaagaaccucaagcccuccgaccuccagcucucccucuggggcggcgacgucguccucuccaagcucgagcucaagcucgacguccucgagcaggagcucaagcuccccuucaccuuccucuccggccacauccacgagcuccgcauccacguccccuggaccaagcucggcuccgagcccgucgucaucaccaucaacaccauggagugcauccucaagcucaaggacggcauccaggacgaccacgaguccugcggcuccaacuccaccaaccgcuccaccgccgaguccaccaaguccuccaucaagccccgccgcaugcagcaggccgcccccaccgaccccgaccucccccccggcuacguccagucccucauccgccgcgucgucaacaacgucaacaucgucaucaacaaccucauccucaaguacgucgaggacgacaucguccucuccgucaacaucaccuccgccgagugcuacaccgucggcgagcucugggaccgcgccuucauggacaucuccgccaccgaccucguccuccgcaaggucaucaacuucuccgacugcaccgucugccucgacaagcgcaacgccuccggcaagaucgaguucuaccaggacccccuccucuacaagugcuccuuccgcacccgccuccacuucaccuacgagaaccucaacuccaagaugcccuccgucaucaagauccacacccucgucgagucccucaagcucuccaucaccgaccagcagcuccccauguucauccgcaucaugcagcucggcaucgcccucuacuacggcgagaucggcaacuucaaggagggcgagaucgaggaccucaccugccacaacaaggacaugcucggcaacaucaccggcuccgaggacgagacccgcaucgacaugcaguaccccgcccagcacaagggccaggagcucuacucccagcaggacgaggagcagccccagggcugggucuccugggccugguccuucguccccgccaucgucuccuacgacgacggcgaggaggacuucgucggcaacgaccccgccuccaccaugcaccagcagaaggcccagacccucaaggaccccaucgucuccaucggcuucuacugcaccaaggccaccgucaccuucaagcucaccgagaugcaggucgaguccuccuacuacuccccccagaaggucaaguccaaggagguccucugcugggagcaggagggcaccaccgucgaggcccucaugaugggcgagcccuucuucgacugccagaucggcuucgucggcugccgcgccaugugccucaagggcaucaugggcgucaaggacuucgaggagaacaugaaccgcuccgagaccgaggccugcuucuucaucugcggcgacaaccucuccaccaagggcuucaccuaccucaccaacucccucuucgacuaccgcucccccgagaacaacggcacccgcgccgaguucauccucgacuccacccaccacaaggagaccuacaccgagaucgccggcaugcagcgcuucggcgccuucuacauggacuaccucuacaccauggagaacaccuccggcaagggcuccaccaaccagcaggacuucuccuccggcaaguccgaggaccucggcaccguccaggagaaguccaccaagucccucgucaucggcccccucgacuuccgccucgacuccuccgccguccaccgcauccucaagaugaucgucugcgcccucgagcacgaguacgagcccuacucccgccucaaguccgacaucaaggacgagaacgagaccauccucaaccccgaggaggucgcccuccucgaggaguacauccccacccgccacaccuccgucacccuccucaagugcaccugcaccaucuccauggccgaguucaaccuccucgaccaccuccuccccgucaucaugggcgagaagaacuccuccaacuucaugaacaccaccaacuuccagucccuccgcccccuccccuccauccgcauccucgucgacaagaucaaccucgagcacuccguccccauguacgccgagcagcucguccacgucgucuccucccucacccagcccuccgacaaccuccuccacuacugcuacguccacugcuaccucaagaucuucggcuuccaggccggccucaccucccucgacugcuccggcuccuacugccuccccguccccgucauccccuccuucuccaccgcccucuacggcaagcuccucaagcuccccaccugcuggaccaagcgcucccagaucgccaucaccgagggcaucuucgagcuccccaaccucaccauccaggccacccgcgcccagacccuccuccuccaggccaucuaccaguccuggucccaccucggcaacgucuccuccuccgccgucaucgaggcccucaucaacgagaucuuccucuccaucgagaucggcuccugcuacgucgcccaggucgaccucgagcuccucgccuccaacgacccccccaccuccaccuccuga

SEQ ID NO: 51674 - RNA, 10887 nt, Artificial Sequence
  derived and/or modified sequence opt2 from VPS13C__Homo_sapiens__NP_001018098
augguccucgaguccgucgucgccgaccuccucaaccgcuuccucggcgacuacgucgagaaccucaacaagucccagcucaagcucggcaucuggggcggcaacgucgcccucgacaaccuccagaucaaggagaacgcccucuccgagcucgacguccccuucaaggucaaggccggccagaucgacaagcucacccucaagauccccuggaagaaccucuacggcgaggccgucgucgccacccucgagggccucuaccuccucgucguccccggcgccuccaucaaguacgacgccgucaaggaggagaagucccuccaggacgucaagcagaaggagcucucccgcaucgaggaggcccuccagaaggccgccgagaagggcacccacuccggcgaguucaucuacggccucgagaacuucgucuacaaggacaucaagcccggccgcaagcgcaagaagcacaagaagcacuucaagaagcccuucaagggccucgaccgcuccaaggacaagcccaaggaggccaagaaggacaccuucgucgagaagcucgccacccaggucaucaagaacguccaggucaagaucaccgacauccacaucaaguacgaggacgacgucaccgaccccaagcgcccccucuccuucggcgucacccucggcgagcucucccuccucaccgccaacgagcacuggacccccugcauccucaacgaggccgacaagaucaucuacaagcucauccgccucgacucccucuccgccuacuggaacgucaacugcuccauguccuaccagcgcucccgcgagcagauccucgaccagcucaagaacgagauccucaccuccggcaacaucccccccaacuaccaguacaucuuccagcccaucuccgccuccgccaagcucuacaugaaccccuacgccgaguccgagcucaagacccccaagcucgacugcaacaucgagauccagaacaucgccaucgagcucaccaagccccaguaccucuccaugaucgaccuccucgaguccgucgacuacaugguccgcaacgcccccuaccgcaaguacaagcccuaccucccccuccacaccaacggccgccgcugguggaaguacgccaucgacuccguccucgagguccacauccgccgcuacacccagaugugguccugguccaacaucaagaagcaccgccagcuccucaaguccuacaagaucgccuacaagaacaagcucacccaguccaaggucuccgaggagauccagaaggagauccaggaccucgagaagacccucgacgucuucaacaucauccucgcccgccagcaggcccaggucgaggucauccgcuccggccagaagcuccgcaagaaguccgccgacaccggcgagaagcgcggcggcugguucuccggccucuggggcaagaaggaguccaagaagaaggacgaggagucccucauccccgagaccaucgacgaccucaugacccccgaggagaaggacaagcucuucaccgccaucggcuacuccgaguccacccacaaccucacccuccccaagcaguacgucgcccacaucaugacccucaagcucgucuccaccuccgucaccauccgcgagaacaagaacauccccgagauccucaagauccagaucaucggccucggcacccaggucucccagcgccccggcgcccaggcccucaaggucgaggccaagcucgagcacugguacaucaccggccuccgccagcaggacaucguccccucccucgucgccuccaucggcgacaccaccuccucccuccucaagaucaaguucgagaccaaccccgaggacucccccgccgaccagacccucaucguccagucccagcccgucgaggucaucuacgacgccaagaccgucaacgccgucgucgaguucuuccaguccaacaagggccucgaccucgagcagaucaccuccgccacccucaugaagcucgaggagaucaaggagcgcaccgccaccggccucacccacaucaucgagacccgcaagguccucgaccuccgcaucaaccucaagcccuccuaccucgucgucccccagaccggcuuccaccacgagaaguccgaccuccucauccucgacuucggcaccuuccagcucaacuccaaggaccagggccuccagaagaccaccaacuccucccucgaggagaucauggacaaggccuacgacaaguucgacgucgagaucaagaacguccagcuccucuucgcccgcgccgaggagaccuggaagaagugccgcuuccagcaccccuccaccaugcacauccuccagcccauggacauccacgucgagcucgccaaggccauggucgagaaggacauccgcauggcccgcuucaaggucuccggcggccucccccucaugcacguccgcaucuccgaccagaagaugaaggacguccucuaccucaugaacuccaucccccucccccagaaguccuccgcccagucccccgagcgccaggucuccuccauccccaucaucuccggcggcaccaagggccuccucggcaccucccuccuccucgacaccgucgaguccgaguccgacgacgaguacuucgacgccgaggacggcgagccccagaccugcaaguccaugaagggcuccgagcucaagaaggccgccgagguccccaacgaggagcucaucaaccuccuccucaaguucgagaucaaggaggucauccucgaguucaccaagcagcagaaggaggaggacaccauccucgucuucaacgucacccagcucggcaccgaggccaccaugcgcaccuucgaccucaccgucgucuccuaccucaagaagaucucccucgacuaccacgagaucgagggcuccaagcgcaagccccuccaccucaucuccuccuccgacaagcccggccucgaccuccucaaggucgaguacaucaaggccgacaagaacggccccuccuuccagaccgccuucggcaagaccgagcagaccgucaaggucgccuucuccucccucaaccuccuccuccagacccaggcccucgucgccuccaucaacuaccucaccaccaucauccccuccgacgaccaguccaucuccgucgccaaggagguccagaucuccaccgagaagcagcagaagaacuccacccuccccaaggccaucgucuccucccgcgacuccgacaucaucgacuuccgccucuucgccaagcucaacgccuucugcgucaucgucugcaacgagaagaacaacaucgccgagaucaagauccagggccucgacuccucccucucccuccagucccgcaagcagucccucuucgcccgccucgagaacaucaucgucaccgacgucgaccccaagaccguccacaagaaggccgucuccaucaugggcaacgaggucuuccgcuucaaccucgaccucuaccccgacgccaccgagggcgaccucuacaccgacauguccaaggucgacggcguccucucccucaacgucggcugcauccagaucgucuaccuccacaaguuccucaugucccuccucaacuuccucaacaacuuccagaccgccaaggagucccucuccgccgccaccgcccaggccgccgagcgcgccgccaccuccgucaaggaccucgcccagcgcuccuuccgcgucuccaucaacaucgaccucaaggcccccgucaucgucaucccccaguccuccaucuccaccaacgccgucgucgucgaccucggccucauccgcguccacaaccaguucucccucgucuccgacgaggacuaccucaacccccccgucaucgaccgcauggacguccagcucaccaagcucacccucuaccgcaccgucauccagcccggcaucuaccaccccgacauccagcuccuccaccccaucaaccucgaguuccucgucaaccgcaaccucgccgccuccugguaccacaagguccccgucgucgagaucaagggccaccucgacuccaugaacgucucccucaaccaggaggaccucaaccuccucuuccgcauccucaccgagaaccucugcgagggcaccgaggaccucgacaaggucaagccccgcguccaggagaccggcgagaucaaggagccccucgagaucuccaucucccaggacguccacgacuccaagaacacccucaccaccggcgucgaggagauccgcuccgucgacaucaucaacaugcuccucaacuucgagaucaaggaggucgucgucacccucaugaagaaguccgagaagaagggccgcccccuccacgagcucaacguccuccagcucggcauggaggccaaggucaagaccuacgacaugaccgccaaggccuaccucaagaagaucuccaugcagugcuucgacuucaccgacuccaagggcgagccccuccacaucaucaacuccuccaacgucaccgacgagccccuccucaagaugcuccucaccaaggccgacuccgacggccccgaguucaagaccauccacgacuccaccaagcagcgccucaaggucuccuucgccucccucgaccucguccuccaccucgaggcccuccucuccuucauggacuuccucuccuccgccgcccccuucuccgagcccuccuccuccgagaaggaguccgagcucaagccccucgucggcgagucccgcuccaucgccgucaaggccgucuccuccaacaucucccagaaggacgucuucgaccucaagaucaccgccgagcucaacgccuucaacgucuucgucugcgaccagaagugcaacaucgccgacaucaagauccacggcauggacgccuccaucuccgucaagcccaagcagaccgacgucuucgcccgccucaaggacaucaucgucaugaacgucgaccuccaguccauccacaagaaggccgucuccauccucggcgacgaggucuuccgcuuccagcucacccucuaccccgacgccaccgagggcgaggccuacgccgacauguccaaggucgacggcaagcucuccuucaaggucggcugcauccagaucgucuacguccacaaguucuucaugucccuccucaacuuccucaacaacuuccagaccgccaaggaggcccucuccaccgccaccguccaggccgccgagcgcgccgccuccuccaugaaggaccucgcccagaaguccuuccgccuccucauggacaucaaccucaaggcccccgucaucaucaucccccaguccuccgucucccccaacgccgucaucgccgaccucggccucauccgcgucgagaacaaguucucccucguccccauggagcacuacucccucccccccgucaucgacaagaugaacaucgagcucacccagcucaagcucucccgcaccauccuccaggccucccucccccagaacgacaucgagauccucaagcccgucaacaugcuccucuccauccagcgcaaccucgccgccgccugguacguccagauccccggcauggagaucaagggcaagcucaagcccaugcaggucgcccucuccgaggacgaccucaccguccucaugaagauccuccucgagaaccucggcgaggccuccucccagcccucccccacccaguccguccaggagaccguccgcguccgcaaggucgacgucuccuccguccccgaccaccucaaggagcaggaggacuggaccgacuccaagcucuccaugaaccagaucgucucccuccaguucgacuuccacuucgagucccucuccaucauccucuacaacaacgacaucaaccaggaguccggcgucgccuuccacaacgacuccuuccagcucggcgagcuccgccuccaccucauggccuccuccggcaagauguucaaggacggcuccaugaacgucuccgucaagcucaagaccugcacccucgacgaccuccgcgagggcaucgagcgcgccaccucccgcaugaucgaccgcaagaacgaccaggacaacaacuccuccaugaucgacaucuccuacaagcaggacaagaacggcucccagaucgacgccguccucgacaagcucuacgucugcgccuccgucgaguuccucaugaccgucgccgacuucuucaucaaggccgucccccagucccccgagaacgucgccaaggagacccagauccucccccgccagaccgccaccggcaaggucaagaucgagaaggacgacuccguccgccccaacaugacccucaaggccaugaucaccgaccccgaggucgucuucgucgccucccucaccaaggccgacgcccccgcccucaccgccuccuuccagugcaaccucucccucuccaccuccaagcucgagcagaugauggaggccuccguccgcgaccucaagguccucgccugccccuuccuccgcgagaagcgcggcaagaacaucaccaccguccuccagcccugcucccucuucauggagaagugcaccugggccuccggcaagcagaacaucaacaucauggucaaggaguucaucaucaagaucucccccaucauccucaacaccguccucaccaucauggccgcccucucccccaagaccaaggaggacggcuccaaggacaccuccaaggagauggagaaccucuggggcaucaaguccaucaacgacuacaacaccugguuccucggcgucgacaccgccaccgagaucaccgaguccuucaagggcaucgagcacucccucaucgaggagaacugcggcgucgucgucgaguccauccaggucacccucgagugcggccucggccaccgcaccgucccccuccuccucgccgaguccaaguucuccggcaacaucaagaacuggaccucccucauggccgccgucgccgacgucacccuccagguccacuacuacaacgagauccacgccgucugggagccccucaucgagcgcgucgagggcaagcgccaguggaaccuccgccucgacgucaagaagaaccccguccaggacaagucccuccuccccggcgacgacuucauccccgagccccagauggccauccacaucuccuccggcaacaccaugaacaucaccaucuccaaguccugccucaacgucuucaacaaccucgccaagggcuucuccgagggcaccgccuccaccuucgacuacucccucaaggaccgcgcccccuucaccgucaagaacgccgucggcguccccaucaaggucaagcccaacugcaaccuccgcgucaugggcuuccccgagaaguccgacaucuucgacgucgacgccggccagaaccucgagcucgaguacgccuccaugguccccuccucccagggcaaccucuccauccucucccgccaggaguccuccuucuucacccucaccaucgucccccacggcuacaccgaggucgccaacauccccgucgcccgccccggccgccgccucuacaacguccgcaaccccaacgccucccacuccgacuccguccucguccagaucgacgccaccgagggcaacaaggucaucacccuccgcuccccccuccagaucaagaaccacuucuccaucgccuucaucaucuacaaguucgucaagaacgucaagcuccucgagcgcaucggcaucgcccgccccgaggaggaguuccacgucccccucgacuccuaccgcugccagcucuucauccagcccgccggcauccucgagcaccaguacaaggaguccaccaccuacaucuccuggaaggaggagcuccaccgcucccgcgagguccgcugcaugcuccagugccccuccgucgaggucuccuuccucccccucaucgucaacaccgucgcccuccccgacgagcucuccuacaucugcacccacggcgaggacugggacgucgccuacaucauccaccucuaccccucccucacccuccgcaaccuccuccccuacucccuccgcuaccuccucgagggcaccgccgagacccacgagcucgccgagggcuccaccgccgacguccuccacucccgcaucuccggcgagaucauggagcucguccucgucaaguaccagggcaagaacuggaacggccacuuccgcauccgcgacacccuccccgaguucuuccccgucugcuucuccuccgacuccaccgaggucaccaccgucgaccucuccguccacguccgccgcaucggcucccgcaugguccucuccgucuucucccccuacuggcucaucaacaagaccacccgcguccuccaguaccgcuccgaggacauccacgucaagcaccccgccgacuuccgcgacaucauccucuucuccuucaagaagaagaacaucuucaccaagaacaagguccagcucaagaucuccaccuccgccugguccuccuccuucucccucgacaccgucggcuccuacggcugcgucaagugccccgccaacaacauggaguaccucgucggcgucuccaucaagauguccuccuucaaccucucccgcaucgucacccucacccccuucugcaccaucgccaacaaguccucccucgagcucgaggucggcgagaucgccuccgacggcuccaugcccaccaacaaguggaacuacaucgccuccuccgagugccuccccuucuggcccgagucccucuccggcaagcucugcguccgcgucgucggcugcgagggcuccuccaagcccuucuucuacaaccgccaggacaacggcacccuccucucccucgaggaccucaacggcggcauccucgucgacgucaacaccgccgagcacuccaccgucaucaccuucuccgacuaccacgagggcuccgcccccgcccucaucaugaaccacacccccugggacauccucaccuacaagcaguccggcucccccgaggagaugguccuccucccccgccaggcccgccucuucgccugggccgaccccaccggcacccgcaagcucaccuggaccuacgccgccaacgucggcgagcacgaccuccucaaggacggcugcggccaguuccccuacgacgccaacauccagauccacugggucuccuuccucgacggccgccagcgcguccuccucuucaccgacgacgucgcccucgucuccaaggcccuccaggccgaggagauggagcaggccgacuacgagaucacccucucccuccacucccucggccucucccucgucaacaacgaguccaagcaggaggucuccuacaucggcaucaccuccuccggcgucgucugggaggucaagcccaagcagaaguggaagcccuucucccagaagcagaucauccuccucgagcaguccuaccagaagcaccagaucucccgcgaccacggcuggaucaagcucgacaacaacuucgaggucaacuucgacaaggaccccauggagaugcgccuccccauccgcucccccaucaagcgcgacuuccucuccggcauccagaucgaguucaagcaguccucccaccagcgcucccuccgcgcccgccucuacuggcuccaggucgacaaccagcuccccggcgccauguuccccgucgucuuccaccccgucgccccccccaaguccaucgcccucgacuccgagcccaagcccuucaucgacgucuccgucaucacccgcuucaacgaguacuccaagguccuccaguucaaguacuucaugguccucauccaggagauggcccucaagaucgaccagggcuuccucggcgccaucaucgcccucuucacccccaccaccgaccccgaggccgagcgccgccgcaccaagcucauccagcaggacaucgacgcccucaacgccgagcucauggagaccuccaugaccgacauguccauccucuccuucuucgagcacuuccacaucucccccgucaagcuccaccucucccucucccucggcuccggcggcgaggaguccgacaaggagaagcaggagauguucgccguccacuccgucaaccuccuccucaaguccaucggcgccacccucaccgacgucgacgaccucaucuucaagcucgccuacuacgagauccgcuaccaguucuacaagcgcgaccagcucaucugguccgucguccgccacuacuccgagcaguuccucaagcagauguacguccucguccucggccucgacguccucggcaaccccuucggccucauccgcggccucuccgagggcgucgaggcccucuucuacgagcccuuccagggcgccguccagggccccgaggaguucgccgagggccucgucaucggcguccgcucccucuucggccacaccgucggcggcgccgccggcgucgucucccgcaucaccggcuccgucggcaagggccucgccgccaucaccauggacaaggaguaccagcagaagcgccgcgaggagcucucccgccagccccgcgacuucggcgacucccucgcccgcggcggcaagggcuuccuccgcggcgucgucggcggcgucaccggcaucaucaccaagcccgucgagggcgccaagaaggagggcgccgccggcuucuucaagggcaucggcaagggccucgucggcgccgucgcccgccccaccggcggcaucgucgacauggccuccuccaccuuccagggcauccagcgcgccgccgaguccaccgaggaggucuccucccuccgccccccccgccucauccacgaggacggcaucauccgccccuacgaccgccaggaguccgagggcuccgaccuccucgagcaggagcucgagauccaggaguga

SEQ ID NO: 51675 - RNA, 756 nt, Artificial Sequence
  derived and/or modified sequence opt2 from VPS26A__Homo_sapiens__NP_001030337
auguccuuccucggcggcuucuucggccccaucugcgagaucgacaucguccucaacgacggcgagacccgcaagauggccgagaugaagaccgaggacggcaaggucgagaagcacuaccucuucuacgacggcgaguccgucuccggcaaggucaaccucgccuucaagcagcccggcaagcgccucgagcaccagggcauccgcaucgaguucgucggccagaucgagcucuucaacgacaaguccaacacccacgaguucgucaaccucgucaaggagcucgcccuccccggcgagcucacccagucccgcuccuacgacuucgaguucaugcaggucgagaagcccuacgaguccuacaucggcgccaacguccgccuccgcuacuuccucaaggucaccaucguccgccgccucaccgaccucgucaaggaguacgaccucaucguccaccagcucgccaccuaccccgacgucaacaacuccaucaagauggaggucggcaucgaggacugccuccacaucgaguucgaguacaacaaguccaaguaccaccucaaggacgucaucgucggcaagaucuacuuccuccucguccgcaucaagauccagcacauggagcuccagcucaucaagaaggagaucaccggcaucggccccuccaccaccaccgagaccgagaccaucgccaaguacgagaucauggacggcgcccccgucaagggcgacaacuucauggagaaguccuccuga

SEQ ID NO: 51676 - RNA, 666 nt, Artificial Sequence
  derived and/or modified sequence opt2 from VPS28__Homo_sapiens__NP_057292
auguuccacggcauccccgccacccccggcaucggcgcccccggcaacaagcccgagcucuacgaggaggucaagcucuacaagaacgcccgcgagcgcgagaaguacgacaacauggccgagcucuucgccgucgucaagaccaugcaggcccucgagaaggccuacaucaaggacugcgucucccccuccgaguacaccgccgccugcucccgccuccucguccaguacaaggccgccuuccgccagguccagggcuccgagaucuccuccaucgacgaguucugccgcaaguuccgccucgacugcccccucgccauggagcgcaucaaggaggaccgccccaucaccaucaaggacgacaagggcaaccucaaccgcugcaucgccgacgucgucucccucuucaucaccgucauggacaagcuccgccucgagauccgcgccauggacgagauccagcccgaccuccgcgagcucauggagaccaugcaccgcaugucccaccucccccccgacuucgagggccgccagaccgucucccaguggcuccagacccucuccggcauguccgccuccgacgagcucgacgacucccagguccgccagaugcucuucgaccucgaguccgccuacaacgccuucaaccgcuuccuccacgccuga

SEQ ID NO: 51677 - RNA, 1791 nt, Artificial Sequence
  derived and/or modified sequence opt2 from VPS33A__Homo_sapiens__NP_075067
auggccgcccaccucuccuacggccgcgucaaccucaacguccuccgcgaggccguccgccgcgagcuccgcgaguuccucgacaagugcgccggcuccaaggccaucgucugggacgaguaccucaccggccccuucggccucaucgcccaguacucccuccucaaggagcacgaggucgagaagauguucacccucaagggcaaccgccuccccgccgccgacgucaagaacaucaucuucuucguccgcccccgccucgagcucauggacaucaucgccgagaacguccucuccgaggaccgccgcggccccacccgcgacuuccacauccucuucgucccccgccgcucccuccucugcgagcagcgccucaaggaccucggcguccucggcuccuucauccaccgcgaggaguacucccucgaccucauccccuucgacggcgaccuccucuccauggaguccgagggcgccuucaaggagugcuaccucgagggcgaccagaccucccucuaccacgccgccaagggccucaugacccuccaggcccucuacggcaccaucccccagaucuucggcaagggcgagugcgcccgccaggucgccaacaugaugauccgcaugaagcgcgaguucaccggcucccagaacuccaucuuccccgucuucgacaaccuccuccuccucgaccgcaacgucgaccuccucaccccccucgccacccagcucaccuacgagggccucaucgacgagaucuacggcauccagaacuccuacgucaagcucccccccgagaaguucgcccccaagaagcagggcgacggcggcaaggaccuccccaccgaggccaagaagcuccagcucaacuccgccgaggagcucuacgccgagauccgcgacaagaacuucaacgccgucggcuccguccucuccaagaaggccaagaucaucuccgccgccuucgaggagcgccacaacgccaagaccgucggcgagaucaagcaguucgucucccagcucccccacaugcaggccgcccgcggcucccucgccaaccacaccuccaucgccgagcucaucaaggacgucaccaccuccgaggacuucuucgacaagcucaccgucgagcaggaguucauguccggcaucgacaccgacaaggucaacaacuacaucgaggacugcaucgcccagaagcacucccucaucaagguccuccgccucgucugccuccaguccgucugcaacuccggccucaagcagaagguccucgacuacuacaagcgcgagauccuccagaccuacggcuacgagcacauccucacccuccacaaccucgagaaggccggccuccucaagccccagaccggcggccgcaacaacuaccccaccauccgcaagacccuccgccucuggauggacgacgucaacgagcagaaccccaccgacaucuccuacgucuacuccggcuacgccccccucuccguccgccucgcccagcuccucucccgccccggcuggcgcuccaucgaggagguccuccgcauccuccccggcccccacuucgaggagcgccagccccuccccaccggccuccagaagaagcgccagcccggcgagaaccgcgucacccucaucuucuuccucggcggcgucaccuucgccgagaucgccgcccuccgcuuccucucccagcucgaggacggcggcaccgaguacgucaucgccaccaccaagcucaugaacggcaccuccuggaucgaggcccucauggagaagcccuucuga

SEQ ID NO: 51678 - RNA, 1854 nt, Artificial Sequence
  derived and/or modified sequence opt2 from VPS33B__Homo_sapiens__NP_061138
auggccuucccccaccgccccgacgcccccgagcuccccgacuucuccaugcucaagcgccucgcccgcgaccagcucaucuaccuccucgagcagcuccccggcaagaaggaccucuucaucgaggccgaccucauguccccccucgaccgcaucgccaacgucuccauccucaagcagcacgaggucgacaagcucuacaaggucgagaacaagcccgcccucuccuccaacgagcagcucugcuuccucguccgcccccgcaucaagaacaugcgcuacaucgccucccucgucaacgccgacaagcucgccggccgcacccgcaaguacaaggucaucuucuccccccagaaguucuacgccugcgagaugguccucgaggaggagggcaucuacggcgacgucuccugcgacgagugggccuucucccuccucccccucgacgucgaccuccucuccauggagcuccccgaguucuuccgcgacuacuuccucgagggcgaccagcgcuggaucaacaccgucgcccaggcccuccaccuccucuccacccucuacggccccuuccccaacugcuacggcaucggccgcugcgccaagauggccuacgagcucuggcgcaaccucgaggaggaggaggacggcgagaccaagggccgccgccccgagaucggccacaucuuccuccucgaccgcgacgucgacuucgucaccgcccucugcucccaggucgucuacgagggccucgucgacgacaccuuccgcaucaagugcggcuccgucgacuucggccccgaggucaccuccuccgacaagucccucaagguccuccucaacgccgaggacaaggucuucaacgagauccgcaacgagcacuucuccaacgucuucggcuuccucucccagaaggcccgcaaccuccaggcccaguacgaccgccgccgcggcauggacaucaagcagaugaagaacuucgucucccaggagcucaagggccucaagcaggagcaccgccuccucucccuccacaucggcgccugcgaguccaucaugaagaagaagaccaagcaggacuuccaggagcucaucaagaccgagcacgcccuccucgagggcuucaacauccgcgaguccaccuccuacaucgaggagcacaucgaccgccaggucucccccaucgagucccuccgccucaugugccuccucuccaucaccgagaacggccucauccccaaggacuaccgcucccucaagacccaguaccuccaguccuacggccccgagcaccuccucaccuucuccaaccuccgccgcgccggccuccucaccgagcaggcccccggcgacacccucaccgccgucgaguccaaggucuccaagcucgucaccgacaaggccgccggcaagaucaccgacgccuucuccucccucgccaagcgcuccaacuuccgcgccaucuccaagaagcucaaccucaucccccgcgucgacggcgaguacgaccucaaggucccccgcgacauggccuacgucuucggcggcgccuacgucccccucuccugccgcaucaucgagcagguccucgagcgccgcuccuggcagggccucgacgaggucguccgccuccucaacugcuccgacuucgccuucaccgacaugaccaaggaggacaaggccuccuccgagucccuccgccucauccucgucgucuuccucggcggcugcaccuucuccgagaucuccgcccuccgcuuccucggccgcgagaagggcuaccgcuucaucuuccucaccaccgccgucaccaacuccgcccgccucauggaggccauguccgaggucaaggccuga

SEQ ID NO: 51679 - RNA, 2391 nt, Artificial Sequence
  derived and/or modified sequence opt2 from VPS35__Homo_sapiens__NP_060676
augcccaccacccagcaguccccccaggacgagcaggagaagcuccucgacgaggccauccaggccgucaagguccaguccuuccagaugaagcgcugccucgacaagaacaagcucauggacgcccucaagcacgccuccaacaugcucggcgagcuccgcaccuccaugcucucccccaaguccuacuacgagcucuacauggccaucuccgacgagcuccacuaccucgaggucuaccucaccgacgaguucgccaagggccgcaaggucgccgaccucuacgagcucguccaguacgccggcaacaucaucccccgccucuaccuccucaucaccgucggcgucgucuacgucaaguccuucccccagucccgcaaggacauccucaaggaccucgucgagaugugccgcggcguccagcacccccuccgcggccucuuccuccgcaacuaccuccuccagugcacccgcaacauccuccccgacgagggcgagcccaccgacgaggagaccaccggcgacaucuccgacuccauggacuucguccuccucaacuucgccgagaugaacaagcucuggguccgcaugcagcaccagggccacucccgcgaccgcgagaagcgcgagcgcgagcgccaggagcuccgcauccucgucggcaccaaccucguccgccucucccagcucgagggcgucaacgucgagcgcuacaagcagaucguccucaccggcauccucgagcaggucgucaacugccgcgacgcccucgcccaggaguaccucauggagugcaucauccaggucuuccccgacgaguuccaccuccagacccucaaccccuuccuccgcgccugcgccgagcuccaccagaacgucaacgucaagaacaucaucaucgcccucaucgaccgccucgcccucuucgcccaccgcgaggacggccccggcauccccgccgacaucaagcucuucgacaucuucucccagcaggucgccaccgucauccagucccgccaggacaugcccuccgaggacgucgucucccuccaggucucccucaucaaccucgccaugaagugcuaccccgaccgcgucgacuacgucgacaagguccucgagaccaccgucgagaucuucaacaagcucaaccucgagcacaucgccaccuccuccgccgucuccaaggagcucacccgccuccucaagauccccgucgacaccuacaacaacauccucaccguccucaagcucaagcacuuccacccccucuucgaguacuucgacuacgagucccgcaaguccauguccugcuacguccucuccaacguccucgacuacaacaccgagaucgucucccaggaccaggucgacuccaucaugaaccucgucuccacccucauccaggaccagcccgaccagcccgucgaggaccccgaccccgaggacuucgccgacgagcagucccucgucggccgcuucauccaccuccuccgcuccgaggaccccgaccagcaguaccucauccucaacaccgcccgcaagcacuucggcgccggcggcaaccagcgcauccgcuucacccuccccccccucgucuucgccgccuaccagcucgccuuccgcuacaaggagaacuccaaggucgacgacaagugggagaagaagugccagaagaucuucuccuucgcccaccagaccaucuccgcccucaucaaggccgagcucgccgagcucccccuccgccucuuccuccagggcgcccucgccgccggcgagaucggcuucgagaaccacgagaccgucgccuacgaguucaugucccaggccuucucccucuacgaggacgagaucuccgacuccaaggcccagcucgccgccaucacccucaucaucggcaccuucgagcgcaugaagugcuucuccgaggagaaccacgagccccuccgcacccagugcgcccucgccgccuccaagcuccucaagaagcccgaccagggccgcgccgucuccaccugcgcccaccucuucugguccggccgcaacaccgacaagaacggcgaggagcuccacggcggcaagcgcgucauggagugccucaagaaggcccucaagaucgccaaccagugcauggaccccucccuccagguccagcucuucaucgagauccucaaccgcuacaucuacuucuacgagaaggagaacgacgccgucaccauccagguccucaaccagcucauccagaagauccgcgaggaccuccccaaccucgaguccuccgaggagaccgagcagaucaacaagcacuuccacaacacccucgagcaccuccgccuccgccgcgagucccccgaguccgagggccccaucuacgagggccucauccucuga

SEQ ID NO: 51680 - RNA, 1161 nt, Artificial Sequence
  derived and/or modified sequence opt2 from VPS36__Homo_sapiens__NP_057159
auggaccgcuucgucuggaccuccggccuccucgagaucaacgagacccucgucauccagcagcgcggcguccgcaucuacgacggcgaggagaagaucaaguucgacgccggcacccuccuccucuccacccaccgccucaucuggcgcgaccagaagaaccacgagugcugcauggccauccuccucucccagaucgucuucaucgaggagcaggccgccggcaucggcaaguccgccaagaucgucguccaccuccaccccgccccccccaacaaggagcccggccccuuccaguccuccaagaacuccuacaucaagcucuccuucaaggagcacggccagaucgaguucuaccgccgccucuccgaggagaugacccagcgccgcugggagaacaugcccgucucccagucccuccagaccaaccgcggcccccagcccggccgcauccgcgccgucggcaucgucggcaucgagcgcaagcucgaggagaagcgcaaggagaccgacaagaacaucuccgaggccuucgaggaccucuccaagcucaugaucaaggccaaggagauggucgagcucuccaaguccaucgccaacaagaucaaggacaagcagggcgacaucaccgaggacgagaccauccgcuucaaguccuaccuccucuccaugggcaucgccaaccccgucacccgcgagaccuacggcuccggcacccaguaccacaugcagcucgccaagcagcucgccggcauccuccaggucccccucgaggagcgcggcggcaucaugucccucaccgaggucuacugccucgucaaccgcgcccgcggcauggagcuccucucccccgaggaccucgucaacgccugcaagaugcucgaggcccucaagcucccccuccgccuccgcgucuucgacuccggcgucauggucaucgagcuccagucccacaaggaggaggagauggucgccuccgcccucgagaccgucuccgagaagggcucccucaccuccgaggaguucgccaagcucgucggcauguccguccuccucgccaaggagcgccuccuccucgccgagaagaugggccaccucugccgcgacgacuccgucgagggccuccgcuucuaccccaaccucuucaugacccaguccuga

SEQ ID NO: 51681 - RNA, 1119 nt, Artificial Sequence
  derived and/or modified sequence opt2 from VPS37A__Homo_sapiens__NP_001138624
auguccuggcucuucccccucaccaaguccgccuccuccuccgccgccggcucccccggcggccucaccucccuccagcagcagaagcagcgccucaucgagucccuccgcaacucccacucccgccuccuccccccccaguucccccaggagaagcccgucaucuccgucuacccccccauccgccaccaccucauggacaagcagggcgucuacgucaccuccccccucgucaacaacuucaccaugcacuccgaccucggcaagaucauccagucccuccucgacgaguucuggaagaacccccccguccucgcccccaccuccaccgccuuccccuaccucuacuccaaccccuccggcaugucccccuacgccucccagggcuuccccuuccucccccccuaccccccccaggaggccaaccgcuccaucaccucccucuccgucgccgacaccgucuccuccuccaccaccucccacaccaccgccaagcccgccgcccccuccuucggcguccucuccaaccucccccuccccauccccaccgucgacgccuccauccccaccucccagaacggcuucggcuacaagaugcccgacguccccgacgccuuccccgagcucuccgagcucuccgucucccagcucaccgacaugaacgagcaggaggagguccuccucgagcaguuccucacccucccccagcucaagcagaucaucaccgacaaggacgaccucgucaaguccaucgaggagcucgcccgcaagaaccuccuccucgagcccucccucgaggccaagcgccagaccguccucgacaaguacgagcuccucacccagaugaaguccaccuucgagaagaagaugcagcgccagcacgagcucuccgaguccugcuccgccuccgcccuccaggcccgccucaaggucgccgcccacgaggccgaggaggaguccgacaacaucgccgaggacuuccucgagggcaagauggagaucgacgacuuccucuccuccuucauggagaagcgcaccaucugccacugccgccgcgccaaggaggagaagcuccagcaggccaucgccaugcacucccaguuccacgccccccucuga

SEQ ID NO: 51682 - RNA, 858 nt, Artificial Sequence
  derived and/or modified sequence opt2 from VPS37B__Homo_sapiens__NP_078943
auggccggcgccggcuccgaggcccgcuucgccggccucucccucguccagcucaacgagcuccucgaggacgagggccagcucaccgagaugguccagaagauggaggagacccagaacguccagcucaacaaggagaugacccucgccuccaaccgcucccucgccgagggcaaccuccucuaccagccccagcucgacacccucaaggcccgccucacccagaaguaccaggagcuccagguccucuucgaggccuaccagaucaagaagaccaagcucgaccgccaguccuccuccgccucccucgagacccuccucgcccuccuccaggccgagggcgccaagaucgaggaggacaccgagaacauggccgagaaguuccucgacggcgagcucccccucgacuccuucaucgacgucuaccaguccaagcgcaagcucgcccacaugcgccgcgucaagaucgagaagcuccaggagaugguccucaagggccagcgccucccccaggcccucgccccccuccccccccgccuccccgagcucgcccccaccgccccccuccccuaccccgcccccgaggccuccggcccccccgccgucgccccccgccgcaucccccccccccccccccccguccccgccggccgccucgccacccccuucaccgccgccauguccuccggccaggccguccccuaccccggccuccagugccccccccuccccccccgcgucggccuccccacccagcagggcuucuccucccaguucgucucccccuacccccccccccucccccagcgcccccccccccgccuccccccccaccagcccggcuucauccuccaguga

SEQ ID NO: 51683 - RNA, 1068 nt, Artificial Sequence
  derived and/or modified sequence opt2 from VPS37C__Homo_sapiens__NP_060436
auggagacccucaaggacaagacccuccaggagcucgaggagcuccagaacgacuccgaggccaucgaccagcucgcccucgagucccccgagguccaggaccuccagcucgagcgcgagauggcccucgccaccaaccgcucccucgccgagcgcaaccucgaguuccagggcccccucgagaucucccgcuccaaccucuccgaccgcuaccaggagcuccgcaagcucgucgagcgcugccaggagcagaaggccaagcucgagaaguucuccuccgcccuccagcccggcacccuccucgaccuccuccaggucgagggcaugaagaucgaggaggaguccgaggccauggccgagaaguuccucgagggcgaggucccccucgagaccuuccucgagaacuucuccuccaugcgcaugcucucccaccuccgccgcguccgcgucgagaagcuccaggaggucguccgcaagccccgcgccucccaggagcucgccggcgacgccccccccccccgcccccccccccccguccgccccgucccccagggcaccccccccgucgucgaggagcagccccagcccccccucgccaugccccccuacccccuccccuacucccccucccccucccuccccgucggccccaccgcccacggcgcccucccccccgcccccuuccccgucgucucccagcccuccuucuacuccggcccccucggccccaccuaccccgccgcccagcucggcccccgcggcgccgccggcuacuccugguccccccagcgcuccaugcccccccgccccggcuaccccggcacccccaugggcgccuccggccccggcuacccccuccgcggcggccgcgcccccucccccggcuacccccagcagucccccuaccccgccaccggcggcaagccccccuaccccauccagccccagcuccccuccuuccccggccagccccagcccuccgucccccuccagccccccuacccccccggccccgccccccccuacggcuucccccccccccccggccccgccuggcccggcuacuga

SEQ ID NO: 51684 - RNA, 2661 nt, Artificial Sequence
  derived and/or modified sequence opt2 from VPS39__Homo_sapiens__NP_001288067
augcacgacgccuucgagcccguccccauccucgagaagcucccccuccagaucgacugccucgccgccugggaggaguggcuccucgucggcaccaagcagggccaccuccuccucuaccgcauccgcaaggacgucguccccgccgacgucgccucccccgaguccggcuccugcaaccgcuucgaggucacccucgagaaguccaacaagaacuucuccaagaagauccagcagauccacgucgucucccaguucaagauccucgucucccuccucgagaacaacaucuacguccacgaccuccucaccuuccagcagaucaccaccgucuccaaggccaagggcgccucccucuucaccugcgaccuccagcacaccgagaccggcgaggagguccuccgcaugugcgucgccgucaagaagaagcuccagcucuacuucuggaaggaccgcgaguuccacgagcuccagggcgacuucuccguccccgacguccccaaguccauggccuggugcgagaacuccaucugcgucggcuucaagcgcgacuacuaccucauccgcgucgacggcaagggcuccaucaaggagcucuuccccaccggcaagcagcucgagccccucgucgccccccucgccgacggcaaggucgccgucggccaggacgaccucaccgucguccucaacgaggagggcaucugcacccagaagugcgcccucaacuggaccgacauccccgucgccauggagcaccagccccccuacaucaucgccguccucccccgcuacgucgagauccgcaccuucgagccccgccuccucguccaguccaucgagcuccagcgcccccgcuucaucaccuccggcggcuccaacaucaucuacgucgccuccaaccacuucgucuggcgccucauccccguccccauggccacccagauccagcagcuccuccaggacaagcaguucgagcucgcccuccagcucgccgagaugaaggacgacuccgacuccgagaagcagcagcagauccaccacaucaagaaccucuacgccuucaaccucuucugccagaagcgcuucgacgaguccaugcaggucuucgccaagcucggcaccgaccccacccacgucaugggccucuaccccgaccuccuccccaccgacuaccgcaagcagcuccaguaccccaacccccuccccguccucuccggcgccgagcucgagaaggcccaccucgcccucaucgacuaccucacccagaagcgcucccagcucgucaagaagcucaacgacuccgaccaccaguccuccaccuccccccucauggagggcacccccaccaucaaguccaagaagaagcuccuccagaucaucgacaccacccuccucaagugcuaccuccacaccaacgucgcccucgucgccccccuccuccgccucgagaacaaccacugccacaucgaggaguccgagcacguccucaagaaggcccacaaguacuccgagcucaucauccucuacgagaagaagggccuccacgagaaggcccuccagguccucgucgaccaguccaagaaggccaacuccccccucaagggccacgagcgcaccguccaguaccuccagcaccucggcaccgagaaccuccaccucaucuucuccuacuccgucuggguccuccgcgacuuccccgaggacggccucaagaucuucaccgaggaccuccccgaggucgagucccucccccgcgaccgcguccucggcuuccucaucgagaacuucaagggccucgccauccccuaccucgagcacaucauccacgucugggaggagaccggcucccgcuuccacaacugccucauccagcucuacugcgagaagguccagggccucaugaaggaguaccuccucuccuuccccgccggcaagacccccguccccgccggcgaggaggagggcgagcucggcgaguaccgccagaagcuccucauguuccucgagaucuccuccuacuacgaccccggccgccucaucugcgacuuccccuucgacggccuccucgaggagcgcgcccuccuccucggccgcaugggcaagcacgagcaggcccucuucaucuacguccacauccucaaggacacccgcauggccgaggaguacugccacaagcacuacgaccgcaacaaggacggcaacaaggacgucuaccucucccuccuccgcauguaccucuccccccccuccauccacugccucggccccaucaagcucgagcuccucgagcccaaggccaaccuccaggccgcccuccagguccucgagcuccaccacuccaagcucgacaccaccaaggcccucaaccuccuccccgccaacacccagaucaacgacauccgcaucuuccucgagaagguccucgaggagaacgcccagaagaagcgcuucaaccagguccucaagaaccuccuccacgccgaguuccuccgcguccaggaggagcgcauccuccaccagcaggucaagugcaucaucaccgaggagaaggucugcauggucugcaagaagaagaucggcaacuccgccuucgcccgcuaccccaacggcgucgucguccacuacuucugcuccaaggaggucaaccccgccgacaccuga

SEQ ID NO: 51685 - RNA, 2565 nt, Artificial Sequence
  derived and/or modified sequence opt2 from VPS41__Homo_sapiens__NP_055211
auggccgaggccgaggagcaggagaccggcucccucgaggaguccaccgacgaguccgaggaggaggaguccgaggaggagcccaagcucaaguacgagcgccucuccaacggcgucaccgagauccuccagaaggacgccgccuccugcaugaccguccacgacaaguuccucgcccucggcacccacuacggcaaggucuaccuccucgacguccagggcaacaucacccagaaguucgacgucucccccgucaagaucaaccagaucucccucgacgaguccggcgagcacaugggcgucugcuccgaggacggcaagguccaggucuucggccucuacuccggcgaggaguuccacgagaccuucgacugccccaucaagaucaucgccguccacccccacuucguccgcuccuccugcaagcaguucgucaccggcggcaagaagcuccuccucuucgagcgcuccuggaugaaccgcuggaaguccgccguccuccacgagggcgagggcaacauccgcuccgucaaguggcgcggccaccucaucgccugggccaacaacaugggcgucaagaucuucgacaucaucuccaagcagcgcaucaccaacgucccccgcgacgacaucucccuccgccccgacauguaccccugcucccucugcuggaaggacaacgucacccucaucaucggcuggggcaccuccgucaaggucugcuccgucaaggagcgccacgccuccgagaugcgcgaccuccccucccgcuacgucgagaucgucucccaguucgagaccgaguucuacaucuccggccucgccccccucugcgaccagcucgucguccucuccuacgucaaggagaucuccgagaagaccgagcgcgaguacugcgcccgcccccgccucgacaucauccagccccucuccgagaccugcgaggagaucuccuccgacgcccucaccguccgcggcuuccaggagaacgagugccgcgacuaccaccucgaguacuccgagggcgagucccucuucuacaucgucuccccccgcgacgucgucgucgccaaggagcgcgaccaggacgaccacaucgacuggcuccucgagaagaagaaguacgaggaggcccucauggccgccgagaucucccagaagaacaucaagcgccacaagauccucgacaucggccucgccuacaucaaccaccucgucgagcgcggcgacuacgacaucgccgcccgcaagugccagaagauccucggcaagaacgccgcccucugggaguacgaggucuacaaguucaaggagaucggccagcucaaggccaucucccccuaccucccccgcggcgaccccguccucaagccccucaucuacgagaugauccuccacgaguuccucgaguccgacuacgagggcuucgccacccucauccgcgaguggcccggcgaccucuacaacaacuccgucaucguccaggccguccgcgaccaccucaagaaggacucccagaacaagacccuccucaagacccucgccgagcucuacaccuacgacaagaacuacggcaacgcccucgagaucuaccucacccuccgccacaaggacgucuuccagcucauccacaagcacaaccucuucuccuccaucaaggacaagaucguccuccucauggacuucgacuccgagaaggccgucgacaugcuccucgacaacgaggacaagaucuccaucaagaaggucgucgaggagcucgaggaccgccccgagcuccagcacgucuaccuccacaagcucuucaagcgcgaccaccacaagggccagcgcuaccacgagaagcagaucucccucuacgccgaguacgaccgccccaaccuccuccccuuccuccgcgacuccacccacugcccccucgagaaggcccucgagaucugccagcagcgcaacuucgucgaggagaccgucuaccuccucucccgcaugggcaacucccgcuccgcccucaagaugaucauggaggagcuccacgacgucgacaaggccaucgaguucgccaaggagcaggacgacggcgagcucugggaggaccucauccucuacuccaucgacaagccccccuucaucaccggccuccucaacaacaucggcacccacgucgaccccauccuccucauccaccgcaucaaggagggcauggagauccccaaccuccgcgacucccucgucaagauccuccaggacuacaaccuccagauccuccuccgcgagggcugcaagaagauccucgucgccgacucccucucccuccucaagaagaugcaccgcacccagaugaagggcguccucgucgacgaggagaacaucugcgaguccugccucucccccauccuccccuccgacgccgccaagcccuucuccgucgucgucuuccacugccgccacauguuccacaaggagugccuccccaugcccuccaugaacuccgccgcccaguucugcaacaucugcuccgccaagaaccgcggccccggcuccgccauccucgagaugaagaaguga

SEQ ID NO: 51686 - RNA, 1314 nt, Artificial Sequence
  derived and/or modified sequence opt2 from VPS4A__Homo_sapiens__NP_037377
augaccaccuccacccuccagaaggccaucgaccucgucaccaaggccaccgaggaggacaaggccaagaacuacgaggaggcccuccgccucuaccagcacgccgucgaguacuuccuccacgccaucaaguacgaggcccacuccgacaaggccaaggaguccauccgcgccaagugcguccaguaccucgaccgcgccgagaagcucaaggacuaccuccgcuccaaggagaagcacggcaagaagcccgucaaggagaaccaguccgagggcaagggcuccgacuccgacuccgagggcgacaaccccgagaagaagaagcuccaggagcagcucaugggcgccgucgucauggagaagcccaacauccgcuggaacgacgucgccggccucgagggcgccaaggaggcccucaaggaggccgucauccuccccaucaaguucccccaccucuucaccggcaagcgcacccccuggcgcggcauccuccucuucggcccccccggcaccggcaaguccuaccucgccaaggccgucgccaccgaggccaacaacuccaccuucuucuccgucuccuccuccgaccucauguccaaguggcucggcgaguccgagaagcucgucaagaaccucuucgagcucgcccgccagcacaagcccuccaucaucuucaucgacgaggucgacucccucugcggcucccgcaacgagaacgaguccgaggccgcccgccgcaucaagaccgaguuccucguccagaugcagggcgucggcaacaacaacgacggcacccucguccucggcgccaccaacauccccuggguccucgacuccgccauccgccgccgcuucgagaagcgcaucuacaucccccuccccgaggaggccgcccgcgcccagauguuccgccuccaccucggcuccaccccccacaaccucaccgacgccaacauccacgagcucgcccgcaagaccgagggcuacuccggcgccgacaucuccaucaucguccgcgacucccucaugcagcccguccgcaagguccaguccgccacccacuucaagaaggucugcggccccucccgcaccaaccccuccaugaugaucgacgaccuccucacccccugcucccccggcgaccccggcgccauggagaugaccuggauggacguccccggcgacaagcuccucgagcccgucgucugcauguccgacaugcuccgcucccucgccaccacccgccccaccgucaacgccgacgaccuccucaaggucaagaaguucuccgaggacuucggccaggaguccuga

SEQ ID NO: 51687 - RNA, 1335 nt, Artificial Sequence
  derived and/or modified sequence opt2 from VPS4B__Homo_sapiens__NP_004860
auguccuccaccucccccaaccuccagaaggccaucgaccucgccuccaaggccgcccaggaggacaaggccggcaacuacgaggaggcccuccagcucuaccagcacgccguccaguacuuccuccacgucgucaaguacgaggcccagggcgacaaggccaagcaguccauccgcgccaagugcaccgaguaccucgaccgcgccgagaagcucaaggaguaccucaagaacaaggagaagaaggcccagaagcccgucaaggagggccagcccucccccgccgacgagaagggcaacgacuccgacggcgagggcgaguccgacgaccccgagaagaagaagcuccagaaccagcuccagggcgccaucgucaucgagcgccccaacgucaagugguccgacgucgccggccucgagggcgccaaggaggcccucaaggaggccgucauccuccccaucaaguucccccaccucuucaccggcaagcgcacccccuggcgcggcauccuccucuucggcccccccggcaccggcaaguccuaccucgccaaggccgucgccaccgaggccaacaacuccaccuucuucuccaucuccuccuccgaccucgucuccaaguggcucggcgaguccgagaagcucgucaagaaccucuuccagcucgcccgcgagaacaagcccuccaucaucuucaucgacgagaucgacucccucugcggcucccgcuccgagaacgaguccgaggccgcccgccgcaucaagaccgaguuccucguccagaugcagggcgucggcgucgacaacgacggcauccucguccucggcgccaccaacauccccuggguccucgacuccgccauccgccgccgcuucgagaagcgcaucuacaucccccuccccgagccccacgcccgcgccgccauguucaagcuccaccucggcaccacccagaacucccucaccgaggccgacuuccgcgagcucggccgcaagaccgacggcuacuccggcgccgacaucuccaucaucguccgcgacgcccucaugcagcccguccgcaagguccaguccgccacccacuucaagaagguccgcggccccucccgcgccgaccccaaccaccucgucgacgaccuccucacccccugcucccccggcgaccccggcgccaucgagaugaccuggauggacguccccggcgacaagcuccucgagcccgucgucuccauguccgacaugcuccgcucccucuccaacaccaagcccaccgucaacgagcacgaccuccucaagcucaagaaguucaccgaggacuucggccaggagggcuga

SEQ ID NO: 51688 - RNA, 2349 nt, Artificial Sequence
  derived and/or modified sequence opt2 from VPS51__Homo_sapiens__NP_037397
auggccgccgccgccgccgccggccccucccccggcuccggccccggcgacucccccgagggccccgagggcgaggcccccgagcgccgccgcaaggcccacggcaugcucaagcucuacuacggccucuccgagggcgaggccgccggccgccccgccggccccgacccccucgaccccaccgaccucaacggcgcccacuucgaccccgaggucuaccucgacaagcuccgccgcgagugcccccucgcccagcucauggacuccgagaccgacaugguccgccagauccgcgcccucgacuccgacaugcagacccucgucuacgagaacuacaacaaguucaucuccgccaccgacaccauccgcaagaugaagaacgacuuccgcaagauggaggacgagauggaccgccucgccaccaacauggccgucaucaccgacuucuccgcccgcaucuccgccacccuccaggaccgccacgagcgcaucaccaagcucgccggcguccacgcccuccuccgcaagcuccaguuccucuucgagcuccccucccgccucaccaagugcgucgagcucggcgccuacggccaggccguccgcuaccagggccgcgcccaggccguccuccagcaguaccagcaccuccccuccuuccgcgccauccaggacgacugccaggucaucaccgcccgccucgcccagcagcuccgccagcgcuuccgcgagggcggcuccggcgcccccgagcaggccgagugcgucgagcuccuccucgcccucggcgagcccgccgaggagcucugcgaggaguuccucgcccacgcccgcggccgccucgagaaggagcuccgcaaccucgaggccgagcucggccccuccccccccgcccccgacguccucgaguucaccgaccacggcggcuccggcuucgucggcggccucugccaggucgccgccgccuaccaggagcucuucgccgcccagggccccgccggcgccgagaagcucgccgccuucgcccgccagcucggcucccgcuacuucgcccucgucgagcgccgccucgcccaggagcagggcggcggcgacaacucccuccucguccgcgcccucgaccgcuuccaccgccgccuccgcgcccccggcgcccuccucgccgccgccggccucgccgacgccgccaccgagaucgucgagcgcgucgcccgcgagcgccucggccaccaccuccagggccuccgcgccgccuuccucggcugccucaccgacguccgccaggcccucgccgccccccgcgucgccggcaaggagggccccggccucgccgagcuccucgccaacgucgccuccuccauccucucccacaucaaggccucccucgccgccguccaccucuucaccgccaaggaggucuccuucuccaacaagcccuacuuccgcggcgaguucugcucccagggcguccgcgagggccucaucgucggcuucguccacuccaugugccagaccgcccaguccuucugcgacucccccggcgagaagggcggcgccaccccccccgcccuccuccuccuccucucccgccucugccucgacuacgagaccgccaccaucuccuacauccucacccucaccgacgagcaguuccucguccaggaccaguuccccgucacccccgucuccacccucugcgccgaggcccgcgagaccgcccgccgccuccucacccacuacgucaagguccagggccucgucaucucccagaugcuccgcaaguccgucgagacccgcgacuggcucuccacccucgagccccgcaacguccgcgccgucaugaagcgcgucgucgaggacaccaccgccaucgacguccaggucggccuccucuacgaggagggcguccgcaaggcccaguccuccgacuccuccaagcgcaccuucuccgucuacuccuccucccgccagcagggccgcuacgcccccuccuacacccccuccgcccccauggacaccaaccuccucuccaacauccagaagcucuucuccgagcgcaucgacgucuucucccccgucgaguucaacaaggucuccguccucaccggcaucaucaagaucucccucaagacccuccucgagugcguccgccuccgcaccuucggccgcuucggccuccagcagguccaggucgacugccacuuccuccagcucuaccucuggcgcuucgucgccgacgaggagcucguccaccuccuccucgacgaggucgucgccuccgccgcccuccgcugccccgaccccguccccauggagcccuccgucgucgaggucaucugcgagcgcggcuga

SEQ ID NO: 51689 - RNA, 1605 nt, Artificial Sequence
  derived and/or modified sequence opt2 from VPS52__Homo_sapiens__NP_001276105
auggagcagaugcucggcgccuuccaguccgaccucuccuccaucuccuccgagauccgcacccuccaggagcaguccggcgccaugaacauccgccuccgcaaccgccaggccguccgcggcaagcucggcgagcucgucgacggccucgucguccccuccgcccucgucaccgccauccucgaggcccccgucaccgagccccgcuuccucgagcagcuccaggagcucgacgccaaggccgccgccguccgcgagcaggaggcccgcggcaccgccgccugcgccgacguccgcggcguccucgaccgccuccgcgucaaggccgucaccaagauccgcgaguucauccuccagaagaucuacuccuuccgcaagcccaugaccaacuaccagaucccccagaccgcccuccucaaguaccgcuucuucuaccaguuccuccucggcaacgagcgcgccaccgccaaggagauccgcgacgaguacgucgagacccucuccaagaucuaccucuccuacuaccgcuccuaccucggccgccucaugaagguccaguaccccuucgaggcccucuuccgcucccagcacuacgcccuccucgacaacuccugccgcgaguaccucuucaucugcgaguucuucgucgucuccggccccgccgcccacgaccucuuccacgccgucaugggccgcacccucuccaugacccucaagcaccucgacuccuaccucgccgacugcuacgacgccaucgccgucuuccucugcauccacaucguccuccgcuuccgcaacaucgccgccaagcgcgacguccccgcccucgaccgcuacugggagcagguccucgcccuccucuggccccgcuucgagcucauccucgagaugaacguccaguccguccgcuccaccgacccccagcgccucggcggccucgacacccgcccccacuacaucacccgccgcuacgccgaguucuccuccgcccucgucuccaucaaccagaccauccccaacgagcgcaccaugcagcuccucggccagcuccaggucgaggucgagaacuucguccuccgcgucgccgccgaguucuccucccgcaaggagcagcucgucuuccucaucaacaacuacgacaugaugcucggcguccucauggagcgcgccgccgacgacuccaaggaggucgaguccuuccagcagcuccucaacgcccgcacccaggaguucaucgaggagcuccucuccccccccuucggcggccucgucgccuucgucaaggaggccgaggcccucaucgagcgcggccaggccgagcgccuccgcggcgaggaggcccgcgucacccagcucauccgcggcuucggcuccuccuggaaguccuccgucgagucccucucccaggacgucaugcgcuccuucaccaacuuccgcaacggcaccuccaucauccagggcgcccucacccagcucauccagcucuaccaccgcuuccaccgcguccucucccagccccagcuccgcgcccuccccgcccgcgccgagcucaucaacauccaccaccucauggucgagcucaagaagcacaagcccaacuucuga

SEQ ID NO: 51690 - RNA, 2499 nt, Artificial Sequence
  derived and/or modified sequence opt2 from VPS53__Homo_sapiens__NP_001121631
augauggaggaggaggagcucgaguucgucgaggagcucgaggccguccuccagcucacccccgagguccagcucgccaucgagcaggucuuccccucccaggacccccucgaccgcgccgacuucaacgccgucgaguacaucaacacccucuuccccaccgagcagucccucgccaacaucgacgaggucgucaacaagauccgccucaagauccgccgccucgacgacaacauccgcaccgucguccgcggccagaccaacgucggccaggacggccgccaggcccucgaggaggcccagaaggccauccagcagcucuucggcaagaucaaggacaucaaggacaaggccgagaaguccgagcagauggucaaggagaucacccgcgacaucaagcagcucgaccacgccaagcgccaccucaccaccuccaucaccacccucaaccaccuccacaugcucgccggcggcgucgacucccucgaggccaugacccgccgccgccaguacggcgaggucgccaaccuccuccagggcgucaugaacguccucgagcacuuccacaaguacaugggcaucccccagauccgccagcucuccgagcgcgucaaggccgcccagaccgagcucggccagcagauccucgccgacuucgaggaggccuuccccucccagggcaccaagcgccccggcggccccuccaacguccuccgcgacgccugccucgucgccaacauccucgacccccgcaucaagcaggagaucaucaagaaguucaucaagcagcaccucuccgaguaccucguccucuuccaggagaaccaggacgucgccuggcucgacaagaucgaccgccgcuacgccuggaucaagcgccagcucgucgacuacgaggagaaguacggccgcauguucccccgcgaguggugcauggccgagcgcaucgccgucgaguucugccacgucacccgcgccgagcucgccaagaucaugcgcacccgcgccaaggagaucgaggucaagcuccuccucuucgccauccagcgcaccaccaacuucgagggcuuccucgccaagcgcuucuccggcugcacccucaccgacggcacccucaagaagcucgagucccccccccccuccaccaaccccuuccucgaggacgagcccacccccgagauggaggagcucgccaccgagaagggcgaccucgaccagcccaagaagcccaaggcccccgacaaccccuuccacggcaucgucuccaagugcuucgagccccaccucuacgucuacaucgagucccaggacaagaaccucggcgagcucaucgaccgcuucgucgccgacuucaaggcccagggcccccccaagcccaacaccgacgagggcggcgccguccuccccuccugcgccgaccucuucgucuacuacaagaagugcaugguccagugcucccagcucuccaccggcgagcccaugaucgcccucaccaccaucuuccagaaguaccuccgcgaguacgccuggaagauccucuccggcaaccuccccaagaccaccaccuccuccggcggccucaccaucuccucccuccucaaggagaaggagggcuccgaggucgccaaguucacccucgaggagcucugccucaucugcaacauccucuccaccgccgaguacugccucgccaccacccagcagcucgaggagaagcucaaggagaaggucgacgucucccucaucgagcgcaucaaccucaccggcgagauggacaccuucuccaccgucaucuccuccuccauccagcuccucguccaggaccucgacgccgccugcgaccccgcccucaccgccauguccaagaugcaguggcagaacgucgagcacgucggcgaccagucccccuacgucaccuccgucauccuccacaucaagcagaacguccccaucauccgcgacaaccucgccuccacccgcaaguacuucacccaguucugcgucaaguucgccaacuccuucauccccaaguucaucacccaccucuucaagugcaagcccaucuccauggucggcgccgagcagcuccuccucgacacccacucccucaagaugguccuccucgaccuccccuccaucuccucccaggucguccgcaaggcccccgccuccuacaccaagaucgucgucaagggcaugacccgcgccgagaugauccucaaggucgucauggccccccacgagccccucgucgucuucgucgacaacuacaucaagcuccucaccgacugcaacaccgagaccuuccagaagauccucgacaugaagggccucaagcgcuccgagcaguccuccaugcucgagcuccuccgccagcgccuccccgccccccccuccggcgccgaguccuccggcucccucucccucaccgcccccacccccgagcaggaguccucccgcauccgcaagcucgagaagcucaucaagaagcgccucuga

SEQ ID NO: 51691 - RNA, 2898 nt, Artificial Sequence
  derived and/or modified sequence opt2 from VPS54__Homo_sapiens__NP_001005739
auggccuccucccacuccuccucccccgucccccagggcuccuccuccgacgucuucuucaagaucgaggucgaccccuccaagcacauccgccccguccccucccuccccgacgucugccccaaggagcccaccgucaccgaccagcaccgcuggaccgucuaccacuccaaggucaaccuccccgccgcccucaacgacccccgccucgccaagcgcgaguccgacuucuucaccaagaccuggggccucgacuucgucgacaccgaggucauccccuccuucuaccucccccagaucuccaaggagcacuucaccgucuaccagcaggagaucucccagcgcgagaagauccacgagcgcugcaagaacaucugcccccccaaggacaccuucgagcgcacccuccuccacacccacgacaagucccgcaccgaccucgagcagguccccaagaucuucaugaagcccgacuucgcccucgacgacucccucaccuucaacuccguccuccccuggucccacuucaacaccgccggcggcaagggcaaccgcgacgccgccuccuccaagcuccuccaggagaagcucucccacuaccucgacaucgucgaggucaacaucgcccaccagaucucccuccgcuccgaggccuucuuccacgccaugaccucccagcacgagcuccaggacuaccuccgcaagaccucccaggccgucaagaugcuccgcgacaagaucgcccagaucgacaaggucaugugcgagggcucccuccacauccuccgccucgcccucacccgcaacaacugcgucaaggucuacaacaagcucaagcucauggccaccguccaccagacccagcccaccguccagguccuccucuccaccuccgaguucgucggcgcccucgaccucaucgccaccacccaggagguccuccagcaggagcuccagggcauccacuccuuccgccaccucggcucccagcucugcgagcucgagaagcucaucgacaagaugaugaucgccgaguucuccaccuacucccacuccgaccucaaccgcccccucgaggacgacugccagguccucgaggaggagcgccucaucucccucgucuucggccuccucaagcagcgcaagcucaacuuccucgagaucuacggcgagaagauggucaucaccgccaagaacaucaucaagcagugcgucaucaacaaggucucccagaccgaggagaucgacaccgacgucgucgucaagcucgccgaccagaugcgcaugcucaacuucccccagugguucgaccuccucaaggacaucuucuccaaguucaccaucuuccuccagcgcgucaaggccacccucaacaucauccacuccgucguccucuccguccucgacaagaaccagcgcacccgcgagcucgaggagaucucccagcagaagaacgccgccaaggacaacucccucgacaccgaggucgccuaccucauccacgagggcauguucaucuccgacgccuucggcgagggcgagcucacccccaucgccgucgacaccaccucccagcgcaacgccucccccaacuccgagcccugcuccuccgacuccgucuccgagcccgagugcaccaccgacuccuccuccuccaaggagcacaccuccuccuccgccauccccggcggcgucgacaucauggucuccgaggacaugaagcucaccgacuccgagcucggcaagcucgccaacaacauccaggagcuccucuacuccgccuccgacaucugccacgaccgcgccgucaaguuccucaugucccgcgccaaggacggcuuccucgagaagcucaacuccauggaguucaucacccucucccgccucauggagaccuucauccucgacaccgagcagaucugcggccgcaaguccaccucccuccucggcgcccuccagucccaggccaucaaguucgucaaccgcuuccacgaggagcgcaagaccaagcucucccuccuccucgacaacgagcgcuggaagcaggccgacguccccgccgaguuccaggaccucgucgacucccucuccgacggcaagaucgcccuccccgagaagaaguccggcgccaccgaggagcgcaagcccgccgagguccucaucgucgagggccagcaguacgccgucgucggcaccguccuccuccucauccgcaucauccucgaguacugccagugcgucgacaacauccccuccgucaccaccgacaugcucacccgccucuccgaccuccucaaguacuucaacucccgcuccugccagcucguccucggcgccggcgcccuccaggucgucggccucaagaccaucaccaccaagaaccucgcccucuccucccgcugccuccagcucaucguccacuacauccccgucauccgcgcccacuucgaggcccgccucccccccaagcaguacuccaugcuccgccacuucgaccacaucaccaaggacuaccacgaccacaucgccgagaucuccgccaagcucgucgccaucauggacucccucuucgacaagcuccucuccaaguacgaggucaaggcccccguccccuccgccugcuuccgcaacaucugcaagcagaugaccaagaugcacgaggccaucuucgaccuccuccccgaggagcagacccagaugcucuuccuccgcaucaacgccuccuacaagcuccaccucaagaagcagcucucccaccucaacgucaucaacgacggcggcccccagaacggccucgucaccgccgacgucgccuucuacaccggcaaccuccaggcccucaagggccucaaggaccucgaccucaacauggccgagaucugggagcagaagcgcuga

SEQ ID NO: 51692 - RNA, 1128 nt, Artificial Sequence
  derived and/or modified sequence opt2 from VPS72__Homo_sapiens__NP_001258016
augucccucgccggcggccgcgccccccgcaagaccgccggcaaccgccucuccggccuccucgaggccgaggaggaggacgaguucuaccagaccaccuacggcggcuucaccgaggaguccggcgacgacgaguaccagggcgaccaguccgacaccgaggacgaggucgacuccgacuucgacaucgacgagggcgacgagcccuccuccgacggcgaggccgaggagccccgccgcaagcgccgcgucgucaccaaggccuacaaggagccccucaagucccuccgcccccgcaaggucaacacccccgccggcuccucccagaaggcccgcgaggagaaggcccuccucccccucgagcuccaggacgacggcuccgacucccgcaaguccaugcgccaguccaccgccgagcacacccgccagaccuuccuccgcguccaggagcgccagggccagucccgccgccgcaagggcccccacugcgagcgcccccucacccaggaggagcuccuccgcgaggccaagaucaccgaggagcucaaccuccgcucccucgagaccuacgagcgccucgaggccgacaagaagaagcagguccacaagaagcgcaagugccccggccccaucaucaccuaccacuccgucaccgucccccucgucggcgagcccggccccaaggaggagaacgucgacaucgagggcucccucugcuucucccucuccuucguccuccgccucgaccccgcccccuccgucuccgcccucaccccccacgccggcaccggccccgucaacccccccgcccgcugcucccgcaccuucaucaccuucuccgacgacgccaccuucgaggagugguucccccagggccgcccccccaagguccccguccgcgaggucugccccgucacccaccgccccgcccucuaccgcgaccccgucaccgacauccccuacgccaccgcccgcgccuucaagaucauccgcgaggccuacaagaaguacaucaccgcccacggccucccccccaccgccuccgcccucggccccggcccccccccccccgagccccuccccggcuccggcccccgcgcccuccgccagaagaucgucaucaaguga

SEQ ID NO: 51693 - RNA, 4287 nt, Artificial Sequence
  derived and/or modified sequence opt2 from VPS8__Homo_sapiens__NP_001009921
auggagaacgagcccgaccacgagaacgucgagcagucccucugcgccaagaccuccgaggaggagcucaacaaguccuucaaccucgaggccucccucuccaaguucuccuacaucgacauggacaaggagcucgaguucaagaacgaccucaucgacgacaaggaguucgacaucccccaggucgacaccccccccacccucgaguccauccucaacgagaccgacgacgaggacgaguccuucauccucgaggaccccacccuccucaacaucgacaccaucgacucccacuccuacgacaccuccuccgucgccuccuccgacuccggcgaccgcaccaaccucaagcgcaagaagaagcuccccgacuccuucucccuccacggcuccgucaugcgccacucccuccucaagggcaucuccgcccagaucgucuccgccgccgacaaggucgacgccggccuccccaccgccaucgccgucuccucccucaucgccgucggcaccucccacggccucgcccucaucuucggcaaggaccagaaccaggcccuccgccucugccucggcuccaccuccgucggcggccaguacggcgccaucuccgcccucuccaucaacaacgacugcucccgccuccucugcggcuucgccaagggccagaucaccaugugggaccucgccuccggcaagcuccuccgcuccaucaccgacgcccacccccccggcaccgccauccuccacaucaaguucaccgacgaccccacccucgccaucugcaacgacuccggcggcuccgucuucgagcucaccuucaagcgcgucaugggcguccgcaccugcgagucccgcugccucuucuccggcuccaagggcgaggucugcugcaucgagccccuccacuccaagcccgagcucaaggaccaccccaucacccaguucucccuccucgccauggccucccucaccaagauccucgucaucggccucaagcccucccucaaggucuggaugaccuuccccuacggccgcauggaccccuccuccgucccccuccucgccuggcacuucgucgccguccagaacuacgucaaccccaugcucgccuucugccgcggcgacgucguccacuuccuccucgucaagcgcgacgaguccggcgccauccacgucaccaagcagaagcaccuccaccucuacuacgaccucaucaacuucaccuggaucaacucccgcaccgucguccuccucgacuccgucgagaagcuccacgucaucgaccgccagacccaggaggagcucgagaccgucgagaucuccgagguccagcucgucuacaacuccucccacuucaagucccucgccaccggcggcaacgucucccaggcccucgcccucgucggcgagaaggccugcuaccaguccaucuccuccuacggcggccagaucuucuaccucggcaccaaguccgucuacgucaugaugcuccgcuccuggcgcgagcgcgucgaccaccuccucaagcaggacugccucaccgaggcccucgcccucgccugguccuuccacgagggcaaggccaaggccgucgucggccucuccggcgacgccuccaagcgcaaggccaucgucgccgaccgcauggucgagauccucuuccacuacgccgaccgcgcccucaagaagugccccgaccagggcaagauccaggucauggagcagcacuuccaggacaugguccccgucaucgucgacuacugccuccuccuccagcgcaaggaccuccucuucucccagauguacgacaagcucuccgagaacuccgucgccaagggcgucuuccucgagugccucgagcccuacauccucuccgacaagcucgucggcaucaccccccaggucaugaaggaccucaucguccacuuccaggacaagaagcucauggagaacgucgaggcccucaucguccacauggacaucaccucccucgacauccagcaggucguccucaugugcugggagaaccgccucuacgacgccaugaucuacgucuacaaccgcggcaugaacgaguucaucucccccauggagaagcucuuccgcgucaucgcccccccccucaacgccggcaagacccucaccgacgagcaggucgucaugggcaacaagcuccucgucuacaucuccugcugccucgccggccgcgccuacccccucggcgacauccccgaggaccucgucccccucgucaagaaccaggucuucgaguuccucauccgccuccacuccgccgaggccucccccgaggaggagaucuaccccuacauccgcacccuccuccacuucgacacccgcgaguuccucaacguccucgcccucaccuucgaggacuucaagaacgacaagcaggccgucgaguaccagcagcgcaucgucgacauccuccucaaggucauggucgagaacuccgacuucacccccucccaggucggcugccucuucaccuuccucgcccgccagcucgccaagcccgacaacacccucuucgucaaccgcacccucuucgaccagguccucgaguuccucugcucccccgacgacgacucccgccacuccgagcgccagcagguccuccucgagcuccuccaggccggcggcaucguccaguucgaggagucccgccucauccgcauggccgagaaggccgaguucuaccagaucugcgaguucauguacgagcgcgagcaccaguacgacaagaucaucgacugcuaccuccgcgacccccuccgcgaggaggaggucuucaacuacauccacaacauccucuccauccccggccacuccgccgaggagaagcaguccgucuggcagaaggccauggaccacaucgaggagcucgucucccucaagcccugcaaggccgccgagcucgucgccacccacuucuccggccacaucgagaccgucaucaagaagcuccagaaccagguccuccucuucaaguuccuccgcucccuccucgacccccgcgagggcauccacgucaaccaggagcuccuccagaucucccccugcaucaccgagcaguucaucgagcuccucugccaguucaaccccacccaggucaucgagacccuccagguccucgagugcuaccgccucgaggagaccauccagaucacccagaaguaccagcuccacgaggucaccgccuaccuccucgagaagaagggcgacauccacggcgccuuccucaucaugcucgagcgccuccaguccaagcuccaggaggucacccaccagggcgagaacaccaaggaggaccccucccucaaggacgucgaggacaccauggucgagaccaucgcccucugccagcgcaacucccacaaccucaaccagcagcagcgcgaggcccucugguucccccuccucgaggccaugauggccccccagaagcucuccuccuccgccaucccccaccuccacuccgaggcccucaagucccucaccaugcagguccucaacuccauggccgccuucaucgcccuccccuccauccuccagcgcauccuccaggaccccgucuacggcaagggcaagcucggcgagauccagggccucauccucggcaugcucgacaccuucaacuacgagcagacccuccucgagaccaccaccucccuccucaaccaggaccuccacuggucccucugcaaccuccgcgccuccgucacccgcggccucaaccccaagcaggacuacugcuccaucugccuccagcaguacaagcgccgccaggagauggccgacgagaucaucgucuucuccugcggccaccucuaccacuccuucugccuccagaacaaggagugcaccgucgaguucgagggccagacccgcuggaccugcuacaagugcuccuccuccaacaaggucggcaagcucuccgagaacuccuccgagaucaagaagggccgcaucacccccucccaggucaagaugucccccuccuaccaccaguccaagggcgaccccaccgccaagaagggcaccuccgagcccguccucgacccccagcagauccaggccuucgaccagcucugccgccucuaccgcggcuccucccgccucgcccuccucaccgagcucucccagaaccgcuccuccgaguccuaccgccccuucuccggcucccaguccgcccccgccuucaacuccaucuuccagaacgagaacuuccagcuccagcucauccccccccccgucaccgaggacuga

SEQ ID NO: 51694 - RNA, 1191 nt, Artificial Sequence
  derived and/or modified sequence opt2 from VRK1__Homo_sapiens__NP_003375
augccccgcgucaaggccgcccaggccggccgccaguccuccgccaagcgccaccucgccgagcaguucgccgucggcgagaucaucaccgacauggccaagaaggaguggaaggucggccuccccaucggccagggcggcuucggcugcaucuaccucgccgacaugaacuccuccgaguccgucggcuccgacgcccccugcgucgucaaggucgagcccuccgacaacggcccccucuucaccgagcucaaguucuaccagcgcgccgccaagcccgagcagauccagaaguggauccgcacccgcaagcucaaguaccucggcguccccaaguacuggggcuccggccuccacgacaagaacggcaaguccuaccgcuucaugaucauggaccgcuucggcuccgaccuccagaagaucuacgaggccaacgccaagcgcuucucccgcaagaccguccuccagcucucccuccgcauccucgacauccucgaguacauccacgagcacgaguacguccacggcgacaucaaggccuccaaccuccuccucaacuacaagaaccccgaccaggucuaccucgucgacuacggccucgccuaccgcuacugccccgagggcguccacaaggaguacaaggaggaccccaagcgcugccacgacggcaccaucgaguucaccuccaucgacgcccacaacggcgucgcccccucccgccgcggcgaccucgagauccucggcuacugcaugauccaguggcucaccggccaccuccccugggaggacaaccucaaggaccccaaguacguccgcgacuccaagauccgcuaccgcgagaacaucgccucccucauggacaagugcuuccccgagaagaacaagcccggcgagaucgccaaguacauggagaccgucaagcuccucgacuacaccgagaagccccucuacgagaaccuccgcgacauccuccuccagggccucaaggccaucggcuccaaggacgacggcaagcucgaccucuccgucgucgagaacggcggccucaaggccaagaccaucaccaagaagcgcaagaaggagaucgaggaguccaaggagcccggcgucgaggacaccgagugguccaacacccagaccgaggaggccauccagacccgcucccgcacccgcaagcgcguccagaaguga

SEQ ID NO: 51695 - RNA, 1527 nt, Artificial Sequence
  derived and/or modified sequence opt2 from VRK2__Homo_sapiens__NP_001123953
augccccccaagcgcaacgagaaguacaagcuccccauccccuuccccgagggcaagguccucgacgacauggagggcaaccaguggguccucggcaagaagaucggcuccggcggcuucggccucaucuaccucgccuuccccaccaacaagcccgagaaggacgcccgccacgucgucaaggucgaguaccaggagaacggcccccucuucuccgagcucaaguucuaccagcgcgucgccaagaaggacugcaucaagaaguggaucgagcgcaagcagcucgacuaccucggcaucccccucuucuacggcuccggccucaccgaguucaagggccgcuccuaccgcuucauggucauggagcgccucggcaucgaccuccagaagaucuccggccagaacggcaccuucaagaaguccaccguccuccagcucggcauccgcaugcucgacguccucgaguacauccacgagaacgaguacguccacggcgacaucaaggccgccaaccuccuccucggcuacaagaaccccgaccaggucuaccucgccgacuacggccucuccuaccgcuacugccccaacggcaaccacaagcaguaccaggagaacccccgcaagggccacaacggcaccaucgaguucaccucccucgacgcccacaagggcgucgcccucucccgccgcuccgacgucgagauccucggcuacugcaugcuccgcuggcucugcggcaagcuccccugggagcagaaccucaaggaccccgucgccguccagaccgccaagaccaaccuccucgacgagcucccccaguccguccucaagugggcccccuccggcuccuccugcugcgagaucgcccaguuccucgucugcgcccacucccucgccuacgacgagaagcccaacuaccaggcccucaagaagauccucaacccccacggcaucccccucggcccccucgacuucuccaccaagggccaguccaucaacguccacacccccaacucccagaaggucgacucccagaaggccgccaccaagcaggucaacaaggcccacaaccgccucaucgagaagaagguccacuccgagcgcuccgccgaguccugcgccaccuggaagguccagaaggaggagaagcucaucggccucaugaacaacgaggccgcccaggaguccacccgccgccgccagaaguaccaggagucccaggagccccucaacgaggucaacuccuucccccagaagaucuccuacacccaguuccccaacuccuucuacgagccccaccaggacuucaccucccccgacaucuucaagaagucccgcucccccuccugguacaaguacaccuccaccgucuccaccggcaucaccgaccucgaguccuccaccggccucuggcccaccaucucccaguucacccucuccgaggagaccaacgccgacgucuacuacuaccgcaucaucauccccguccuccucaugcucgucuuccucgcccucuucuuccucuga

SEQ ID NO: 51696 - RNA, 1623 nt, Artificial Sequence
  derived and/or modified sequence opt2 from VSIG10__Homo_sapiens__NP_061959
auggccgccggcggcuccgcccccgagccccgcguccucgucugccucggcgcccuccucgccggcugggucgccgucggccucgaggccgucgucaucggcgagguccacgagaacgucacccuccacugcggcaacaucuccggccuccgcggccaggucaccugguaccgcaacaacuccgagcccgucuuccuccucuccuccaacuccucccuccgccccgccgagccccgcuucucccucgucgacgccaccucccuccacaucgagucccucucccucggcgacgagggcaucuacaccugccaggagauccucaacgucacccagugguuccaggucuggcuccaggucgccuccggccccuaccagaucgagguccacaucgucgccaccggcacccuccccaacggcacccucuacgccgcccgcggcucccaggucgacuucuccugcaacuccuccucccgccccccccccgucgucgaguggugguuccaggcccucaacuccuccuccgaguccuucggccacaaccucaccgucaacuucuucucccuccuccucaucucccccaaccuccagggcaacuacaccugccucgcccucaaccagcucuccaagcgccaccgcaaggucaccaccgagcuccucgucuacuaccccccccccuccgccccccagugcugggcccagauggccuccggcuccuucaugcuccagcucaccugccgcugggacggcggcuaccccgaccccgacuuccucuggaucgaggagcccggcggcgucaucgucggcaaguccaagcucggcgucgagaugcucuccgagucccagcucuccgacggcaagaaguucaagugcgucaccucccacaucgucggccccgaguccggcgccuccugcaugguccagauccgcggccccucccuccucuccgagcccaugaagaccugcuucaccggcggcaacgucacccucaccugccaggucuccggcgccuacccccccgccaagauccucuggcuccgcaaccucacccagcccgaggucaucauccagcccuccucccgccaccucaucacccaggacggccagaacuccacccucaccauccacaacugcucccaggaccucgacgagggcuacuacaucugccgcgccgacucccccgucggcguccgcgagauggagaucuggcucuccgucaaggagccccucaacaucggcggcaucgucggcaccaucgucucccuccuccuccucggccucgccaucaucuccggccuccuccuccacuacucccccgucuucugcuggaaggucggcaacaccucccgcggccagaacauggacgacgucaugguccucgucgacuccgaggaggaggaggaggaggaggaggaggaggaggaggacgccgccgucggcgagcaggagggcgcccgcgagcgcgaggagcuccccaaggagauccccaagcaggaccacauccaccgcgucaccgcccucgucaacggcaacaucgagcagaugggcaacggcuuccaggaccuccaggacgacuccuccgaggagcaguccgacaucguccaggaggaggaccgccccgucuga

SEQ ID NO: 51697 - RNA, 1272 nt, Artificial Sequence
  derived and/or modified sequence opt2 from VSIG1__Homo_sapiens__NP_001164024
auggucuucgccuucuggaaggucuuccucauccucuccugccucgccggccaggucuccgucguccaggucaccauccccgacggcuucgucaacgucaccgucggcuccaacgucacccucaucugcaucuacaccaccaccgucgccucccgcgagcagcucuccauccagugguccuucuuccacaagaaggagauggagcccaucucccacuccuccugccucuccaccgagggcauggaggagaaggccgucucccagugccucaagaugacccacgcccgcgacgcccgcggccgcugcuccuggaccuccgagaucuacuucucccagggcggccaggccgucgccaucggccaguucaaggaccgcaucaccggcuccaacgaccccggcaacgccuccaucaccaucucccacaugcagcccgccgacuccggcaucuacaucugcgacgucaacaacccccccgacuuccucggccagaaccagggcauccucaacgucuccguccucgucaagcccuccaagccccucugcuccguccagggccgccccgagaccggccacaccaucucccucuccugccucuccgcccucggcacccccucccccgucuacuacuggcacaagcucgagggccgcgacaucguccccgucaaggagaacuucaaccccaccaccggcauccucgucaucggcaaccucaccaacuucgagcagggcuacuaccagugcaccgccaucaaccgccucggcaacuccuccugcgagaucgaccucaccuccucccaccccgaggucggcaucaucgucggcgcccucaucggcucccucgucggcgccgccaucaucaucuccgucgucugcuucgcccgcaacaaggccaaggccaaggccaaggagcgcaacuccaagaccaucgccgagcucgagcccaugaccaagaucaacccccgcggcgaguccgaggccaugccccgcgaggacgccacccagcucgaggucacccuccccuccuccauccacgagaccggccccgacaccauccaggagcccgacuacgagcccaagcccacccaggagcccgcccccgagcccgcccccggcuccgagcccauggccguccccgaccucgacaucgagcucgagcucgagcccgagacccaguccgagcucgagcccgagcccgagcccgagcccgaguccgagcccggcgucgucgucgagccccucuccgaggacgagaagggcgucgucaaggccuga

SEQ ID NO: 51698 - RNA, 984 nt, Artificial Sequence
  derived and/or modified sequence opt2 from VSIG2__Homo_sapiens__NP_055127
auggccgagcuccccggccccuuccucugcggcgcccuccucggcuuccucugccucuccggccucgccgucgaggucaagguccccaccgagccccucuccaccccccucggcaagaccgccgagcucaccugcaccuacuccaccuccgucggcgacuccuucgcccucgagugguccuucguccagcccggcaagcccaucuccgagucccaccccauccucuacuucaccaacggccaccucuaccccaccggcuccaaguccaagcgcgucucccuccuccagaacccccccaccgucggcgucgccacccucaagcucaccgacguccaccccuccgacaccggcaccuaccucugccaggucaacaacccccccgacuucuacaccaacggccucggccucaucaaccucaccguccucgucccccccuccaacccccucugcucccaguccggccagaccuccgucggcggcuccaccgcccuccgcugcuccuccuccgagggcgcccccaagcccgucuacaacuggguccgccucggcaccuuccccacccccucccccggcuccaugguccaggacgaggucuccggccagcucauccucaccaaccucucccucaccuccuccggcaccuaccgcugcgucgccaccaaccagaugggcuccgccuccugcgagcucacccucuccgucaccgagcccucccagggccgcgucgccggcgcccucaucggcguccuccucggcguccuccuccucuccgucgccgccuucugccucguccgcuuccagaaggagcgcggcaagaagcccaaggagaccuacggcggcuccgaccuccgcgaggacgccaucgcccccggcaucuccgagcacaccugcaugcgcgccgacuccuccaagggcuuccucgagcgccccuccuccgccuccaccgucaccaccaccaaguccaagcuccccauggucgucuga

SEQ ID NO: 51699 - RNA, 918 nt, Artificial Sequence
  derived and/or modified sequence opt2 from VSIG4__Homo_sapiens__NP_001093901
augggcauccuccucggccuccuccuccucggccaccucaccgucgacaccuacggccgccccauccucgagguccccgaguccgucaccggccccuggaagggcgacgucaaccuccccugcaccuacgacccccuccagggcuacacccagguccucgucaaguggcucguccagcgcggcuccgaccccgucaccaucuuccuccgcgacuccuccggcgaccacauccagcaggccaaguaccagggccgccuccacgucucccacaagguccccggcgacgucucccuccagcucuccacccucgagauggacgaccgcucccacuacaccugcgaggucaccuggcagacccccgacggcaaccaggucguccgcgacaagaucaccgagcuccgcguccagaagcacuccuccaagcuccucaagaccaagaccgaggcccccaccaccaugaccuacccccucaaggccaccuccaccgucaagcaguccugggacuggaccaccgacauggacggcuaccucggcgagaccuccgccggccccggcaagucccuccccgucuucgccaucauccucaucaucucccucugcugcauggucgucuucaccauggccuacaucaugcucugccgcaagaccucccagcaggagcacgucuacgaggccgcccgcgcccacgcccgcgaggccaacgacuccggcgagaccaugcgcgucgccaucuucgccuccggcugcuccuccgacgagcccaccucccagaaccucggcaacaacuacuccgacgagcccugcaucggccaggaguaccagaucaucgcccagaucaacggcaacuacgcccgccuccucgacaccgucccccucgacuacgaguuccucgccaccgagggcaaguccgucugcuga

SEQ ID NO: 51700 - RNA, 576 nt, Artificial Sequence
  derived and/or modified sequence opt2 from VSNL1__Homo_sapiens__NP_003376
augggcaagcagaacuccaagcucgcccccgaggucauggaggaccucgucaaguccaccgaguucaacgagcacgagcucaagcagugguacaagggcuuccucaaggacugccccuccggccgccucaaccucgaggaguuccagcagcucuacgucaaguucuuccccuacggcgacgccuccaaguucgcccagcacgccuuccgcaccuucgacaagaacggcgacggcaccaucgacuuccgcgaguucaucugcgcccucuccaucaccucccgcggcuccuucgagcagaagcucaacugggccuucaacauguacgaccucgacggcgacggcaagaucacccgcgucgagaugcucgagaucaucgaggccaucuacaagauggucggcaccgucaucaugaugaagaugaacgaggacggccucacccccgagcagcgcgucgacaagaucuucuccaagauggacaagaacaaggacgaccagaucacccucgacgaguucaaggaggccgccaaguccgaccccuccaucguccuccuccuccagugcgacauccagaaguga

SEQ ID NO: 51701 - RNA, 447 nt, Artificial Sequence
  derived and/or modified sequence opt2 from VSTM1__Homo_sapiens__NP_001275720
augcgcaagcgcaugggccccacccgccucccccgccucgagugcuccggcgccaucaccgcccacugcucccucgaccuccccggccccgacaagcacgacgagcucgaggcccccuccaugaagaccgacacccgcaccaucuucgucgccaucuucuccugcaucuccauccuccuccucuuccucuccgucuucaucaucuaccgcugcucccagcacuccuccuccuccgaggaguccaccaagcgcaccucccacuccaagcuccccgagcaggaggccgccgaggccgaccucuccaacauggagcgcgucucccucuccaccgccgacccccagggcgucaccuacgccgagcucuccaccuccgcccucuccgaggccgccuccgacaccacccaggagccccccggcucccacgaguacgccgcccucaaggucuga

SEQ ID NO: 51702 - RNA, 711 nt, Artificial Sequence
  derived and/or modified sequence opt2 from VSX1__Homo_sapiens__NP_001243200
augaccggccgcgacucccucuccgacggccgcaccuccucccgcgcccucguccccggcggcuccccccgcggcucccgcccccgcggcuucgccaucaccgaccuccucggccucgaggccgagcuccccgcccccgccggccccggccagggcuccggcugcgagggccccgccgucgcccccugccccggccccggccucgacggcuccucccucgcccgcggcgcccucccccucggccucggccuccucugcggcuucggcacccagccccccgccgccgcccgcgcccccugccuccuccucgccgacguccccuuccuccccccccgcggccccgagcccgccgccccccucgcccccucccgccccccccccgcccucggccgccagaagcgcuccgacuccgucuccaccuccgacgaggacucccaguccgaggaccgcaacgaccucaaggccucccccacccucggcaagcgcaagaagcgccgccaccgcaccgucuucaccgcccaccagcucgaggagcucgagaaggccuucuccgaggcccacuaccccgacgucuacgcccgcgagaugcucgccgucaagaccgagcuccccgaggaccgcauccagugcaagcuccuccuccucgaggcccccguccacuggacccuccaggagacccaccgccucccccgcccccgcggcggcgccuga

SEQ ID NO: 51703 - RNA, 1086 nt, Artificial Sequence
  derived and/or modified sequence opt2 from VSX2__Homo_sapiens__NP_878314
augaccggcaaggccggcgaggcccucuccaagcccaaguccgagaccgucgccaaguccaccuccggcggcgcccccgcccgcugcaccggcuucggcauccaggagauccucggccucaacaaggagccccccuccucccacccccgcgccgcccucgacggccucgcccccggccaccuccucgccgcccgcuccguccucucccccgccggcgucggcggcaugggccuccucggccccggcggccuccccggcuucuacacccagcccaccuuccucgagguccucuccgacccccaguccguccaccuccagccccucggccgcgccuccggcccccucgacaccucccagaccgccuccuccgacuccgaggacgucuccuccuccgaccgcaagauguccaaguccgcccucaaccagaccaagaagcgcaagaagcgccgccaccgcaccaucuucaccuccuaccagcucgaggagcucgagaaggccuucaacgaggcccacuaccccgacgucuacgcccgcgagaugcucgccaugaagaccgagcuccccgaggaccgcauccaggucugguuccagaaccgccgcgccaaguggcgcaagcgcgagaagugcuggggccgcuccuccgucauggccgaguacggccucuacggcgccaugguccgccacuccaucccccuccccgaguccauccucaaguccgccaaggacggcaucauggacuccugcgcccccuggcuccucggcaugcacaagaagucccucgaggccgccgccgaguccggccgcaagcccgagggcgagcgccaggcccuccccaagcucgacaagauggagcaggacgagcgcggccccgacgcccaggccgccaucucccaggaggagcuccgcgagaacuccaucgccguccuccgcgccaaggcccaggagcacuccaccaagguccucggcaccgucuccggccccgacucccucgcccgcuccaccgagaagcccgaggaggaggaggccauggacgaggaccgccccgccgagcgccucucccccccccagcucgaggacauggccuga

SEQ ID NO: 51704 - RNA, 843 nt, Artificial Sequence
  derived and/or modified sequence opt2 from VTA1__Homo_sapiens__NP_001273300
auggccgcccucgccccccuccccccccuccccgcccaguucaaguccauccagcaccaccuccgcaccgcccaggagcacgacaagcgcgaccccgucgucgccuacuacugccgccucuacgccaugcagaccggcaugaagaucgacuccaagacccccgagugccgcaaguuccucuccaagcucauggaccagcucgaggcccucaagaagcagcucggcgacaacgaggccaucacccaggagaucgucggcugcgcccaccucgagaacuacgcccucaagauguuccucuacgccgacaacgaggaccgcgccggccgcuuccacaagaacaugaucaaguccuucuacaccgccucccuccucaucgacgucaucaccgucuucggcgagcucaccgacgagaacgucaagcaccgcaaguacgcccgcuggaaggccaccuacauccacaacugccucaagaacggcgagaccccccaggccggccccgucggcaucgaggaggacaacgacaucgaggagaacgaggacgccggcgccgccucccuccccacccagcccacccagcccuccuccuccuccaccuacgaccccuccaacaugcccuccggcaacuacaccggcauccagaucccccccggcgcccacgcccccgccaacacccccgccgaggucccccacuccaccggcgacguccgccucacccccgaggacuucgcccgcgcccagaaguacugcaaguacgccggcuccgcccuccaguacgaggacgucuccaccgccguccagaaccuccagaaggcccucaagcuccucaccaccggccgcgaguga

SEQ ID NO: 51705 - RNA, 900 nt, Artificial Sequence
  derived and/or modified sequence opt2 from VTCN1__Homo_sapiens__XP_011540445
augggcuccgucaugcuccucaaggaguccugcggcaacgucuucuucuccgccguccgcauccgccgcucccgcaagcacuccaucaucuccaucaucaucauccucgccggcgccaucgcccucaucaucggcuucggcaucuccggccgccacuccaucaccgucaccaccgucgccuccgccggcaacaucggcgaggacggcauccucuccugcaccuucgagcccgacaucaagcucuccgacaucgucauccaguggcucaaggagggcguccucggccucguccacgaguucaaggagggcaaggacgagcucuccgagcaggacgagauguuccgcggccgcaccgccgucuucgccgaccaggucaucgucggcaacgccucccuccgccucaagaacguccagcucaccgacgccggcaccuacaagugcuacaucaucaccuccaagggcaagggcaacgccaaccucgaguacaagaccggcgccuucuccaugcccgaggucaacgucgacuacaacgccuccuccgagacccuccgcugcgaggccccccgcugguucccccagcccaccgucgucugggccucccaggucgaccagggcgccaacuucuccgaggucuccaacaccuccuucgagcucaacuccgagaacgucaccaugaaggucgucuccguccucuacaacgucaccaucaacaacaccuacuccugcaugaucgagaacgacaucgccaaggccaccggcgacaucaaggucaccgaguccgagaucaagcgccgcucccaccuccagcuccucaacuccaaggccucccucugcgucuccuccuucuucgccaucuccugggcccuccucccccucucccccuaccucaugcucaaguga

SEQ ID NO: 51706 - RNA, 654 nt, Artificial Sequence
  derived and/or modified sequence opt2 from VTI1A__Homo_sapiens__NP_660207
auguccuccgacuucgagggcuacgagcaggacuucgccguccucaccgccgagaucaccuccaagaucgcccgcgucccccgccucccccccgacgagaagaagcagauggucgccaacgucgagaagcagcucgaggaggccaaggagcuccucgagcagauggaccucgagguccgcgagauccccccccagucccgcggcauguacuccaaccgcaugcgcuccuacaagcaggagaugggcaagcucgagaccgacuucaagcgcucccgcaucgccuacuccgacgagguccgcaacgagcuccucggcgacgacggcaacuccuccgagaaccagcgcgcccaccuccucgacaacaccgagcgccucgagcgcuccucccgccgccucgaggccggcuaccagaucgccgucgagaccgagcagaucggccaggagaugcucgagaaccucucccacgaccgcgagaagauccagcgcgcccgcgagcgccuccgcgagaccgacgccaaccucggcaaguccucccgcauccucaccggcaugcuccgccgcaucauccagaaccgcauccuccucgucauccucggcaucaucgucgucaucaccauccucauggccaucaccuucuccguccgccgccacuga

SEQ ID NO: 51707 - RNA, 699 nt, Artificial Sequence
  derived and/or modified sequence opt2 from VTI1B__Homo_sapiens__NP_006361
auggccuccuccgccgccuccuccgagcacuucgagaagcuccacgagaucuuccgcggccuccacgaggaccuccagggcguccccgagcgccuccucggcaccgccggcaccgaggagaagaagaagcucauccgcgacuucgacgagaagcagcaggaggccaacgagacccucgccgagauggaggaggagcuccgcuacgccccccucuccuuccgcaaccccaugauguccaagcuccgcaacuaccgcaaggaccucgccaagcuccaccgcgagguccgcuccaccccccucaccgccacccccggcggccgcggcgacaugaaguacggcaucuacgccgucgagaacgagcacaugaaccgccuccagucccagcgcgccaugcuccuccagggcaccgagucccucaaccgcgccacccaguccaucgagcgcucccaccgcaucgccaccgagaccgaccagaucggcuccgagaucaucgaggagcucggcgagcagcgcgaccagcucgagcgcaccaagucccgccucgucaacaccuccgagaaccucuccaagucccgcaagauccuccgcuccaugucccgcaaggucaccaccaacaagcuccuccucuccaucaucauccuccucgagcucgccauccucggcggccucgucuacuacaaguucuuccgcucccacuga

SEQ ID NO: 51708 - RNA, 1437 nt, Artificial Sequence
  derived and/or modified sequence opt2 from VTN__Homo_sapiens__NP_000629
auggccccccuccgcccccuccucauccucgcccuccucgccugggucgcccucgccgaccaggaguccugcaagggccgcugcaccgagggcuucaacgucgacaagaagugccagugcgacgagcucugcuccuacuaccaguccugcugcaccgacuacaccgccgagugcaagccccaggucacccgcggcgacgucuucaccaugcccgaggacgaguacaccgucuacgacgacggcgaggagaagaacaacgccaccguccacgagcaggucggcggccccucccucaccuccgaccuccaggcccaguccaagggcaaccccgagcagacccccguccucaagcccgaggaggaggcccccgcccccgaggucggcgccuccaagcccgagggcaucgacucccgccccgagacccuccaccccggccgcccccagccccccgccgaggaggagcucugcuccggcaagcccuucgacgccuucaccgaccucaagaacggcucccucuucgccuuccgcggccaguacugcuacgagcucgacgagaaggccguccgccccggcuaccccaagcucauccgcgacgucuggggcaucgagggccccaucgacgccgccuucacccgcaucaacugccagggcaagaccuaccucuucaagggcucccaguacuggcgcuucgaggacggcguccucgaccccgacuacccccgcaacaucuccgacggcuucgacggcauccccgacaacgucgacgccgcccucgcccuccccgcccacuccuacuccggccgcgagcgcgucuacuucuucaagggcaagcaguacugggaguaccaguuccagcaccagcccucccaggaggagugcgagggcuccucccucuccgccgucuucgagcacuucgccaugaugcagcgcgacuccugggaggacaucuucgagcuccucuucuggggccgcaccuccgccggcacccgccagccccaguucaucucccgcgacuggcacggcguccccggccaggucgacgccgccauggccggccgcaucuacaucuccggcauggccccccgccccucccucgccaagaagcagcgcuuccgccaccgcaaccgcaagggcuaccgcucccagcgcggccacucccgcggccgcaaccagaacucccgccgccccucccgcgccaccuggcucucccucuucuccuccgaggaguccaaccucggcgccaacaacuacgacgacuaccgcauggacuggcucguccccgccaccugcgagcccauccaguccgucuucuucuucuccggcgacaaguacuaccgcgucaaccuccgcacccgccgcgucgacaccgucgacccccccuacccccgcuccaucgcccaguacuggcucggcugccccgcccccggccaccucuga

SEQ ID NO: 51709 - RNA, 2268 nt, Artificial Sequence
  derived and/or modified sequence opt2 from VWA2__Homo_sapiens__NP_001258975
augccccccuuccuccuccucgaggccgucugcgucuuccucuucucccgcgucccccccucccucccccuccaggagguccacgucuccaaggagaccaucggcaagaucuccgccgccuccaagaugauguggugcuccgccgccgucgacaucauguuccuccucgacggcuccaacuccgucggcaagggcuccuucgagcgcuccaagcacuucgccaucaccgucugcgacggccucgacaucucccccgagcgcguccgcgucggcgccuuccaguucuccuccaccccccaccucgaguucccccucgacuccuucuccacccagcaggaggucaaggcccgcaucaagcgcauggucuucaagggcggccgcaccgagaccgagcucgcccucaaguaccuccuccaccgcggccuccccggcggccgcaacgccuccgucccccagauccucaucaucgucaccgacggcaagucccagggcgacgucgcccuccccuccaagcagcucaaggagcgcggcgucaccgucuucgccgucggcguccgcuucccccgcugggaggagcuccacgcccucgccuccgagccccgcggccagcacguccuccucgccgagcaggucgaggacgccaccaacggccucuucuccacccucuccuccuccgccaucugcuccuccgccacccccgacugccgcgucgaggcccaccccugcgagcaccgcacccucgagaugguccgcgaguucgccggcaacgcccccugcuggcgcggcucccgccgcacccucgccguccucgccgcccacugccccuucuacuccuggaagcgcgucuuccucacccaccccgccaccugcuaccgcaccaccugccccggccccugcgacucccagcccugccagaacggcggcaccugcguccccgagggccucgacggcuaccagugccucugcccccucgccuucggcggcgaggccaacugcgcccucaagcucucccucgagugccgcgucgaccuccucuuccuccucgacuccuccgccggcaccacccucgacggcuuccuccgcgccaaggucuucgucaagcgcuucguccgcgccguccucuccgaggacucccgcgcccgcgucggcgucgccaccuacucccgcgagcuccucgucgccguccccgucggcgaguaccaggacguccccgaccucgucuggucccucgacggcauccccuuccgcggcggccccacccucaccggcuccgcccuccgccaggccgccgagcgcggcuucggcuccgccacccgcaccggccaggaccgcccccgccgcgucgucguccuccucaccgagucccacuccgaggacgaggucgccggccccgcccgccacgcccgcgcccgcgagcuccuccuccucggcgucggcuccgaggccguccgcgccgagcucgaggagaucaccggcucccccaagcacgucauggucuacuccgacccccaggaccucuucaaccagauccccgagcuccagggcaagcucugcucccgccagcgccccggcugccgcacccaggcccucgaccucgucuucaugcucgacaccuccgccuccgucggccccgagaacuucgcccagaugcaguccuucguccgcuccugcgcccuccaguucgaggucaaccccgacgucacccaggucggccucgucgucuacggcucccagguccagaccgccuucggccucgacaccaagcccacccgcgccgccaugcuccgcgccaucucccaggcccccuaccucggcggcgucggcuccgccggcaccgcccuccuccacaucuacgacaaggucaugaccguccagcgcggcgcccgccccggcguccccaaggccgucgucguccucaccggcggccgcggcgccgaggacgccgccguccccgcccagaagcuccgcaacaacggcaucuccguccucgucgucggcgucggccccguccucuccgagggccuccgccgccucgccggcccccgcgacucccucauccacgucgccgccuacgccgaccuccgcuaccaccaggacguccucaucgaguggcucugcggcgaggccaagcagcccgucaaccucugcaagcccucccccugcaugaacgagggcuccugcguccuccagaacggcuccuaccgcugcaagugccgcgacggcugggagggcccccacugcgagaaccgcuuccuccgccgccccuga

SEQ ID NO: 51710 - RNA, 3555 nt, Artificial Sequence
  derived and/or modified sequence opt2 from VWA3A__Homo_sapiens__NP_775886
augaagaaguaccgcaagaucuccaucggcugcuucgccauggccacccagaccucccacgucuuccacggccaggagaacauguuccucgagaaccacugcauccgccgcaacaccggccgcgacuccaagaagccccucaagcagaagaacaugaacggccucggccagaacuccgacaacggccuccucgucacccacgucaaccagacccaggaccuccuccgccuccagggcuccgagacccaguccuccgacugggaggacuccgaggacuggcucuccgcccacucccucaagugccagaagcucacccucgccgaccucaucucccagggcaccgagguccucgaggagggcaccaacgucguccagaagaucugcuucuccacccagaucauccgccacuucgaguccaagcucuccgacaccaucgaggucuaccaggagcgcauccaguggcucaccgagaacuccaagaaggccuucggccucaucaagggcgcccgcgucuccauccucaucgacgucuccgccaucuccuccggcccccagaaggaggaguuccagaaggaccucaugucccucaucgacgagcagcucucccacaaggagaagcucuucguccucuccuucggcaccaacgccggcucccucuggcccgaccccauggaggucuccgccuccacccuccaggagcucaagcucugggucaagacccuccagcccgacggcggcuccaaccuccuccaggcccucaagaagaucuucacccucaagggccucgacucccucgucgccaucaugcgcuccugccccgaccagcccuccgagauccucuccgacuacauccagcaguccaccaugggccgcgaccucaucauccacuucaucaccuaccgcugcgacgaccagaugccccccgccguccucaagaaccucgccgaggccguccgcggcuacuaccacugcuacucccccaagauggagcacuacaccucccgcgacauggacgagcuccucgccgagauccagaaggcccagucccuccucucccacguccaggcccuccagcacuccucccccugcgaggcccucaccugcaccauggaggagaucuccaccgagaucaccaacggcccccucaucucccuccuccccaagccccccaagcacgacgccccccucaccaucgaguuccccaaccucgacaagaccuccgccgaguggcucaaggucaacggccucaaggccaagaagcucucccucuaccagguccucgcccccaacgccuucucccccgucgaggaguucguccccauccuccagaagaccgucuccuccaccauccacgagaaggccaugauccaguucgaguggcacgacggcaccgucaagaacauccacgucgacccccccuuccucuacaaguaccagcagcagcucucccgcgccaugcgcauguacgagcgccgcaucgaguggcucucccucgccucccgccgcaucuggggcaccgucugcgagaagcgcgucgucguccuccucgacaucuccgccaccaacuccauguacaucauccacauccagcacucccuccgccuccuccucgaggagcagcucuccaacaaggacugcuucaaccucaucgccuucggcuccaccaucgaguccuggcgccccgagaugguccccgucucccacaacaaccuccaguccgccuggcgcugggcccucaaccuccgcugccgcggcucccgcaacguccucuccgcccuccgcaaggccgucgaggucgacuucaaggacaaggacaagcaccagucccagggcaucuaccucuucaccggcggcauccccgaccaggacaugcccacccucuccgccuacauggccgaggccugcggcggcugcgaccuccagcucaacgucugccucuucuacgucggcgagcccaagauggacaccaccccccccgcccgcuacgccucccacaccgacaccgccgccgccuacaaggaggucacccgcgccgccggcggccgcuuccacugguucggcgacaccggcaucuacgaguccgacgacaucaacuccaucauguccgagauggagaaggcccucaacuacucccagaagugcgccuuccucauggccucccucaagaaccacuccggcaagguccucggcuccuccgcccuccccaaggagaagcccaagacccuccagcuccgcucccagcccaagaagcucugccccccccgccccaccgucccccucggcgcccgcauguccaucaaggacgaccccgaccgcgagaagucccccccccucaagucccucaaguggcgcccccucuccucccgcgucggcaucucccccgccgccgcccagcccaccaaggagggcaugauggagcuccgccgcaagaccaagucccgcgaggccgagaccucccuccuccucuucuacaccgagaagggcaacgacgucggcuccgucuacaagaaguacccccagggccgcggccuccgccgcaccuccuccuccaucgaccucccccgcaaggacaccgucugcuccucccaggagugggucgccaaguacggccucaagaagcucaagcucgagaucucccgcugcaugggccccaacugcacccaccagaaguccggccagcgcuccgccuccgccaagcacugcuccaucuuccccuccgucgagauccacggcgucguccgccacauccaguggaccccccgcgagauggaggucuacauccgccaccucgagaagguccuccgccgcuacguccagcgccuccaguggcuccucuccggcucccgccgccucuucggcaccguccucgaguccaaggucugcauccuccucgacaccuccggcuccaugggccccuaccuccagcaggucaagaccgagcucguccuccucaucugggagcagcuccgcaagugcugcgacuccuucaaccuccucuccuucgccgaguccuuccaguccuggcaggacacccucgucgagaccaccgacgccgccugccacgaggccaugcagugggucacccaccuccaggcccagggcuccaccuccauccuccaggcccuccucaaggccuucuccuuccacgaccucgagggccucuaccuccucaccgacggcaagcccgacaccuccugcucccucguccucaacgagguccagaagcuccgcgagaagcgcgacgucaagguccacaccaucucccucaacugcuccgaccgcgccgccgucgaguuccuccgcaagcucgccuccuucaccggcggccgcuaccacugccccgucggcgaggacacccucuccaagauccacucccuccucaccaagggcuucaucaacgagaaggaccccacccucccccccuucgagggcgacgaccuccgcauccucgcccaggagaucaccaaggcccgcuccuuccucuggcaggcccaguccuuccgcucccagcuccagaagaagaacgacgccgagcccaaggucacccucuccuga

SEQ ID NO: 51711 - RNA, 3885 nt, Artificial Sequence
  derived and/or modified sequence opt2 from VWA3B__Homo_sapiens__NP_659429
auggagaaguccggccccuccuccaccaucuccgagcagcagcuccagcgccaggagggcuggaucaacaccaagaccgaccucgccgagcagucccucaucuccuccgagaaguggcuccagcuccacggccucaaguccaacaagcucacccucaagcagauccucucccagaucggcuucccccacugcgaggacuacgucgccucccucggccgccccgucgccucccgcuacgccgacggccucuucccccagcucuaccgcgccgaggacggccgcgucuacaaccucaccgccaaguccgagcucaucuaccaguucgucgagcaccucacccaggccgucgaguccuacaagcagcgcauggacuggcucaccuccaagucccgccagaucuucggcgucauccucgagcagugcgucaccaucguccucgacuucggcggcauccucgagggcgagcucgaccucugccgcgaggcccucaccaugguccuccaggagcaggucgcccacaucaccgaguucaacaucauccgcgucucccaggagcccgucaaguggcaggagaacgccacccccgucaccgagcaguccaucgccaccgccaucuccugggucgagaagcucaccgucgagcucaccgucuccgaggccggccgccucgacgcccuccucgaggccggccgcgacaagaccaucgaguccaucuacuacuucgucgucggcgacguccccgaggaguccaaggagcuccuccuccagcgcgcccucgagauccccugccccgucuacaccgucuccuucaacgcccgcggcgagggcaccaucgccuuccucaaggaccucuccgccaagacccacucccgcuuccacgccuucgccgagcgcaccgagugcgucgaguuccccgccuucuccaccaaggacggcgacaacgucaugaccuggaacucccgcaagcucaagggcaagcucccccccggcgccggcguccgcgaggacgucuuccucgucuggcaggagauggaggaggccugcuccacccucgcccagauccagcgccucgucgccgagccccccaagcccgacgucgccaccgucgacugcgaguccgagaccaccuccgucgagaucgccuccaaccccgaggacaccugggacuccaagaccuggcuccagaaguacggccucaaggcccagaagcucucccucuacgacguccucgccgacugcuccuuccgccacgccgacggcgucgucgacaucaaggccaagcccgagaacgaguccguccagaccuccgccgagaccaacaagaagaccguccacgccaaguacugcucccgcuucguccacgcccccuggaaggacggcucccucguccacgucaacaucaccaaggagaagugcaagugguacuccgagcgcauccacaccgcccucgcccgcauccgccgccgcaucaaguggcuccaggacggcucccagucccucuucggccgccuccacaacgacugcaucuacauccucaucgacaccucccacuccaugaaguccaagcucgaccucgucaaggacaagaucauccaguucauccaggagcagcucaaguacaaguccaaguucaacuucgucaaguucgacggccaggccgucgccuggcgcgagcagcucgccgaggucaacgaggacaaccucgagcaggcccaguccuggauccgcgacaucaagaucggcuccuccaccaacacccucuccgcccucaagaccgccuucgccgacaaggagacccaggccaucuaccuccucaccgacggccgccccgaccagccccccgagaccgucaucgaccaggucaagcgcuuccaggagauccccaucuacaccaucuccuucaacuacaacgacgagaucgccaaccgcuuccucaaggaggucgccgcccucaccggcggcgaguuccacuucuacaacuucggcugcaaggaccccaccccccccgaggccguccagaacgaggaccucacccuccucgucaaggagauggagcagggccacuccgaccucgagaagaugcaggaccucuacuccgagucccucaucauggacuggugguacaacgccgagaaggacggcgacuccaagcaccagaaggagaucugcuccaugaucuccacccccgagaagugcgccaagccccaguccgacgucgacuccacccagaccuccucccucaacaugcucaagggccccuggggccucuccgaccagaagguccagaagaagaagguccuccacgccgaguccaccaagaccucccuccuccgcucccagauguccucccuccgcuccuccgccugcuccgagcgcaaggacggccucuccaacgccuccucccgccgcaccgcccucuccgacaaggagauguccauccuccucgccgaggaguggcucgacgacaaguccuccgagaaggucacccgcgagggcucccaggucuacgaccacgacuccuccgacgucuccuccgagaacuggcucaagaccuacggccucgucgccaagaagcucacccucauggacgcccucuccgucgccgccgucccccacuccuccaccuacguccccguccucgacaagcacgucgucuccaaggucuucgacgaggucuucccccucgcccacgucugcaacgacaccaacaagaugacccucaucaacccccagggcgccaagcucaacaucuacaagcgcaaggucgagcaggccauccaguccuacgagaagcgccucaacaagaucgucuggcgcgcccucucccaggaggagaaggagaagcucgacgccaacaagcccauccaguaccucgagaacaagaccguccucaaccaggcccucgagcgccucaacuggcccaucucccucaaggagcucuccaugcucgaguccgagauccucgccggcaagauguacauccagcaggccauggagcuccaggaggccgccaagaagaacuacgccaacaaggcccccggcgagcagcagaagcuccagggcaaccccaccaagaagaccaaguccaagcgccccgacccccucaagggccagaaggucaucgcccgcugcgacgagaacggcuucuacuuccccggcgucgucaagaagugcgucucccgcacccaggcccucgucggcuucuccuacggcgacaccaaggucgucuccaccuccuucaucacccccgucggcggcgccaugcccugcccccuccuccaggucggcgacuacgucuucgccaagaucgucauccccaagggcuucgacuucuacguccccgccaucgucaucgcccuccccaacaagcacgucgccaccgagaaguucuacaccguccucaagugcaacaaccgccgcgaguucugcccccgcuccgcccucaucaagaucucccagaacaaguacgcccucuccugcucccacaucaaguccccccccauccccgaggaccccgaggucgaggacgucgaggcccgcaacuccgccuuccucuucuggccccucaaggaggccgacacccaggacucccgcgagccccgccgcgagaagccccgccgcaagaagcgccccgccaagcagccccuccagcaggccgcccccuccgacuccgacggcuccucccacggcaucuccucccacggcuccugccagggcacccaccccgagccccgcaccgcccaccuccacuuccccgccgccggccgccucggccucuccucccacgccaucaucgccaccccccccccccgcgccgcccuccccugcacccuccaggccacccacuccuccaagggccuccgcuccguccccgagacccucuga

SEQ ID NO: 51712 - RNA, 2361 nt, Artificial Sequence
  derived and/or modified sequence opt2 from VWA5A__Homo_sapiens__NP_055437
augguccacuucugcggccuccucacccuccaccgcgagcccgucccccucaaguccaucuccgucuccgucaacaucuacgaguucgucgccggcgucuccgccacccucaacuacgagaacgaggagaaggucccccucgaggccuucuucgucuuccccauggacgaggacuccgccgucuacuccuucgaggcccucgucgacggcaagaagaucgucgccgagcuccaggacaagaugaaggcccgcaccaacuacgagaaggccaucucccagggccaccaggccuuccuccucgagggcgacuccuccucccgcgacgucuucuccugcaacgucggcaaccuccagcccggcuccaaggccgccgucacccucaaguacguccaggagcucccccucgaggccgacggcgcccuccgcuucguccuccccgccguccucaacccccgcuaccaguucuccggcuccuccaaggacuccugccucaacgucaagacccccaucguccccgucgaggaccuccccuacacccucuccauggucgccaccaucgacucccagcacggcaucgagaagguccaguccaacugcccccucucccccaccgaguaccucggcgaggacaagaccuccgcccaggucucccucgccgccggccacaaguucgaccgcgacgucgagcuccucaucuacuacaacgagguccacacccccuccgucguccucgagaugggcaugcccaacaugaagcccggccaccucaugggcgaccccuccgccauggucuccuucuaccccaacauccccgaggaccagcccuccaacaccugcggcgaguucaucuuccucauggaccgcuccggcuccaugcagucccccauguccucccaggacaccucccagcuccgcauccaggccgccaaggagacccucauccuccuccucaagucccuccccaucggcugcuacuucaacaucuacggcuucggcuccuccuacgaggccugcuuccccgaguccgucaaguacacccagcagaccauggaggaggcccucggccgcgucaagcucaugcaggccgaccucggcggcaccgagauccucgccccccuccagaacaucuaccgcggccccuccauccccggccacccccuccagcucuucgucuucaccgacggcgaggucaccgacaccuucuccgucaucaaggagguccgcaucaaccgccagaagcaccgcugcuucuccuucggcaucggcgagggcaccuccaccucccucaucaagggcaucgcccgcgccuccggcggcaccuccgaguucaucaccggcaaggaccgcaugcaguccaaggcccuccgcacccucaagcgcucccuccagcccgucgucgaggacgucucccucuccuggcaccucccccccggccucuccgccaagaugcucucccccgagcagaccgucaucuuccgcggccagcgccucaucuccuacgcccagcucaccggccgcaugcccgccgccgagaccaccggcgaggucugccucaaguacacccuccagggcaagaccuucgaggacaaggucaccuucccccuccagcccaagcccgacgucaaccucaccauccaccgccucgccgccaagucccuccuccagaccaaggacaugggccuccgcgagacccccgccuccgacaagaaggacgcccucaaccucucccucgaguccggcgucaucuccuccuucaccgccuucaucgccaucaacaaggagcucaacaagcccguccagggcccccucgcccaccgcgacgucccccgccccauccuccucggcgccuccgccccccucaagaucaagugccaguccggcuuccgcaaggcccuccacuccgaccgcccccccuccgccucccagccccgcggcgagcucaugugcuacaaggccaagaccuuccagauggacgacuacucccucugcggccucaucucccacaaggaccagcacucccccggcuucggcgagaaccaccucguccagcucaucuaccaccagaacgccaacggcuccugggaccucaacgaggaccucgccaagauccucggcaugucccucgaggagaucauggccgcccagcccgccgagcucgucgacuccuccggcugggccaccauccucgccgucaucuggcuccacuccaacggcaaggaccucaagugcgagugggagcuccucgagcgcaaggccgucgccuggaugcgcgcccacgccggcuccaccaugcccuccgucgucaaggccgccaucaccuuccucaaguccuccgucgaccccgccaucuucgccuucuga

SEQ ID NO: 51713 - RNA, 3648 nt, Artificial Sequence
  derived and/or modified sequence opt2 from VWA5B1__Homo_sapiens__XP_011538989
augcccggccuccucaacuggaucaccggcgccgcccucccccucaccgccuccgacgucaccuccugcgucuccggcuacgcccucggccucaccgccucccucaccuacggcaaccucgaggcccagcccuuccagggccucuucgucuacccccucgacgagugcaccaccgucaucggcuucgaggccgucaucgccgaccgcgucgucaccguccagaucaaggacaaggccaagcucgaguccggccacuucgacgccucccacguccgcucccccaccgucaccggcaacauccuccaggacggcgucuccaucgccccccacuccugcacccccggcaaggucacccucgacgaggaccucgagcgcauccucuucgucgccaaccucggcaccaucgcccccauggagaacgucaccaucuucaucuccaccuccuccgagcuccccacccuccccuccggcgccguccgcguccuccuccccgccgucugcgcccccaccgucccccaguucugcaccaaguccaccggcaccuccaaccagcaggcccagggcaaggaccgccacugcuucggcgccugggcccccggcuccuggaacaagcucugccucgccacccuccucaacaccgaggucuccaaccccauggaguacgaguucaacuuccagcucgagauccgcggccccugccuccucgccggcgucgagucccccacccacgagauccgcgccgacgccgcccccuccgcccgcuccgccaaguccaucaucaucacccucgccaacaagcacaccuucgaccgccccgucgagauccucauccaccccuccgagccccacaugccccacguccucaucgagaagggcgacaugacccucggcgaguucgaccagcaccucaagggccgcaccgacuucaucaagggcaugaagaagaagucccgcgccgagcgcaagaccgagaucauccgcaagcgccuccacaaggacaucccccaccacuccgucaucaugcucaacuucugccccgaccuccaguccguccagcccugccuccgcaaggcccacggcgaguucaucuuccucaucgaccgcuccuccuccauguccggcaucuccaugcaccgcgucaaggacgccaugcucgucgcccucaagucccucaugcccgccugccucuucaacaucaucggcuucggcuccaccuucaagucccucuuccccuccucccagaccuacuccgaggacucccucgccauggccugcgacgacauccagcgcaugaaggccgacaugggcggcaccaacauccucuccccccucaagugggucauccgccagcccguccaccgcggccacccccgccuccucuucgucaucaccgacggcgccgucaacaacaccggcaagguccucgagcucguccgcaaccacgccuucuccacccgcugcuacuccuucggcaucggccccaacgucugccaccgccucgucaagggccucgccuccgucuccgagggcuccgccgagcuccucauggagggcgagcgccuccagcccaagauggucaagucccucaagaaggccauggcccccguccucuccgacgucaccgucgaguggaucuuccccgagaccaccgagguccucgucucccccgucuccgccuccucccucuuccccggcgagcgccucgucggcuacggcaucgucugcgacgccucccuccacaucuccaacccccgcuccgacaagcgccgccgcuacuccaugcuccacucccaggaguccggcuccuccgucuucuaccacucccaggacgacggccccggccucgagggcggcgacugcgccaagaacuccggcgcccccuucauccucggccaggccaagaacgcccgccucgccuccggcgacuccaccaccaagcacgaccucaaccucucccagcgccgccgcgccuacuccaccaaccagaucaccaaccacaagccccucccccgcgccaccauggccuccgaccccaugcccgccgccaagcgcuacccccuccgcaaggcccgccuccaggaccucaccaaccagaccucccucgacguccagcgcuggcagaucgaccuccagccccuccucaacuccggccaggaccucaaccagggccccaagcuccgcggccccggcgcccgccgccccucccuccucccccagggcugccagcccuuccuccccuggggccaggagacccaggccuggucccccguccgcgagcgcaccuccgacucccgcucccccggcgaccucgagcccucccaccaccccuccgccuucgagaccgagaccuccuccgacugggacccccccgccgagucccaggagcgcgccucccccucccgccccgccacccccgcccccguccucggcaaggcccucgucaagggccuccacgacucccagcgccuccagugggaggucuccuucgagcucggcacccccggccccgagcgcggcggcgcccaggacgccgaccucugguccgagaccuuccaccaccucgccgcccgcgccaucauccgcgacuucgagcagcucgccgagcgcgagggcgagaucgagcagggcuccaaccgccgcuaccaggucuccgcccuccacaccuccaaggccugcaacaucaucuccaaguacaccgccuucguccccgucgacgucuccaagucccgcuaccuccccaccgucgucgaguaccccaacuccggcgccgcccuccgcaugcucggcucccgcgcccucgcccagcaguggcgcggcaccuccuccggcuucggccgcccccagaccaugcucggcgaggacuccgcccccggcaacgacauggaggccucccccaccgcccucuucuccgaggcccgcucccccggccgcgagaagcacggcgccuccgagggcccccagcgcucccucgccaccaacacccucuccuccaugaaggccuccgagaaccucuucggcuccuggcucaaccucaacaagucccgccuccucacccgcgccgccaagggcuuccucuccaagccccucaucaaggccgucgaguccaccuccggcaaccaguccuucgacuacaucccccucgucucccuccagcucgccuccggcgccuuccuccucaacgaggccuucugcgaggccacccacauccccauggagaagcucaaguggaccucccccuucaccugccaccgcgucucccucaccacccgccccuccgaguccaagacccccuccccccagcucugcaccuccucccccccccgccaccccuccugcgacuccuucucccucgagccccucgccaagggcaagcucggccucgagccccgcgccgucgucgagcacaccggcaagcucugggccaccgucgucggccucgccuggcucgagcacuccuccgccuccuacuucaccgagugggagcucgucgccgccaaggccaacuccuggcucgagcagcaggagguccccgagggccgcacccagggcacccucaaggccgccgcccgccagcucuucguccuccuccgccacugggacgagaaccucgaguucaacaugcucugcuacaaccccaacuacgucuga

SEQ ID NO: 51714 - RNA, 2676 nt, Artificial Sequence
  derived and/or modified sequence opt2 from VWA7__Homo_sapiens__NP_079534
augcuccccaccgaggucccccagucccaccccggccccuccgcccuccuccuccuccagcuccuccucccccccaccuccgccuucuuccccaacaucuggucccuccucgccgcccccggcuccaucacccaccaggaccucaccgaggaggccgcccucaacgucacccuccagcucuuccucgagcagcccccccccggccgccccccccuccgccucgaggacuuccucggccgcacccuccucgccgacgaccucuucgccgccuacuucggccccggcuccucccgccgcuuccgcgccgcccucggcgaggucucccgcgccaacgccgcccaggacuuccuccccaccucccgcaacgaccccgaccuccacuucgacgccgagcgccucggccagggccgcgcccgccucgucggcgcccuccgcgagaccgucgucgccgcccgcgcccucgaccacacccucgcccgccagcgccucggcgccgcccuccacgcccuccaggacuucuacucccacuccaacugggucgagcucggcgagcagcagccccacccccaccuccucuggccccgccaggagcuccagaaccucgcccaggucgccgaccccaccugcuccgacugcgaggagcucuccugcccccgcaacuggcucggcuucacccuccucaccuccggcuacuucggcacccacccccccaagccccccggcaagugcucccacggcggccacuucgaccgcuccuccucccagcccccccgcggcggcaucaacaaggacuccaccucccccggcuucuccccccaccacaugcuccaccuccaggccgccaagcucgcccuccucgccuccauccaggccuucucccuccuccgcucccgccucggcgaccgcgacuucucccgccuccucgacaucacccccgccuccucccucuccuucguccucgacaccaccggcuccaugggcgaggagaucaacgccgccaagauccaggcccgccaccucgucgagcagcgccgcggcucccccauggagcccguccacuacguccucguccccuuccacgaccccggcuucggccccgucuucaccaccuccgaccccgacuccuucuggcagcagcucaacgagauccacgcccucggcggcggcgacgagcccgagaugugccucuccgcccuccagcucgcccuccuccacacccccccccucuccgacaucuucgucuucaccgacgccucccccaaggacgccuuccucaccaaccaggucgagucccucacccaggagcgccgcugccgcgucaccuuccucgucaccgaggacaccucccgcguccagggccgcgcccgccgcgagauccucuccccccuccgcuucgagcccuacaaggccgucgcccucgccuccggcggcgaggucaucuucaccaaggaccagcacauccgcgacgucgccgccaucgucggcgaguccauggccgcccucgucacccucccccucgacccccccgucgucguccccggccagccccucgucuucuccgucgacggccuccuccagaagaucaccguccgcauccacggcgacaucuccuccuucuggaucaagaaccccgccggcgucucccagggccaggaggagggcggcggcccccucggccacacccgccgcuucggccaguucuggauggucaccauggacgaccccccccagaccggcaccugggagauccaggucaccgccgaggacacccccggcguccgcguccaggcccagaccucccucgacuuccucuuccacuucggcauccccauggaggacggcccccaccccggccucuacccccucacccagcccgucgccggccuccagacccagcuccucgucgaggucaccggccucggcucccgcgccaaccccggcgacccccagccccacuucucccacgucauccuccgcggcguccccgagggcgccgagcucggccaggucccccucgagcccgucggcccccccgagcgcggccuccucgccgccucccucucccccacccuccucuccaccccccgccccuucucccucgagcucaucggccaggacgccgccggccgccgccuccaccgcgccgccccccagcccuccaccgucguccccguccuccucgagcucuccggccccuccggcuuccucgcccccggcuccaaggucccccucucccuccgcaucgccuccuucuccggcccccaggaccucgaccuccgcaccuucgucaaccccuccuucucccucaccuccaaccucucccgcgcccaccucgagcucaacgaguccgccuggggccgccucuggcucgagguccccgacuccgccgcccccgacuccgucgucauggucaccgucaccgccggcggccgcgaggccaaccccgucccccccacccacgccuuccuccgccuccucgucuccgcccccgccccccaggaccgccacaccacccccaccggcuccuccgaccccauccucaccaccgccacccccgccuucucccccuucacccucgucacccagggccgcgccggcgccggccucgccgccggcucccccugguggggcaccgucggcggcguccuccuccuccucggccucgccuccugguga

SEQ ID NO: 51715 - RNA, 3120 nt, Artificial Sequence
  derived and/or modified sequence opt2 from VWA8__Homo_sapiens__NP_001009814
augcagucccgccuccuccuccucggcgcccccggcggccacggcggccccgccucccgccgcaugcgccuccuccuccgccaggucguccagcgccgccccggcggcgaccgccagcgccccgagguccgccuccuccacgccggcuccggcgccgacaccggcgacaccgucaacaucggcgacgucuccuacaagcucaagauccccaagaaccccgagcucgucccccagaacuacaucuccgacucccucgcccaguccgucguccagcaccuccgcuggaucaugcagaaggaccuccucggccaggacgucuuccucaucggcccccccggcccccuccgccgcuccaucgccaugcaguaccucgagcucaccaagcgcgaggucgaguacaucgcccucucccgcgacaccaccgagaccgaccucaagcagcgccgcgagauccgcgccggcaccgccuucuacaucgaccagugcgccguccgcgccgccaccgagggccgcacccucauccucgagggccucgagaaggccgagcgcaacguccuccccguccucaacaaccuccucgagaaccgcgagaugcagcucgaggacggccgcuuccucauguccgccgagcgcuacgacaagcuccuccgcgaccacaccaagaaggagcucgacuccuggaagaucguccgcgucuccgagaacuuccgcgucaucgcccucggccuccccgucccccgcuacuccggcaacccccucgaccccccccuccgcucccgcuuccaggcccgcgacaucuacuaccuccccuucaaggaccagcucaagcuccucuacuccaucggcgccaacgucuccgccgagaaggucucccagcuccucuccuucgccaccacccucugcucccaggaguccuccacccucggccuccccgacuucccccucgacucccucgccgccgccguccagauccucgacuccuuccccaugaugcccaucaagcacgccauccaguggcucuaccccuacuccauccuccucggccacgagggcaagauggccgucgagggcguccucaagcgcuucgagcuccaggacuccggcuccucccuccuccccaaggagaucgucaaggucgagaagaugauggagaaccacgucucccaggccuccgucaccauccgcaucgccgacaaggaggucaccaucaagguccccgccggcacccgccuccucucccagcccugcgccuccgaccgcuucauccagacccucucccacaagcagcuccaggccgagaugaugcagucccacauggucaaggacaucugccucaucggcggcaagggcugcggcaagaccgucaucgccaagaacuucgccgacacccucggcuacaacaucgagcccaucaugcucuaccaggacaugaccgcccgcgaccuccuccagcagcgcuacacccuccccaacggcgacaccgccuggcgcuccuccccccucgucaacgccgcccucgagggcaagcucguccuccucgacggcauccaccgcgucaacgccggcacccucgccguccuccagcgccucauccacgaccgcgagcucucccucuacgacggcucccgccuccuccgcgaggaccgcuacaugcgccucaaggaggagcuccagcucuccgacgagcagcuccagaagcgcuccaucuuccccauccaccccuccuuccgcaucaucgcccucgccgagccccccgucaucggcuccaccgcccaccaguggcucggccccgaguuccucaccauguucuucuuccacuacaugaagccccucgucaaguccgaggagauccaggucaucaaggagaagguccccaacgucccccaggaggcccucgacaagcuccucuccuucacccacaagcuccgcgagacccaggaccccaccgcccagucccucgccgccucccucuccacccgccagcuccuccgcaucucccgccgccucucccaguaccccaacgagaaccuccacuccgccgucaccaaggccugccucucccgcuuccuccccucccucgcccgcuccgcccucgagaagaaccucgccgacgccaccaucgagaucaacaccgacgacaaccucgagcccgagcucaaggacuacaagugcgaggucaccuccggcacccuccgcaucggcgccgucuccgcccccaucuacaacgcccacgagaagaugaagguccccgacguccucuucuacgacaacauccagcacgucaucgucauggaggacaugcucaaggacuuccuccucggcgagcaccuccuccucgucggcaaccagggcgucggcaagaacaagaucgucgaccgcuuccuccaccuccucaaccgcccccgcgaguacauccagcuccaccgcgacaccaccguccagacccucacccuccagcccuccgucaaggacggccucaucgucuacgaggacuccccccucgucaaggccgucaagcucggccacauccucgucgucgacgaggccgacaaggcccccaccaacgucaccugcauccucaagacccucgucgagaacggcgagaugauccucgccgacggccgccgcaucgucgccaacuccgccaacgucaacggccgcgagaacgucgucgucauccaccccgacuuccgcaugaucguccucgccaaccgccccggcuuccccuuccucggcaacgacuucuucggcacccucggcgacaucuucuccugccacgccgucgacaaccccaagccccacuccgagcucgagaugcuccgccaguacggccccaacguccccgagcccauccuccagaagcucgucgccgccuucggcgagcuccgcucccucgccgaccagggcaucaucaacuaccccuacuccacccgcgaggucgucaacaucgucaagcaccuccagaaguuccccaccgagggccucuccuccgucguccgcaacgucuucgacuucgacuccuacaacaacgacaugcgcgagauccucaucaacacccuccacaaguacggcauccccaucggcgccaagcccaccuccguccagcucgccaaggaguga

SEQ ID NO: 51716 - RNA, 2868 nt, Artificial Sequence
  derived and/or modified sequence opt2 from VWCE__Homo_sapiens__NP_689931
augugggccggccuccuccuccgcgccgccugcgucgcccuccuccuccccggcgcccccgcccgcggcuacaccggccgcaagccccccggccacuucgccgccgagcgccgccgccucggcccccacgucugccucuccggcuucggcuccggcugcugccccggcugggcccccuccaugggcggcggccacugcacccucccccucugcuccuucggcugcggcuccggcaucugcaucgcccccaacgucugcuccugccaggacggcgagcagggcgccaccugccccgagacccacggccccugcggcgaguacggcugcgaccucaccugcaaccacggcggcugccaggaggucgcccgcgucugccccgucggcuucuccaugaccgagaccgccgucggcauccgcugcaccgacaucgacgagugcgucaccuccuccugcgagggccacugcgucaacaccgagggcggcuucgucugcgagugcggccccggcaugcagcucuccgccgaccgccacuccugccaggacaccgacgagugccucggcacccccugccagcagcgcugcaagaacuccaucggcuccuacaagugcuccugccgcaccggcuuccaccuccacggcaaccgccacuccugcgucgacgucaacgagugccgccgcccccucgagcgccgcgucugccaccacuccugccacaacaccgucggcuccuuccucugcaccugccgccccggcuuccgccuccgcgccgaccgcgucuccugcgaggccuuccccaaggccguccucgcccccuccgccauccuccagccccgccagcaccccuccaagaugcuccuccuccuccccgaggccggccgccccgcccucucccccggccacuccccccccuccggcgcccccggcccccccgccggcguccgcaccacccgccuccccucccccaccccccgccuccccaccuccucccccuccgcccccgucuggcuccucuccacccuccucgccacccccguccccaccgccucccuccucggcaaccuccgcccccccucccuccuccagggcgaggucaugggcacccccuccuccccccgcggccccgaguccccccgccucgccgccggccccucccccugcuggcaccucggcgccaugcacgagucccgcucccgcuggaccgagcccggcugcucccagugcuggugcgaggacggcaaggucaccugcgagaagguccgcugcgaggccgccugcucccaccccauccccucccgcgacggcggcugcugccccuccugcaccggcugcuuccacuccggcgucguccgcgccgagggcgacgucuucuccccccccaacgagaacugcaccgucugcgucugccucgccggcaacgucuccugcaucucccccgagugccccuccggccccugccagacccccccccagaccgacugcugcaccugcguccccguccgcugcuacuuccacggccgcugguacgccgacggcgccgucuucuccggcggcggcgacgagugcaccaccugcgucugccagaacggcgaggucgagugcuccuucaugcccugccccgagcucgccugcccccgcgaggaguggcgccucggccccggccagugcugcuucaccugccaggagcccacccccuccaccggcugcucccucgacgacaacggcgucgaguuccccaucggccagaucuggucccccggcgaccccugcgagcucugcaucugccaggccgacggcuccgucuccugcaagcgcaccgacugcgucgacuccugcccccaccccauccgcauccccggccagugcugccccgacugcuccgccggcugcaccuacaccggccgcaucuucuacaacaacgagaccuuccccuccguccucgaccccugccucuccugcaucugccuccucggcuccgucgccugcucccccgucgacugccccaucaccugcaccuaccccuuccaccccgacggcgagugcugccccgucugccgcgacugcaacuacgagggccgcaaggucgccaacggccaggucuucacccucgacgacgagcccugcacccgcugcaccugccagcucggcgaggucuccugcgagaagguccccugccagcgcgccugcgccgaccccgcccuccuccccggcgacugcugcuccuccugccccgacucccucuccccccucgaggagaagcagggccucuccccccacggcaacgucgccuucuccaaggccggccgcucccuccacggcgacaccgaggcccccgucaacugcuccuccugccccggcccccccaccgccucccccucccgccccguccuccaccuccuccagcuccuccuccgcaccaaccucaugaagacccagacccuccccaccucccccgccggcgcccacggcccccacucccucgcccucggccucaccgccaccuuccccggcgagcccggcgccuccccccgccucucccccggccccuccaccccccccggcgcccccacccucccccucgccucccccggcgccccccagcccccccccgucacccccgagcgcuccuucuccgccuccggcgcccagaucgucucccgcuggcccccccuccccggcacccuccucaccgaggccuccgcccucuccaugauggaccccucccccuccaagacccccaucacccuccucggcccccgcguccucucccccaccaccucccgccucuccaccgcccucgccgccaccacccaccccggcccccagcagccccccgucggcgccucccgcggcgaggaguccaccauguga

SEQ ID NO: 51717 - RNA, 4773 nt, Artificial Sequence
  derived and/or modified sequence opt2 from VWDE__Homo_sapiens__NP_001129396
augcccggcggcgccugcguccucgucaucgcccucauguuccucgccuggggcgaggcccaggagugcucccccggcggccaccaguuccuccgcucccccuaccgcuccguccgcuucgacuccuggcaccuccagcaguccgccguccaggaccucaucugcgaccacucccucucccccggcugguaccgcuuccucauccucgaccgccccgccgagaugcccaccaagugcgucgagaugaaccacugcggcacccaggcccccaucuggcucucccuccgcgacuccgagacccuccccucccccggcgagaucaagcagcucaccgccugcgccaccuggcaguuccucuucuccaccaccaaggacugcugccucuuccagauccccgucuccguccgcaacugcggcaacuucuccgucuaccuccuccagcccacccagggcugcaugggcuacugcgccgaggccaucuccgacgcccgccuccaccccugcggcuccgacgagaccgagaccggcggcgacugcguccgccagcucgccgccucccucccccccccccccgccggccgccccgagguccucgucgagcucaucgagucccgccucuucugccgcugcuccuucgacguccccgccaccaagaacuccgucggcuuccacaucgccuggucccgccucuccucccaggaggucaaggaggagcucacccaggagaccaccguccaggccuucucccuccucgagcucgacggcaucaaccuccgccucggcgaccgcaucuucugcuccgccuccgucuucuuccucgagaacccccacguccaguccgucgccaucgagucccaggaguucuucgccggcuucaagcuccagcccgagcucuccaccaucuccgaggacggcaaggaguacuaccuccgcaucgaguccaccguccccaucaucugcuccgaguucuccgagcucgaccaggagugcaagaucucccucaagcucaagaccaucggccagggccgcgagcaccucggccucaaccucgcccucuccuccugccacgucgaccuccuccagaccuccuccugcgccaacggcaccugcucccacaccuucgucuacuacaccgccgucaccgacuucucccgcgacggcgaccgcgucuccaacaucgucguccagcccaucgucaacgaggacuuccucuggaacaacuacauccccgacuccauccagaucaaggucaaggacguccccaccgccuacugcuacaccuucaccgacccccacaucaucaccuucgacggccgcgucuacgacaacuucaagaccggcaccuucguccucuacaaguccaugucccgcgacuucgagguccacguccgccagugggacugccgcucccuccacuaccccgucuccugcaacugcggcuucgucgcccaggagggcggcgacaucgucaccuucgacaugugcaacggccagcuccgcgagucccagcccuaccucuucaucaagucccaggacgucacccgcaacaucaagaucuccgaguccuaccucggccgcaaggucaccaucugguucuccuccggcgccuucauccgcgccgaccucggcgaguggggcaugucccucaccauccgcgcccccuccgucgacuaccgcaacacccucggccucugcggcaccuucgacgagaaccccgagaacgacuuccacgacaagaacggcaugcagaucgaccagaacuucaacaacuacgucgccuucaucaacgaguggcgcauccuccccggcaaguccauguccgacacccuccccgucuccaugaccucccccggcaagcccuccuacugcuccugcucccucgacaccgccgccuaccccuccuccgaggaccucgacuccgucucccgcuccgagaucgcccucggcugcaaggaccucaaccacgucucccucuccucccucauccccgagcucgacgucaccuccgaguacaucaacuccgacacccucguccgcgagaucaacaagcacaccucccccgaggaguacaaccucaaccucuuccuccaggagaagaagcacaucaaccucaccaagcucggccucaacguccagaagcaccccggcaacgagaaggaggacucccuccaguaccucgccaacaagaaguacacccagggccgcggcucccacucccaggagaugcgcuacaaccgccagaaccgcuggaagcgccagaacuuccacgaguuccccccccucuucgccuuccccucccucucccagaccgaccucgaggagcucaccuacuucuuccccgaggaccacgccgaggacguccagcaggaguucuuccccuccuggcccacccccuccggccucaccgaguacuccacccucacccucugccaggagacccucgccaacuccuccaucggccgccucugccucgccuuccucggcaagcgccucgacuccgucaucgagaugugcgucaaggacguccuccucaaggacgaccucuccugggccgaggccggcgucgcccuccucgagaacgagugcgagaagcgcaucgucgaggagggcaaguacaacaccgaggaguacggcaccuccaucgaggacauccucuccguccucaagugccccaaccucugcuccggcaacggccagugcauggaguggggcugcgccugcucccccuccuucuccuccuacgacugcuccgacuccuacgacaaggcccccgagaucaccgagcucggcaacgccggcuucugcgacguccagaaguacaacugcaugaugguccgcgucuucggcaagggcuucaaggagcuccccuccaucaagugcgaggucaccaagcuccaguacaacuccuccgaguggaugcccggcgagcccaucuacacccagaccgucuuccacaacucccgcgccgucgacugccagcuccccaccgacguccagcaguucgacaccauggaccucgucggcggcaagcccaccggcaaguggcagcucaaggucuccaacgacggcuacaaguucuccaaccccaagaucaccgucaucuacgacggcgccugccaggucugcggccucuacaagaacgacuccugcaccaucaaggagaacgucugcaucaucgacggccucugcuacgucgagggcgacaagaaccccaccucccccugccucaucugccgccccaagaucucccgcuucaccugguccuuccucgagaacaaccagccccccgucauccaggcccuccaggacaagcuccagaccuucuacggcgagaacuucgaguaccaguucgucgccuucgaccccgagggcuccgacauccacuucacccucgacuccggccccgagggcgccuccgucuccuccgccggccucuucauguggaagaccgaccuccucaccacccagcagaucaccguccgccucaacgacgacugcgacgccgagacccgcgucaccaucgaggucaccgucaaguccugcgacugccucaacggcggcuccugcgucuccgaccgcaacuucucccccggcuccggcgucuaccucugcgucugccuccccggcuuccacggcucccucugcgaggucgacaucuccggcugccaguccaaccccugcggccucggcuccuacaucuccggcuuccacuccuacuccugcgacugcccccccgagcucaaggucgagacccaguucgucaaccaguucaccacccagaccgucguccucacccgcuccgacaaguccgucaacaaggaggaggacgacaagaacgcccagggccgcaagcgccacgucaagcccaccuccggcaacgccuucaccaucugcaaguaccccugcggcaagucccgcgagugcgucgcccccaacaucugcaagugcaagcccggcuacaucggcuccaacugccagaccgcccucugcgaccccgacugcaagaaccacggcaagugcaucaagcccaacaucugccagugccuccccggccacggcggcgccaccugcgacgaggagcacugcaacccccccugccagcacggcggcaccugccucgccggcaaccucugcaccugccccuacggcuucgucggcccccgcugcgagaccauggucugcaaccgccacugcgagaacggcggccagugccucacccccgacaucugccagugcaagcccggcugguacggccccaccugcuccaccgcccucugcgaccccgucugccucaacggcggcuccugcaacaagcccaacaccugccucugccccaacggcuucuucggcgagcacugccagaacgccuucugccacccccccugcaagaacggcggccacugcaugcgcaacaacgucugcgucugccgcgagggcuacaccggccgccgcuuccagaaguccaucugcgaccccaccugcaugaacggcggcaagugcgucggccccuccaccugcuccugccccuccggcugguccggcaagcgcugcaacacccccaucugccuccagaagugcaagaacggcggcgagugcaucgcccccuccaucugccacugccccuccuccugggagggcguccgcugccagauccccaucugcaaccccaagugccucuacggcggccgcugcaucuuccccaacgucugcuccugccgcaccgaguacuccggcgucaagugcgagaagaagauccagauccgccgccacuga

SEQ ID NO: 51718 - RNA, 8442 nt, Artificial Sequence
  derived and/or modified sequence opt2 from VWF__Homo_sapiens__NP_000543
augauccccgcccgcuucgccggcguccuccucgcccucgcccucauccuccccggcacccucugcgccgagggcacccgcggccgcuccuccaccgcccgcugcucccucuucggcuccgacuucgucaacaccuucgacggcuccauguacuccuucgccggcuacugcuccuaccuccucgccggcggcugccagaagcgcuccuucuccaucaucggcgacuuccagaacggcaagcgcgucucccucuccgucuaccucggcgaguucuucgacauccaccucuucgucaacggcaccgucacccagggcgaccagcgcgucuccaugcccuacgccuccaagggccucuaccucgagaccgaggccggcuacuacaagcucuccggcgaggccuacggcuucgucgcccgcaucgacggcuccggcaacuuccagguccuccucuccgaccgcuacuucaacaagaccugcggccucugcggcaacuucaacaucuucgccgaggacgacuucaugacccaggagggcacccucaccuccgaccccuacgacuucgccaacuccugggcccucuccuccggcgagcaguggugcgagcgcgccuccccccccuccuccuccugcaacaucuccuccggcgagaugcagaagggccucugggagcagugccagcuccucaaguccaccuccgucuucgcccgcugccacccccucgucgaccccgagcccuucgucgcccucugcgagaagacccucugcgagugcgccggcggccucgagugcgccugccccgcccuccucgaguacgcccgcaccugcgcccaggagggcaugguccucuacggcuggaccgaccacuccgccugcucccccgucugccccgccggcauggaguaccgccagugcgucucccccugcgcccgcaccugccagucccuccacaucaacgagaugugccaggagcgcugcgucgacggcugcuccugccccgagggccagcuccucgacgagggccucugcgucgaguccaccgagugccccugcguccacuccggcaagcgcuacccccccggcaccucccucucccgcgacugcaacaccugcaucugccgcaacucccaguggaucugcuccaacgaggagugccccggcgagugccucgucaccggccagucccacuucaaguccuucgacaaccgcuacuucaccuucuccggcaucugccaguaccuccucgcccgcgacugccaggaccacuccuucuccaucgucaucgagaccguccagugcgccgacgaccgcgacgccgucugcacccgcuccgucaccguccgccuccccggccuccacaacucccucgucaagcucaagcacggcgccggcgucgccauggacggccaggacguccagcucccccuccucaagggcgaccuccgcauccagcacaccgucaccgccuccguccgccucuccuacggcgaggaccuccagauggacugggacggccgcggccgccuccucgucaagcucucccccgucuacgccggcaagaccugcggccucugcggcaacuacaacggcaaccagggcgacgacuuccucacccccuccggccucgccgagccccgcgucgaggacuucggcaacgccuggaagcuccacggcgacugccaggaccuccagaagcagcacuccgaccccugcgcccucaacccccgcaugacccgcuucuccgaggaggccugcgccguccucaccucccccaccuucgaggccugccaccgcgccgucuccccccuccccuaccuccgcaacugccgcuacgacgucugcuccugcuccgacggccgcgagugccucugcggcgcccucgccuccuacgccgccgccugcgccggccgcggcguccgcgucgccuggcgcgagcccggccgcugcgagcucaacugccccaagggccaggucuaccuccagugcggcacccccugcaaccucaccugccgcucccucuccuaccccgacgaggagugcaacgaggccugccucgagggcugcuucugcccccccggccucuacauggacgagcgcggcgacugcguccccaaggcccagugccccugcuacuacgacggcgagaucuuccagcccgaggacaucuucuccgaccaccacaccaugugcuacugcgaggacggcuucaugcacugcaccauguccggcguccccggcucccuccuccccgacgccguccucuccuccccccucucccaccgcuccaagcgcucccucuccugccgcccccccauggucaagcucgucugccccgccgacaaccuccgcgccgagggccucgagugcaccaagaccugccagaacuacgaccucgagugcauguccaugggcugcgucuccggcugccucugcccccccggcaugguccgccacgagaaccgcugcgucgcccucgagcgcugccccugcuuccaccagggcaaggaguacgcccccggcgagaccgucaagaucggcugcaacaccugcgucugccgcgaccgcaaguggaacugcaccgaccacgucugcgacgccaccugcuccaccaucggcauggcccacuaccucaccuucgacggccucaaguaccucuuccccggcgagugccaguacguccucguccaggacuacugcggcuccaaccccggcaccuuccgcauccucgucggcaacaagggcugcucccaccccuccgucaagugcaagaagcgcgucaccauccucgucgagggcggcgagaucgagcucuucgacggcgaggucaacgucaagcgccccaugaaggacgagacccacuucgaggucgucgaguccggccgcuacaucauccuccuccucggcaaggcccucuccgucgucugggaccgccaccucuccaucuccgucguccucaagcagaccuaccaggagaaggucugcggccucugcggcaacuucgacggcauccagaacaacgaccucaccuccuccaaccuccaggucgaggaggaccccgucgacuucggcaacuccuggaaggucuccucccagugcgccgacacccgcaaggucccccucgacuccucccccgccaccugccacaacaacaucaugaagcagaccauggucgacuccuccugccgcauccucaccuccgacgucuuccaggacugcaacaagcucgucgaccccgagcccuaccucgacgucugcaucuacgacaccugcuccugcgaguccaucggcgacugcgccugcuucugcgacaccaucgccgccuacgcccacgucugcgcccagcacggcaaggucgucaccuggcgcaccgccacccucugcccccaguccugcgaggagcgcaaccuccgcgagaacggcuacgagugcgaguggcgcuacaacuccugcgcccccgccugccaggucaccugccagcaccccgagccccucgccugccccguccagugcgucgagggcugccacgcccacugcccccccggcaagauccucgacgagcuccuccagaccugcgucgaccccgaggacugccccgucugcgaggucgccggccgccgcuucgccuccggcaagaaggucacccucaaccccuccgaccccgagcacugccagaucugccacugcgacgucgucaaccucaccugcgaggccugccaggagcccggcggccucgucgucccccccaccgacgcccccgucucccccaccacccucuacgucgaggacaucuccgagcccccccuccacgacuucuacugcucccgccuccucgaccucgucuuccuccucgacggcuccucccgccucuccgaggccgaguucgagguccucaaggccuucgucgucgacaugauggagcgccuccgcaucucccagaaguggguccgcgucgccgucgucgaguaccacgacggcucccacgccuacaucggccucaaggaccgcaagcgccccuccgagcuccgccgcaucgccucccaggucaaguacgccggcucccaggucgccuccaccuccgagguccucaaguacacccucuuccagaucuucuccaagaucgaccgccccgaggccucccgcaucacccuccuccucauggccucccaggagccccagcgcaugucccgcaacuucguccgcuacguccagggccucaagaagaagaaggucaucgucauccccgucggcaucggcccccacgccaaccucaagcagauccgccucaucgagaagcaggcccccgagaacaaggccuucguccucuccuccgucgacgagcucgagcagcagcgcgacgagaucgucuccuaccucugcgaccucgcccccgaggcccccccccccacccucccccccgacauggcccaggucaccgucggccccggccuccucggcgucuccacccucggccccaagcgcaacuccaugguccucgacgucgccuucguccucgagggcuccgacaagaucggcgaggccgacuucaaccgcuccaaggaguucauggaggaggucauccagcgcauggacgucggccaggacuccauccacgucaccguccuccaguacuccuacauggucaccgucgaguaccccuucuccgaggcccaguccaagggcgacauccuccagcgcguccgcgagauccgcuaccagggcggcaaccgcaccaacaccggccucgcccuccgcuaccucuccgaccacuccuuccucgucucccagggcgaccgcgagcaggcccccaaccucgucuacauggucaccggcaaccccgccuccgacgagaucaagcgccuccccggcgacauccaggucguccccaucggcgucggccccaacgccaacguccaggagcucgagcgcaucggcuggcccaacgcccccauccucauccaggacuucgagacccucccccgcgaggcccccgaccucguccuccagcgcugcugcuccggcgagggccuccagauccccacccucucccccgcccccgacugcucccagccccucgacgucauccuccuccucgacggcuccuccuccuuccccgccuccuacuucgacgagaugaaguccuucgccaaggccuucaucuccaaggccaacaucggcccccgccucacccaggucuccguccuccaguacggcuccaucaccaccaucgacguccccuggaacgucguccccgagaaggcccaccuccucucccucgucgacgucaugcagcgcgagggcggccccucccagaucggcgacgcccucggcuucgccguccgcuaccucaccuccgagaugcacggcgcccgccccggcgccuccaaggccgucgucauccucgucaccgacgucuccgucgacuccgucgacgccgccgccgacgccgcccgcuccaaccgcgucaccgucuuccccaucggcaucggcgaccgcuacgacgccgcccagcuccgcauccucgccggccccgccggcgacuccaacgucgucaagcuccagcgcaucgaggaccuccccaccauggucacccucggcaacuccuuccuccacaagcucugcuccggcuucguccgcaucugcauggacgaggacggcaacgagaagcgccccggcgacgucuggacccuccccgaccagugccacaccgucaccugccagcccgacggccagacccuccucaagucccaccgcgucaacugcgaccgcggccuccgccccuccugccccaacucccagucccccgucaaggucgaggagaccugcggcugccgcuggaccugccccugcgucugcaccggcuccuccacccgccacaucgucaccuucgacggccagaacuucaagcucaccggcuccugcuccuacguccucuuccagaacaaggagcaggaccucgaggucauccuccacaacggcgccugcucccccggcgcccgccagggcugcaugaaguccaucgaggucaagcacuccgcccucuccgucgagcuccacuccgacauggaggucaccgucaacggccgccucgucuccguccccuacgucggcggcaacauggaggucaacgucuacggcgccaucaugcacgagguccgcuucaaccaccucggccacaucuucaccuucaccccccagaacaacgaguuccagcuccagcucucccccaagaccuucgccuccaagaccuacggccucugcggcaucugcgacgagaacggcgccaacgacuucaugcuccgcgacggcaccgucaccaccgacuggaagacccucguccaggaguggaccguccagcgccccggccagaccugccagcccauccucgaggagcagugccucguccccgacuccucccacugccagguccuccuccucccccucuucgccgagugccacaagguccucgcccccgccaccuucuacgccaucugccagcaggacuccugccaccaggagcaggucugcgaggucaucgccuccuacgcccaccucugccgcaccaacggcgucugcgucgacuggcgcacccccgacuucugcgccauguccugcccccccucccucgucuacaaccacugcgagcacggcugcccccgccacugcgacggcaacgucuccuccugcggcgaccaccccuccgagggcugcuucugcccccccgacaaggucaugcucgagggcuccugcguccccgaggaggccugcacccagugcaucggcgaggacggcguccagcaccaguuccucgaggccuggguccccgaccaccagcccugccagaucugcaccugccucuccggccgcaaggucaacugcaccacccagcccugccccaccgccaaggcccccaccugcggccucugcgaggucgcccgccuccgccagaacgccgaccagugcugccccgaguacgagugcgucugcgaccccgucuccugcgaccucccccccgucccccacugcgagcgcggccuccagcccacccucaccaaccccggcgagugccgccccaacuucaccugcgccugccgcaaggaggagugcaagcgcgucuccccccccuccugccccccccaccgccuccccacccuccgcaagacccagugcugcgacgaguacgagugcgccugcaacugcgucaacuccaccgucuccugcccccucggcuaccucgccuccaccgccaccaacgacugcggcugcaccaccaccaccugccuccccgacaaggucugcguccaccgcuccaccaucuaccccgucggccaguucugggaggagggcugcgacgucugcaccugcaccgacauggaggacgccgucaugggccuccgcgucgcccagugcucccagaagcccugcgaggacuccugccgcuccggcuucaccuacguccuccacgagggcgagugcugcggccgcugccuccccuccgccugcgaggucgucaccggcuccccccgcggcgacucccaguccuccuggaaguccgucggcucccagugggccucccccgagaaccccugccucaucaacgagugcguccgcgucaaggaggaggucuucauccagcagcgcaacgucuccugcccccagcucgagguccccgucugccccuccggcuuccagcucuccugcaagaccuccgccugcugccccuccugccgcugcgagcgcauggaggccugcaugcucaacggcaccgucaucggccccggcaagaccgucaugaucgacgucugcaccaccugccgcugcaugguccaggucggcgucaucuccggcuucaagcucgagugccgcaagaccaccugcaaccccugcccccucggcuacaaggaggagaacaacaccggcgagugcugcggccgcugccuccccaccgccugcaccauccagcuccgcggcggccagaucaugacccucaagcgcgacgagacccuccaggacggcugcgacacccacuucugcaaggucaacgagcgcggcgaguacuucugggagaagcgcgucaccggcugcccccccuucgacgagcacaagugccucgccgagggcggcaagaucaugaagauccccggcaccugcugcgacaccugcgaggagcccgagugcaacgacaucaccgcccgccuccaguacgucaaggucggcuccugcaaguccgaggucgaggucgacauccacuacugccagggcaagugcgccuccaaggccauguacuccaucgacaucaacgacguccaggaccagugcuccugcugcucccccacccgcaccgagcccaugcaggucgcccuccacugcaccaacggcuccgucgucuaccacgagguccucaacgccauggagugcaagugcuccccccgcaagugcuccaaguga

SEQ ID NO: 51719 - RNA, 3573 nt, Artificial Sequence
  derived and/or modified sequence opt2 from WAPAL__Homo_sapiens__NP_055860
augaccucccgcuucggcaagaccuacucccgcaagggcggcaacggcuccuccaaguucgacgaggucuucuccaacaagcgcaccacccucuccaccaaguggggcgagaccaccuucauggccaagcucggccagaagcgccccaacuucaagcccgacauccaggagauccccaagaagcccaaggucgaggaggaguccaccggcgaccccuucggcuucgacuccgacgacgagucccuccccgucuccuccaagaaccucgcccaggucaagugcuccuccuacuccgaguccuccgaggccgcccagcucgaggaggucaccuccguccucgaggccaacuccaagaucucccacgucgucgucgaggacaccgucgucuccgacaagugcuucccccucgaggacacccuccucggcaaggagaaguccaccaaccgcaucgucgaggacgacgccuccaucuccuccugcaacaagcucaucaccuccgacaaggucgagaacuuccacgaggagcacgagaagaacucccaccacauccacaagaacgccgacgacuccaccaagaagcccaacgccgagaccaccgucgccuccgagaucaaggagaccaacgacaccuggaacucccaguucggcaagcgccccgagucccccuccgagaucucccccaucaagggcuccguccgcaccggccucuucgagugggacaacgacuucgaggacauccgcuccgaggacugcauccucucccucgacuccgacccccuccucgagaugaaggacgacgacuucaagaaccgccucgagaaccucaacgaggccaucgaggaggacaucguccaguccguccuccgccccaccaacugccgcaccuacugccgcgccaacaagaccaaguccucccagggcgccuccaacuucgacaagcucauggacggcaccucccaggcccucgccaaggccaacuccgaguccuccaaggacggccucaaccaggccaagaagggcggcgucuccugcggcaccuccuuccgcggcaccgucggccgcacccgcgacuacaccguccuccaccccuccugccucuccgucugcaacgucaccauccaggacaccauggagcgcuccauggacgaguucaccgccuccacccccgccgaccucggcgaggccggccgccuccgcaagaaggccgacaucgccaccuccaagaccaccacccgcuuccgccccuccaacaccaaguccaagaaggacgucaagcucgaguucuucggcuucgaggaccacgagaccggcggcgacgagggcggcuccggcuccuccaacuacaagaucaaguacuucggcuucgacgaccucuccgaguccgaggacgacgaggacgacgacugccaggucgagcgcaagaccuccaagaagcgcaccaagaccgcccccucccccucccuccagcccccccccgaguccaacgacaacucccaggacucccaguccggcaccaacaacgccgagaaccucgacuucaccgaggaccuccccggcguccccgaguccgucaagaagcccaucaacaagcagggcgacaaguccaaggagaacacccgcaagaucuucuccggccccaagcgcucccccaccaaggccgucuacaacgcccgccacuggaaccaccccgacuccgaggagcuccccggcccccccgucgucaagccccaguccgucaccguccgccucuccuccaaggagcccaaccagaaggacgacggcgucuucaaggcccccgccccccccuccaaggucaucaagaccgucaccauccccacccagcccuaccaggacaucgucaccgcccucaagugccgccgcgaggacaaggagcucuacaccgucguccagcacgucaagcacuucaacgacgucgucgaguucggcgagaaccaggaguucaccgacgacaucgaguaccuccucuccggccucaaguccacccagccccucaacacccgcugccucuccgucaucucccucgccaccaagugcgccaugcccuccuuccgcaugcaccuccgcgcccacggcauggucgccauggucuucaagacccucgacgacucccagcaccaccagaaccucucccucugcaccgccgcccucauguacauccucucccgcgaccgccucaacauggaccucgaccgcgccucccucgaccucaugauccgccuccucgagcucgagcaggacgccuccuccgccaagcuccucaacgagaaggacaugaacaagaucaaggagaagauccgccgccucugcgagaccguccacaacaagcaccucgaccucgagaacaucaccaccggccaccucgccauggagacccuccucucccucaccuccaagcgcgccggcgacugguucaaggaggagcuccgccuccucggcggccucgaccacaucgucgacaaggucaaggagugcgucgaccaccucucccgcgacgaggacgaggagaagcucgucgccucccucuggggcgccgagcgcugccuccgcguccucgaguccgucaccguccacaaccccgagaaccaguccuaccucaucgccuacaaggacucccagcucaucgucuccuccgccaaggcccuccagcacugcgaggagcucauccagcaguacaaccgcgccgaggacuccaucugccucgccgacuccaagccccucccccaccagaacgucaccaaccacgucggcaaggccgucgaggacugcaugcgcgccaucaucggcguccuccucaaccucaccaacgacaacgaguggggcuccaccaagaccggcgagcaggacggccucaucggcaccgcccucaacugcguccuccagguccccaaguaccucccccaggagcagcgcuucgacauccgcguccucggccucggccuccucaucaaccucgucgaguacuccgcccgcaaccgccacugccucgucaacauggagaccuccugcuccuucgacuccuccaucugcuccggcgagggcgacgacucccuccgcaucggcggccagguccacgccguccaggcccucguccagcucuuccucgagcgcgagcgcgccgcccagcucgccgaguccaagaccgacgagcucaucaaggacgcccccaccacccagcacgacaaguccggcgaguggcaggagaccuccggcgagauccagugggucuccaccgagaagaccgacggcaccgaggagaagcacaagaaggaggaggaggacgaggagcucgaccucaacaaggcccuccagcacgccggcaagcacauggaggacugcaucgucgccuccuacaccgcccuccuccucggcugccucugccaggagucccccaucaacgucaccaccguccgcgaguaccuccccgagggcgacuucuccaucaugaccgagaugcucaagaaguuccucuccuucaugaaccucaccugcgccgucggcaccaccggccagaaguccaucucccgcgucaucgaguaccucgagcacugcuga

SEQ ID NO: 51720 - RNA, 1014 nt, Artificial Sequence
  derived and/or modified sequence opt2 from WARS2__Homo_sapiens__XP_011538796
augauggucgccuggaccaccaaggacuccaagaagcgcgucuucuccggcauccagcccaccggcauccuccaccucggcaacuaccucggcgccaucgaguccuggguccgccuccaggacgaguacgacuccguccucuacuccaucgucgaccuccacuccaucaccgucccccaggaccccgccguccuccgccaguccauccucgacaugaccgccguccuccucgccugcggcaucaaccccgagaaguccauccucuuccagcagucccaggucuccgagcacacccagcucuccuggauccucuccugcaugguccgccucccccgccuccagcaccuccaccaguggaaggccaagaccaccaagcagaagcacgacggcaccgucggccuccucaccuaccccguccuccaggccgccgacauccuccucuacaaguccacccacguccccgucggcgaggaccagguccagcacauggagcucguccaggaccucgcccagggcuucaacaagaaguacggcgaguucuuccccguccccgaguccauccucaccuccaugaagaaggucaagucccuccgcgaccccuccgccaagauguccaaguccgaccccgacaagcucgccaccguccgcaucaccgacucccccgaggagaucguccagaaguuccgcaaggccgucaccgacuucaccuccgaggucaccuacgaccccgccggccgcgccggcgucuccaacaucgucgccguccacgccgccgucaccggccucuccgucgaggaggucguccgccgcuccgccggcaugaacaccgcccgcuacaagcucgccgucgccgacgccgucaucgagaaguucgcccccaucaagcgcgagaucgagaagcucaagcucgacaaggaccaccucgagaagguccuccagaucggcuccgccaaggccaaggagcucgccuacaccgucugccaggaggucaagaagcucgucggcuuccucuga

SEQ ID NO: 51721 - RNA, 1416 nt, Artificial Sequence
  derived and/or modified sequence opt2 from WARS__Homo_sapiens__XP_006720312
augcccaacuccgagcccgccucccuccucgagcucuucaacuccaucgccacccagggcgagcucguccgcucccucaaggccggcaacgccuccaaggacgagaucgacuccgccgucaagaugcucgucucccucaagauguccuacaaggccgccgccggcgaggacuacaaggccgacugcccccccggcaaccccgcccccaccuccaaccacggccccgacgccaccgaggccgaggaggacuucgucgaccccuggaccguccagaccuccuccgccaagggcaucgacuacgacaagcucaucguccgcuucggcuccuccaagaucgacaaggagcucaucaaccgcaucgagcgcgccaccggccagcgcccccaccacuuccuccgccgcggcaucuucuucucccaccgcgacaugaaccagguccucgacgccuacgagaacaagaagcccuucuaccucuacaccggccgcggccccuccuccgaggccaugcacgucggccaccucauccccuucaucuucaccaaguggcuccaggacgucuucaacgucccccucgucauccagaugaccgacgacgagaaguaccucuggaaggaccucacccucgaccaggccuacuccuacgccgucgagaacgccaaggacaucaucgccugcggcuucgacaucaacaagaccuucaucuucuccgaccucgacuacaugggcauguccuccggcuucuacaagaacgucgucaagauccagaagcacgucaccuucaaccaggucaagggcaucuucggcuucaccgacuccgacugcaucggcaagaucuccuuccccgccauccaggccgcccccuccuucuccaacuccuucccccagaucuuccgcgaccgcaccgacauccagugccucauccccugcgccaucgaccaggaccccuacuuccgcaugacccgcgacgucgccccccgcaucggcuaccccaagcccgcccuccuccacuccaccuucuuccccgcccuccagggcgcccagaccaagauguccgccuccgaccccaacuccuccaucuuccucaccgacaccgccaagcagaucaagaccaaggucaacaagcacgccuucuccggcggccgcgacaccaucgaggagcaccgccaguucggcggcaacugcgacgucgacgucuccuucauguaccucaccuucuuccucgaggacgacgacaagcucgagcagauccgcaaggacuacaccuccggcgccaugcucaccggcgagcucaagaaggcccucaucgagguccuccagccccucaucgccgagcaccaggcccgccgcaaggaggucaccgacgagaucgucaaggaguucaugaccccccgcaagcucuccuucgacuuccaguga

SEQ ID NO: 51722 - RNA, 1680 nt, Artificial Sequence
  derived and/or modified sequence opt2 from WASF1__Homo_sapiens__NP_001020106
augccccucgucaagcgcaacaucgacccccgccaccucugccacaccgcccucccccgcggcaucaagaacgagcucgagugcgucaccaacaucucccucgccaacaucauccgccagcucuccucccucuccaaguacgccgaggacaucuucggcgagcucuucaacgaggcccacuccuucuccuuccgcgucaacucccuccaggagcgcgucgaccgccucuccgucuccgucacccagcucgaccccaaggaggaggagcucucccuccaggacaucaccaugcgcaaggccuuccgcuccuccaccauccaggaccagcagcucuucgaccgcaagacccuccccaucccccuccaggagaccuacgacgucugcgagcagccccccccccucaacauccucacccccuaccgcgacgacggcaaggagggccucaaguucuacaccaaccccuccuacuucuucgaccucuggaaggagaagaugcuccaggacaccgaggacaagcgcaaggagaagcgcaagcagaagcagaagaaccucgaccgcccccacgagcccgagaaggucccccgcgccccccacgaccgccgccgcgaguggcagaagcucgcccagggccccgagcucgccgaggacgacgccaaccuccuccacaagcacaucgaggucgccaacggccccgccucccacuucgagacccgcccccagaccuacgucgaccacauggacggcuccuacucccucuccgcccuccccuucucccagauguccgagcuccucacccgcgccgaggagcgcguccucguccgcccccacgagccccccccccccccccccaugcacggcgccggcgacgccaagcccauccccaccugcaucuccuccgccaccggccucaucgagaaccgcccccagucccccgccaccggccgcacccccgucuucgucucccccaccccccccccccccccccccccccuccccuccgcccucuccaccuccucccuccgcgccuccaugaccuccaccccccccccccccguccccccccccccccccccccccgccaccgcccuccaggcccccgccgucccccccccccccgccccccuccagaucgcccccggcguccuccaccccgcccccccccccaucgcccccccccucguccagcccuccccccccgucgcccgcgccgcccccgucugcgagaccguccccguccacccccucccccagggcgagguccagggccuccccccccccccccccccccccccccuccccccccccggcauccgccccuccucccccgucaccgucaccgcccucgcccacccccccuccggccuccaccccacccccuccaccgcccccggcccccacgucccccucaugccccccuccccccccucccaggucauccccgccuccgagcccaagcgccaccccuccacccuccccgucaucuccgacgcccgcuccguccuccucgaggccauccgcaagggcauccagcuccgcaaggucgaggagcagcgcgagcaggaggccaagcacgagcgcaucgagaacgacgucgccaccauccucucccgccgcaucgccgucgaguacuccgacuccgaggacgacuccgaguucgacgaggucgacuggcucgaguga

SEQ ID NO: 51723 - RNA, 1500 nt, Artificial Sequence
  derived and/or modified sequence opt2 from WASF3__Homo_sapiens__NP_001278894
augccccucgucaagcgcaacaucgagccccgccaccucugccgcggcgcccuccccgagggcaucaccuccgagcucgagugcgucaccaacuccacccucgccgccaucauccgccagcucuccucccucuccaagcacgccgaggacaucuucggcgagcucuucaacgaggccaacaacuucuacauccgcgccaacucccuccaggaccgcaucgaccgccucgccgucaaggucacccagcucgacuccaccgucgaggaggucucccuccaggacaucaacaugaagaaggccuucaaguccuccaccguccaggaccagcaggucgucuccaagaacuccauccccaaccccgucgccgacaucuacaaccaguccgacaagccccccccccucaacauccucacccccuaccgcgacgacaagaaggacggccucaaguucuacaccgaccccuccuacuucuucgaccucuggaaggagaagaugcuccaggacaccgaggacaagcgcaaggagaagcgccgccagaagcgcgagaagcacaagcucaaccccaaccgcaaccagcaggucaacguccgcaagguccgcacccgcaaggaggagugggagcgccgcaagaugggcaucgaguucauguccgacgccaagaagcucgagcaggccggcuccgccaaggaggaccgcguccccuccggcucccacgccuccgacgucaccgacuacuccuaccccgccacccccaaccacucccuccacccccagcccgucacccccuccuacgccgccggcgacguccccccccacggccccgccucccaggccgccgagcacgaguaccgcccccccuccgccuccgcccgccacauggcccucaaccgcccccagcagccccccccccccccccccccccaggcccccgagggcucccaggccuccgcccccauggcccccgccgacuacggcaugcuccccgcccagaucaucgaguacuacaaccccuccggcccccccccccccccccccccccccgucauccccuccgcccagaccgccuucgucuccccccuccagaugcccaugcagccccccuuccccgccuccgccuccuccacccacgccgcccccccccacccccccuccaccggccuccucgucaccgccccccccccccccggcccccccccccccccccccggcccccccggccccggcuccucccucuccuccucccccaugcacggcccccccgucgccgaggccaagcgccaggagcccgcccagccccccaucuccgacgcccgcuccgaccuccucgccgccauccgcaugggcauccagcucaagaagguccaggagcagcgcgagcaggaggccaagcgcgagcccgucggcaacgacgucgccaccauccucucccgccgcaucgccgucgaguacuccgacuccgacgacgacuccgaguucgacgagaacgacugguccgacuga

SEQ ID NO: 51724 - RNA, 1440 nt, Artificial Sequence
  derived and/or modified sequence opt2 from WASH1__Homo_sapiens__XP_011515960
augggcgccgucugcaccuccggcgcccgcuccgagcgcaccaugacccccguccgcaugcagcacucccucgccggccagaccuacgccguccccuucauccagcccgaccuccgccgcgaggaggccguccagcagauggccgacgcccuccaguaccuccagaaggucuccggcgacaucuucucccgcaucucccagcaggucgagcagucccgcucccagguccaggccaucggcgagaaggucucccucgcccaggccaagaucgagaagaucaagggcuccaagaaggccaucaaggucuucuccuccgccaaguaccccgcccccggccgccuccaggaguacggcuccaucuucaccggcgcccaggaccccggccuccagcgccgcccccgccaccgcauccaguccaagcaccgcccccucgacgagcgcgcccuccaggagaagcucaaggacuuccccgucugcgucuccaccaagcccgagcccgaggacgacgccgaggagggccucggcggccuccccuccaacaucuccuccgucuccucccuccuccucuucaacaccaccgagaaccucuacaagaaguacgucuuccucgacccccucgccggcgccgucaccaagacccacgucaugcucggcgccgagaccgaggagaagcucuucgacgccccccucuccaucuccaagcgcgagcagcucgagcagcagguccccgagaacuacuucuacguccccgaccucggccagguccccgagauccacguccccuccuaccuccccgaccuccccggcaucgccaacgaccucauguacuccgccgaccucggccccggcaucgcccccuccgcccccggcaccauccccgagcuccccaccuuccacaccgaggucgccgagccccucaaggucgaccuccaggacggcguccucaccccccccccccccccccccccccccccccccgcccccgagguccucgccuccgcccccccccucccccccuccaccgccgcccccgucggccagggcgcccgccaggacgacuccuccuccuccgccucccccuccguccagggcgccccccgcgaggucgucgaccccuccggcggcugggccacccuccucgaguccauccgccaggccggcggcaucggcaaggccaagcuccgcuccaugaaggagcgcaagcucgagaagcagcagcagaaggagcaggagcagguccgcgccaccucccagggcggccaccucauguccgaccucuucaacaagcucgucaugcgccgcaagggcaucuccggcaagggccccggcgccggcgagggccccggcggcgccuucguccgcgucuccgacuccauccccccccucccccccccccagcagccccaggccgaggaggacgaggacgacugggaguccuga

SEQ ID NO: 51725 - RNA, 1509 nt, Artificial Sequence
  derived and/or modified sequence opt2 from WAS__Homo_sapiens__NP_000368
auguccggcggccccaugggcggccgccccggcggccgcggcgcccccgccguccagcagaacauccccuccacccuccuccaggaccacgagaaccagcgccucuucgagaugcucggccgcaagugccucacccucgccaccgccgucguccagcucuaccucgcccucccccccggcgccgagcacuggaccaaggagcacugcggcgccgucugcuucgucaaggacaacccccagaaguccuacuucauccgccucuacggccuccaggccggccgccuccucugggagcaggagcucuacucccagcucgucuacuccacccccacccccuucuuccacaccuucgccggcgacgacugccaggccggccucaacuucgccgacgaggacgaggcccaggccuuccgcgcccucguccaggagaagauccagaagcgcaaccagcgccaguccggcgaccgccgccagcucccccccccccccacccccgccaacgaggagcgccgcggcggccuccccccccucccccuccaccccggcggcgaccagggcggcccccccgucggcccccucucccucggccucgccaccgucgacauccagaaccccgacaucaccuccucccgcuaccgcggccuccccgcccccggccccucccccgccgacaagaagcgcuccggcaagaagaagaucuccaaggccgacaucggcgcccccuccggcuucaagcacgucucccacgucggcugggacccccagaacggcuucgacgucaacaaccucgaccccgaccuccgcucccucuucucccgcgccggcaucuccgaggcccagcucaccgacgccgagaccuccaagcucaucuacgacuucaucgaggaccagggcggccucgaggccguccgccaggagaugcgccgccaggagccccucccccccccccccccccccucccgcggcggcaaccagcucccccgcccccccaucgucggcggcaacaagggccgcuccggcccccucccccccgucccccucggcaucgccccccccccccccaccccccgcggcccccccccccccggccgcggcggccccccccccccccccccccccgccaccggccgcuccggcccccuccccccccccccccccggcgccggcggcccccccaugcccccccccccccccccccccccccccccccccuccuccggcaacggccccgccccccccccccucccccccgcccucguccccgccggcggccucgcccccggcggcggccgcggcgcccuccucgaccagauccgccagggcauccagcucaacaagacccccggcgcccccgaguccuccgcccuccagccccccccccaguccuccgagggccucgucggcgcccucaugcacgucaugcagaagcgcucccgcgccauccacuccuccgacgagggcgaggaccaggccggcgacgaggacgaggacgacgagugggacgacuga

SEQ ID NO: 51726 - RNA, 1518 nt, Artificial Sequence
  derived and/or modified sequence opt2 from WASL__Homo_sapiens__NP_003932
auguccuccguccagcagcagcccccccccccccgccgcgucaccaacgucggcucccuccuccucaccccccaggagaacgagucccucuucaccuuccucggcaagaagugcgucaccauguccuccgccgucguccagcucuacgccgccgaccgcaacugcaugugguccaagaagugcuccggcgucgccugccucgucaaggacaacccccagcgcuccuacuuccuccgcaucuucgacaucaaggacggcaagcuccucugggagcaggagcucuacaacaacuucgucuacaacuccccccgcggcuacuuccacaccuucgccggcgacaccugccaggucgcccucaacuucgccaacgaggaggaggccaagaaguuccgcaaggccgucaccgaccuccucggccgccgccagcgcaaguccgagaagcgccgcgacccccccaacggccccaaccuccccauggccaccgucgacaucaagaaccccgagaucaccaccaaccgcuucuacggcccccaggucaacaacaucucccacaccaaggagaagaagaagggcaaggccaagaagaagcgccucaccaaggccgacaucggcacccccuccaacuuccagcacaucggccacgucggcugggaccccaacaccggcuucgaccucaacaaccucgaccccgagcucaagaaccucuucgacaugugcggcaucuccgaggcccagcucaaggaccgcgagaccuccaaggucaucuacgacuucaucgagaagaccggcggcgucgaggccgucaagaacgagcuccgccgccaggccccccccccccccccccccucccgcggcggccccccccccccccccccccccccccacaacuccggccccccccccccccccgcccgcggccgcggcgcccccccccccccccccucccgcgcccccaccgccgccccccccccccccccccccucccgccccuccgucgccguccccccccccccccccaaccgcauguaccccccccccccccccgcccuccccuccuccgcccccuccggcccccccccccccccccccuccguccucggcgucggccccgucgcccccccccccccccccccccccccccccccccccggccccccccccccccccggccuccccuccgacggcgaccaccagguccccaccaccgccggcaacaaggccgcccuccucgaccagauccgcgagggcgcccagcucaagaaggucgagcagaacucccgccccgucuccugcuccggccgcgacgcccuccucgaccagauccgccagggcauccagcucaaguccgucgccgacggccaggaguccaccccccccacccccgcccccaccuccggcaucgucggcgcccucauggaggucaugcagaagcgcuccaaggccauccacuccuccgacgaggacgaggacgaggacgacgaggaggacuucgaggacgacgacgagugggaggacuga

SEQ ID NO: 51727 - RNA, 1092 nt, Artificial Sequence
  derived and/or modified sequence opt2 from WBP1L__Homo_sapiens__NP_001077382
auggagcgccgccgccuccucggcggcauggcccuccuccuccuccaggcccuccccuccccccucuccgcccgcgccgagcccccccaggacaaggaggccugcgucggcaccaacaaccaguccuacaucugcgacaccggccacugcugcggccagucccagugcugcaacuacuacuacgagcucuggugguucuggcucgucuggaccaucaucaucauccucuccugcugcugcgucugccaccaccgccgcgccaagcaccgccuccaggcccagcagcgccagcacgagaucaaccucaucgccuaccgcgaggcccacaacuacuccgcccuccccuucuacuuccgcuuccuccccaacuaccuccucccccccuacgaggaggucgucaaccgcccccccaccccccccccccccuacuccgccuuccagcuccagcagcagcagcuccuccccccccagugcggccccgccggcggcuccccccccggcaucgaccccacccgcggcucccagggcgcccaguccuccccccucuccgagcccucccgcuccuccacccgcccccccuccaucgccgaccccgaccccuccgaccuccccgucgaccgcgccgccaccaaggcccccggcauggagcccuccggcuccgucgccggccucggcgagcucgaccccggcgccuuccucgacaaggacgccgagugccgcgaggagcuccucaaggacgacuccuccgagcacggcgcccccgacuccaaggagaagacccccggccgccaccgccgcuucaccggcgacuccggcaucgaggucugcgucugcaaccgcggccaccacgacgacgaccucaaggaguucaacacccucaucgacgacgcccucgacggcccccucgacuucugcgacuccugccacguccgcccccccggcgacgaggaggagggccucugccaguccuccgaggagcaggcccgcgagcccggccacccccaccucccccgcccccccgccugccuccuccucaacaccaucaacgagcaggacucccccaacucccaguccuccuccucccccuccuga

SEQ ID NO: 51728 - RNA, 786 nt, Artificial Sequence
  derived and/or modified sequence opt2 from WBP2__Homo_sapiens__NP_036610
auggcccucaacaagaaccacuccgagggcggcggcgucaucgucaacaacaccgaguccauccucauguccuacgaccacgucgagcucaccuucaacgacaugaagaacguccccgaggccuucaagggcaccaagaagggcaccgucuaccucacccccuaccgcgucaucuuccucuccaagggcaaggacgccaugcaguccuucaugaugcccuucuaccucaugaaggacugcgagaucaagcagcccgucuucggcgccaacuacaucaagggcaccgucaaggccgaggccggcggcggcugggagggcuccgccuccuacaagcucaccuucaccgccggcggcgccaucgaguucggccagcgcaugcuccaggucgccucccaggccucccgcggcgagguccccuccggcgccuacggcuacuccuacaugcccuccggcgccuacgucuaccccccccccgucgccaacggcauguaccccugcccccccggcuaccccuaccccccccccccccccgaguucuaccccggcccccccaugauggacggcgccaugggcuacguccagcccccccccccccccuaccccggccccauggagccccccgucuccggccccgacguccccuccacccccgccgccgaggccaaggccgccgaggccgccgccuccgccuacuacaaccccggcaacccccacaacgucuacaugcccaccucccagcccccccccccccccuacuacccccccgaggacaagaagacccaguga

SEQ ID NO: 51729 - RNA, 1797 nt, Artificial Sequence
  derived and/or modified sequence opt2 from WBSCR17__Homo_sapiens__NP_071924
auggccucccuccgccgcgucaagguccuccucguccucaaccucaucgccgucgccggcuucguccucuuccucgccaagugccgccccaucgccguccgcuccggcgacgccuuccacgagauccgcccccgcgccgaggucgccaaccucuccgcccacuccgccucccccauccaggacgccguccucaagcgccucucccuccucgaggacaucgucuaccgccagcucaacggccucuccaagucccucggccucaucgagggcuacggcggccgcggcaagggcggccuccccgccacccucucccccgccgaggaggagaaggccaagggcccccacgagaaguacggcuacaacuccuaccucuccgagaagaucucccucgaccgcuccauccccgacuaccgccccaccaagugcaaggagcucaaguacuccaaggaccucccccagaucuccaucaucuucaucuucgucaacgaggcccucuccgucauccuccgcuccguccacuccgccgucaaccacacccccacccaccuccucaaggagaucauccucgucgacgacaacuccgacgaggaggagcucaaggucccccucgaggaguacguccacaagcgcuaccccggccucgucaaggucguccgcaaccagaagcgcgagggccucauccgcgcccgcaucgagggcuggaaggucgccaccggccaggucaccggcuucuucgacgcccacgucgaguucaccgccggcugggccgagcccguccucucccgcauccaggagaaccgcaagcgcgucauccuccccuccaucgacaacaucaagcaggacaacuucgagguccagcgcuacgagaacuccgcccacggcuacuccugggagcucuggugcauguacaucuccccccccaaggacuggugggacgccggcgaccccucccuccccauccgcacccccgccaugaucggcugcuccuucgucgucaaccgcaaguucuucggcgagaucggccuccucgaccccggcauggacgucuacggcggcgagaacaucgagcucggcaucaaggucuggcucugcggcggcuccauggagguccuccccugcucccgcgucgcccacaucgagcgcaagaagaagcccuacaacuccaacaucggcuucuacaccaagcgcaacgcccuccgcgucgccgaggucuggauggacgacuacaagucccacgucuacaucgccuggaaccucccccucgagaaccccggcaucgacaucggcgacgucuccgagcgccgcgcccuccgcaagucccucaagugcaagaacuuccagugguaccucgaccacgucuaccccgagaugcgccgcuacaacaacaccgucgccuacggcgagcuccgcaacaacaaggccaaggacgucugccucgaccagggcccccucgagaaccacaccgccauccucuaccccugccacggcuggggcccccagcucgcccgcuacaccaaggagggcuuccuccaccucggcgcccucggcaccaccacccuccuccccgacacccgcugccucgucgacaacuccaagucccgccucccccagcuccucgacugcgacaaggucaaguccucccucuacaagcgcuggaacuucauccagaacggcgccaucaugaacaagggcaccggccgcugccucgaggucgagaaccgcggccucgccggcaucgaccucauccuccgcuccugcaccggccagcgcuggaccaucaagaacuccaucaaguga

SEQ ID NO: 51730 - RNA, 897 nt, Artificial Sequence
  derived and/or modified sequence opt2 from WBSCR22__Homo_sapiens__NP_001189489
auggccucccgcggccgccgccccgagcacggcggcccccccgagcucuucuacgacgagaccgaggcccgcaaguacguccgcaacucccgcaugaucgacauccagacccgcauggccggccgcgcccucgagcuccucuaccuccccgagaacaagcccugcuaccuccucgacaucggcugcggcaccggccucuccggcuccuaccucuccgacgagggccacuacugggucggccucgacaucucccccgccaugcucgacgaggccgucgaccgcgagaucgagggcgaccuccuccucggcgacaugggccagggcauccccuucaagcccggcaccuucgacggcugcaucuccaucuccgccguccaguggcucugcaacgccaacaagaaguccgagaaccccgccaagcgccucuacugcuucuucgccucccucuucuccguccucguccgcggcucccgcgccguccuccagcucuaccccgagaacuccgagcagcucgagcucaucaccacccaggccaccaaggccggcuucuccggcggcauggucgucgacuaccccaacuccgccaaggccaagaaguucuaccucugccucuucuccggccccuccaccuucauccccgagggccucuccgagaaccaggacgaggucgagccccgcgaguccgucuucaccaacgagcgcgagggcggcgccuucgagcgccgcggcauccgcggccaccagacccgccgcuucccccuccgcaugucccgccgcggcaugguccgcaagucccgcgccuggguccucgagaagaaggagcgccaccgccgccagggccgcgagguccgccccgacacccaguacaccggccgcaagcgcaagccccgcuucuga

SEQ ID NO: 51731 - RNA, 1203 nt, Artificial Sequence
  derived and/or modified sequence opt2 from WDFY2__Homo_sapiens__NP_443182
auggccgccgagauccagcccaagccccucacccgcaagcccauccuccuccagcgcauggagggcucccaggaggucgucaacauggccgucaucguccccaaggaggagggcgucaucuccgucuccgaggaccgcaccguccgcgucuggcucaagcgcgacuccggccaguacuggcccuccgucuaccacgccaugcccucccccugcuccugcauguccuucaaccccgagacccgccgccucuccaucggccucgacaacggcaccaucuccgaguucauccucuccgaggacuacaacaagaugacccccgucaagaacuaccaggcccaccagucccgcgucaccaugauccucuucguccucgagcucgaguggguccucuccaccggccaggacaagcaguucgccuggcacugcuccgaguccggccagcgccucggcggcuaccgcaccuccgccgucgccuccggccuccaguucgacgucgagacccgccacgucuucaucggcgaccacuccggccaggucaccauccucaagcucgagcaggagaacugcacccucgucaccaccuuccgcggccacaccggcggcgucaccgcccucugcugggaccccguccagcgcguccucuucuccggcuccuccgaccacuccgucaucaugugggacaucggcggccgcaagggcaccgccaucgagcuccagggccacaacgaccgcguccaggcccucuccuacgcccagcacacccgccagcucaucuccugcggcggcgacggcggcaucgucgucuggaacauggacgucgagcgccaggagacccccgaguggcucgacuccgacuccugccagaagugcgaccagcccuucuucuggaacuucaagcagaugugggacuccaagaagaucggccuccgccagcaccacugccgcaagugcggcaaggccgucugcggcaagugcuccuccaagcgcuccuccaucccccucaugggcuucgaguucgagguccgcgucugcgacuccugccacgaggccaucaccgacgaggagcgcgcccccaccgccaccuuccacgacuccaagcacaacaucguccacguccacuucgacgccacccgcggcuggcuccucaccuccggcaccgacaaggucaucaagcucugggacaugacccccgucgucuccuga

SEQ ID NO: 51732 - RNA, 9555 nt, Artificial Sequence
  derived and/or modified sequence opt2 from WDFY4__Homo_sapiens__NP_065996
auggaggccgaggaccucuccaaggccgaggaccgcaacgaggaccccggcuccaagaacgagggccagcucgccgccguccagcccgacgucccccacggcggccaguccuccucccccaccgcccucugggacaugcucgagcgcaaguuccucgaguaccagcagcucacccacaagucccccaucgagcgccagaagucccuccucucccuccucccccucuuccucaaggccugggagcacuccgucggcaucaucugcuuccccucccuccagcgccucgccgaggacgucuccgaccagcucgcccagcagcuccagaaggcccucgucggcaagcccgccgagcaggcccgccucgccgccggccagcuccucugguggaagggcgacgucgaccaggacggcuaccuccuccucaaguccgucuacguccucaccggcaccgacuccgagacccucggccgcgucgccgaguccggccuccccgcccuccuccuccagugccucuaccucuucuucgucuucccccucgacaaggacgagcuccucgaguccgaccuccagguccagaagauguucguccagaugcuccucaacaucugcuccgacucccagggccucgagggccuccucuccggcuccgagcuccagucccuccucaucgccaccaccugccuccgcgagcacuccugcugcuucuggaaggagcccaccuucugcguccuccgcgccaucuccaaggcccagaaccucuccaucauccaguaccuccaggccaccgacugcguccgccucucccuccagaaccucucccgccucaccgacacccuccccgcccccgaggucuccgaggccgucucccucauccucggcuucgucaaggacuccuaccccgucuccuccgcccucuuccucgaguucgagaacuccgagggcuacccccuccuccucaagguccuccuccgcuacgacggccucacccaguccgaggucgacccccaccucgaggagcuccucggccucgucgucuggcucaccaccugcggccgcuccgagcucaaggucuucgacuccaucaccuacccccagcucgagggcuucaaguuccaccacgaggccuccggcgucaccgucaagaaccuccaggccuuccagguccuccagaacgucuuccacaaggccuccgacuccguccucugcauccagguccucuccgucauccgcaccaugugggccuggaacgcccgcaacuucuuccuccucgaguggacccuccagcccaucucccaguucgucgagaucaugccccucaagcccgcccccguccaggagcacuucuuccagcuccucgaggcccucgucuucgagcuccacuacgucccccacgagauccuccgcaagguccagcaccucaucaaggagucccccggccccuccugcacccucauggcccuccaguccauccucuccaucgccggcggcgacccccucuucaccgacaucuuccgcgacuccggccuccucggccuccuccucgcccagcuccgcaagcaggccaagaucaugcgcaaguccggcaacaaggucuccacccccggcguccaggaccccgagcgcgagcucaccugcgucaugcuccgcaucgucgucacccuccucaagggcuccguccgcaacgccgucguccucaaggaccacggcaugguccccuucaucaagaucuuccucgacgacgagugcuaccgcgaggccucccucuccauccucgagcagcucuccgccaucaacgccgaggaguacauguccaucaucgucggcgcccucugcuccuccacccagggcgagcuccagcucaagcucgaccuccucaagucccuccuccgcauccucgucacccccaagggccgcgccgccuuccgcgucuccuccggcuucaacggccuccucucccuccucuccgaccucgagggcucccuccaggagcccccccuccaggccuggggcgccgucuccccccgccagacccucgagcucguccucuacacccucugcgccgucuccgccgcccuccacugggaccccgucaacggcuacuucuuccgccgcaacggccucuucgagaagcucgccgaggaccucugccuccucggcugcuucggcgcccucgaggaggagggcaaccuccuccgcuccugggucgacaccaaggcccgccccuucgccgaccuccucggcaccgccuucuccuccuccggcucccuccccccccgcauccaguccugccuccagauccucggcuuccucgacuccauggccuccggcacccuccaccuccgcggcgaccucaaggagucccuccgcaccaagcagggccccgucgucgacguccagaagggcgagaccggcuccgacccccagcgcaacuucaagcaguggcccgaccucgaggagcgcauggacgagggcgacgccgccaucaugcaccccggcgucgucugcaucaugguccgccuccucccccgccucuaccacgaggaccacccccagcucuccgaggagauccagugcucccucgccucccacauccagucccucgucaaguccgagaagaaccgccaggucaugugcgaggccggccuccucggcacccucauggccuccugccaccgcgcccucgucaccuccggcuccccccuccacucccgccucauccgcaucuucgagaagcucgccucccaggccaucgagcccgacguccuccgccaguuccucggccucggcauccccuccucccucuccgccaccaccaagauccucgacuccucccacacccaccgcggcaaccccggcugcuccggcucccagaccgcccagggccucgccgagggccccuggcccgccgcccccgacgccggccuccaccccggcgucacccaggccccccagccccucggcgagucccaggacuccaccaccgcccuccagaccgcccucucccucaucuccaugaccuccccccgcaaccuccagccccagcgcgccgcccucgcccccuccuucgucgaguucgacauguccgucgagggcuacggcugccucuucauccccacccucuccaccgucaugggcaccuccaccgaguacuccgucuccggcggcaucggcaccggcgccacccgccccuuccccccccccggcggccucaccuucuccugcugguuccucaucucccgccacggcgccgccaccgagggccacccccuccgcuuccucacccucguccgccaccucgcccgcaccgagcagcccuucgucugcuucuccgucucccucugccccgacgaccucucccucgucgucuccaccgaggagaaggaguuccagccccucgacgucauggagcccgaggacgacuccgagcccuccgccggcugccagcuccagguccgcugcggccagcuccucgccugcggccaguggcaccaccucgccgucgucgucaccaaggagaugaagcgccacugcaccgucuccaccugccucgacggccaggucaucggcuccgccaagaugcucuacauccaggcccuccccggccccuuccucuccauggaccccuccgccuucgucgacgucuacggcuacaucgccaccccccgcgucuggaagcagaaguccucccucaucuggcgccucggccccaccuaccucuucgaggaggccaucuccauggagacccucgaggucaucaacaagcucggcccccgcuacugcggcaacuuccaggccguccacguccagggcgaggaccucgacuccgaggccacccccuucgucgccgaggagcgcgucuccuucggccuccacaucgccuccuccuccaucaccuccgucgccgacauccgcaacgccuacaacgaggucgacucccgccucaucgccaaggagaugaacaucuccucccgcgacaacgccaugcccgucuuccuccuccgcaacugcgccggccaccucuccggcucccuccgcaccaucggcgccgucgccgucggccagcucggcguccgcgucuuccacuccucccccgccgccuccucccucgacuucaucggcggccccgccauccuccucggccucaucucccucgccaccgacgaccacaccauguacgccgccgucaagguccuccacuccguccucaccuccaacgccaugugcgacuuccucaugcagcacaucugcggcuaccagaucauggccuuccuccuccgcaagaaggccucccuccucaaccaccgcaucuuccagcucauccucuccgucgccggcaccgucgagcucggcuuccgcuccuccgccaucaccaacaccggcgucuuccagcacauccucugcaacuucgagcucuggaugaacaccgccgacaaccucgagcucucccucuucucccaccuccucgagauccuccaguccccccgcgagggcccccgcaacgccgaggccgcccaccaggcccagcucauccccaagcucaucuuccucuucaacgagcccucccucauccccuccaagaucuccaccaucaucggcauccucgccugccagcuccgcggccacuucuccacccaggaccuccuccgcaucggccucuucgucgucuacacccucaagcccuccuccgucaacgagcgccagaucugcauggacggcgcccucgaccccucccuccccgccggcucccagaccuccggcaagaccaucuggcuccgcaaccagcuccucgagaugcuccucuccgucaucuccuccccccagcuccaccucuccuccgaguccaaggaggagauguuccucaagcucggccccgacugguuccuccuccuccuccagggccaccuccacgccuccaccaccguccucgcccucaagcuccuccucuacuuccucgccucccccucccuccgcacccgcuuccgcgacggccucugcgccggcuccugggucgagcgcuccaccgagggcgucgacaucgucauggacaaccucaagucccaguccccccuccccgagcagucccccugccuccuccccggcuuccgcguccucaacgacuuccucgcccaccacguccacauccccgaggucuaccucaucgucuccaccuucuuccuccagaccccccucaccgagcucauggacggccccaaggacucccucgacgccaugcuccaguggcuccuccagcgccaccaccaggaggagguccuccaggccggccucugcaccgagggcgcccuccuccuccucgagaugcucaaggccaccaugucccagccccucgccggcuccgaggacggcgccugggcccagaccuuccccgccuccguccuccaguuccucucccucguccaccgcaccuacccccaggaccccgccuggcgcgcccccgaguuccuccagacccucgccaucgccgccuucccccucggcgcccagaagggcgucggcgccgaguccacccgcaacaccuccucccccgaggccgccgccgagggcgacuccaccgucgagggccuccaggcccccaccaaggcccaccccgcccgccgcaagcuccgcgaguucacccagcuccuccuccgcgagcuccuccucggcgccuccucccccaagcaguggcucccccucgagguccuccucgaggccucccccgaccacgccaccucccagcagaagcgcgacuuccaguccgagguccuccucuccgccauggagcucuuccacaugaccuccggcggcgacgccgccauguuccgcgacggcaaggagccccagcccuccgccgaggccgccgccgcccccucccucgccaacaucuccugcuucacccagaagcucgucgagaagcucuacuccggcauguucuccgccgacccccgccacauccuccucuucauccucgagcacaucauggucgucaucgagaccgccuccucccagcgcgacaccguccucuccacccucuacuccucccucaacaaggucauccucuacugccucuccaagccccagcagucccucuccgagugccucggccuccucuccauccucggcuuccuccaggagcacugggacgucgucuucgccaccuacaacuccaacaucuccuuccuccucugccucaugcacugccuccuccuccucaacgagcgcuccuaccccgagggcuucggccucgagcccaagccccgcauguccaccuaccaccaggucuuccucucccccaacgaggacgucaaggagaagcgcgaggaccuccccucccucuccgacguccagcacaacauccagaagaccguccagacccucuggcagcagcucgucgcccagcgccagcagacccucgaggacgccuucaagaucgaccucuccgucaagcccggcgagcgcgaggucaagaucgaggaggucaccccccucugggaggagaccaugcucaaggccuggcagcacuaccucgccuccgagaagaagucccucgccucccgcuccaacgucgcccaccacuccaaggucacccucugguccggcucccucuccuccgccaugaagcucaugcccggccgccaggccaaggaccccgagugcaagaccgaggacuucgucuccugcaucgagaacuaccgccgccgcggccaggagcucuacgccucccucuacaaggaccacguccagcgccgcaagugcggcaacaucaaggccgccaacgccugggcccgcauccaggagcagcucuucggcgagcucggccucuggucccagggcgaggagaccaagcccugcucccccugggagcucgacuggcgcgagggccccgcccgcaugcgcaagcgcaucaagcgccucuccccccucgaggcccucuccuccggccgccacaaggagucccaggacaagaacgaccacaucucccagaccaacgccgagaaccaggacgagcucacccuccgcgaggccgagggcgagcccgacgaggucggcgucgacugcacccagcucaccuucuuccccgcccuccacgagucccuccacuccgaggacuuccucgagcucugccgcgagcgccaggucauccuccaggagcuccucgacaaggagaaggucacccagaaguucucccucgucaucguccagggccaccucgucuccgagggcguccuccucuucggccaccagcacuucuacaucugcgagaacuucacccucucccccaccggcgacgucuacugcacccgccacugccucuccaacaucuccgaccccuucaucuucaaccucugcuccaaggaccgcuccaccgaccacuacuccugccagugccacuccuacgccgacaugcgcgagcuccgccaggcccgcuuccuccuccaggacaucgcccucgagaucuucuuccacaacggcuacuccaaguuccucgucuucuacaacaacgaccgcuccaaggccuucaaguccuucugcuccuuccagcccucccucaagggcaaggccaccuccgaggacacccucucccuccgccgcuaccccggcuccgaccgcaucaugcuccagaaguggcagaagcgcgacaucuccaacuucgaguaccucauguaccucaacaccgccgccggccgcaccugcaacgacuacaugcaguaccccgucuuccccuggguccucgccgacuacaccuccgagacccucaaccucgccaaccccaagaucuuccgcgaccucuccaagcccaugggcgcccagaccaaggagcgcaagcucaaguucauccagcgcuucaaggaggucgagaagaccgagggcgacaugaccguccagugccacuacuacacccacuacuccuccgccaucaucgucgccuccuaccucguccgcaugccccccuucacccaggccuucugcgcccuccagggcggcuccuucgacgucgccgaccgcauguuccacuccgucaaguccaccugggaguccgccucccgcgagaacauguccgacguccgcgagcucacccccgaguucuucuaccuccccgaguuccucaccaacugcaacggcgucgaguucggcugcaugcaggacggcaccguccucggcgacguccagcucccccccugggccgacggcgacccccgcaaguucaucucccuccaccgcaaggcccucgaguccgacuucgucuccgccaaccuccaccacuggaucgaccucaucuucggcuacaagcagcagggccccgccgccgucgacgccgucaacaucuuccaccccuacuucuacggcgaccgcauggaccucuccuccaucaccgacccccucaucaaguccaccauccucggcuucgucuccaacuucggccagguccccaagcagcucuucaccaagccccaccccgcccgcaccgccgccggcaagccccuccccggcaaggacgucuccacccccgucucccuccccggccacccccagcccuucuucuacucccuccagucccuccgccccucccaggucaccgucaaggacauguaccucuucucccucggcuccgagucccccaagggcgccaucggccacaucgucuccaccgagaagaccauccucgccgucgagcgcaacaagguccuccuccccccccucuggaaccgcaccuucuccuggggcuucgacgacuucuccugcugccucggcuccuacggcuccgacaagguccucaugaccuucgagaaccucgccgccuggggccgcugccucugcgccgucugccccucccccaccaccaucgucaccuccggcaccuccaccgucgucugcgucugggagcucuccaugaccaagggccgcccccgcggccuccgccuccgccaggcccucuacggccacacccaggccgucaccugccucgccgccuccgucaccuucucccuccucgucuccggcucccaggacugcaccugcauccucugggaccucgaccaccucacccacgucacccgccuccccgcccaccgcgagggcaucuccgccaucaccaucuccgacgucuccggcaccaucgucuccugcgccggcgcccaccucucccucuggaacgucaacggccagccccucgccuccaucaccaccgccuggggccccgagggcgccaucaccugcugcugccucauggagggccccgccugggacaccucccagaucaucaucaccggcucccaggacggcaugguccgcgucuggaagaccgaggacgucaagauguccguccccggccgccccgccggcgaggagccccccgcccagccccccuccccccgcggccacaagugggagaagaaccucgcccucucccgcgagcucgacgucuccaucgcccucaccggcaagcccuccaagaccucccccgccgucaccgcccucgccgucucccgcaaccacaccaagcuccucgucggcgacgagcgcggccgcaucuucugcugguccgccgacggcuga

SEQ ID NO: 51733 - RNA, 3021 nt, Artificial Sequence
  derived and/or modified sequence opt2 from WDHD1__Homo_sapiens__NP_001008397
auggacuccucccagcagaagaccuuccgcggccacgacgcccccguccucucccucuccuucgaccccaaggacaucuuccucgccuccgccuccugcgacggcuccguccgcgucuggcagaucuccgaccagaccugcgccaucuccuggccccuccuccagaagugcaacgacgucaucaacgccaaguccaucugccgccucgccuggcagcccaaguccggcaagcuccucgccauccccgucgagaaguccgucaagcucuaccgccgcgaguccuggucccaccaguucgaccucuccgacaacuucaucucccagacccucaacaucgucaccuggucccccugcggccaguaccucgccgccggcuccaucaacggccucaucaucgucuggaacgucgagaccaaggacugcauggagcgcgucaagcacgagaagggcuacgccaucugcggccucgccuggcaccccaccugcggccgcaucuccuacaccgacgccgagggcaaccucggccuccucgagaacgucugcgaccccuccggcaagaccuccuccuccaaggucuccucccgcgucgagaaggacuacaacgaccucuucgacggcgacgacauguccaacgccggcgacuuccucaacgacaacgccgucgagauccccuccuucuccaagggcaucaucaacgacgacgaggacgacgaggaccucaugauggccuccggccgcccccgccagcgcucccacauccucgaggacgacgagaacuccgucgacaucuccaugcucaagaccggcuccucccuccucaaggaggaggaggaggacggccaggagggcuccauccacaaccucccccucgucaccucccagcgccccuucuacgacggccccaugcccaccccccgccagaagcccuuccaguccggcuccaccccccuccaccucacccaccgcuucauggucuggaacuccaucggcaucauccgcugcuacaacgacgagcaggacaacgccaucgacgucgaguuccacgacaccuccauccaccacgccacccaccucuccaacacccucaacuacaccaucgccgaccucucccacgaggccauccuccucgccugcgaguccaccgacgagcucgccuccaagcuccacugccuccacuucuccuccugggacuccuccaaggaguggaucaucgaccucccccagaacgaggacaucgaggccaucugccucggccagggcugggccgccgccgccaccuccgcccuccuccuccgccucuucaccaucggcggcguccagaaggaggucuucucccucgccggccccgucgucuccauggccggccacggcgagcagcucuucaucgucuaccaccgcggcaccggcuucgacggcgaccagugccucggcguccagcuccucgagcucggcaagaagaagaagcagauccuccacggcgacccccucccccucacccgcaaguccuaccucgccuggaucggcuucuccgccgagggcacccccugcuacgucgacuccgagggcaucguccgcaugcucaaccgcggccucggcaacaccuggacccccaucugcaacacccgcgagcacugcaagggcaaguccgaccacuacugggucgucggcauccacgagaacccccagcagcuccgcugcauccccugcaagggcucccgcuucccccccacccucccccgccccgccgucgccauccucuccuucaagcuccccuacugccagaucgccaccgagaagggccagauggaggagcaguucuggcgcuccgucaucuuccacaaccaccucgacuaccucgccaagaacggcuacgaguacgaggaguccaccaagaaccaggccaccaaggagcagcaggagcuccucaugaagaugcucgcccucuccugcaagcucgagcgcgaguuccgcugcgucgagcucgccgaccucaugacccagaacgccgucaaccucgccaucaaguacgccucccgcucccgcaagcucauccucgcccagaagcucuccgagcucgccgucgagaaggccgccgagcucaccgccacccaggucgaggaggaggaggaggaggaggacuuccgcaagaagcucaacgccggcuacuccaacaccgccaccgaguggucccagccccgcuuccgcaaccaggucgaggaggacgccgaggacuccggcgaggccgacgacgaggagaagcccgagauccacaagcccggccagaacuccuucuccaaguccaccaacuccuccgacgucuccgccaaguccggcgccgucaccuucuccucccagggccgcgucaaccccuucaaggucuccgccuccuccaaggagcccgccauguccaugaacuccgcccgcuccaccaacauccucgacaacaugggcaaguccuccaagaaguccaccgcccucucccgcaccaccaacaacgagaagucccccaucaucaagccccucauccccaagcccaagcccaagcaggccuccgccgccuccuacuuccagaagcgcaacucccagaccaacaagaccgaggaggucaaggaggagaaccucaagaacguccucuccgagacccccgccaucugccccccccagaacaccgagaaccagcgccccaagaccggcuuccagauguggcucgaggagaaccgcuccaacauccucuccgacaaccccgacuucuccgacgaggccgacaucaucaaggagggcaugauccgcuuccgcguccucuccaccgaggagcgcaaggucugggccaacaaggccaagggcgagaccgccuccgagggcaccgaggccaagaagcgcaagcgcgucgucgacgaguccgacgagaccgagaaccaggaggagaaggccaaggagaaccucaaccucuccaagaagcagaagccccucgacuucuccaccaaccagaagcucuccgccuucgccuucaagcaggaguga

SEQ ID NO: 51734 - RNA, 2241 nt, Artificial Sequence
  derived and/or modified sequence opt2 from WDPCP__Homo_sapiens__NP_056994
augcgccgcgaguucugcugggacgccuacuccaaggccgccggcucccgcgccuccuccccccucccccgccaggaccgcgacuccuucugccaccagauguccuucugccucaccgagcuccaccucuggucccucaagaacacccuccacaucgccgaccgcgacaucggcaucuaccaguacuacgacaagaaggacccccccgccaccgagcacggcaaccucgagaagaagcagaagcucgccgagucccgcgacuaccccuggacccucaagaaccgccgccccgagaagcuccgcgacucccucaaggagcucgaggagcucaugcagaacucccgcugcguccucuccaaguggaagaacaaguacgucugccagcuccucuucggcuccggcguccucgucucccucucccucuccggcccccagcucgagaaggucgucaucgaccgcucccucgucggcaagcucaucuccgacaccaucuccgacgcccuccucaccgacuccuucaucauccucuccuuccucgcccagaacaagcucugcuucauccaguucaccaagaagauggaguccuccgacgucaacaagcgccucgagaagcucuccgcccucgacuacaagaucuucuacuacgagauccccggccccaucaacaagaccaccgagcgccaccucgccaucaacugcguccacgaccgcgucgucugcugguggccccucgucaacgacgacgccuggcccugggcccccaucuccuccgagaaggaccgcgccaaccuccuccuccucggcuacgcccagggccgccucgagguccucuccuccguccgcaccgagugggacccccucgacguccgcuucggcaccaagcagcccuaccaggucuucaccgucgagcacuccgucuccgucgacaaggagcccauggccgacuccugcaucuacgagugcauccgcaacaagauccagugcgucuccgucacccgcaucccccucaaguccaaggccaucuccugcugccgcaacgucaccgaggacaagcucauccucggcugcgaggacuccucccucauccucuacgagacccaccgccgcgucacccuccucgcccagaccgagcuccuccccucccucaucuccugccaccccuccggcgccauccuccucgucggcuccaaccagggcgagcuccagaucuucgacauggcccucucccccaucaacauccagcuccucgccgaggaccgccucccccgcgagacccuccaguucuccaagcucuucgacgccuccuccucccucguccagaugcaguggaucgccccccaggucgucucccagaagggcgagggcuccgacaucuacgaccuccucuuccuccgcuucgagcgcggcccccucggcguccuccucuucaagcucggcgucuucacccgcggccagcucggccucaucgacaucaucuuccaguacauccacugcgacgagaucuacgaggccaucaacauccucuccuccaugaacugggacacccucggccaccagugcuucaucuccauguccgccaucgucaaccaccuccuccgccagaagcucacccccgagcgcgaggcccagcucgagaccucccucggcaccuucuacgcccccacccgcccccuccucgacuccaccauccucgaguaccgcgaccagaucuccaaguacgcccgccgcuucuuccaccaccuccuccgcuaccagcgcuucgagaaggccuuccuccucgccgucgacgucggcgcccgcgaccucuucauggacauccacuaccucgcccucgacaagggcgagcucgcccucgccgaggucgcccgcaagcgcgccuccgacaucgacgccgaguccaucaccuccggcgucgagcuccucggcccccucgaccgcggcgacaugcucaacgaggccuucaucggccucucccucgccccccagggcgaggacuccuuccccgacaaccucccccccuccugccccacccaccgccacauccuccagcagcgcauccucaacggcuccuccaaccgccagaucaucgaccgccgcaacgagcucgagaaggacaucugcuccggcuuccucaugaccaacaccugcaacgccgaggacggcgagcuccgcgaggacggccgcgagcaggagauccgcgacggcggcucccucaagaugauccacuucggccucgucuga

SEQ ID NO: 51735 - RNA, 3675 nt, Artificial Sequence
  derived and/or modified sequence opt2 from WDR11__Homo_sapiens__NP_060587
augcuccccuacaccgucaacuucaaggucuccgcccgcacccucaccggcgcccucaacgcccacaacaaggccgccgucgacuggggcuggcagggccucaucgccuacggcugccacucccucgucgucgucaucgacuccaucaccgcccagacccuccagguccucgagaagcacaaggccgacgucgucaaggucaagugggcccgcgagaacuaccaccacaacaucggcucccccuacugccuccgccucgccuccgccgacgucaacggcaagaucaucgucugggacgucgccgccggcgucgcccagugcgagauccaggagcacgccaagcccauccaggacguccaguggcucuggaaccaggacgccucccgcgaccuccuccucgccauccacccccccaacuacaucguccucuggaacgccgacaccggcaccaagcucuggaagaaguccuacgccgacaacauccucuccuucuccuucgaccccuucgaccccucccaccucacccuccucaccuccgagggcaucgucuucaucuccgacuucucccccuccaagccccccuccggccccggcaagaaggucuacaucuccuccccccacuccucccccgcccacaacaagcucgccaccgccaccggcgccaagaaggcccucaacaaggucaagauccucaucacccaggagaagcccuccgccgaguucaucacccucaacgacugccuccagcucgccuaccuccccuccaagcgcaaccacaugcuccuccucuacccccgcgagauccucauccucgaccucgaggucaaccagaccgucggcgucaucgccaucgagcgcaccggcguccccuuccuccaggucauccccugcuuccagcgcgacggccucuucugccuccacgagaacggcugcaucacccuccgcguccgccgcuccuacaacaacaucuucaccaccuccaacgaggagcccgaccccgaccccguccaggagcucaccuacgaccuccgcucccagugcgacgccauccgcgucaccaagaccguccgccccuucuccauggucugcugccccgucaacgagaacgccgccgcccucgucgucuccgacggccgcgucaugaucugggagcucaaguccgccgucugcaaccgcaacucccgcaacuccuccuccggcgucuccccccucuacucccccgucuccuucugcggcauccccgucggcguccuccagaacaagcuccccgaccucucccucgacaacaugaucggccaguccgccaucgccggcgaggagcacccccgcggcuccauccuccgcgagguccaccucaaguuccuccucaccggccuccucuccggccuccccgccccccaguucgccauccgcaugugccccccccucaccaccaagaacaucaagauguaccagccccuccucgccgucggcaccuccaacggcuccguccucgucuaccaccucaccuccggccuccuccacaaggagcucuccauccacuccugcgaggucaagggcaucgaguggaccucccucaccuccuuccucuccuucgccaccuccacccccaacaacaugggccucguccgcaacgagcuccagcucgucgaccuccccaccggccgcuccaucgccuuccgcggcgagcgcggcaacgacgaguccgccaucgagaugaucaaggucucccaccucaagcaguaccucgccgucgucuuccgcgacaagccccucgagcucugggacguccgcaccugcacccuccuccgcgagauguccaagaacuuccccaccaucaccgcccucgaguggucccccucccacaaccucaagucccuccgcaagaagcagcucgccacccgcgaggccauggcccgccagaccgucgucuccgacaccgagcucuccaucgucgaguccuccgucaucucccuccuccaggaggccgaguccaaguccgagcucucccagaacaucuccgcccgcgagcacuucgucuucaccgacaucgacggccaggucuaccaccucaccgucgagggcaacuccgucaaggacuccgcccgcaucccccccgacggcuccaugggcuccaucaccugcaucgccuggaagggcgacacccucguccucggcgacauggacggcaaccucaacuucugggaccucaagggccgcgucucccgcggcauccccacccaccgcuccuggguccgcaagauccgcuucgcccccggcaagggcaaccagaagcucaucgccauguacaacgacggcgccgaggucugggacaccaaggagguccagauggucuccucccuccgcuccggccgcaacgucaccuuccgcauccucgacgucgacuggugcaccuccgacaaggucauccucgccuccgacgacggcugcauccgcguccucgagauguccaugaaguccgccugcuuccgcauggacgagcaggagcucaccgagcccgucuggugccccuaccuccucgucccccgcgccucccucgcccucaaggccuuccuccuccaccagcccuggaacggccaguacucccucgacaucucccacgucgacuaccccgagaacgaggagaucaagaaccuccuccaggagcagcucaacucccucuccaacgacaucaagaagcuccuccucgaccccgaguucacccuccuccagcgcugccuccucgucucccgccucuacggcgacgaguccgagcuccacuucuggaccgucgccgcccacuaccuccacucccucucccaggagaaguccgccuccaccaccgcccccaaggaggccgccccccgcgacaagcucuccaacccccucgacaucugcuacgacguccucugcgagaacgccuacuuccagaaguuccagcucgagcgcgucaaccuccaggaggucaagcgcuccaccuacgaccacacccgcaagugcaccgaccagcuccuccuccucggccagaccgaccgcgccguccagcuccuccucgagaccuccgccgacaaccagcacuacuacugcgacucccucaaggccugccucgucaccaccgucaccuccuccggccccucccaguccaccaucaagcucgucgccaccaacaugaucgccaacggcaagcucgccgagggcguccagcuccucugccucaucgacaaggccgccgacgccugccgcuaccuccagaccuacggcgaguggaaccgcgccgccuggcucgccaagguccgccucaaccccgaggagugcgccgacguccuccgccgcugggucgaccaccucugcuccccccaggucaaccagaaguccaaggcccuccucguccuccucucccucggcugcuucuucuccgucgccgagacccuccacuccaugcgcuacuucgaccgcgccgcccucuucgucgaggccugccucaaguacggcgccuucgaggucaccgaggacaccgagaagcucaucaccgccaucuacgccgacuacgcccgcucccucaagaaccucggcuucaagcagggcgccguccucuucgccuccaaggccggcgccgccggcaaggaccuccucaacgagcucgagucccccaaggaggagcccaucgaggaguga

SEQ ID NO: 51736 - RNA, 1272 nt, Artificial Sequence
  derived and/or modified sequence opt2 from WDR12__Homo_sapiens__NP_060726
auggcccagcuccagacccgcuucuacaccgacaacaagaaguacgccgucgacgacguccccuucuccauccccgccgccuccgagaucgccgaccucuccaacaucaucaacaagcuccucaaggacaagaacgaguuccacaagcacgucgaguucgacuuccucaucaagggccaguuccuccgcaugccccucgacaagcacauggagauggagaacaucuccuccgaggaggucgucgagaucgaguacgucgagaaguacaccgccccccagcccgagcagugcauguuccacgacgacuggaucuccuccaucaagggcgccgaggaguggauccucaccggcuccuacgacaagaccucccgcaucuggucccucgagggcaaguccaucaugaccaucgucggccacaccgacgucgucaaggacgucgccugggucaagaaggacucccucuccugccuccuccucuccgccuccauggaccagaccauccuccucugggaguggaacgucgagcgcaacaaggucaaggcccuccacugcugccgcggccacgccggcuccgucgacuccaucgccgucgacggcuccggcaccaaguucugcuccggcuccugggacaagaugcucaagaucugguccaccguccccaccgacgaggaggacgagauggaggaguccaccaaccgcccccgcaagaagcagaagaccgagcagcucggccucacccgcacccccaucgucacccucuccggccacauggaggccgucuccuccguccucugguccgacgccgaggagaucugcuccgccuccugggaccacaccauccgcgucugggacgucgaguccggcucccucaaguccacccucaccggcaacaaggucuucaacugcaucuccuacuccccccucugcaagcgccucgccuccggcuccaccgaccgccacauccgccucugggacccccgcaccaaggacggcucccucgucucccucucccucaccucccacaccggcugggucaccuccgucaaguggucccccacccacgagcagcagcucaucuccggcucccucgacaacaucgucaagcucugggacacccgcuccugcaaggccccccucuacgaccucgccgcccacgaggacaagguccucuccgucgacuggaccgacaccggccuccuccucuccggcggcgccgacaacaagcucuacuccuaccgcuacucccccaccaccucccacgucggcgccuga

SEQ ID NO: 51737 - RNA, 3969 nt, Artificial Sequence
  derived and/or modified sequence opt2 from WDR17__Homo_sapiens__NP_733828
auggccuggaugaccuacaucuccaacugguucgagcaggacgacugguacgagggccuccagcgcgccaacaugucccagguccgccaggucggccuccucgccgccggcugccagcccuggaacaaggacgucugcgccgccuccggcgaccgcuucgccuacugcgccacccucgccaucuacaucuaccagcucgaccaccgcuacaacgaguucaagcuccacgccaucauguccgagcacaagaagaccaucaccgccaucuccuggugcccccacaaccccgaccucuucgccuccggcuccaccgacaaccucgucaucaucuggaacgucgccgagcagaaggucaucgccaagcucgacuccaccaagggcauccccgccucccucuccuggugcuggaacgccgaggacgucgucgccuucgucucccaccgcggcccccucuucaucuggaccaucuccggccccgacuccggcgucaucguccacaaggacgcccacuccuuccucuccgacaucugcauguuccgcuggcacacccaccagaagggcaaggucgucuucggccacaucgacggcucccucuccaucuuccaccccggcaacaagaaccagaagcacguccuccgccccgagucccucgagggcaccgacgaggaggaccccgucaccgcccucgagugggacccccucuccaccgacuaccuccucgucgucaaccuccacuacggcauccgccucgucgacuccgagucccucuccugcaucaccaccuucaaccuccccuccgccgccgccuccguccagugccucgccuggguccccuccgcccccggcauguucaucaccggcgacucccaggucggcguccuccgcaucuggaacgucucccgcaccacccccaucgacaaccucaagcucaagaagaccggcuuccacugccuccacguccucaacucccccccccgcaagaaguucuccguccagucccccaccaagaaccacuacaccuccuccaccuccgaggccguccccccccccacccucacccagaaccaggccuucucccucccccccggccacgccgucugcugcuuccucgacggcggcgucggccucuacgacaugggcgccaagaagugggacuuccuccgcgaccucggccacgucgagaccaucuucgacugcaaguucaagcccgacgaccccaaccuccucgccaccgccuccuucgacggcaccaucaaggucugggacaucaacacccucaccgccgucuacaccucccccggcaacgagggcgucaucuacucccucuccugggcccccggcggccucaacugcaucgccggcggcaccucccgcaacggcgccuucaucuggaacguccagaagggcaagaucauccagcgcuucaacgagcacggcaccaacggcaucuucugcaucgccuggucccacaaggacuccaagcgcaucgccaccugcuccuccgacggcuucugcaucauccgcaccaucgacggcaagguccuccacaaguacaagcaccccgccgccgucuucggcugcgacuggucccagaacaacaaggacaugaucgccaccggcugcgaggacaccaacguccgcgucuacuacgucgccaccuccuccgaccagccccucaaggucuucuccggccacaccgccaaggucuuccacgucaagugguccccccuccgcgagggcauccucugcuccggcuccgacgacggcaccguccgcaucugggacuacacccaggacgccugcaucaacauccucaacggccacaccgcccccguccgcggccucauguggaacaccgagauccccuaccuccucaucuccggcuccugggacuacaccaucaaggucugggacacccgcgagggcaccugcgucgacaccgucuacgaccacggcgccgacgucuacggccucaccugccaccccucccgccccuucaccauggccuccugcucccgcgacuccaccguccgccucuggucccucaccgcccucgucacccccguccagaucaacauccucgccgaccgcuccugggaggagaucaucggcaacaccgacuacgccaucgagcccggcacccccccccuccucugcggcaaggucucccgcgacauccgccaggagaucgagaagcucaccgccaacucccaggucaagaagcuccgcugguucuccgagugccucuccccccccggcggcuccgacaaccucuggaaccucgucgccgucaucaagggccaggacgacucccuccucccccagaacuacugcaagggcaucaugcaccucaagcaccucaucaaguuccgcaccuccgaggcccaggagcucaccaccgucaagauguccaaguucggcggcggcaucggcguccccgccaaggaggagcgccucaaggaggccgccgagauccaccuccgccucggccagauccagcgcuacugcgagcucauggucgagcucggcgagugggacaaggcccucuccaucgcccccggcgucuccgucaaguacuggaagaagcucaugcagcgccgcgccgaccagcucauccaggaggacaaggacgacgucauccccuacugcaucgccaucggcgacgucaagaagcucguccacuucuucaugucccgcggccagcucaaggaggcccuccucgucgcccaggccgccugcgagggcaacaugcagccccuccacgucuccguccccaagggcgccuccuacuccgacgacaucuacaaggaggacuucaacgagcuccuccacaaggucuccaaggagcucgccgagugguacuuccaggacggccgcgccguccucgccgccugcugccaccucgccaucgacaacaucgagcucgccauggccuaccucauccgcggcaacgagcucgagcucgccgucugcgucggcaccguccucggcgaguccgccgcccccgccacccacuacgcccucgagcuccucgcccgcaagugcaugaugaucuccgucugcuuccccugcgucggcuacuccguccccuucugcuacgucaaccgcaaccucgccgccgaccuccuccucaugauccccgacaacgagcuccaccucaucaagcucugcgccuucuaccccggcugcaccgaggagaucaacgaccuccacgacaagugcaagcuccccaccgucgaggagugcaugcagcucgccgagaccgcccgcgccgacgacaacaucuucgagaccgucaaguacuaccuccucucccaggagcccgagaaggcccuccccaucggcaucuccuucgucaaggaguacaucuccuccuccgacuggacccucgacaccaucuaccccguccucgaccuccucuccuacauccgcaccgagaagcuccuccuccacaccugcaccgaggcccgcaacgagcuccucauccucugcggcuacaucggcgcccuccucgccauccgccgccaguaccaguccaucguccccgcccucuacgaguacaccucccagcuccucaagcgccgcgaggucuccgucccccucaagaucgaguaccucuccgaggagcucgacgccuggcgcgccugcacccaguccaccaaccgcucccucgaggacucccccuacaccccccccuccgacucccagcgcaugaucuacgccacccuccucaagcgccucaaggaggagucccucaagggcaucaucggccccgacuacgucaccggcuccaaccuccccucccacuccgacauccacaucuccugccucaccggccucaagauccagggccccgucuucuuccucgaggacggcaaguccgccaucucccucaacgacgcccucaugugggccaaggucaaccccuucuccccccucggcaccggcauccgccucaaccccuucuga

SEQ ID NO: 51738 - RNA, 4029 nt, Artificial Sequence
  derived and/or modified sequence opt2 from WDR19__Homo_sapiens__NP_079408
augaagcgcaucuucucccuccucgagaagaccuggcucggcgcccccauccaguucgccuggcagaagaccuccggcaacuaccucgccgucaccggcgccgacuacaucgucaagaucuucgaccgccacggccagaagcgcuccgagaucaaccuccccggcaacugcgucgccauggacugggacaaggacggcgacguccucgccgucaucgccgagaaguccuccugcaucuaccucugggacgccaacaccaacaagaccucccagcucgacaacggcaugcgcgaccagauguccuuccuccucugguccaaggucggcuccuuccucgccgucggcaccgucaagggcaaccuccucaucuacaaccaccagaccucccgcaagauccccguccucggcaagcacaccaagcgcaucaccugcggcugcuggaacgccgagaaccuccucgcccucggcggcgaggacaagaugaucaccgucuccaaccaggagggcgacaccauccgccagacccagguccgcuccgagcccuccaacaugcaguucuuccucaugaagauggacgaccgcaccuccgccgccgaguccaugaucuccgucguccucggcaagaagacccucuucuuccucaaccucaacgagcccgacaaccccgccgaccucgaguuccagcaggacuucggcaacaucgucugcuacaacugguacggcgacggccgcaucaugaucggcuucuccugcggccacuucgucgucaucuccacccacaccggcgagcucggccaggagaucuuccaggcccgcaaccacaaggacaaccucaccuccaucgccgucucccagacccucaacaaggucgccaccugcggcgacaacugcaucaagauccaggaccucgucgaccucaaggacauguacgucauccucaaccucgacgaggagaacaagggccucggcacccucuccuggaccgacgacggccagcuccucgcccucuccacccagcgcggcucccuccacgucuuccucaccaagcuccccauccucggcgacgccugcuccacccgcaucgccuaccucaccucccuccucgaggucaccgucgccaaccccgucgagggcgagcuccccaucaccgucuccgucgacgucgagcccaacuucgucgccgucggccucuaccaccucgccgucggcaugaacaaccgcgccugguucuacguccucggcgagaacgccgucaagaagcucaaggacauggaguaccucggcaccgucgccuccaucugccuccacuccgacuacgccgccgcccucuucgagggcaagguccagcuccaccucaucgaguccgagauccucgacgcccaggaggagcgcgagacccgccucuuccccgccgucgacgacaagugccgcauccucugccacgcccucaccuccgacuuccucaucuacggcaccgacaccggcgucguccaguacuucuacaucgaggacuggcaguucgucaacgacuaccgccaccccgucuccgucaagaagaucuuccccgaccccaacggcacccgccucgucuucaucgacgagaaguccgacggcuucgucuacugccccgucaacgacgccaccuacgagauccccgacuucucccccaccaucaagggcguccucugggagaacuggcccauggacaagggcgucuucaucgccuacgacgacgacaaggucuacaccuacgucuuccacaaggacaccauccagggcgccaaggucauccucgccggcuccaccaagguccccuucgcccacaagccccuccuccucuacaacggcgagcucaccugccagacccaguccggcaaggucaacaacaucuaccucuccacccacggcuuccucuccaaccucaaggacaccggccccgacgagcuccgccccaugcucgcccagaaccucaugcucaagcgcuucuccgacgccugggagaugugccgcauccucaacgacgaggccgccuggaacgagcucgcccgcgccugccuccaccacauggaggucgaguucgccauccgcgucuaccgccgcaucggcaacgucggcaucgucaugucccucgagcagaucaagggcaucgaggacuacaaccuccucgccggccaccucgccauguucaccaacgacuacaaccucgcccaggaccucuaccucgccuccuccugccccaucgccgcccucgagaugcgccgcgaccuccagcacugggacuccgcccuccagcucgccaagcaccucgcccccgaccagauccccuucaucuccaaggaguacgccauccagcucgaguucgccggcgacuacgucaacgcccucgcccacuacgagaagggcaucaccggcgacaacaaggagcacgacgaggccugccucgccggcgucgcccagauguccauccgcaugggcgacauccgccgcggcgucaaccaggcccucaagcaccccucccgcguccucaagcgcgacugcggcgccauccucgagaacaugaagcaguucuccgaggccgcccagcucuacgagaagggccucuacuacgacaaggccgccuccgucuacauccgcuccaagaacugggccaaggucggcgaccuccucccccacgucuccucccccaagauccaccuccaguacgccaaggccaaggaggccgacggccgcuacaaggaggccgucgucgccuacgagaacgccaagcaguggcaguccgucauccgcaucuaccucgaccaccucaacaaccccgagaaggccgucaacaucguccgcgagacccagucccucgacggcgccaagauggucgcccgcuucuuccuccagcucggcgacuacggcuccgccauccaguuccucgucauguccaagugcaacaacgaggccuucacccucgcccagcagcacaacaagauggagaucuacgccgacaucaucggcuccgaggacaccaccaacgaggacuaccaguccaucgcccucuacuucgagggcgagaagcgcuaccuccaggccggcaaguucuuccuccucugcggccaguacucccgcgcccucaagcacuuccucaagugccccuccuccgaggacaacgucgccaucgagauggccaucgagaccgucggccaggccaaggacgagcuccucaccaaccagcucaucgaccaccuccucggcgagaacgacggcaugcccaaggacgccaaguaccucuuccgccucuacauggcccucaagcaguaccgcgaggccgcccagaccgccaucaucaucgcccgcgaggagcaguccgccggcaacuaccgcaacgcccacgacguccucuucuccauguacgccgagcucaagucccagaagaucaagauccccuccgagauggccaccaaccucaugauccuccacuccuacauccucgucaagauccacgucaagaacggcgaccacaugaagggcgcccgcaugcucauccgcgucgccaacaacaucuccaaguuccccucccacaucguccccauccucaccuccaccgucaucgagugccaccgcgccggccucaagaacuccgccuucuccuucgccgccaugcucaugcgccccgaguaccgcuccaagaucgacgccaaguacaagaagaagaucgagggcaugguccgccgccccgacaucuccgagaucgaggaggccaccacccccugccccuucugcaaguuccuccuccccgagugcgagcuccucugccccggcugcaagaacuccauccccuacugcaucgccaccggccgccacaugcucaaggacgacuggaccgucugcccccacugcgacuuccccgcccucuacuccgagcucaagaucaugcucaacaccgaguccaccugccccaugugcuccgagcgccucaacgccgcccagcucaagaagaucuccgacugcacccaguaccuccgcaccgaggaggagcucuga

SEQ ID NO: 51739 - RNA, 1401 nt, Artificial Sequence
  derived and/or modified sequence opt2 from WDR1__Homo_sapiens__NP_005103
augcccuacgagaucaagaaggucuucgccucccucccccaggucgagcgcggcgucuccaagaucaucggcggcgaccccaagggcaacaacuuccucuacaccaacggcaagugcgucauccuccgcaacaucgacgaccacucccgcuucgucaacugcguccgcuucucccccgacggcaaccgcuucgccaccgccuccgccgacggccagaucuacaucuacgacggcaagaccggcgagaaggucugcgcccucggcggcuccaaggcccacgacggcggcaucuacgccaucuccuggucccccgacuccacccaccuccucuccgccuccggcgacaagaccuccaagaucugggacgucuccgucaacuccgucgucuccaccuuccccaugggcuccaccguccucgaccagcagcucggcugccucuggcagaaggaccaccuccucuccgucucccucuccggcuacaucaacuaccucgaccgcaacaaccccuccaagccccuccacgucaucaagggccacuccaaguccauccagugccucaccguccacaagaacggcggcaaguccuacaucuacuccggcucccacgacggccacaucaacuacugggacuccgagaccggcgagaacgacuccuucgccggcaagggccacaccaaccaggucucccgcaugaccgucgacgaguccggccagcucaucuccugcuccauggacgacaccguccgcuacaccucccucaugcuccgcgacuacuccggccagggcgucgucaagcucgacguccagcccaagugcgucgccgucggccccggcggcuacgccgucgucgucugcaucggccagaucguccuccucaaggaccagcgcaagugcuucuccaucgacaaccccggcuacgagcccgaggucgucgccguccaccccggcggcgacaccgucgccaucggcggcgucgacggcaacguccgccucuacuccauccucggcaccacccucaaggacgagggcaagcuccucgaggccaagggccccgucaccgacgucgccuacucccacgacggcgccuuccucgccgucugcgacgccuccaaggucgucaccgucuucuccgucgccgacggcuacuccgagaacaacgucuucuacggccaccacgccaagaucgucugccucgccuggucccccgacaacgagcacuucgccuccggcggcauggacaugauggucuacgucuggacccucuccgaccccgagacccgcgucaagauccaggacgcccaccgccuccaccacgucuccucccucgccuggcucgacgagcacacccucgucaccaccucccacgacgccuccgucaaggaguggaccaucaccuacuga

SEQ ID NO: 51740 - RNA, 588 nt, Artificial Sequence
  derived and/or modified sequence opt2 from WDR20__Homo_sapiens__NP_001229344
auggccaccgagggcggcggcaaggagaugaacgagaucaagacccaguucaccacccgcgagggccucuacaagcuccucccccacuccgaguacucccgccccaaccgcguccccuucaacucccagggcuccaaccccguccgcgucuccuucgucaaccucaacgaccaguccggcaacggcgaccgccucugcuucaacgucggccgcgagcucuacuucuacaucuacaagggcguccgcaaggccgccgaccucuccaagcccaucgacaagcgcaucuacaagggcacccagcccaccugccacgacuucaaccaccucaccgccaccgccgaguccgucucccuccucgucggcuucuccgccggccagguccagcucaucgaccccaucaagaaggagaccuccaagcucuucaacgaggagaacuccugccagcaccucuggaaggucgacuggaacgaggagcgccagaacgagggcuccaagaccuccgaggaggcccucgucaccguccagcccgccgagcacuucugccgccaggaggaccgcaugcagggcguccuccaggaccagaacuga

SEQ ID NO: 51741 - RNA, 1938 nt, Artificial Sequence
  derived and/or modified sequence opt2 from WDR26__Homo_sapiens__NP_001108585
augcaggccaacggcgccggcggcggcggcggcggcggcggcggcggcggcggcggcggcggcggcggcggcggccagggccagacccccgagcucgccugccucuccgcccagaacggcgaguccucccccuccuccuccuccuccgccggcgaccucgcccacgccaacggccuccuccccuccgcccccuccgccgccuccaacaacuccaacucccucaacgucaacaacggcguccccggcggcgccgccgccgccuccuccgccaccgucgccgccgccuccgccaccaccgccgccuccuccucccucgccacccccgagcucggcuccucccucaagaagaagaagcgccucucccaguccgacgaggacgucauccgccucaucggccagcaccucaacggccucggccucaaccagaccgucgaccuccucaugcaggaguccggcugccgccucgagcaccccuccgccaccaaguuccgcaaccacgucauggagggcgacugggacaaggccgagaacgaccucaacgagcucaagccccucguccacuccccccacgccaucguccgcaugaaguuccuccuccuccagcagaaguaccucgaguaccucgaggacggcaagguccucgaggcccuccagguccuccgcugcgagcucaccccccucaaguacaacaccgagcgcauccacguccucuccggcuaccucaugugcucccacgccgaggaccuccgcgccaaggccgagugggagggcaagggcaccgccucccgcuccaagcuccucgacaagcuccagaccuaccucccccccuccgucaugcuccccccccgccgccuccagacccuccuccgccaggccgucgagcuccagcgcgaccgcugccucuaccacaacaccaagcucgacaacaaccucgacuccgucucccuccucaucgaccacgucugcucccgccgccaguuccccugcuacacccagcagauccucaccgagcacugcaacgaggucugguucugcaaguucuccaacgacggcaccaagcucgccaccggcuccaaggacaccaccgucaucaucuggcaggucgaccccgacacccaccuccucaagcuccucaagacccucgagggccacgccuacggcgucuccuacaucgccuggucccccgacgacaacuaccucgucgccugcggccccgacgacugcuccgagcucuggcucuggaacguccagaccggcgagcuccgcaccaagaugucccagucccacgaggacucccucaccuccgucgccuggaaccccgacggcaagcgcuucgucaccggcggccagcgcggccaguucuaccagugcgaccucgacggcaaccuccucgacuccugggagggcguccgcguccagugccucuggugccucuccgacggcaagaccguccucgccuccgacacccaccagcgcauccgcggcuacaacuucgaggaccucaccgaccgcaacaucguccaggaggaccaccccaucauguccuucaccaucuccaagaacggccgccucgcccuccucaacgucgccacccagggcguccaccucugggaccuccaggaccgcguccucguccgcaaguaccagggcgucacccagggcuucuacaccauccacuccugcuucggcggccacaacgaggacuucaucgccuccggcuccgaggaccacaaggucuacaucuggcacaagcgcuccgagcuccccaucgccgagcucaccggccacacccgcaccgucaacugcgucuccuggaacccccagauccccuccaugauggccuccgccuccgacgacggcaccguccgcaucuggggccccgcccccuucaucgaccaccagaacaucgaggaggagugcuccuccauggacuccuga

SEQ ID NO: 51742 - RNA, 1104 nt, Artificial Sequence
  derived and/or modified sequence opt2 from WDR31__Homo_sapiens__NP_001012361
augcuccuccuccgcugccagcucaagcaggcccccccccagaaggucuccuuccgcuucugcgucgucaugggcaagcagcaguccaagcucaagcacuccaccuacaaguacggccgccccgacgagaucaucgaggagcgcauccagaccaaggccuuccaggaguacucccccgcccacauggacaccgucuccgucgucgccgcccucaacuccgaccucugcgucuccggcggcaaggacaagaccgucgucgccuacaacuggaagaccggcaacgucgucaagcgcuucaagggccacgagcacgagaucaccaaggucgccugcauccccaaguccucccaguucuucuccgccucccgcgaccgcauggucaugaugugggaccuccacggcuccucccagccccgccagcagcucugcggccacgccauggucgucaccggccucgccgucucccccgacuccucccagcucugcaccggcucccgcgacaacacccuccuccucugggacgucgucaccggccaguccgucgagcgcgccuccgucucccgcaacgucgucacccaccucugcugggucccccgcgagcccuacauccuccagaccuccgaggacaagacccuccgccucugggacucccgcggccuccaggucgcccacauguuccccgccaagcagcacauccagaccuacugcgaggucuccgucgacggccacaagugcaucuccugcuccaacggcuucggcggcgagggcugcgaggccacccucugggaccuccgccagacccgcaaccgcaucugcgaguacaagggccacuuccagaccgucgccuccugcgucuuccucccccgcgcccucgcccucaugccccucaucgccaccuccucccacgacugcaaggucaagaucuggaaccaggacaccggcgccugccucuucacccucucccucgacggcuccggcccccucaccucccucgccgucggcgacgccaucucccuccucugcgccuccuucaaccgcggcauccaccuccuccgcauggaccacucccagggccucgagcuccaggaggucgccgccuucuga

SEQ ID NO: 51743 - RNA, 1611 nt, Artificial Sequence
  derived and/or modified sequence opt2 from WDR34__Homo_sapiens__NP_443076
auggccacccgcgcccagcccggcccccucucccaggccggcuccgccggcgucgccgcccucgccaccgucggcgucgccuccggccccggccccggccgccccggcccccuccaggacgagacccucggcgucgccuccguccccucccaguggcgcgccguccagggcauccgcugggagaccaaguccugccagaccgccuccaucgccaccgccuccgccuccgcccaggcccgcaaccacgucgacgcccagguccagaccgaggcccccguccccgucuccguccagccccccucccaguacgacaucccccgccucgccgccuuccuccgccgcgucgaggccauggucauccgcgagcucaacaagaacuggcagucccacgccuucgacggcuucgaggucaacuggaccgagcagcagcagauggucuccugccucuacacccucggcuacccccccgcccaggcccagggccuccacgucaccuccaucuccuggaacuccaccggcuccgucgucgccugcgccuacggccgccucgaccacggcgacugguccacccucaaguccuucgucugcgccuggaaccucgaccgccgcgaccuccgcccccagcagcccuccgccgucgucgagguccccuccgccguccucugccucgccuuccaccccacccagcccucccacgucgccggcggccucuacuccggcgagguccucgucugggaccucucccgccucgaggacccccuccucuggcgcaccggccucaccgacgacacccacaccgaccccgucucccaggucgucuggcuccccgagcccggccacucccaccgcuuccagguccucuccgucgccaccgacggcaagguccuccucuggcagggcaucggcgucggccagcuccagcucaccgagggcuucgcccucgucaugcagcagcucccccgcuccaccaagcucaagaagcacccccgcggcgagaccgaggucggcgccaccgccgucgccuucuccuccuucgacccccgccucuucauccucggcaccgagggcggcuucccccucaagugcucccucgccgccggcgaggccgcccucacccgcaugcccuccuccgucccccuccgcgcccccgcccaguucaccuucuccccccacggcggccccaucuacuccgucuccugcucccccuuccaccgcaaccucuuccucuccgccggcaccgacggccacguccaccucuacuccaugcuccaggcccccccccucaccucccuccagcucucccucaaguaccucuucgccguccgcuggucccccguccgcccccucgucuucgccgccgccuccggcaagggcgacguccagcucuucgaccuccagaaguccucccagaagcccaccguccucaucaagcagacccaggacgagucccccgucuacugccucgaguucaacucccagcagacccagcuccucgccgccggcgacgcccagggcaccgucaaggucuggcagcucuccaccgaguucaccgagcagggcccccgcgaggccgaggaccucgacugccucgccgccgaggucgccgccuga

SEQ ID NO: 51744 - RNA, 3546 nt, Artificial Sequence
  derived and/or modified sequence opt2 from WDR35__Homo_sapiens__NP_001006658
auguucuucuaccucuccaagaagaucuccauccccaacaacgucaagcuccagugcgucuccuggaacaaggagcagggcuucaucgccugcggcggcgaggacggccuccucaagguccucaagcucgagacccagaccgacgacgccaagcuccgcggccucgccgcccccuccaaccucuccaugaaccagacccucgagggccacuccggcuccguccaggucgucaccuggaacgagcaguaccagaagcucaccaccuccgacgagaacggccucaucaucgucuggaugcucuacaagggcuccuggaucgaggagaugaucaacaaccgcaacaaguccgucguccgcuccauguccuggaacgccgacggccagaagaucugcaucgucuacgaggacggcgccgucaucgucggcuccgucgacggcaaccgcaucuggggcaaggaccucaagggcauccagcucucccacgucaccugguccgccgacuccaagguccuccucuucggcauggccaacggcgagauccacaucuacgacaaccagggcaacuucaugaucaagaugaagcucuccugccucgucaacgucaccggcgccaucuccaucgccggcauccacugguaccacggcaccgagggcuacgucgagcccgacugccccugccucgccgucugcuucgacaacggccgcugccagaucaugcgccacgagaacgaccagaaccccguccucaucgacaccggcauguacgucgucggcauccaguggaaccacaugggcuccguccucgccgucgccggcuuccagaaggccgccaugcaggacaaggacgucaacaucguccaguucuacacccccuucggcgagcaccucggcacccucaagguccccggcaaggagaucuccgcccucuccugggagggcggcggccucaagaucgcccucgccgucgacuccuucaucuacuucgccaacauccgccccaacuacaaguggggcuacugcuccaacaccgucgucuacgccuacacccgccccgaccgccccgaguacugcgucgucuucugggacaccaagaacaacgagaaguacgucaaguacgucaagggccucaucuccaucaccaccugcggcgacuucugcauccucgccaccaaggccgacgagaaccacccccaggaggagaacgagauggagaccuucggcgccaccuucguccucguccucugcaacuccaucggcaccccccucgaccccaaguacaucgacaucgucccccucuucgucgccaugaccaagacccacgucaucgccgccuccaaggaggccuucuacaccuggcaguaccgcgucgccaagaagcucaccgcccucgagaucaaccagaucacccgcucccgcaaggagggccgcgagcgcaucuaccacgucgacgacacccccuccggcuccauggacggcguccucgacuacuccaagaccauccagggcacccgcgaccccaucugcgccaucaccgccuccgacaagauccucaucgucggccgcgaguccggcaccauccagcgcuacucccuccccaacgucggccucauccagaaguacucccucaacugccgcgccuaccagcucucccucaacugcaacuccucccgccucgccaucaucgacaucuccggcguccucaccuucuucgaccucgacgcccgcgucaccgacuccaccggccagcaggucgucggcgagcuccucaagcucgagcgccgcgacgucugggacaugaagugggccaaggacaaccccgaccucuucgccaugauggagaagacccgcauguacgucuuccgcaaccucgaccccgaggagcccauccagaccuccggcuacaucugcaacuucgaggaccucgagaucaaguccguccuccucgacgagauccucaaggaccccgagcaccccaacaaggacuaccucaucaacuucgagauccgcucccuccgcgacucccgcgcccucaucgagaaggucggcaucaaggacgccucccaguucaucgaggacaacccccacccccgccucuggcgccuccucgccgaggccgcccuccagaagcucgaccucuacaccgccgagcaggccuucguccgcugcaaggacuaccagggcaucaaguucgucaagcgccucggcaagcuccucuccgaguccaugaagcaggccgaggucgucggcuacuucggccgcuucgaggaggccgagcgcaccuaccucgagauggaccgccgcgaccucgccaucggccuccgccucaagcucggcgacugguuccgcguccuccagcuccucaagaccggcuccggcgacgccgacgacucccuccucgagcaggccaacaacgccaucggcgacuacuucgccgaccgccagaaguggcucaacgccguccaguacuacguccagggccgcaaccaggagcgccucgccgagugcuacuacaugcucgaggacuacgagggccucgagaaccucgccaucucccuccccgagaaccacaagcuccuccccgagaucgcccagauguucguccgcgucggcaugugcgagcaggccgucaccgccuuccucaagugcucccagcccaaggccgccgucgacaccugcguccaccucaaccaguggaacaaggccgucgagcucgccaagaaccacuccaugaaggagaucggcucccuccucgcccgcuacgccucccaccuccucgagaagaacaagacccucgacgccaucgagcucuaccgcaaggccaacuacuucuucgacgccgccaagcucauguucaagaucgccgacgaggaggccaagaagggcuccaagccccuccgcgucaagaagcucuacguccucuccgcccuccucaucgagcaguaccacgagcagaugaagaacgcccagcgcggcaaggucaagggcaaguccuccgaggccaccuccgcccucgccggccuccucgaggaggagguccucuccaccaccgaccgcuucaccgacaacgccuggcgcggcgccgaggccuaccacuucuucauccucgcccagcgccagcucuacgagggcugcgucgacaccgcccucaagaccgcccuccaccucaaggacuacgaggacaucaucccccccgucgagaucuacucccuccucgcccucugcgccugcgccucccgcgccuucggcaccugcuccaaggccuucaucaagcucaagucccucgagacccucuccuccgagcagaagcagcaguacgaggaccucgcccucgagaucuucaccaagcacaccuccaaggacaaccgcaagcccgagcucgacucccucauggagggcggcgagggcaagcuccccaccugcgucgccaccggcucccccaucaccgaguaccaguucuggaugugcuccgucugcaagcacggcguccucgcccaggagaucucccacuacuccuucugcccccucugccacucccccgucggcuga

SEQ ID NO: 51745 - RNA, 2856 nt, Artificial Sequence
  derived and/or modified sequence opt2 from WDR36__Homo_sapiens__NP_644810
augugcugcaccgagggcucccuccgcaagcgcgacucccagcgcgcccccgaggccguccucugccuccagcucuggcagcgcaccgucccccucgacacccucaagggccucggcaccugcuuccccuccggccccgagcuccgcggcgccggcaucgccgccgccauggagcgcgccuccgagcgccgcaccgccuccgcccucuucgccggcuuccgcgcccucggccucuucuccaacgacaucccccacgucguccgcuucuccgcccucaagcgccgcuucuacgucaccaccugcgucggcaaguccuuccacaccuacgacguccagaagcucucccucgucgccgucuccaacuccgucccccaggacaucugcugcauggccgccgacggccgccucgucuucgccgccuacggcaacgucuucuccgccuucgcccgcaacaaggagaucguccacaccuucaagggccacaaggccgagauccacuuccuccagcccuucggcgaccacaucaucuccgucgacaccgacggcauccucaucaucuggcacaucuacuccgaggaggaguaccuccagcucaccuucgacaaguccgucuucaagaucuccgccauccuccaccccuccaccuaccucaacaagauccuccucggcuccgagcagggcucccuccagcucuggaacgucaaguccaacaagcuccucuacaccuuccccggcuggaaggucggcgucaccgcccuccagcaggcccccgccgucgacgucgucgccaucggccucauguccggccaggucaucauccacaacaucaaguucaacgagacccucaugaaguuccgccaggacuggggccccaucaccuccaucuccuuccgcaccgacggccaccccgucauggccgccggcucccccugcggccacaucggccucugggaccucgaggacaagaagcucaucaaccagaugcgcaacgcccacuccaccgccaucgccggccucaccuuccuccaccgcgagccccuccucgucaccaacggcgccgacaacgcccuccgcaucuggaucuucgacggccccaccggcgagggccgccuccuccgcuuccgcaugggccacuccgccccccucaccaacauccgcuacuacggccagaacggccagcagauccucuccgccucccaggacggcacccuccaguccuucuccaccguccacgagaaguucaacaagucccucggccacggccucaucaacaagaagcgcgucaagcgcaagggccuccagaacaccauguccguccgccucccccccaucaccaaguucgccgccgaggaggcccgcgaguccgacugggacggcaucaucgccugccaccagggcaagcucuccugcuccaccuggaacuaccagaaguccaccaucggcgccuacuuccucaagcccaaggagcucaagaaggacgacaucaccgccaccgccgucgacaucaccuccugcggcaacuucgccgucaucggccucuccuccggcaccgucgacgucuacaacaugcaguccggcauccaccgcggcuccuucggcaaggaccaggcccacaagggcuccguccgcggcgucgccgucgacggccucaaccagcucaccgucaccaccggcuccgagggccuccucaaguucuggaacuucaagaacaagauccucauccacuccgucucccucuccuccucccccaacaucaugcuccuccaccgcgacuccggcauccucggccucgcccucgacgacuucuccaucuccguccucgacaucgagacccgcaagaucguccgcgaguucuccggccaccagggccagaucaacgacauggccuucucccccgacggccgcuggcucaucuccgccgccauggacugcuccauccgcaccugggaccuccccuccggcugccucaucgacugcuuccuccucgacuccgccccccucaacgucuccaugucccccaccggcgacuuccucgccaccucccacgucgaccaccucggcaucuaccucugguccaacaucucccucuacuccgucgucucccuccgcccccuccccgccgacuacguccccuccaucgucaugcuccccggcaccugccagacccaggacgucgaggucuccgaggagaccgucgagcccuccgacgagcucaucgaguacgacucccccgagcagcucaacgagcagcucgucacccucucccuccuccccgagucccgcuggaagaaccuccucaaccucgacgucaucaagaagaagaacaagcccaaggagccccccaagguccccaaguccgcccccuucuucauccccaccauccccggccucgucccccgcuacgccgcccccgagcagaacaacgacccccagcaguccaaggucgucaaccucggcguccucgcccagaaguccgacuucugccucaagcucgaggagggccucgucaacaacaaguacgacaccgcccucaaccuccucaaggaguccggccccuccggcaucgagaccgagcuccgcucccucucccccgacugcggcggcuccaucgaggucaugcaguccuuccucaagaugaucggcaugaugcucgaccgcaagcgcgacuucgagcucgcccaggccuaccucgcccucuuccucaagcuccaccucaagaugcuccccuccgagcccguccuccucgaggagaucaccaaccucuccucccaggucgaggagaacuggacccaccuccagucccucuucaaccaguccaugugcauccucaacuaccucaaguccgcccuccucuga

SEQ ID NO: 51746 - RNA, 1485 nt, Artificial Sequence
  derived and/or modified sequence opt2 from WDR37__Homo_sapiens__NP_054742
augcccaccgaguccgccuccugcuccaccgcccgccagaccaagcagaagcgcaagucccacucccucuccauccgccgcaccaacuccuccgagcaggagcgcaccggccucccccgcgacaugcucgagggccaggacuccaagcuccccuccuccguccgcuccacccuccucgagcucuucggccagaucgagcgcgaguucgagaaccucuacaucgagaaccucgagcuccgccgcgagaucgacacccucaacgagcgccucgccgccgagggccaggccaucgacggcgccgagcucuccaagggccagcucaagaccaaggccucccacuccaccucccagcucucccagaagcucaagaccaccuacaaggccuccaccuccaagaucgucuccuccuucaagaccaccaccucccgcgccgccugccagcucgucaaggaguacaucggccaccgcgacggcaucugggacgucuccgucgccaagacccagcccgucguccucggcaccgccuccgccgaccacaccgcccuccucugguccaucgagaccggcaagugccucgucaaguacgccggccacgucggcuccgucaacuccaucaaguuccaccccuccgagcagcucgcccucaccgccuccggcgaccagaccgcccacaucuggcgcuacgccguccagcuccccaccccccagcccgucgccgacaccuccaucuccggcgaggacgaggucgagugcuccgacaaggacgagcccgaccucgacggcgacgucuccuccgacugccccaccauccgcgucccccucaccucccucaagucccaccagggcgucgucaucgccuccgacuggcucgucggcggcaagcaggccgucaccgccuccugggaccgcaccgccaaccucuacgacgucgagaccuccgagcucguccacucccucaccggccacgaccaggagcucacccacugcugcacccaccccacccagcgccucgucgucaccuccucccgcgacaccaccuuccgccucugggacuuccgcgaccccuccauccacuccgucaacgucuuccagggccacaccgacaccgucaccuccgccgucuucaccgucggcgacaacgucgucuccggcuccgacgaccgcaccgucaaggucugggaccucaagaacaugcgcucccccaucgccaccauccgcaccgacuccgccaucaaccgcaucaacgucugcgucggccagaagaucaucgcccucccccacgacaaccgccagguccgccucuucgacauguccggcguccgccucgcccgccucccccgcuccucccgccagggccaccgccgcauggucugcugcuccgccugguccgaggaccaccccgucugcaaccucuucaccugcggcuucgaccgccaggccaucggcuggaacaucaacauccccgcccuccuccaggagaaguga

SEQ ID NO: 51747 - RNA, 2034 nt, Artificial Sequence
  derived and/or modified sequence opt2 from WDR43__Homo_sapiens__NP_055946
auggccgccggcggcggcggcuccugcgacccccucgcccccgccggcguccccugcgccuucuccccccacucccaggccuacuucgcccucgccuccaccgacggccaccuccgcgucugggagaccgccaacaaccgccuccaccaggaguacguccccuccgcccaccucuccggcaccugcaccugccucgccugggcccccgcccgccuccaggccaaggaguccccccagcgcaagaagcgcaaguccgaggccgucggcauguccaaccagaccgaccuccucgcccucggcaccgccgucggcuccauccuccucuacuccaccgucaagggcgagcuccacuccaagcucaucuccggcggccacgacaaccgcgucaacugcauccaguggcaccaggacuccggcugccucuacuccugcuccgacgacaagcacaucgucgaguggaacguccagaccugcaaggucaagugcaaguggaagggcgacaacuccuccgucuccucccucugcaucucccccgacggcaagaugcuccucuccgccggccgcaccaucaagcucuggguccucgagaccaaggaggucuaccgccacuucaccggccacgccacccccgucuccucccucauguucaccaccauccgcccccccaacgagucccagcccuucgacggcaucaccggccucuacuuccucuccggcgccguccacgaccgccuccucaacgucuggcagguccgcuccgagaacaaggagaaguccgccgucauguccuucaccgucaccgacgagcccgucuacaucgaccucacccucuccgagaacaaggaggagcccgucaagcucgccgucgucugccgcgacggccagguccaccucuucgagcacauccucaacggcuacugcaagaagccccucaccuccaacugcaccauccagaucgccacccccggcaagggcaagaaguccacccccaagcccauccccauccucgccgccggcuucugcuccgacaagaugucccuccuccucgucuacggcuccugguuccagcccaccaucgagcgcgucgcccucaacucccgcgagccccacaugugccucguccgcgacaucuccaacugcugggcccccaaggucgagaccgccaucaccaagguccgcacccccgucaugaacuccgaggccaagguccucguccccggcauccccggccaccacgccgccaucaagcccgcccccccccagaccgagcaggucgaguccaagcgcaaguccggcggcaacgaggucuccaucgaggagcgccucggcgccauggacaucgacacccacaagaagggcaaggaggaccuccagaccaacuccuuccccguccuccucacccagggccucgaguccaacgacuucgagaugcucaacaagguccuccagacccgcaacgucaaccucaucaagaagaccguccuccgcaugccccuccacaccaucaucccccuccuccaggagcucaccaagcgccuccagggccaccccaacuccgccguccucaugguccaguggcucaagugcguccucaccguccacgccuccuaccucuccacccuccccgaccucgucccccagcucggcacccucuaccagcucauggagucccgcgucaagaccuuccagaagcucucccaccuccacggcaagcucauccuccucaucacccaggucaccgccuccgagaagaccaagggcgccaccucccccggccagaaggccaagcucgucuacgaggaggaguccuccgaggaggaguccgacgacgagaucgccgacaaggacuccgaggacaacugggacgaggacgaggaggaguccgaguccgagaaggacgaggacgucgaggaggaggacgaggacgccgagggcaaggacgaggagaacggcgaggaccgcgacaccgccuccgagaaggagcucaacggcgacuccgaccucgaccccgagaacgaguccgaggaggaguga

SEQ ID NO: 51748 - RNA, 1035 nt, Artificial Sequence
  derived and/or modified sequence opt2 from WDR45B__Homo_sapiens__NP_062559
augaaccuccuccccugcaacccccacggcaacggccuccucuacgccggcuucaaccaggaccacggcugcuucgccugcggcauggagaacggcuuccgcgucuacaacaccgacccccucaaggagaaggagaagcaggaguuccucgagggcggcgucggccacgucgagaugcucuuccgcugcaacuaccucgcccucgucggcggcggcaagaagcccaaguacccccccaacaaggucaugaucugggacgaccucaagaagaagaccgucaucgagaucgaguucuccaccgaggucaaggccgucaagcuccgccgcgaccgcaucgucgucguccucgacuccaugaucaaggucuucaccuucacccacaacccccaccagcuccacgucuucgagaccugcuacaaccccaagggccucugcguccucugccccaacuccaacaacucccuccucgccuuccccggcacccacaccggccacguccagcucgucgaccucgccuccaccgagaagccccccgucgacauccccgcccacgagggcguccucuccugcaucgcccucaaccuccagggcacccgcaucgccaccgccuccgagaagggcacccucauccgcaucuucgacaccuccuccggccaccucauccaggagcuccgccgcggcucccaggccgccaacaucuacugcaucaacuucaaccaggacgccucccucaucugcgucuccuccgaccacggcaccguccacaucuucgccgccgaggaccccaagcgcaacaagcaguccucccucgccuccgccuccuuccuccccaaguacuucuccuccaagugguccuucuccaaguuccagguccccuccggcucccccugcaucugcgccuucggcaccgagcccaacgccgucaucgccaucugcgccgacggcuccuacuacaaguuccucuucaaccccaagggcgagugcauccgcgacgucuacgcccaguuccucgagaugaccgacgacaagcucuga

SEQ ID NO: 51749 - RNA, 1083 nt, Artificial Sequence
  derived and/or modified sequence opt2 from WDR45__Homo_sapiens__NP_001025067
augacccagcagccccuccgcggcgucaccucccuccgcuucaaccaggaccaguccugcuucugcugcgccauggagaccggcguccgcaucuacaacgucgagccccucauggagaagggccaccucgaccacgagcaggucggcuccaugggccucgucgagaugcuccaccgcuccaaccuccucgcccucgucggcggcggcuccucccccaaguucuccgagaucuccguccucaucugggacgacgcccgcgagggcaaggacuccaaggagaagcucguccucgaguucaccuucaccaagcccguccucuccguccgcaugcgccacgacaagaucgucaucguccucaagaaccgcaucuacgucuacuccuuccccgacaacccccgcaagcucuucgaguucgacacccgcgacaaccccaagggccucugcgaccucugccccucccucgagaagcagcuccucgucuuccccggccacaagugcggcucccuccagcucgucgaccucgccuccaccaagcccggcaccuccuccgcccccuucaccaucaacgcccaccaguccgacaucgccugcgucucccucaaccagcccggcaccgucgucgccuccgccucccagaagggcacccucauccgccucuucgacacccaguccaaggagaagcucgucgagcuccgccgcggcaccgaccccgccacccucuacugcaucaacuucucccacgacuccuccuuccucugcgccuccuccgacaagggcaccguccacaucuucgcccucaaggacacccgccucaaccgccgcuccgcccucgcccgcgucggcaaggucggccccaugaucggccaguacgucgacucccaguggucccucgccuccuucaccguccccgccgaguccgccugcaucugcgccuucggccgcaacaccuccaagaacgucaacuccgucaucgccaucugcgucgacggcaccuuccacaaguacgucuucacccccgacggcaacugcaaccgcgaggccuucgacgucuaccucgacaucugcgacgacgacgacuucuga

SEQ ID NO: 51750 - RNA, 1833 nt, Artificial Sequence
  derived and/or modified sequence opt2 from WDR46__Homo_sapiens__NP_005443
auggagaccgcccccaagcccggcaaggacgucccccccaagaaggacaagcuccagaccaagcgcaagaagccccgccgcuacugggaggaggagaccguccccaccaccgccggcgccucccccggccccccccgcaacaagaagaaccgcgagcuccgcccccagcgccccaagaacgccuacauccucaagaagucccgcaucuccaagaagccccagguccccaagaagccccgcgaguggaagaaccccgagucccagcgcggccucuccggcacccaggaccccuuccccggccccgcccccguccccgucgaggucguccagaaguucugccgcaucgacaagucccgcaagcucccccacuccaaggccaagacccgcucccgccucgaggucgccgaggccgaggaggaggagaccuccaucaaggccgcccgcuccgagcuccuccucgccgaggagcccggcuuccucgagggcgaggacggcgaggacaccgccaagaucugccaggccgacaucgucgaggccgucgacaucgccuccgccgccaagcacuucgaccucaaccuccgccaguucggccccuaccgccucaacuacucccgcaccggccgccaccucgccuucggcggccgccgcggccacgucgccgcccucgacugggucaccaagaagcucaugugcgagaucaacgucauggaggccguccgcgacauccgcuuccuccacuccgaggcccuccucgccgucgcccagaaccgcuggcuccacaucuacgacaaccagggcaucgagcuccacugcauccgccgcugcgaccgcgucacccgccucgaguuccuccccuuccacuuccuccucgccaccgccuccgagaccggcuuccucaccuaccucgacgucuccgucggcaagaucgucgccgcccucaacgcccgcgccggccgccucgacgucaugucccagaaccccuacaacgccgucauccaccucggccacuccaacggcaccgucucccucuggucccccgccaugaaggagccccucgccaagauccucugccaccgcggcggcguccgcgccgucgccgucgacuccaccggcaccuacauggccaccuccggccucgaccaccagcucaagaucuucgaccuccgcggcaccuaccagccccucuccacccgcacccucccccacggcgccggccaccucgccuucucccagcgcggccuccucgucgccggcaugggcgacgucgucaacaucugggccggccagggcaaggccuccccccccucccucgagcagcccuaccucacccaccgccucuccggccccguccacggccuccaguucugccccuucgaggacguccucggcgucggccacaccggcggcaucaccuccaugcucguccccggcgccggcgagcccaacuucgacggccucgaguccaaccccuaccgcucccgcaagcagcgccaggagugggaggucaaggcccuccucgagaagguccccgccgagcucaucugccucgacccccgcgcccucgccgaggucgacgucaucucccucgagcagggcaagaaggagcagaucgagcgccucggcuacgacccccaggccaaggcccccuuccagcccaagcccaagcagaagggccgcuccuccaccgccucccucgucaagcgcaagcgcaaggucauggacgaggagcaccgcgacaagguccgccagucccuccagcagcagcaccacaaggaggccaaggccaagcccaccggcgcccgccccuccgcccucgaccgcuucguccgcuga

SEQ ID NO: 51751 - RNA, 1788 nt, Artificial Sequence
  derived and/or modified sequence opt2 from WDR48__Homo_sapiens__NP_001290331
auggagugccaguccgcccaggucaucuccgccuccuccgacaccaccgucaaggucuggaacgcccacaagggcuucugcauguccacccuccgcacccacaaggacuacgucaaggcccucgccuacgccaaggacaaggagcucgucgccuccgccggccucgaccgccagaucuuccucugggacgucaacacccucaccgcccucaccgccuccaacaacaccgucaccaccuccucccucuccggcaacaaggacuccaucuacucccucgccaugaaccagcucggcaccaucaucgucuccggcuccaccgagaagguccuccgcgucugggacccccgcaccugcgccaagcucaugaagcucaagggccacaccgacaacgucaaggcccuccuccucaaccgcgacggcacccagugccucuccggcuccuccgacggcaccauccgccucuggucccucggccagcagcgcugcaucgccaccuaccgcguccacgacgagggcgucugggcccuccaggucaacgacgccuucacccacgucuacuccggcggccgcgaccgcaagaucuacugcaccgaccuccgcaaccccgacauccgcguccucaucugcgaggagaaggcccccguccucaagauggagcucgaccgcuccgccgaccccccccccgccaucugggucgccaccaccaaguccaccgucaacaaguggacccucaagggcauccacaacuuccgcgccuccggcgacuacgacaacgacugcaccaaccccaucaccccccucugcacccagcccgaccaggucaucaagggcggcgccuccaucauccagugccacauccucaacgacaagcgccacauccucaccaaggacaccaacaacaacgucgccuacugggacguccucaaggccugcaaggucgaggaccucggcaaggucgacuucgaggacgagaucaagaagcgcuucaagauggucuacguccccaacugguucuccgucgaccucaagaccggcaugcucaccaucacccucgacgaguccgacugcuucgccgccugggucuccgccaaggacgccggcuucuccucccccgacggcuccgaccccaagcucaaccucggcggccuccuccuccaggcccuccucgaguacuggccccgcacccacgucaaccccauggacgaggaggagaacgaggucaaccacgucaacggcgagcaggagaaccgcguccagaagggcaacggcuacuuccagguccccccccacacccccgucaucuucggcgaggccggcggccgcacccucuuccgccuccucugccgcgacuccggcggcgagaccgaguccaugcuccucaacgagaccgucccccagugggucaucgacaucaccgucgacaagaacaugcccaaguucaacaagauccccuucuaccuccagccccacgccuccuccggcgccaagacccucaagaaggaccgccucuccgccuccgacaugcuccagguccgcaaggucauggagcacgucuacgagaagaucaucaaccucgacaacgagucccagaccaccuccuccuccaacaacgagaagcccggcgagcaggagaaggaggaggacaucgccguccucgccgaggagaagaucgagcuccucugccaggaccagguccucgaccccaacauggaccuccgcaccgucaagcacuucaucuggaaguccggcggcgaccucacccuccacuaccgccagaaguccaccuga

SEQ ID NO: 51752 - RNA, 2094 nt, Artificial Sequence
  derived and/or modified sequence opt2 from WDR49__Homo_sapiens__NP_849146
auggccuggcgcgagaaguccaagaagcgccucaacaugaccuccuucaacaucgcccagggcauccacgccuucgacuaccacucccgccucaaccucaucgccaccgccggcaucaacaacaaggucugccucuggaaccccuacgucgucuccaagcccgucggcguccucuggggccacuccgccuccgucaucgccguccaguucuucgucgagcgcaagcagcucuucuccuucuccaaggacaagguccuccgccucugggacauccagcaccagcucuccauccagcgcaucgccugcuccuuccccaagucccaggacuuccgcugccucuuccacuucgacgaggcccacggccgccucuucaucuccuucaacaaccagcucgcccuccucgccaugaaguccgaggccuccaagcgcgucaagucccacgagaaggccgucaccugcguccucuacaacuccauccucaagcaggucaucuccuccgacaccggcuccaccgucuccuucuggaugaucgacaccggccagaagaucaagcaguucaccggcugccacggcaacgccgagaucuccaccauggcccucgacgccaacgagacccgccuccucaccggcuccaccgacggcaccgucaagaucugggacuucaacggcuacugccaccacacccucaacgucggccaggacggcgccgucgacaucucccagauccucauccucaagaagaagauccucgucaccggcugggagcgcgccaucaccgucuuccgcccccagaacuucaaccaguucuucauccagcccgaggaguggaagggcggcauccagcaccacgacgacauccucugcgccgccuuccuccccccccagacccucgucaccggcuccuacgacggcgagaucguccucuggaacaacuccaccgagaacgcccaccacguccuccaccccgacuaccagcgccuccucaaguccaagcucgacaccaagccccagaagcuccucuccgccggccgcucccagcccucccaccccauggccgaccacuccaccaccggcguccgcaacuucgagaucgacaccgagggcaagaacgccgucaugcgccucugcuuccucaaggcccgcaagaacaccgccgucaccggcggcgccaaccucgucuccugcggcggcuccggcuacguccgcuucugggacaucuacaagaagcagcuccucgccgaguuccucgcccacuccggcgucggcuccaucaucauguccaccgacaagaugaaccgcuaccucaccaccggcgaccucgacggcuggcucaagaucuggaacaucgaggaguacugccucaacuccuccaagaacaagaucaccaaggcccccacccucauccgcuccuuccagccccacgaggaccgcaucuccucccucgagaugugcgagcccggcggccagcuccucaucaucuccuccuccgccgacugcuccaucugcgucaccggcgucugcaacgcccccgucuggaucuucggccaggccaagcacuggcacaucgagaacugccucuuccuccccaagcgcgacaccaaccucgucgaguccgagauccagaaggagaucucccucuucuccaaggaggaguccugccucgaccccaccgagcacucccuccucaacaagaagaacaaggacgacuccaccuacaacguccgccccuccgaggacaucaaccucgacaucaaguacaaggagcgcuccaccugcaugaaggagacccagaagcccuacuacggcgaggucaucaagaaguccuucuccaccuuccgcucccucaacaucggcgcccucgaggagcuccccgaggucaacaagcccgccuuccuccucgaccccgagaaguacuuccgcaaggagcccgaggaggagcgcccccagauccucgaggcccccucccucuucaagacccucaaggccgucuucgacgagaagaaccucuuccccaaggagauccuccaccacgagcgcaaggccaagcagcucugccaggagaaguccugcgaggucaagaagaacaagaaguga

SEQ ID NO: 51753 - RNA, 1239 nt, Artificial Sequence
  derived and/or modified sequence opt2 from WDR4__Homo_sapiens__NP_387510
auggccggcuccgucggccucgcccucugcggccagacccucgucguccgcggcggcucccgcuuccucgccaccuccaucgccuccuccgacgacgacucccucuucaucuacgacugcuccgccgccgagaagaagucccaggagaacaagggcgaggacgccccccucgaccagggcuccggcgccauccucgccuccaccuucuccaaguccggcuccuacuucgcccucaccgacgacuccaagcgccucauccucuuccgcaccaagcccuggcagugccucuccguccgcaccgucgcccgccgcugcaccgcccucaccuucaucgccuccgaggagaagguccucgucgccgacaaguccggcgacgucuacuccuucuccguccucgagccccacggcugcggccgccucgagcucggccaccucuccaugcuccucgacgucgccgucucccccgacgaccgcuucauccucaccgccgaccgcgacgagaagauccgcgucuccugggccgccgccccccacuccaucgaguccuucugccucggccacaccgaguucgucucccgcaucuccgucguccccacccagcccggccuccuccucuccuccuccggcgacggcacccuccgccucugggaguaccgcuccggccgccagcuccacugcugccaccucgccucccuccaggagcucgucgacccccaggccccccagaaguucgccgccucccgcaucgccuucuggugccaggagaacugcgucgcccuccucugcgacggcacccccgucgucuacaucuuccagcucgacgcccgccgccagcagcucgucuaccgccagcagcucgccuuccagcaccaggucugggacgucgccuucgaggagacccagggccucuggguccuccaggacugccaggaggccccccucguccucuaccgccccgucggcgaccaguggcaguccguccccgaguccaccguccucaagaaggucuccggcguccuccgcggcaacugggccaugcucgagggcuccgccggcgccgacgccuccuucuccucccucuacaaggccaccuucgacaacgucaccuccuaccucaagaagaaggaggagcgccuccagcagcagcucgagaagaagcagcgccgccgcucccccccccccggccccgacggccacgccaagaagaugcgccccggcgaggccacccucuccugcuga

SEQ ID NO: 51754 - RNA, 1152 nt, Artificial Sequence
  derived and/or modified sequence opt2 from WDR55__Homo_sapiens__XP_005268526
auggaccgcaccugcgaggagcgccccgccgaggacggcuccgacgaggaggaccccgacuccauggaggcccccacccgcauccgcgacacccccgaggacaucguccucgaggcccccgccuccggccucgccuuccaccccgcccgcgaccuccucgccgccggcgacgucgacggcgacgucuucgucuucuccuacuccugccaggagggcgagaccaaggagcucugguccuccggccaccaccucaaggccugccgcgccgucgccuucuccgaggacggccagaagcucaucaccgucuccaaggacaaggccauccacguccucgacgucgagcagggccagcucgagcgccgcgucuccaaggcccacggcgcccccaucaacucccuccuccucgucgacgagaacguccucgccaccggcgacgacaccggcggcaucugccucugggaccagcgcaaggagggcccccucauggacaugcgccagcacgaggaguacaucgccgacauggcccucgaccccgccaagaagcuccuccucaccgccuccggcgacggcugccucggcaucuucaacaucaagcgccgccgcuucgagcuccucuccgagccccaguccggcgaccucaccuccgucacccucaugaaguggggcaagaaggucgccugcggcuccuccgagggcaccaucuaccucuucaacuggaacggcuucggcgccaccuccgaccgcuucgcccuccgcgccgaguccaucgacugcaugguccccgucaccgagucccuccucugcaccggcuccaccgacggcgucauccgcgccgucaacauccuccccaaccgcgucgucggcuccgucggccagcacaccggcgagcccgucgaggagcucgcccucucccacugcggccgcuuccucgccuccuccggccacgaccagcgccucaaguucugggacauggcccagcuccgcgccgucgucgucgacgacuaccgccgccgcaagaagaagggcggcccccuccgcgcccucuccuccaagaccugguccaccgacgacuucuucgccggccuccgcgaggagggcgaggacuccauggcccaggaggagaaggaggagaccggcgacgacuccgacuga

SEQ ID NO: 51755 - RNA, 1005 nt, Artificial Sequence
  derived and/or modified sequence opt2 from WDR5__Homo_sapiens__XP_005272220
auggccaccgaggagaagaagcccgagaccgaggccgcccgcgcccagcccacccccuccuccuccgccacccaguccaagcccacccccgucaagcccaacuacgcccucaaguucacccucgccggccacaccaaggccgucuccuccgucaaguucucccccaacggcgaguggcucgccuccuccuccgccgacaagcucaucaagaucuggggcgccuacgacggcaaguucgagaagaccaucuccggccacaagcucggcaucuccgacgucgccugguccuccgacuccaaccuccucgucuccgccuccgacgacaagacccucaagaucugggacgucuccuccggcaagugccucaagacccucaagggccacuccaacuacgucuucugcugcaacuucaacccccaguccaaccucaucgucuccggcuccuucgacgaguccguccgcaucugggacgucaagaccggcaagugccucaagacccuccccgcccacuccgaccccgucuccgccguccacuucaaccgcgacggcucccucaucgucuccuccuccuacgacggccucugccgcaucugggacaccgccuccggccagugccucaagacccucaucgacgacgacaacccccccgucuccuucgucaaguucucccccaacggcaaguacauccucgccgccacccucgacaacacccucaagcucugggacuacuccaagggcaagugccucaagaccuacaccggccacaagaacgagaaguacugcaucuucgccaacuucuccgucaccggcggcaaguggaucgucuccggcuccgaggacaaccucgucuacaucuggaaccuccagaccaaggagaucguccagaagcuccagggccacaccgacgucgucaucuccaccgccugccaccccaccgagaacaucaucgccuccgccgcccucgagaacgacaagaccaucaagcucuggaaguccgacugcuga

SEQ ID NO: 51756 - RNA, 3201 nt, Artificial Sequence
  derived and/or modified sequence opt2 from WDR60__Homo_sapiens__NP_060521
auggagcccggcaagcgccgcaccaaggacgacaccuggaaggccgacgaccuccgcaagcaccucugggccauccaguccggcggcuccaaggaggagcgcaagcaccgcgagaagaagcuccgcaaggaguccgagauggaccuccccgagcacaaggagccccgcugccgcgaccccgaccaggacgcccgcucccgcgaccgcgucgccgagguccacaccgccaaggaguccccccgcggcgagcgcgaccgcgaccgccagcgcgagcgccgccgcgacgccaaggaccgcgagaaggagaagcucaaggagaagcaccgcgaggccgagaagucccacucccgcggcaaggaccgcgagaaggagaaggaccgccgcgcccgcaaggaggagcuccgccagaccgucgcccaccacaaccuccucggccaggagacccgcgaccgccagcuccucgagcgcgccgagcgcaagggccgcuccgucuccaagguccgcuccgaggagaaggacgaggacuccgagcgcggcgacgaggaccgcgagcgccgcuaccgcgagcgcaagcuccaguacggcgacuccaaggacaacccccucaaguacuggcucuacaaggaggagggcgagcgccgccaccgcaagccccgcgagcccgaccgcgacaacaagcaccgcgagaaguccuccacccgcgagaagcgcgagaaguacuccaaggagaaguccaacuccuucuccgacaagggcgaggagcgccacaaggagaagcgccacaaggagggcuuccacuucgacgacgagcgccaccaguccaacgucgaccgcaaggagaaguccgccaaggacgagccccgcaagcgcgagucccagaacggcgagcaccgcaaccgcggcgccuccuccaagcgcgacggcaccuccucccagcacgccgagaaccucguccgcaaccacggcaaggacaaggacucccgccgcaagcacggccacgaggagggcuccuccgucugguggaagcucgaccagcgccccggcggcgaggagaccgucgagaucgagaaggaggagaccgaccucgagaacgcccgcgccgacgccuacaccgccuccugcgaggacgacuucgaggacuacgaggacgacuucgaggucugcgacggcgacgacgacgaguccuccaacgagcccgagucccgcgagaagcucgaggagcucccccucgcccagaagaaggagauccaggagauccagcgcgccaucaacgccgagaacgagcgcaucggcgagcucucccucaagcucuuccagaagcgcggccgcaccgaguucgagaaggagccccgcaccgacaccaacuccucccccucccgcgccuccgucugcggcaucuucgucgacuucgccuccgccucccaccgccagaagucccgcacccaggcccucaagcagaagaugcgcuccaccaagcuccuccgccucaucgaccucgacuucuccuucaccuucucccuccucgaccucccccccgucaacgaguacgacauguacauccgcaacuucggcaagaagaacaccaagcaggccuacguccagugcaacgaggacaacgucgagcgcgacauccagaccgaggagaucgagacccgcgaggucuggacccagcaccccggcgaguccaccgucgucuccggcggcuccgagcagcgcgacaccuccgacgccgucgucaugcccaagaucgacaccccccgccucugcuccuuccuccgcgccgccugccaggucauggccguccuccucgaggaggaccgccucgccgccgagcccuccuggaaccuccgcgcccaggaccgcgcccucuacuucuccgacuccuccucccagcucaacaccucccuccccuuccuccagaaccgcaaggucuccucccuccacaccucccgcguccagcgccagauggucgucuccguccacgaccuccccgagaaguccuucgucccccuccucgacuccaaguacguccucugcgucugggacaucuggcagcccuccggcccccagaagguccucaucugcgagucccaggucaccugcugcugccucuccccccucaaggccuuccuccucuucgccggcaccgcccacggcuccgucgucgucugggaccuccgcgaggacucccgccuccacuacuccgucacccucuccgacggcuucuggaccuuccgcaccgccaccuucuccaccgacggcauccucaccuccgucaaccaccgcuccccccuccaggccgucgagcccaucuccaccuccguccacaagaagcaguccuucguccucucccccuucuccacccaggaggagauguccggccucuccuuccacaucgccucccucgacgaguccggcguccucaacgucugggucgucgucgagcuccccaaggccgacaucgccggcuccaucuccgaccucggccucaugcccggcggccgcgucaagcucguccacuccgcccucauccagcucggcgacucccucucccacaagggcaacgaguucuggggcaccacccagacccucaacgucaaguuccuccccuccgaccccaaccacuucaucaucggcaccgacaugggccucaucucccacggcacccgccaggaccuccgcgucgcccccaagcucuucaagccccagcagcacggcauccgccccgucaaggucaacgucaucgacuucucccccuucggcgagcccaucuuccucgccggcugcuccgacggcuccauccgccuccaccagcucuccuccgccuucccccuccuccagugggacuccuccaccgacucccacgccgucaccggccuccaguggucccccacccgccccgccgucuuccucguccaggacgacaccuccaacaucuacaucugggaccuccuccaguccgaccucggccccgucgccaagcagcaggucucccccaaccgccucgucgccauggccgccgucggcgagcccgagaaggccggcggcuccuuccucgcccucguccucgcccgcgccuccggcuccaucgacauccagcaccucaagcgccgcugggccgcccccgaggucgacgagugcaaccgccuccgccuccuccuccaggaggcccucuggcccgagggcaagcuccacaaguga

SEQ ID NO: 51757 - RNA, 4572 nt, Artificial Sequence
  derived and/or modified sequence opt2 from WDR62__Homo_sapiens__NP_001077430
auggccgccgucggcuccggcggcuacgcccgcaacgacgccggcgagaagcuccccuccgucauggccggcguccccgcccgccgcggccaguccucccccccccccgccccccccaucugccuccgccgccgcacccgccucuccaccgccuccgaggagaccguccagaaccgcgucucccucgagaagguccucggcaucaccgcccagaacuccuccggccucaccugcgaccccggcaccggccacgucgccuaccucgccggcugcgucgucgucauccucgaccccaaggagaacaagcagcagcacaucuucaacaccgcccgcaagucccucuccgcccucgccuucucccccgacggcaaguacaucgucaccggcgagaacggccaccgccccgccguccgcaucugggacgucgaggagaagaaccaggucgccgagaugcucggccacaaguacggcgucgccugcgucgccuucucccccaacaugaagcacaucgucuccaugggcuaccagcacgacaugguccucaacgucugggacuggaagaaggacaucgucgucgccuccaacaaggucuccugccgcgucaucgcccucuccuucuccgaggacuccuccuacuucgucaccgucggcaaccgccacguccgcuucugguuccucgaggucuccaccgagaccaaggucaccuccaccgucccccucgucggccgcuccggcauccucggcgagcuccacaacaacaucuucugcggcgucgccugcggccgcggccgcauggccggcuccaccuucugcgucuccuacuccggccuccucugccaguucaacgagaagcgcguccucgagaaguggaucaaccucaaggucucccucuccuccugccucugcgucucccaggagcucaucuucugcggcugcaccgacggcaucguccgcaucuuccaggcccacucccuccacuaccucgccaaccuccccaagccccacuaccucggcgucgacgucgcccagggccucgagcccuccuuccucuuccaccgcaaggccgaggccgucuaccccgacaccgucgcccucaccuucgaccccauccaccaguggcucuccugcgucuacaaggaccacuccaucuacaucugggacgucaaggacaucaaccgcgucggcaaggucugguccgagcucuuccacuccuccuacgucuggaacgucgaggucuaccccgaguucgaggaccagcgcgccugccuccccuccggcuccuuccucaccugcuccuccgacaacaccauccgcuucuggaaccucgacuccucccccgacucccacuggcagaagaacaucuucuccaacacccuccucaaggucgucuacgucgagaacgacauccagcaccuccaggacaugucccacuuccccgaccgcggcuccgagaacggcacccccauggacgucaaggccggcguccgcgucaugcaggucucccccgacggccagcaccucgccuccggcgaccgcuccggcaaccuccgcauccacgagcuccacuucauggacgagcucgucaaggucgaggcccacgacgccgagguccucugccucgaguacuccaagcccgagaccggccucacccuccucgccuccgccucccgcgaccgccucauccacguccucaacgucgagaagaacuacaaccucgagcagacccucgacgaccacuccuccuccaucaccgccaucaaguucgccggcaaccgcgacauccagaugaucuccugcggcgccgacaaguccaucuacuuccgcuccgcccagcagggcuccgacggccuccacuucguccgcacccaccacgucgccgagaagaccacccucuacgacauggacaucgacaucacccagaaguacgucgccgucgccugccaggaccgcaacguccgcgucuacaacaccgucaacggcaagcagaagaagugcuacaagggcucccagggcgacgagggcucccuccucaagguccacgucgaccccuccggcaccuuccucgccaccuccugcuccgacaaguccaucuccgucaucgacuucuacuccggcgagugcaucgccaagauguucggccacuccgagaucaucaccuccaugaaguucaccuacgacugccaccaccucaucaccgucuccggcgacuccugcgucuucaucuggcaccucggccccgagaucaccaacugcaugaagcagcaccuccucgagaucgaccaccgccagcagcagcagcacaccaacgacaagaagcgcuccggccacccccgccaggacaccuacgucuccacccccuccgagauccacucccucucccccggcgagcagaccgaggacgaccucgaggaggagugcgagcccgaggagaugcucaagacccccuccaaggacucccucgaccccgacccccgcugccuccucaccaacggcaagcucccccucugggccaagcgccuccucggcgacgacgacgucgccgacggccucgccuuccacgccaagcgcuccuaccagccccacggccgcugggccgagcgcgccggccaggagccccucaagaccauccucgacgcccaggaccucgacugcuacuucacccccaugaagcccgagucccucgagaacuccauccucgacucccucgagccccagucccucgccucccuccucuccgaguccgaguccccccaggaggccggccgcggccaccccuccuuccucccccagcagaaggaguccuccgaggccuccgagcucauccucuacucccucgaggccgaggucaccgucaccggcaccgacucccaguacugccgcaaggaggucgaggccggccccggcgaccagcagggcgacuccuaccuccgcgucuccuccgacucccccaaggaccaguccccccccgaggacuccggcgaguccgaggccgaccucgagugcuccuucgccgccauccacucccccgcccccccccccgaccccgccccccgcuucgccaccucccucccccacuuccccggcugcgccggccccaccgaggacgagcucucccuccccgagggccccuccguccccuccuccucccucccccagacccccgagcaggagaaguuccuccgccaccacuucgagacccucaccgagucccccugccgcgagcucuuccccgccgcccucggcgacgucgaggccuccgaggccgaggaccacuucuucaacccccgccucuccaucuccacccaguuccucuccucccuccagaaggccucccgcuucacccacaccuuccccccccgcgccacccagugccucgucaagucccccgaggucaagcucauggaccgcggcggcucccagccccgcgccggcaccggcuacgccucccccgaccgcacccacguccucgccgccggcaaggccgaggagacccucgaggccuggcgcccccccccccccugccucaccucccucgccuccugcguccccgccuccuccguccuccccaccgaccgcaaccuccccacccccaccuccgcccccacccccggccucgcccagggcguccacgcccccuccaccugcuccuacauggaggccaccgccuccucccgcgcccgcaucucccgcuccaucucccucggcgacuccgagggccccaucgucgccacccucgcccagccccuccgccgccccuccuccgucggcgagcucgccucccucggccaggagcuccaggccaucaccaccgccaccacccccucccucgacuccgagggccaggagcccgcccuccgcuccuggggcaaccacgaggcccgcgccaaccuccgccucacccucuccuccgccugcgacggccuccuccagccccccgucgacacccagcccggcgucaccguccccgccgucuccuuccccgcccccucccccgucgaggaguccgcccuccgccuccacggcuccgccuuccgccccucccuccccgcccccgagucccccggccuccccgcccaccccuccaacccccagcuccccgaggcccgccccggcauccccggcggcaccgccucccuccucgagcccaccuccggcgcccucggccuccuccagggcucccccgcccgcugguccgagcccuggguccccgucgaggcccucccccccuccccccucgagcucucccgcgucggcaacauccuccaccgccuccagaccaccuuccaggaggcccucgaccucuaccgcguccucgucuccuccggccaggucgacaccggccagcagcaggcccgcaccgagcucgucuccaccuuccucuggauccacucccagcucgaggccgagugccucgucggcaccuccgucgcccccgcccaggcccuccccucccccggcccccccuccccccccacccucuacccccucgccucccccgaccuccaggcccuccucgagcacuacuccgagcuccucguccaggccguccgccgcaaggcccgcggccacuga

SEQ ID NO: 51758 - RNA, 3246 nt, Artificial Sequence
  derived and/or modified sequence opt2 from WDR64__Homo_sapiens__NP_653226
auggacauccgcaaggagaagcgccucaacauggcccuccagauguccaacuucaagaaggcccucaaccgcuucgagaagcucgucgagcagaccgccgcccagaagcgcgacgagcgcgccggccucuucauccacaaggaggacgccaucggcuacgacaaguucuacgccuccguccagaagcucuucggccccgacgucaagaaccaggacgucaagcgcuucuaccgcaagcucugcaacaacaccgacgccuccgccgacuggugcgagaucuucggcuacuucuccuccgaggaggaccccaucgccucccagcucgacgaggagaaccucgucuucuucgucucccgcaagcgccgcauccucaucuccggcucccgccgccgcgacgucaucaaguccaucgucaagaucccccaccucgaccuccucaucaccgccacccagaagggccucaucaccgucuucaacaaccaggacaccuccuggaucaccggcugcgacuaccuccuccagcucaagcgcaucgucgccaccaccgagcgcaccaucaucgucugggacuacaaggcccagggcuccucccaggagaacuacuucgucaucaagcccauggaccacugccuccucugcgucugcgucgucccccuccccgaccaccucugccgcgacgacauccuccucggcgacgacggcggcuucgucaaccgcuucaccgucaacuccgacgacuucggcaucaagcaggccaaguccaagcgcaagcuccagaaccagguccucgacuccaagaacuucaaguccgucaagcgcaagcuccacaacgacugggucaugaagauccgcuacaucuccgcccucaacugcuucggcuccugcucccucgacuccaaccacucccucguccucgagucccucaagcgccucgaggacaaccuccccguccgcgaguucuccaugccccgcggcgccaacaccuucugcuacugcgucaaggccaacgucaucgucaccggcggcgacgacaaggucauccgccucuggcaccccaacaucuccaccaagcccgucggcaagcucgucggccacauguucuccaucgccgagaucgucaccaacgagaaggaccagcacgucgucucccucuccuccgccaaggucuuccgcgucugggacauccagacccucucccuccuccaggucuuccacgacucccagggcggccccggcgacaugcagaucuacuccaugaucuacgacgccaaccacggcaugcucaucaccggcuccuccgucauggacauguacccccucacccgcaugauccaggacaccaagcaggucccccacacccacgagcgcgagaucaacgucaugcucuacaacaaguacuuccaccagguccucaccaucugcuccgaguccaucauccgcgucugggagcucgagaccggccuccaggucuaccagauccucgagccccacggcuucaacaccgaggucaccuccgccgccgucgacgaguccggcuuccucuucgccaccggcgccuacaacggcaccguccgcaucugggacuucggcuccggccaggagaugaagguccuccccgagggcaaggacuggaaggaggacgagcacugccuccgccgccucaucuuccucaaggcccaggagaagcaccagcagcucguccucgcccucgagcgcaacggcaccaucaagaugauccagggcaaggaggacgacaucuaccucauggucaucugggagcuccccgacgucguccccuuccuccaggacggcaagcacgccguccaccuccgcauguccacccgcgaccgcaacauggccauccccuuccccgacgucgagcucaucgucgagcgcaacuucucccagcccaccgacaaccccaccauggaccuccuccgcgucaacugcaucgaccuccuccaggucgagggcuacaaccucaucgccgccggcacccucaacggcgucaucauccucuggaacuucgucaccuccaccgucaagaaggucuaccgccccgaggacugcuucaccgucaaccccgaccuccaccccaagcacuucaagaucaacgacauccucuuccucuuccgcacccccgagugcgcccgccgcuccucccaggacuccaucugcuccuccucccagugcgaguccuccaagggcccccaguccuccaagggcuccaagcaguccauccacgacuccgaggucaagggcgagcagaccgacgucauggucggcaagcagcagcccauggacaagaagcaccccggcaucgccaaccuccccgaggcccagccccccauccucgucaccgcccacgaggacggccaccuccgccucuggacccucgagggccgccuccucaaggacaugcuccccuucaccaagcacuccgccaucucccucaccucccucuacaccgacuccugcacccgcauccuccucgccggcaacgucgagggccacgucauccucugcaacaucuccuccuuccucgaccccccccacgacgagaagaaguucaagcagcuccucuccuggcgcgcccacucccucgagaucauccaggucaucuacgucgaggagaagcaggucguccucaccgccuccaucgacggcuccguccgccucuggcacgcccucaacggccacuacugcggcuacuucggccagcgccgccucuucgagcucucccagacccgcgacuucauccuccccugcgacgucaccgaguaccccaucgagaucaaggaggaguccaaguucaccgagaagcagaaguacgaguacccccucaucuucgaccgcgagaaguggcgcaagauguccuccgucucccuccucuucaagcgcaccccccccaaggccuucgaggucgagcaggacuucaaguucuucaagucccucuccucccccaagauccgccgcuacccccucgagggcuucgucaccgagaaccgcgaggccggcaucgucuucggcucccuccccaucuacuccaucuccucccccaccucccuccgcuuccucccccucaucggcgucgaggcccagaaggacuccuccgacggcaucaccggcaagaagaagggcggccacguccagcgcgagaaggccccccgccgccgcucccucaagaagaaccucgucccccagaucaaccucgccuccuccuucuuccccgccauccccaaguga

SEQ ID NO: 51759 - RNA, 2826 nt, Artificial Sequence
  derived and/or modified sequence opt2 from WDR66__Homo_sapiens__NP_001171474
auguccgacgccgccgaggccccccgcgaggccaccggcgagaacggcgagaccgagaugaaggaggaggaggagcccaaccccaacuacaaggaggucgaggacccccagcaggaguccaaggacgacaccaucgccuggcgcgagucccaggaggaggagcgcaagaccggcgaggaggagggcgaggaggagggcaaggaggacaagaagaucgucauggaggagaccgaggagaaggccggcgagguccaggagaaggaggccuccggcauccaggaggagaccaccgucgagccccaggaggucaccgccuccaugauccgccucgagacccagaucaccgacucccaguccaucaccuccggcaucuuccccaagacccagcgcggcuccaaguccaagcucucccuccagcucgaggacgccgagaccgacgagcuccuccgcgaccucuccacccagaucgaguuccucgaccucgaccagaucucccccgaggagcagcagaucuccucccccgagcgccagcccuccggcgagcucgaggagaagaccgaccgcaugccccaggacgagcucggccaggagcgccgcgaccucgagcccgagaaccgcgaggagggccaggagcgccgcgucuccgacauccaguccaaggccggcaucucccgcgagucccucgucuccuccaccaccgaggacauccucuuccagaaggacaaguccacccccgucuacccccucaccaugaccugguccuucggcuggaacuccucccuccccgucuacuacauccgcgaggagcgccagcgcguccuccucuacgucugcgcccacaccgccaucaucuacaacgucuuccgcaacaaccaguaccaccuccagggccacgccaacaucaucuccugccucugcgucuccgaggaccgccgcuggaucgccaccgccgacaagggccccgacugccucgucaucaucugggacuccuucaccggcauccccguccacaccaucuucgacuccugccccgagggcaacggcaucauggccauggccaugacccacgacgccaaguaccucgccaccaucuccgacgccgagguccagaaggucugcaucuggaaguggacccucgccgucgagacccccgccugcacccucgagcuccccaccgaguacggcguccagaacuacgucaccuucaaccccaccaacaacaaggagcucgucuccaacuccaagacccgcgccaucuacuacgccugguacgaggagcgcgacacccucgcccacuccgccccccuccucaccgagaagaccuucaacaagcucgucggcaaguucucccaguccaucuuccaccucaaccucacccagauccucuccgccaccauggagggcaagcucgucgucugggacauccaccgcccccccuccuccgccuccaccuuccucggcuuccccuacaucaagcccugcaagcucguccaccuccagaaggagggcaucaccguccucaccaccaucgacuccuacaucgucaccggcgacaucaagggcaacaucaaguucuacgaccacacccucuccaucgucaacugguacucccaccucaagcucggcgccauccgcacccucuccuucuccaagacccccgccaccccccccaccgagaaguccaacuacccccccgacugcacccucaagggcgaccucuucguccuccgcaacuucaucaucggcaccuccgacgccgccgucuaccaccucaccaccgacggcaccaagcucgagaagcucuucgucgagcccaaggacgccaucugcgccaucuccugccaccccuaccagccccucaucgccaucggcuccaucugcggcaugaucaaggucuggaacuacgagaacaagcaguaccucuucucccgcgucuucgagaagggccucggcguccagucccucaccuacaaccccgagggcgcccuccucggcgccggcuucaccgagggcaccgucuacauccucgacgccaugucccucgagaacgagucccccgagcccuucaaguacucccgcaccuccgucacccacaucuccuucucccacgacucccaguacauggccaccgccgaccgcuccuucaccgucgccgucuacaugcucgucguccgcaacggccagcgcgucugggaguaccucgcccgccuccgcucccaccgcaaguccauccgcucccuccucuucggcgucuaccucgacuccaacgagccccgccuccucucccucggcaccgaccgccuccucaucgaguacgaccuccuccgcuccuacaaggaccaccucgagguccucgacauccaccacaccgaccagggcugcuaccccaccugcauggucugguaccccccccucacccgcgagcucuuccuccucaucugcaacuccggcuacaaggucaagcucuucaacgccaccaccaagaugugccgcaagacccuccucggccccgccuacggcucccccaucgagcagacccagguccuccccguccgcuccauggccgagcuccagaagcgcuaccucgucuucaucaaccgcgacaaggucggccuccagauccuccccgucgacggcaacccccacaagaccuccgccaucgucugccaccccaacggcgucgccggcauggccgucuccuacgacggcugcuacgccuucaccgccggcggccacgaccgcuccgucguccaguggaagaucacccucucccaccccggcucccaggcccccauccucucccccuccgacaccucccgcuccuga

SEQ ID NO: 51760 - RNA, 1965 nt, Artificial Sequence
  derived and/or modified sequence opt2 from WDR70__Homo_sapiens__NP_060504
auggagcgcuccggccccuccgaggucaccggcuccgacgccuccggccccgacccccagcucgccgucaccaugggcuucaccggcuucggcaagaaggcccgcaccuucgaccucgaggccauguucgagcagacccgccgcaccgccgucgagcgcucccgcaagacccucgaggcccgcgagaaggaggaggagaugaaccgcgagaaggagcuccgccgccagaacgaggacaucgagcccaccuccucccgcuccaacgucguccgcgacugcuccaaguccuccucccgcgacaccuccuccuccgaguccgagcaguccuccgacuccuccgacgacgagcucaucggccccccccucccccccaagauggucggcaagcccgucaacuucauggaggaggacauccucggcccccucccccccccccucaacgaggaggaggaggaggccgaggaggaggaggaggaggaggaggaggaggagaaccccguccacaagauccccgacucccacgagaucacccucaagcacggcaccaagaccgucuccgcccucggccucgaccccuccggcgcccgccucgucaccggcggcuacgacuacgacgucaaguucugggacuucgccggcauggacgccuccuucaaggccuuccgcucccuccagcccugcgagugccaccagaucaagucccuccaguacuccaacaccggcgacaugauccucgucgucuccggcuccucccaggccaaggucaucgaccgcgacggcuucgaggucauggagugcaucaagggcgaccaguacaucgucgacauggccaacaccaagggccacaccgccaugcuccacaccggcuccuggcaccccaagaucaagggcgaguucaugaccugcuccaacgacgccaccguccgcaccugggaggucgagaaccccaagaagcagaaguccgucuucaagccccgcaccaugcagggcaagaaggucauccccaccaccugcaccuacucccgcgacggcaaccucaucgccgccgccugccagaacggcuccauccagaucugggaccgcaaccucaccguccaccccaaguuccacuacaagcaggcccacgacuccggcaccgacaccuccugcgucaccuucuccuacgacggcaacguccucgccucccgcggcggcgacgacucccucaagcucugggacauccgccaguucaacaagccccucuucuccgccuccggccuccccaccauguuccccaugaccgacugcugcuucucccccgacgacaagcucaucgucaccggcaccuccauccagcgcggcugcggcuccggcaagcucgucuucuucgagcgccgcaccuuccagcgcgucuacgagaucgacaucaccgacgccuccgucguccgcugccucuggcaccccaagcucaaccagaucauggucggcaccggcaacggccucgccaaggucuacuacgaccccaacaagucccagcgcggcgccaagcucugcgucgucaagacccagcgcaaggccaagcaggccgagacccucacccaggacuacaucaucaccccccacgcccuccccauguuccgcgagccccgccagcgcuccacccgcaagcagcucgagaaggaccgccucgacccccucaagucccacaagcccgagccccccgucgccggccccggccgcggcggccgcgucggcacccacggcggcacccucuccuccuacaucgucaagaacaucgcccucgacaagaccgacgacuccaacccccgcgaggccauccuccgccacgccaaggccgccgaggacucccccuacugggucucccccgccuacuccaagacccagcccaagaccauguucgcccaggucgaguccgacgacgaggaggccaagaacgagcccgaguggaagaagcgcaagaucuga

SEQ ID NO: 51761 - RNA, 3309 nt, Artificial Sequence
  derived and/or modified sequence opt2 from WDR72__Homo_sapiens__XP_011519737
augcgcaccucccuccaggccgucgcccucuggggccagaaggcccccccccacuccaucaccgccaucaugaucaccgacgaccagcgcaccaucgucaccggcucccaggagggccagcucugccucuggaaccucucccacgagcucaagaucuccgccaaggagcuccucuucggccacuccgccuccgucaccugccucgcccgcgcccgcgacuucuccaagcagcccuacaucgucuccgccgccgagaacggcgagaugugcgucuggaacgucaccaacggccagugcauggagaaggccacccuccccuaccgccacaccgccaucugcuacuaccacugcuccuuccgcaugaccggcgagggcuggcuccucugcugcggcgaguaccaggacguccucaucaucgacgccaagacccucgccgucguccacuccuuccgcuccucccaguuccccgacuggaucaacugcaugugcaucguccacuccaugcgcauccaggaggacucccuccucgucgucuccgucgccggcgagcucaaggucugggaccucuccuccuccaucaacuccauccaggagaagcaggacgucuacgagaaggaguccaaguuccucgagucccucaacugccagaccauccgcuucugcaccuacaccgagcgccuccuccucgucgucuucuccaagugcuggaaggucuacgacuacugcgacuucucccuccuccucaccgaggucucccgcaacggccaguucuucgccggcggcgaggucaucgccgcccaccgcauccucaucuggaccgaggacggccacuccuacaucuaccagcuccucaacuccggccucuccaaguccaucuaccccgccgacggccgcguccucaaggagaccaucuacccccaccuccucugcuccaccuccguccaggagaacaaggagcagucccgccccuucgucaugggcuacaugaacgagcgcaaggagcccuucuacaagguccucuucuccggcgaggucuccggccgcaucacccucuggcacauccccgacguccccgucuccaaguucgacggcuccccccgcgagauccccgucaccgccaccuggacccuccaggacaacuucgacaagcacgacaccaugucccaguccaucaucgacuacuucuccggccucaaggacggcgccggcaccgccgucgucaccuccuccgaguacauccccucccucgacaagcucaucugcggcugcgaggacggcaccaucaucaucacccaggcccucaacgccgccaaggcccgccuccucgagggcggcucccucgucaaggacucccccccccacaagguccucaagggccaccaccaguccgucaccucccuccucuacccccacggccucuccuccaagcucgaccaguccuggaugcucuccggcgaccucgacuccugcgucauccucugggacaucuucaccgaggagauccuccacaaguucuuccucgaggccggccccgucaccucccuccucaugucccccgagaaguucaagcuccgcggcgagcagaucaucugcugcgucugcggcgaccacuccgucgcccuccuccaccucgagggcaaguccugccuccuccacgcccgcaagcaccucuuccccguccgcaugaucaaguggcaccccgucgagaacuuccucaucgucggcugcgccgacgacuccgucuacaucugggagaucgagaccggcacccucgagcgccacgagaccggcgagcgcgcccgcaucauccucaacugcugcgacgacucccagcucgucaaguccguccuccccaucgccuccgagacccucaagcacaaguccaucgagcagcgcuccuccucccccuaccagcucggcccccuccccugccccggccuccaggucgaguccuccugcaaggucaccgacgccaaguucugcccccgccccuucaacguccuccccgucaagaccaagugguccaacgucggcuuccacauccuccucuucgaccucgagaaccucgucgagcuccuccuccccaccccccucuccgacgucgacuccuccuccuccuucuacggcggcgagguccuccgccgcgccaaguccaccgucgagaagaagacccucacccuccgcaaguccaagaccgccugcggcccccucuccgccgaggcccucgccaagcccaucaccgagucccucgcccagggcgacaacaccaucaaguucuccgaggagaacgacggcaucaagcgccagaagaagaugaagaucuccaagaagaugcagcccaagcccucccgcaaggucgacgccucccucaccaucgacaccgccaagcucuuccucuccugccuccuccccuggggcgucgacaaggaccucgacuaccucugcaucaagcaccucaacauccucaagcuccagggccccaucucccucggcaucucccucaacgaggacaacuucucccucaugcuccccggcugggaccucugcaacuccggcaugaucaaggacuacuccggcgucaaccucuucucccgcaagguccucgaccucuccgacaaguacaccgccacccuccccaaccaggucggcaucccccgcggccucgagaacaacugcgacucccuccgcgaguccgacaccaucgucuaccuccucucccgccucuuccucgucaacaagcucgucaacaugccccucgagcucgccugccgcgucggcuccuccuuccgcauggaguccauccacaacaagaugcgcggcgccggcaacgacauccucaacauguccuccuucuacuccugccuccgcaacggcaagaacgagucccacguccccgaggccgaccucucccuccucaagcucaucuccugcuggcgcgaccaguccguccaggucaccgaggccauccaggccguccuccucgccgagguccagcagcacaugaagucccucggcaagauccccgucaacucccagcccgucuccauggccgagaacggcaacugcgagaugaagcagaugcuccccaagcucgaguggaccgaggagcucgagcuccagugcguccgcaacacccucccccuccagacccccgucucccccgucaagcacgacuccaacuccaacuccgccaacuuccaggacgucgaggacaugcccgaccgcugcgcccucgaggaguccgagucccccggcgagccccgccaccacuccuggaucgccaaggucugccccugcaaggucuccuga

SEQ ID NO: 51762 - RNA, 1158 nt, Artificial Sequence
  derived and/or modified sequence opt2 from WDR74__Homo_sapiens__NP_060563
auggccgccgccgccgcccgcuggaaccacgucugggucggcaccgagaccggcauccucaagggcgucaaccuccagcgcaagcaggccgccaacuucaccgccggcggccagccccgccgcgaggaggccgucuccgcccucugcuggggcaccggcggcgagacccagaugcucgucggcugcgccgaccgcaccgucaagcacuucuccaccgaggacggcaucuuccagggccagcgccacugccccggcggcgagggcauguuccgcggccucgcccaggccgacggcacccucaucaccugcgucgacuccggcauccuccgcgucuggcacgacaaggacaaggacaccuccuccgacccccuccucgagcuccgcgucggccccggcgucugccgcaugcgccaggaccccgcccacccccacgucgucgccaccggcggcaaggagaacgcccucaagaucugggaccuccagggcuccgaggagcccgucuuccgcgccaagaacguccgcaacgacuggcucgaccuccgcguccccaucugggaccaggacauccaguuccuccccggcucccagaagcucgucaccugcaccggcuaccaccagguccgcgucuacgaccccgccuccccccagcgccgccccguccucgagaccaccuacggcgaguacccccucaccgccaugacccucacccccggcggcaacuccgucaucgucggcaacacccacggccagcucgccgagaucgaccuccgccagggccgccuccucggcugccucaagggccucgccggcuccguccgcggccuccagugccaccccuccaagccccuccucgccuccugcggccucgaccgcguccuccgcauccaccgcauccagaacccccgcggccucgagcacaaggucuaccucaagucccagcucaacugccuccuccucuccggccgcgacaacugggaggacgagccccaggagccccaggagcccaacaaggucccccucgaggacaccgagaccgacgagcucugggccucccucgaggccgccgccaagcgcaagcucuccggccucgagcagccccagggcgcccuccagacccgccgccgcaagaagaagcgccccggcuccaccucccccuga

SEQ ID NO: 51763 - RNA, 1881 nt, Artificial Sequence
  derived and/or modified sequence opt2 from WDR76__Homo_sapiens__NP_079184
augucccgcuccggcgccgccgccgagaaggccgacucccgccagcgcccccagaugaaggucaacgaguacaaggagaaccagaacaucgccuacgucucccuccgccccgcccagaccaccguccucaucaagaccgccaaggucuaccucgcccccuucucccucuccaacuaccagcucgaccagcucaugugccccaagucccucuccgagaagaacuccaacaacgaggucgccugcaagaagaccaagaucaagaagaccugccgccgcaucaucccccccaagaugaagaacaccuccuccaaggccgaguccacccuccagaacuccuccuccgccguccacaccgaguccaacaagcuccagcccaagcgcaccgccgacgccaugaaccucuccgucgacgucgaguccucccaggacggcgacuccgacgaggacaccacccccucccucgacuucuccggccucucccccuacgagcgcaagcgccucaagaacaucuccgagaacgccgacuucuucgccucccuccagcucuccgaguccgccgcccgccuccgcgagaugaucgagaagcgccagccccccaaguccaagcgcaagaagcccaagcgcgagaacggcaucggcugccgccgcuccaugcgccuccucaaggucgaccccuccggcgucucccuccccgccgcccccaccccccccacccucgucgccgacgagaccccccuccucccccccggcccccucgagaugaccuccgagaaccaggaggacaacaacgagcgcuucaagggcuuccuccacaccugggccggcauguccaagcccuccuccaagaacaccgagaagggccucuccuccaucaaguccuacaaggccaaccucaacggcauggucaucuccgaggacaccgucuacaaggucaccaccggccccaucuucuccauggcccuccaccccuccgagacccgcacccucgucgccgucggcgccaaguucggccaggucggccucugcgaccucacccagcagcccaaggaggacggcgucuacgucuuccacccccacucccagcccgucuccugccucuacuucucccccgccaaccccgcccacauccucucccucuccuacgacggcacccuccgcugcggcgacuucucccgcgccaucuucgaggaggucuaccgcaacgagcgcuccuccuucuccuccuucgacuuccucgccgaggacgccuccacccucaucgucggccacugggacggcaacaugucccucgucgaccgccgcacccccggcaccuccuacgagaagcucaccuccuccuccaugggcaagauccgcaccguccacguccaccccguccaccgccaguacuucaucaccgccggccuccgcgacacccacaucuacgacgcccgccgccucaacucccgccgcucccagccccucaucucccucaccgagcacaccaaguccaucgccuccgccuacuucuccccccucaccggcaaccgcgucgucaccaccugcgccgacugcaaccuccgcaucuucgacuccuccugcaucuccuccaagaucccccuccucaccaccauccgccacaacaccuucaccggccgcuggcucacccgcuuccaggccaugugggaccccaagcaggaggacugcgucaucgucggcuccauggcccacccccgccgcgucgagaucuuccacgagaccggcaagcgcguccacuccuucggcggcgaguaccucgucuccgucugcuccaucaacgccaugcaccccacccgcuacauccucgccggcggcaacuccuccggcaagauccacgucuucaugaacgagaaguccugcuga

SEQ ID NO: 51764 - RNA, 2448 nt, Artificial Sequence
  derived and/or modified sequence opt2 from WDR78__Homo_sapiens__XP_011540464
augacccccggcaagcacuccggcgccuccgcccgcgccgccaacggcggcgccuggggcuaccgcgacuuccgcggcggccagaagaagggcuggugcaccaccccccagcucgucgccaccaugcccgucucccccgccggcucccacaagcagcagaacuucggccucaacaacgccacccagcccaagaaguccaucuccuucuucgccaccaugaaggccaccuccgucaagggcuacaccggcgccaaccagucccgcauggccgucuccaagaccguccucaucccccccgagcucaagaccgucgagaagcccaaccccaacaucaagaccacccaggucuucgacaucaacggcaccgacgucaccccccgcccccucuaccaccccgacccccucaccggcaccgccaagcccuccaagcuccucaccucccaggagggcucccucggcuccgaguucaucuccuccuacucccucuaccagaacaccaucaaccccuccacccucggccaguucacccgcuccguccucggcuccuccaccgucuccaaguccuccgucuccgccuccgaguccaucgccgaggaccucgaggagcccuccuacaagcgcgagcgccucaccuccuucaccgaccuccaggucauccgcgccgcccccgagaagaucgucaccaaggaggaccucgagaagaacaucgagaucauccucaccgagaccgagacccuccgcuucuucgaccuccccaccgucauggucuccgucgaguccgaggaggccgagaaggucacccagcgcaacaagaacuacgagguccucugccgcaaccgccucggcaacgaccucuacgucgagcgcaugaugcagaccuucaacggcgcccccaagaacaaggacguccagugcgacaagaucaucauggaggacaagggcaucauguccaccgccugggaccucuacgacuccuacaacgccauggagcucgucucccucuccgucaagcaguccgucgucgaguccuccuccaaggccaacguccuccccaaggaccaggaccagcgccuccccggcuccaccaccgagaagaacuccgagaccuccucccucauggacaucgagaacgucauccucgccaagauccacgaggacgaggaggaccacuccgacgccauccucaaguccgacaaguuccaccaggaccucuucuucauggagcgcguccucauggagaacaucuuccagcccaagcucgccgccuaccgccagcuccccguccucaaggagcccgagcccgaggagcccgaggacguccucgaguccgccaagcacgaggaggucgaggaggaguccaagaaggaggaggaggaggagauccacgccgaggaguccaccauccccgccaaccucgagcgccucugguccuucuccugcgaccucaccaagggccucaacgucuccucccucgccuggaacaagaccaaccccgaccuccucgccgucggcuacggccacuucggcuucaaggagcagaagcgcggccucgccugcugcugguccaucaagaaccccauguggcccgagcgcaucuaccagucccccuacggcgucaccgccgucgacuucuccaucggcgcccccaaccuccucgccgucggcuaccacaacggcaccaucgccaucuacaacguccgcuccaacuccaacguccccguccucgacuccuccgaguccccccagaagcaccucggccccgucuggcagcuccaguggaucgagcaggaccgcggcaccaccggcgacggcaagcgcgagauccucgucuccaucuccgccgacggccgcaucuccaagugggucauccgcaagggccucgacugcuacgaccucaugcgccucaagcgcaccaccgccgccuccaacaagaagggcggcgagaaggagaagaaggacgaggcccucaucucccgccaggcccccggcaugugcuucgccuuccaccccaagggccccgucuacaaggucaccuggaaccccuucugccacgacgucuuccucuccugcuccgccgacuggggcgucaucaucuggcagcaggagaacgucaagcccucccucuccuucuaccccgccaccuccgucgucuacgacgucgccuggucccccaaguccuccuacaucuucgccgccgccaacgagaaccgcgucgagaucugggaccuccacaucuccacccucgacccccucaucgucaacaccgccaaccccggcaucaaguucaccaccauccucuucgccaagcagaccgacugccuccucgucggcgacuccgacggccaggucuccgucuacgagcuccgcaacaugcccaccguccucgagaccggccgcggcgacaucauggacacccuccucggcuccaaguccaaccaguccgccuga

SEQ ID NO: 51765 - RNA, 4473 nt, Artificial Sequence
  derived and/or modified sequence opt2 from WDR7__Homo_sapiens__NP_056100
auggccggcaacucccucguccuccccaucguccucuggggccgcaaggcccccacccacugcaucuccgccguccuccucaccgacgacggcgccaccaucgucaccggcugccacgacggccagaucugccucugggaccucuccgucgagcuccagaucaacccccgcgcccuccucuucggccacaccgccuccaucaccugccucuccaaggccugcgccuccuccgacaagcaguacaucgucuccgccuccgaguccggcgagaugugccucugggacgucuccgacggccgcugcaucgaguucaccaagcucgccugcacccacaccggcauccaguucuaccaguucuccgucggcaaccagcgcgagggccgccuccucugccacggccacuaccccgagauccucgucgucgacgccaccucccucgagguccucuacucccucgucuccaagaucucccccgacuggaucuccuccauguccaucauccgcucccaccgcacccaggaggacaccgucgucgcccucuccgucaccggcauccucaaggucuggaucgucaccuccgagaucuccgacaugcaggacaccgagcccaucuucgaggaggaguccaagcccaucuacugccagaacugccaguccaucuccuucugcgccuucacccagcgcucccuccucgucgucugcuccaaguacuggcgcgucuucgacgccggcgacuacucccuccucugcuccggccccuccgagaacggccagaccuggaccggcggcgacuucgucuccuccgacaaggucaucaucuggaccgagaacggccaguccuacaucuacaagcuccccgccuccugccuccccgccuccgacuccuuccgcuccgacgucggcaaggccgucgagaaccucaucccccccguccagcacauccuccucgaccgcaaggacaaggagcuccucaucugcccccccgucacccgcuucuucuacggcugccgcgaguacuuccacaagcuccucauccagggcgacuccuccggccgccucaacaucuggaacaucuccgacaccgccgacaagcagggcuccgaggagggccucgccaugaccaccuccaucucccuccaggaggccuucgacaagcucaaccccugccccgccggcaucaucgaccagcucuccgucauccccaacuccaacgagccccucaaggucaccgccuccgucuacauccccgcccacggccgccucgucugcggccgcgaggacggcuccaucgucaucguccccgccacccagaccgccaucguccagcuccuccagggcgagcacaugcuccgccgcggcuggcccccccaccgcacccuccgcggccaccgcaacaaggucaccugccuccucuacccccaccaggucuccgcccgcuacgaccagcgcuaccucaucuccggcggcgucgacuucuccgucaucaucugggacaucuucuccggcgagaugaagcacaucuucugcguccacggcggcgagaucacccagcuccucgucccccccgagaacugcuccgcccgcguccagcacugcaucugcuccgucgccuccgaccacuccgucggccuccucucccuccgcgagaagaagugcaucaugcucgccucccgccaccucuuccccauccaggucaucaaguggcgccccuccgacgacuaccucgucgucggcugcuccgacggcuccgucuacgucuggcagauggacaccggcgcccucgaccgcugcgucaugggcaucaccgccgucgagauccucaacgccugcgacgaggccguccccgccgccgucgacucccucucccaccccgccgucaaccucaagcaggccaugacccgccgcucccucgccgcccucaagaacauggcccaccacaagcuccagacccucgccaccaaccuccucgccuccgaggccuccgacaagggcaaccuccccaaguacucccacaacucccucaugguccaggccaucaagaccaaccucaccgaccccgacauccacguccucuucuucgacgucgaggcccucaucauccagcuccucaccgaggaggccucccgccccaacaccgcccucaucucccccgagaaccuccagaaggccuccggcuccuccgacaagggcggcuccuuccucaccggcaagcgcgccgccguccucuuccagcaggucaaggagaccaucaaggagaacaucaaggagcaccuccucgacgacgaggaggaggacgaggagaucaugcgccagcgccgcgaggaguccgaccccgaguaccgcuccuccaaguccaagccccucacccuccucgaguacaaccucaccauggacaccgccaagcucuucauguccugccuccacgccuggggccucaacgagguccucgacgaggucugccucgaccgccucggcaugcucaagccccacugcaccgucuccuucggccuccucucccgcggcggccacaugucccucaugcuccccggcuacaaccagcccgccugcaagcucucccacggcaagaccgaggucggccgcaagcuccccgccuccgagggcgucggcaagggcaccuacggcgucucccgcgccgucaccacccagcaccuccucuccaucaucucccucgccaacacccucauguccaugaccaacgccaccuucaucggcgaccacaugaagaagggccccacccgccccccccgccccuccacccccgaccucuccaaggcccgcggcuccccccccaccuccuccaacaucguccagggccagaucaagcaggucgccgcccccgucgucuccgcccgcuccgacgccgaccacuccggcuccgacccccccuccgcccccgcccuccacaccugcuuccucgucaacgagggcuggucccagcucgccgccaugcacugcgucaugcuccccgaccuccucggccucgacaaguuccgccccccccuccucgagaugcucgcccgccgcuggcaggaccgcugccucgagguccgcgaggccgcccaggcccuccuccucgccgagcuccgccgcaucgagcaggccggccgcaaggaggccaucgacgccugggcccccuaccucccccaguacaucgaccacgucaucucccccggcgucaccuccgaggccgcccagaccaucaccaccgcccccgacgccuccggccccgaggccaagguccaggaggaggagcacgaccucgucgacgacgacaucaccaccggcugccucuccuccgucccccagaugaagaagaucuccaccuccuacgaggagcgccgcaagcaggccaccgccaucguccuccucggcgucaucggcgccgaguucggcgccgagaucgagccccccaagcuccucacccgcccccgcuccuccucccagauccccgagggcuucggccucaccuccggcggcuccaacuacucccucgcccgccacaccugcaaggcccucaccuuccuccuccuccagccccccucccccaagcuccccccccacuccaccauccgccgcaccgccaucgaccucaucggccgcggcuucaccgucugggagcccuacauggacgucuccgccguccucaugggccuccucgagcucugcgccgacgccgagaagcagcucgccaacaucaccaugggccucccccucucccccgccgccgacuccgcccgcuccgcccgccacgcccucucccucaucgccaccgcccgcccccccgccuucaucaccaccaucgccaaggagguccaccgccacaccgcccucgccgccaacacccagucccagcagaacaugcacaccaccacccucgcccgcgccaagggcgagauccuccgcgucaucgagauccucaucgagaagaugcccaccgacgucgucgaccuccucgucgaggucauggacaucaucauguacugccucgagggcucccucgucaagaagaagggccuccaggagugcuuccccgccaucugccgcuucuacauggucuccuacuacgagcgcaaccaccgcaucgccgucggcgcccgccacggcuccgucgcccucuacgacauccgcaccggcaagugccagaccauccacggccacaagggccccaucaccgccgucgccuucgcccccgacggccgcuaccucgccaccuacuccaacaccgacucccacaucuccuucuggcagaugaacaccucccuccucggcuccaucggcaugcucaacuccgccccccagcuccgcugcaucaagaccuaccaggucccccccguccagcccgccucccccggcucccacaacgcccucaagcucgcccgccucaucuggaccuccaaccgcaacgucauccucauggcccacgacggcaaggagcaccgcuucauggucuga

SEQ ID NO: 51766 - RNA, 2217 nt, Artificial Sequence
  derived and/or modified sequence opt2 from WDR81__Homo_sapiens__NP_001157145
augcucguccgcgucguccucucccucacccccuccuuccccgagcccuccgcccucuacaccgccugcaagaugguccgcuggcucuccgccaagcucggccccaccgucgccucccgccacgucgcccgcaaccuccuccgccuccucaccuccugcuacgucggccccacccgccagcaguucaccgucuccuccggcgagucccccccccucuccgccggcaacaucuaccagaagcgccccguccucggcgacaucgucuccggccccguccucuccugccuccuccacaucgcccgccucuacggcgagcccguccucaccuaccaguaccuccccuacaucuccuaccucgucgcccccggcuccgccuccggccccucccgccucaacucccgcaaggaggccggccuccucgccgccgucacccucacccagaagaucaucgucuaccucuccgacaccacccucauggacauccucccccgcaucucccacgagguccuccuccccguccucuccuuccucaccucccucgucaccggcuuccccuccggcgcccaggcccgcaccauccucugcgucaagaccaucucccucaucgcccucaucugccuccgcaucggccaggagaugguccagcagcaccucuccgagcccgucgccaccuucuuccaggucuucucccagcuccacgagcuccgccagcaggaccucaagcucgaccccgccggccgcggcgagggccagcucccccaggucgucuucuccgacggccagcagcgccccgucgaccccgcccuccucgacgagcuccagaaggucuucacccucgagauggccuacaccaucuacguccccuucuccugccuccucggcgacaucauccgcaagaucauccccaaccacgagcucgucggcgagcucgccgcccucuaccucgaguccaucucccccuccucccgcaaccccgccuccgucgagcccaccaugcccggcaccggccccgagugggacccccacggcggcggcugcccccaggacgacggccacuccggcaccuucggcuccguccucgucggcaaccgcauccagauccccaacgacucccgccccgagaaccccggcccccucggccccaucuccggcgucggcggcggcggccucggcuccggcuccgacgacaacgcccucaagcaggagcucccccgcuccguccacggccucuccggcaacuggcucgccuacuggcaguacgagaucggcgucucccagcaggacgcccacuuccacuuccaccagauccgccuccaguccuuccccggccacuccggcgccgucaagugcgucgccccccucuccuccgaggacuucuuccucuccggcuccaaggaccgcaccguccgccucuggccccucuacaacuacggcgacggcaccuccgagaccgccccccgccucgucuacacccagcaccgcaaguccgucuucuucgucggccagcucgaggccccccagcacgucgucuccugcgacggcgccguccacgucugggaccccuucaccggcaagacccuccgcaccgucgagccccucgacucccgcgucccccucaccgccgucgccgucaugcccgccccccacaccuccaucaccauggccuccuccgacuccacccuccgcuucgucgacugccgcaagcccggccuccagcacgaguuccgccucggcggcggccucaaccccggccucguccgcgcccucgccaucucccccuccggccgcuccgucgucgccggcuucuccuccggcuucaugguccuccucgacacccgcaccggccucguccuccgcggcuggcccgcccacgagggcgacauccuccagaucaaggccgucgagggcuccguccucgucuccuccuccuccgaccacucccucaccgucuggaaggagcucgagcagaagcccacccaccacuacaaguccgccuccgaccccauccacaccuucgaccucuacggcuccgaggucgucaccggcaccgucuccaacaagaucggcgucugcucccuccucgagccccccucccaggccaccaccaagcucuccuccgagaacuuccgcggcacccucaccucccucgcccuccuccccaccaagcgccaccuccuccucggcuccgacaacggcgucauccgccuccucgccuga

SEQ ID NO: 51767 - RNA, 948 nt, Artificial Sequence
  derived and/or modified sequence opt2 from WDR83__Homo_sapiens__NP_115708
auggccuuccccgagcccaagccccgcccccccgagcucccccagaagcgccucaagacccucgacugcggccagggcgccguccgcgccguccgcuucaacgucgacggcaacuacugccucaccugcggcuccgacaagacccucaagcucuggaacccccuccgcggcacccuccuccgcaccuacuccggccacggcuacgagguccucgacgccgccggcuccuucgacaacuccucccucugcuccggcggcggcgacaaggccgucguccucugggacgucgccuccggccaggucguccgcaaguuccgcggccacgccggcaaggucaacaccguccaguucaacgaggaggccaccgucauccucuccggcuccaucgacuccuccauccgcugcugggacugccgcucccgccgccccgagcccguccagacccucgacgaggcccgcgacggcgucuccuccgucaaggucuccgaccacgagauccucgccggcuccgucgacggccgcguccgccgcuacgaccuccgcaugggccagcucuucuccgacuacgucggcucccccaucaccugcaccugcuucucccgcgacggccagugcacccucgucuccucccucgacuccacccuccgccuccucgacaaggacaccggcgagcuccucggcgaguacaagggccacaagaaccaggaguacaagcucgacugcugccucuccgagcgcgacacccacgucgucuccugcuccgaggacggcaaggucuucuucugggaccucgucgagggcgcccucgcccucgcccuccccgucggcuccggcgucguccagucccucgccuaccaccccaccgagcccugccuccucaccgccaugggcggcuccguccagugcuggcgcgaggaggccuacgaggccgaggacggcgccggcuga

SEQ ID NO: 51768 - RNA, 834 nt, Artificial Sequence
  derived and/or modified sequence opt2 from WDR86__Homo_sapiens__NP_001271190
augucccgcgaguuccgcggccaccgcaacugcguccucacccucgccuacuccgcccccugggaccuccccuccacccccugcgccgaggaggccgccgccggcggccuccucgucaccggcuccaccgacggcaccgccaaggucuggcaggucgccuccggcugcugccaccagacccuccgcggccacaccggcgccguccucugccucguccucgacacccccggccacaccgccuucaccggcuccaccgacgccaccauccgcgccugggacauccucuccggcgagcagcuccgcgucuuccgcgagcaccgcggcuccgucaucugccucgagugcucccgcgccgccggcacccucgcccccggccccuccacccgcucccucgaguccugcggcggcugcuccggcgccacccacuccuccuccaccgccucccgcugcaccgcccgcugcuccacccccccccgcaccaccgcccccugcgccuccggcaccugcgccggcuccgaggucccccgcggcccccuccgccccugcgccgccucccgcggcuccuccgccacccgcugggccgcccccccccgccccugcucccgccccgaccccgccggcccccuccagacccccgcccagacccccuccggcucccaguccgccccccccugcuacccccgcugguggcgccccauggccggcgagggccgcggcgcccgcaagcccggccgcgaggagucccccucccaggccuccggcuucucccucgucgcccgccgccgcugggagcgcgagugcucccccuggggccccccccccuuccccuucuga

SEQ ID NO: 51769 - RNA, 1977 nt, Artificial Sequence
  derived and/or modified sequence opt2 from WDR93__Homo_sapiens__NP_001271324
auguccuucccccgcggcucccagacccagaagaucaagcaccccaucggcacccgcaagggcccccucgagguccccccccccaccgagaaggacuggcccaaggacgacgagcaggaccacguccucgucgaccccgacgaggagcucgacucccucccccagcccuaccgcaugaucaacaagcucgucaaccuccucuucgaccaguccugggagaucaucgaggagcgcaacgcccuccgcgaggccgaguccucccagauccagcccaccgucuaccccccccucggcgagauccagcucaacaagaugcccaacugcauggccgucucccaggacuacgucuucaucggcggcgccaagggcuucuccaucuacaaccucuacuccgccaagcagaucuacgccugggagaagcucaaggucgacgucaccuccaucugggccaccgaccucggcaacgagauccucaucgcccccgucgacgagaugggcaucauccgccucuucuacuucuacaaggagggccucuaccucgucaaggccaucaacgaggucgacgacaccuccaagcagaccaccugcaucaagauggagaucucccagggcggcgacuucgccgccuuccuccuccagggcgccggcgacaucuggcucgacgucuacaagcuccccaaggagaccuggcucaagaagcucgagcacccccagcucaccuccaaccccaagaagaagguccgccagccccagcucaacucccucggccccaucuccgccgacccccucgagauggacgccaacgucuccuucaagggcgacaucaagcucucccuccccgucuacaucaugaagaucaagccccccaagcccgucaccggcaccaccuucaaguccccccucgaggucuucgccaagaucaaggacugcuacggccucggcuccggccagaaccacuucaucaaggacucccagugggagcagcaggccgagaucuucaacgccuccuacaagaaguaccucgaccgcgagugggaggaggagccccucuccaccgccaccuucuacuuccuccuccccuccugccucuucgccaugccccccgaggucaagggccccuccggcauggccugcguccucggcauccacuggacccgcucccacaacuucuuccucuacucccucaaccgcacccucaaggacaaggccgaccccgagggcgucuggcccugcgccgcccccaucgccgucucccagcucuccugcuccuccuccuaccucguccucgccugcgaggacggcguccucacccucugggaccucgccaagggccagaacauguaccccgagggccaggucaagucccagaugaagugcgucguccucugcaccgacgccucccuccaccucgucgaggccuccggcacccagggccccaccaucuccguccucgucgagcgccccgucaagcaccucgacaagaccaucugcgccgucgcccccguccccgcccuccccggcaugguccucaucuucuccaagaacggcuccgucugccucauggacgucgccaagcgcgagaucaucugcgccuucgccccccccggcgccuucccccucgagguccccuggaagcccgucuucgccgucucccccgaccaccccugcuuccuccuccgcggcgacuacucccacgagaccgccuccaccgacgacgccggcauccaguacuccgucuucuacuucaacuucgaggccugcccccuccucgagaacaucuccaagaacugcaccaucccccagcgcgaccucgacaacauggccuucccccaggcccucccccucgagaagcgcugcgagcgcuuccuccagaaguccuaccgcaagcucgagaagaaccccgagaaggaggaggagcacugggcccgccuccagcgcuacucccucucccuccagcgcgagaacuucaagaaguga

SEQ ID NO: 51770 - RNA, 1299 nt, Artificial Sequence
  derived and/or modified sequence opt2 from WEE1__Homo_sapiens__NP_001137448
auggacaccgagaaguccggcaagcgcgaguucgacguccgccagaccccccaggucaacaucaaccccuucacccccgacucccuccuccuccacuccuccggccagugccgccgccgcaagcgcaccuacuggaacgacuccugcggcgaggacauggaggccuccgacuacgagcucgaggacgagacccgccccgccaagcgcaucaccaucaccgaguccaacaugaagucccgcuacaccaccgaguuccacgagcucgagaagaucggcuccggcgaguucggcuccgucuucaagugcgucaagcgccucgacggcugcaucuacgccaucaagcgcuccaagaagccccucgccggcuccgucgacgagcagaacgcccuccgcgaggucuacgcccacgccguccucggccagcacucccacgucguccgcuacuucuccgccugggccgaggacgaccacaugcucauccagaacgaguacugcaacggcggcucccucgccgacgccaucuccgagaacuaccgcaucauguccuacuucaaggaggccgagcucaaggaccuccuccuccaggucggccgcggccuccgcuacauccacuccaugucccucguccacauggacaucaagcccuccaacaucuucaucucccgcaccuccauccccaacgccgccuccgaggagggcgacgaggacgacugggccuccaacaaggucauguucaagaucggcgaccucggccacgucacccgcaucuccuccccccaggucgaggagggcgacucccgcuuccucgccaacgagguccuccaggagaacuacacccaccuccccaaggccgacaucuucgcccucgcccucaccgucgucugcgccgccggcgccgagccccucccccgcaacggcgaccaguggcacgagauccgccagggccgccucccccgcaucccccagguccucucccaggaguucaccgagcuccucaaggucaugauccaccccgaccccgagcgccgccccuccgccauggcccucgucaagcacuccguccuccucuccgccucccgcaaguccgccgagcagcuccgcaucgagcucaacgccgagaaguucaagaacucccuccuccagaaggagcucaagaaggcccagauggccaaggccgccgccgaggagcgcgcccucuucaccgaccgcauggccacccgcuccaccacccaguccaaccgcaccucccgccucaucggcaagaagaugaaccgcuccgucucccucaccaucuacuga

SEQ ID NO: 51771 - RNA, 663 nt, Artificial Sequence
  derived and/or modified sequence opt2 from WFDC1__Homo_sapiens__NP_001269395
augccccucaccggcgucggccccggcuccugccgccgccagaucauccgcgcccucugccuccuccuccuccuccuccacgccggcuccgccaagaacaucuggaagcgcgcccuccccgcccgccucgccgagaagucccgcgccgaggaggccggcgcccccggcggcccccgccagccccgcgccgaccgcugccccccccccccccgcacccucccccccggcgccugccaggccgcccgcugccaggccgacuccgagugcccccgccaccgccgcugcugcuacaacggcugcgccuacgccugccucgaggccgucccccccccccccguccucgacuggcucguccagcccaagccccgcuggcucggcggcaacggcuggcuccucgacggccccgaggagguccuccaggccgaggccugcuccaccaccgaggacggcgccgagccccuccucugccccuccggcuacgagugccacauccucucccccggcgacgucgccgagggcauccccaaccgcggccagugcgucaagcagcgccgccaggccgacggccgcauccuccgccacaagcucuacaaggaguaccccgagggcgacuccaagaacgucgccgagcccggccgcggccagcagaagcacuuccaguga

SEQ ID NO: 51772 - RNA, 375 nt, Artificial Sequence
  derived and/or modified sequence opt2 from WFDC2__Homo_sapiens__XP_011526797
augcccgccugccgccucggcccccucgccgccgcccuccuccucucccuccuccucuucggcuucacccucgucuccggcaccggcgccgagaagaccggcgucugccccgagcuccaggccgaccagaacugcacccaggagugcgucuccgacuccgagugcgccgacaaccucaagugcugcuccgccggcugcgccaccuucugcucccuccccaacgacaaggagggcuccugcccccaggucaacaucaacuucccccagcucggccucugccgcgaccagugccaggucgacucccagugccccggccagaugaagugcugccgcaacggcugcggcaaggucuccugcgucacccccaacuucuga

SEQ ID NO: 51773 - RNA, 2673 nt, Artificial Sequence
  derived and/or modified sequence opt2 from WFS1__Homo_sapiens__NP_001139325
auggacuccaacaccgccccccucggccccuccugcccccagcccccccccgccccccagccccaggcccgcucccgccucaacgccaccgccucccucgagcaggagcgcuccgagcgcccccgcgcccccggcccccaggccggccccggccccggcguccgcgacgccgccgcccccgccgagccccaggcccagcacacccgcucccgcgagcgcgccgacggcaccggccccaccaagggcgacauggagauccccuucgaggagguccucgagcgcgccaaggccggcgaccccaaggcccagaccgaggucggcaagcacuaccuccagcucgccggcgacaccgacgaggagcucaacuccugcaccgccgucgacuggcucguccucgccgccaagcagggccgccgcgaggccgucaagcuccuccgccgcugccucgccgaccgccgcggcaucaccuccgagaacgagcgcgagguccgccagcucuccuccgagaccgaccucgagcgcgccguccgcaaggccgcccucgucauguacuggaagcucaaccccaagaagaagaagcaggucgccgucgccgagcuccucgagaacgucggccaggucaacgagcacgacggcggcgcccagcccggccccguccccaagucccuccagaagcagcgccgcaugcucgagcgccucgucuccuccgaguccaagaacuacaucgcccucgacgacuucgucgagaucaccaagaaguacgccaagggcgucauccccuccucccucuuccuccaggacgacgaggacgacgacgagcucgccggcaagucccccgaggaccucccccuccgccucaaggucgucaaguacccccuccacgccaucauggagaucaaggaguaccucaucgacauggccucccgcgccggcaugcacuggcucuccaccaucauccccacccaccacaucaacgcccucaucuucuucuucaucgucuccaaccucaccaucgacuucuucgccuucuucaucccccucgucaucuucuaccucuccuucaucuccauggucaucugcacccucaaggucuuccaggacuccaaggccugggagaacuuccgcacccucaccgaccuccuccuccgcuucgagcccaaccucgacgucgagcaggccgaggucaacuucggcuggaaccaccucgagcccuacgcccacuuccuccucuccgucuucuucgucaucuucuccuuccccaucgccuccaaggacugcauccccugcuccgagcucgccgucaucaccggcuucuucaccgucaccuccuaccucucccucuccacccacgccgagcccuacacccgccgcgcccucgccaccgaggucaccgccggccuccucucccuccuccccuccaugccccucaacuggcccuaccucaagguccucggccagaccuucaucaccguccccgucggccaccucgucguccucaacgucuccguccccugccuccucuacgucuaccuccucuaccucuucuuccgcauggcccagcuccgcaacuucaagggcaccuacugcuaccucguccccuaccucgucugcuucauguggugcgagcucuccgucgucauccuccucgaguccaccggccucggccuccuccgcgccuccaucggcuacuuccucuuccucuucgcccuccccauccucgucgccggccucgcccucgucggcguccuccaguucgcccgcugguucaccucccucgagcucaccaagaucgccgucaccgucgccgucugcuccgucccccuccuccuccgcugguggaccaaggccuccuucuccgucgucggcauggucaagucccucacccgcuccuccauggucaagcucauccucgucuggcucaccgccaucguccucuucugcugguucuacgucuaccgcuccgagggcaugaaggucuacaacuccacccucaccuggcagcaguacggcgcccucugcggcccccgcgccuggaaggagaccaacauggcccgcacccagauccucugcucccaccucgagggccaccgcgucaccuggaccggccgcuucaaguacguccgcgucaccgacaucgacaacuccgccgaguccgccaucaacaugcuccccuucuucaucggcgacuggaugcgcugccucuacggcgaggccuaccccgccugcucccccggcaacaccuccaccgccgaggaggagcucugccgccucaagcuccucgccaagcaccccugccacaucaagaaguucgaccgcuacaaguucgagaucaccgucggcaugcccuucuccuccggcgccgacggcucccgcucccgcgaggaggacgacgucaccaaggacaucguccuccgcgccuccuccgaguucaaguccguccuccucucccuccgccagggcucccucaucgaguucuccaccauccucgagggccgccucggcuccaaguggcccgucuucgagcucaaggccaucuccugccucaacugcauggcccagcucucccccacccgccgccacgucaagaucgagcacgacuggcgcuccaccguccacggcgccgucaaguucgccuucgacuucuucuucuuccccuuccucuccgccgccuga

SEQ ID NO: 51774 - RNA, 1890 nt, Artificial Sequence
  derived and/or modified sequence opt2 from WHSC1__Homo_sapiens__NP_015627
auggaguucuccaucaagcaguccccccucuccguccaguccgucgucaagugcaucaagaugaagcaggcccccgagauccucggcuccgccaacggcaagacccccuccugcgaggucaaccgcgagugcuccgucuuccucuccaaggcccagcucuccuccucccuccaggagggcgucaugcagaaguucaacggccacgacgcccuccccuucauccccgccgacaagcucaaggaccucaccucccgcgucuucaacggcgagcccggcgcccacgacgccaagcuccgcuucgagucccaggagaugaagggcaucggcaccccccccaacaccacccccaucaagaacggcucccccgagaucaagcucaagaucaccaagaccuacaugaacggcaagccccucuucgaguccuccaucugcggcgacuccgccgccgacgucucccaguccgaggagaacggccagaagcccgagaacaaggcccgccgcaaccgcaagcgcuccaucaaguacgacucccuccucgagcagggccucgucgaggccgcccucgucuccaagaucuccucccccuccgacaagaagauccccgccaagaaggaguccugccccaacaccggccgcgacaaggaccaccuccucaaguacaacgucggcgaccucgucugguccaaggucuccggcuaccccugguggcccugcauggucuccgccgacccccuccuccacuccuacaccaagcucaagggccagaagaaguccgcccgccaguaccacguccaguucuucggcgacgcccccgagcgcgccuggaucuucgagaagucccucgucgccuucgagggcgagggccaguucgagaagcucugccaggaguccgccaagcaggcccccaccaaggccgagaagaucaagcuccucaagcccaucuccggcaagcuccgcgcccagugggagaugggcaucguccaggccgaggaggccgccuccauguccgucgaggagcgcaaggccaaguucaccuuccucuacgucggcgaccagcuccaccucaacccccaggucgccaaggaggccggcaucgccgccgagucccucggcgagauggccgaguccuccggcgucuccgaggaggccgccgagaaccccaaguccguccgcgaggagugcauccccaugaagcgccgccgccgcgccaagcucugcuccuccgccgagacccucgagucccaccccgacaucggcaaguccaccccccagaagaccgccgaggccgacccccgccgcggcgucggcuccccccccggccgcaagaagaccaccgucuccaugccccgcucccgcaagggcgacgccgccucccaguuccucgucuucugccagaagcaccgcgacgaggucgucgccgagcaccccgacgccuccggcgaggagaucgaggagcuccuccgcucccaguggucccuccucuccgagaagcagcgcgcccgcuacaacaccaaguucgcccucgucgcccccguccaggccgaggaggacuccggcaacgucaacggcaagaagcgcaaccacaccaagcgcauccaggaccccaccgaggacgccgaggccgaggacaccccccgcaagcgccuccgcaccgacaagcacucccuccgcaagcgcgacaccaucaccgacaagaccgcccgcaccuccuccuacaaggccauggaggccgccuccucccucaagucccaggccgccaccaagaaccucuccgacgccugcaagccccucaagaagcgcaaccgcgccuccaccgccgccuccuccgcccucggcuucuccaaguccuccucccccuccgccucccucaccgagaacgaggucaaguga

SEQ ID NO: 51775 - RNA, 1938 nt, Artificial Sequence
  derived and/or modified sequence opt2 from WHSC1L1__Homo_sapiens__NP_060248
auggacuucuccuucuccuucaugcagggcaucaugggcaacaccauccagcagcccccccagcucaucgacuccgccaacauccgccaggaggacgccuucgacaacaacuccgacaucgccgaggacggcggccagacccccuacgaggccacccuccagcagggcuuccaguaccccgccaccaccgaggaccuccccccccucaccaacggcuaccccuccuccaucuccgucuacgagacccagaccaaguaccaguccuacaaccaguaccccaacggcuccgccaacggcuucggcgccguccgcaacuucucccccaccgacuacuaccacuccgagauccccaacacccgcccccacgagauccucgagaagcccucccccccccagcccccccccccccccuccgucccccagaccgucauccccaagaagaccggcucccccgagaucaagcucaagaucaccaagaccauccagaacggccgcgagcucuucgaguccucccucugcggcgaccuccucaacgagguccaggccuccgagcacaccaaguccaagcacgagucccgcaaggagaagcgcaagaaguccaacaagcacgacuccucccgcuccgaggagcgcaagucccacaagauccccaagcucgagcccgaggagcagaaccgccccaacgagcgcgucgacaccgucuccgagaagccccgcgaggagcccguccucaaggaggaggcccccguccagcccauccucuccuccguccccaccaccgaggucuccaccggcgucaaguuccaggucggcgaccucgucugguccaaggucggcaccuaccccugguggcccugcauggucuccuccgacccccagcucgagguccacaccaagaucaacacccgcggcgcccgcgaguaccacguccaguucuucuccaaccagcccgagcgcgccuggguccacgagaagcgcguccgcgaguacaagggccacaagcaguacgaggagcuccucgccgaggccaccaagcaggccuccaaccacuccgagaagcagaagauccgcaagccccgcccccagcgcgagcgcgcccagugggacaucggcaucgcccacgccgagaaggcccucaagaugacccgcgaggagcgcaucgagcaguacaccuucaucuacaucgacaagcagcccgaggaggcccucucccaggccaagaaguccgucgccuccaagaccgaggucaagaagacccgccgcccccgcuccguccucaacacccagcccgagcagaccaacgccggcgaggucgccuccucccucuccuccaccgagauccgccgccacucccagcgccgccacaccuccgccgaggaggaggagcccccccccgucaagaucgccuggaagaccgccgccgcccgcaagucccuccccgccuccaucaccaugcacaagggcucccucgaccuccagaagugcaacaugucccccgucgucaagaucgagcaggucuucgcccuccagaacgccaccggcgacggcaaguucaucgaccaguucgucuacuccaccaagggcaucggcaacaagaccgagaucuccguccgcggccaggaccgccucaucaucuccacccccaaccagcgcaacgagaagcccacccaguccgucuccucccccgaggccaccuccggcuccaccggcuccgucgagaagaagcagcagcgccgcuccauccgcacccgcuccgaguccgagaaguccaccgaggucguccccaagaagaagaucaagaaggagcaggucgagaccgucccccaggccaccgucaagaccggccuccagaagggcuccgccgaccgcggcguccagggcuccguccgcuucuccgacuccuccgucuccgccgccaucgaggagaccgucgacuga

SEQ ID NO: 51776 - RNA, 1140 nt, Artificial Sequence
  derived and/or modified sequence opt2 from WIF1__Homo_sapiens__NP_009122
auggcccgccgcuccgccuuccccgccgccgcccucuggcucugguccauccuccucugccuccucgcccuccgcgccgaggccggccccccccaggaggagucccucuaccucuggaucgacgcccaccaggcccgcguccucaucggcuucgaggaggacauccucaucgucuccgagggcaagauggcccccuucacccacgacuuccgcaaggcccagcagcgcaugcccgccauccccgucaacauccacuccaugaacuucaccuggcaggccgccggccaggccgaguacuucuacgaguuccucucccuccgcucccucgacaagggcaucauggccgaccccaccgucaacgucccccuccucggcaccgucccccacaaggccuccgucguccaggucggcuuccccugccucggcaagcaggacggcgucgccgccuucgaggucgacgucaucgucaugaacuccgagggcaacaccauccuccagaccccccagaacgccaucuucuucaagaccugccagcaggccgagugccccggcggcugccgcaacggcggcuucugcaacgagcgccgcaucugcgagugccccgacggcuuccacggcccccacugcgagaaggcccucugcaccccccgcugcaugaacggcggccucugcgucacccccggcuucugcaucugcccccccggcuucuacggcgucaacugcgacaaggccaacugcuccaccaccugcuucaacggcggcaccugcuucuaccccggcaagugcaucugcccccccggccucgagggcgagcagugcgagaucuccaagugcccccagcccugccgcaacggcggcaagugcaucggcaaguccaagugcaagugcuccaagggcuaccagggcgaccucugcuccaagcccgucugcgagcccggcugcggcgcccacggcaccugccacgagcccaacaagugccagugccaggagggcuggcacggccgccacugcaacaagcgcuacgaggccucccucauccacgcccuccgccccgccggcgcccagcuccgccagcacacccccucccucaagaaggccgaggagcgccgcgacccccccgaguccaacuacaucugguga

SEQ ID NO: 51777 - RNA, 1512 nt, Artificial Sequence
  derived and/or modified sequence opt2 from WIPF1__Homo_sapiens__NP_003378
augcccgucccccccccccccgcccccccccccccccccaccuucgcccucgccaacaccgagaagcccacccucaacaagaccgagcaggccggccgcaacgcccuccucuccgacaucuccaagggcaagaagcucaagaagaccgucaccaacgaccgcuccgcccccauccucgacaagcccaagggcgccggcgccggcggcggcggcggcggcuucggcggcggcggcggcuucggcggcggcggcggcggcggcggcggcggcuccuucggcggcggcggcccccccggccucggcggccucuuccaggccggcaugcccaagcuccgcuccaccgccaaccgcgacaacgacuccggcggcucccgccccccccuccucccccccggcggccgcuccaccuccgccaagcccuucuccccccccuccggccccggccgcuuccccguccccucccccggccaccgcuccggcccccccgagccccagcgcaaccgcaugccccccccccgccccgacgucggcuccaagcccgacuccauccccccccccguccccuccaccccccgccccauccaguccuccccccacaaccgcggcuccccccccguccccggcggcccccgccagcccucccccggccccacccccccccccuuccccggcaaccgcggcaccgcccucggcggcggcuccauccgccaguccccccucuccuccuccucccccuucuccaaccgccccccccucccccccacccccucccgcgcccucgacgacaagcccccccccccccccccccccgucggcaaccgccccuccauccaccgcgaggccgucccccccccccccccccagaacaacaagccccccguccccuccaccccccgccccuccgccuccucccaggcccccccccccccccccccccccucccgccccggcccccccccccucccccccuccuccuccggcaacgacgagaccccccgccucccccagcgcaaccucucccucuccuccuccacccccccccuccccucccccggccgcuccggcccccucccccccccccccuccgagcgcccccccccccccguccgcgacccccccggccgcuccggcccccuccccccccccccccccgucucccgcaacggcuccaccucccgcgcccuccccgccaccccccagcuccccucccgcuccggcgucgacuccccccgcuccggcccccgccccccccucccccccgaccgccccuccgccggcgccccccccccccccccccccuccaccuccauccgcaacggcuuccaggacucccccugcgaggacgagugggagucccgcuucuacuuccaccccaucuccgaccuccccccccccgagcccuacguccagaccaccaaguccuaccccuccaagcucgcccgcaacgagucccgcuccggcuccaaccgccgcgagcgcggcgcccccccccucccccccaucccccgcuga

SEQ ID NO: 51778 - RNA, 1323 nt, Artificial Sequence
  derived and/or modified sequence opt2 from WIPF2__Homo_sapiens__NP_573571
augcccaucccccccccccccccccccccccccggccccccccccccccccaccuuccaccaggccaacaccgagcagcccaagcucucccgcgacgagcagcgcggccgcggcgcccuccuccaggacaucugcaagggcaccaagcucaagaaggucaccaacaucaacgaccgcuccgcccccauccucgagaagcccaagggcuccuccggcggcuacggcuccggcggcgccgcccuccagcccaagggcggccucuuccagggcggcguccucaagcuccgccccgucggcgccaaggacggcuccgagaaccucgccggcaagcccgcccuccagauccccuccucccgcgccgccgccccccgcccccccgucuccgccgccuccggccgcccccaggacgacaccgacuccucccgcgccucccuccccgagcucccccgcaugcagcgccccucccuccccgaccucucccgccccaacaccaccuccuccaccggcaugaagcacuccuccuccgccccccccccccccccccccggccgccgcgccaacgccccccccaccccccuccccaugcacuccuccaaggcccccgccuacaaccgcgagaagccccucccccccacccccggccagcgccuccaccccggccgcgagggcccccccgcccccccccccgucaagcccccccccucccccgucaacauccgcaccggccccuccggccagucccucgcccccccccccccccccuaccgccagccccccggcguccccaacggccccuccucccccaccaacgaguccgcccccgagcucccccagcgccacaacucccuccaccgcaagacccccggccccguccgcggccucgccccccccccccccaccuccgccucccccucccuccucuccaaccgcccccccccccccgcccgcgacccccccucccgcggcgccgccccccccccccccccccccgucauccgcaacggcgcccgcgacgccccccccccccccccccccuaccgcaugcacggcuccgagccccccucccgcggcaagcccccccccccccccucccgcacccccgccggccccccccccccccccccccccccccuccgcaacggccaccgcgacuccaucaccaccguccgcuccuuccucgacgacuucgaguccaaguacuccuuccaccccgucgaggacuuccccgcccccgaggaguacaagcacuuccagcgcaucuaccccuccaagaccaaccgcgccgcccgcggcgcccccccccucccccccauccuccgcuga

SEQ ID NO: 51779 - RNA, 1452 nt, Artificial Sequence
  derived and/or modified sequence opt2 from WIPF3__Homo_sapiens__NP_001073998
augcccgucccccccccccccccccccccccuccccccccccccccccccccucggcgccccccccccccccccccccuccgccccccccgucuccaccgacaccuccucccuccgccgcgccgaccccaagggccgcuccgcccuccucgccgacauccagcagggcacccgccuccgcaaggucacccagaucaacgaccgcuccgccccccagaucgaguccuccaagggcaccaacaaggagggcggcggcuccgccaacacccgcggcgccuccaccccccccacccucggcgaccucuucgccggcggcuuccccguccuccgccccgccggccagcgcgacgucgccggcggcaagaccggccagggccccggcucccgcgcccccuccccccgccuccccaacaagaccaucuccggcccccucaucccccccgccuccccccgccucggcaacaccuccgaggcccacggcgccgcccgcaccgcccccccccgccccaacguccccgccccccccccccccaccccccccccccccccccccccccucccccccccccuccccuccuccucccccaucaagaccccccucgucuccccccccggcccccucaccaagggcaaccuccccgucgucgccccccccguccccugcgccccccccccccccccccccccccccccccccaccccccccccccucccccccgccuccguccucuccgacaaggccgucaagccccagcucgccccccuccaccucccccccaucccccccccccucccccuccucccccccugcggcuaccccggccucaaggccgagcccgccucccccgcccaggacgcccaggagccccccgcccccccccccccccucccccccuacgccuccugcuccccccgcgccucccuccccgcccccccccuccccggcgucaacuccuccuccgagaccccccccccccucccccccaagucccccuccuuccaggcccccccccagaaggccggcgcccaggcccuccccgccccccccgccccccccggcucccagcccuuccuccagaagaagcgccacggccgccccggcgccggcggcggcaagcucaaccccccccccgccccccccgcccgcucccccaccaccgagcucuccuccaagucccagcaggccaccgccuggacccccacccagcagcccggcggccagcuccgcaacggcucccuccacaucaucgacgacuucgaguccaaguucaccuuccacuccgucgaggacuuccccccccccgacgaguacaagcccugccagaagaucuaccccuccaagaucccccgcucccgcacccccggccccuggcuccaggccgaggccgucggccaguccuccgacgacaucaagggccgcaacucccagcucucccucaagacccuccgcuga

SEQ ID NO: 51780 - RNA, 1341 nt, Artificial Sequence
  derived and/or modified sequence opt2 from WIPI1__Homo_sapiens__NP_060453
auggaggccgaggccgccgacgccccccccggcggcgucgaguccgcccucuccugcuucuccuucaaccaggacugcaccucccucgccaccggcaccaaggccggcuacaagcucuucucccucuccuccgucgagcagcucgaccagguccacggcuccaacgagauccccgacgucuacaucgucgagcgccucuucuccuccucccucgucgucgucgucucccacaccaagccccgccagaugaacgucuaccacuucaagaagggcaccgagaucugcaacuacuccuacuccuccaacauccucuccauccgccucaaccgccagcgccuccucgucugccucgaggaguccaucuacauccacaacaucaaggacaugaagcuccucaagacccuccucgacauccccgccaaccccaccggccucugcgcccucuccaucaaccacuccaacuccuaccucgccuaccccggcucccucaccuccggcgagaucguccucuacgacggcaacucccucaagaccgucugcaccaucgccgcccacgagggcacccucgccgccaucaccuucaacgccuccggcuccaagcucgccuccgccuccgagaagggcaccgucauccgcgucuucuccguccccgacggccagaagcucuacgaguuccgccgcggcaugaagcgcuacgucaccaucuccucccucgucuucuccauggacucccaguuccucugcgccuccuccaacaccgagaccguccacaucuucaagcucgagcaggucaccaacucccgccccgaggagcccuccaccugguccggcuacaugggcaagauguucauggccgccaccaacuaccuccccacccaggucuccgacaugaugcaccaggaccgcgccuucgccaccgcccgccucaacuucuccggccagcgcaacaucugcacccucuccaccauccagaagcucccccgccuccucgucgccuccuccuccggccaccucuacauguacaaccucgacccccaggacggcggcgagugcguccucaucaagacccacucccuccucggcuccggcaccaccgaggagaacaaggagaacgaccuccgccccucccucccccaguccuacgccgccaccgucgcccgccccuccgccuccuccgccuccaccguccccggcuacuccgaggacggcggcgcccuccgcggcgaggucauccccgagcacgaguucgccaccggccccgucugccucgacgacgagaacgaguucccccccaucauccucugccgcggcaaccagaagggcaagaccaagcaguccuga

SEQ ID NO: 51781 - RNA, 1332 nt, Artificial Sequence
  derived and/or modified sequence opt2 from WIPI2__Homo_sapiens__NP_001028690
augaaccucgccucccaguccggcgaggccggcgccggccagcuccucuucgccaacuucaaccaggacaacaccgaggucaagggcgccucccgcgccgccggccucggccgccgcgccgucgucuggucccucgccgucggcuccaaguccggcuacaaguucuucucccucuccuccgucgacaagcucgagcagaucuacgagugcaccgacaccgaggacgucugcaucgucgagcgccucuucuccuccucccucgucgccaucgucucccucaaggccccccgcaagcucaaggucugccacuucaagaagggcaccgagaucugcaacuacuccuacuccaacaccauccucgccgucaagcucaaccgccagcgccucaucgucugccucgaggagucccucuacauccacaacauccgcgacaugaagguccuccacaccauccgcgagaccccccccaaccccgccggccucugcgcccucuccaucaacaacgacaacugcuaccucgccuaccccggcuccgccaccaucggcgagguccaggucuucgacaccaucaaccuccgcgccgccaacaugauccccgcccacgacuccccccucgccgcccucgccuucgacgccuccggcaccaagcucgccaccgccuccgagaagggcaccgucauccgcgucuucuccauccccgagggccagaagcucuucgaguuccgccgcggcgucaagcgcugcgucuccaucugcucccucgccuucuccauggacggcauguuccucuccgccuccuccaacaccgagaccguccacaucuucaagcucgagaccgucaaggagaagccccccgaggagcccaccaccuggaccggcuacuucggcaagguccucauggccuccaccuccuaccuccccucccaggucaccgagauguucaaccagggccgcgccuucgccaccguccgccuccccuucugcggccacaagaacaucugcucccucgccaccauccagaagaucccccgccuccucgucggcgccgccgacggcuaccucuacauguacaaccucgacccccaggagggcggcgagugcgcccucaugaagcagcaccgccucgacggcucccucgagaccaccaacgagauccucgacuccgccucccacgacugcccccucgucacccagaccuacggcgccgccgccggcaaggccuacaccgacgaccucggcgccgucggcggcgccugccucgaggacgaggccuccgcccuccgccucgacgaggacuccgagcacccccccaugauccuccgcaccgacuga

SEQ ID NO: 51782 - RNA, 468 nt, Artificial Sequence
  derived and/or modified sequence opt2 from WISP1__Homo_sapiens__NP_001191798
augcgcugguuccuccccuggacccucgccgccgucaccgccgccgccgccuccaccguccucgccaccgcccucucccccgcccccaccaccauggacuucacccccgccccccucgaggacaccuccucccgcccccaguucugcaaguggcccugcgagugcccccccucccccccccgcugcccccucggcgucucccucaucaccgacggcugcgagugcugcaagaugugcgcccagcagcucggcgacaacugcaccgaggccgccaucugcgacccccaccgcggccucuacugcgacuacuccggcgaccgcccccgcuacgccaucggcgucugcgcccgccgcgaggaggucuccggcugcguccccgcccgcggcauccacgagcuccacaccugcggccuccaccagcacacccuccucuccacccagguccucuggucccuccacggccaguga

SEQ ID NO: 51783 - RNA, 753 nt, Artificial Sequence
  derived and/or modified sequence opt2 from WISP2__Homo_sapiens__XP_005260660
augcgcggcacccccaagacccaccuccucgccuucucccuccucugccuccucuccaagguccgcacccagcucugccccacccccugcaccugccccuggccccccccccgcugcccccucggcgucccccucguccucgacggcugcggcugcugccgcgucugcgcccgccgccucggcgagcccugcgaccagcuccacgucugcgacgccucccagggccucgucugccagcccggcgccggccccggcggccgcggcgcccucugccuccucgccgaggacgacuccuccugcgaggucaacggccgccucuaccgcgagggcgagaccuuccagccccacugcuccauccgcugccgcugcgaggacggcggcuucaccugcgucccccucugcuccgaggacguccgccuccccuccugggacugcccccacccccgccgcgucgagguccucggcaagugcugccccgagugggucugcggccagggcggcggccucggcacccagccccuccccgcccagggcccccaguucuccggccucgucuccucccucccccccggcguccccugccccgagugguccaccgccuggggccccugcuccaccaccugcggccucggcauggccacccgcgucuccaaccagaaccgcuucugccgccucgagacccagcgccgccucugccucucccgccccugcccccccucccgcggccgcuccccccagaacuccgccuucuga

SEQ ID NO: 51784 - RNA, 1065 nt, Artificial Sequence
  derived and/or modified sequence opt2 from WISP3__Homo_sapiens__NP_003871
augcagggccuccucuucuccacccuccuccucgccggccucgcccaguucugcugccgcguccagggcaccggcccccucgacaccacccccgagggccgccccggcgaggucuccgacgccccccagcgcaagcaguucugccacuggcccugcaagugcccccagcagaagccccgcugcccccccggcgucucccucguccgcgacggcugcggcugcugcaagaucugcgccaagcagcccggcgagaucugcaacgaggccgaccucugcgacccccacaagggccucuacugcgacuacuccgucgaccgcccccgcuacgagaccggcgucugcgccuaccucgucgccgucggcugcgaguucaaccagguccacuaccacaacggccaggucuuccagcccaacccccucuucuccugccucugcgucuccggcgccaucggcugcaccccccucuucauccccaagcucgccggcucccacugcuccggcgccaagggcggcaagaaguccgaccaguccaacugcucccucgagccccuccuccagcagcucuccaccuccuacaagaccaugcccgccuaccgcaaccucccccucaucuggaagaagaagugccucguccaggccaccaaguggacccccugcucccgcaccugcggcaugggcaucuccaaccgcgucaccaacgagaacuccaacugcgagaugcgcaaggagaagcgccucugcuacauccagcccugcgacuccaacauccucaagaccaucaagauccccaagggcaagaccugccagcccaccuuccagcucuccaaggccgagaaguucgucuucuccggcugcuccuccacccaguccuacaagcccaccuucugcggcaucugccucgacaagcgcugcugcauccccaacaaguccaagaugaucaccauccaguucgacugccccaacgagggcuccuucaaguggaagaugcucuggaucaccuccugcgucugccagcgcaacugccgcgagcccggcgacaucuucuccgagcucaagauccucuga

SEQ ID NO: 51785 - RNA, 1638 nt, Artificial Sequence
  derived and/or modified sequence opt2 from WLS__Homo_sapiens__XP_011540493
auggccggcgccaucaucgagaacauguccaccaagaagcucugcaucgucggcggcauccuccucgucuuccagaucaucgccuuccucgucggcggccucaucgcccccggccccaccaccgccgucuccuacauguccgucaagugcgucgacgcccgcaagaaccaccacaagaccaagugguucguccccuggggccccaaccacugcgacaagauccgcgacaucgaggaggccaucccccgcgagaucgaggccaacgacaucgucuucuccguccacaucccccucccccacauggagaugucccccugguuccaguucaugcucuucauccuccagcucgacaucgccuucaagcucaacaaccagauccgcgagaacgccgaggucuccauggacgucucccucgccuaccgcgacgacgccuucgccgaguggaccgagauggcccacgagcgcgucccccgcaagcucaagugcaccuucaccucccccaagacccccgagcacgagggccgcuacuacgagugcgacguccuccccuucauggagaucggcuccgucgcccacaaguucuaccuccucaacauccgccuccccgucaacgagaagaagaagaucaacgucggcaucggcgagaucaaggacauccgccucgucggcauccaccagaacggcggcuucaccaaggucugguucgccaugaagaccuuccucacccccuccaucuucaucaucauggucugguacuggcgccgcaucaccaugaugucccgcccccccguccuccucgagaaggucaucuucgcccucggcaucuccaugaccuucaucaacauccccgucgagugguucuccaucggcuucgacuggaccuggaugcuccucuucggcgacauccgccagggcaucuucuacgccaugcuccucuccuucuggaucaucuucugcggcgagcacaugauggaccagcacgagcgcaaccacaucgccggcuacuggaagcaggucggccccaucgccgucggcuccuucugccucuucaucuucgacaugugcgagcgcggcguccagcucaccaaccccuucuacuccaucuggaccaccgacaucggcaccgagcucgccauggccuucaucaucgucgccggcaucugccucugccucuacuuccucuuccucugcuucauggucuuccaggucuuccgcaacaucuccggcaagcaguccucccuccccgccauguccaagguccgccgccuccacuacgagggccucaucuuccgcuucaaguuccucaugcucaucacccucgccugcgccgccaugaccgucaucuucuucaucgucucccaggucaccgagggccacuggaaguggggcggcgucaccguccaggucaacuccgccuucuucaccggcaucuacggcauguggaaccucuacgucuucgcccucauguuccucuacgcccccucccacaagaacuacggcgaggaccaguccaacggcaugcagcuccccugcaagucccgcgaggacugcgcccucuucgucuccgagcucuaccaggagcucuucuccgccuccaaguacuccuucaucaacgacaacgccgccuccggcaucuga

SEQ ID NO: 51786 - RNA, 7929 nt, Artificial Sequence
  derived and/or modified sequence opt2 from WNK1__Homo_sapiens__NP_001171914
auguccggcggcgccgccgagaagcaguccuccacccccggcucccucuuccucuccccccccgcccccgcccccaagaacggcuccuccuccgacuccuccgucggcgagaagcucggcgccgccgccgccgacgccgucaccggccgcaccgaggaguaccgccgccgccgccacaccauggacaaggacucccgcggcgccgccgccaccaccaccaccaccgagcaccgcuucuuccgccgcuccgucaucugcgacuccaacgccaccgcccucgagcuccccggccucccccucucccucccccagcccuccauccccgccgccgucccccaguccgccccccccgagccccaccgcgaggagaccgucaccgccaccgccaccucccaggucgcccagcagccccccgccgccgccgcccccggcgagcaggccgucgccggccccgcccccuccaccguccccuccuccaccuccaaggaccgccccgucucccagcccucccucgucggcuccaaggaggagcccccccccgcccgcuccggcuccggcggcggcuccgccaaggagccccaggaggagcgcucccagcagcaggacgacaucgaggagcucgagaccaaggccgucggcauguccaacgacggccgcuuccucaaguucgacaucgagaucggccgcggcuccuucaagaccgucuacaagggccucgacaccgagaccaccgucgaggucgccuggugcgagcuccaggaccgcaagcucaccaaguccgagcgccagcgcuucaaggaggaggccgagaugcucaagggccuccagcaccccaacaucguccgcuucuacgacuccugggaguccaccgucaagggcaagaagugcaucguccucgucaccgagcucaugaccuccggcacccucaagaccuaccucaagcgcuucaaggucaugaagaucaagguccuccgcuccuggugccgccagauccucaagggccuccaguuccuccacacccgcaccccccccaucauccaccgcgaccucaagugcgacaacaucuucaucaccggccccaccggcuccgucaagaucggcgaccucggccucgccacccucaagcgcgccuccuucgccaaguccgucaucggcacccccgaguucauggcccccgagauguacgaggagaaguacgacgaguccgucgacgucuacgccuucggcaugugcaugcucgagauggccaccuccgaguaccccuacuccgagugccagaacgccgcccagaucuaccgccgcgucaccuccggcgucaagcccgccuccuucgacaaggucgccauccccgaggucaaggagaucaucgagggcugcauccgccagaacaaggacgagcgcuacuccaucaaggaccuccucaaccacgccuucuuccaggaggagaccggcguccgcgucgagcucgccgaggaggacgacggcgagaagaucgccaucaagcucuggcuccgcaucgaggacaucaagaagcucaagggcaaguacaaggacaacgaggccaucgaguucuccuucgaccucgagcgcgacguccccgaggacgucgcccaggagauggucgaguccggcuacgucugcgagggcgaccacaagaccauggccaaggccaucaaggaccgcgucucccucaucaagcgcaagcgcgagcagcgccagcucguccgcgaggagcaggagaagaagaagcaggaggaguccucccucaagcagcaggucgagcaguccuccgccucccagaccggcaucaagcagcuccccuccgccuccaccggcauccccaccgccuccaccaccuccgccuccgucuccacccaggucgagcccgaggagcccgaggccgaccagcaccagcagcuccaguaccagcagcccuccaucuccguccucuccgacggcaccgucgacuccggccagggcuccuccgucuucaccgagucccgcgucuccucccagcagaccgucuccuacggcucccagcacgagcaggcccacuccaccggcaccguccccggccacauccccuccaccguccaggcccagucccagccccacggcgucuacccccccuccuccgucccccaguccauggcccaccccugcggcggcacccccaccuaccccgagucccagaucuucuuccccaccauccacgagcgccccgucuccuucucccccccccccaccugcccccccaaggucgccaucucccagcgccgcaaguccaccuccuuccucgaggcccagacccaccacuuccagccccuccuccgcaccgucggccagucccuccucccccccggcggcucccccaccaacuggacccccgaggccgucgucaugcucggcaccaccgccucccgcgucaccggcgaguccugcgagauccagguccaccccauguucgagcccucccaggucuacuccgacuaccgccccggccucguccuccccgaggaggcccacuacuucaucccccaggaggccgucuacgucgccggcguccacuaccaggcccgcgucgccgagcaguacgagggcauccccuacaacuccuccguccucuccucccccaugaagcagauccccgagcagaagcccguccagggcggccccaccuccuccuccgucuucgaguuccccuccggccaggccuuccucgucggccaccuccagaaccuccgccucgacuccggccucggccccggcuccccccucuccuccaucuccgcccccaucuccaccgacgccacccgccucaaguuccaccccgucuucgucccccacuccgcccccgccguccucacccacaacaacgagucccgcuccaacugcgucuucgaguuccacguccacacccccuccuccuccuccggcgagggcggcggcauccucccccagcgcgucuaccgcaaccgccaggucgccgucgaccucaaccaggaggagcuccccccccaguccgucggccuccacggcuaccuccagcccgucaccgaggagaagcacaacuaccacgcccccgagcucaccgucuccgucgucgagcccaucggccagaacuggcccaucggcucccccgaguacuccuccgacuccucccagaucaccuccuccgaccccuccgacuuccagucccccccccccaccggcggcgccgccgcccccuucggcuccgacgucuccaugcccuucauccaccucccccagaccguccuccaggaguccccccucuucuucugcuucccccagggcaccaccucccagcagguccucaccgccuccuucuccuccggcggcuccgcccuccacccccaggcccagggccagucccagggccagcccuccuccuccucccucaccggcgucuccuccucccagcccauccagcacccccagcagcagcagggcauccagcagaccgcccccccccagcagaccguccaguacucccucucccagaccuccaccuccuccgaggccaccaccgcccagcccgucucccagccccaggccccccagguccucccccaggucuccgccggcaagcagggcuuccccccccgccuccccccccaguaccccggcgacuccaacaucgcccccuccuccaacgucgccuccgucugcauccacuccaccguccucuccccccccaugcccaccgagguccucgccacccccggcuacuuccccaccgucguccagcccuacgucgaguccaaccuccucguccccaugggcggcgucggcggccagguccaggucucccagcccggcggcucccucgcccaggcccccaccaccuccucccagcaggccguccucgaguccacccagggcgucucccaggucgcccccgccgagcccgucgccgucgcccagacccaggccacccagcccaccacccucgccuccuccgucgacuccgcccacuccgacgucgccuccggcauguccgacggcaacgagaacguccccuccuccuccggccgccacgagggccgcaccaccaagcgccacuaccgcaaguccguccgcucccgcucccgccacgagaagaccucccgccccaagcuccgcauccucaacgucuccaacaagggcgaccgcgucgucgagugccagcucgagacccacaaccgcaagauggucaccuucaaguucgaccucgacggcgacaaccccgaggagaucgccaccaucauggucaacaacgacuucauccucgccaucgagcgcgaguccuucgucgaccagguccgcgagaucaucgagaaggccgacgagaugcucuccgaggacgucuccgucgagcccgagggcgaccagggccucgagucccuccagggcaaggacgacuacggcuucuccggcucccagaagcucgagggcgaguucaagcagcccauccccgccuccuccaugccccagcagaucggcauccccaccuccucccucacccaggucguccacuccgccggccgccgcuucaucgucucccccguccccgagucccgccuccgcgaguccaaggucuuccccuccgagaucaccgacaccgucgccgccuccaccgcccagucccccggcaugaaccucucccacuccgccuccucccucucccuccagcaggccuucuccgagcuccgccgcgcccagaugaccgagggccccaacaccgccccccccaacuucucccacaccggccccaccuuccccgucgucccccccuuccucuccuccaucgccggcguccccaccaccgccgccgccaccgcccccguccccgccaccuccuccccccccaacgacaucuccaccuccgucauccaguccgaggucaccguccccaccgaggagggcaucgccggcgucgccaccuccaccggcgucgucaccuccggcggccuccccaucccccccgucuccgagucccccguccucuccuccgucgucuccuccaucaccauccccgccgucgucuccaucuccaccaccucccccucccuccagguccccaccuccaccuccgagaucgucgucuccuccaccgcccucuaccccuccgucaccgucuccgccaccuccgccuccgccggcggcuccaccgccacccccggccccaagccccccgccgucgucucccagcaggccgccggcuccaccaccgucggcgccacccucaccuccgucuccaccaccaccuccuuccccuccaccgccucccagcucugcauccagcucuccuccuccaccuccacccccacccucgccgagaccgucgucgucuccgcccacucccucgacaagaccucccacuccuccaccaccggccucgccuucucccucuccgcccccuccuccuccuccucccccggcgccggcgucuccuccuacaucucccagcccggcggccuccacccccucgucauccccuccgucaucgccuccacccccauccucccccaggccgccggccccaccuccaccccccuccucccccagguccccuccauccccccccucguccagcccgucgccaacguccccgccguccagcagacccucauccacucccagccccagcccgcccuccuccccaaccagccccacacccacugccccgaggucgacuccgacacccagcccaaggcccccggcaucgacgacaucaagacccucgaggagaagcuccgcucccucuucuccgagcacuccuccuccggcgcccagcacgccuccgucucccucgagaccucccucgucaucgaguccaccgucacccccggcauccccaccaccgccgucgcccccuccaagcuccucaccuccaccaccuccaccugccucccccccaccaaccucccccucggcaccgucgcccuccccgucacccccgucgucacccccggccaggucuccacccccgucuccaccaccaccuccggcgucaagcccggcaccgcccccuccaagcccccccucaccaaggcccccguccuccccgucggcaccgagcuccccgccggcacccuccccuccgagcagcucccccccuuccccggccccucccucacccagucccagcagccccucgaggaccucgacgcccagcuccgccgcacccucucccccgagaugaucaccgucaccuccgccgucggccccgucuccauggccgcccccaccgccaucaccgaggccggcacccagccccagaagggcgucucccaggucaaggagggccccguccucgccaccuccuccggcgccggcgucuucaagaugggccgcuuccaggucuccgucgccgccgacggcgcccagaaggagggcaagaacaaguccgaggacgccaaguccguccacuucgaguccuccaccuccgaguccuccguccucuccuccuccucccccgaguccacccucgucaagcccgagcccaacggcaucaccauccccggcaucuccuccgacguccccgaguccgcccacaagaccaccgccuccgaggccaaguccgacaccggccagcccaccaaggucggccgcuuccaggucaccaccaccgccaacaaggucggccgcuucuccgucuccaagaccgaggacaagaucaccgacaccaagaaggagggccccgucgccuccccccccuucauggaccucgagcaggccguccuccccgccgucauccccaagaaggagaagcccgagcucuccgagcccucccaccucaacggccccuccuccgaccccgaggccgccuuccucucccgcgacgucgacgacggcuccggcuccccccacuccccccaccagcucuccuccaagucccuccccucccagaaccucucccagucccucuccaacuccuucaacuccuccuacauguccuccgacaacgaguccgacaucgaggacgaggaccucaagcucgagcuccgccgccuccgcgacaagcaccucaaggagauccaggaccuccagucccgccagaagcacgagaucgagucccucuacaccaagcucggcaaggucccccccgccgucaucaucccccccgccgccccccucuccggccgccgccgccgccccaccaaguccaagggcuccaaguccucccgcuccuccucccucggcaacaaguccccccagcucuccggcaaccucuccggccaguccgccgccuccguccuccacccccagcagacccuccacccccccggcaacauccccgaguccggccagaaccagcuccuccagccccucaagcccucccccuccuccgacaaccucuacuccgccuucaccuccgacggcgccaucuccguccccucccucuccgcccccggccagggcaccuccuccaccaacaccgucggcgccaccgucaacucccaggccgcccaggcccagccccccgccaugaccuccucccgcaagggcaccuucaccgacgaccuccacaagcucgucgacaacugggcccgcgacgccaugaaccucuccggccgccgcggcuccaagggccacaugaacuacgagggccccggcauggcccgcaaguucuccgcccccggccagcucugcaucuccaugaccuccaaccucggcggcuccgcccccaucuccgccgccuccgccaccucccucggccacuucaccaaguccaugugccccccccagcaguacggcuuccccgccacccccuucggcgcccagugguccggcaccggcggccccgccccccagccccucggccaguuccagcccgucggcaccgccucccuccagaacuucaacaucuccaaccuccagaaguccaucuccaacccccccggcuccaaccuccgcaccaccuga

SEQ ID NO: 51787 - RNA, 6894 nt, Artificial Sequence
  derived and/or modified sequence opt2 from WNK2__Homo_sapiens__NP_001269323
auggacggcgacggcggccgccgcgacguccccggcacccucauggagcccggccgcggcgccggccccgccggcauggccgagccccgcgccaaggccgcccgccccggcccccagcgcuuccuccgccgcuccgucgucgaguccgaccaggaggagccccccggccucgaggccgccgaggcccccggcccccagcccccccagccccuccagcgccgcguccuccuccucugcaagacccgccgccucaucgccgagcgcgcccgcggccgccccgccgcccccgcccccgccgcccucgucgcccagcccggcgcccccggcgcccccgccgacgccggccccgagcccgucggcacccaggagcccggccccgaccccaucgccgccgccgucgagaccgcccccgcccccgacggcggcccccgcgaggaggccgccgccaccguccgcaaggaggacgagggcgccgccgaggccaagcccgagcccggccgcacccgccgcgacgagcccgaggaggaggaggacgacgaggacgaccucaaggccgucgccaccucccucgacggccgcuuccucaaguucgacaucgagcucggccgcggcuccuucaagaccgucuacaagggccucgacaccgagaccugggucgaggucgccuggugcgagcuccaggaccgcaagcucaccaagcucgagcgccagcgcuucaaggaggaggccgagaugcucaagggccuccagcaccccaacaucguccgcuucuacgacuucugggaguccuccgccaagggcaagcgcugcaucguccucgucaccgagcucaugaccuccggcacccucaagaccuaccucaagcgcuucaaggucaugaagcccaagguccuccgcuccuggugccgccagauccucaagggccuccucuuccuccacacccgcaccccccccaucauccaccgcgaccucaagugcgacaacaucuucaucaccggccccaccggcuccgucaagaucggcgaccucggccucgccacccucaagcgcgccuccuucgccaaguccgucaucggcacccccgaguucauggcccccgagauguacgaggagcacuacgacgaguccgucgacgucuacgccuucggcaugugcaugcucgagauggccaccuccgaguaccccuacuccgagugccagaacgccgcccagaucuaccgcaaggucaccugcggcaucaagcccgccuccuucgagaagguccacgaccccgagaucaaggagaucaucggcgagugcaucugcaagaacaaggaggagcgcuacgagaucaaggaccuccucucccacgccuucuucgccgaggacaccggcguccgcgucgagcucgccgaggaggaccacggccgcaaguccaccaucgcccuccgccucugggucgaggaccccaagaagcucaagggcaagcccaaggacaacggcgccaucgaguucaccuucgaccucgagaaggagacccccgacgaggucgcccaggagaugaucgaguccggcuucuuccacgaguccgacgucaagaucgucgccaaguccauccgcgaccgcgucgcccucauccaguggcgccgcgagcgcaucuggcccgcccuccagcccaaggagcagcaggacgucggcucccccgacaaggcccgcggcccccccgucccccuccagguccaggucaccuaccacgcccaggccggccagcccggcccccccgagcccgaggagcccgaggccgaccagcaccuccucccccccacccuccccaccuccgccaccucccucgccuccgacuccaccuucgacuccggccagggcuccaccgucuacuccgacucccaguccucccagcaguccgucaugcucggcucccucgccgacgccgcccccucccccgcccagugcgucugcuccccccccgucuccgagggccccguccucccccagucccuccccucccucggcgccuaccagcagcccaccgccgcccccggccuccccgucggcuccguccccgcccccgccugcccccccucccuccagcagcacuuccccgaccccgccauguccuucgcccccguccuccccccccccuccacccccaugcccaccggccccggccagcccgccccccccggccagcagccccccccccucgcccagcccaccccccucccccagguccucgccccccagcccgucgucccccuccagcccguccccccccaccucccccccuaccucgcccccgccucccaggucggcgcccccgcccagcucaagccccuccagaugccccaggccccccuccagccccucgcccagguccccccccagaugccccccauccccgucgucccccccaucaccccccucgccggcaucgacggccucccccccgcccuccccgaccuccccaccgccaccgucccccccgucccccccccccaguacuucucccccgccgucauccuccccucccucgccgccccccucccccccgccucccccgcccucccccuccaggccgucaagcucccccacccccccggcgccccccucgccaugcccugccgcaccaucguccccaacgcccccgccaccaucccccuccucgccgucgccccccccggcgucgccgcccucuccauccacuccgccgucgcccagcuccccggccagcccgucuaccccgccgccuucccccagauggcccccaccgacgucccccccuccccccaccacaccguccagaacaugcgcgccacccccccccagcccgcccuccccccccagcccacccuccccccccagcccguccuccccccccagcccacccuccccccccagcccguccuccccccccagcccacccgccccccccagcccguccuccccccccagcccaugcuccccccccagcccguccuccccccccagcccgcccuccccguccgccccgagccccuccagccccaccuccccgagcaggccgcccccgccgccacccccggcucccagauccuccucggccaccccgcccccuacgccgucgacgucgccgcccagguccccaccguccccgucccccccgccgccguccucucccccccccuccccgagguccuccuccccgccgcccccgagcuccucccccaguuccccuccucccucgccaccgucuccgccuccguccaguccguccccacccagaccgccacccuccucccccccgccaaccccccccuccccggcggccccggcaucgccucccccugccccaccguccagcucaccgucgagcccguccaggaggagcaggccucccaggacaagccccccggccucccccaguccugcgaguccuacggcggcuccgacgucaccuccggcaaggagcucuccgacuccugcgagggcgccuucggcggcggccgccucgagggccgcgccgcccgcaagcaccaccgccgcuccacccgcgcccgcucccgccaggagcgcgccucccgcccccgccucaccauccucaacgucugcaacaccggcgacaagauggucgagugccagcucgagacccacaaccacaagauggucaccuucaaguucgaccucgacggcgacgcccccgacgagaucgccaccuacauggucgagcacgacuucauccuccaggccgagcgcgagaccuucaucgagcagaugaaggacgucauggacaaggccgaggacaugcucuccgaggacaccgacgccgaccgcggcuccgaccccggcaccucccccccccaccucuccaccugcggccucggcaccggcgaggagucccgccagucccaggccaacgcccccgucuaccagcagaacguccuccacaccggcaagcgcugguucaucaucugccccgucgccgagcaccccgcccccgaggcccccgaguccucccccccccucccccucuccucccucccccccgaggccucccagggccccugccgcggccucacccuccccugccuccccuggcgccgcgccgccugcggcgccgucuuccucucccucuucuccgccgaguccgcccaguccaagcagccccccgacuccgcccccuacaaggaccagcucuccuccaaggagcagcccuccuuccucgccucccagcagcuccucucccaggccggccccuccaacccccccggcgccccccccgccccccucgcccccuccuccccccccgucaccgcccucccccaggacggcgccgcccccgccaccuccaccaugcccgagcccgccuccggcaccgccucccaggccggcggccccggcaccccccagggccucaccuccgagcucgagaccucccagccccucgccgagacccacgaggccccccucgccguccagccccucgucgucggccucgcccccugcacccccgcccccgaggccgccuccacccgcgacgccuccgccccccgcgagccccuccccccccccgcccccgagcccuccccccacuccggcaccccccagcccgcccucggccagcccgccccccuccuccccgccgccgucggcgccgucucccucgccaccucccagcuccccucccccccccucggccccaccguccccccccagccccccuccgcccucgaguccgacggcgagggcccccccccccgcgucggcuucgucgacuccaccaucaagucccucgacgagaagcuccgcacccuccucuaccaggagcacguccccaccuccuccgccuccgccggcacccccgucgaggucggcgaccgcgacuucacccucgagccccuccgcggcgaccagccccgcuccgaggucugcggcggcgaccucgcccucccccccguccccaaggaggccgucuccggccgcguccagcucccccagccccucgucgagaaguccgagcucgcccccacccgcggcgccgucauggagcagggcaccuccuccuccaugaccgccgaguccuccccccgcuccaugcucggcuacgaccgcgacggccgccaggucgccuccgacucccacgucguccccuccgucccccaggacguccccgccuucguccgccccgcccgcgucgagcccaccgaccgcgacggcggcgaggccggcgaguccuccgccgagcccccccccuccgacaugggcaccgucggcggccaggccucccacccccagacccucggcgcccgcgcccucggcuccccccgcaagcgccccgagcagcaggacgucuccucccccgccaagaccgucggccgcuucuccgucgucuccacccaggacgaguggacccucgccuccccccacucccuccgcuacuccgccccccccgacgucuaccucgacgaggcccccuccucccccgacgucaagcucgccguccgccgcgcccagaccgccuccuccaucgaggucggcgucggcgagcccgucuccuccgacuccggcgacgagggcccccgcgcccgcccccccguccagaagcaggccucccuccccgucuccggcuccgucgccggcgacuucgucaagaaggccaccgccuuccuccagcgccccucccgcgccggcucccucggccccgagacccccucccgcgucggcaugaagguccccaccaucuccgucaccuccuuccacucccaguccuccuacaucuccuccgacaacgacuccgagcucgaggacgccgacaucaagaaggagcuccagucccuccgcgagaagcaccucaaggagaucuccgagcuccagucccagcagaagcaggagaucgaggcccucuaccgccgccucggcaagccccucccccccaacgucggcuucuuccacaccgccccccccaccggccgccgccgcaagaccuccaaguccaagcucaaggccggcaagcuccucaacccccucguccgccagcucaaggucgucgccuccuccaccggccaccucgccgacuccucccgcggcccccccgccaaggaccccgcccaggccuccgucggccucaccgccgacuccaccggccucuccggcaaggccguccagacccagcagcccugcuccguccgcgccucccucuccuccgacaucugcuccggccucgccuccgacggcggcggcgcccgcggccagggcuggaccgucuaccaccccaccuccgagcgcgucaccuacaaguccuccuccaagccccgcgcccgcuuccucuccggccccgucuccgucuccaucugguccgcccucaagcgccucugccucggcaaggagcacuccucccgcuccuccaccuccucccucgcccccggccccgagcccggcccccagcccgcccuccacguccaggcccaggucaacaacuccaacaacaagaagggcaccuucaccgacgaccuccacaagcucgucgacgaguggaccuccaagaccgucggcgccgcccagcucaagcccacccucaaccagcucaagcagacccagaagcuccaggacauggaggcccaggccggcugggccgcccccggcgaggcccgcgccaugaccgccccccgcgccggcgucggcaugccccgccucccccccgcccccggcccccucuccaccaccgucauccccggcgccgcccccacccucuccguccccacccccgacggcgcccucggcaccgcccgccgcaaccaggucugguucggccuccgcgucccccccaccgccugcugcggccacuccacccagccccgcggcggccagcgcgucggcuccaagaccgccuccuucgccgccuccgaccccguccgcuccuga

SEQ ID NO: 51788 - RNA, 5403 nt, Artificial Sequence
  derived and/or modified sequence opt2 from WNK3__Homo_sapiens__NP_065973
auggccaccgacuccggcgaccccgccuccaccgaggacuccgagaagcccgacggcaucuccuucgagaaccgcgucccccaggucgccgccacccucaccgucgaggcccgccucaaggagaagaacuccaccuucuccgccuccggcgagaccgucgagcgcaagcgcuucuuccgcaaguccgucgagaugaccgaggacgacaaggucgccgaguccucccccaaggacgagcgcaucaaggccgccaugaacaucccccgcgucgacaagcuccccuccaacguccuccgcggcggccaggaggucaaguacgagcagugcuccaaguccaccuccgagaucuccaaggacugcuucaaggagaagaacgagaaggagauggaggaggaggccgagaugaaggccgucgccaccucccccuccggccgcuuccucaaguucgacaucgagcucggccgcggcgccuucaagaccgucuacaagggccucgacaccgagaccugggucgaggucgccuggugcgagcuccaggaccgcaagcucaccaaggccgagcagcagcgcuucaaggaggaggccgagaugcucaagggccuccagcaccccaacaucguccgcuucuacgacuccugggaguccauccucaagggcaagaagugcaucguccucgucaccgagcucaugaccuccggcacccucaagaccuaccucaagcgcuucaaggucaugaagcccaagguccuccgcuccuggugccgccagauccucaagggccuccaguuccuccacacccgcaccccccccaucauccaccgcgaccucaagugcgacaacaucuucaucaccggccccaccggcuccgucaagaucggcgaccucggccucgccacccucaugcgcaccuccuucgccaaguccgucaucggcacccccgaguucauggcccccgagauguacgaggagcacuacgacgaguccgucgacgucuacgccuucggcaugugcaugcucgagauggccaccuccgaguaccccuacuccgagugccagaacgccgcccagaucuaccgcaaggucaccuccggcaucaagcccgccuccuucaacaaggucaccgaccccgaggucaaggagaucaucgagggcugcauccgccagaacaaguccgagcgccucuccauccgcgaccuccucaaccacgccuucuucgccgaggacaccggccuccgcgucgagcucgccgaggaggacgacugcuccaacuccucccucgcccuccgccucugggucgaggaccccaagaagcucaagggcaagcacaaggacaacgaggccaucgaguucuccuucaaccucgagaccgacacccccgaggaggucgccuacgagauggucaaguccggcuucuuccacgaguccgacuccaaggccgucgccaaguccauccgcgaccgcgucacccccaucaagaagacccgcgagaagaagcccgccggcugccucgaggagcgccgcgacucccagugcaaguccaugggcaacgucuucccccagccccagaacaccacccucccccucgcccccgcccagcagaccggcgccgagugcgaggagaccgaggucgaccagcacguccgccagcagcuccuccagcgcaagccccagcagcacugcuccuccgucaccggcgacaaccucuccgaggccggcgccgccuccgucauccacuccgacaccuccucccagcccuccgucgccuacuccuccaaccagaccaugggcucccagauggucuccaacaucccccaggccgaggucaacguccccggccagaucuacuccucccagcagcucgucggccacuaccagcaggucuccggccuccagaagcacuccaagcucacccagccccagauccucccccucguccagggccaguccaccguccuccccguccacguccucggccccaccgucgucucccagccccaggucuccccccucaccguccagaaggucccccagaucaagcccgucucccagcccgucggcgccgagcagcaggccgcccuccucaagcccgaccucguccgcucccucaaccaggacgucgccaccaccaaggagaacgucuccucccccgacaaccccuccggcaacggcaagcaggaccgcaucaagcagcgccgcgccuccugcccccgccccgagaagggcaccaaguuccagcucaccguccuccaggucuccaccuccggcgacaacauggucgagugccagcucgagacccacaacaacaagauggucaccuucaaguucgacgucgacggcgacgcccccgaggacaucgccgacuacauggucgaggacaacuucguccucgaguccgagaaggagaaguucgucgaggagcuccgcgccaucgucggccaggcccaggagauccuccacguccacuucgccaccgagcgcgccaccggcgucgacuccaucaccgucgacuccaacuccucccagaccggcuccuccgagcagguccagaucaacuccaccuccacccagaccuccaacgaguccgccccccaguccucccccgucggccgcuggcgcuucugcaucaaccagaccauccgcaaccgcgagacccaguccccccccucccuccagcacuccauguccgccguccccggccgccacccccuccccucccccaagaacaccuccaacaaggagaucucccgcgacacccuccucaccaucgagaacaaccccugccaccgcgcccucuucaccuccaaguccgagcacaaggacgucgucgacggcaagaucuccgagugcgccuccgucgagaccaagcagcccgccauccucuaccaggucgaggacaaccgccagaucauggcccccgucaccaacuccuccuccuacuccaccaccuccguccgcgccguccccgccgagugcgagggccucaccaagcaggccuccaucuucauccccgucuaccccugccaccagaccgccucccaggccgacgcccucaugucccaccccggcgaguccacccagaccuccggcaacucccucaccacccucgccuucgaccagaagccccagacccucuccguccagcagcccgccauggacgccgaguucaucucccaggagggcgagaccaccgucaacaccgaggccuccucccccaagaccgucauccccacccagacccccggccucgagcccaccacccuccagcccaccaccguccucgaguccgacggcgagcgcccccccaagcucgaguucgccgacaaccgcaucaagacccucgacgagaagcuccgcaaccuccucuaccaggagcacuccaucuccuccaucuaccccgagucccagaaggacacccaguccaucgacucccccuucuccuccuccgccgaggacacccucuccugccccgucaccgaggucaucgccaucucccacugcggcaucaaggacucccccguccagucccccaacuuccagcagaccggcuccaagcuccucuccaacgucgccgccucccagcccgccaacaucuccgucuucaagcgcgaccucaacgucaucaccuccguccccuccgagcucugccuccacgagauguccuccgacgccucccuccccggcgaccccgaggccuaccccgccgccgucuccuccggcggcgccauccaccuccagaccggcggcggcuacuucggccucuccuucaccugccccucccucaagaaccccaucuccaagaaguccuggacccgcaagcucaaguccugggccuaccgccuccgccaguccaccuccuucuucaagcgcuccaagguccgccaggucgagaccgaggagaugcgcuccgccaucgcccccgaccccaucccccucacccgcgaguccaccgccgacacccgcgcccucaaccgcugcaaggccauguccggcuccuuccagcgcggccgcuuccaggucaucaccaucccccagcagcaguccgccaagaugaccuccuucggcaucgagcacaucuccgucuucuccgagaccaaccacuccuccgaggaggccuucaucaagaccgccaagucccagcucgucgagaucgagcccgccacccagaaccccaagaccuccuucuccuacgagaagcuccaggcccuccaggagaccugcaaggagaacaagggcguccccaagcagggcgacaacuuccucuccuucuccgccgccugcgagaccgacgucuccuccgucacccccgagaaggaguucgaggagaccuccgccaccggcuccuccaugcaguccggcuccgagcuccuccucaaggagcgcgagauccucaccgccggcaagcagcccuccuccgacuccgaguucuccgccucccucgccggcuccggcaaguccgucgccaagaccggccccgaguccaaccagugccucccccaccacgaggagcaggccuacgcccagacccaguccucccucuucuacucccccuccucccccauguccuccgacgacgaguccgagaucgaggacgaggaccucaaggucgagcuccagcgccuccgcgagaagcacauccaggaggucgucaaccuccagacccagcagaacaaggagcuccaggagcucuacgagcgccuccgcuccaucaaggacuccaagacccaguccaccgagaucccccucccccccgccuccccccgccgcccccgcuccuucaaguccaagcuccgcucccgcccccagucccucacccacgucgacaacggcaucgucgccaccggcaaguccugccucaucaacgagcucgagaacccccucugcgucgaguccaacgccgccuccugccagcagucccccgccuccaagaagggcauguucaccgacgaccuccacaagcucgucgacgacuggaccaaggaggccgucggcaacucccucaucaagcccucccucaaccagcucaagcagucccagcacaagcucgagaccgagaacuggaacaaggucuccgagaacacccccuccaccaugggcuacaccuccaccuggaucuccucccucucccagauccgcggcgccguccccaccucccucccccagggccucucccuccccuccuuccccggcccccucuccuccuacggcaugccccacgucugccaguacaacgccgucgccggcgccggcuaccccguccagugggucggcaucuccggcaccacccagcaguccgucgucauccccgcccaguccggcggccccuuccagcccggcaugaacaugcaggccuuccccaccuccuccguccagaaccccgccaccaucccccccggccccaaguga

SEQ ID NO: 51789 - RNA, 3732 nt, Artificial Sequence
  derived and/or modified sequence opt2 from WNK4__Homo_sapiens__NP_115763
augcucgccucccccgccaccgagaccaccguccucaugucccagaccgaggccgaccucgcccuccgccccccccccccccucggcaccgccggccagccccgccucggcccccccccccgccgcgcccgccgcuucuccggcaaggccgagccccgcccccgcuccucccgccucucccgccgcuccuccgucgaccucggccuccucuccuccuggucccuccccgccucccccgcccccgacccccccgacccccccgacuccgccggccccggccccgcccgcucccccccccccuccuccaaggagccccccgagggcaccuggaccgagggcgcccccgucaaggccgccgaggacuccgcccgccccgagcuccccgacuccgccgucggccccggcucccgcgagccccuccgcguccccgaggccgucgcccucgagcgccgccgcgagcaggaggagaaggaggacauggagacccaggccgucgccaccucccccgacggccgcuaccucaaguucgacaucgagaucggccgcggcuccuucaagaccgucuaccgcggccucgacaccgacaccaccgucgaggucgccuggugcgagcuccagacccgcaagcucucccgcgccgagcgccagcgcuucuccgaggaggucgagaugcucaagggccuccagcaccccaacaucguccgcuucuacgacuccuggaaguccguccuccgcggccaggucugcaucguccucgucaccgagcucaugaccuccggcacccucaagaccuaccuccgccgcuuccgcgagaugaagccccgcguccuccagcgcuggucccgccagauccuccgcggccuccacuuccuccacucccgcgucccccccauccuccaccgcgaccucaagugcgacaacgucuucaucaccggccccaccggcuccgucaagaucggcgaccucggccucgccacccucaagcgcgccuccuucgccaaguccgucaucggcacccccgaguucauggcccccgagauguacgaggagaaguacgacgaggccgucgacgucuacgccuucggcaugugcaugcucgagauggccaccuccgaguaccccuacuccgagugccagaacgccgcccagaucuaccgcaaggucaccuccggccgcaagcccaacuccuuccacaaggucaagauccccgaggucaaggagaucaucgagggcugcauccgcaccgacaagaacgagcgcuucaccauccaggaccuccucgcccacgccuucuuccgcgaggagcgcggcguccacgucgagcucgccgaggaggacgacggcgagaagcccggccucaagcucuggcuccgcauggaggacgcccgccgcggcggccgcccccgcgacaaccaggccaucgaguuccucuuccagcucggccgcgacgccgccgaggaggucgcccaggagauggucgcccucggccucgucugcgaggccgacuaccagcccgucgcccgcgccguccgcgagcgcgucgccgccauccagcgcaagcgcgagaagcuccgcaaggcccgcgagcucgaggcccucccccccgagcccggccccccccccgccaccguccccauggcccccggcccccccuccgucuucccccccgagcccgaggagcccgaggccgaccagcaccagcccuuccucuuccgccacgccuccuacuccuccaccaccuccgacugcgagaccgacggcuaccucuccuccuccggcuuccucgacgccuccgaccccgcccuccagccccccggcggcguccccuccucccucgccgagucccaccucugccuccccuccgccuucgcccucuccaucccccgcuccggccccggcuccgacuucucccccggcgacuccuacgccuccgacgccgccuccggccucuccgacgucggcgagggcaugggccagaugcgccgcccccccggccgcaaccuccgccgccgcccccgcucccgccuccgcgucaccuccgucuccgaccagaacgaccgcgucgucgagugccagcuccagacccacaacuccaagauggucaccuuccgcuucgaccucgacggcgacucccccgaggagaucgccgccgccauggucuacaacgaguucauccuccccuccgagcgcgacggcuuccuccgccgcauccgcgagaucauccagcgcgucgagacccuccucaagcgcgacaccggccccauggaggccgccgaggacacccucuccccccaggaggagcccgccccccuccccgcccuccccgucccccuccccgaccccuccaacgaggagcuccaguccuccaccucccucgagcaccgcuccuggaccgccuucuccaccuccuccuccucccccggcaccccccucucccccggcaaccccuucucccccggcacccccaucucccccggccccaucuuccccaucaccuccccccccugccaccccucccccucccccuucucccccaucuccucccaggucuccuccaaccccuccccccaccccaccuccuccccccuccccuucuccuccuccacccccgaguuccccgucccccucucccagugccccugguccucccuccccaccaccuccccccccaccuucucccccaccugcucccaggucacccucuccucccccuucuucccccccugccccuccaccuccuccuuccccuccaccaccgccgccccccuccucucccucgccuccgccuucucccucgccgucaugaccgucgcccagucccuccucucccccucccccggccuccucucccaguccccccccgccccccccuccccccuccccucccucccccuccccccccccgucgcccccggcggccaggagucccccuccccccacaccgccgaggucgaguccgaggccucccccccccccgcccgcccccuccccggcgaggcccgccucgcccccaucuccgaggagggcaagccccagcucgucggccgcuuccaggucaccuccuccaaggagcccgccgagccccucccccuccagcccaccucccccacccucuccggcucccccaagcccuccaccccccagcucaccuccgaguccuccgacaccgaggacuccgccggcggcggccccgagacccgcgaggcccucgccgaguccgaccgcgccgccgagggccucggcgccggcgucgaggaggagggcgacgacggcaaggagccccaggucggcggcuccccccagccccucucccaccccucccccgucuggaugaacuacuccuacuccucccucugccucuccuccgaggaguccgaguccuccggcgaggacgaggaguucugggccgagcuccagucccuccgccagaagcaccucuccgaggucgagacccuccagacccuccagaagaaggagaucgaggaccucuacucccgccucggcaagcagcccccccccggcaucgucgcccccgccgccaugcucuccucccgccagcgccgccucuccaagggcuccuuccccaccucccgccgcaacucccuccagcgcuccgagccccccggccccggcaucaugcgccgcaacucccucuccggcuccuccaccggcucccaggagcagcgcgccuccaagggcgucaccuucgccggcgacgucggccgcauguga

SEQ ID NO: 51790 - RNA, 1254 nt, Artificial Sequence
  derived and/or modified sequence opt2 from WNT10A__Homo_sapiens__NP_079492
augggcuccgcccacccccgccccuggcuccgccuccgcccccagccccagccccgccccgcccucuggguccuccucuucuuccuccuccuccucgccgccgccaugccccgcuccgcccccaacgacauccucgaccuccgccucccccccgagcccguccucaacgccaacaccgucugccucacccuccccggccucucccgccgccagauggaggucugcguccgccaccccgacgucgccgccuccgccauccagggcauccagaucgccauccacgagugccagcaccaguuccgcgaccagcgcuggaacugcuccucccucgagacccgcaacaagauccccuacgagucccccaucuucucccgcggcuuccgcgaguccgccuucgccuacgccaucgccgccgccggcgucguccacgccgucuccaacgccugcgcccucggcaagcucaaggccugcggcugcgacgccucccgccgcggcgacgaggaggccuuccgccgcaagcuccaccgccuccagcucgacgcccuccagcgcggcaagggccucucccacggcguccccgagcaccccgcccuccccaccgccucccccggccuccaggacuccugggaguggggcggcugcucccccgacaugggcuucggcgagcgcuucuccaaggacuuccucgacucccgcgagccccaccgcgacauccacgcccgcaugcgccuccacaacaaccgcgucggccgccaggccgucauggagaacaugcgccgcaagugcaagugccacggcaccuccggcuccugccagcucaagaccugcuggcaggucacccccgaguuccgcaccgucggcgcccuccuccgcucccgcuuccaccgcgccacccucauccgcccccacaaccgcaacggcggccagcucgagcccggccccgccggcgcccccucccccgcccccggcgcccccggcccccgccgccgcgccucccccgccgaccucgucuacuucgagaagucccccgacuucugcgagcgcgagccccgccucgacuccgccggcaccgucggccgccucugcaacaaguccuccgccggcuccgacggcugcggcuccaugugcugcggccgcggccacaacauccuccgccagacccgcuccgagcgcugccacugccgcuuccacuggugcugcuucgucgucugcgaggagugccgcaucaccgagugggucuccgucugcaaguga

SEQ ID NO: 51791 - RNA, 1170 nt, Artificial Sequence
  derived and/or modified sequence opt2 from WNT10B__Homo_sapiens__NP_003385
augcucgaggagccccgcccccgccccccccccuccggccucgccggccuccucuuccucgcccucugcucccgcgcccucuccaacgagauccucggccucaagcuccccggcgagcccccccucaccgccaacaccgucugccucacccucuccggccucuccaagcgccagcucggccucugccuccgcaaccccgacgucaccgccuccgcccuccagggccuccacaucgccguccacgagugccagcaccagcuccgcgaccagcgcuggaacugcuccgcccucgagggcggcggccgccucccccaccacuccgccauccucaagcgcggcuuccgcgaguccgccuucuccuucuccaugcucgccgccggcgucaugcacgccgucgccaccgccugcucccucggcaagcucgucuccugcggcugcggcuggaagggcuccggcgagcaggaccgccuccgcgccaagcuccuccagcuccaggcccucucccgcggcaaguccuucccccacucccuccccucccccggccccggcuccucccccucccccggcccccaggacaccugggaguggggcggcugcaaccacgacauggacuucggcgagaaguucucccgcgacuuccucgacucccgcgaggccccccgcgacauccaggcccgcaugcgcauccacaacaaccgcgucggccgccaggucgucaccgagaaccucaagcgcaagugcaagugccacggcaccuccggcuccugccaguucaagaccugcuggcgcgccgcccccgaguuccgcgccgucggcgccgcccuccgcgagcgccucggccgcgccaucuucaucgacacccacaaccgcaacuccggcgccuuccagccccgccuccgcccccgccgccucuccggcgagcucgucuacuucgagaagucccccgacuucugcgagcgcgaccccaccaugggcucccccggcacccgcggccgcgccugcaacaagaccucccgccuccucgacggcugcggcucccucugcugcggccgcggccacaacguccuccgccagacccgcgucgagcgcugccacugccgcuuccacuggugcugcuacguccucugcgacgagugcaaggucaccgagugggucaacgucugcaaguga

SEQ ID NO: 51792 - RNA, 1065 nt, Artificial Sequence
  derived and/or modified sequence opt2 from WNT11__Homo_sapiens__NP_004617
augcgcgcccgcccccaggucugcgaggcccuccucuucgcccucgcccuccagaccggcgucugcuacggcaucaaguggcucgcccucuccaagacccccuccgcccucgcccucaaccagacccagcacugcaagcagcucgagggccucgucuccgcccagguccagcucugccgcuccaaccucgagcucaugcacaccgucguccacgccgcccgcgaggucaugaaggccugccgccgcgccuucgccgacaugcgcuggaacugcuccuccaucgagcucgcccccaacuaccuccucgaccucgagcgcggcacccgcgaguccgccuucgucuacgcccucuccgccgccgccaucucccacgccaucgcccgcgccugcaccuccggcgaccuccccggcugcuccugcggccccguccccggcgagccccccggccccggcaaccgcuggggcggcugcgccgacaaccucuccuacggccuccucaugggcgccaaguucuccgacgcccccaugaaggucaagaagaccggcucccaggccaacaagcucaugcgccuccacaacuccgaggucggccgccaggcccuccgcgccucccucgagaugaagugcaagugccacggcgucuccggcuccugcuccauccgcaccugcuggaagggccuccaggagcuccaggacgucgccgccgaccucaagacccgcuaccucuccgccaccaaggucguccaccgccccaugggcacccgcaagcaccucguccccaaggaccucgacauccgccccgucaaggacuccgagcucgucuaccuccaguccucccccgacuucugcaugaagaacgagaaggucggcucccacggcacccaggaccgccagugcaacaagaccuccaacggcuccgacuccugcgaccucaugugcugcggccgcggcuacaaccccuacaccgaccgcgucgucgagcgcugccacugcaaguaccacuggugcugcuacgucaccugccgccgcugcgagcgcaccgucgagcgcuacgucugcaaguga

SEQ ID NO: 51793 - RNA, 1068 nt, Artificial Sequence
  derived and/or modified sequence opt2 from WNT16__Homo_sapiens__NP_057171
augcagcucaccaccugccuccgcgagacccucuucaccggcgccucccagaagaccucccucugguggcucggcaucgccuccuucggcguccccgagaagcucggcugcgccaaccucccccucaacucccgccagaaggagcucugcaagcgcaagcccuaccuccuccccuccauccgcgagggcgcccgccucggcauccaggagugcggcucccaguuccgccacgagcgcuggaacugcaugaucaccgccgccgccaccaccgcccccaugggcgccuccccccucuucggcuacgagcucuccuccggcaccaaggagaccgccuucaucuacgccgucauggccgccggccucguccacuccgucacccgcuccugcuccgccggcaacaugaccgagugcuccugcgacaccacccuccagaacggcggcuccgccuccgagggcuggcacuggggcggcugcuccgacgacguccaguacggcaugugguucucccgcaaguuccucgacuuccccaucggcaacaccaccggcaaggagaacaagguccuccucgccaugaaccuccacaacaacgaggccggccgccaggccgucgccaagcucauguccgucgacugccgcugccacggcgucuccggcuccugcgccgucaagaccugcuggaagaccauguccuccuucgagaagaucggccaccuccucaaggacaaguacgagaacuccauccagaucuccgacaagaccaagcgcaagaugcgccgccgcgagaaggaccagcgcaagauccccauccacaaggacgaccuccucuacgucaacaagucccccaacuacugcgucgaggacaagaagcucggcauccccggcacccagggccgcgagugcaaccgcaccuccgagggcgccgacggcugcaaccuccucugcugcggccgcggcuacaacacccacgucguccgccacgucgagcgcugcgagugcaaguucaucuggugcugcuacguccgcugccgccgcugcgaguccaugaccgacguccacaccugcaaguga

SEQ ID NO: 51794 - RNA, 1113 nt, Artificial Sequence
  derived and/or modified sequence opt2 from WNT1__Homo_sapiens__NP_005421
augggccucugggcccuccuccccggcugggucuccgccacccuccuccucgcccucgccgcccuccccgccgcccucgccgccaacuccuccggccgcugguggggcaucgucaacgucgccuccuccaccaaccuccucaccgacuccaagucccuccagcucguccucgagcccucccuccagcuccucucccgcaagcagcgccgccucauccgccagaaccccggcauccuccacuccgucuccggcggccuccaguccgccguccgcgagugcaaguggcaguuccgcaaccgccgcuggaacugccccaccgcccccggcccccaccucuucggcaagaucgucaaccgcggcugccgcgagaccgccuucaucuucgccaucaccuccgccggcgucacccacuccgucgcccgcuccugcuccgagggcuccaucgaguccugcaccugcgacuaccgccgccgcggccccggcggccccgacuggcacuggggcggcugcuccgacaacaucgacuucggccgccucuucggccgcgaguucgucgacuccggcgagaagggccgcgaccuccgcuuccucaugaaccuccacaacaacgaggccggccgcaccaccgucuucuccgagaugcgccaggagugcaagugccacggcauguccggcuccugcaccguccgcaccugcuggaugcgccuccccacccuccgcgccgucggcgacguccuccgcgaccgcuucgacggcgccucccgcguccucuacggcaaccgcggcuccaaccgcgccucccgcgccgagcuccuccgccucgagcccgaggaccccgcccacaagccccccuccccccacgaccucgucuacuucgagaagucccccaacuucugcaccuacuccggccgccucggcaccgccggcaccgccggccgcgccugcaacuccuccucccccgcccucgacggcugcgagcuccucugcugcggccgcggccaccgcacccgcacccagcgcgucaccgagcgcugcaacugcaccuuccacuggugcugccacgucuccugccgcaacugcacccacacccgcguccuccacgagugccucuga

SEQ ID NO: 51795 - RNA, 900 nt, Artificial Sequence
  derived and/or modified sequence opt2 from WNT2B__Homo_sapiens__NP_001278809
augcgcuccgucggcgagggcgcccgcgaguggauccgcgagugccagcaccaguuccgccaccaccgcuggaacugcaccacccucgaccgcgaccacaccgucuucggccgcgucaugcuccgcuccucccgcgaggccgccuucgucuacgccaucuccuccgccggcgucguccacgccaucacccgcgccugcucccagggcgagcucuccgucugcuccugcgaccccuacacccgcggccgccaccacgaccagcgcggcgacuucgacuggggcggcugcuccgacaacauccacuacggcguccgcuucgccaaggccuucgucgacgccaaggagaagcgccucaaggacgcccgcgcccucaugaaccuccacaacaaccgcugcggccgcaccgccguccgccgcuuccucaagcucgagugcaagugccacggcgucuccggcuccugcacccuccgcaccugcuggcgcgcccucuccgacuuccgccgcaccggcgacuaccuccgccgccgcuacgacggcgccguccaggucauggccacccaggacggcgccaacuucaccgccgcccgccagggcuaccgccgcgccacccgcaccgaccucgucuacuucgacaacucccccgacuacugcguccucgacaaggccgccggcucccucggcaccgccggccgcgucugcuccaagaccuccaagggcaccgacggcugcgagaucaugugcugcggccgcggcuacgacaccacccgcgucacccgcgucacccagugcgagugcaaguuccacuggugcugcgccguccgcugcaaggagugccgcaacaccgucgacguccacaccugcaaggcccccaagaaggccgaguggcucgaccagaccuga

SEQ ID NO: 51796 - RNA, 1083 nt, Artificial Sequence
  derived and/or modified sequence opt2 from WNT2__Homo_sapiens__NP_003382
augaacgccccccucggcggcaucuggcucuggcucccccuccuccucaccuggcucacccccgaggucaacuccuccuggugguacaugcgcgccaccggcggcuccucccgcgucaugugcgacaacguccccggccucgucuccucccagcgccagcucugccaccgccaccccgacgucaugcgcgccaucucccagggcgucgccgaguggaccgccgagugccagcaccaguuccgccagcaccgcuggaacugcaacacccucgaccgcgaccacucccucuucggccgcguccuccuccgcuccucccgcgaguccgccuucgucuacgccaucuccuccgccggcgucgucuucgccaucacccgcgccugcucccagggcgaggucaaguccugcuccugcgaccccaagaagaugggcuccgccaaggacuccaagggcaucuucgacuggggcggcugcuccgacaacaucgacuacggcaucaaguucgcccgcgccuucgucgacgccaaggagcgcaagggcaaggacgcccgcgcccucaugaaccuccacaacaaccgcgccggccgcaaggccgucaagcgcuuccucaagcaggagugcaagugccacggcgucuccggcuccugcacccuccgcaccugcuggcucgccauggccgacuuccgcaagaccggcgacuaccucuggcgcaaguacaacggcgccauccaggucgucaugaaccaggacggcaccggcuucaccgucgccaacgagcgcuucaagaagcccaccaagaacgaccucgucuacuucgagaacucccccgacuacugcauccgcgaccgcgaggccggcucccucggcaccgccggccgcgucugcaaccucaccucccgcggcauggacuccugcgaggucaugugcugcggccgcggcuacgacaccucccacgucacccgcaugaccaagugcggcugcaaguuccacuggugcugcgccguccgcugccaggacugccucgaggcccucgacguccacaccugcaaggcccccaagaacgccgacuggaccaccgccaccuga

SEQ ID NO: 51797 - RNA, 1059 nt, Artificial Sequence
  derived and/or modified sequence opt2 from WNT3A__Homo_sapiens__NP_149122
auggccccccucggcuacuuccuccuccucugcucccucaagcaggcccucggcuccuaccccaucugguggucccucgccgucggcccccaguacuccucccucggcucccagcccauccucugcgccuccauccccggccucguccccaagcagcuccgcuucugccgcaacuacgucgagaucaugcccuccgucgccgagggcaucaagaucggcauccaggagugccagcaccaguuccgcggccgccgcuggaacugcaccaccguccacgacucccucgccaucuucggccccguccucgacaaggccacccgcgaguccgccuucguccacgccaucgccuccgccggcgucgccuucgccgucacccgcuccugcgccgagggcaccgccgccaucugcggcugcuccucccgccaccagggcucccccggcaagggcuggaaguggggcggcugcuccgaggacaucgaguucggcggcauggucucccgcgaguucgccgacgcccgcgagaaccgccccgacgcccgcuccgccaugaaccgccacaacaacgaggccggccgccaggccaucgccucccacaugcaccucaagugcaagugccacggccucuccggcuccugcgaggucaagaccugcugguggucccagcccgacuuccgcgccaucggcgacuuccucaaggacaaguacgacuccgccuccgagauggucgucgagaagcaccgcgagucccgcggcugggucgagacccuccgcccccgcuacaccuacuucaagguccccaccgagcgcgaccucgucuacuacgaggccucccccaacuucugcgagcccaaccccgagaccggcuccuucggcacccgcgaccgcaccugcaacgucuccucccacggcaucgacggcugcgaccuccucugcugcggccgcggccacaacgcccgcgccgagcgccgccgcgagaagugccgcugcgucuuccacuggugcugcuacgucuccugccaggagugcacccgcgucuacgacguccacaccugcaaguga

SEQ ID NO: 51798 - RNA, 1068 nt, Artificial Sequence
  derived and/or modified sequence opt2 from WNT3__Homo_sapiens__NP_110380
auggagccccaccuccucggccuccuccucggccuccuccucggcggcacccgcguccucgccggcuaccccaucugguggucccucgcccucggccagcaguacaccucccucggcucccagccccuccucugcggcuccauccccggccucguccccaagcagcuccgcuucugccgcaacuacaucgagaucaugcccuccgucgccgagggcgucaagcucggcauccaggagugccagcaccaguuccgcggccgccgcuggaacugcaccaccaucgacgacucccucgccaucuucggccccguccucgacaaggccacccgcgaguccgccuucguccacgccaucgccuccgccggcgucgccuucgccgucacccgcuccugcgccgagggcaccuccaccaucugcggcugcgacucccaccacaagggcccccccggcgagggcuggaaguggggcggcugcuccgaggacgccgacuucggcguccucgucucccgcgaguucgccgacgcccgcgagaaccgccccgacgcccgcuccgccaugaacaagcacaacaacgaggccggccgcaccaccauccucgaccacaugcaccucaagugcaagugccacggccucuccggcuccugcgaggucaagaccugcuggugggcccagcccgacuuccgcgccaucggcgacuuccucaaggacaaguacgacuccgccuccgagauggucgucgagaagcaccgcgagucccgcggcugggucgagacccuccgcgccaaguacucccucuucaagccccccaccgagcgcgaccucgucuacuacgagaacucccccaacuucugcgagcccaaccccgagaccggcuccuucggcacccgcgaccgcaccugcaacgucaccucccacggcaucgacggcugcgaccuccucugcugcggccgcggccacaacacccgcaccgagaagcgcaaggagaagugccacugcaucuuccacuggugcugcuacgucuccugccaggagugcauccgcaucuacgacguccacaccugcaaguga

SEQ ID NO: 51799 - RNA, 1122 nt, Artificial Sequence
  derived and/or modified sequence opt2 from WNT4__Homo_sapiens__XP_011539899
augacccagcucacccccgcccccccccccgccuccucccagggcucccucugcuccacccagggcaagcgcaacaagcgccucccccgcacccuccccaaccagcgcggcuacgagggcgaggacaccggccacaucccccgcuaccucgccaagcucuccuccgucggcuccaucuccgaggaggagaccugcgagaagcucaagggccucauccagcgccagguccagaugugcaagcgcaaccucgaggucauggacuccguccgccgcggcgcccagcucgccaucgaggagugccaguaccaguuccgcaaccgccgcuggaacugcuccacccucgacucccuccccgucuucggcaaggucgucacccagggcacccgcgaggccgccuucgucuacgccaucuccuccgccggcgucgccuucgccgucacccgcgccugcuccuccggcgagcucgagaagugcggcugcgaccgcaccguccacggcgucuccccccagggcuuccagugguccggcugcuccgacaacaucgccuacggcgucgccuucucccaguccuucgucgacguccgcgagcgcuccaagggcgccuccuccucccgcgcccucaugaaccuccacaacaacgaggccggccgcaaggccauccucacccacaugcgcgucgagugcaagugccacggcgucuccggcuccugcgaggucaagaccugcuggcgcgccgucccccccuuccgccaggucggccacgcccucaaggagaaguucgacggcgccaccgaggucgagccccgccgcgucggcuccucccgcgcccucgucccccgcaacgcccaguucaagccccacaccgacgaggaccucgucuaccucgagcccucccccgacuucugcgagcaggacaugcgcuccggcguccucggcacccgcggccgcaccugcaacaagaccuccaaggccaucgacggcugcgagcuccucugcugcggccgcggcuuccacaccgcccaggucgagcucgccgagcgcugcuccugcaaguuccacuggugcugcuucgucaagugccgccagugccagcgccucgucgagcuccacaccugccgcuga

SEQ ID NO: 51800 - RNA, 1098 nt, Artificial Sequence
  derived and/or modified sequence opt2 from WNT5A__Homo_sapiens__NP_001243034
auggccggcuccgccauguccuccaaguucuuccucgucgcccucgccaucuucuucuccuucgcccaggucgucaucgaggccaacuccugguggucccucggcaugaacaaccccguccagauguccgaggucuacaucaucggcgcccagccccucugcucccagcucgccggccucucccagggccagaagaagcucugccaccucuaccaggaccacaugcaguacaucggcgagggcgccaagaccggcaucaaggagugccaguaccaguuccgccaccgccgcuggaacugcuccaccgucgacaacaccuccgucuucggccgcgucaugcagaucggcucccgcgagaccgccuucaccuacgccgucuccgccgccggcgucgucaacgccaugucccgcgccugccgcgagggcgagcucuccaccugcggcugcucccgcgccgcccgccccaaggaccucccccgcgacuggcucuggggcggcugcggcgacaacaucgacuacggcuaccgcuucgccaaggaguucgucgacgcccgcgagcgcgagcgcauccacgccaagggcuccuacgaguccgcccgcauccucaugaaccuccacaacaacgaggccggccgccgcaccgucuacaaccucgccgacgucgccugcaagugccacggcgucuccggcuccugcucccucaagaccugcuggcuccagcucgccgacuuccgcaaggucggcgacgcccucaaggagaaguacgacuccgccgccgccaugcgccucaacucccgcggcaagcucguccaggucaacucccgcuucaacucccccaccacccaggaccucgucuacaucgaccccucccccgacuacugcguccgcaacgaguccaccggcucccucggcacccagggccgccucugcaacaagaccuccgagggcauggacggcugcgagcucaugugcugcggccgcggcuacgaccaguucaagaccguccagaccgagcgcugccacugcaaguuccacuggugcugcuacgucaagugcaagaagugcaccgagaucgucgaccaguucgucugcaaguga

SEQ ID NO: 51801 - RNA, 1080 nt, Artificial Sequence
  derived and/or modified sequence opt2 from WNT5B__Homo_sapiens__NP_110402
augcccucccuccuccuccucuucaccgccgcccuccucuccuccugggcccagcuccucaccgacgccaacuccugguggucccucgcccucaaccccguccagcgccccgagauguucaucaucggcgcccagcccgucugcucccagcuccccggccucucccccggccagcgcaagcucugccagcucuaccaggagcacauggccuacaucggcgagggcgccaagaccggcaucaaggagugccagcaccaguuccgccagcgccgcuggaacugcuccaccgccgacaacgccuccgucuucggccgcgucaugcagaucggcucccgcgagaccgccuucacccacgccgucuccgccgccggcgucgucaacgccaucucccgcgccugccgcgagggcgagcucuccaccugcggcugcucccgcaccgcccgccccaaggaccucccccgcgacuggcucuggggcggcugcggcgacaacgucgaguacggcuaccgcuucgccaaggaguucgucgacgcccgcgagcgcgagaagaacuucgccaagggcuccgaggagcagggccgcguccucaugaaccuccagaacaacgaggccggccgccgcgccgucuacaagauggccgacgucgccugcaagugccacggcgucuccggcuccugcucccucaagaccugcuggcuccagcucgccgaguuccgcaaggucggcgaccgccucaaggagaaguacgacuccgccgccgccaugcgcgucacccgcaagggccgccucgagcucgucaacucccgcuucacccagcccacccccgaggaccucgucuacgucgaccccucccccgacuacugccuccgcaacgaguccaccggcucccucggcacccagggccgccucugcaacaagaccuccgagggcauggacggcugcgagcucaugugcugcggccgcggcuacaaccaguucaaguccguccaggucgagcgcugccacugcaaguuccacuggugcugcuucguccgcugcaagaagugcaccgagaucgucgaccaguacaucugcaaguga

SEQ ID NO: 51802 - RNA, 1098 nt, Artificial Sequence
  derived and/or modified sequence opt2 from WNT6__Homo_sapiens__NP_006513
augcuccccccccuccccucccgccucggccuccuccuccuccuccuccucugccccgcccacgucggcggccucuggugggccgucggcuccccccucgucauggaccccaccuccaucugccgcaaggcccgccgccucgccggccgccaggccgagcucugccaggccgagcccgaggucgucgccgagcucgcccgcggcgcccgccucggcguccgcgagugccaguuccaguuccgcuuccgccgcuggaacugcuccucccacuccaaggccuucggccgcauccuccagcaggacauccgcgagaccgccuucgucuucgccaucaccgccgccggcgccucccacgccgucacccaggccugcuccaugggcgagcuccuccagugcggcugccaggccccccgcggccgcgcccccccccgccccuccggccuccccggcacccccggcccccccggccccgccggcucccccgagggcuccgccgccugggaguggggcggcugcggcgacgacgucgacuucggcgacgagaagucccgccucuucauggacgcccgccacaagcgcggccgcggcgacauccgcgcccucguccagcuccacaacaacgaggccggccgccucgccguccgcucccacacccgcaccgagugcaagugccacggccucuccggcuccugcgcccuccgcaccugcuggcagaagcucccccccuuccgcgaggucggcgcccgccuccucgagcgcuuccacggcgccucccgcgucaugggcaccaacgacggcaaggcccuccuccccgccguccgcacccucaagccccccggccgcgccgaccuccucuacgccgccgacucccccgacuucugcgcccccaaccgccgcaccggcucccccggcacccgcggccgcgccugcaacuccuccgcccccgaccucuccggcugcgaccuccucugcugcggccgcggccaccgccaggaguccguccagcucgaggagaacugccucugccgcuuccacuggugcugcgucguccagugccaccgcugccgcguccgcaaggagcucucccucugccucuga

SEQ ID NO: 51803 - RNA, 1050 nt, Artificial Sequence
  derived and/or modified sequence opt2 from WNT7A__Homo_sapiens__NP_004616
augaaccgcaaggcccgccgcugccucggccaccucuuccucucccucggcauggucuaccuccgcaucggcggcuucuccuccgucgucgcccucggcgccuccaucaucugcaacaagauccccggccucgccccccgccagcgcgccaucugccagucccgccccgacgccaucaucgucaucggcgagggcucccagaugggccucgacgagugccaguuccaguuccgcaacggccgcuggaacugcuccgcccucggcgagcgcaccgucuucggcaaggagcucaaggucggcucccgcgaggccgccuucaccuacgccaucaucgccgccggcgucgcccacgccaucaccgccgccugcacccagggcaaccucuccgacugcggcugcgacaaggagaagcagggccaguaccaccgcgacgagggcuggaaguggggcggcugcuccgccgacauccgcuacggcaucggcuucgccaaggucuucgucgacgcccgcgagaucaagcagaacgcccgcacccucaugaaccuccacaacaacgaggccggccgcaagauccucgaggagaacaugaagcucgagugcaagugccacggcgucuccggcuccugcaccaccaagaccugcuggaccacccucccccaguuccgcgagcucggcuacguccucaaggacaaguacaacgaggccguccacgucgagcccguccgcgccucccgcaacaagcgccccaccuuccucaagaucaagaagccccucuccuaccgcaagcccauggacaccgaccucgucuacaucgagaagucccccaacuacugcgaggaggaccccgucaccggcuccgucggcacccagggccgcgccugcaacaagaccgccccccaggccuccggcugcgaccucaugugcugcggccgcggcuacaacacccaccaguacgcccgcgucuggcagugcaacugcaaguuccacuggugcugcuacgucaagugcaacaccugcuccgagcgcaccgagauguacaccugcaaguga

SEQ ID NO: 51804 - RNA, 1050 nt, Artificial Sequence
  derived and/or modified sequence opt2 from WNT7B__Homo_sapiens__NP_478679
augcaccgcaacuuccgcaaguggaucuucuacgucuuccucugcuucggcguccucuacgucaagcucggcgcccucuccuccgucgucgcccucggcgccaacaucaucugcaacaagauccccggccucgccccccgccagcgcgccaucugccagucccgccccgacgccaucaucgucaucggcgagggcgcccagaugggcaucaacgagugccaguaccaguuccgcuucggccgcuggaacugcuccgcccucggcgagaagaccgucuucggccaggagcuccgcgucggcucccgcgaggccgccuucaccuacgccaucaccgccgccggcgucgcccacgccgucaccgccgccugcucccagggcaaccucuccaacugcggcugcgaccgcgagaagcagggcuacuacaaccaggccgagggcuggaaguggggcggcugcuccgccgacguccgcuacggcaucgacuucucccgccgcuucgucgacgcccgcgagaucaagaagaacgcccgccgccucaugaaccuccacaacaacgaggccggccgcaagguccucgaggaccgcaugcagcucgagugcaagugccacggcgucuccggcuccugcaccaccaagaccugcuggaccacccuccccaaguuccgcgaggucggccaccuccucaaggagaaguacaacgccgccguccaggucgaggucguccgcgccucccgccuccgccagcccaccuuccuccgcaucaagcagcuccgcuccuaccagaagcccauggagaccgaccucgucuacaucgagaagucccccaacuacugcgaggaggacgccgccaccggcuccgucggcacccagggccgccucugcaaccgcaccucccccggcgccgacggcugcgacaccaugugcugcggccgcggcuacaacacccaccaguacaccaaggucuggcagugcaacugcaaguuccacuggugcugcuucgucaagugcaacaccugcuccgagcgcaccgaggucuucaccugcaaguga

SEQ ID NO: 51805 - RNA, 1056 nt, Artificial Sequence
  derived and/or modified sequence opt2 from WNT8A__Homo_sapiens__NP_490645
augggcaaccucuucaugcucugggccgcccucggcaucugcugcgccgccuucuccgccuccgccugguccgucaacaacuuccucaucaccggccccaaggccuaccucaccuacaccaccuccgucgcccucggcgcccaguccggcaucgaggagugcaaguuccaguucgccugggagcgcuggaacugccccgagaacgcccuccagcucuccacccacaaccgccuccgcuccgccacccgcgagaccuccuucauccacgccaucuccuccgccggcgucauguacaucaucaccaagaacugcuccaugggcgacuucgagaacugcggcugcgacggcuccaacaacggcaagaccggcggccacggcuggaucuggggcggcugcuccgacaacgucgaguucggcgagcgcaucuccaagcucuucgucgacucccucgagaagggcaaggacgcccgcgcccucaugaaccuccacaacaaccgcgccggccgccucgccguccgcgccaccaugaagcgcaccugcaagugccacggcaucuccggcuccugcuccauccagaccugcuggcuccagcucgccgaguuccgcgagaugggcgacuaccucaaggccaaguacgaccaggcccucaagaucgagauggacaagcgccagcuccgcgccggcaacuccgccgagggccacuggguccccgccgaggccuuccuccccuccgccgaggccgagcucaucuuccucgaggagucccccgacuacugcaccugcaacuccucccucggcaucuacggcaccgagggccgcgagugccuccagaacucccacaacaccucccgcugggagcgccgcuccugcggccgccucugcaccgagugcggccuccaggucgaggagcgcaagaccgaggucaucuccuccugcaacugcaaguuccaguggugcugcaccgucaagugcgaccagugccgccacgucgucuccaaguacuacugcgcccgcucccccggcuccgcccagucccucggcaagggcuccgccuga

SEQ ID NO: 51806 - RNA, 1056 nt, Artificial Sequence
  derived and/or modified sequence opt2 from WNT8B__Homo_sapiens__NP_003384
auguuccucuccaagcccuccgucuacaucugccucuucaccugcguccuccagcucucccacuccugguccgucaacaacuuccucaugaccggccccaaggccuaccucaucuacuccuccuccgucgccgccggcgcccaguccggcaucgaggagugcaaguaccaguucgccugggaccgcuggaacugccccgagcgcgcccuccagcucuccucccacggcggccuccgcuccgccaaccgcgagaccgccuucguccacgccaucuccuccgccggcgucauguacacccucacccgcaacugcucccucggcgacuucgacaacugcggcugcgacgacucccgcaacggccagcucggcggccagggcuggcucuggggcggcugcuccgacaacgucggcuucggcgaggccaucuccaagcaguucgucgacgcccucgagaccggccaggacgcccgcgccgccaugaaccuccacaacaacgaggccggccgcaaggccgucaagggcaccaugaagcgcaccugcaagugccacggcgucuccggcuccugcaccacccagaccugcuggcuccagcuccccgaguuccgcgaggucggcgcccaccucaaggagaaguaccacgccgcccucaaggucgaccuccuccagggcgccggcaacuccgccgccggccgcggcgccaucgccgacaccuuccgcuccaucuccacccgcgagcucguccaccucgaggacucccccgacuacugccucgagaacaagacccucggccuccucggcaccgagggccgcgagugccuccgccgcggccgcgcccucggccgcugggagcgccgcuccugccgccgccucugcggcgacugcggccucgccgucgaggagcgccgcgccgagaccgucuccuccugcaacugcaaguuccacuggugcugcgccguccgcugcgagcagugccgccgccgcgucaccaaguacuucugcucccgcgccgagcgcccccgcggcggcgccgcccacaagcccggccgcaagcccuga

SEQ ID NO: 51807 - RNA, 1098 nt, Artificial Sequence
  derived and/or modified sequence opt2 from WNT9A__Homo_sapiens__NP_003386
augcucgacggcuccccccucgcccgcuggcucgccgccgccuucggccucacccuccuccucgccgcccuccgccccuccgccgccuacuucggccucaccggcuccgagccccucaccauccucccccucacccucgagcccgaggccgccgcccaggcccacuacaaggccugcgaccgccucaagcucgagcgcaagcagcgccgcaugugccgccgcgaccccggcgucgccgagacccucgucgaggccgucuccauguccgcccucgagugccaguuccaguuccgcuucgagcgcuggaacugcacccucgagggccgcuaccgcgccucccuccucaagcgcggcuucaaggagaccgccuuccucuacgccaucuccuccgccggccucacccacgcccucgccaaggccugcuccgccggccgcauggagcgcugcaccugcgacgaggcccccgaccucgagaaccgcgaggccuggcaguggggcggcugcggcgacaaccucaaguacuccuccaaguucgucaaggaguuccucggccgccgcuccuccaaggaccuccgcgcccgcgucgacuuccacaacaaccucgucggcgucaaggucaucaaggccggcgucgagaccaccugcaagugccacggcgucuccggcuccugcaccguccgcaccugcuggcgccagcucgcccccuuccacgaggucggcaagcaccucaagcacaaguacgagaccgcccucaaggucggcuccaccaccaacgaggccgccggcgaggccggcgccaucucccccccccgcggccgcgccuccggcgccggcggcuccgacccccucccccgcacccccgagcucguccaccucgacgacucccccuccuucugccucgccggccgcuucucccccggcaccgccggccgccgcugccaccgcgagaagaacugcgaguccaucugcugcggccgcggccacaacacccagucccgcgucgucacccgccccugccagugccagguccgcuggugcugcuacgucgagugccgccagugcacccagcgcgaggaggucuacaccugcaagggcuga

SEQ ID NO: 51808 - RNA, 1074 nt, Artificial Sequence
  derived and/or modified sequence opt2 from WNT9B__Homo_sapiens__NP_003387
augcgccccccccccgcccucgcccucgccggccucugccuccucgcccuccccgccgccgccgccuccuacuucggccucaccggccgcgagguccucacccccuuccccggccucggcaccgccgccgcccccgcccagggcggcgcccaccucaagcagugcgaccuccucaagcucucccgccgccagaagcagcucugccgccgcgagcccggccucgccgagacccuccgcgacgccgcccaccucggccuccucgagugccaguuccaguuccgccacgagcgcuggaacugcucccucgagggccgcaugggccuccucaagcgcggcuucaaggagaccgccuuccucuacgccgucuccuccgccgcccucacccacacccucgcccgcgccugcuccgccggccgcauggagcgcugcaccugcgacgacucccccggccucgagucccgccaggccuggcaguggggcgucugcggcgacaaccucaaguacuccaccaaguuccucuccaacuuccucggcuccaagcgcggcaacaaggaccuccgcgcccgcgccgacgcccacaacacccacgucggcaucaaggccgucaaguccggccuccgcaccaccugcaagugccacggcgucuccggcuccugcgccguccgcaccugcuggaagcagcucucccccuuccgcgagaccggccagguccucaagcuccgcuacgacuccgccgucaaggucuccuccgccaccaacgaggcccucggccgccucgagcucugggcccccgcccgccagggcucccucaccaagggccucgccccccgcuccggcgaccucgucuacauggaggacucccccuccuucugccgccccuccaaguacucccccggcaccgccggccgcgucugcucccgcgaggccuccugcuccucccucugcugcggccgcggcuacgacacccagucccgccucgucgccuucuccugccacugccagguccaguggugcugcuacgucgagugccagcagugcguccaggaggagcucgucuacaccugcaagcacuga

SEQ ID NO: 51809 - RNA, 1647 nt, Artificial Sequence
  derived and/or modified sequence opt2 from WRAP53__Homo_sapiens__NP_001137462
augaagacccucgagacccagccccucgcccccgacugcugccccuccgaccaggaccccgcccccgcccaccccuccccccacgccucccccaugaacaagaacgccgacuccgagcucaugccccccccccccgagcgcggcgaccccccccgccucucccccgaccccgucgccggcuccgccgucucccaggagcuccgcgagggcgaccccgucucccucuccaccccccucgagaccgaguucggcucccccuccgagcucuccccccgcaucgaggagcaggagcucuccgagaacaccucccuccccgccgaggaggccaacggcucccucuccgaggaggaggccaacggccccgagcucggcuccggcaaggccauggaggacaccuccggcgagcccgccgccgaggacgagggcgacaccgccuggaacuacuccuucucccagcucccccgcuuccucuccggcuccugguccgaguucuccacccagcccgagaacuuccucaagggcugcaagugggcccccgacggcuccugcauccucaccaacuccgccgacaacauccuccgcaucuacaaccucccccccgagcucuaccacgagggcgagcaggucgaguacgccgagaugguccccguccuccgcauggucgagggcgacaccaucuacgacuacugcugguacucccucauguccuccgcccagcccgacaccuccuacgucgccuccuccucccgcgagaaccccauccacaucugggacgccuucaccggcgagcuccgcgccuccuuccgcgccuacaaccaccucgacgagcucaccgccgcccacucccucugcuucucccccgacggcucccagcucuucugcggcuucaaccgcaccguccgcgucuucuccaccgcccgccccggccgcgacugcgagguccgcgccaccuucgccaagaagcagggccaguccggcaucaucuccugcaucgccuucucccccgcccagccccucuacgccugcggcuccuacggccgcucccucggccucuacgccugggacgacggcuccccccucgcccuccucggcggccaccagggcggcaucacccaccucugcuuccaccccgacggcaaccgcuucuucuccggcgcccgcaaggacgccgagcuccucugcugggaccuccgccaguccggcuacccccucuggucccucggccgcgaggucaccaccaaccagcgcaucuacuucgaccucgaccccaccggccaguuccucgucuccggcuccaccuccggcgccgucuccgucugggacaccgacggccccggcaacgacggcaagcccgagcccguccucuccuuccucccccagaaggacugcaccaacggcgucucccuccaccccucccucccccuccucgccaccgccuccggccagcgcgucuuccccgagcccaccgaguccggcgacgagggcgaggagcucggccucccccuccucuccacccgccacguccaccucgagugccgccuccagcucugguggugcggcggcgcccccgacuccuccauccccgacgaccaccagggcgagaagggccagggcggcaccgagggcggcgucggcgagcucaucuga

SEQ ID NO: 51810 - RNA, 423 nt, Artificial Sequence
  derived and/or modified sequence opt2 from WRB__Homo_sapiens__NP_001139690
augucccgcguccuccagaaggacgccgagcaggagucccagaugcgcgccgagauccaggacaugaagcaggagcucuccaccgucaacaugauggacgaguucgcccgcuacgcccgccucgagcgcaagaucaacaagaugaccgacaagcucaagacccacgucaaggcccgcaccgcccagcucgccaagaucaagugggucaucuccgucgccuucuacguccuccaggccgcccucaugaucucccucaucuggaaguacuacuccguccccgucgccgucguccccuccaaguggaucaccccccucgaccgccucgucgccuuccccacccgcgucgccggcggcgucggcaucaccugcuggauccucgucugcaacaaggucgucgccaucguccuccaccccuucuccuga

SEQ ID NO: 51811 - RNA, 4299 nt, Artificial Sequence
  derived and/or modified sequence opt2 from WRN__Homo_sapiens__NP_000544
auguccgagaagaagcucgagaccaccgcccagcagcgcaagugccccgaguggaugaacguccagaacaagcgcugcgccgucgaggagcgcaaggccugcguccgcaaguccgucuucgaggacgaccuccccuuccucgaguucaccggcuccaucgucuacuccuacgacgccuccgacugcuccuuccucuccgaggacaucuccaugucccucuccgacggcgacgucgucggcuucgacauggaguggcccccccucuacaaccgcggcaagcucggcaaggucgcccucauccagcucugcgucuccgaguccaagugcuaccucuuccacgucuccuccauguccgucuucccccagggccucaagaugcuccucgagaacaaggccgucaagaaggccggcgucggcaucgagggcgaccaguggaagcuccuccgcgacuucgacaucaagcucaagaacuucgucgagcucaccgacgucgccaacaagaagcucaagugcaccgagaccuggucccucaacucccucgucaagcaccuccucggcaagcagcuccucaaggacaaguccauccgcugcuccaacugguccaaguucccccucaccgaggaccagaagcucuacgccgccaccgacgccuacgccggcuucaucaucuaccgcaaccucgagauccucgacgacaccguccagcgcuucgccaucaacaaggaggaggagauccuccucuccgacaugaacaagcagcucaccuccaucuccgaggaggucauggaccucgccaagcaccucccccacgccuucuccaagcucgagaacccccgccgcgucuccauccuccucaaggacaucuccgagaaccucuacucccuccgccgcaugaucaucggcuccaccaacaucgagaccgagcuccgccccuccaacaaccucaaccuccucuccuucgaggacuccaccaccggcggcguccagcagaagcagauccgcgagcacgagguccucauccacgucgaggacgagaccugggaccccacccucgaccaccucgccaagcacgacggcgaggacguccucggcaacaaggucgagcgcaaggaggacggcuucgaggacggcgucgaggacaacaagcucaaggagaacauggagcgcgccugccucaugucccucgacaucaccgagcacgagcuccagauccucgagcagcagucccaggaggaguaccucuccgacaucgccuacaaguccaccgagcaccucucccccaacgacaacgagaacgacaccuccuacgucaucgaguccgacgaggaccucgagauggagaugcucaagcaccucucccccaacgacaacgagaacgacaccuccuacgucaucgaguccgacgaggaccucgagauggagaugcucaagucccucgagaaccucaacuccggcaccgucgagcccacccacuccaagugccucaagauggagcgcaaccucggccuccccaccaaggaggaggaggaggacgacgagaacgaggccaacgagggcgaggaggacgacgacaaggacuuccucuggcccgcccccaacgaggagcaggucaccugccucaagauguacuucggccacuccuccuucaagcccguccaguggaaggucauccacuccguccucgaggagcgccgcgacaacgucgccgucauggccaccggcuacggcaagucccucugcuuccaguacccccccgucuacgucggcaagaucggccucgucaucuccccccucaucucccucauggaggaccagguccuccagcucaagauguccaacauccccgccugcuuccucggcuccgcccaguccgagaacguccucaccgacaucaagcucggcaaguaccgcaucgucuacgucacccccgaguacugcuccggcaacaugggccuccuccagcagcucgaggccgacaucggcaucacccucaucgccgucgacgaggcccacugcaucuccgaguggggccacgacuuccgcgacuccuuccgcaagcucggcucccucaagaccgcccuccccaugguccccaucgucgcccucaccgccaccgccuccuccuccauccgcgaggacaucguccgcugccucaaccuccgcaacccccagaucaccugcaccggcuucgaccgccccaaccucuaccucgagguccgccgcaagaccggcaacauccuccaggaccuccagcccuuccucgucaagaccuccucccacugggaguucgagggccccaccaucaucuacugccccucccgcaagaugacccagcaggucaccggcgagcuccgcaagcucaaccucuccugcggcaccuaccacgccggcauguccuucuccacccgcaaggacauccaccaccgcuucguccgcgacgagauccagugcgucaucgccaccaucgccuucggcaugggcaucaacaaggccgacauccgccaggucauccacuacggcgcccccaaggacauggaguccuacuaccaggagaucggccgcgccggccgcgacggccuccaguccuccugccacguccucugggcccccgccgacaucaaccucaaccgccaccuccucaccgagauccgcaacgagaaguuccgccucuacaagcucaagaugauggccaagauggagaaguaccuccacuccucccgcugccgccgccagaucauccucucccacuucgaggacaagcagguccagaaggccucccucggcaucaugggcaccgagaagugcugcgacaacugccgcucccgccucgaccacugcuacuccauggacgacuccgaggacaccuccugggacuucggcccccaggccuucaagcuccucuccgccgucgacauccucggcgagaaguucggcaucggccuccccauccucuuccuccgcggcuccaacucccagcgccucgccgaccaguaccgccgccacucccucuucggcaccggcaaggaccagaccgaguccugguggaaggccuucucccgccagcucaucaccgagggcuuccucgucgaggucucccgcuacaacaaguucaugaagaucugcgcccucaccaagaagggccgcaacuggcuccacaaggccaacaccgagucccagucccucauccuccaggccaacgaggagcucugccccaagaagcuccuccuccccuccuccaagaccgucuccuccggcaccaaggagcacugcuacaaccagguccccgucgagcucuccaccgagaagaaguccaaccucgagaagcucuacuccuacaagcccugcgacaagaucuccuccggcuccaacaucuccaagaaguccaucaugguccagucccccgagaaggccuacuccuccucccagcccgucaucuccgcccaggagcaggagacccagaucguccucuacggcaagcucgucgaggcccgccagaagcacgccaacaagauggacgucccccccgccauccucgccaccaacaagauccucgucgacauggccaagaugcgccccaccaccgucgagaacgucaagcgcaucgacggcgucuccgagggcaaggccgccaugcucgccccccuccucgaggucaucaagcacuucugccagaccaacuccguccagaccgaccucuucuccuccaccaagccccaggaggagcagaagaccucccucgucgccaagaacaagaucugcacccucucccaguccauggccaucaccuacucccucuuccaggagaagaagaugccccucaaguccaucgccgagucccgcauccucccccucaugaccaucggcaugcaccucucccaggccgucaaggccggcugcccccucgaccucgagcgcgccggccucacccccgagguccagaagaucaucgccgacgucauccgcaacccccccgucaacuccgacauguccaagaucucccucauccgcaugcucguccccgagaacaucgacaccuaccucauccacauggccaucgagauccucaagcacggccccgacuccggccuccagcccuccugcgacgucaacaagcgccgcugcuuccccggcuccgaggagaucugcuccuccuccaagcgcuccaaggaggaggucggcaucaacaccgagaccuccuccgccgagcgcaagcgccgccuccccgucugguucgccaagggcuccgacaccuccaagaagcucauggacaagaccaagcgcggcggccucuucuccuga

SEQ ID NO: 51812 - RNA, 1998 nt, Artificial Sequence
  derived and/or modified sequence opt2 from WRNIP1__Homo_sapiens__NP_064520
auggaggucuccggccccgaggacgaccccuuccucucccagcuccaccagguccagugccccgucugccagcagaugaugcccgccgcccacaucaacucccaccucgaccgcugccuccuccuccaccccgccggccacgccgagcccgccgccggcucccaccgcgccggcgagcgcgccaagggccccuccccccccggcgccaagcgccgccgccucuccgaguccuccgcccucaagcagcccgccacccccaccgccgccgaguccuccgagggcgagggcgaggagggcgacgacggcggcgagaccgagucccgcgaguccuacgacgccccccccacccccuccggcgcccgccucauccccgacuuccccgucgcccgcuccuccucccccggccgcaagggcuccggcaagcgccccgccgccgccgccgccgccggcuccgccuccccccgcuccugggacgaggccgaggcccaggaggaggaggaggccgucggcgacggcgacggcgacggcgacgccgacgccgacggcgaggacgaccccggccacugggacgccgacgccgccgaggccgccaccgccuucggcgccuccggcggcggccgcccccacccccgcgcccucgccgccgaggagauccgccagaugcuccagggcaagccccucgccgacaccaugcgccccgacacccuccaggacuacuucggccaguccaaggccgucggccaggacacccuccuccgcucccuccucgagaccaacgagauccccucccucauccucuggggcccccccggcugcggcaagaccacccucgcccacaucaucgccuccaacuccaagaagcacuccauccgcuucgucacccucuccgccaccaacgccaagaccaacgacguccgcgacgucaucaagcaggcccagaacgagaaguccuucuucaagcgcaagaccauccucuucaucgacgagauccaccgcuucaacaagucccagcaggacaccuuccucccccacgucgagugcggcaccaucacccucaucggcgccaccaccgagaaccccuccuuccaggucaacgccgcccuccucucccgcugccgcgucaucguccucgagaagcuccccgucgaggccauggucaccauccucaugcgcgccaucaacucccucggcauccacguccucgacuccucccgccccaccgacccccucucccacuccuccaacuccuccuccgagcccgccauguucaucgaggacaaggccgucgacacccucgccuaccucuccgacggcgacgcccgcgccggccucaacggccuccagcucgccguccucgcccgccucuccucccgcaagauguucugcaagaaguccggccaguccuacucccccucccgcguccucaucaccgagaacgacgucaaggagggccuccagcgcucccacauccucuacgaccgcgccggcgaggagcacuacaacugcaucuccgcccuccacaaguccaugcgcggcuccgaccagaacgccucccucuacuggcucgcccgcaugcucgagggcggcgaggacccccucuacgucgcccgccgccucguccgcuucgccuccgaggacaucggccucgccgaccccuccgcccucacccaggccgucgccgccuaccagggcugccacuucaucggcaugcccgagugcgagguccuccucgcccagugcgucgucuacuucgcccgcgcccccaaguccaucgaggucuacuccgccuacaacaacgucaaggccugccuccgcaaccaccagggcccccucccccccgucccccuccaccuccgcaacgcccccacccgccucaugaaggaccucggcuacggcaagggcuacaaguacaaccccauguacuccgagcccgucgaccaggaguaccuccccgaggagcuccgcggcgucgacuucuucaagcagcgccgcugcuga

SEQ ID NO: 51813 - RNA, 1266 nt, Artificial Sequence
  derived and/or modified sequence opt2 from WSB1__Homo_sapiens__NP_056441
auggccuccuuccccccccgcgucaacgagaaggagaucguccgccuccgcaccaucggcgagcuccucgcccccgccgcccccuucgacaagaagugcggccgcgagaacuggaccgucgccuucgcccccgacggcuccuacuucgccuggucccagggccaccgcaccgucaagcucguccccuggucccagugccuccagaacuuccuccuccacggcaccaagaacgucaccaacuccuccucccuccgccucccccgccagaacuccgacggcggccagaagaacaagccccgcgagcacaucaucgacugcggcgacaucgucuggucccucgccuucggcuccuccguccccgagaagcagucccgcugcgucaacaucgaguggcaccgcuuccgcuucggccaggaccagcuccuccucgccaccggccucaacaacggccgcaucaagaucugggacgucuacaccggcaagcuccuccucaaccucgucgaccacaccgaggucguccgcgaccucaccuucgcccccgacggcucccucauccucgucuccgccucccgcgacaagacccuccgcgucugggaccucaaggacgacggcaacaugaugaagguccuccgcggccaccagaacugggucuacuccugcgccuucucccccgacuccuccaugcucugcuccgucggcgccuccaaggccgucuuccucuggaacauggacaaguacaccaugauccgcaagcucgagggccaccaccacgacgucgucgccugcgacuucucccccgacggcgcccuccucgccaccgccuccuacgacacccgcgucuacaucugggacccccacaacggcgacauccucauggaguucggccaccucuuccccccccccacccccaucuucgccggcggcgccaacgaccgcuggguccgcuccgucuccuucucccacgacggccuccacgucgccucccucgccgacgacaagaugguccgcuucuggcgcaucgacgaggacuaccccguccaggucgccccccucuccaacggccucugcugcgccuucuccaccgacggcuccguccucgccgccggcacccacgacggcuccgucuacuucugggccaccccccgccagguccccucccuccagcaccucugccgcauguccauccgccgcgucaugcccacccaggagguccaggagcuccccauccccuccaagcuccucgaguuccucuccuaccgcaucuga

SEQ ID NO: 51814 - RNA, 1728 nt, Artificial Sequence
  derived and/or modified sequence opt2 from WSCD1__Homo_sapiens__NP_056068
auggccaagcccuucuuccgccuccagaaguuccuccgccgcacccaguuccuccucuucuuccucaccgccgccuaccucaugaccggcucccuccuccuccuccagcgcguccgcgucgcccucccccagggcccccgcgcccccggcccccuccagacccuccccgucgccgccgucgcccucggcgucggccuccucgacucccgcgcccuccacgacccccgcgucucccccgagcuccuccucggcgucgacaugcuccaguccccccucacccgcccccgccccggcccccgcuggcuccgcucccgcaacuccgagcuccgccagcuccgccgccgcugguuccaccacuucauguccgacucccagggcccccccgcccucggccccgaggccgcccgccccgccauccacucccgcggcaccuacaucggcugcuucuccgacgacggccacgagcgcacccucaagggcgccgucuucuacgaccuccgcaagaugaccgucucccacugccaggacgccugcgccgagcgcuccuacgucuacgccggccucgaggccggcgccgagugcuacugcggcaaccgccuccccgccgucuccgucggccucgaggagugcaaccacgagugcaagggcgagaagggcuccgucugcggcgccgucgaccgccucuccgucuaccgcgucgacgagcuccagcccggcucccgcaagcgccgcaccgccaccuaccgcggcugcuuccgccuccccgagaacaucacccacgccuuccccuccucccucauccaggccaacgucaccgucggcaccugcuccggcuucugcucccagaaggaguucccccucgccauccuccgcggcugggagugcuacugcgccuaccccaccccccgcuucaaccuccgcgacgccauggacuccuccgucugcggccaggaccccgaggcccagcgccucgccgaguacugcgaggucuaccagacccccguccaggacacccgcugcaccgaccgccgcuuccuccccaacaaguccaaggucuucgucgcccucuccuccuuccccggcgccggcaacaccugggcccgccaccucaucgagcacgccaccggcuucuacaccggcuccuacuacuucgacggcacccucuacaacaagggcuucaagggcgagaaggaccacuggcgcucccgccgcaccaucugcgucaagacccacgaguccggccgccgcgagaucgagauguucgacuccgccauccuccucauccgcaaccccuaccgcucccucgucgccgaguucaaccgcaagugcgccggccaccucggcuacgccgccgaccgcaacuggaaguccaaggaguggcccgacuucgucaacuccuacgccuccuggugguccucccacguccucgacuggcucaaguacggcaagcgccuccucgucguccacuacgaggagcuccgccgcucccucguccccacccuccgcgagauggucgccuuccucaacgucuccgucuccgaggagcgccuccucugcgucgagaacaacaaggagggcuccuuccgccgccgcggccgccgcucccacgaccccgagcccuucacccccgagaugaaggaccucaucaacggcuacauccgcaccgucgaccaggcccuccgcgaccacaacuggaccggccucccccgcgaguacgucccccgcuga

SEQ ID NO: 51815 - RNA, 1698 nt, Artificial Sequence
  derived and/or modified sequence opt2 from WSCD2__Homo_sapiens__NP_001291376
auggccaagcucugguucaaguuccagcgcuacuuccgccgcaagcccguccgcuucuucaccuuccucgcccucuaccucaccgccggcucccucgucuuccuccacuccggcuucgucggccagcccgccgucuccggcaaccaggccaaccccgccgccgccggcggccccgccgagggcgccgagcucuccuuccucggcgacaugcaccucggccgcggcuuccgcgacaccggcgaggccuccuccaucgcccgccgcuacggccccugguucaagggcaaggacggcaacgagcgcgccaagcucggcgacuacggcggcgccuggucccgcgcccucaagggccgcgucguccgcgagaaggaggaggagcgcgccaaguacaucggcugcuaccucgacgacacccagucccgcgcccuccgcggcgucuccuucuucgacuacaagaagaugaccaucuuccgcugccaggacaacugcgccgagcgcggcuaccucuacggcggccucgaguucggcgccgagugcuacugcggccacaagauccaggccaccaacgucuccgaggccgagugcgacauggagugcaagggcgagcgcggcuccgucugcggcggcgccaaccgccucuccgucuaccgccuccagcucgcccaggaguccgcccgccgcuacggcuccgccgucuuccgcggcugcuuccgccgccccgacaaccucucccucgcccuccccgucaccgccgccaugcucaacauguccgucgacaagugcgucgacuucugcaccgagaaggaguacccccucgccgcccucgccggcaccgccugccacugcggcuuccccaccacccgcuucccccuccacgaccgcgaggacgagcagcucugcgcccagaagugcuccgccgaggaguucgaguccugcggcacccccuccuacuucaucgucuaccagacccagguccaggacaaccgcugcauggaccgccgcuuccuccccggcaaguccaagcagcucaucgcccucgccuccuuccccggcgccggcaacaccugggcccgccaccucaucgagcucgccaccggcuucuacaccggcuccuacuacuucgacggcucccucuacaacaagggcuucaagggcgagcgcgaccacuggcgcuccggccgcaccaucugcaucaagacccacgaguccggccagaaggagaucgaggccuucgacgccgccauccuccucauccgcaaccccuacaaggcccucauggccgaguucaaccgcaaguacggcggccacaucggcuucgccgcccacgcccacuggaagggcaaggaguggcccgaguucguccgcaacuacgcccccuggugggccacccacacccucgacuggcucaaguucggcaagaagguccucgucguccacuucgaggaccucaagcaggaccucuucguccagcucggccgcauggucucccuccucggcgucgccguccgcgaggaccgccuccucugcgucgagucccagaaggacggcaacuucaagcgcuccggccuccgcaagcucgaguacgaccccuacaccgccgacaugcagaagaccaucuccgccuacaucaagauggucgacgccgcccucaagggccgcaaccucaccggcguccccgacgacuacuacccccgcuga

SEQ ID NO: 51816 - RNA, 1494 nt, Artificial Sequence
  derived and/or modified sequence opt2 from WT1__Homo_sapiens__NP_000369
augcaggaccccgccuccaccugcguccccgagcccgccucccagcacacccuccgcuccggccccggcugccuccagcagcccgagcagcagggcguccgcgaccccggcggcaucugggccaagcucggcgccgccgaggccuccgccgagcgccuccagggccgccgcucccgcggcgccuccggcuccgagccccagcagaugggcuccgacguccgcgaccucaacgcccuccuccccgccguccccucccucggcggcggcggcggcugcgcccuccccgucuccggcgccgcccagugggcccccguccucgacuucgccccccccggcgccuccgccuacggcucccucggcggccccgcccccccccccgccccccccccccccccccccccccccccccacuccuucaucaagcaggagcccuccuggggcggcgccgagccccacgaggagcagugccucuccgccuucaccguccacuucuccggccaguucaccggcaccgccggcgccugccgcuacggccccuucggcccccccccccccucccaggccuccuccggccaggcccgcauguuccccaacgcccccuaccuccccuccugccucgagucccagcccgccauccgcaaccagggcuacuccaccgucaccuucgacggcacccccuccuacggccacacccccucccaccacgccgcccaguuccccaaccacuccuucaagcacgaggaccccaugggccagcagggcucccucggcgagcagcaguacuccguccccccccccgucuacggcugccacacccccaccgacuccugcaccggcucccaggcccuccuccuccgcacccccuacuccuccgacaaccucuaccagaugaccucccagcucgagugcaugaccuggaaccagaugaaccucggcgccacccucaagggccacuccaccggcuacgaguccgacaaccacaccacccccauccucugcggcgcccaguaccgcauccacacccacggcgucuuccgcggcauccaggacguccgccgcguccccggcgucgcccccacccucguccgcuccgccuccgagaccuccgagaagcgccccuucaugugcgccuaccccggcugcaacaagcgcuacuucaagcucucccaccuccagaugcacucccgcaagcacaccggcgagaagcccuaccagugcgacuucaaggacugcgagcgccgcuucucccgcuccgaccagcucaagcgccaccagcgccgccacaccggcgucaagcccuuccagugcaagaccugccagcgcaaguucucccgcuccgaccaccucaagacccacacccgcacccacaccggcgagaagcccuucuccugccgcuggcccuccugccagaagaaguucgcccgcuccgacgagcucguccgccaccacaacaugcaccagcgcaacaugaccaagcuccagcucgcccucuga

SEQ ID NO: 51817 - RNA, 1191 nt, Artificial Sequence
  derived and/or modified sequence opt2 from WTAP__Homo_sapiens__NP_001257460
augaccaacgaggagccccuccccaagaagguccgccucuccgagaccgacuucaaggucauggcccgcgacgagcucauccuccgcuggaagcaguacgaggccuacguccaggcccucgagggcaaguacaccgaccucaacuccaacgacgucaccggccuccgcgaguccgaggagaagcucaagcagcagcagcaggaguccgcccgccgcgagaacauccucgucaugcgccucgccaccaaggagcaggagaugcaggagugcaccacccagauccaguaccucaagcagguccagcagcccuccgucgcccagcuccgcuccaccauggucgaccccgccaucaaccucuucuuccucaagaugaagggcgagcucgagcagaccaaggacaagcucgagcaggcccagaacgagcucuccgccuggaaguucacccccgacucccagaccggcaagaagcucauggccaagugccgcaugcucauccaggagaaccaggagcucggccgccagcucucccagggccgcaucgcccagcucgaggccgagcucgcccuccagaagaaguacuccgaggagcucaaguccucccaggacgagcucaacgacuucaucauccagcucgacgaggaggucgagggcaugcaguccaccauccucguccuccagcagcagcucaaggagacccgccagcagcucgcccaguaccagcagcagcagucccaggccuccgcccccuccaccucccgcaccaccgccuccgagcccgucgagcaguccgaggccaccuccaaggacugcucccgccucaccaacggccccuccaacggcuccuccucccgccagcgcaccuccggcuccggcuuccaccgcgagggcaacaccaccgaggacgacuuccccuccucccccggcaacggcaacaaguccuccaacuccuccgaggagcgcaccggccgcggcggcuccggcuacgucaaccagcucuccgccggcuacgaguccgucgacucccccaccggcuccgagaacucccucacccaccaguccaacgacaccgacuccucccacgacccccaggaggagaaggccgucuccggcaagggcaaccgcaccgucggcucccgccacguccagaacggccucgacuccuccgucaacguccagggcuccguccucuga

SEQ ID NO: 51818 - RNA, 1293 nt, Artificial Sequence
  derived and/or modified sequence opt2 from WTIP__Homo_sapiens__NP_001073905
augcagcgcucccgcgccggcgccgacgaggccgcccuccuccucgccggccucgcccuccgcgagcucgagcccggcugcggcucccccggccgcggccgccgcggcccccgccccggccccggcgacgaggccgcccccgcccucggccgccgcggcaagggcuccggcggccccgaggccggcgccgacggccucucccgcggcgagcgcggcccccgccgcgccgccguccccgagcucuccgcccagcccgccggcuccccccgcgccucccucgccggcuccgacggcggcggcggcggcggcuccgcccgcuccuccggcaucucccucggcuacgaccagcgccacggcuccccccgcuccggccgcuccgacccccgccccggccccggcccccccuccgucggcuccgcccgcuccuccgucuccucccucggcucccgcggcuccgccggcgccuacgccgacuuccucccccccggcgccugccccgcccccgcccgcucccccgagcccgccggccccgcccccuucccccuccccgcccucccccucccccccggccgcgagggcggccccuccgccgccgagcgccgccucgaggcccucacccgcgagcucgagcgcgcccucgaggcccgcaccgcccgcgacuacuucggcaucugcaucaagugcggccucggcaucuacggcgcccagcaggccugccaggccaugggcucccucuaccacaccgacugcuucaccugcgacuccugcggccgccgccuccgcggcaaggccuucuacaacgucggcgagaaggucuacugccaggaggacuuccucuacuccggcuuccagcagaccgccgacaagugcuccgucugcggccaccucaucauggagaugauccuccaggcccucggcaaguccuaccaccccggcugcuuccgcugcuccgucugcaacgagugccucgacggcguccccuucaccgucgacgucgagaacaacaucuacugcguccgcgacuaccacaccgucuucgcccccaagugcgccuccugcgcccgccccauccuccccgcccagggcugcgagaccaccauccgcgucgucuccauggaccgcgacuaccacgucgccugcuaccacugcgaggacugcggccuccagcucuccggcgaggagggccgccgcugcuacccccucgccggccaccuccucugccgccgcugccaccuccgccgccuccagcccggcccccuccccucccccaccguccacgucaccgagcucuga

SEQ ID NO: 51819 - RNA, 3360 nt, Artificial Sequence
  derived and/or modified sequence opt2 from WWC1__Homo_sapiens__NP_001155133
augccccgccccgagcucccccuccccgagggcugggaggaggcccgcgacuucgacggcaaggucuacuacaucgaccacaccaaccgcaccaccuccuggaucgacccccgcgaccgcuacaccaagccccucaccuucgccgacugcaucuccgacgagcucccccucggcugggaggaggccuacgacccccaggucggcgacuacuucaucgaccacaacaccaagaccacccagaucgaggacccccgcguccaguggcgccgcgagcaggagcacaugcucaaggacuaccucgucgucgcccaggaggcccucuccgcccagaaggagaucuaccaggucaagcagcagcgccucgagcucgcccagcaggaguaccagcagcuccacgccgucugggagcacaagcucggcucccaggucucccucgucuccggcuccuccuccuccuccaaguacgaccccgagauccucaaggccgagaucgccaccgccaagucccgcgucaacaagcucaagcgcgagaugguccaccuccagcacgagcuccaguucaaggagcgcggcuuccagacccucaagaagaucgacaagaagauguccgacgcccagggcuccuacaagcucgacgaggcccaggccguccuccgcgagaccaaggccaucaagaaggccaucaccugcggcgagaaggagaagcaggaccucaucaagucccucgccaugcucaaggacggcuuccgcaccgaccgcggcucccacuccgaccucugguccuccuccuccucccucgaguccuccuccuucccccuccccaagcaguaccucgacgucuccucccagaccgacaucuccggcuccuucggcaucaacuccaacaaccagcucgccgagaagguccgccuccgccuccgcuacgaggaggccaagcgccgcaucgccaaccucaagauccagcucgccaagcucgacuccgaggccuggcccggcguccucgacuccgagcgcgaccgccucauccucaucaacgagaaggaggagcuccucaaggagaugcgcuucaucuccccccgcaaguggacccagggcgaggucgagcagcucgagauggcccgcaagcgccucgagaaggaccuccaggccgcccgcgacacccaguccaaggcccucaccgagcgccucaagcucaacuccaagcgcaaccagcucguccgcgagcucgaggaggccacccgccaggucgccacccuccacucccagcucaagucccucuccuccuccaugcagucccucuccuccggcuccucccccggcucccucaccuccucccgcggcucccucgucgccuccucccucgacuccuccaccuccgccuccuucaccgaccucuacuacgaccccuucgagcagcucgacuccgagcuccaguccaaggucgaguuccuccuccucgagggcgccaccggcuuccgccccuccggcugcaucaccaccauccacgaggacgaggucgccaagacccagaaggccgagggcggcggccgccuccaggcccuccgcucccucuccggcacccccaaguccaugaccucccucuccccccgcuccucccucuccucccccuccccccccugcuccccccucauggccgacccccuccucgccggcgacgccuuccucaacucccucgaguucgaggaccccgagcucuccgccacccucugcgagcucucccucggcaacuccgcccaggagcgcuaccgccucgaggagcccggcaccgagggcaagcagcucggccaggccgucaacaccgcccagggcugcggccucaaggucgccugcgucuccgccgccgucuccgacgaguccgucgccggcgacuccggcgucuacgaggccuccguccagcgccucggcgccuccgaggccgccgccuucgacuccgacgaguccgaggccgucggcgccacccgcauccagaucgcccucaaguacgacgagaagaacaagcaguucgccauccucaucauccagcucuccaaccucuccgcccuccuccagcagcaggaccagaaggucaacauccgcgucgccguccuccccugcuccgaguccaccaccugccucuuccgcacccgcccccucgacgccuccgacacccucgucuucaacgaggucuucugggucuccauguccuaccccgcccuccaccagaagacccuccgcgucgacgucugcaccaccgaccgcucccaccucgaggagugccucggcggcgcccagaucucccucgccgaggucugccgcuccggcgagcgcuccacccgcugguacaaccuccucuccuacaaguaccucaagaagcagucccgcgagcucaagcccgucggcgucauggcccccgccuccggccccgccuccaccgacgccgucuccgcccuccucgagcagaccgccgucgagcucgagaagcgccaggagggccgcuccuccacccagacccucgaggacuccuggcgcuacgaggagaccuccgagaacgaggccgucgccgaggaggaggaggaggaggucgaggaggaggagggcgaggaggacgucuucaccgagaaggccucccccgacauggacggcuaccccgcccucaaggucgacaaggagaccaacaccgagacccccgcccccucccccaccgucguccgccccaaggaccgccgcgucggcacccccucccagggccccuuccuccgcggcuccaccaucauccgcuccaagaccuucucccccggcccccagucccaguacgucugccgccucaaccgcuccgacuccgacuccuccacccucuccaagaagccccccuucguccgcaacucccucgagcgccgcuccguccgcaugaagcgccccuccccccccccccagcccuccuccgucaagucccuccgcuccgagcgccucauccgcaccucccucgaccucgagcucgaccuccaggccacccgcaccuggcacucccagcucacccaggagaucuccguccucaaggagcucaaggagcagcucgagcaggccaagucccacggcgagaaggagcucccccaguggcuccgcgaggacgagcgcuuccgccuccuccuccgcaugcucgagaagcgccagauggaccgcgccgagcacaagggcgagcuccagaccgacaagaugaugcgcgccgccgccaaggacguccaccgccuccgcggccaguccugcaaggagccccccgagguccaguccuuccgcgagaagauggccuucuucacccgcccccgcaugaacauccccgcccucuccgccgacgacgucuga

SEQ ID NO: 51820 - RNA, 3579 nt, Artificial Sequence
  derived and/or modified sequence opt2 from WWC2__Homo_sapiens__NP_079225
augccccgccgcgccggcuccggccagcucccccucccccgcggcugggaggaggcccgcgacuacgacggcaaggucuucuacaucgaccacaacacccgccgcaccuccuggaucgacccccgcgaccgccucaccaagccccucuccuucgccgacugcgucggcgacgagcuccccuggggcugggaggccggcuucgacccccagaucggcgucuacuacaucgaccacaucaacaagaccacccagaucgaggacccccgcaagcaguggcgcggcgagcaggagaagaugcucaaggacuaccucuccgucgcccaggacgcccuccgcacccagaaggagcucuaccacgucaaggagcagcgccucgcccucgcccucgacgaguacguccgccucaacgacgccuacaaggagaaguccuccucccacaccucccucuucuccggcuccuccuccuccaccaaguacgaccccgacauccucaaggccgagaucuccaccacccgccuccgcgucaagaagcucaagcgcgagcucucccagaugaagcaggagcuccucuacaaggagcagggcuucgagacccuccagcagaucgacaagaagauguccggcggccaguccggcuacgagcucuccgaggccaaggccauccucaccgagcucaaguccauccgcaaggccaucuccuccggcgagaaggagaagcaggaccucaugcagucccucgccaagcuccaggagcgcuuccaccucgaccagaacaucggccgcuccgagcccgaccuccgcugcucccccgucaacucccaccucugccucucccgccagacccucgacgccggcucccagaccuccaucuccggcgacaucggcguccgcucccgcuccaaccucgccgagaagguccgccucucccuccaguacgaggaggccaagcgcuccauggccaaccucaagaucgagcucuccaagcucgacuccgaggccuggcccggcgcccucgacaucgagaaggagaagcucaugcucaucaacgagaaggaggagcuccucaaggagcuccaguucgucaccccccagaagcgcacccaggacgagcucgagcgccucgaggccgagcgccagcgccucgaggaggagcuccucuccguccgcggcacccccucccgcgcccucgccgagcgccuccgccucgaggagcgccgcaaggagcuccuccagaagcucgaggagaccaccaagcucaccaccuaccuccacucccagcucaagucccucuccgccuccacccucuccauguccuccggcuccucccucggcucccucgccuccucccgcggcucccucaacaccuccucccgcggcucccucaacucccucuccuccaccgagcucuacuacuccucccaguccgaccagaucgacgucgacuaccaguacaagcucgacuuccuccuccaggagaaguccggcuacauccccuccggccccaucaccaccauccacgagaacgaggucgucaagucccccucccagcccggccaguccggccucugcggcgucgccgccgccgccaccggccacacccccccccucgccgaggcccccaaguccgucgccucccucuccucccgcuccucccucuccucccucuccccccccggcuccccccucguccucgagggcaccuuccccauguccuccucccacgacgccucccuccaccaguucaccgccgacuucgaggacugcgagcucuccucccacuucgccgacaucucccucaucgagaaccagauccuccucgacuccgacuccggcggcgccucccagucccucuccgaggacaaggaccucaacgagugcgcccgcgagccccucuacgagggcaccgccgacgucgagaagucccuccccaagcgccgcgucauccaccuccucggcgagaagaccaccugcgucuccgccgccgucuccgacgaguccgucgccggcgacuccggcgucuacgaggccuucgucaagcagcccuccgagauggaggacgucaccuacuccgaggaggacgucgccaucgucgagaccgcccagguccagaucggccuccgcuacaacgccaaguccuccuccuucauggucaucaucgcccagcuccgcaaccuccacgccuuccucaucccccacaccuccaaggucuacuuccgcgucgccguccuccccuccuccaccgacgucuccugccucuuccgcaccaagguccacccccccaccgaguccauccucuucaacgacgucuuccgcgucgccaucucccagaccgcccuccagcagaagacccuccgcgucgaccucugcuccgucuccaagcaccgccgcgaggagugccucgccggcacccagaucucccucgccgaccuccccuucuccuccgaggucuucacccucugguacaaccuccuccccuccaagcagaugcccugcaagaagaacgaggagaacgaggacuccgucuuccagcccaaccagccccucgucgacuccaucgaccucgacgccgucuccgcccuccucgcccgcaccuccgccgagcuccucgccgucgagcaggagcucgcccaggaggaggaggaggaguccggccaggaggagccccgcggccccgacggcgacuggcucaccaugcuccgcgaggccuccgacgagaucgucgccgagaaggaggccgaggucaagcuccccgaggacuccuccugcaccgaggaccucuccuccugcaccuccguccccgagaugaacgaggacggcaaccgcaaggaguccaacugcgccaaggaccuccgcucccagccccccacccgcauccccacccucgucgacaaggagaccaacaccgacgaggccgccaacgacaacauggccguccgccccaaggagcgcuccucccucuccucccgccagcaccccuucguccgcuccuccgucaucguccgcucccagaccuucucccccggcgagcgcaaccaguacaucugccgccucaaccgcuccgacuccgacuccuccacccucgccaagaagucccucuucguccgcaacuccaccgagcgccgcucccuccgcgucaagcgcaccgucugccaguccguccuccgccgcaccacccaggagugccccguccgcaccucccucgaccucgagcucgaccuccaggccucccucacccgccagucccgccucaacgacgagcuccaggcccuccgcgaccuccgccagaagcucgaggagcucaaggcccagggcgagaccgaccucccccccggcguccucgaggacgagcgcuuccagcgccuccucaagcaggccgagaagcaggccgagcaguccaaggaggagcagaagcagggccucaacgccgagaagcucaugcgccaggucuccaaggacgucugccgccuccgcgagcagucccagaaggucccccgccagguccaguccuuccgcgagaagaucgccuacuucacccgcgccaagaucuccauccccucccuccccgccgacgacgucuga

SEQ ID NO: 51821 - RNA, 906 nt, Artificial Sequence
  derived and/or modified sequence opt2 from WWOX__Homo_sapiens__NP_001278926
auggagauccuccagggccgcgacuucaccggcaaggucgucgucgucaccggcgccaacuccggcaucggcuucgagaccgccaaguccuucgcccuccacggcgcccacgucauccucgccugccgcaacauggcccgcgccuccgaggccgucucccgcauccucgaggaguggcacaaggccaaggucgaggccaugacccucgaccucgcccuccuccgcuccguccagcacuucgccgaggccuucaaggccaagaacgucccccuccacguccucgucugcaacgccgccaccuucgcccuccccuggucccucaccaaggacggccucgagaccaccuuccaggucaaccaccucggccacuucuaccucguccagcuccuccaggacguccucugccgcuccgcccccgcccgcgucaucgucgucuccuccgagucccaccgcuucaccgacaucaacgacucccucggcaagcucgacuucucccgccucucccccaccaagaacgacuacugggccaugcucgccuacaaccgcuccaagcucugcaacauccucuucuccaacgagcuccaccgccgccucuccccccgcggcgucaccuccaacgccguccaccccggcaacaugauguacuccaacauccaccgcuccuggugggucuacacccuccucuucacccucgcccgccccuucaccaaguccaugcagcagggcgccgccaccaccgucuacugcgccgccguccccgagcucgagggccucggcggcauguacuucaacaacugcugccgcugcaugcccucccccgaggcccaguccgaggagaccgcccgcacccucugggcccucuccgagcgccucauccaggagcgccucggcucccaguccggcuga

SEQ ID NO: 51822 - RNA, 2769 nt, Artificial Sequence
  derived and/or modified sequence opt2 from WWP1__Homo_sapiens__XP_005250817
auggccaccgccuccccccgcuccgacaccuccaacaaccacuccggccgccuccagcuccaggucaccgucuccuccgccaagcucaagcgcaagaagaacugguucggcaccgccaucuacaccgaggucgucgucgacggcgagaucaccaagaccgccaaguccuccuccuccuccaaccccaagugggacgagcagcucaccgucaacgucaccccccagaccacccucgaguuccaggucuggucccaccgcacccucaaggccgacgcccuccucggcaaggccaccaucgaccucaagcaggcccuccucauccacaaccgcaagcucgagcgcgucaaggagcagcucaagcucucccucgagaacaagaacggcaucgcccagaccggcgagcucaccgucguccucgacggccucgucaucgagcaggagaacaucaccaacugcuccuccucccccaccaucgagauccaggagaacggcgacgcccuccacgagaacggcgagcccuccgcccgcaccaccgcccgccucgccgucgagggcaccaacggcaucgacaaccacguccccaccuccacccucguccagaacuccugcugcuccuacgucgucaacggcgacaacacccccuccucccccucccaggucgccgcccgccccaagaacacccccgcccccaagccccucgccuccgagcccgccgacgacaccgucaacggcgaguccuccuccuucgcccccaccgacaacgccuccgucaccggcacccccgucgucuccgaggagaacgcccucucccccaacugcaccuccaccaccgucgaggacccccccguccaggagauccucaccuccuccgagaacaacgagugcauccccuccaccuccgccgagcucgaguccgaggcccgcuccauccucgagcccgacaccuccaacucccgcuccuccuccgccuucgaggccgccaagucccgccagcccgacggcugcauggaccccguccgccagcaguccggcaacgccaacaccgagacccuccccuccggcugggagcagcgcaaggacccccacggccgcaccuacuacgucgaccacaacacccgcaccaccaccugggagcgcccccagccccucccccccggcugggagcgccgcgucgacgaccgccgccgcgucuacuacgucgaccacaacacccgcaccaccaccuggcagcgccccaccauggaguccguccgcaacuucgagcaguggcagucccagcgcaaccagcuccagggcgccaugcagcaguucaaccagcgcuaccucuacuccgccuccaugcucgccgccgagaacgaccccuacggcccccucccccccggcugggagaagcgcgucgacuccaccgaccgcgucuacuucgucaaccacaacaccaagaccacccagugggaggacccccgcacccagggccuccagaacgaggagccccuccccgagggcugggagauccgcuacacccgcgagggcguccgcuacuucgucgaccacaacacccgcaccaccaccuucaaggacccccgcaacggcaaguccuccgucaccaagggcggcccccagaucgccuacgagcgcggcuuccgcuggaagcucgcccacuuccgcuaccucugccaguccaacgcccuccccucccacgucaagaucaacgucucccgccagacccucuucgaggacuccuuccagcagaucauggcccucaagcccuacgaccuccgccgccgccucuacgucaucuuccgcggcgaggagggccucgacuacggcggccucgcccgcgagugguucuuccuccucucccacgagguccucaaccccauguacugccucuucgaguacgccggcaagaacaacuacugccuccagaucaaccccgccuccaccaucaaccccgaccaccucuccuacuucugcuucaucggccgcuucaucgccauggcccucuuccacggcaaguucaucgacaccggcuucucccuccccuucuacaagcgcaugcucuccaagaagcucaccaucaaggaccucgaguccaucgacaccgaguucuacaacucccucaucuggauccgcgacaacaacaucgaggagugcggccucgagauguacuucuccgucgacauggagauccucggcaaggucaccucccacgaccucaagcucggcggcuccaacauccucgucaccgaggagaacaaggacgaguacaucggccucaugaccgaguggcgcuucucccgcggcguccaggagcagaccaaggccuuccucgacggcuucaacgaggucgucccccuccaguggcuccaguacuucgacgagaaggagcucgaggucaugcucugcggcaugcaggaggucgaccucgccgacuggcagcgcaacaccgucuaccgccacuacacccgcaacuccaagcagaucaucugguucuggcaguucgucaaggagaccgacaacgagguccgcaugcgccuccuccaguucgucaccggcaccugccgccucccccucggcggcuucgccgagcucaugggcuccaacggcccccagaaguucugcaucgagaaggucggcaaggacaccuggcucccccgcucccacaccugcuucaaccgccucgaccucccccccuacaaguccuacgagcagcucaaggagaagcuccucuucgccaucgaggagaccgagggcuucggccaggaguga

SEQ ID NO: 51823 - RNA, 1008 nt, Artificial Sequence
  derived and/or modified sequence opt2 from WWP2__Homo_sapiens__NP_001257384
auggccuccgccuccuccucccgcgccggcgucgcccuccccuucgagaagucccagcucacccucaaggucgucuccgccaagcccaagguccacaaccgccagccccgcaucaacuccuacgucgaggucgccgucgacggccuccccuccgagaccaagaagaccggcaagcgcaucggcuccuccgagcuccucuggaacgagaucaucauccucaacgucaccgcccagucccaccucgaccucaaggucugguccugccacacccuccgcaacgagcuccucggcaccgccuccgucaaccucuccaacguccucaagaacaacggcggcaagauggagaacaugcagcucacccucaaccuccagaccgagaacaagggcuccgucgucuccggcggcgagcucaccaucuuccucgacggccccaccgucgaccucggcaacguccccaacggcuccgcccucaccgacggcucccagcuccccucccgcgacuccuccggcaccgccgucgcccccgagaaccgccaccagccccccuccaccaacugcuucggcggccgcucccgcacccaccgccacuccggcgccuccgcccgcaccacccccgccaccggcgagcagucccccggcgcccgcucccgccaccgccagcccgucaagaacuccggccacuccggccucgccaacggcaccgucaacgacgagcccaccaccgccaccgaccccgaggagcccuccgucgucggcgucaccuccccccccgccgccccccucuccgucacccccaaccccaacaccaccucccuccccgcccccgccacccccgccgagggcgaggagcccuccaccuccggcacccagcagcuccccgccgccgcccaggcccccgacgcccuccccgccggcugggagcagcgcgagcuccccaacggccgcgucuacuacgucgaccacaacaccaagaccaccaccugggagcgcccccucccccccggcuga

SEQ ID NO: 51824 - RNA, 1203 nt, Artificial Sequence
  derived and/or modified sequence opt2 from WWTR1__Homo_sapiens__NP_001161750
augaaccccgccuccgccccccccccccuccccccccccggccagcaggucauccacgucacccaggaccucgacaccgaccucgaggcccucuucaacuccgucaugaaccccaagcccuccuccuggcgcaagaagauccuccccgaguccuucuucaaggagcccgacuccggcucccacucccgccaguccuccaccgacuccuccggcggccaccccggcccccgccucgccggcggcgcccagcacguccgcucccacuccucccccgccucccuccagcucggcaccggcgccggcgccgccggcucccccgcccagcagcacgcccaccuccgccagcaguccuacgacgucaccgacgagcucccccucccccccggcugggagaugaccuucaccgccaccggccagcgcuacuuccucaaccacaucgagaagaucaccaccuggcaggacccccgcaaggccaugaaccagccccucaaccacaugaaccuccaccccgccgucuccuccacccccgucccccagcgcuccauggccgucucccagcccaaccucgucaugaaccaccagcaccagcagcagauggcccccuccacccucucccagcagaaccaccccacccagaacccccccgccggccucauguccaugcccaacgcccucaccacccagcagcagcagcagcagaagcuccgccuccagcgcauccagauggagcgcgagcgcauccgcaugcgccaggaggagcucaugcgccaggaggccgcccucugccgccagcuccccauggaggccgagacccucgcccccguccaggccgccgucaacccccccaccaugacccccgacaugcgcuccaucaccaacaacuccuccgaccccuuccucaacggcggccccuaccacucccgcgagcaguccaccgacuccggccucggccucggcugcuacuccguccccaccacccccgaggacuuccucuccaacgucgacgagauggacaccggcgagaacgccggccagacccccaugaacaucaacccccagcagacccgcuuccccgacuuccucgacugccuccccggcaccaacgucgaccucggcacccucgaguccgaggaccucaucccccucuucaacgacgucgaguccgcccucaacaaguccgagcccuuccucaccuggcucuga

SEQ ID NO: 51825 - RNA, 2568 nt, Artificial Sequence
  derived and/or modified sequence opt2 from XAB2__Homo_sapiens__NP_064581
auggucgucauggcccgccucucccgccccgagcgccccgaccucgucuucgaggaggaggaccuccccuacgaggaggagaucaugcgcaaccaguucuccgucaagugcuggcuccgcuacaucgaguucaagcagggcgcccccaagccccgccucaaccagcucuacgagcgcgcccucaagcuccuccccugcuccuacaagcucugguaccgcuaccucaaggcccgccgcgcccaggucaagcaccgcugcgucaccgaccccgccuacgaggacgucaacaacugccacgagcgcgccuucgucuucaugcacaagaugccccgccucuggcucgacuacugccaguuccucauggaccagggccgcgucacccacacccgccgcaccuucgaccgcgcccuccgcgcccuccccaucacccagcacucccgcaucuggccccucuaccuccgcuuccuccgcucccacccccuccccgagaccgccguccgcggcuaccgccgcuuccucaagcucucccccgaguccgccgaggaguacaucgaguaccucaaguccuccgaccgccucgacgaggccgcccagcgccucgccaccgucgucaacgacgagcgcuucgucuccaaggccggcaaguccaacuaccagcucuggcacgagcucugcgaccucaucucccagaaccccgacaagguccagucccucaacgucgacgccaucauccgcggcggccucacccgcuucaccgaccagcucggcaagcucuggugcucccucgccgacuacuacauccgcuccggccacuucgagaaggcccgcgacgucuacgaggaggccauccgcaccgucaugaccguccgcgacuucacccaggucuucgacuccuacgcccaguucgaggaguccaugaucgccgccaagauggagaccgccuccgagcucggccgcgaggaggaggacgacgucgaccucgagcuccgccucgcccgcuucgagcagcucaucucccgccgcccccuccuccucaacuccguccuccuccgccagaacccccaccacguccacgaguggcacaagcgcgucgcccuccaccagggccgcccccgcgagaucaucaacaccuacaccgaggccguccagaccgucgaccccuucaaggccaccggcaagccccacacccucugggucgccuucgccaaguucuacgaggacaacggccagcucgacgacgcccgcgucauccucgagaaggccaccaaggucaacuucaagcaggucgacgaccucgccuccgucuggugccagugcggcgagcucgagcuccgccacgagaacuacgacgaggcccuccgccuccuccgcaaggccaccgcccuccccgcccgccgcgccgaguacuucgacggcuccgagcccguccagaaccgcgucuacaagucccucaaggucugguccaugcucgccgaccucgaggagucccucggcaccuuccaguccaccaaggccgucuacgaccgcauccucgaccuccgcaucgccaccccccagaucgucaucaacuacgccauguuccucgaggagcacaaguacuucgaggaguccuucaaggccuacgagcgcggcaucucccucuucaaguggcccaacgucuccgacaucugguccaccuaccucaccaaguucaucgcccgcuacggcggccgcaagcucgagcgcgcccgcgaccucuucgagcaggcccucgacggcugcccccccaaguacgccaagacccucuaccuccucuacgcccagcucgaggaggaguggggccucgcccgccacgccauggccgucuacgagcgcgccacccgcgccgucgagcccgcccagcaguacgacauguucaacaucuacaucaagcgcgccgccgagaucuacggcgucacccacacccgcggcaucuaccagaaggccaucgagguccucuccgacgagcacgcccgcgagaugugccuccgcuucgccgacauggagugcaagcucggcgagaucgaccgcgcccgcgccaucuacuccuucugcucccagaucugcgacccccgcaccaccggcgccuucuggcagaccuggaaggacuucgagguccgccacggcaacgaggacaccaucaaggagaugcuccgcauccgccgcuccguccaggccaccuacaacacccaggucaacuucauggccucccagaugcucaaggucuccggcuccgccaccggcaccgucuccgaccucgcccccggccaguccggcauggacgacaugaagcuccucgagcagcgcgccgagcagcucgccgccgaggccgagcgcgaccagccccuccgcgcccaguccaagauccucuucguccgcuccgacgccucccgcgaggagcucgccgagcucgcccagcaggucaaccccgaggagauccagcucggcgaggacgaggacgaggacgagauggaccucgagcccaacgagguccgccucgagcagcaguccguccccgccgccgucuucggcucccucaaggaggacuga

SEQ ID NO: 51826 - RNA, 906 nt, Artificial Sequence
  derived and/or modified sequence opt2 from XAF1__Homo_sapiens__NP_059993
auggagggcgacuucuccgucugccgcaacugcaagcgccacgucgucuccgccaacuucacccuccacgaggccuacugccuccgcuuccucguccucugccccgagugcgaggagcccguccccaaggagaccauggaggagcacugcaagcucgagcaccagcaggucggcugcaccaugugccagcaguccaugcagaaguccucccucgaguuccacaaggccaacgagugccaggagcgccccgucgagugcaaguucugcaagcucgacaugcagcucuccaagcucgagcuccacgaguccuacugcggcucccgcaccgagcucugccagggcugcggccaguucaucaugcaccgcaugcucgcccagcaccgcgacgucugccgcuccgagcaggcccagcucggcaagggcgagcgcaucuccgcccccgagcgcgagaucuacugccacuacugcaaccagaugauccccgagaacaaguacuuccaccacaugggcaagugcugccccgacuccgaguucaagaagcacuuccccgucggcaaccccgagauccuccccuccucccuccccucccaggccgccgagaaccagaccuccaccauggagaaggacguccgccccaagacccgcuccaucaaccgcuucccccuccacuccgaguccuccuccaagaaggccccccgcuccaagaacaagacccucgacccccuccucauguccgagcccaagccccgcaccuccuccccccgcggcgacaaggccgccuacgacauccuccgccgcugcucccagugcggcauccuccucccccuccccauccucaaccagcaccaggagaagugccgcuggcucgccuccuccaagggcaagcagguccgcaacuucuccuga

SEQ ID NO: 51827 - RNA, 210 nt, Artificial Sequence
  derived and/or modified sequence opt2 from XAGE1B__Homo_sapiens__NP_001091065
auggagucccccaagaagaagaaccagcagcucaaggucggcauccuccaccucggcucccgccagaagaagauccgcauccagcuccgcucccagguccucggccgcgagaugcgcgacauggagggcgaccuccaggagcuccaccaguccaacaccggcgacaaguccggcuucggcuuccgccgccagggcgaggacaacaccuga

SEQ ID NO: 51828 - RNA, 246 nt, Artificial Sequence
  derived and/or modified sequence opt2 from XAGE1E__Homo_sapiens__NP_001091073
auggagucccccaagaagaagaaccagcagcucaaggucggcauccuccaccucggcucccgccagaagaagauccgcauccagcuccgcucccagugcgccaccuggaaggucaucugcaaguccugcaucucccagacccccggcaucaaccucgaccucggcuccggcgucaaggucaagaucauccccaaggaggagcacugcaagaugcccgaggccggcgaggagcagccccaggucuga

SEQ ID NO: 51829 - RNA, 1131 nt, Artificial Sequence
  derived and/or modified sequence opt2 from XBP1__Homo_sapiens__NP_001073007
auggucgucgucgccgccgcccccaaccccgccgacggcacccccaagguccuccuccucuccggccagcccgccuccgccgccggcgcccccgccggccaggcccucccccucaugguccccgcccagcgcggcgccucccccgaggccgccuccggcggccucccccaggcccgcaagcgccagcgccucacccaccucucccccgaggagaaggcccuccgccgcaagcucaagaaccgcgucgccgcccagaccgcccgcgaccgcaagaaggcccgcauguccgagcucgagcagcaggucgucgaccucgaggaggagaaccagaagcuccuccucgagaaccagcuccuccgcgagaagacccacggccucgucgucgagaaccaggagcuccgccagcgccucggcauggacgcccucgucgccgaggaggaggccgaggccaagggcaacgagguccgccccgucgccggcuccgccgaguccgccgccggcgccggccccgucgucaccccccccgagcaccuccccauggacuccggcggcaucgacuccuccgacuccgaguccgacauccuccucggcauccucgacaaccucgaccccgucauguucuucaagugccccucccccgagcccgccucccucgaggagcuccccgaggucuaccccgagggccccuccucccuccccgccucccucucccucuccgucggcaccuccuccgccaagcucgaggccaucaacgagcucauccgcuucgaccacaucuacaccaagccccucguccucgagauccccuccgagaccgagucccaggccaacgucgucgucaagaucgaggaggccccccucucccccuccgagaacgaccaccccgaguucaucgucuccgucaaggaggagcccgucgaggacgaccucguccccgagcucggcaucuccaaccuccucuccuccucccacugccccaagcccuccuccugccuccucgacgccuacuccgacugcggcuacggcggcucccucucccccuucuccgacauguccucccuccucggcgucaaccacuccugggaggacaccuucgccaacgagcucuucccccagcucaucuccgucuga

SEQ ID NO: 51830 - RNA, 345 nt, Artificial Sequence
  derived and/or modified sequence opt2 from XCL1__Homo_sapiens__XP_011508167
augcgccuccucauccucgcccuccucggcaucugcucccucaccgccuacaucgucgagggcgucggcuccgaggucuccgacaagcgcaccugcgucucccucaccacccagcgccuccccgucucccgcaucaagaccuacaccaucaccgagggcucccuccgcgccgucaucuucaucaccaagcgcggccucaaggucugcgccgacccccaggccaccuggguccgcgacgucguccgcuccauggaccgcaaguccaacacccgcaacaacaugauccagaccaagcccaccggcacccagcaguccaccaacaccgccgucacccucaccggcuga

SEQ ID NO: 51831 - RNA, 345 nt, Artificial Sequence
  derived and/or modified sequence opt2 from XCL2__Homo_sapiens__NP_003166
augcgccuccucauccucgcccuccucggcaucugcucccucaccgccuacaucgucgagggcgucggcuccgaggucucccaccgccgcaccugcgucucccucaccacccagcgccuccccgucucccgcaucaagaccuacaccaucaccgagggcucccuccgcgccgucaucuucaucaccaagcgcggccucaaggucugcgccgacccccaggccaccuggguccgcgacgucguccgcuccauggaccgcaaguccaacacccgcaacaacaugauccagaccaagcccaccggcacccagcaguccaccaacaccgccgucacccucaccggcuga

SEQ ID NO: 51832 - RNA, 1002 nt, Artificial Sequence
  derived and/or modified sequence opt2 from XCR1__Homo_sapiens__NP_001019815
auggaguccuccggcaaccccgaguccaccaccuucuucuacuacgaccuccagucccagcccugcgagaaccaggccugggucuucgccacccucgccaccaccguccucuacugccucgucuuccuccucucccucgucggcaacucccucguccucuggguccucgucaaguacgagucccucgagucccucaccaacaucuucauccucaaccucugccucuccgaccucgucuucgccugccuccuccccgucuggaucucccccuaccacuggggcuggguccucggcgacuuccucugcaagcuccucaacaugaucuucuccaucucccucuacuccuccaucuucuuccucaccaucaugaccauccaccgcuaccucuccgucgucuccccccucuccacccuccgcguccccacccuccgcugccgcguccucgucaccauggccgucugggucgccuccauccucuccuccauccucgacaccaucuuccacaagguccucuccuccggcugcgacuacuccgagcucaccugguaccucaccuccgucuaccagcacaaccucuucuuccuccucucccucggcaucauccucuucugcuacgucgagauccuccgcacccucuuccgcucccgcuccaagcgccgccaccgcaccgucaagcucaucuucgccaucgucgucgccuacuuccucuccuggggccccuacaacuucacccucuuccuccagacccucuuccgcacccagaucauccgcuccugcgaggccaagcagcagcucgaguacgcccuccucaucugccgcaaccucgccuucucccacugcugcuucaaccccguccucuacgucuucgucggcgucaaguuccgcacccaccucaagcacguccuccgccaguucugguucugccgccuccaggcccccucccccgccuccaucccccacucccccggcgccuucgccuacgagggcgccuccuucuacuga

SEQ ID NO: 51833 - RNA, 4002 nt, Artificial Sequence
  derived and/or modified sequence opt2 from XDH__Homo_sapiens__NP_000370
augaccgccgacaagcucgucuucuucgucaacggccgcaaggucgucgagaagaacgccgaccccgagaccacccuccucgccuaccuccgccgcaagcucggccucuccggcaccaagcucggcugcggcgagggcggcugcggcgccugcaccgucaugcucuccaaguacgaccgccuccagaacaagaucguccacuucuccgccaacgccugccucgcccccaucugcucccuccaccacgucgccgucaccaccgucgagggcaucggcuccaccaagacccgccuccaccccguccaggagcgcaucgccaagucccacggcucccagugcggcuucugcacccccggcaucgucauguccauguacacccuccuccgcaaccagcccgagcccaccauggaggagaucgagaacgccuuccagggcaaccucugccgcugcaccggcuaccgccccauccuccagggcuuccgcaccuucgcccgcgacggcggcugcugcggcggcgacggcaacaaccccaacugcugcaugaaccagaagaaggaccacuccgucucccucucccccucccucuucaagcccgaggaguucaccccccucgaccccacccaggagcccaucuucccccccgagcuccuccgccucaaggacaccccccgcaagcagcuccgcuucgagggcgagcgcgucaccuggauccaggccuccacccucaaggagcuccucgaccucaaggcccagcaccccgacgccaagcucgucgucggcaacaccgagaucggcaucgagaugaaguucaagaacaugcucuuccccaugaucgucugccccgccuggauccccgagcucaacuccgucgagcacggccccgacggcaucuccuucggcgccgccugcccccucuccaucgucgagaagacccucgucgacgccgucgccaagcuccccgcccagaagaccgaggucuuccgcggcguccucgagcagcuccgcugguucgccggcaagcaggucaaguccgucgccuccgucggcggcaacaucaucaccgccucccccaucuccgaccucaaccccgucuucauggccuccggcgccaagcucacccucgucucccgcggcacccgccgcaccguccagauggaccacaccuucuuccccggcuaccgcaagacccuccucucccccgaggagauccuccucuccaucgagauccccuacucccgcgagggcgaguacuucuccgccuucaagcaggccucccgccgcgaggacgacaucgccaaggucaccuccggcaugcgcguccucuucaagcccggcaccaccgagguccaggagcucgcccucugcuacggcggcauggccaaccgcaccaucuccgcccucaagaccacccagcgccagcucuccaagcucuggaaggaggagcuccuccaggacgucugcgccggccucgccgaggagcuccaccucccccccgacgcccccggcggcauggucgacuuccgcugcacccucacccucuccuucuucuucaaguucuaccucaccguccuccagaagcucggccaggagaaccucgaggacaagugcggcaagcucgaccccaccuucgccuccgccacccuccucuuccagaaggacccccccgccgacguccagcucuuccaggagguccccaagggccaguccgaggaggacauggucggccgcccccucccccaccucgccgccgacaugcaggccuccggcgaggccgucuacugcgacgacaucccccgcuacgagaacgagcucucccuccgccucgucaccuccacccgcgcccacgccaagaucaaguccaucgacaccuccgaggccaagaagguccccggcuucgucugcuucaucuccgccgacgacguccccggcuccaacaucaccggcaucugcaacgacgagaccgucuucgccaaggacaaggucaccugcgucggccacaucaucggcgccgucgucgccgacacccccgagcacacccagcgcgccgcccagggcgucaagaucaccuacgaggagcuccccgccaucaucaccaucgaggacgccaucaagaacaacuccuucuacggccccgagcucaagaucgagaagggcgaccucaagaagggcuucuccgaggccgacaacgucgucuccggcgagaucuacaucggcggccaggagcacuucuaccucgagacccacugcaccaucgccguccccaagggcgaggccggcgagauggagcucuucgucuccacccagaacaccaugaagacccaguccuucgucgccaagaugcucggcguccccgccaaccgcaucgucguccgcgucaagcgcaugggcggcggcuucggcggcaaggagacccgcuccaccgucgucuccaccgccgucgcccucgccgccuacaagaccggccgccccguccgcugcaugcucgaccgcgacgaggacaugcucaucaccggcggccgccaccccuuccucgcccgcuacaaggucggcuucaugaagaccggcaccgucgucgcccucgaggucgaccacuucuccaacgucggcaacacccaggaccucucccaguccaucauggagcgcgcccucuuccacauggacaacugcuacaagauccccaacauccgcggcaccggccgccucugcaagaccaaccuccccuccaacaccgccuuccgcggcuucggcggcccccagggcaugcucaucgccgagugcuggauguccgaggucgccgucaccugcggcaugcccgccgaggagguccgccgcaagaaccucuacaaggagggcgaccucacccacuucaaccagaagcucgagggcuucacccucccccgcugcugggaggagugccucgccuccucccaguaccacgcccgcaaguccgaggucgacaaguucaacaaggagaacugcuggaagaagcgcggccucugcaucauccccaccaaguucggcaucuccuucaccguccccuuccucaaccaggccggcgcccuccuccacgucuacaccgacggcuccguccuccucacccacggcggcaccgagaugggccagggccuccacaccaagaugguccaggucgccucccgcgcccucaagauccccaccuccaagaucuacaucuccgagaccuccaccaacaccguccccaacaccucccccaccgccgccuccgucuccgccgaccucaacggccaggccgucuacgccgccugccagaccauccucaagcgccucgagcccuacaagaagaagaaccccuccggcuccugggaggacugggucaccgccgccuacauggacaccgucucccucuccgccaccggcuucuaccgcacccccaaccucggcuacuccuucgagaccaacuccggcaaccccuuccacuacuucuccuacggcgucgccugcuccgaggucgagaucgacugccucaccggcgaccacaagaaccuccgcaccgacaucgucauggacgucggcuccucccucaaccccgccaucgacaucggccaggucgagggcgccuucguccagggccucggccucuucacccucgaggagcuccacuacucccccgagggcucccuccacacccgcggccccuccaccuacaagauccccgccuucggcuccauccccaucgaguuccgcgucucccuccuccgcgacugccccaacaagaaggccaucuacgccuccaaggccgucggcgagcccccccucuuccucgccgccuccaucuucuucgccaucaaggacgccauccgcgccgcccgcgcccagcacaccggcaacaacgucaaggagcucuuccgccucgacucccccgccacccccgagaagauccgcaacgccugcgucgacaaguucaccacccucugcgucaccggcguccccgagaacugcaagcccugguccguccgcgucuga

SEQ ID NO: 51834 - RNA, 588 nt, Artificial Sequence
  derived and/or modified sequence opt2 from XG__Homo_sapiens__NP_001135391
auggaguccugguggggccuccccugccucgccuuccucugcuuccucaugcacgcccgcggccagcgcgacuucgaccucgccgacgcccucgacgaccccgagcccaccaagaagcccaacuccgacaucuaccccaagcccaagccccccuacuacccccagcccgagaaccccgacuccggcggcaacaucuacccccgccccaagccccgcccccagccccagcccggcaacuccggcaacuccggcggcuacuucaacgacgucgaccgcgacgacggccgcuaccccccccgcccccgcccccgcccccccgccggcggcggcggcggcggcuacuccuccuacggcaacuccgacaacacccacggccgcggcggcuaccgccucaacucccgcuacggcaacaccuacggcggcgaccaccacuccaccuacggcaaccccgagggcaacauggucgccaagaucgucucccccaucgucuccgucgucgucgucacccuccucggcgccgccgccuccuacuucaagcucaacaaccgccgcaacugcuuccgcacccacgagcccgagaacgucuga

SEQ ID NO: 51835 - RNA, 1494 nt, Artificial Sequence
  derived and/or modified sequence opt2 from XIAP__Homo_sapiens__XP_011529631
augaccuucaacuccuucgagggcuccaagaccugcguccccgccgacaucaacaaggaggaggaguucgucgaggaguucaaccgccucaagaccuucgccaacuuccccuccggcucccccgucuccgccuccacccucgcccgcgccggcuuccucuacaccggcgagggcgacaccguccgcugcuucuccugccacgccgccgucgaccgcuggcaguacggcgacuccgccgucggccgccaccgcaaggucucccccaacugccgcuucaucaacggcuucuaccucgagaacuccgccacccaguccaccaacuccggcauccagaacggccaguacaaggucgagaacuaccucggcucccgcgaccacuucgcccucgaccgccccuccgagacccacgccgacuaccuccuccgcaccggccaggucgucgacaucuccgacaccaucuacccccgcaaccccgccauguacuccgaggaggcccgccucaaguccuuccagaacuggcccgacuacgcccaccucaccccccgcgagcucgccuccgccggccucuacuacaccggcaucggcgaccagguccagugcuucugcugcggcggcaagcucaagaacugggagcccugcgaccgcgccugguccgagcaccgccgccacuuccccaacugcuucuucguccucggccgcaaccucaacauccgcuccgaguccgacgccgucuccuccgaccgcaacuuccccaacuccaccaaccucccccgcaaccccuccauggccgacuacgaggcccgcaucuucaccuucggcaccuggaucuacuccgucaacaaggagcagcucgcccgcgccggcuucuacgcccucggcgagggcgacaaggucaagugcuuccacugcggcggcggccucaccgacuggaagcccuccgaggaccccugggagcagcacgccaagugguaccccggcugcaaguaccuccucgagcagaagggccaggaguacaucaacaacauccaccucacccacucccucgaggagugccucguccgcaccaccgagaagacccccucccucacccgccgcaucgacgacaccaucuuccagaaccccaugguccaggaggccauccgcaugggcuucuccuucaaggacaucaagaagaucauggaggagaagauccagaucuccggcuccaacuacaagucccucgagguccucgucgccgaccucgucaacgcccagaaggacuccaugcaggacgaguccucccagaccucccuccagaaggagaucuccaccgaggagcagcuccgccgccuccaggaggagaagcucugcaagaucugcauggaccgcaacaucgccaucgucuucguccccugcggccaccucgucaccugcaagcagugcgccgaggccgucgacaagugccccaugugcuacaccgucaucaccuucaagcagaagaucuucauguccuga

SEQ ID NO: 51836 - RNA, 3366 nt, Artificial Sequence
  derived and/or modified sequence opt2 from XIRP1__Homo_sapiens__NP_001185550
auggccgacacccagacccaggucgcccccacccccaccaugcgcauggccaccgccgaggaccucccccucccccccccccccgcccucgaggaccucccccuccccccccccaaggaguccuucuccaaguuccaccagcagcgccaggccuccgagcuccgccgccucuaccgccacauccaccccgagcuccgcaagaaccucgccgaggccgucgccgaggaccucgccgagguccucggcuccgaggagcccaccgagggcgacguccagugcaugcgcuggaucuucgagaacuggcgccucgacgccaucggcgagcacgagcgccccgccgccaaggagcccguccucugcggcgacguccaggccaccucccgcaaguucgaggagggcuccuucgccaacuccaccgaccaggagcccacccgcccccagcccggcggcggcgacguccgcgccgcccgcuggcucuucgagaccaagccccucgacgagcucaccggccaggccaaggagcucgaggccaccguccgcgagcccgccgccuccggcgacguccagggcacccgcaugcucuucgagacccgcccccucgaccgccucggcucccgccccucccuccaggagcaguccccccucgagcuccgcuccgagauccaggagcucaagggcgacgucaagaagaccgucaagcucuuccagaccgagccccucugcgccauccaggacgccgagggcgccauccacgaggucaaggccgccugccgcgaggagauccaguccaacgccguccgcuccgcccgcuggcucuucgagacccgcccccucgacgccaucaaccaggaccccucccagguccgcgucauccgcggcaucucccucgaggagggcgcccgccccgacgucuccgccacccgcuggaucuucgagacccagccccucgacgccauccgcgagauccucgucgacgagaaggacuuccagcccucccccgaccucaucccccccggccccgacguccagcagcagcagcaccucuucgagacccgcgcccucgacacccucaagggcgacgaggaggccggcgccgaggccccccccaaggaggaggucguccccggcgacguccgcuccacccucuggcucuucgagaccaagccccucgacgccuuccgcgacaagguccaggucggccaccuccagcgcgucgacccccaggacggcgagggccaccucuccuccgacuccuccuccgcccuccccuucucccaguccgccccccagcgcgacgagcucaagggcgacgucaagaccuucaagaaccucuucgagacccucccccucgacuccaucggccagggcgagguccucgcccacggcucccccucccgcgaggagggcaccgacuccgccggccaggcccagggcaucggcucccccgucuacgccaugcaggacuccaagggccgccuccacgcccucaccuccgucucccgcgagcagaucgucggcggcgacguccagggcuaccgcuggauguucgagacccagccccucgaccagcucggccgcucccccuccaccaucgacgucguccgcggcaucacccgccaggaggucgucgccggcgacgucggcaccgcccgcuggcucuucgagacccagccccucgagaugauccaccagcgcgagcagcaggagcgccagaaggaggagggcaagucccagggcgacccccagcccgaggccccccccaagggcgacguccagaccauccgcuggcucuucgagaccugccccauguccgagcucgccgagaagcagggcuccgaggucaccgaccccaccgccaaggccgaggcccaguccugcaccuggauguucaagccccagcccgucgaccgccccgucggcucccgcgagcagcaccuccaggucucccagguccccgccggcgagcgccagaccgaccgccacgucuucgagaccgagccccuccaggccuccggccgccccugcggccgccgccccguccgcuacugcucccgcgucgagauccccuccggccaggucucccgccagaaggaggucuuccaggcccucgaggccggcaagaaggaggagcaggagccccgcgucaucgccggcuccauccccgccggcuccguccacaaguucaccuggcucuucgagaacugccccaugggcucccucgccgccgaguccauccagggcggcaaccuccucgaggagcagcccaugucccccuccggcaaccgcaugcaggagucccaggagaccgccgccgagggcacccuccgcacccuccacgccacccccggcauccuccaccacggcggcauccucauggaggcccgcggccccggcgagcucugccucgccaaguacguccucuccggcaccggccagggccaccccuacauccgcaaggaggagcucgucuccggcgagcucccccgcaucaucugccagguccuccgccgccccgacgucgaccagcagggccuccucguccaggaggaccccaccggccagcuccagcucaagccccuccgccuccccacccccggcuccuccggcaacaucgaggacauggaccccgagcuccagcagcuccucgccugcggccucggcaccuccgucgcccgcaccggccucgucaugcaggagaccgagcagggccucgucgcccucaccgccuacucccuccagccccgccucaccuccaaggccuccgagcgcuccuccguccagcuccucgccuccugcaucgacaagggcgaccucuccggccuccacucccuccgcugggagccccccgccgaccccucccccguccccgccuccgagggcgcccagucccuccaccccaccgaguccaucauccacguccccccccucgaccccuccaugggcaugggccaccuccgcgccuccggcgccacccccugccccccccaggccaucggcaaggccgucccccucgccggcgaggccgccgcccccgcccagcuccagaacaccgagaagcaggaggacucccacuccggccagaagggcauggccguccucggcaaguccgagggcgccaccaccaccccccccggccccggcgcccccgaccuccucgccgccaugcagucccuccgcauggccaccgccgaggcccagucccuccaccagcagguccucaacaagcacaagcagggccccacccccaccgccaccuccaaccccauccaggacggccuccgcaaggccggcgccacccaguccaacauccgccccggcggcggcuccgacccccgcauccccgccgccccccgcaagcuccucuga

SEQ ID NO: 51837 - RNA, 2817 nt, Artificial Sequence
  derived and/or modified sequence opt2 from XIRP2__Homo_sapiens__NP_001073278
auguuccccaugcagaagggcucccucaaccuccuccgccagaagugggaguccugcgacuaccagcgcuccgagugccacccccgcgacucccacugcaccaucuuccagccccaggaguccaagcuccucgcccccgagggcgaggucgucuccgccccccagucccucgaccccaccucccuccccuacuccaccggcgaggagaugugguccuccaagcccgaggagaaggacuccgucgacaaguccaacaacacccgcgaguacggccgccccgagguccucaaggaggacucccucuccucccgccgccgcaucgagcgcuucuccaucgcccucgacgagcuccgcuccgucuucgaggcccccaaguccggcaacaagcccgccgaguacggcggcaaggaggucgagaucgagcgcucccucugcucccccgccuucaagucccaccccggcucccagcucgaggacuccgucaaggacuccgacaagaagggcaaggagaccuccuucgacaagaugucccccgaguccggccacucccgcaucuucgaggccaccgccggccccaacaagcccgaguccggcuucgccgaggacuccgccgcccgcggcgagggcgucuccgaccuccacgaggucgucucccucaaggagcgcauggcccgcuaccaggccgccgucucccgcggcgacugccgcuccuucuccgccaacaugauggaggaguccgagaugugcgccguccccggcggccucgccaaggucaagaagcaguucgaggacgagaucaccuccucccgcaacaccuucgcccaguaccaguaccagcaccagaaccgcuccgagcaggaggccauccacuccucccaggucggcaccucccgcuccucccaggagauggcccgcaacgagcaggagggcuccaagguccagaagaucgacguccacggcaccgagauggucucccaccucgagaagcacaccgaggaggucaaccaggccucccaguuccaccaguacguccaggagaccgucaucgacacccccgaggacgaggagauccccaaggucuccaccaagcuccucaaggagcaguucgagaaguccgcccaggagaagauccucuacuccgacaaggagaugaccacccccgccaagcagaucaagaagcuccuccuccaggacaaggagaucugcauccucugccagaagaccgucuaccccauggagugccucgucgccgacaagcagaacuuccacaaguccugcuuccgcugccaccacugcaacuccaagcucucccucggcaacuacgccucccuccacggccagaucuacugcaagccccacuucaagcagcucuucaaguccaagggcaacuacgacgagggcuucggccacaagcagcacaaggaccgcuggaacugcaagaaccagucccgcuccgucgacuucauccccaacgaggagcccaacaugugcaagaacaucgccgagaacacccucguccccggcgaccgcaacgagcaccucgacgccggcaacuccgagggccagcgcaacgaccuccgcaagcucggcgagcgcggcaagcucaaggucaucuggccccccuccaaggagauccccaagaagacccuccccuucgaggaggagcucaagauguccaagcccaaguggccccccgagaugaccacccuccucucccccgaguucaaguccgagucccuccucgaggacguccgcacccccgagaacaagggccagcgccaggaccacuuccccuuccuccagcccuaccuccaguccacccacgucugccagaaggaggacgucaucggcaucaaggagaugaagaugcccgagggccgcaaggacgagaagaaggagggccgcaagaacguccaggaccgccccuccgaggccgaggacaccaaguccaaccgcaaguccgccauggaccucaacgacaacaacaacgucaucguccaguccgccgagaaggagaagaacgagaagaccaaccagaccaacggcgccgagguccuccaggucaccaacaccgacgacgagaugaugcccgagaaccacaaggagaaccucaacaagaacaacaacaacaacuacgucgccgucuccuaccucaacaacugccgccagaagaccuccauccucgaguuccucgaccuccucccccucuccuccgaggccaacgacaccgccaacgaguacgagaucgagaagcucgagaacaccucccgcaucuccgagcuccucggcaucuucgaguccgagaagaccuacucccgcaacguccucgccauggcccucaagaagcagaccgaccgcgccgccgccggcucccccguccagcccgcccccaagcccucccucucccgcggccucauggucaagggcggcuccuccaucaucucccccgacaccaaccuccucaacaucaagggcucccacuccaaguccaagaaccuccacuucuucuucuccaacaccgucaagaucaccgccuucuccaagaagaacgagaacaucuucaacugcgaccucaucgacuccgucgaccagaucaagaacaugcccugccucgaccuccgcgaguucggcaaggacgucaagcccuggcacgucgagaccaccgaggccgcccgcaacaacgagaacaccggcuucgacgcccucucccacgagugcaccgccaagccccucuucccccgcgucgagguccaguccgagcagcucaccgucgaggagcagaucaagcgcaaccgcugcuacuccgacaccgaguga

SEQ ID NO: 51838 - RNA, 1335 nt, Artificial Sequence
  derived and/or modified sequence opt2 from XK__Homo_sapiens__NP_066569
augaaguuccccgccuccguccucgccuccgucuuccucuucgucgccgagaccaccgccgcccucucccucuccuccaccuaccgcuccggcggcgaccgcauguggcaggcccucacccuccucuucucccuccuccccugcgcccucguccagcucacccuccucuucguccaccgcgaccucucccgcgaccgcccccucguccuccuccuccaccuccuccagcucggcccccucuuccgcugcuucgaggucuucugcaucuacuuccaguccggcaacaacgaggagcccuacgucuccaucaccaagaagcgccagaugcccaagaacggccucuccgaggagaucgagaaggaggucggccaggccgagggcaagcucaucacccaccgcuccgccuucucccgcgccuccgucauccaggccuuccucggcuccgccccccagcucacccuccagcucuacaucuccgucaugcagcaggacgucaccgucggccgcucccuccucaugaccaucucccuccucuccaucgucuacggcgcccuccgcugcaacauccucgccaucaagaucaaguacgacgaguacgaggucaaggucaagccccucgccuacgucugcaucuuccucuggcgcuccuucgagaucgccacccgcgucgucguccucguccucuucaccuccguccucaagaccugggucgucgucaucauccucaucaacuucuucuccuucuuccucuaccccuggauccucuucuggugcuccggcucccccuuccccgagaacaucgagaaggcccucucccgcgucggcaccaccaucguccucugcuuccucacccuccucuacaccggcaucaacauguucugcugguccgccguccagcucaagaucgacucccccgaccucaucuccaagucccacaacugguaccagcuccucgucuacuacaugauccgcuucaucgagaacgccauccuccuccuccucugguaccucuucaagaccgacaucuacauguacgucugcgccccccuccucguccuccagcuccucaucggcuacugcaccgccauccucuucaugcucgucuucuaccaguucuuccaccccugcaagaagcucuucuccuccuccgucuccgagggcuuccagcgcuggcuccgcugcuucugcugggccugccgccagcagaagcccugcgagcccaucggcaaggaggaccuccaguccucccgcgaccgcgacgagacccccuccuccuccaagaccucccccgagcccggccaguuccucaacgccgaggaccucugcuccgccuga

SEQ ID NO: 51839 - RNA, 1953 nt, Artificial Sequence
  derived and/or modified sequence opt2 from XKR4__Homo_sapiens__NP_443130
auggccgccaaguccgacggccgccucaagaugaagaaguccuccgacgucgccuucaccccccuccagaacuccgaccacuccggcuccguccagggccucgcccccggccuccccuccggcuccggcgccgaggacgaggaggccgccggcggcggcugcugccccgacggcggcggcugcucccgcugcugcugcugcugcgccggcuccggcggcuccgccggcuccggcggcuccggcggcgucgccggccccggcggcggcggcgccggcuccgccgcccucugccuccgccucggccgcgagcagcgccgcuacucccucugggacugccucuggauccucgccgccgucgccgucuacuucgccgacgucggcaccgacgucuggcucgccgucgacuacuaccuccgcggccagcgcuggugguucggccucacccucuucuucgucguccucggcucccucuccguccaggucuucuccuuccgcugguucguccacgacuucuccaccgaggacuccgccaccgccgccgccgccuccuccugcccccagcccggcgccgacugcaagaccgucgucggcggcggcuccgccgccggcgagggcgaggcccgccccuccaccccccagcgccaggccuccaacgccuccaaguccaacaucgccgccgccaacuccggcuccaacuccuccggcgccacccgcgccuccggcaagcaccgcuccgccuccugcuccuucugcaucuggcuccuccagucccucauccacauccuccagcucggccagaucuggcgcuacuuccacaccaucuaccucggcauccgcucccgccaguccggcgagaacgaccgcuggcgcuucuacuggaagauggucuacgaguacgccgacgucuccaugcuccaccuccucgccaccuuccucgaguccgccccccagcucguccuccagcucugcaucaucguccagacccacucccuccaggcccuccagggcuucaccgccgccgccucccucgucucccucgccugggcccucgccuccuaccagaaggcccuccgcgacucccgcgacgacaagaagcccaucuccuacauggccgucaucauccaguucugcuggcacuucuucaccaucgccgcccgcgucaucaccuucgcccucuucgccuccgucuuccagcucuacuucggcaucuucaucguccuccacuggugcaucaugaccuucuggaucguccacugcgagaccgaguucugcaucaccaagugggaggagaucgucuucgacauggucgucggcaucaucuacaucuucuccugguucaacgucaaggagggccgcacccgcugccgccucuucaucuacuacuucgucauccuccucgagaacaccgcccucuccgcccucugguaccucuacaaggccccccagaucgccgacgccuucgccauccccgcccucugcgucgucuucuccuccuuccucaccggcgucgucuucaugcucauguacuacgccuucuuccaccccaacggcccccgcuucggccagucccccuccugcgccugcgaggaccccgccgccgccuucacccucccccccgacgucgccaccuccacccuccgcuccaucuccaacaaccgcuccgucgucuccgaccgcgaccagaaguucgccgagcgcgacggcugcguccccgucuuccagguccgccccaccgcccccuccacccccuccucccgccccccccgcaucgaggaguccgucaucaagaucgaccucuuccgcaaccgcuaccccgccugggagcgccacguccucgaccgcucccuccgcaaggccauccucgccuucgagugcucccccucccccccccgccuccaguacaaggacgacgcccucauccaggagcgccucgaguacgagaccacccucuga

SEQ ID NO: 51840 - RNA, 1926 nt, Artificial Sequence
  derived and/or modified sequence opt2 from XKR6__Homo_sapiens__NP_775954
auggccgccaaguccgacggcggcggcgucggcgucggcuucgcccagcuccacaaccucgacgaggccgucggcuccggcggcgaggaggacggcgagcccggcggcggcggcugcggcggcggcggcgacggcuccgagcccggcgaguccuccuccaugcacaucugccacugcugcaacaccuccuccugcuacuggggcugccgcuccgccugccuccgcucccuccucggccgcaagccccgccgcuccgccgccgccgacggcggcgaccagccccuccagccccccgccgcccccggcgccggccgccagccccccacccccuccgccgcccgccccgagcccccccccccccaggucgagcgccccuggcucgacugccucuggaucguccucgcccuccucgucuucuucggcgacgucggcaccgaccucuggcucgcccucgacuacuaccgcaagggcgacuacgucuacuucggccucacccucuucuucguccucguccccucccuccucguccagucccucuccuuccgcugguucguccaggacuacaccggcggcggccucggcgccgucgagggccucaccucccgcggcccccccaugaugggcgccggcuacguccacggcgccgcccgcggcggccccggcguccgcgucucccccacccccggcgcccagcgccucugccgccucuccgucuggaucuggcaguccgucauccaccuccuccagaugggccaggucuggcgcuacauccgcaccauguaccucggcauccagucccagcgccgcaaggagcaccagcgccgcuucuacugggccaugauguacgaguacgccgacgucaacaugcuccgccuccucgagaccuuccucgaguccgccccccagcucguccuccagcucuacaucaugcuccagaagaacuccgccgagacccuccccugcgucuccuccgucaccucccucaugucccucgccuggguccucgccuccuaccacaagcuccuccgcgacucccgcgacgacaagaaguccauguccuaccgcggcgccaucauccaggucuucuggcgccucuucaccaucuccucccgcgucaucuccuucgcccucuucgccuccaucuuccagcucuacuucggcaucuucgucgucguccacuggugcgccauggccuucuggaucauccacggcggcaccgacuucugcauguccaagugggaggagauccucuucaacauggucgucggcaucgucuacaucuucugcugguucaacgucaaggagggccgcacccgcuaccgcauguucgccuacuacaccaucguccucaccgagaacgccgcccucaccuuccucugguacuucuaccgcgaccccgagaccaccgacuccuacgccguccccgcccucugcugcgucuucaucuccuucgucgccggcaucgccaugaugcuccucuacuacggcguccuccaccccaccggcccccgcgccaagauccucgccuccuccugcugcgccgagcuccucuggggcaucccccucccccccgacgucgagcccauggcccccgagauccccggcuaccgcggcacccaggucacccccacccgcgccgucaccgagcagcaggaggaccucaccgccgacaccugccuccccgucuuccagguccgccccaugggcccccccaccccccucggccgccccuaccuccccgagggcccccucaucaagaucgacaugccccgcaagcgcuaccccgccugggacgcccacuucgucgaccgccgccuccgccgcaccaucaacauccuccaguacgucacccccaccgccgucggcauccgcuaccgcgacggcccccuccucuacgagcuccuccaguacgaguccucccucuga

SEQ ID NO: 51841 - RNA, 1122 nt, Artificial Sequence
  derived and/or modified sequence opt2 from XKR9__Homo_sapiens__NP_001274188
augaaguacaccaagcagaacuucaugauguccguccucggcaucaucaucuacgucaccgaccucaucgucgacaucugggucuccguccgcuucuuccacgagggccaguacgucuucuccgcccucgcccucuccuucaugcucuucggcacccucgucgcccagugcuucuccuacuccugguucaaggccgaccucaagaaggccggccaggagucccagcacugcuuccuccuccuccacugccuccagggcggcgucuucacccgcuacugguucgcccucaagcgcggcuaccacgccgccuucaaguacgacuccaacaccuccaacuucgucgaggagcagaucgaccuccacaaggaggucaucgaccgcgucaccgaccucuccaugcuccgccucuucgagaccuaccucgagggcugcccccagcucauccuccagcucuacauccuccucgagcacggccaggccaacuucucccaguacgccgccaucauggucuccugcugcgccaucuccugguccaccgucgacuaccaggucgcccuccgcaagucccuccccgacaagaagcuccucaacggccucugccccaagaucaccuaccucuucuacaagcucuucacccuccucuccuggaugcucuccgucguccuccuccucuuccucaacgucaagaucgcccucuuccuccuccucuuccucuggcuccucggcaucaucugggccuucaagaacaacacccaguucugcaccugcaucuccauggaguuccucuaccgcaucgucgucggcuucauccucaucuucaccuucuucaacaucaagggccagaacaccaagugccccauguccugcuacuacaucguccgcguccucggcacccucggcauccucaccgucuucugggucugcccccucaccaucuucaaccccgacuacuucauccccaucuccaucaccaucguccucacccuccuccucggcauccucuuccucaucgucuacuacggcuccuuccaccccaaccgcuccgccgagaccaagugcgacgagaucgacggcaagcccguccuccgcgagugccgcaugcgcuacuuccucauggaguga

SEQ ID NO: 51842 - RNA, 822 nt, Artificial Sequence
  derived and/or modified sequence opt2 from XPA__Homo_sapiens__NP_000371
auggccgccgccgacggcgcccuccccgaggccgccgcccucgagcagcccgccgagcuccccgccuccguccgcgccuccaucgagcgcaagcgccagcgcgcccucaugcuccgccaggcccgccucgccgcccgccccuacuccgccaccgccgccgccgccaccggcggcauggccaacgucaaggccgcccccaagaucaucgacaccggcggcggcuucauccucgaggaggaggaggaggaggagcagaagaucggcaaggucguccaccagcccggccccgucauggaguucgacuacgucaucugcgaggagugcggcaaggaguucauggacuccuaccucaugaaccacuucgaccuccccaccugcgacaacugccgcgacgccgacgacaagcacaagcucaucaccaagaccgaggccaagcaggaguaccuccucaaggacugcgaccucgagaagcgcgagcccccccucaaguucaucgucaagaagaacccccaccacucccaguggggcgacaugaagcucuaccucaagcuccagaucgucaagcgcucccucgaggucuggggcucccaggaggcccucgaggaggccaaggagguccgccaggagaaccgcgagaagaugaagcagaagaaguucgacaagaaggucaaggagcuccgccgcgccguccgcuccuccgucuggaagcgcgagaccaucguccaccagcacgaguacggccccgaggagaaccucgaggacgacauguaccgcaagaccugcaccaugugcggccacgagcucaccuacgagaagauguga

SEQ ID NO: 51843 - RNA, 2823 nt, Artificial Sequence
  derived and/or modified sequence opt2 from XPC__Homo_sapiens__NP_004619
auggcccgcaagcgcgccgccggcggcgagccccgcggccgcgagcuccgcucccagaaguccaaggccaaguccaaggcccgccgcgaggaggaggaggaggacgccuucgaggacgagaagccccccaagaagucccuccucuccaaggucucccagggcaagcgcaagcgcggcugcucccaccccggcggcuccgccgacggccccgccaagaagaaggucgccaaggucaccgucaaguccgagaaccucaaggucaucaaggacgaggcccucuccgacggcgacgaccuccgcgacuuccccuccgaccucaagaaggcccaccaccucaagcgcggcgccaccaugaacgaggacuccaacgaggaggaggaggaguccgagaacgacugggaggaggucgaggagcucuccgagcccguccucggcgacguccgcgaguccaccgccuucucccgcucccuccuccccgucaagcccgucgagaucgagaucgagacccccgagcaggccaagacccgcgagcgcuccgagaagaucaagcucgaguucgagaccuaccuccgccgcgccaugaagcgcuucaacaagggcguccacgaggacacccacaagguccaccuccucugccuccucgccaacggcuucuaccgcaacaacaucugcucccagcccgaccuccacgccaucggccucuccaucauccccgcccgcuucacccgcguccucccccgcgacgucgacaccuacuaccucuccaaccucgucaagugguucaucggcaccuucaccgucaacgccgagcucuccgccuccgagcaggacaaccuccagaccacccucgagcgccgcuucgccaucuacuccgcccgcgacgacgaggagcucguccacaucuuccuccucauccuccgcgcccuccagcuccucacccgccucguccucucccuccagcccaucccccucaaguccgccaccgccaagggcaagaagcccuccaaggagcgccucaccgccgaccccggcggcuccuccgagaccuccucccagguccucgagaaccacaccaagcccaagaccuccaagggcaccaagcaggaggagaccuucgccaagggcaccugccgccccuccgccaagggcaagcgcaacaagggcggccgcaagaagcgcuccaagcccuccuccuccgaggaggacgagggccccggcgacaagcaggagaaggccacccagcgccgcccccacggccgcgagcgccgcgucgccucccgcgucuccuacaaggaggaguccggcuccgacgaggccggcuccggcuccgacuucgagcucuccuccggcgaggccuccgaccccuccgacgaggacuccgagcccggcccccccaagcagcgcaaggcccccgccccccagcgcaccaaggccggcuccaaguccgccucccgcacccaccgcggcucccaccgcaaggaccccucccuccccgccgccuccuccuccuccuccuccuccaagcgcggcaagaagaugugcuccgacggcgagaaggccgagaagcgcuccaucgccggcaucgaccaguggcucgaggucuucugcgagcaggaggagaagugggucugcgucgacugcguccacggcgucgucggccagccccucaccugcuacaaguacgccaccaagcccaugaccuacgucgucggcaucgacuccgacggcuggguccgcgacgucacccagcgcuacgaccccgucuggaugaccgucacccgcaagugccgcgucgacgccgaguggugggccgagacccuccgccccuaccagucccccuucauggaccgcgagaagaaggaggaccucgaguuccaggccaagcacauggaccagccccuccccaccgccaucggccucuacaagaaccacccccucuacgcccucaagcgccaccuccucaaguacgaggccaucuaccccgagaccgccgccauccucggcuacugccgcggcgaggccgucuacucccgcgacugcguccacacccuccacucccgcgacaccuggcucaagaaggcccgcgucguccgccucggcgagguccccuacaagauggucaagggcuucuccaaccgcgcccgcaaggcccgccucgccgagccccagcuccgcgaggagaacgaccucggccucuucggcuacuggcagaccgaggaguaccagccccccgucgccgucgacggcaaggucccccgcaacgaguucggcaacgucuaccucuuccuccccuccaugaugcccaucggcugcguccagcucaaccuccccaaccuccaccgcgucgcccgcaagcucgacaucgacugcguccaggccaucaccggcuucgacuuccacggcggcuacucccaccccgucaccgacggcuacaucgucugcgaggaguucaaggacguccuccucaccgccugggagaacgagcaggccgucaucgagcgcaaggagaaggagaagaaggagaagcgcgcccucggcaacuggaagcuccucgccaagggccuccucauccgcgagcgccucaagcgccgcuacggccccaaguccgaggccgccgccccccacaccgacgccggcggcggccucuccuccgacgaggaggagggcaccuccucccaggccgaggccgcccgcauccucgccgccuccuggccccagaaccgcgaggacgaggagaagcagaagcucaagggcggccccaagaagaccaagcgcgagaagaaggccgccgccucccaccucuuccccuucgagcagcucuga

SEQ ID NO: 51844 - RNA, 1929 nt, Artificial Sequence
  derived and/or modified sequence opt2 from XPNPEP1__Homo_sapiens__NP_001161076
auggccgccucccgcaagcccccccgcguccgcgucaaccaccaggacuuccagcuccgcaaccuccgcaucaucgagcccaacgaggucacccacuccggcgacaccggcgucgagaccgacggccgcaugccccccaaggucaccuccgagcuccuccgccagcuccgccaggccaugcgcaacuccgaguacgucaccgagcccauccaggccuacaucauccccuccggcgacgcccaccaguccgaguacaucgcccccugcgacugccgccgcgccuucgucuccggcuucgacggcuccgccggcaccgccaucaucaccgaggagcacgccgccauguggaccgacggccgcuacuuccuccaggccgccaagcagauggacuccaacuggacccucaugaagaugggccucaaggacacccccacccaggaggacuggcucgucuccguccuccccgagggcucccgcgucggcgucgacccccucaucauccccaccgacuacuggaagaagauggccaagguccuccgcuccgccggccaccaccucauccccgucaaggagaaccucgucgacaagaucuggaccgaccgccccgagcgccccugcaagccccuccucacccucggccucgacuacaccggcaucuccuggaaggacaaggucgccgaccuccgccucaagauggccgagcgcaacgucaugugguucgucgucaccgcccucgacgagaucgccuggcucuucaaccuccgcggcuccgacgucgagcacaaccccgucuucuucuccuacgccaucaucggccucgagaccaucaugcucuucaucgacggcgaccgcaucgacgcccccuccgucaaggagcaccuccuccucgaccucggccucgaggccgaguaccgcauccagguccaccccuacaaguccauccucuccgagcucaaggcccucugcgccgaccucuccccccgcgagaaggucugggucuccgacaaggccuccuacgccgucuccgagaccauccccaaggaccaccgcugcugcaugcccuacacccccaucugcaucgccaaggccgucaagaacuccgccgaguccgagggcaugcgccgcgcccacaucaaggacgccgucgcccucugcgagcucuucaacuggcucgagaaggagguccccaagggcggcgucaccgagaucuccgccgccgacaaggccgaggaguuccgccgccagcaggccgacuucgucgaccucuccuuccccaccaucuccuccaccggccccaacggcgccaucauccacuacgccgacggcaccaccgacgucacccgcaccaugcacuucggcacccccaccgccuacgagaaggagugcuucaccuacguccucaagggccacaucgccgucuccgccgccgucuuccccaccggcaccaagggccaccuccucgacuccuucgcccgcuccgcccucugggacuccggccucgacuaccuccacggcaccggccacggcgucggcuccuuccucaacguccacgagggccccugcggcaucuccuacaagaccuucuccgacgagccccucgaggccggcaugaucgucaccgacgagcccggcuacuacgaggacggcgccuucggcauccgcaucgagaacgucguccucgucguccccgucaagaccaaguacaacuucaacaaccgcggcucccucaccuucgagccccucacccucguccccauccagaccaagaugaucgacgucgacucccucaccgacaaggagugcgacuggcucaacaacuaccaccucaccugccgcgacgucaucggcaaggagcuccagaagcagggccgccaggaggcccucgaguggcucauccgcgagacccagcccaucuccaagcagcacuga

SEQ ID NO: 51845 - RNA, 2025 nt, Artificial Sequence
  derived and/or modified sequence opt2 from XPNPEP2__Homo_sapiens__NP_003390
auggcccgcgcccacuggggcugcugccccuggcucguccuccucugcgccugcgccuggggccacaccaagcccgucgaccucggcggccaggacguccgcaacugcuccaccaacccccccuaccuccccgucaccgucgucaacaccaccaugucccucaccgcccuccgccagcagaugcagacccagaaccucuccgccuacaucauccccggcaccgacgcccacaugaacgaguacaucggccagcacgacgagcgccgcgccuggaucaccggcuucaccggcuccgccggcaccgccgucgucaccaugaagaaggccgccgucuggaccgacucccgcuacuggacccaggccgagcgccagauggacugcaacugggagcuccacaaggaggucggcaccacccccaucgucaccuggcuccucaccgagauccccgccggcggccgcgucggcuucgaccccuuccuccucuccaucgacaccugggaguccuacgaccucgcccuccagggcuccaaccgccagcucgucuccaucaccaccaaccucgucgaccucgucuggggcuccgagcgcccccccguccccaaccagcccaucuacgcccuccaggaggccuucaccggcuccaccuggcaggagaaggucuccggcguccgcucccagaugcagaagcaccagaagguccccaccgccguccuccucuccgcccucgaggagaccgccuggcucuucaaccuccgcgccuccgacauccccuacaaccccuucuucuacuccuacacccuccucaccgacuccuccauccgccucuucgccaacaagucccgcuucuccuccgagacccucuccuaccucaacuccuccugcaccggccccaugugcguccagaucgaggacuacucccagguccgcgacuccauccaggccuacucccucggcgacguccgcaucuggaucggcaccuccuacaccauguacggcaucuacgagaugauccccaaggagaagcucgucaccgacaccuacucccccgucaugaugaccaaggccgucaagaacuccaaggagcaggcccuccucaaggccucccacguccgcgacgccgucgccgucauccgcuaccucgucuggcucgagaagaacguccccaagggcaccgucgacgaguucuccggcgccgagaucgucgacaaguuccgcggcgaggagcaguucuccuccggccccuccuucgagaccaucuccgccuccggccucaacgccgcccucgcccacuacucccccaccaaggagcucaaccgcaagcucuccuccgacgagauguaccuccucgacuccggcggccaguacugggacggcaccaccgacaucacccgcaccguccacuggggcacccccuccgccuuccagaaggaggccuacacccgcguccucaucggcaacaucgaccucucccgccucaucuuccccgccgccaccuccggccgcauggucgaggccuucgcccgccgcgcccucugggacgccggccucaacuacggccacggcaccggccacggcaucggcaacuuccucugcguccacgaguggcccgucggcuuccaguccaacaacaucgccauggccaagggcauguucaccuccaucgagcccggcuacuacaaggacggcgaguucggcauccgccucgaggacgucgcccucgucgucgaggccaagaccaaguaccccggcuccuaccucaccuucgaggucgucuccuucguccccuacgaccgcaaccucaucgacgucucccuccucucccccgagcaccuccaguaccucaaccgcuacuaccagaccauccgcgagaaggucggccccgagcuccagcgccgccagcuccucgaggaguucgaguggcuccagcagcacaccgagccccucgccgcccgcgcccccgacaccgccuccugggccuccguccucgucgucuccacccucgccauccucggcugguccgucuga

SEQ ID NO: 51846 - RNA, 1524 nt, Artificial Sequence
  derived and/or modified sequence opt2 from XPNPEP3__Homo_sapiens__NP_071381
augcccuggcuccucuccgcccccaagcucguccccgccgucgccaacguccgcggccucuccggcugcaugcucugcucccagcgccgcuacucccuccagcccguccccgagcgccgcauccccaaccgcuaccucggccagcccucccccuucacccacccccaccuccuccgccccggcgaggucacccccggccucucccaggucgaguacgcccuccgccgccacaagcucaugucccucauccagaaggaggcccagggccaguccggcaccgaccagaccgucgucguccucuccaaccccaccuacuacauguccaacgacauccccuacaccuuccaccaggacaacaacuuccucuaccucugcggcuuccaggagcccgacuccauccucguccuccagucccuccccggcaagcagcuccccucccacaaggccauccucuucgucccccgccgcgaccccucccgcgagcucugggacggcccccgcuccggcaccgacggcgccaucgcccucaccggcgucgacgaggccuacacccucgaggaguuccagcaccuccuccccaagaugaaggccgagaccaacauggucugguacgacuggaugcgccccucccacgcccagcuccacuccgacuacaugcagccccucaccgaggccaaggccaaguccaagaacaagguccgcggcguccagcagcucauccagcgccuccgccucaucaagucccccgccgagaucgagcgcaugcagaucgccggcaagcucaccucccaggccuucaucgagaccauguucaccuccaaggcccccgucgaggaggccuuccucuacgccaaguucgaguucgagugccgcgcccgcggcgccgacauccucgccuacccccccgucgucgccggcggcaaccgcuccaacacccuccacuacgucaagaacaaccagcucaucaaggacggcgagaugguccuccucgacggcggcugcgaguccuccugcuacgucuccgacaucacccgcaccuggcccgucaacggccgcuucaccgccccccaggccgagcucuacgaggccguccucgagauccagcgcgacugccucgcccucugcuuccccggcaccucccucgagaacaucuacuccaugaugcucacccucaucggccagaagcucaaggaccucggcaucaugaagaacaucaaggagaacaacgccuucaaggccgcccgcaaguacugcccccaccacgucggccacuaccucggcauggacguccacgacacccccgacaugccccgcucccucccccuccagcccggcauggucaucaccaucgagcccggcaucuacauccccgaggacgacaaggacgcccccgagaaguuccgcggccucggcguccgcaucgaggacgacgucgucgucacccaggacuccccccucauccucuccgccgacugccccaaggagaugaacgacaucgagcagaucugcucccaggccuccuga

SEQ ID NO: 51847 - RNA, 3216 nt, Artificial Sequence
  derived and/or modified sequence opt2 from XPO1__Homo_sapiens__XP_011531399
augcccgccaucaugaccaugcucgccgaccacgccgcccgccagcuccucgacuucucccagaagcucgacaucaaccuccucgacaacgucgucaacugccucuaccacggcgagggcgcccagcagcgcauggcccaggagguccucacccaccucaaggagcaccccgacgccuggacccgcgucgacaccauccucgaguucucccagaacaugaacaccaaguacuacggccuccagauccucgagaacgucaucaagacccgcuggaagauccucccccgcaaccagugcgagggcaucaagaaguacgucgucggccucaucaucaagaccuccuccgaccccaccugcgucgagaaggagaaggucuacaucggcaagcucaacaugauccucguccagauccucaagcaggaguggcccaagcacuggcccaccuucaucuccgacaucgucggcgccucccgcaccuccgagucccucugccagaacaacauggucauccucaagcuccucuccgaggaggucuucgacuucuccuccggccagaucacccaggucaaguccaagcaccucaaggacuccaugugcaacgaguucucccagaucuuccagcucugccaguucgucauggagaacucccagaacgccccccucguccacgccacccucgagacccuccuccgcuuccucaacuggaucccccucggcuacaucuucgagaccaagcucaucuccacccucaucuacaaguuccucaacguccccauguuccgcaacgucucccucaagugccucaccgagaucgccggcgucuccgucucccaguacgaggagcaguucgucacccucuucacccucaccaugaugcagcucaagcagaugcucccccucaacaccaacauccgccucgccuacuccaacggcaaggacgacgagcagaacuucauccagaaccucucccucuuccucugcaccuuccucaaggagcacgaccagcucaucgagaagcgccucaaccuccgcgagacccucauggaggcccuccacuacaugcuccucgucuccgaggucgaggagaccgagaucuucaagaucugccucgaguacuggaaccaccucgccgccgagcucuaccgcgagucccccuucuccaccuccgccuccccccuccucuccggcucccagcacuucgacguccccccccgccgccagcucuaccuccccaugcucuucaagguccgccuccucauggucucccgcauggccaagcccgaggagguccucgucgucgagaacgaccagggcgaggucguccgcgaguucaugaaggacaccgacuccaucaaccucuacaagaacaugcgcgagacccucgucuaccucacccaccucgacuacgucgacaccgagcgcaucaugaccgagaagcuccacaaccaggucaacggcaccgagugguccuggaagaaccucaacacccucugcugggccaucggcuccaucuccggcgccaugcacgaggaggacgagaagcgcuuccucgucaccgucaucaaggaccuccucggccucugcgagcagaagcgcggcaaggacaacaaggccaucaucgccuccaacaucauguacaucgucggccaguacccccgcuuccuccgcgcccacuggaaguuccucaagaccgucgucaacaagcucuucgaguucaugcacgagacccacgacggcguccaggacauggccugcgacaccuucaucaagaucgcccagaagugccgccgccacuucguccagguccaggucggcgaggucaugcccuucaucgacgagauccucaacaacaucaacaccaucaucugcgaccuccagccccagcagguccacaccuucuacgaggccgucggcuacaugaucggcgcccagaccgaccagaccguccaggagcaccucaucgagaaguacaugcuccuccccaaccaggucugggacuccaucauccagcaggccaccaagaacgucgacauccucaaggaccccgagaccgucaagcagcucggcuccauccucaagaccaacguccgcgccugcaaggccgucggccaccccuucgucauccagcucggccgcaucuaccucgacaugcucaacgucuacaagugccucuccgagaacaucuccgccgccauccaggccaacggcgagauggucaccaagcagccccucauccgcuccaugcgcaccgucaagcgcgagacccucaagcucaucuccggcugggucucccgcuccaacgacccccagauggucgccgagaacuucguccccccccuccucgacgccguccucaucgacuaccagcgcaacguccccgccgcccgcgagcccgagguccucuccaccauggccaucaucgucaacaagcucggcggccacaucaccgccgagaucccccagaucuucgacgccgucuucgagugcacccucaacaugaucaacaaggacuucgaggaguaccccgagcaccgcaccaacuucuuccuccuccuccaggccgucaacucccacugcuuccccgccuuccucgccaucccccccacccaguucaagcucguccucgacuccaucaucugggccuucaagcacaccaugcgcaacgucgccgacaccggccuccagauccucuucacccuccuccagaacgucgcccaggaggaggccgccgcccaguccuucuaccagaccuacuucugcgacauccuccagcacaucuucuccgucgucaccgacaccucccacaccgccggccucaccaugcacgccuccauccucgccuacauguucaaccucgucgaggagggcaagaucuccaccucccucaaccccggcaaccccgucaacaaccagaucuuccuccaggaguacgucgccaaccuccucaaguccgccuucccccaccuccaggacgcccaggucaagcucuucgucaccggccucuucucccucaaccaggacauccccgccuucaaggagcaccuccgcgacuuccucguccagaucaaggaguucgccggcgaggacaccuccgaccucuuccucgaggagcgcgagaucgcccuccgccaggccgacgaggagaagcacaagcgccagauguccguccccggcaucuucaacccccacgagauccccgaggagaugugcgacuga

SEQ ID NO: 51848 - RNA, 3456 nt, Artificial Sequence
  derived and/or modified sequence opt2 from XPO4__Homo_sapiens__NP_071904
augauggccgccgcccucggcccccccgaggucaucgcccagcucgagaacgccgccaagguccucauggccccccccuccauggucaacaacgagcagcgccagcacgccgagcacaucuuccucuccuuccgcaaguccaagucccccuucgccgucugcaagcacauccucgagaccuccaaggucgacuacguccucuuccaggccgccaccgccaucauggaggccgucguccgcgaguggauccuccucgagaagggcuccaucgagucccuccgcaccuuccuccucaccuacguccuccagcgccccaaccuccagaaguacguccgcgagcagauccuccucgccgucgccgucaucgucaagcgcggcucccucgacaaguccaucgacugcaaguccaucuuccacgaggucucccagcucaucuccuccggcaaccccaccguccagacccucgccugcuccauccucaccgcccuccucuccgaguucuccuccuccuccaagaccuccaacaucggccucuccauggaguuccacggcaacugcaagcgcgucuuccaggaggaggaccuccgccagaucuucaugcucaccgucgagguccuccaggaguucucccgccgcgagaaccucaacgcccagauguccuccgucuuccagcgcuaccucgcccucgccaaccagguccucuccuggaacuuccucccccccaaccucggccgccacuacaucgccauguucgaguccucccagaacguccuccucaagcccaccgaguccuggcgcgagacccuccucgacucccgcgucauggagcucuucuucaccguccaccgcaagauccgcgaggacuccgacauggcccaggacucccuccagugccucgcccagcucgccucccuccacggccccaucuuccccgacgagggcucccaggucgacuaccucgcccacuucaucgagggccuccucaacaccaucaacggcaucgagaucgaggacuccgaggccgucggcaucuccuccaucaucuccaaccucaucaccgucuucccccgcaacguccucaccgccauccccuccgagcucuucuccuccuucgucaacugccucacccaccucaccugcuccuucggccgcuccgccgcccucgaggagguccucgacaaggacgacauggucuacauggaggccuacgacaagcuccucgaguccuggcucacccucguccaggacgacaagcacuuccacaagggcuucuucacccagcacgccguccaggucuucaacuccuacauccagugccaccucgccgcccccgacggcacccgcaaccucaccgccaacggcgucgccucccgcgaggaggaggagaucuccgagcuccaggaggacgaccgcgaccaguucuccgaccagcucgccuccgucggcaugcucggccgcaucgccgccgagcacugcaucccccuccucaccucccuccucgaggagcgcgucacccgccuccacggccagcuccagcgccaccagcagcagcuccucgccucccccggcuccuccaccgucgacaacaagaugcucgacgaccucuacgaggacauccacuggcucauccucgucaccggcuaccuccucgccgacgacacccagggcgagaccccccucaucccccccgagaucauggaguacuccaucaagcacuccuccgaggucgacaucaacaccacccuccagauccucggcucccccggcgagaaggccuccuccauccccggcuacaaccgcaccgacuccgucauccgccuccucuccgccauccuccgcgucuccgaggucgagucccgcgccauccgcgccgaccucacccaccuccucuccccccagaugggcaaggacaucgucugguuccucaagcgcugggccaagaccuaccuccucgucgacgagaagcucuacgaccagaucucccuccccuucuccaccgccuucggcgccgacaccgagggcucccaguggaucaucggcuaccuccuccagaaggucaucuccaaccucuccgucugguccuccgagcaggaccucgccaacgacaccguccagcuccucgucacccucgucgagcgccgcgagcgcgccaaccucgucauccagugcgagaacugguggaaccucgccaagcaguucgccucccgcucccccccccucaacuuccucuccucccccguccagcgcacccucaugaaggcccucguccucggcggcuucgcccacauggacaccgagaccaagcagcaguacuggaccgagguccuccagccccuccagcagcgcuuccuccgcgucaucaaccaggagaacuuccagcagaugugccagcaggaggaggucaagcaggagaucaccgccacccucgaggcccucugcggcaucgccgaggccacccagaucgacaacgucgccauccucuucaacuuccucauggacuuccucaccaacugcaucggccucauggaggucuacaagaacacccccgagaccgucaaccucaucaucgaggucuucgucgaggucgcccacaagcagaucugcuaccucggcgaguccaaggccaugaaccucuacgaggccugccucacccuccuccaggucuacuccaagaacaaccucggccgccagcgcaucgacgucaccgccgaggaggagcaguaccaggaccuccuccucaucauggagcuccucaccaaccuccucuccaaggaguucaucgacuucuccgacaccgacgaggucuuccgcggccacgagcccggccaggccgccaaccgcuccgucuccgccgccgacgucguccucuacggcgucaaccucauccucccccucaugucccaggaccuccucaaguuccccacccucugcaaccaguacuacaagcucaucaccuucaucugcgagaucuuccccgagaagaucccccagcuccccgaggaccucuucaagucccucauguacucccucgagcucggcaugaccuccauguccuccgaggucugccagcucugccucgaggcccucaccccccucgccgagcagugcgccaaggcccaggagaccgacuccccccucuuccucgccacccgccacuuccucaagcucgucuucgacaugcucguccuccagaagcacaacaccgagaugaccaccgccgccggcgaggccuucuacacccucgucugccuccaccaggccgaguacuccgagcucgucgagacccuccucuccucccagcaggaccccgucaucuaccagcgccucgccgacgccuucaacaagcucaccgccuccuccaccccccccacccucgaccgcaagcagaagauggccuuccucaagucccucgaggaguucauggccaacgucggcggccuccucugcgucaaguga

SEQ ID NO: 51849 - RNA, 3615 nt, Artificial Sequence
  derived and/or modified sequence opt2 from XPO5__Homo_sapiens__NP_065801
auggccauggaccaggucaacgcccucugcgagcagcucgucaaggccgucaccgucaugauggaccccaacuccacccagcgcuaccgccucgaggcccucaaguucugcgaggaguucaaggagaagugccccaucugcguccccugcggccuccgccucgccgagaagacccaggucgccaucguccgccacuucggccuccagauccucgagcacgucgucaaguuccgcuggaacggcaugucccgccucgagaaggucuaccucaagaacuccgucauggagcucaucgccaacggcacccucaacauccucgaggaggagaaccacaucaaggacgcccucucccgcaucgucgucgagaugaucaagcgcgaguggccccagcacuggcccgacaugcucaucgagcucgacacccucuccaagcagggcgagacccagaccgagcucgucauguucauccuccuccgccucgccgaggacgucgucaccuuccagacccuccccccccagcgccgccgcgacauccagcagacccucacccagaacauggagcgcaucuucuccuuccuccucaacacccuccaggagaacgucaacaaguaccagcaggucaagaccgacaccucccaggaguccaaggcccaggccaacugccgcgucggcgucgccgcccucaacacccucgccggcuacaucgacugggucuccaugucccacaucaccgccgagaacugcaagcuccucgagauccucugccuccuccucaacgagcaggagcuccagcucggcgccgccgagugccuccucaucgccgucucccgcaagggcaagcucgaggaccgcaagccccucaugguccucuucggcgacgucgccaugcacuacauccucuccgccgcccagaccgccgacggcggcggccucgucgagaagcacuacgucuuccucaagcgccucugccagguccucugcgcccucggcaaccagcucugcgcccuccucggcgccgacuccgacgucgagacccccuccaacuucggcaaguaccucgaguccuuccucgccuucaccacccaccccucccaguuccuccgcuccuccacccagaugaccuggggcgcccucuuccgccacgagauccucucccgcgacccccuccuccucgccaucauccccaaguaccuccgcgccuccaugaccaaccucgucaagaugggcuuccccuccaagaccgacucccccuccugcgaguacucccgcuucgacuucgacuccgacgaggacuucaacgccuucuucaacuccucccgcgcccagcagggcgaggucaugcgccucgccugccgccucgaccccaagaccuccuuccagauggccggcgaguggcucaaguaccagcucuccaccuuccucgacgccggcuccgucaacuccugcuccgccgucggcaccggcgagggcucccucugcuccgucuucucccccuccuucguccagugggaggccaugacccucuuccucgaguccgucaucacccagauguuccgcacccucaaccgcgaggagauccccgucaacgacggcaucgagcuccuccagaugguccucaacuucgacaccaaggacccccucauccucuccugcguccucaccaacgucuccgcccucuuccccuucgucaccuaccgccccgaguuccucccccaggucuucuccaagcucuucuccuccgucaccuucgagaccgucgaggaguccaaggccccccgcacccgcgccguccgcaacguccgccgccacgccugcuccuccaucaucaagaugugccgcgacuacccccagcucguccuccccaacuucgacaugcucuacaaccacgucaagcagcuccucuccaacgagcuccuccucacccagauggagaagugcgcccucauggaggcccucguccucaucuccaaccaguucaagaacuacgagcgccagaaggucuuccucgaggagcucauggcccccgucgccuccaucuggcucucccaggacaugcaccgcguccucuccgacgucgacgccuucaucgccuacgucggcaccgaccagaaguccugcgaccccggccucgaggaccccugcggccucaaccgcgcccgcauguccuucugcgucuacuccauccucggcgucgucaagcgcaccugcuggcccaccgaccucgaggaggccaaggccggcggcuucgucgucggcuacaccuccuccggcaaccccaucuuccgcaaccccugcaccgagcagauccucaagcuccucgacaaccuccucgcccucauccgcacccacaacacccucuacgcccccgagaugcucgccaagauggccgagcccuucaccaaggcccucgacaugcucgacgccgagaaguccgccauccucggccucccccagccccuccucgagcucaacgacucccccgucuucaagaccguccucgagcgcaugcagcgcuucuucuccacccucuacgagaacugcuuccacauccucggcaaggccggccccuccaugcagcaggacuucuacaccgucgaggaccucgccacccagcuccucuccuccgccuucgucaaccucaacaacauccccgacuaccgccuccgccccaugcuccgcgucuucgucaagccccucguccucuucugcccccccgagcacuacgaggcccucgucucccccauccucggcccccucuucaccuaccuccacaugcgccucucccagaaguggcaggucaucaaccagcgcucccuccucugcggcgaggacgaggccgccgacgagaaccccgagucccaggagaugcucgaggagcagcucguccgcaugcucacccgcgaggucauggaccucaucaccgucugcugcgucuccaagaagggcgccgaccacuccuccgccccccccgccgacggcgacgacgaggagaugauggccaccgaggucacccccuccgccauggccgagcucaccgaccucggcaagugccucaugaagcacgaggacgucugcaccgcccuccucaucaccgccuucaacucccucgccuggaaggacacccucuccugccagcgcaccaccucccagcucugcuggccccuccucaagcagguccucuccggcacccuccucgccgacgccgucaccuggcucuucaccuccguccucaagggccuccagaugcacggccagcacgacggcugcauggccucccucguccaccucgccuuccagaucuacgaggcccuccgcccccgcuaccucgagauccgcgccgucauggagcagauccccgagauccagaaggacucccucgaccaguucgacugcaagcuccucaaccccucccuccagaaggucgccgacaagcgccgcaaggaccaguucaagcgccucaucgccggcugcaucggcaagccccucggcgagcaguuccgcaaggagguccacaucaagaaccuccccucccucuucaagaagaccaagcccaugcucgagaccgagguccucgacaacgacggcggcggccucgccaccaucuucgagcccuga

SEQ ID NO: 51850 - RNA, 3336 nt, Artificial Sequence
  derived and/or modified sequence opt2 from XPO6__Homo_sapiens__NP_001257869
augaccgaguucuuccacgacugcaccaccaacgagcgcaagcgcgagaucgaggagcuccucaacaacuucgcccagcagaucggcgccuggcgcuucugccucuacuuccucuccuccacccgcaacgacuacgucaugauguacucccucaccgucuucgagaaccucaucaacaagauguggcucggcguccccucccaggacaagauggagauccgcuccugccuccccaagcuccuccucgcccaccacaagacccuccccuacuucauccgcaacaagcucugcaaggucaucgucgacaucggccgccaggacuggcccauguucuaccacgacuucuucaccaacauccuccagcucauccagucccccgucaccaccccccucggccucaucaugcucaagaccaccuccgaggagcucgccugcccccgcgaggaccucuccgucgcccgcaaggaggagcuccgcaagcuccuccucgaccagguccagaccguccucggccuccucaccggcauccucgagaccgucugggacaagcacuccgucaccgccgccacccccccccccucccccaccuccggcgaguccggcgaccuccucuccaaccuccuccagucccccuccuccgccaagcuccucaaccagcccauccccauccucgacgucgaguccgaguacaucugcucccucgcccucgagugccucgcccaccucuucuccuggaucccccucuccgccuccaucacccccucccuccucaccaccaucuuccacuucgcccgcuucggcugcgacauccgcgcccgcaagauggccuccgucaacggcuccucccagaacugcgucuccggccaggagcgcggccgccucggcguccucgccauguccugcaucaacgagcucauguccaagaacugcguccccauggaguucgaggaguaccuccuccgcauguuccagcagaccuucuaccuccuccagaagaucaccaaggacaacaacgcccacaccgucaagucccgccucgaggagcucgacgaguccuacaucgagaaguucaccgacuuccuccgccucuucgucuccguccaccuccgccgcaucgaguccuacucccaguuccccgucgucgaguuccucacccuccucuucaaguacaccuuccaccagcccacccacgagggcuacuucuccugccucgacaucuggacccucuuccucgacuaccucaccuccaagaucaagucccgccucggcgacaaggaggccguccucaaccgcuacgaggacgcccucguccuccuccucaccgagguccucaaccgcauccaguuccgcuacaaccaggcccagcucgaggagcucgacgacgagacccucgacgacgaccagcagaccgaguggcagcgcuaccuccgccagucccucgaggucgucgccaaggucauggagcuccuccccacccacgccuucuccacccucuuccccguccuccaggacaaccucgaggucuaccucggccuccagcaguucaucgucaccuccggcuccggccaccgccucaacaucaccgccgagaacgacugccgccgccuccacugcucccuccgcgaccucuccucccuccuccaggccgucggccgccucgccgaguacuucaucggcgacgucuucgccgcccgcuucaacgacgcccucaccgucgucgagcgccucgucaaggucacccucuacggcucccagaucaagcucuacaacaucgagaccgccguccccuccguccucaagcccgaccucaucgacguccacgcccagucccucgccgcccuccaggccuacucccacuggcucgcccaguacugcuccgagguccaccgccagaacacccagcaguucgucacccucaucuccaccaccauggacgccaucaccccccucaucuccaccaagguccaggacaagcuccuccucuccgccugccaccuccucgucucccucgccaccaccguccgccccgucuuccucaucuccauccccgccguccagaaggucuucaaccgcaucaccgacgccuccgcccuccgccucgucgacaaggcccagguccucgucugccgcgcccucuccaacauccuccuccuccccuggcccaaccuccccgagaacgagcagcaguggcccguccgcuccaucaaccacgccucccucaucuccgcccucucccgcgacuaccgcaaccucaagcccuccgccgucgccccccagcgcaagaugccccucgacgacaccaagcucaucauccaccagacccucuccguccucgaggacaucgucgagaacaucuccggcgaguccaccaagucccgccagaucugcuaccagucccuccaggaguccguccaggucucccucgcccucuuccccgccuucauccaccaguccgacgucaccgacgagaugcucuccuucuuccucacccucuuccgcggccuccgcguccagaugggcguccccuucaccgagcagaucauccagaccuuccucaacauguucacccgcgagcagcucgccgaguccauccuccacgagggcuccaccggcugccgcgucgucgagaaguuccucaagauccuccaggucgucguccaggagcccggccaggucuucaagcccuuccuccccuccaucaucgcccucugcauggagcaggucuaccccaucaucgccgagcgccccucccccgacgucaaggccgagcucuucgagcuccucuuccgcacccuccaccacaacuggcgcuacuucuucaaguccaccguccucgccuccguccagcgcggcaucgccgaggagcagauggagaacgagccccaguucuccgccaucaugcaggccuucggccaguccuuccuccagcccgacauccaccucuucaagcagaaccucuucuaccucgagacccucaacaccaagcagaagcucuaccacaagaagaucuuccgcaccgccaugcucuuccaguucgucaacguccuccuccagguccucguccacaagucccacgaccuccuccaggaggagaucggcaucgccaucuacaacauggccuccgucgacuucgacggcuucuucgccgccuuccuccccgaguuccucaccuccugcgacggcgucgacgccaaccagaaguccguccucggccgcaacuucaagauggaccgcgaccuccccuccuucacccagaacguccaccgccucgucaacgaccuccgcuacuaccgccucugcaacgacucccucccccccggcaccgucaagcucuga

SEQ ID NO: 51851 - RNA, 3264 nt, Artificial Sequence
  derived and/or modified sequence opt2 from XPO7__Homo_sapiens__NP_055839
auggccgaccacguccagucccucgcccagcucgagaaccucugcaagcagcucuacgagaccaccgacaccaccacccgccuccaggccgagaaggcccucgucgaguucaccaacucccccgacugccucuccaagugccagcuccuccucgagcgcggcuccuccuccuacucccagcuccucgccgccaccugccucaccaagcucgucucccgcaccaacaacccccucccccucgagcagcgcaucgacauccgcaacuacguccucaacuaccucgccacccgccccaagcucgccaccuucgucacccaggcccucauccagcucuacgcccgcaucaccaagcucggcugguucgacugccagaaggacgacuacgucuuccgcaacgccaucaccgacgucacccgcuuccuccaggacuccgucgaguacugcaucaucggcgucaccauccucucccagcucaccaacgagaucaaccaggccgacaccacccacccccucaccaagcaccgcaagaucgccuccuccuuccgcgacuccucccucuucgacaucuucacccucuccugcaaccuccucaagcaggccuccggcaagaaccucaaccucaacgacgagucccagcacggccuccucaugcagcuccucaagcucacccacaacugccucaacuucgacuucaucggcaccuccaccgacgaguccuccgacgaccucugcaccguccagauccccaccuccuggcgcuccgccuuccucgacuccuccacccuccagcucuucuucgaccucuaccacuccaucccccccuccuucuccccccucguccucuccugccucguccagaucgccuccguccgccgcucccucuucaacaacgccgagcgcgccaaguuccucucccaccucgucgacggcgucaagcgcauccucgagaacccccagucccucuccgaccccaacaacuaccacgaguucugccgccuccucgcccgccucaaguccaacuaccagcucggcgagcucgucaaggucgagaacuaccccgaggucauccgccucaucgccaacuucaccgucaccucccuccagcacugggaguucgcccccaacuccguccacuaccuccucucccucuggcagcgccucgccgccuccguccccuacgucaaggccaccgagccccacaugcucgagaccuacacccccgaggucaccaaggccuacaucaccucccgccucgaguccguccacaucauccuccgcgacggccucgaggacccccucgaggacaccggccucguccagcagcagcucgaccagcucuccaccaucggccgcugcgaguacgagaagaccugcgcccuccucguccagcucuucgaccaguccgcccaguccuaccaggagcuccuccaguccgccuccgccucccccauggacaucgccguccaggagggccgccucaccuggcucgucuacaucaucggcgccgucaucggcggccgcgucuccuucgccuccaccgacgagcaggacgccauggacggcgagcucgucugccgcguccuccagcucaugaaccucaccgacucccgccucgcccaggccggcaacgagaagcucgagcucgccaugcucuccuucuucgagcaguuccgcaagaucuacaucggcgaccagguccagaaguccuccaagcucuaccgccgccucuccgagguccucggccucaacgacgagaccaugguccucuccgucuucaucggcaagaucaucaccaaccucaaguacuggggccgcugcgagcccaucaccuccaagacccuccagcuccucaacgaccucuccaucggcuacuccuccguccgcaagcucgucaagcucuccgccguccaguucaugcucaacaaccacaccuccgagcacuucuccuuccucggcaucaacaaccaguccaaccucaccgacaugcgcugccgcaccaccuucuacaccgcccucggccgccuccucauggucgaccucggcgaggacgaggaccaguacgagcaguucaugcucccccucaccgccgccuucgaggccgucgcccagauguucuccaccaacuccuucaacgagcaggaggccaagcgcacccucgucggccucguccgcgaccuccgcggcaucgccuucgccuucaacgccaagaccuccuucaugaugcucuucgaguggaucuaccccuccuacaugcccauccuccagcgcgccaucgagcucugguaccacgaccccgccugcaccacccccguccucaagcucauggccgagcucguccacaaccgcucccagcgccuccaguucgacgucuccucccccaacggcauccuccucuuccgcgagaccuccaagaugaucaccauguacggcaaccgcauccucacccucggcgagguccccaaggaccaggucuacgcccucaagcucaagggcaucuccaucugcuucuccaugcucaaggccgcccucuccggcuccuacgucaacuucggcgucuuccgccucuacggcgacgacgcccucgacaacgcccuccagaccuucaucaagcuccuccucuccaucccccacuccgaccuccucgacuaccccaagcucucccaguccuacuacucccuccucgagguccucacccaggaccacaugaacuucaucgccucccucgagccccacgucaucauguacauccucuccuccaucuccgagggccucaccgcccucgacaccauggucugcaccggcugcugcuccugccucgaccacaucgucaccuaccucuucaagcagcucucccgcuccaccaagaagcgcaccaccccccucaaccaggaguccgaccgcuuccuccacaucaugcagcagcaccccgagaugauccagcagaugcucuccaccguccucaacaucaucaucuucgaggacugccgcaaccagugguccaugucccgcccccuccucggccucauccuccucaacgagaaguacuucuccgaccuccgcaacuccaucgucaacucccagccccccgagaagcagcaggccaugcaccucugcuucgagaaccucauggagggcaucgagcgcaaccuccucaccaagaaccgcgaccgcuucacccagaaccucuccgccuuccgccgcgaggucaacgacuccaugaagaacuccaccuacggcgucaacuccaacgacaugauguccuga

SEQ ID NO: 51852 - RNA, 1896 nt, Artificial Sequence
  derived and/or modified sequence opt2 from XPR1__Homo_sapiens__NP_001129141
augaaguucgccgagcaccucuccgcccacaucacccccgaguggcgcaagcaguacauccaguacgaggccuucaaggacaugcucuacuccgcccaggaccaggcccccuccgucgaggucaccgacgaggacaccgucaagcgcuacuucgccaaguucgaggagaaguucuuccagaccugcgagaaggagcucgccaagaucaacaccuucuacuccgagaagcucgccgaggcccagcgccgcuucgccacccuccagaacgagcuccaguccucccucgacgcccagaaggaguccaccggcgucaccacccuccgccagcgccgcaagcccgucuuccaccucucccacgaggagcgcguccagcaccgcaacaucaaggaccucaagcucgccuucuccgaguucuaccucucccucauccuccuccagaacuaccagaaccucaacuucaccggcuuccgcaagauccucaagaagcacgacaagauccucgagaccucccgcggcgccgacuggcgcgucgcccacgucgaggucgcccccuucuacaccugcaagaagaucaaccagcucaucuccgagaccgaggccgucgucaccaacgagcucgaggacggcgaccgccagaaggccaugaagcgccuccgcguccccccccucggcgccgcccagcccgcccccgccuggaccaccuuccgcgucggccucuucugcggcaucuucaucguccucaacaucacccucguccucgccgccgucuucaagcucgagaccgaccgcuccaucuggccccucauccgcaucuaccgcggcggcuuccuccucaucgaguuccucuuccuccucggcaucaacaccuacggcuggcgccaggccggcgucaaccacguccucaucuucgagcucaacccccgcuccaaccucucccaccagcaccucuucgagaucgccggcuuccucggcauccucuggugccucucccuccucgccugcuucuucgcccccaucuccgucauccccaccuacgucuacccccucgcccucuacggcuucauggucuucuuccucaucaaccccaccaagaccuucuacuacaagucccgcuucuggcuccucaagcuccucuuccgcgucuucaccgcccccuuccacaaggucggcuucgccgacuucuggcucgccgaccagcucaacucccucuccgucauccucauggaccucgaguacaugaucugcuucuacucccucgagcucaagugggacgaguccaagggccuccuccccaacaacuccgaggagcgcggccacuccgacaccauggucuucuucuaccucuggaucgucuucuacaucaucuccuccugcuacacccucaucugggaccucaagauggacuggggccucuucgacaagaacgccggcgagaacaccuuccuccgcgaggagaucgucuacccccagaaggccuacuacuacugcgccaucaucgaggacgucauccuccgcuucgccuggaccauccagaucuccaucaccuccaccacccuccucccccacuccggcgacaucaucgccaccgucuucgccccccucgaggucuuccgccgcuucgucuggaacuucuuccgccucgagaacgagcaccucaacaacugcggcgaguuccgcgccguccgcgacaucuccgucgccccccucaacgccgacgaccagacccuccucgagcagaugauggaccaggacgacggcguccgcaaccgccagaagaaccgcuccuggaaguacaaccaguccaucucccuccgccgcccccgccucgccucccaguccaaggcccgcgacaccaagguccucaucgaggacaccgacgacgaggccaacaccuga

SEQ ID NO: 51853 - RNA, 1902 nt, Artificial Sequence
  derived and/or modified sequence opt2 from XRCC1__Homo_sapiens__NP_006288
augcccgagauccgccuccgccacgucgucuccugcuccucccaggacuccacccacugcgccgagaaccuccucaaggccgacaccuaccgcaaguggcgcgccgccaaggccggcgagaagaccaucuccgucguccuccagcucgagaaggaggagcagauccacuccgucgacaucggcaacgacggcuccgccuucgucgagguccucgucggcuccuccgccggcggcgccggcgagcaggacuacgagguccuccucgucaccuccuccuucaugucccccuccgagucccgcuccggcuccaaccccaaccgcguccgcauguucggccccgacaagcucguccgcgccgccgccgagaagcgcugggaccgcgucaagaucgucugcucccagcccuacuccaaggacucccccuucggccucuccuucguccgcuuccacuccccccccgacaaggacgaggccgaggcccccucccagaaggucaccgucaccaagcucggccaguuccgcgucaaggaggaggacgaguccgccaacucccuccgccccggcgcccucuucuucucccgcaucaacaagaccucccccgucaccgccuccgaccccgccggccccuccuacgccgccgccacccuccaggccuccuccgccgccuccuccgccucccccgucucccgcgccaucggcuccaccuccaagccccaggagucccccaagggcaagcgcaagcucgaccucaaccaggaggagaagaagacccccuccaagccccccgcccagcucucccccuccguccccaagcgccccaagcuccccgcccccacccgcacccccgccaccgcccccguccccgcccgcgcccagggcgccgucaccggcaagccccgcggcgagggcaccgagccccgccgcccccgcgccggccccgaggagcucggcaagauccuccagggcgucgucgucguccucuccggcuuccagaaccccuuccgcuccgagcuccgcgacaaggcccucgagcucggcgccaaguaccgccccgacuggacccgcgacuccacccaccucaucugcgccuucgccaacacccccaaguacucccagguccucggccucggcggccgcaucguccgcaaggaguggguccucgacugccaccgcaugcgccgccgccuccccucccagcgcuaccucauggccggccccggcuccuccuccgaggaggacgaggccucccacuccggcggcuccggcgacgaggcccccaagcucccccagaagcagccccagaccaagaccaagcccacccaggccgccggccccuccuccccccagaagccccccacccccgaggagaccaaggccgccucccccguccuccaggaggacaucgacaucgagggcguccaguccgagggccaggacaacggcgccgaggacuccggcgacaccgaggacgagcuccgccgcgucgccgagcagaaggagcaccgccucccccccggccaggaggagaacggcgaggaccccuacgccggcuccaccgacgagaacaccgacuccgaggagcaccaggagccccccgaccuccccguccccgagcuccccgacuucuuccagggcaagcacuucuuccucuacggcgaguuccccggcgacgagcgccgcaagcucauccgcuacgucaccgccuucaacggcgagcucgaggacuacauguccgaccgcguccaguucgucaucaccgcccaggagugggaccccuccuucgaggaggcccucauggacaaccccucccucgccuucguccgcccccgcuggaucuacuccugcaacgagaagcagaagcuccucccccaccagcucuacggcgucgucccccaggccuga

SEQ ID NO: 51854 - RNA, 843 nt, Artificial Sequence
  derived and/or modified sequence opt2 from XRCC2__Homo_sapiens__NP_005422
augugcuccgccuuccaccgcgccgaguccggcaccgagcuccucgcccgccucgagggccgcuccucccucaaggagaucgagcccaaccucuucgccgacgaggacucccccguccacggcgacauccucgaguuccacggccccgagggcaccggcaagaccgagaugcucuaccaccucaccgcccgcugcauccuccccaaguccgagggcggccucgaggucgagguccucuucaucgacaccgacuaccacuucgacaugcuccgccucgucaccauccucgagcaccgccucucccaguccuccgaggagaucaucaaguacugccucggccgcuucuuccucgucuacugcuccuccuccacccaccuccuccucacccucuacucccucgaguccauguucugcucccaccccucccucugccuccucauccucgacucccucuccgccuucuacuggaucgaccgcgucaacggcggcgaguccgucaaccuccaggaguccacccuccgcaagugcucccagugccucgagaagcucgucaacgacuaccgccucguccucuucgccaccacccagaccaucaugcagaaggccuccuccuccuccgaggagcccucccacgccucccgccgccucugcgacgucgacaucgacuaccgccccuaccucugcaaggccuggcagcagcucgucaagcaccgcauguucuucuccaagcaggacgacucccaguccuccaaccaguucucccucgucucccgcugccucaaguccaacucccucaagaagcacuucuucaucaucggcgaguccggcgucgaguucugcuga

SEQ ID NO: 51855 - RNA, 1041 nt, Artificial Sequence
  derived and/or modified sequence opt2 from XRCC3__Homo_sapiens__XP_005268103
auggaccucgaccuccucgaccucaacccccgcaucaucgccgccaucaagaaggccaagcucaaguccgucaaggagguccuccacuucuccggccccgaccucaagcgccucaccaaccucuccucccccgaggucuggcaccuccuccgcaccgccucccuccaccuccgcggcuccuccauccucaccgcccuccagcuccaccagcagaaggagcgcuuccccacccagcaccagcgccucucccucggcugccccguccucgacgcccuccuccgcggcggccucccccucgacggcaucaccgagcucgccggccgcuccuccgccggcaagacccagcucgcccuccagcucugccucgccguccaguucccccgccagcacggcggccucgaggccggcgccgucuacaucugcaccgaggacgccuucccccacaagcgccuccagcagcucauggcccagcagccccgccuccgcaccgacguccccggcgagcuccuccagaagcuccgcuucggcucccagaucuucaucgagcacgucgccgacgucgacacccuccucgagugcgucaacaagaagguccccguccuccucucccgcggcauggcccgccucgucgucaucgacuccgucgccgcccccuuccgcugcgaguucgacucccaggccuccgccccccgcgcccgccaccuccagucccucggcgccacccuccgcgagcucuccuccgccuuccagucccccguccucugcaucaaccaggucaccgaggccauggaggagcagggcgccgcccacggcccccucggcuucugggacgagcgcgucucccccgcccucggcaucaccugggccaaccagcuccucguccgccuccucgccgaccgccuccgcgaggaggaggccgcccucggcugccccgcccgcacccuccgcguccucuccgccccccaccucccccccuccuccugcuccuacaccaucuccgccgagggcguccgcggcacccccggcacccagucccacuga

SEQ ID NO: 51856 - RNA, 1005 nt, Artificial Sequence
  derived and/or modified sequence opt2 from XRCC4__Homo_sapiens__NP_072044
auggagcgcaagaucucccgcauccaccucgucuccgagcccuccaucacccacuuccuccaggucuccugggagaagacccucgaguccggcuucgucaucacccucaccgacggccacuccgccuggaccggcaccgucuccgaguccgagaucucccaggaggccgacgacauggccauggagaagggcaaguacgucggcgagcuccgcaaggcccuccucuccggcgccggccccgccgacgucuacaccuucaacuucuccaaggaguccugcuacuucuucuucgagaagaaccucaaggacgucuccuuccgccucggcuccuucaaccucgagaaggucgagaaccccgccgaggucauccgcgagcucaucugcuacugccucgacaccaucgccgagaaccaggccaagaacgagcaccuccagaaggagaacgagcgccuccuccgcgacuggaacgacguccagggccgcuucgagaagugcgucuccgccaaggaggcccucgagaccgaccucuacaagcgcuucauccucguccucaacgagaagaagaccaagauccgcucccuccacaacaagcuccucaacgccgcccaggagcgcgagaaggacaucaagcaggagggcgagaccgccaucugcuccgagaugaccgccgaccgcgaccccgucuacgacgaguccaccgacgaggaguccgagaaccagaccgaccucuccggccucgccuccgccgccgucuccaaggacgacuccaucaucuccucccucgacgucaccgacaucgcccccucccgcaagcgccgccagcgcaugcagcgcaaccucggcaccgagcccaagauggccccccaggagaaccagcuccaggagaaggagaagcccgacuccucccuccccgagaccuccaagaaggagcacaucuccgccgagaacaugucccucgagacccuccgcaacuccucccccgaggaccucuucgacgagaucuga

SEQ ID NO: 51857 - RNA, 2199 nt, Artificial Sequence
  derived and/or modified sequence opt2 from XRCC5__Homo_sapiens__NP_066964
augguccgcuccggcaacaaggccgccgucguccucugcauggacgucggcuucaccauguccaacuccauccccggcaucgagucccccuucgagcaggccaagaaggucaucaccauguucguccagcgccaggucuucgccgagaacaaggacgagaucgcccucguccucuucggcaccgacggcaccgacaacccccucuccggcggcgaccaguaccagaacaucaccguccaccgccaccucaugcuccccgacuucgaccuccucgaggacaucgaguccaagauccagcccggcucccagcaggccgacuuccucgacgcccucaucgucuccauggacgucauccagcacgagaccaucggcaagaaguucgagaagcgccacaucgagaucuucaccgaccucuccucccgcuucuccaagucccagcucgacaucaucauccacucccucaagaagugcgacaucucccuccaguucuuccuccccuucucccucggcaaggaggacggcuccggcgaccgcggcgacggccccuuccgccucggcggccacggccccuccuucccccucaagggcaucaccgagcagcagaaggagggccucgagaucgucaagauggucaugaucucccucgagggcgaggacggccucgacgagaucuacuccuucuccgagucccuccgcaagcucugcgucuucaagaagaucgagcgccacuccauccacuggcccugccgccucaccaucggcuccaaccucuccauccgcaucgccgccuacaaguccauccuccaggagcgcgucaagaagaccuggaccgucgucgacgccaagacccucaagaaggaggacauccagaaggagaccgucuacugccucaacgacgacgacgagaccgagguccucaaggaggacaucauccagggcuuccgcuacggcuccgacaucguccccuucuccaaggucgacgaggagcagaugaaguacaaguccgagggcaagugcuucuccguccucggcuucugcaaguccucccagguccagcgccgcuucuucaugggcaaccagguccucaaggucuucgccgcccgcgacgacgaggccgccgccgucgcccucuccucccucauccacgcccucgacgaccucgacauggucgccaucguccgcuacgccuacgacaagcgcgccaacccccaggucggcgucgccuucccccacaucaagcacaacuacgagugccucgucuacguccagcuccccuucauggaggaccuccgccaguacauguucuccucccucaagaacuccaagaaguacgcccccaccgaggcccagcucaacgccgucgacgcccucaucgacuccaugucccucgccaagaaggacgagaagaccgacacccucgaggaccucuuccccaccaccaagauccccaacccccgcuuccagcgccucuuccagugccuccuccaccgcgcccuccacccccgcgagccccucccccccauccagcagcacaucuggaacaugcucaacccccccgccgaggucaccaccaagucccagaucccccucuccaagaucaagacccucuucccccucaucgaggccaagaagaaggaccaggucaccgcccaggagaucuuccaggacaaccacgaggacggccccaccgccaagaagcucaagaccgagcagggcggcgcccacuucuccgucuccucccucgccgagggcuccgucaccuccgucggcuccgucaaccccgccgagaacuuccgcguccucgucaagcagaagaaggccuccuucgaggaggccuccaaccagcucaucaaccacaucgagcaguuccucgacaccaacgagacccccuacuucaugaaguccaucgacugcauccgcgccuuccgcgaggaggccaucaaguucuccgaggagcagcgcuucaacaacuuccucaaggcccuccaggagaaggucgagaucaagcagcucaaccacuucugggagaucgucguccaggacggcaucacccucaucaccaaggaggaggccuccggcuccuccgucaccgccgaggaggccaagaaguuccucgcccccaaggacaagcccuccggcgacaccgccgccgucuucgaggagggcggcgacgucgacgaccuccucgacaugaucuga

SEQ ID NO: 51858 - RNA, 741 nt, Artificial Sequence
  derived and/or modified sequence opt2 from XRCC6BP1__Homo_sapiens__NP_150592
auggccggcgcccccgacgagcgccgccgcggccccgccgccggcgagcagcuccagcagcagcacgucuccugccaggucuuccccgagcgccucgcccagggcaacccccagcagggcuucuucuccuccuucuucaccuccaaccagaagugccagcuccgccuccucaagacccucgagaccaaccccuacgucaagcuccuccucgacgccaugaagcacuccggcugcgccgucaacaaggaccgccacuucuccugcgaggacugcaacggcaacgucuccggcggcuucgacgccuccaccucccagaucguccucugccagaacaacauccacaaccaggcccacaugaaccgcgucgucacccacgagcucauccacgccuucgaccacugccgcgcccacgucgacugguucaccaacauccgccaccucgccugcuccgagguccgcgccgccaaccucuccggcgacugcucccucgucaacgagaucuuccgccuccacuucggccucaagcagcaccaccagaccugcguccgcgaccgcgccacccucuccauccucgccguccgcaacaucuccaaggaggucgccaagaaggccgucgacgaggucuucgaguccugcuucaacgaccacgagcccuucggccgcaucccccacaacaagaccuacgcccgcuacgcccaccgcgacuucgagaaccgcgaccgcuacuacuccaacaucuga

SEQ ID NO: 51859 - RNA, 1830 nt, Artificial Sequence
  derived and/or modified sequence opt2 from XRCC6__Homo_sapiens__NP_001275905
auguccggcugggaguccuacuacaagaccgagggcgacgaggaggccgaggaggagcaggaggagaaccucgaggccuccggcgacuacaaguacuccggccgcgacucccucaucuuccucgucgacgccuccaaggccauguucgagucccaguccgaggacgagcucacccccuucgacauguccauccagugcauccaguccgucuacaucuccaagaucaucuccuccgaccgcgaccuccucgccgucgucuucuacggcaccgagaaggacaagaacuccgucaacuucaagaacaucuacguccuccaggagcucgacaaccccggcgccaagcgcauccucgagcucgaccaguucaagggccagcagggccagaagcgcuuccaggacaugaugggccacggcuccgacuacucccucuccgagguccucugggucugcgccaaccucuucuccgacguccaguucaagaugucccacaagcgcaucaugcucuucaccaacgaggacaacccccacggcaacgacuccgccaaggccucccgcgcccgcaccaaggccggcgaccuccgcgacaccggcaucuuccucgaccucaugcaccucaagaagcccggcggcuucgacaucucccucuucuaccgcgacaucaucuccaucgccgaggacgaggaccuccgcguccacuucgaggaguccuccaagcucgaggaccuccuccgcaagguccgcgccaaggagacccgcaagcgcgcccucucccgccucaagcucaagcucaacaaggacaucgucaucuccgucggcaucuacaaccucguccagaaggcccucaagcccccccccaucaagcucuaccgcgagaccaacgagcccgucaagaccaagacccgcaccuucaacaccuccaccggcggccuccuccuccccuccgacaccaagcgcucccagaucuacggcucccgccagaucauccucgagaaggaggagaccgaggagcucaagcgcuucgacgaccccggccucaugcucaugggcuucaagccccucguccuccucaagaagcaccacuaccuccgccccucccucuucgucuaccccgaggagucccucgucaucggcuccuccacccucuucuccgcccuccucaucaagugccucgagaaggaggucgccgcccucugccgcuacaccccccgccgcaacaucccccccuacuucgucgcccucgucccccaggaggaggagcucgacgaccagaagauccaggucaccccccccggcuuccagcucgucuuccuccccuucgccgacgacaagcgcaagaugcccuucaccgagaagaucauggccacccccgagcaggucggcaagaugaaggccaucgucgagaagcuccgcuucaccuaccgcuccgacuccuucgagaaccccguccuccagcagcacuuccgcaaccucgaggcccucgcccucgaccucauggagcccgagcaggccgucgaccucacccuccccaaggucgaggccaugaacaagcgccucggcucccucgucgacgaguucaaggagcucgucuacccccccgacuacaaccccgagggcaaggucaccaagcgcaagcacgacaacgagggcuccggcuccaagcgccccaaggucgaguacuccgaggaggagcucaagacccacaucuccaagggcacccucggcaaguucaccguccccaugcucaaggaggccugccgcgccuacggccucaaguccggccucaagaagcaggagcuccucgaggcccucaccaagcacuuccaggacuga

SEQ ID NO: 51860 - RNA, 5085 nt, Artificial Sequence
  derived and/or modified sequence opt2 from XRN1__Homo_sapiens__NP_001269786
augggcguccccaaguucuaccgcuggaucuccgagcgcuaccccugccucuccgaggucgucaaggagcaccagauccccgaguucgacaaccucuaccucgacaugaacggcaucauccaccagugcucccaccccaacgacgacgacguccacuuccgcaucuccgacgacaagaucuucaccgacaucuuccacuaccucgagguccucuuccgcaucaucaagccccgcaaggucuucuucauggccgucgacggcgucgccccccgcgccaagaugaaccagcagcgcggccgccgcuuccgcuccgccaaggaggccgaggacaagaucaagaaggccaucgagaagggcgagacccuccccaccgaggcccgcuucgacuccaacugcaucacccccggcaccgaguucauggcccgccuccacgagcaccucaaguacuucgucaacaugaagaucuccaccgacaaguccuggcagggcgucaccaucuacuucuccggccacgagacccccggcgagggcgagcacaagaucauggaguucauccgcuccgagaaggccaagcccgaccacgaccccaacacccgccacugccucuacggccucgacgccgaccucaucaugcucggccucaccucccacgaggcccacuucucccuccuccgcgaggagguccgcuucggcggcaagaagacccagcgcgucugcgcccccgaggagaccaccuuccaccuccuccaccucucccucaugcgcgaguacaucgacuacgaguucuccguccucaaggagaagaucaccuucaaguacgacaucgagcgcaucaucgacgacuggauccucaugggcuuccucgucggcaacgacuucaucccccaccucccccaccuccacaucaaccacgacgcccucccccuccucuacggcaccuacgucaccauccuccccgagcucggcggcuacaucaacgaguccggccaccucaaccucccccgcuucgagaaguaccucgucaagcucuccgacuucgaccgcgagcacuucuccgaggucuucgucgaccucaagugguucgaguccaaggucggcaacaaguaccucaacgaggccgccggcgucgccgccgaggaggcccgcaacuacaaggagaagaagaagcucaagggccaggagaacucccucugcuggaccgcccucgacaagaacgagggcgagaugaucaccuccaaggacaaccucgaggacgagaccgaggacgacgaccucuucgagaccgaguuccgccaguacaagcgcaccuacuacaugaccaagaugggcgucgacgucgucuccgacgacuuccucgccgaccaggccgccugcuacguccaggccauccaguggauccuccacuacuacuaccacggcguccaguccugguccugguacuaccccuaccacuacgcccccuuccucuccgacauccacaacaucuccacccucaagauccacuucgagcucggcaagcccuucaagcccuucgagcagcuccucgccguccuccccgccgccuccaagaaccuccuccccgccugcuaccagcaccucaugaccaacgaggacucccccaucaucgaguacuacccccccgacuucaagaccgaccucaacggcaagcagcaggagugggaggccgucguccucauccccuucaucgacgagaagcgccuccucgaggccauggagaccugcaaccacucccucaagaaggaggagcgcaagcgcaaccagcacuccgagugccucaugugcugguacgaccgcgacaccgaguucaucuaccccucccccuggcccgagaaguuccccgccaucgagcgcugcugcacccgcuacaagaucaucucccucgacgccuggcgcgucgacaucaacaagaacaagaucacccgcaucgaccagaaggcccucuacuucugcggcuuccccacccucaagcacauccgccacaaguucuuccucaagaaguccggcguccaggucuuccagcaguccucccgcggcgagaacaugaugcucgagauccucgucgacgccgaguccgacgagcucaccgucgagaacgucgccuccuccguccucggcaaguccgucuucgucaacuggccccaccucgaggaggcccgcgucgucgccgucuccgacggcgagaccaaguucuaccucgaggagccccccggcacccagaagcucuacuccggccgcaccgccccccccuccaaggucguccaccucggcgacaaggagcaguccaacugggccaaggagguccagggcaucuccgagcacuaccuccgccgcaagggcaucaucaucaacgagaccuccgccgucgucuacgcccagcuccucaccggccgcaaguaccagaucaaccagaacggcgagguccgccucgagaagcagugguccaagcaggucguccccuucgucuaccagaccaucgucaaggacauccgcgccuucgacucccgcuucuccaacaucaagacccucgacgaccucuucccccuccgcuccauggucuucaugcucggcacccccuacuacggcugcaccggcgagguccaggacuccggcgacgucaucaccgagggccgcauccgcgucaucuucuccauccccugcgagcccaaccucgacgcccucauccagaaccagcacaaguacuccaucaaguacaaccccggcuacguccucgccucccgccucggcgucuccggcuaccucgucucccgcuucaccggcuccaucuucaucggccgcggcucccgccgcaacccccacggcgaccacaaggccaacgucggccucaaccucaaguucaacaagaagaacgaggagguccccggcuacaccaagaaggucggcuccgaguggauguacuccuccgccgccgagcagcuccucgccgaguaccucgagcgcgcccccgagcucuucuccuacaucgccaagaacucccaggaggacgucuucuacgaggacgacaucuggcccggcgagaacgagaacggcgccgagaagguccaggagaucaucaccuggcucaagggccaccccgucuccacccucucccgcuccuccugcgaccuccagauccucgacgccgccaucgucgagaagaucgaggaggaggucgagaagugcaagcagcgcaagaacaacaagaagguccgcgucaccgucaagccccaccuccucuaccgcccccucgagcagcagcacggcgucauccccgaccgcgacgccgaguucugccucuucgaccgcgucgucaacguccgcgagaacuucuccguccccgucggccuccgcggcaccaucaucggcaucaagggcgccaaccgcgaggccgacguccucuucgagguccucuucgacgaggaguuccccggcggccucaccauccgcugcucccccggccgcggcuaccgccuccccaccuccgcccucgucaaccucucccacggcucccgcuccgagaccggcaaccagaagcucaccgccaucgucaagccccagcccgccguccaccagcacuccuccuccuccuccgucuccuccggccaccucggcgcccucaaccacuccccccagucccucuucguccccacccagguccccaccaaggacgacgacgaguucugcaacaucuggcagucccuccagggcuccggcaagaugcaguacuuccagcccaccauccaggagaagggcgccguccucccccaggagaucucccaggucaaccagcaccacaaguccggcuucaacgacaacuccgucaaguaccagcagcgcaagcacgacccccaccgcaaguucaaggaggagugcaagucccccaaggccgagugcuggucccagaagauguccaacaagcagcccaacuccggcaucgagaacuuccucgccucccucaacaucuccaaggagaacgagguccaguccucccaccacggcgagccccccuccgaggagcaccucuccccccaguccuucgccaugaagggcacccgcaugcucaaggagauccucaagaucgacggcuccaacaccgucgaccacaagaacgagaucaagcagaucgccaacgagauccccgucuccuccaaccgccgcgacgaguacggccuccccucccagcccaagcagaacaagaagcucgccuccuacaugaacaagccccacuccgccaacgaguaccacaacguccaguccauggacaacaugugcuggcccgcccccucccagaucccccccgucuccacccccgucaccgagcucucccgcaucugcucccucgucggcaugccccagcccgacuucuccuuccuccgcaugccccagaccaugaccgucugccaggucaagcucuccaacggccuccucguccacggcccccagugccacuccgagaacgaggccaaggagaaggccgcccucuucgcccuccagcagcucggcucccucggcaugaacuucccccuccccucccaggucuucgccaacuaccccuccgccgucccccccggcaccaucccccccgccuuccccccccccaccgccaacaucaugcccuccuccucccaccucuucggcuccaugcccuggggccccuccguccccguccccggcaagcccuuccaccacacccucuacuccggcaccaugcccauggccggcggcauccccggcggcguccacaaccaguucaucccccuccaggucaccaagaagcgcgucgccaacaagaagaacuucgagaacaaggaggcccaguccucccaggccacccccguccagaccucccagcccgacuccuccaacaucgucaaggucuccccccgcgaguccuccuccgccucccucaaguccucccccaucgcccagcccgccuccuccuuccaggucgagaccgccucccagggccacuccaucucccaccacaaguccacccccaucuccuccucccgccgcaagucccgcaagcucgccgucaacuucggcgucuccaagcccuccgaguga

SEQ ID NO: 51861 - RNA, 2853 nt, Artificial Sequence
  derived and/or modified sequence opt2 from XRN2__Homo_sapiens__NP_036387
augggcguccccgccuucuuccgcuggcucucccgcaaguaccccuccaucaucgucaacugcgucgaggagaagcccaaggagugcaacggcgucaagauccccgucgacgccuccaagcccaaccccaacgacgucgaguucgacaaccucuaccucgacaugaacggcaucauccaccccugcacccaccccgaggacaagcccgcccccaagaacgaggacgagaugauggucgccaucuucgaguacaucgaccgccucuucuccaucguccgcccccgccgccuccucuacauggccaucgacggcgucgccccccgcgccaagaugaaccagcagcgcucccgccgcuuccgcgccuccaaggagggcauggaggccgccgucgagaagcagcgcguccgcgaggagauccucgccaagggcggcuuccucccccccgaggagaucaaggagcgcuucgacuccaacugcaucacccccggcaccgaguucauggacaaccucgccaagugccuccgcuacuacaucgccgaccgccucaacaacgaccccggcuggaagaaccucaccgucauccucuccgacgccuccgcccccggcgagggcgagcacaagaucauggacuacauccgccgccagcgcgcccagcccaaccacgaccccaacacccaccacugccucugcggcgccgacgccgaccucaucaugcucggccucgccacccacgagcccaacuucaccaucauccgcgaggaguucaagcccaacaagcccaagcccugcggccucugcaaccaguucggccacgaggucaaggacugcgagggccucccccgcgagaagaagggcaagcacgacgagcucgccgacucccuccccugcgccgagggcgaguucaucuuccuccgccucaacguccuccgcgaguaccucgagcgcgagcucaccauggccucccuccccuucaccuucgacgucgagcgcuccaucgacgacugggucuucaugugcuucuucgucggcaacgacuuccucccccaccuccccucccucgagauccgcgagaacgccaucgaccgccucgucaacaucuacaagaacgucguccacaagaccggcggcuaccucaccgaguccggcuacgucaaccuccagcgcguccagaugaucaugcucgccgucggcgaggucgaggacuccaucuucaagaagcgcaaggacgacgaggacuccuuccgccgccgccagaaggagaagcgcaagcgcaugaagcgcgaccagcccgccuucacccccuccggcauccucaccccccacgcccucggcucccgcaacucccccggcucccaggucgccuccaacccccgccaggccgccuacgagaugcgcaugcagaacaacuccucccccuccaucucccccaacaccuccuucaccuccgacggcucccccuccccccucggcggcaucaagcgcaaggccgaggacuccgacuccgagcccgagcccgaggacaacguccgccucugggaggccggcuggaagcagcgcuacuacaagaacaaguucgacgucgacgccgccgacgagaaguuccgccgcaaggucguccaguccuacgucgagggccucugcuggguccuccgcuacuacuaccagggcugcgccuccuggaagugguacuaccccuuccacuacgcccccuucgccuccgacuucgagggcaucgccgacaugcccuccgacuucgagaagggcaccaagcccuucaagccccucgagcagcucaugggcgucuuccccgccgccuccggcaacuuccucccccccuccuggcgcaagcucauguccgaccccgacuccuccaucaucgacuucuaccccgaggacuucgccaucgaccucaacggcaagaaguacgccuggcagggcgucgcccuccuccccuucgucgacgagcgccgccuccgcgccgcccucgaggaggucuaccccgaccucacccccgaggagacccgccgcaacucccucggcggcgacguccucuucgucggcaagcaccacccccuccacgacuucauccucgagcucuaccagaccggcuccaccgagcccgucgaggucccccccgagcucugccacggcauccagggcaaguucucccucgacgaggaggccauccuccccgaccagaucgucugcucccccguccccaugcuccgcgaccucacccagaacaccgucgucuccaucaacuucaaggacccccaguucgccgaggacuacaucuucaaggccgucaugcuccccggcgcccgcaagcccgccgccguccucaagcccuccgacugggagaaguccuccaacggccgccaguggaagccccagcucggcuucaaccgcgaccgccgccccguccaccucgaccaggccgccuuccgcacccucggccacgucaugccccgcggcuccggcaccggcaucuacuccaacgccgcccccccccccgucaccuaccagggcaaccucuaccgcccccuccuccgcggccaggcccagauccccaagcucauguccaacaugcgcccccaggacuccuggcgcggcccccccccccucuuccagcagcagcgcuucgaccgcggcgucggcgccgagccccuccuccccuggaaccgcaugcuccagacccagaacgccgccuuccagcccaaccaguaccagaugcucgccggccccggcggcuaccccccccgccgcgacgaccgcggcggccgccagggcuacccccgcgagggccgcaaguacccccuccccccccccuccggccgcuacaacuggaacuga

SEQ ID NO: 51862 - RNA, 1797 nt, Artificial Sequence
  derived and/or modified sequence opt2 from XRRA1__Homo_sapiens__NP_001257309
auggccuucuccggcaucuacaagcucgacgacggcaagcccuaccucaacaacugcuuccccgcccgcaaccuccuccgcguccccgaggagggccagggccacuggcucgucguccagaagggcaaccucaagaagaagcccaagggccucgucggcgcccaggccgagcgccgcgagucccucaaggccaccuccuucgaguucaagggcaagaaggagucccgccgcgagaaccaggucgaccuccccggccacauccucgaccaggccuuccuccucaagcaccacugcguccgcaagcccuccgaccucugcaccaucaacgccaaggagaacgacuucaagcacuuccacuccgucaucuacaucaacgccuccgagaaccuccucccccucgaggccuuccacaccuuccccgcccucaaggagcucgaccucgccuucaacggcaucaagaccaucuacgucaaguacggcgacuucaagcuccucgaguuccucgaccucuccuucaacucccucaccgucgaggccaucugcgaccucggcauccucccccaccuccgcguccuccuccucaccggcaacggccucaccucccucccccccaaccucgccgucgccgagcaggaggccuccgucaccucccucaccuccaagcgcuacauccuccgcuuccccgcccucgagacccucaugcucgacgacaaccgccucuccaaccccuccugcuucgccucccucgccggccuccgccgccucaagaagcucucccucgacgagaaccgcaucauccgcauccccuaccuccagcagguccagcucuacgacgaguccgucgacuggaacggcggccgcggcuccccccacaaggagccccaguucaugcuccaguccaagccccgcaugcucgaggacuccgacgagcagcucgacuacaccguccuccccaugaagaaggacgucgaccgcaccggcguccccccccuccucaaguccuuccuccaggagcgccucggcauccaccucauccgccgcaagaucgucaagcccaagcaccacguccucaugucccgcaaggaguccuggaaggucaaguccgagauccccaagguccccaagcagccccucguccuccaccacccccgcaugaccaccaccaagucccccuccaaggacaugcucgagcccgaggccgagcucgccgaggaccuccccaccaccaaguccaccuccgucgaguccgagaugcccaccgagaaccucgagggccacucccccuccugccgcaccuucgucccccucccccccaucugcuccaacuccaccguccacuccgaggagacccucucccaccucuccgacaccaccguccgccucucccccgagcgccccuccgacgaggacuccaaguccaccgaguccaucuuccucacccaggucuccgagcuccccuccuccgucauccacaaggacgaccucgagcucaaggagaaggaccagaagaagccccccaccgccccccgcgaggucaagggcacccgccgcaagcuccccaccgccuuccuccccuccaaguaccacggcuacgaggagcuccucaccgccaagcccgaccccgccuucaucgagcccaagggcauccagaagaacgcccaggcccuccagcagaugcucaagcacccccuccucugccacuccuccaagcccaagcucgacacccuccagaagcccuacguccacaaggagaagcgcguccucuccugcaccuccggccagaacggcggcugguga

SEQ ID NO: 51863 - RNA, 1182 nt, Artificial Sequence
  derived and/or modified sequence opt2 from XXYLT1__Homo_sapiens__NP_689744
augggccuccuccgcggcggccuccccugcgcccgcgccauggcccgccucggcgccguccgcucccacuacugcgcccuccuccucgccgccgcccucgccgucugcgccuucuacuaccucggcuccggccgcgagaccuucuccuccgccaccaagcgccucaaggaggcccgcgccggcgcccccgccgcccccuccccccccgcccucgagcucgcccgcggcuccgucgcccccgcccccggcgccaaggccaagucccucgagggcggcggcgccggccccgucgacuaccaccuccucaugauguucaccaaggccgagcacaacgccgcccuccaggccaaggcccgcgucgcccuccgcucccuccuccgccucgccaaguucgaggcccacgagguccucaaccuccacuucgucuccgaggaggccucccgcgaggucgccaagggccuccuccgcgagcuccucccccccgccgccggcuucaagugcaaggucaucuuccacgacgucgccguccucaccgacaagcucuuccccaucgucgaggccaugcagaagcacuucuccgccggccucggcaccuacuacuccgacuccaucuucuuccucuccgucgccaugcaccagaucaugcccaaggagauccuccagaucauccagcucgaccucgaccucaaguucaagaccaacauccgcgagcucuucgaggaguucgacuccuuccuccccggcgccaucaucggcaucgcccgcgagaugcagcccgucuaccgccacaccuucuggcaguuccgccacgagaacccccagacccgcgucggcggccccccccccgagggccuccccggcuucaacuccggcgucaugcuccucaaccucgaggccaugcgccaguccccccucuacucccgccuccucgagcccgcccagguccagcagcucgccgacaaguaccacuuccgcggccaccucggcgaccaggacuucuucaccaugaucggcauggagcaccccaagcucuuccacguccucgacugcaccuggaaccgccagcucugcaccugguggcgcgaccacggcuacuccgacgucuucgaggccuacuuccgcugcgagggccacgucaagaucuaccacggcaacugcaacacccccauccccgaggacuga

SEQ ID NO: 51864 - RNA, 1611 nt, Artificial Sequence
  derived and/or modified sequence opt2 from XYLB__Homo_sapiens__NP_005099
auggccgagcacgccccccgccgcugcugccucggcugggacuucuccacccagcaggucaaggucgucgccgucgacgccgagcucaacgucuucuacgaggaguccguccacuucgaccgcgaccuccccgaguucggcacccagggcggcguccacguccacaaggacggccucaccgucaccucccccguccucauguggguccaggcccucgacaucauccucgagaagaugaaggccuccggcuucgacuucucccagguccucgcccucuccggcgccggccagcagcacggcuccaucuacuggaaggccggcgcccagcaggcccucaccucccucucccccgaccuccgccuccaccagcagcuccaggacugcuucuccaucuccgacugccccgucuggauggacuccuccaccaccgcccagugccgccagcucgaggccgccgucggcggcgcccaggcccucuccugccucaccggcucccgcgccuacgagcgcuucaccggcaaccagaucgccaagaucuaccagcagaaccccgaggccuacucccacaccgagcgcaucucccucgucuccuccuucgccgccucccucuuccucggcuccuacucccccaucgacuacuccgacggcuccggcaugaaccuccuccagauccaggacaaggucuggucccaggccugccucggcgccugcgccccccaccucgaggagaagcucuccccccccguccccuccugcuccgucgucggcgccaucuccuccuacuacguccagcgcuacggcuucccccccggcugcaaggucgucgccuucaccggcgacaaccccgccucccucgccggcaugcgccucgaggagggcgacaucgccgucucccucggcaccuccgacacccucuuccucuggcuccaggagcccaugcccgcccucgagggccacaucuucugcaaccccgucgacucccagcacuacauggcccuccucugcuucaagaacggcucccucaugcgcgagaagauccgcaacgaguccgucucccgcuccugguccgacuucuccaaggcccuccaguccaccgagaugggcaacggcggcaaccucggcuucuacuucgacgucauggagaucacccccgagaucaucggccgccaccgcuucaacaccgagaaccacaaggucgccgccuuccccggcgacgucgagguccgcgcccucaucgagggccaguucauggccaagcgcauccacgccgagggccucggcuaccgcgucauguccaagaccaagauccucgccaccggcggcgccucccacaaccgcgagauccuccagguccucgccgacgucuucgacgcccccgucuacgucaucgacaccgccaacuccgccugcgucggcuccgccuaccgcgccuuccacggccucgccggcggcaccgacguccccuucuccgaggucgucaagcucgcccccaacccccgccucgccgccacccccucccccggcgccucccaggucuacgaggcccuccucccccaguacgccaagcucgagcagcgcauccucucccagacccgcggcccccccgaguga

SEQ ID NO: 51865 - RNA, 2880 nt, Artificial Sequence
  derived and/or modified sequence opt2 from XYLT1__Homo_sapiens__NP_071449
auggucgccgcccccugcgcccgccgccucgcccgccgcucccacuccgcccuccucgccgcccucaccguccuccuccuccagacccucgucgucuggaacuucuccucccucgacuccggcgccggcgagcgccgcggcggcgccgccgucggcggcggcgagcagcccccccccgcccccgccccccgccgcgagcgccgcgaccuccccgccgagcccgccgccgcccgcggcggcggcggcggcggcggcggcggcggcggcggccgcggcccccaggcccgcgcccgcggcggcggccccggcgagccccgcggccagcagcccgccucccgcggcgcccuccccgcccgcgcccucgacccccaccccuccccccucaucacccucgagacccaggacggcuacuucucccaccgccccaaggagaagguccgcaccgacuccaacaacgagaacuccguccccaaggacuucgagaacgucgacaacuccaacuucgccccccgcacccagaagcagaagcaccagcccgagcucgccaagaagccccccucccgccagaaggagcuccucaagcgcaagcucgagcagcaggagaagggcaagggccacaccuuccccggcaagggccccggcgagguccucccccccggcgaccgcgccgccgccaacuccucccacggcaaggacgucucccgccccccccacgcccgcaagaccggcggcuccucccccgagaccaaguacgaccagccccccaagugcgacaucuccggcaaggaggccaucuccgcccucucccgcgccaaguccaagcacugccgccaggagaucggcgagaccuacugccgccacaagcucggccuccucaugcccgagaaggucacccgcuucugcccccucgagggcaaggccaacaagaacguccagugggacgaggacuccgucgaguacaugcccgccaaccccguccgcaucgccuucguccucgucguccacggccgcgccucccgccagcuccagcgcauguucaaggccaucuaccacaaggaccacuucuacuacauccacgucgacaagcgcuccaacuaccuccaccgccagguccuccaggucucccgccaguacuccaacguccgcgucacccccuggcgcauggccaccaucuggggcggcgccucccuccucuccaccuaccuccaguccaugcgcgaccuccucgagaugaccgacuggcccugggacuucuucaucaaccucuccgccgccgacuaccccauccgcaccaacgaccagcucgucgccuuccucucccgcuaccgcgacaugaacuuccucaagucccacggccgcgacaacgcccgcuucauccgcaagcagggccucgaccgccucuuccucgagugcgacgcccacauguggcgccucggcgaccgccgcauccccgagggcaucgccgucgacggcggcuccgacugguuccuccucaaccgccgcuucgucgaguacgucaccuucuccaccgacgaccucgucaccaagaugaagcaguucuacuccuacacccuccuccccgccgaguccuucuuccacaccguccucgagaacuccccccacugcgacaccauggucgacaacaaccuccgcaucaccaacuggaaccgcaagcucggcugcaagugccaguacaagcacaucgucgacuggugcggcugcucccccaacgacuucaagccccaggacuuccaccgcuuccagcagaccgcccgccccaccuucuucgcccgcaaguucgaggccgucgucaaccaggagaucaucggccagcucgacuacuaccucuacggcaacuaccccgccggcacccccggccuccgcuccuacugggagaacgucuacgacgagcccgacggcauccacucccucuccgacgucacccucacccucuaccacuccuucgcccgccucggccuccgccgcgccgagaccucccuccacaccgacggcgagaacuccugccgcuacuaccccaugggccaccccgccuccguccaccucuacuuccucgccgaccgcuuccagggcuuccucaucaagcaccacgccaccaaccucgccgucuccaagcucgagacccucgagaccugggucaugcccaagaaggucuucaagaucgccuccccccccuccgacuucggccgccuccaguucuccgaggucggcaccgacugggacgccaaggagcgccucuuccgcaacuucggcggccuccucggccccauggacgagcccgucggcaugcagaaguggggcaagggccccaacgucaccgucaccgucaucugggucgaccccgucaacgucaucgccgccaccuacgacauccucaucgaguccaccgccgaguucacccacuacaagcccccccucaaccucccccuccgccccggcgucuggaccgucaagauccuccaccacuggguccccgucgccgagaccaaguuccucgucgccccccucaccuucuccaaccgccagcccaucaagcccgaggaggcccucaagcuccacaacggcccccuccgcaacgccuacauggagcaguccuuccagucccucaaccccguccucucccuccccaucaaccccgcccaggucgagcaggcccgccgcaacgccgccuccaccggcaccgcccucgagggcuggcucgacucccucgucggcggcauguggaccgccauggacaucugcgccaccggccccaccgccugccccgucaugcagaccugcucccagaccgccugguccuccuucucccccgaccccaaguccgagcucggcgccgucaagcccgacggccgccuccgcuga

SEQ ID NO: 51866 - RNA, 2598 nt, Artificial Sequence
  derived and/or modified sequence opt2 from XYLT2__Homo_sapiens__NP_071450
auggucgccuccgcccgcguccagaagcucguccgccgcuacaagcucgccaucgccaccgcccucgccauccuccuccuccagggccucgucgucugguccuucuccggccucgaggaggacgaggccggcgagaagggccgccagcgcaagccccgcccccucgaccccggcgagggcuccaaggacaccgacuccuccgccggccgccgcggcuccaccggccgccgccacggccgcuggcgcggccgcgccgagucccccggcguccccgucgccaaggucguccgcgccgucaccucccgccagcgcgccucccgccgcgucccccccgcccccccccccgaggcccccggccgccagaaccucuccggcgccgccgccggcgaggcccucgucggcgccgccggcuuccccccccacggcgacaccggcuccgucgagggcgccccccagcccaccgacaacggcuucacccccaagugcgagaucgucggcaaggacgcccucuccgcccucgcccgcgccuccaccaagcagugccagcaggagaucgccaacgucgucugccuccaccaggccggcucccucaugcccaaggccgucccccgccacugccagcucaccggcaagaugucccccggcauccagugggacgagucccaggcccagcagcccauggacggcccccccguccgcaucgccuacaugcucgucguccacggccgcgccauccgccagcucaagcgccuccucaaggccgucuaccacgagcagcacuucuucuacauccacgucgacaagcgcuccgacuaccuccaccgcgaggucgucgagcucgcccagggcuacgacaacguccgcgucacccccuggcgcauggucaccaucuggggcggcgccucccuccuccgcauguaccuccgcuccaugcgcgaccuccucgagguccccggcugggccugggacuucuucaucaaccucuccgccaccgacuaccccacccgcaccaacgaggagcucgucgccuuccucuccaagaaccgcgacaagaacuuccucaagucccacggccgcgacaacucccgcuucaucaagaagcagggccucgaccgccucuuccacgagugcgacucccacauguggcgccucggcgagcgccagauccccgccggcaucgucgucgacggcggcuccgacugguucguccucacccgcuccuucgucgaguacgucgucuacaccgacgacccccucgucgcccagcuccgccaguucuacaccuacacccuccuccccgccgaguccuucuuccacaccguccucgagaacucccucgccugcgagacccucgucgacaacaaccuccgcgucaccaacuggaaccgcaagcucggcugcaagugccaguacaagcacaucgucgacuggugcggcugcucccccaacgacuucaagccccaggacuuccuccgccuccagcaggucucccgccccaccuucuucgcccgcaaguucgaguccaccgucaaccaggagguccucgagauccucgacuuccaccucuacggcuccuacccccccggcacccccgcccucaaggccuacugggagaacaccuacgacgccgccgacggccccuccggccucuccgacgucaugcucaccgccuacaccgccuucgcccgccucucccuccaccacgccgccaccgccgccccccccaugggcaccccccucugccgcuucgagccccgcggccuccccuccuccguccaccucuacuucuacgacgaccacuuccagggcuaccucgucacccaggccguccagcccuccgcccagggccccgccgagacccucgagauguggcucaugccccagggcucccucaagcuccucggccgcuccgaccaggccucccgccuccagucccucgaggucggcaccgacugggaccccaaggagcgccucuuccgcaacuucggcggccuccucggcccccucgacgagcccgucgccguccagcgcugggcccgcggccccaaccucaccgccaccgucgucuggaucgaccccaccuacgucgucgccaccuccuacgacaucaccgucgacaccgagaccgaggucacccaguacaagcccccccucucccgcccccuccgccccggccccuggaccguccgccuccuccaguucugggagccccucggcgagacccgcuuccucguccucccccucaccuucaaccgcaagcucccccuccgcaaggacgacgccuccuggcuccacgccggccccccccacaacgaguacauggagcaguccuuccagggccucuccuccauccucaaccucccccagcccgagcucgccgaggaggccgcccagcgccacacccagcucaccggccccgcccucgaggccuggaccgaccgcgagcucuccuccuucugguccgucgccggccucugcgccaucggccccucccccugccccucccucgagcccugccgccucaccuccugguccucccucucccccgaccccaaguccgagcucggccccgucaaggccgacggccgccuccgcuga

SEQ ID NO: 51867 - RNA, 621 nt, Artificial Sequence
  derived and/or modified sequence opt2 from YAE1D1__Homo_sapiens__NP_001269375
auguccuggguccaggccgccucccucauccagggccccggcgacaagggcgacgucuucgacgaggaggccgacgagucccuccucgcccagcgcgaguggcaguccaacaugcagcgccgcgucaaggagggcuaccgcgacggcaucgacgccggcaaggccgucacccuccagcagggcuucaaccagggcuacaagaagggcgccgaggucauccucaacuacggccgccuccgcggcacccuccgcaacuccaccgacuggucccuccucggccuccgcgccccccuccgcucccccgaggucggcacccagcuccucccccgcccccuccccguccccggccacauggccuccggcgccacccccaagcagcccaccgagcucgaggccacccuccucucccucgucccccaguccggccgcgccaccccccgcuuccccgcccgccuccgcgcccccggccccggcacccccucccaccgccgccgcuuccgccgcaagccccaccgcgaccccgccgccgccugccccgccuggccccccgaggcccccuccaacuccgagacccacuucuccaccuacaaccgcaucaucauccgcggcggccacaucuga

SEQ ID NO: 51868 - RNA, 1515 nt, Artificial Sequence
  derived and/or modified sequence opt2 from YAP1__Homo_sapiens__NP_001123617
auggaccccggccagcagccccccccccagcccgccccccagggccagggccagccccccucccagcccccccagggccagggcccccccuccggccccggccagcccgcccccgccgccacccaggccgccccccaggccccccccgccggccaccagaucguccacguccgcggcgacuccgagaccgaccucgaggcccucuucaacgccgucaugaaccccaagaccgccaacgucccccagaccguccccaugcgccuccgcaagcuccccgacuccuucuucaagccccccgagcccaagucccacucccgccaggccuccaccgacgccggcaccgccggcgcccucaccccccagcacguccgcgcccacuccucccccgccucccuccagcucggcgccgucucccccggcacccucacccccaccggcgucgucuccggccccgccgccacccccaccgcccagcaccuccgccaguccuccuucgagauccccgacgacgucccccuccccgccggcugggagauggccaagaccuccuccggccagcgcuacuuccucaaccacaucgaccagaccaccaccuggcaggacccccgcaaggccaugcucucccagaugaacgucaccgcccccaccuccccccccguccagcagaacaugaugaacuccgccuccggcccccuccccgacggcugggagcaggccaugacccaggacggcgagaucuacuacaucaaccacaagaacaagaccaccuccuggcucgacccccgccucgacccccgcuucgccaugaaccagcgcaucucccaguccgcccccgucaagcagccccccccccucgccccccaguccccccagggcggcgucaugggcggcuccaacuccaaccagcagcagcagaugcgccuccagcagcuccagauggagaaggagcgccuccgccucaagcagcaggagcuccuccgccaggccaugcgcaacaucaaccccuccaccgccaacucccccaagugccaggagcucgcccuccgcucccagcuccccacccucgagcaggacggcggcacccagaaccccgucuccucccccggcaugucccaggagcuccgcaccaugaccaccaacuccuccgaccccuuccucaacuccggcaccuaccacucccgcgacgaguccaccgacuccggccucuccauguccuccuacuccgucccccgcacccccgacgacuuccucaacuccgucgacgagauggacaccggcgacaccaucaaccaguccacccuccccucccagcagaaccgcuuccccgacuaccucgaggccauccccggcaccaacgucgaccucggcacccucgagggcgacggcaugaacaucgagggcgaggagcucaugcccucccuccaggaggcccucuccuccgacauccucaacgacauggaguccguccucgccgccaccaagcucgacaaggaguccuuccucaccuggcucuga

SEQ ID NO: 51869 - RNA, 1434 nt, Artificial Sequence
  derived and/or modified sequence opt2 from YARS2__Homo_sapiens__NP_001035526
auggccgcccccauccuccgcuccuucuccuggggccgcugguccggcacccucaaccucuccguccuccucccccucggccuccgcaaggcccacuccggcgcccagggccuccucgccgcccagaaggcccgcggccucuucaaggacuucuuccccgagaccggcaccaagaucgagcuccccgagcucuucgaccgcggcaccgccuccuucccccagaccaucuacugcggcuucgaccccaccgccgacucccuccacgucggccaccuccucgcccuccucggccucuuccaccuccagcgcgccggccacaacgucaucgcccucgucggcggcgccaccgcccgccucggcgaccccuccggccgcaccaaggagcgcgaggcccucgagaccgagcgcguccgcgccaacgcccgcgcccuccgccucggccucgaggcccucgccgccaaccaccagcagcucuucaccgacggccgcuccuggggcuccuucaccguccucgacaacuccgccugguaccagaagcagcaccucgucgacuuccucgccgccgucggcggccacuuccgcaugggcacccuccucucccgccaguccguccagcuccgccucaagucccccgagggcaugucccucgccgaguucuucuaccagguccuccaggccuacgacuucuacuaccucuuccagcgcuacggcugccgcguccagcucggcggcuccgaccagcucggcaacaucauguccggcuacgaguucaucaacaagcucaccggcgaggacgucuucggcaucaccgucccccucaucaccuccaccaccggcgccaagcucggcaaguccgccggcaacgccgucuggcucaaccgcgacaagaccucccccuucgagcucuaccaguucuucguccgccagcccgacgacuccgucgagcgcuaccucaagcucuucaccuuccucccccuccccgagaucgaccacaucaugcagcuccacgucaaggagcccgagcgccgcggcccccagaagcgccucgccgccgaggucaccaagcucguccacggccgcgagggccucgacuccgccaagcgcugcacccaggcccucuaccacuccuccaucgacgcccucgaggucauguccgaccaggagcucaaggagcucuucaaggaggcccccuucuccgaguucuuccucgaccccggcaccuccguccucgacaccugccgcaaggccaacgccauccccgacggcccccgcggcuaccgcaugaucaccgagggcggcgucuccaucaaccaccagcaggucaccaaccccgaguccguccucaucgucggccagcacauccucaagaacggccucucccuccucaagaucggcaagcgcaacuucuacaucaucaaguggcuccagcucuga

SEQ ID NO: 51870 - RNA, 1095 nt, Artificial Sequence
  derived and/or modified sequence opt2 from YBX2__Homo_sapiens__NP_057066
auguccgaggucgaggccgccgccggcgccaccgccguccccgccgccaccguccccgccaccgccgccggcgucgucgccgucgucguccccguccccgccggcgagccccagaagggcggcggcgccggcggcggcggcggcgccgccuccggccccgccgccggcacccccuccgcccccggcucccgcacccccggcaaccccgccaccgccgucuccggcacccccgccccccccgcccgcucccaggccgacaagcccguccucgccauccagguccucggcaccgucaagugguucaacguccgcaacggcuacggcuucaucaaccgcaacgacaccaaggaggacgucuucguccaccagaccgccaucaagcgcaacaacccccgcaaguuccuccgcuccgucggcgacggcgagaccgucgaguucgacgucgucgagggcgagaagggcgccgaggccaccaacgucaccggccccggcggcguccccgucaagggcucccgcuacgcccccaaccgccgcaagucccgccgcuucaucccccgcccccccuccgucgcccccccccccauggucgccgagauccccuccgccggcaccggccccggcuccaagggcgagcgcgccgaggacuccggccagcgcccccgccgcuggugccccccccccuucuucuaccgccgccgcuucguccgcggcccccgcccccccaaccagcagcagcccaucgagggcaccgaccgcgucgagcccaaggagaccgccccccucgagggccaccagcagcagggcgacgagcgcgucccccccccccgcuuccgcccccgcuaccgccgccccuuccgcccccgcccccgccagcagcccaccaccgagggcggcgacggcgagaccaagcccucccagggccccgccgacggcucccgccccgagccccagcgcccccgcaaccgccccuacuuccagcgccgccgccagcaggcccccggcccccagcaggcccccggcccccgccagcccgccgcccccgagaccuccgcccccgucaacuccggcgaccccaccaccaccauccucgaguga

SEQ ID NO: 51871 - RNA, 912 nt, Artificial Sequence
  derived and/or modified sequence opt2 from YBX3__Homo_sapiens__NP_001138898
auguccgaggccggcgaggccaccaccaccaccaccaccacccucccccaggcccccaccgaggccgccgccgccgccccccaggaccccgcccccaagucccccgucggcuccggcgccccccaggccgccgcccccgcccccgccgcccacgucgccggcaaccccggcggcgacgccgcccccgccgccaccggcaccgccgccgccgccucccucgccaccgccgccggcuccgaggacgccgagaagaagguccucgccaccaagguccucggcaccgucaagugguucaacguccgcaacggcuacggcuucaucaaccgcaacgacaccaaggaggacgucuucguccaccagaccgccaucaagaagaacaacccccgcaaguaccuccgcuccgucggcgacggcgagaccgucgaguucgacgucgucgagggcgagaagggcgccgaggccgccaacgucaccggccccgacggcguccccgucgagggcucccgcuacgccgccgaccgccgccgcuaccgccgcggcuacuacggccgccgccgcggccccccccgcaacgccggcgagaucggcgagaugaaggacggcguccccgagggcgcccagcuccagggccccguccaccgcaaccccaccuaccgcccccgcuaccgcucccgcggccccccccgcccccgccccgcccccgccgucggcgaggccgaggacaaggagaaccagcaggccaccuccggccccaaccagcccuccguccgccgcggcuaccgccgccccuacaacuaccgccgccgcccccgcccccccaacgcccccucccaggacggcaaggaggccaaggccggcgaggcccccaccgagaaccccgccccccccacccagcaguccuccgccgaguga

SEQ ID NO: 51872 - RNA, 972 nt, Artificial Sequence
  derived and/or modified sequence opt2 from YDJC__Homo_sapiens__NP_001017964
augucccgcccccgcaugcgccucgucgucaccgccgacgacuucggcuacugcccccgccgcgacgagggcaucgucgaggccuuccucgccggcgccgucaccuccgucucccuccucgucaacggcgccgccaccgaguccgccgccgagcucgcccgccgccacuccauccccaccggccuccacgccaaccucuccgagggccgccccgucggccccgcccgccgcggcgccuccucccuccucggccccgagggcuucuuccucggcaagaugggcuuccgcgaggccgucgccgccggcgacgucgaccucccccagguccgcgaggagcucgaggcccagcucuccugcuuccgcgagcuccucggccgcgcccccacccacgccgacggccaccagcacguccacguccuccccggcgucugccaggucuucgccgaggcccuccaggccuacggcguccgcuucacccgccucccccucgagcgcggcgucggcggcugcaccuggcucgaggcccccgcccgcgccuucgccugcgccgucgagcgcgacgcccgcgccgccgucggccccuucucccgccacggccuccgcuggaccgacgccuucgucggccucuccaccugcggccgccacauguccgcccaccgcgucuccggcgcccucgcccgcguccucgagggcacccucgccggccacacccucaccgccgagcucauggcccaccccggcuaccccuccgucccccccaccggcggcugcggcgagggccccgacgccuucuccugcuccugggagcgccuccacgagcuccgcguccucaccgcccccacccuccgcgcccagcucgcccaggacggcguccagcucugcgcccucgacgaccucgacuccaagcgccccggcgaggagguccccugcgagcccacccucgagcccuuccucgagcccucccuccucuga

SEQ ID NO: 51873 - RNA, 684 nt, Artificial Sequence
  derived and/or modified sequence opt2 from YEATS4__Homo_sapiens__NP_006521
auguucaagcgcauggccgaguucggccccgacuccggcggccgcgucaagggcgucaccaucgucaagcccaucgucuacggcaacgucgcccgcuacuucggcaagaagcgcgaggaggacggccacacccaccaguggaccgucuacgucaagcccuaccgcaacgaggacauguccgccuacgucaagaagauccaguucaagcuccacgaguccuacggcaacccccuccgcgucgucaccaagccccccuacgagaucaccgagaccggcuggggcgaguucgagaucaucaucaagaucuucuucaucgaccccaacgagcgccccgucacccucuaccaccuccucaagcucuuccaguccgacaccaacgccaugcucggcaagaagaccgucgucuccgaguucuacgacgagaugaucuuccaggaccccaccgccaugaugcagcagcuccucaccaccucccgccagcucacccucggcgccuacaagcacgagaccgaguucgccgagcucgaggucaagacccgcgagaagcucgaggccgccaagaagaagaccuccuucgagaucgccgagcucaaggagcgccucaaggccucccgcgagaccaucaacugccucaagaacgagauccgcaagcucgaggaggacgaccaggccaaggacaucuga

SEQ ID NO: 51874 - RNA, 1632 nt, Artificial Sequence
  derived and/or modified sequence opt2 from YES1__Homo_sapiens__XP_011524038
augggcugcaucaaguccaaggagaacaagucccccgccaucaaguaccgccccgagaacacccccgagcccgucuccaccuccgucucccacuacggcgccgagcccaccaccgucucccccugccccuccuccuccgccaagggcaccgccgucaacuucuccucccucuccaugacccccuucggcggcuccuccggcgucacccccuucggcggcgccuccuccuccuucuccgucguccccuccuccuaccccgccggccucaccggcggcgucaccaucuucgucgcccucuacgacuacgaggcccgcaccaccgaggaccucuccuucaagaagggcgagcgcuuccagaucaucaacaacaccgagggcgacuggugggaggcccgcuccaucgccaccggcaagaacggcuacauccccuccaacuacgucgcccccgccgacuccauccaggccgaggagugguacuucggcaagaugggccgcaaggacgccgagcgccuccuccucaaccccggcaaccagcgcggcaucuuccucguccgcgaguccgagaccaccaagggcgccuacucccucuccauccgcgacugggacgagauccgcggcgacaacgucaagcacuacaagauccgcaagcucgacaacggcggcuacuacaucaccacccgcgcccaguucgacacccuccagaagcucgucaagcacuacaccgagcacgccgacggccucugccacaagcucaccaccgucugccccaccgucaagccccagacccagggccucgccaaggacgccugggagaucccccgcgagucccuccgccucgaggucaagcucggccagggcugcuucggcgaggucuggaugggcaccuggaacggcaccaccaaggucgccaucaagacccucaagcccggcaccaugaugcccgaggccuuccuccaggaggcccagaucaugaagaagcuccgccacgacaagcucgucccccucuacgccgucgucuccgaggagcccaucuacaucgucaccgaguucauguccaagggcucccuccucgacuuccucaaggagggcgacggcaaguaccucaagcucccccagcucgucgacauggccgcccagaucgccgacggcauggccuacaucgagcgcaugaacuacauccaccgcgaccuccgcgccgccaacauccucgucggcgagaaccucgucugcaagaucgccgacuucggccucgcccgccucaucgaggacaacgaguacaccgcccgccagggcgccaaguuccccaucaaguggaccgcccccgaggccgcccucuacggccgcuucaccaucaaguccgacgucugguccuucggcauccuccagaccgagcucgucaccaagggccgcguccccuaccccggcauggucaaccgcgagguccucgagcaggucgagcgcggcuaccgcaugcccugcccccagggcugccccgagucccuccacgagcucaugaaccucugcuggaagaaggaccccgacgagcgccccaccuucgaguacauccaguccuuccucgaggacuacuucaccgccaccgagccccaguaccagcccggcgagaaccucuga

SEQ ID NO: 51875 - RNA, 882 nt, Artificial Sequence
  derived and/or modified sequence opt2 from YIF1A__Homo_sapiens__NP_065203
auggccuaccacuccggcuacggcgcccacggcuccaagcaccgcgcccgcgccgcccccgacccccccccccucuucgacgacaccuccggcggcuacuccucccagcccggcggcuaccccgccaccggcgccgacgucgccuucuccgucaaccaccuccucggcgaccccauggccaacgucgccauggccuacggcuccuccaucgccucccacggcaaggacaugguccacaaggagcuccaccgcuucgucuccgucuccaagcucaaguacuucuucgccgucgacaccgccuacgucgccaagaagcucggccuccucgucuuccccuacacccaccagaacugggagguccaguacucccgcgacgccccccuccccccccgccaggaccucaacgcccccgaccucuacauccccaccauggccuucaucaccuacguccuccucgccggcauggcccucggcauccagaagcgcuucucccccgagguccucggccucugcgccuccaccgcccucgucugggucgucauggagguccucgcccuccuccucggccucuaccucgccaccguccgcuccgaccucuccaccuuccaccuccucgccuacuccggcuacaaguacgucggcaugauccucuccguccucaccggccuccucuucggcuccgacggcuacuacgucgcccucgccuggaccuccuccgcccucauguacuucaucguccgcucccuccgcaccgccgcccucggccccgacuccaugggcggccccgucccccgccagcgccuccagcucuaccucacccucggcgccgccgccuuccagccccucaucaucuacuggcucaccuuccaccucguccgcuga

SEQ ID NO: 51876 - RNA, 372 nt, Artificial Sequence
  derived and/or modified sequence opt2 from YIPF1__Homo_sapiens__XP_011539907
auguggcgcaacuccaaggucaugaacaucgucuccuacuccuuccucgagaucgucugcgucuacggcuacucccucuucaucuacauccccaccgccauccucuggaucaucccccagaaggccguccgcuggauccucgucaugaucgcccucggcaucuccggcucccuccucgccaugaccuucuggcccgccguccgcgaggacaaccgccgcgucgcccucgccaccaucgucaccaucguccuccuccacaugcuccucuccgucggcugccucgccuacuucuucgacgcccccgagauggaccaccuccccaccaccaccgccacccccaaccagaccgucgccgccgccaaguccuccuga

SEQ ID NO: 51877 - RNA, 1053 nt, Artificial Sequence
  derived and/or modified sequence opt2 from YIPF3__Homo_sapiens__NP_056203
auggccaccaccgccgcccccgccggcggcgcccgcaacggcgccggccccgaguggggcggcuucgaggagaacauccagggcggcggcuccgccgucaucgacauggagaacauggacgacaccuccggcuccuccuucgaggacaugggcgagcuccaccagcgccuccgcgaggaggaggucgacgccgacgccgccgacgccgccgccgccgaggaggaggacggcgaguuccucggcaugaagggcuucaagggccagcucucccgccaggucgccgaccagauguggcaggccggcaagcgccaggccucccgcgccuucucccucuacgccaacaucgacauccuccgccccuacuucgacgucgagcccgcccagguccgcucccgccuccucgaguccaugauccccaucaagauggucaacuucccccagaagaucgccggcgagcucuacggcccccucaugcucgucuucacccucgucgccauccuccuccacggcaugaagaccuccgacaccaucauccgcgagggcacccucaugggcaccgccaucggcaccugcuucggcuacuggcucggcgucuccuccuucaucuacuuccucgccuaccucugcaacgcccagaucaccaugcuccagaugcucgcccuccucggcuacggccucuucggccacugcaucguccucuucaucaccuacaacauccaccuccacgcccucuucuaccucuucuggcuccucgucggcggccucuccacccuccgcauggucgccguccucgucucccgcaccgucggccccacccagcgccuccuccucugcggcacccucgccgcccuccacaugcucuuccuccucuaccuccacuucgccuaccacaaggucgucgagggcauccucgacacccucgagggccccaacaucccccccauccagcgcgucccccgcgacauccccgccaugcuccccgccgcccgccuccccaccaccguccucaacgccaccgccaaggccgucgccgucacccuccagucccacuga

SEQ ID NO: 51878 - RNA, 774 nt, Artificial Sequence
  derived and/or modified sequence opt2 from YIPF5__Homo_sapiens__NP_001020118
auguccggcuucgagaaccucaacaccgacuucuaccagaccuccuacuccaucgacgaccagucccagcaguccuacgacuacggcggcuccggcggccccuacuccaagcaguacgccggcuacgacuacucccagcagggccgcuucgucccccccgacaugaugcagccccagcagcccuacaccggccagaucuaccagcccacccaggccuacacccccgccuccccccagcccuucuacggcaacaacuucgaggacgagcccccccuccucgaggagcucggcaucaacuucgaccacaucuggcagaagacccucaccguccuccacccccucaaggucgccgacggcuccaucaugaacgagaccgaccucgccggccccauggucuucugccucgccuucggcgccacccuccuccucgccggcaagauccaguucggcuacgucuacggcaucuccgccaucggcugccucggcauguucugccuccucaaccucauguccaugaccggcgucuccuucggcugcgucgccuccguccucggcuacugccuccuccccaugauccuccucuccuccuucgccgucaucuucucccuccagggcauggucggcaucauccucaccgccggcaucaucggcuggugcuccuucuccgccuccaagaucuucaucuccgcccucgccauggagggccagcagcuccucgucgccuaccccugcgcccuccucuacggcgucuucgcccucaucuccgucuucuga

SEQ ID NO: 51879 - RNA, 597 nt, Artificial Sequence
  derived and/or modified sequence opt2 from YKT6__Homo_sapiens__NP_006546
augaagcucuacucccucuccguccucuacaagggcgaggccaaggucguccuccucaaggccgccuacgacgucuccuccuucuccuucuuccagcgcuccuccguccaggaguucaugaccuucaccucccagcucaucgucgagcgcuccuccaagggcacccgcgccuccgucaaggagcaggacuaccucugccacgucuacguccgcaacgacucccucgccggcgucgucaucgccgacaacgaguaccccucccgcgucgccuucacccuccucgagaagguccucgacgaguucuccaagcaggucgaccgcaucgacuggcccgucggcucccccgccaccauccacuaccccgcccucgacggccaccucucccgcuaccagaacccccgcgaggccgaccccaugaccaagguccaggccgagcucgacgagaccaagaucauccuccacaacaccauggagucccuccucgagcgcggcgagaagcucgacgaccucgucuccaaguccgagguccucggcacccaguccaaggccuucuacaagaccgcccgcaagcagaacuccugcugcgccaucauguga

SEQ ID NO: 51880 - RNA, 6441 nt, Artificial Sequence
  derived and/or modified sequence opt2 from YLPM1__Homo_sapiens__NP_062535
auguaccccaacuggggccgcuacggcggcuccucccacuacccccccccccccguccccccccccccccccgucgcccuccccgaggccucccccggccccggcuacuccuccuccaccacccccgccgcccccuccuccuccggcuucauguccuuccgcgagcagcaccucgcccagcuccagcagcuccagcagaugcaccagaagcagaugcagugcguccuccagccccaccaccuccccccccccccccucccccccccccccgucaugcccggcggcggcuacggcgacuggcagcccccccccccccccaugccccccccccccggccccgcccucuccuaccagaagcagcagcaguacaagcaccagaugcuccaccaccagcgcgacggcccccccggccucguccccauggagcucgaguccccccccgaguccccccccgucccccccggcuccuacaugccccccucccaguccuacaugccccccccccagcccccccccuccuacuacccccccaccuccucccagcccuaccucccccccgcccagcccucccccucccaguccccccccucccaguccuaccucgcccccacccccuccuacuccuccuccuccuccuccucccaguccuaccucucccacucccaguccuaccuccccuccucccaggccucccccucccgccccucccagggccacuccaagucccagcuccucgccccccccccccccuccgccccccccggcaacaagaccaccguccagcaggagccccucgaguccggcgccaagaacaaguccaccgagcagcagcaggccgcccccgagcccgaccccuccaccaugaccccccaggagcagcagcaguacugguaccgccagcaccuccucucccuccagcagcgcaccaagguccaccuccccggccacaagaagggccccgucgucgccaaggacacccccgagcccgucaaggaggaggucaccguccccgccaccucccagguccccgagucccccuccuccgaggagcccccccuccccccccccaacgaggaggucccccccccccucccccccgaggagccccaguccgaggaccccgaggaggacgcccgccucaagcagcuccaggccgccgccgcccacuggcagcagcaccagcagcaccgcgucggcuuccaguaccagggcaucaugcagaagcacacccagcuccagcagauccuccagcaguaccagcagaucauccagccccccccccacauccagaccauguccgucgacaugcagcuccgccacuacgagaugcagcagcagcaguuccagcaccucuaccaggagugggagcgcgaguuccagcucugggaggagcagcuccacuccuacccccacaaggaccagcuccaggaguacgagaagcaguggaagaccuggcagggccacaugaaggccacccaguccuaccuccaggagaaggucaacuccuuccagaacaugaagaaccaguacaugggcaacauguccaugcccccccccuucguccccuacucccagaugccccccccccuccccaccaugcccccccccguccucccccccucccuccccccccccgucaugccccccgcccuccccgccaccguccccccccccggcaugcccccccccgucaugccccccucccuccccaccuccguccccccccccggcaugccccccucccucuccuccgccggccccccccccguccuccccccccccucccucuccuccgccggccccccccccguccuccccccccccucccucuccuccaccgcccccccccccgucaugccccuccccccccucuccuccgccacccccccccccggcauccccccccccggcgucccccagggcauccccccccagcucaccgccgcccccgucccccccgccuccuccucccaguccucccagguccccgagaagccccgccccgcccuccuccccacccccgucuccuucggcuccgccccccccaccaccuaccaccccccccuccaguccgccggccccuccgagcaggucaacuccaaggccccccucuccaaguccgcccuccccuacuccuccuucuccuccgaccagggccucggcgaguccuccgccgcccccucccagcccaucaccgccgucaaggacaugcccguccgcuccggcggccuccuccccgaccccccccgcuccuccuaccucgaguccccccgcggcccccgcuucgacggcccccgccgcuucgaggaccucggcucccgcugcgagggcccccgccccaagggcccccgcuucgagggcaaccgccccgacggcccccgcccccgcuacgagggccaccccgccgagggcaccaaguccaaguggggcaugaucccccgcggccccgccucccaguucuacaucacccccuccaccucccucuccccccgccaguccggcccccaguggaagggccccaagcccgccuucggccagcagcaccagcagcagcccaagucccaggccgagccccucuccggcaacaaggagccccucgccgacaccuccuccaaccagcagaagaacuucaagaugcaguccgccgccuucuccaucgccgccgacgucaaggacgucaaggccgcccaguccaacgagaaccucuccgacucccagcaggagccccccaaguccgaggucuccgagggccccgucgagcccuccaacugggaccagaacguccaguccauggagacccagaucgacaaggcccaggccgucacccagcccgucccccucgccaacaagcccguccccgcccaguccaccuuccccuccaagaccggcggcauggagggcggcaccgccgucgccaccuccucccucaccgccgacaacgacuucaagcccgucggcaucggccucccccacuccgagaacaaccaggacaagggccucccccgccccgacaaccgcgacaaccgccucgagggcaaccgcggcaacuccuccuccuaccgcggccccggccagucccgcauggaggacacccgcgacaagggccucgucaaccgcggccgcggccaggccaucucccgcggccccggccucgucaagcaggaggacuuccgcgacaagaugaugggccgccgcgaggacucccgcgagaagaugaaccgcggcgagggcucccgcgaccgcggccucguccgccccggcuccucccgcgagaagguccccggcggccuccagggcucccaggaccgcggcgccgccggcucccgcgagcgcggccccccccgccgcgccggcucccaggagcgcggcccccuccgccgcgccggcucccgcgagcgcauccccccccgccgcgccggcucccgcgagcgcggccccccccgcggccccggcucccgcgagcgcggccucggccgcuccgacuucggccgcgaccgcggccccuuccgccccgagcccggcgacggcggcgagaagauguaccccuaccaccgcgacgagcccccccgcgcccccuggaaccacggcgaggagcgcggccacgaggaguucccccucgacggccgcaacgcccccauggagcgcgagcgccucgacgacugggaccgcgagcgcuacuggcgcgagugcgagcgcgacuaccaggacgacacccucgagcucuacaaccgcgaggaccgcuucuccgccccccccucccgcucccacgacggcgaccgccgcggccccuggugggacgacugggagcgcgaccaggacauggacgaggacuacaaccgcgagauggagcgcgacauggaccgcgacgucgaccgcaucucccgccccauggacauguacgaccgcucccucgacaacgagugggaccgcgacuacggccgcccccucgacgagcaggagucccaguuccgcgagcgcgacauccccucccuccccccccuccccccccuccccccccuccccccccucgaccgcuaccgcgacgaccgcuggcgcgaggagcgcaaccgcgagcacggcuacgaccgcgacuuccgcgaccgcggcgagcuccgcauccgcgaguaccccgagcgcggcgacaccuggcgcgagaagcgcgacuacguccccgaccgcauggacugggagcgcgagcgccucuccgaccgcugguaccccuccgacgucgaccgccacucccccauggccgagcacaugcccuccucccaccacuccuccgagaugaugggcuccgacgccucccucgacuccgaccagggccucggcggcgucaugguccucucccagcgccagcacgagaucauccucaaggccgcccaggagcucaagaugcuccgcgagcagaaggagcagcuccagaagaugaaggacuucggcuccgagccccagauggccgaccaccuccccccccaggagucccgccuccagaacaccuccucccgccccggcauguaccccccccccggcuccuaccgcccccccccccccaugggcaagccccccggcuccaucguccgccccuccgccccccccgcccgcuccuccguccccgucacccgcccccccguccccauccccccccccccccccccccccccccuccccccccccccccccgucaucaagccccagaccuccgccgucgagcaggagcgcugggacgaggacuccuucuacggccucugggacaccaacgacgagcagggccucaacuccgaguucaaguccgagaccgccgccauccccuccgcccccguccucccccccccccccguccacuccuccauccccccccccggccccguccccaugggcaugccccccauguccaagcccccccccguccagcagaccgucgacuacggccacggccgcgacaucuccaccaacaaggucgagcagauccccuacggcgagcgcaucacccuccgccccgacccccuccccgagcgcuccaccuucgagaccgagcacgccggccagcgcgaccgcuacgaccgcgagcgcgaccgcgagcccuacuucgaccgccaguccaacgucaucgccgaccaccgcgacuucaagcgcgaccgcgagacccaccgcgaccgcgaccgcgaccgcggcgucaucgacuacgaccgcgaccgcuucgaccgcgagcgccgcccccgcgacgaccgcgcccaguccuaccgcgacaagaaggaccacuccuccucccgccgcggcggcuucgaccgccccuccuacgaccgcaaguccgaccgccccgucuacgagggccccuccauguucggcggcgagcgccgcaccuaccccgaggagcgcaugccccuccccgcccccucccucucccaccagcccccccccgccccccgcgucgagaagaagcccgaguccaagaacgucgacgacauccucaagccccccggccgcgagucccgccccgagcgcaucgucgucaucaugcgcggccuccccggcuccggcaagacccacgucgccaagcucauccgcgacaaggaggucgaguucggcggccccgccccccgcguccucucccucgacgacuacuucaucaccgaggucgagaaggaggagaaggaccccgacuccggcaagaaggucaagaagaaggucauggaguacgaguacgaggccgagauggaggagaccuaccgcaccuccauguucaagaccuucaagaagacccucgacgacggcuucuuccccuucaucauccucgacgccaucaacgaccgcguccgccacuucgaccaguucugguccgccgccaagaccaagggcuucgaggucuaccucgccgagauguccgccgacaaccagaccugcggcaagcgcaacauccacggccgcaagcucaaggagaucaacaagauggccgaccacugggagaccgccccccgccacaugaugcgccucgacauccgcucccuccuccaggacgccgccaucgaggaggucgagauggaggacuucgacgccaacaucgaggagcagaaggaggagaagaaggacgccgaggaggaggaguccgagcucggcuacauccccaaguccaagugggagauggacaccuccgaggccaagcucgacaagcucgacggccuccgcaccggcaccaagcgcaagcgcgacugggaggccaucgccucccgcauggaggacuaccuccagcuccccgacgacuacgacacccgcgccuccgagcccggcaagaagcgcguccgcugggccgaccucgaggagaagaaggacgccgaccgcaagcgcgccaucggcuucgucgucggccagaccgacugggagaagaucaccgacgaguccggccaccucgccgagaaggcccucaaccgcaccaaguacaucuga

SEQ ID NO: 51881 - RNA, 2052 nt, Artificial Sequence
  derived and/or modified sequence opt2 from YME1L1__Homo_sapiens__NP_001240795
auguucucccucuccuccaccguccagccccaggucaccgucccccucucccaccucaucaacgccuuccacacccccaagaacaccuccgucucccucuccggcgucuccgucucccagaaccagcaccgcgacgucguccccgagcacgaggcccccuccuccgagcccucccucaaccuccgcgaccucggccucuccgagcucaagaucggccagaucgaccagcucgucgagaaccuccuccccggcuucugcaagggcaagaacaucuccucccacuggcacaccucccacgucuccgcccaguccuucuucgagaacaaguacgucuucauccagucccgcggcuucaagacccucaagucccgcacccgccgccuccaguccaccuccgagcgccucgccgagacccagaacaucgcccccuccuucgucaagggcuuccuccuccgcgaccgcggcuccgacgucgagucccucgacaagcucaugaagaccaagaacauccccgaggcccaccaggacgccuucaagaccggcuucgccgagggcuuccucaaggcccaggcccucacccagaagaccaacgacucccuccgccgcacccgccucauccucuucguccuccuccucuucggcaucuacggccuccucaagaaccccuuccucuccguccgcuuccgcaccaccaccggccucgacuccgccgucgaccccguccagaugaagaacgucaccuucgagcacgucaagggcgucgaggaggccaagcaggagcuccaggaggucgucgaguuccucaagaacccccagaaguucaccauccucggcggcaagcuccccaagggcauccuccucgucggcccccccggcaccggcaagacccuccucgcccgcgccgucgccggcgaggccgacguccccuucuacuacgccuccggcuccgaguucgacgagauguucgucggcgucggcgccucccgcauccgcaaccucuuccgcgaggccaaggccaacgcccccugcgucaucuucaucgacgagcucgacuccgucggcggcaagcgcaucgagucccccaugcaccccuacucccgccagaccaucaaccagcuccucgccgagauggacggcuucaagcccaacgagggcgucaucaucaucggcgccaccaacuuccccgaggcccucgacaacgcccucauccgccccggccgcuucgacaugcaggucaccgucccccgccccgacgucaagggccgcaccgagauccucaagugguaccucaacaagaucaaguucgaccaguccgucgaccccgagaucaucgcccgcggcaccgucggcuucuccggcgccgagcucgagaaccucgucaaccaggccgcccucaaggccgccgucgacggcaaggagauggucaccaugaaggagcucgaguucuccaaggacaagauccucaugggccccgagcgccgcuccgucgagaucgacaacaagaacaagaccaucaccgccuaccacgaguccggccacgccaucaucgccuacuacaccaaggacgccaugcccaucaacaaggccaccaucaugccccgcggccccacccucggccacgucucccuccuccccgagaacgaccgcuggaacgagacccgcgcccagcuccucgcccagauggacgucuccaugggcggccgcgucgccgaggagcucaucuucggcaccgaccacaucaccaccggcgccuccuccgacuucgacaacgccaccaagaucgccaagcgcauggucaccaaguucggcauguccgagaagcucggcgucaugaccuacuccgacaccggcaagcucucccccgagacccaguccgccaucgagcaggagauccgcauccuccuccgcgacuccuacgagcgcgccaagcacauccucaagacccacgccaaggagcacaagaaccucgccgaggcccuccucaccuacgagacccucgacgccaaggagauccagaucguccucgagggcaagaagcucgagguccgcuga

SEQ ID NO: 51882 - RNA, 360 nt, Artificial Sequence
  derived and/or modified sequence opt2 from YPEL1__Homo_sapiens__NP_037445
auggucaagaugaccaaguccaagaccuuccaggccuaccuccccaacugccaccgcaccuacuccugcauccacugccgcgcccaccucgccaaccacgacgagcucaucuccaaguccuuccagggcucccagggccgcgccuaccucuucaacuccgucgucaacgucggcugcggccccgccgaggagcgcguccuccucaccggccuccacgccgucgccgacaucuacugcgagaacugcaagaccacccucggcuggaaguacgagcacgccuucgaguccucccagaaguacaaggagggcaaguucaucaucgagcucgcccacaugaucaaggacaacggcugggaguga

SEQ ID NO: 51883 - RNA, 360 nt, Artificial Sequence
  derived and/or modified sequence opt2 from YPEL2__Homo_sapiens__NP_001005404
auggucaagaugacccgcuccaagaccuuccaggccuaccuccccuccugccaccgcaccuacuccugcauccacugccgcgcccaccucgccaaccacgacgagcucaucuccaaguccuuccagggcucccagggccgcgccuaccucuucaacuccgucgucaacgucggcugcggccccgccgaggagcgcguccuccucaccggccuccacgccgucgccgacaucuacugcgagaacugcaagaccacccucggcuggaaguacgagcacgccuucgaguccucccagaaguacaaggagggcaaguacaucaucgagcucgcccacaugaucaaggacaacggcugggacuga

SEQ ID NO: 51884 - RNA, 360 nt, Artificial Sequence
  derived and/or modified sequence opt2 from YPEL3__Homo_sapiens__NP_001138996
augguccgcaucuccaagcccaagaccuuccaggccuaccucgacgacugccaccgccgcuacuccugcgcccacugccgcgcccaccucgccaaccacgacgaccucaucuccaaguccuuccagggcucccagggccgcgccuaccucuucaacuccgucgucaacgucggcugcggccccgccgaggagcgcguccuccucaccggccuccacgccgucgccgacauccacugcgagaacugcaagaccacccucggcuggaaguacgagcaggccuucgaguccucccagaaguacaaggagggcaaguacaucaucgagcucaaccacaugaucaaggacaacggcugggacuga

SEQ ID NO: 51885 - RNA, 384 nt, Artificial Sequence
  derived and/or modified sequence opt2 from YPEL4__Homo_sapiens__NP_659445
augcccuccugcgaccccggccccggccccgccugccuccccaccaagaccuuccgcuccuaccucccccgcugccaccgcaccuacuccugcguccacugccgcgcccaccucgccaagcacgacgagcucaucuccaaguccuuccagggcucccacggccgcgccuaccucuucaacuccgucgucaacgucggcugcggccccgccgagcagcgccuccuccucaccggccuccacuccgucgccgacaucuucugcgaguccugcaagaccacccucggcuggaaguacgagcaggccuucgagaccucccagaaguacaaggagggcaaguacaucaucgagaugucccacauggucaaggacaacggcugggacuga

SEQ ID NO: 51886 - RNA, 366 nt, Artificial Sequence
  derived and/or modified sequence opt2 from YPEL5__Homo_sapiens__NP_001120872
augggccgcaucuuccucgaccacaucggcggcacccgccucuucuccugcgccaacugcgacaccauccucaccaaccgcuccgagcucaucuccacccgcuucaccggcgccaccggccgcgccuuccucuucaacaaggucgucaaccuccaguacuccgagguccaggaccgcgucaugcucaccggccgccacaugguccgcgacgucuccugcaagaacugcaacuccaagcucggcuggaucuacgaguucgccaccgaggacucccagcgcuacaaggagggccgcgucauccucgagcgcgcccucguccgcgaguccgagggcuucgaggagcacguccccuccgacaacuccuga

SEQ ID NO: 51887 - RNA, 2184 nt, Artificial Sequence
  derived and/or modified sequence opt2 from YTHDC1__Homo_sapiens__NP_001026902
auggccgccgacucccgcgaggagaaggacggcgagcucaacguccucgacgacauccucaccgagguccccgagcaggacgacgagcucuacaaccccgaguccgagcaggacaagaacgagaagaagggcuccaagcgcaaguccgaccgcauggaguccaccgacaccaagcgccagaagcccuccguccacucccgccagcucgucuccaagccccucuccuccuccgucuccaacaacaagcgcaucgucuccaccaagggcaaguccgccaccgaguacaagaacgaggaguaccagcgcuccgagcgcaacaagcgccucgacgccgaccgcaagauccgccucuccuccuccgccucccgcgagcccuacaagaaccagcccgagaagaccugcguccgcaagcgcgaccccgagcgccgcgccaagucccccacccccgacggcuccgagcgcaucggccucgaggucgaccgccgcgccucccgcuccucccaguccuccaaggaggaggucaacuccgaggaguacggcuccgaccacgagaccggcuccuccggcuccuccgacgagcagggcaacaacaccgagaacgaggaggagggcgucgaggaggacgucgaggaggacgaggaggucgaggaggacgccgaggaggacgaggaggucgacgaggacggcgaggaggaggaggaggaggaggaggaggaggaggaggaggaggaggaggaggaggaggaguacgagcaggacgagcgcgaccagaaggaggagggcaacgacuacgacacccgcuccgaggccuccgacuccggcuccgaguccgucuccuucaccgacggcuccguccgcuccggcuccggcaccgacggcuccgacgagaagaagaaggagcgcaagcgcgcccgcggcaucucccccaucgucuucgaccgcuccggcuccuccgccuccgaguccuacgccggcuccgagaagaagcacgagaagcucuccuccuccguccgcgccguccgcaaggaccagaccuccaagcucaaguacguccuccaggacgcccgcuucuuccucaucaaguccaacaaccacgagaacgucucccucgccaaggccaagggcgucugguccacccuccccgucaacgagaagaagcucaaccucgccuuccgcuccgcccgcuccgucauccucaucuucuccguccgcgaguccggcaaguuccagggcuucgcccgccucuccuccgagucccaccacggcggcucccccauccacuggguccuccccgccggcauguccgccaagaugcucggcggcgucuucaagaucgacuggaucugccgccgcgagcuccccuucaccaaguccgcccaccucaccaaccccuggaacgagcacaagcccgucaagaucggccgcgacggccaggagaucgagcucgagugcggcacccagcucugccuccucuucccccccgacgaguccaucgaccucuaccaggucauccacaagaugcgccacaagcgccgcaugcacucccagccccgcucccgcggccgccccucccgccgcgagcccguccgcgacgucggccgccgccgccccgaggacuacgacauccacaacucccgcaagaagccccgcaucgacuacccccccgaguuccaccagcgccccggcuaccucaaggacccccgcuaccaggaggucgaccgccgcuucuccggcguccgccgcgacgucuuccucaacggcuccuacaacgacuacguccgcgaguuccacaacaugggcccccccccccccuggcagggcaugccccccuaccccggcauggagcagcccccccaccaccccuacuaccagcaccacgccccccccccccaggcccacccccccuacuccggccaccaccccgucccccacgaggcccgcuaccgcgacaagcgcguccacgacuacgacaugcgcgucgacgacuuccuccgccgcacccaggccgucgucuccggccgccgcucccgcccccgcgagcgcgaccgcgagcgcgagcgcgaccgcccccgcgacaaccgccgcgaccgcgagcgcgaccgcggccgcgaccgcgagcgcgagcgcgagcgccucugcgaccgcgaccgcgaccgcggcgagcgcggccgcuaccgccgcuga

SEQ ID NO: 51888 - RNA, 4293 nt, Artificial Sequence
  derived and/or modified sequence opt2 from YTHDC2__Homo_sapiens__NP_073739
augucccgccccuccuccgucuccccccgccagcccgcccccggcggcggcggcggcggcggccccucccccugcggccccggcggcggcggccgcgccaagggccucaaggacauccgcaucgacgaggaggucaagaucgccgucaacaucgcccucgagcgcuuccgcuacggcgaccagcgcgagauggaguuccccuccucccucaccuccaccgagcgcgccuucauccaccgccucucccagucccucggccucgucuccaaguccaagggcaagggcgccaaccgcuaccucaccgucaagaagaaggacggcuccgagaccgcccacgccaugaugaccugcaaccucacccacaacaccaagcacgccguccgcucccucauccagcgcuuccccgucaccaacaaggagcgcaccgagcuccuccccaagaccgagcgcggcaacgucuucgccgucgaggccgagaaccgcgagauguccaagaccuccggccgccucaacaacggcaucccccagauccccgucaagcgcggcgaguccgaguucgacuccuuccgccagucccuccccgucuucgagaagcaggaggagaucgucaagaucaucaaggagaacaaggucguccucaucgucggcgagaccggcuccggcaagaccacccagaucccccaguuccuccucgacgacugcuucaagaacggcauccccugccgcaucuucugcacccagccccgccgccucgccgccaucgccgucgccgagcgcgucgccgccgagcgccgcgagcgcaucggccagaccaucggcuaccagauccgccucgagucccgcgucucccccaagacccuccucaccuucugcaccaacggcguccuccuccgcacccucauggccggcgacuccacccucuccaccgucacccacgucaucgucgacgagguccacgagcgcgaccgcuucuccgacuuccuccucaccaagcuccgcgaccuccuccagaagcaccccacccucaagcucauccucuccuccgccgcccucgacgucaaccucuucauccgcuacuucggcuccugccccgucaucuacauccagggccgccccuucgaggucaaggagauguuccucgaggacauccuccgcaccaccggcuacaccaacaaggagaugcucaaguacaagaaggagaagcagcaggaggagaagcagcagaccacccucaccgagugguacuccgcccaggagaacuccuucaagcccgagucccagcgccagcgcaccguccucaacgucaccgacgaguacgaccuccucgacgacggcggcgacgccgucuucucccagcucaccgagaaggacgucaacugccucgagcccuggcucaucaaggagauggacgccugccucuccgacaucuggcuccacaaggacaucgacgccuucgcccaggucuuccaccucauccucaccgagaacgucuccgucgacuaccgccacuccgagaccuccgccaccgcccucauggucgccgccggccgcggcuucgccucccaggucgagcagcucaucuccaugggcgccaacguccacuccaaggccuccaacggcuggauggcccucgacugggccaagcacuucggccagaccgagaucgucgaccuccucgaguccuacuccgccacccucgaguucggcaaccucgacgaguccucccucguccagaccaacggcuccgaccucuccgccgaggaccgcgagcuccucaaggccuaccaccacuccuucgacgacgagaaggucgaccucgaccucaucaugcaccuccucuacaacaucugccacuccugcgacgccggcgccguccucaucuuccuccccggcuacgacgagaucgucggccuccgcgaccgcauccucuucgacgacaagcgcuucgccgacuccacccaccgcuaccaggucuucaugcuccacuccaacaugcagaccuccgaccagaagaagguccucaagaacccccccgccggcguccgcaagaucauccucuccaccaacaucgccgagaccuccaucaccgucaacgacgucgucuucgucaucgacuccggcaaggucaaggagaaguccuucgacgcccucaacuucgucaccaugcucaagauggucuggaucuccaaggccuccgccauccagcgcaagggccgcgccggccgcugccgccccggcaucugcuuccgccucuucucccgccuccgcuuccagaacaugcucgaguuccagacccccgagcuccuccgcaugccccuccaggagcucugccuccacaccaagcuccucgcccccgucaacugccccaucgccgacuuccucaugaaggcccccgagcccccccccgcccucaucguccgcaacgccguccagaugcucaagaccaucgacgccauggacaccugggaggaccucaccgagcucggcuaccaccucgccgaccuccccgucgagccccaccucggcaagaugguccucugcgccgucguccucaagugccucgaccccauccucaccaucgccugcacccucgccuaccgcgaccccuucguccuccccacccaggccucccagaagcgcgccgccaugcucugccgcaagcgcuucaccgccggcgccuucuccgaccacauggcccuccuccgcgccuuccaggccuggcagaaggcccgcuccgacggcugggagcgcgccuucugcgagaagaacuuccucucccaggccaccauggagaucaucaucggcaugcgcacccagcuccucggccagcuccgcgccuccggcuucguccgcgcccgcggcggcggcgacauccgcgacgucaacaccaacuccgagaacugggccgucgucaaggccgcccucgucgccggcauguaccccaaccucguccacgucgaccgcgagaaccucguccucaccggccccaaggagaagaagguccgcuuccaccccgccuccguccucucccagccccaguacaagaagaucccccccgccaacggccaggccgccgccaucaaggcccuccccaccgacuggcucaucuacgacgagaugacccgcgcccaccgcaucgccaacauccgcugcugcuccgccgucacccccgucaccauccucgucuucugcggccccgcccgccucgccuccaacgcccuccaggagcccuccuccuuccgcgucgacggcauccccaacgacuccuccgacuccgagauggaggacaagaccaccgccaaccucgccgcccucaagcucgacgaguggcuccacuucacccucgagcccgaggccgccucccuccuccuccagcuccgccagaaguggcacucccucuuccuccgccgcaugcgcgcccccuccaagcccuggucccaggucgacgaggccaccauccgcgccaucaucgccguccucuccaccgaggagcaguccgccggccuccagcagcccuccggcaucggccagcgcccccgccccauguccuccgaggagcucccccucgccuccuccuggcgcuccaacaacucccgcaaguccuccgccgacaccgaguucuccgacgagugcaccaccgccgagcgcguccucaugaagucccccucccccgcccuccaccccccccagaaguacaaggaccgcggcauccuccaccccaagcgcggcaccgaggaccgcuccgaccaguccucccucaaguccaccgacuccuccuccuaccccucccccugcgccucccccuccccccccuccuccggcaagggcuccaagucccccuccccccgccccaacaugcccguccgcuacuucaucaugaaguccuccaaccuccgcaaccucgagaucucccagcagaagggcaucugguccaccacccccuccaacgagcgcaagcucaaccgcgccuucugggaguccuccaucgucuaccucgucuucuccguccagggcuccggccacuuccagggcuucucccgcauguccuccgagaucggccgcgagaagucccaggacuggggcuccgccggccucggcggcgucuucaaggucgaguggauccgcaaggagucccuccccuuccaguucgcccaccaccuccucaaccccuggaacgacaacaagaagguccagaucucccgcgacggccaggagcucgagccccucgucggcgagcagcuccuccagcucugggagcgccucccccucggcgagaagaacaccaccgacuga

SEQ ID NO: 51889 - RNA, 741 nt, Artificial Sequence
  derived and/or modified sequence opt2 from YWHAB__Homo_sapiens__NP_647539
augaccauggacaaguccgagcucguccagaaggccaagcucgccgagcaggccgagcgcuacgacgacauggccgccgccaugaaggccgucaccgagcagggccacgagcucuccaacgaggagcgcaaccuccucuccgucgccuacaagaacgucgucggcgcccgccgcuccuccuggcgcgucaucuccuccaucgagcagaagaccgagcgcaacgagaagaagcagcagaugggcaaggaguaccgcgagaagaucgaggccgagcuccaggacaucugcaacgacguccucgagcuccucgacaaguaccucauccccaacgccacccagcccgaguccaaggucuucuaccucaagaugaagggcgacuacuuccgcuaccucuccgaggucgccuccggcgacaacaagcagaccaccgucuccaacucccagcaggccuaccaggaggccuucgagaucuccaagaaggagaugcagcccacccaccccauccgccucggccucgcccucaacuucuccgucuucuacuacgagauccucaacucccccgagaaggccugcucccucgccaagaccgccuucgacgaggccaucgccgagcucgacacccucaacgaggaguccuacaaggacuccacccucaucaugcagcuccuccgcgacaaccucacccucuggaccuccgagaaccagggcgacgagggcgacgccggcgagggcgagaacuga

SEQ ID NO: 51890 - RNA, 768 nt, Artificial Sequence
  derived and/or modified sequence opt2 from YWHAE__Homo_sapiens__NP_006752
auggacgaccgcgaggaccucgucuaccaggccaagcucgccgagcaggccgagcgcuacgacgagauggucgaguccaugaagaaggucgccggcauggacgucgagcucaccgucgaggagcgcaaccuccucuccgucgccuacaagaacgucaucggcgcccgccgcgccuccuggcgcaucaucuccuccaucgagcagaaggaggagaacaagggcggcgaggacaagcucaagaugauccgcgaguaccgccagauggucgagaccgagcucaagcucaucugcugcgacauccucgacguccucgacaagcaccucauccccgccgccaacaccggcgaguccaaggucuucuacuacaagaugaagggcgacuaccaccgcuaccucgccgaguucgccaccggcaacgaccgcaaggaggccgccgagaacucccucgucgccuacaaggccgccuccgacaucgccaugaccgagcucccccccacccaccccauccgccucggccucgcccucaacuucuccgucuucuacuacgagauccucaacucccccgaccgcgccugccgccucgccaaggccgccuucgacgacgccaucgccgagcucgacacccucuccgaggaguccuacaaggacuccacccucaucaugcagcuccuccgcgacaaccucacccucuggaccuccgacaugcagggcgacggcgaggagcagaacaaggaggcccuccaggacgucgaggacgagaaccaguga

SEQ ID NO: 51891 - RNA, 744 nt, Artificial Sequence
  derived and/or modified sequence opt2 from YWHAG__Homo_sapiens__NP_036611
auggucgaccgcgagcagcucguccagaaggcccgccucgccgagcaggccgagcgcuacgacgacauggccgccgccaugaagaacgucaccgagcucaacgagccccucuccaacgaggagcgcaaccuccucuccgucgccuacaagaacgucgucggcgcccgccgcuccuccuggcgcgucaucuccuccaucgagcagaagaccuccgccgacggcaacgagaagaagaucgagaugguccgcgccuaccgcgagaagaucgagaaggagcucgaggccgucugccaggacguccucucccuccucgacaacuaccucaucaagaacugcuccgagacccaguacgaguccaaggucuucuaccucaagaugaagggcgacuacuaccgcuaccucgccgaggucgccaccggcgagaagcgcgccaccgucgucgaguccuccgagaaggccuacuccgaggcccacgagaucuccaaggagcacaugcagcccacccaccccauccgccucggccucgcccucaacuacuccgucuucuacuacgagauccagaacgcccccgagcaggccugccaccucgccaagaccgccuucgacgacgccaucgccgagcucgacacccucaacgaggacuccuacaaggacuccacccucaucaugcagcuccuccgcgacaaccucacccucuggaccuccgaccagcaggacgacgacggcggcgagggcaacaacuga

SEQ ID NO: 51892 - RNA, 741 nt, Artificial Sequence
  derived and/or modified sequence opt2 from YWHAH__Homo_sapiens__NP_003396
augggcgaccgcgagcagcuccuccagcgcgcccgccucgccgagcaggccgagcgcuacgacgacauggccuccgccaugaaggccgucaccgagcucaacgagccccucuccaacgaggaccgcaaccuccucuccgucgccuacaagaacgucgucggcgcccgccgcuccuccuggcgcgucaucuccuccaucgagcagaagaccauggccgacggcaacgagaagaagcucgagaaggucaaggccuaccgcgagaagaucgagaaggagcucgagaccgucugcaacgacguccucucccuccucgacaaguuccucaucaagaacugcaacgacuuccaguacgaguccaaggucuucuaccucaagaugaagggcgacuacuaccgcuaccucgccgaggucgccuccggcgagaagaagaacuccgucgucgaggccuccgaggccgccuacaaggaggccuucgagaucuccaaggagcagaugcagcccacccaccccauccgccucggccucgcccucaacuucuccgucuucuacuacgagauccagaacgcccccgagcaggccugccuccucgccaagcaggccuucgacgacgccaucgccgagcucgacacccucaacgaggacuccuacaaggacuccacccucaucaugcagcuccuccgcgacaaccucacccucuggaccuccgaccagcaggacgaggaggccggcgagggcaacuga

SEQ ID NO: 51893 - RNA, 738 nt, Artificial Sequence
  derived and/or modified sequence opt2 from YWHAQ__Homo_sapiens__NP_006817
auggagaagaccgagcucauccagaaggccaagcucgccgagcaggccgagcgcuacgacgacauggccaccugcaugaaggccgucaccgagcagggcgccgagcucuccaacgaggagcgcaaccuccucuccgucgccuacaagaacgucgucggcggccgccgcuccgccuggcgcgucaucuccuccaucgagcagaagaccgacaccuccgacaagaagcuccagcucaucaaggacuaccgcgagaaggucgaguccgagcuccgcuccaucugcaccaccguccucgagcuccucgacaaguaccucaucgccaacgccaccaaccccgaguccaaggucuucuaccucaagaugaagggcgacuacuuccgcuaccucgccgaggucgccugcggcgacgaccgcaagcagaccaucgacaacucccagggcgccuaccaggaggccuucgacaucuccaagaaggagaugcagcccacccaccccauccgccucggccucgcccucaacuucuccgucuucuacuacgagauccucaacaaccccgagcucgccugcacccucgccaagaccgccuucgacgaggccaucgccgagcucgacacccucaacgaggacuccuacaaggacuccacccucaucaugcagcuccuccgcgacaaccucacccucuggaccuccgacuccgccggcgaggagugcgacgccgccgagggcgccgagaacuga

SEQ ID NO: 51894 - RNA, 738 nt, Artificial Sequence
  derived and/or modified sequence opt2 from YWHAZ__Homo_sapiens__NP_001129172
auggacaagaacgagcucguccagaaggccaagcucgccgagcaggccgagcgcuacgacgacauggccgccugcaugaaguccgucaccgagcagggcgccgagcucuccaacgaggagcgcaaccuccucuccgucgccuacaagaacgucgucggcgcccgccgcuccuccuggcgcgucgucuccuccaucgagcagaagaccgagggcgccgagaagaagcagcagauggcccgcgaguaccgcgagaagaucgagaccgagcuccgcgacaucugcaacgacguccucucccuccucgagaaguuccucauccccaacgccucccaggccgaguccaaggucuucuaccucaagaugaagggcgacuacuaccgcuaccucgccgaggucgccgccggcgacgacaagaagggcaucgucgaccagucccagcaggccuaccaggaggccuucgagaucuccaagaaggagaugcagcccacccaccccauccgccucggccucgcccucaacuucuccgucuucuacuacgagauccucaacucccccgagaaggccugcucccucgccaagaccgccuucgacgaggccaucgccgagcucgacacccucuccgaggaguccuacaaggacuccacccucaucaugcagcuccuccgcgacaaccucacccucuggaccuccgacacccagggcgacgaggccgaggccggcgagggcggcgagaacuga

SEQ ID NO: 51895 - RNA, 2667 nt, Artificial Sequence
  derived and/or modified sequence opt2 from YY1AP1__Homo_sapiens__NP_001185832
auggccggcgucggccgcuccggcggccccuggggccgcacccgcggcggccgcuccggccgccucggcgucucccucggcgcccucuccucccucccccucgaggagcucccccgcccccucugcugccgccgcugccgccgccacuucggcuucgcccuccgcggcgagaccauccccgucuccgucgccggcuccgccuccucccaguucgccccccucgcccuccaccucucccuccuccucucccgcaucuccgccucccgccucacccgcuggcccccccccgacaagcgcgagggcuccgccgucgaccccggcaagcgccgcucccucgccgccacccccuccuccucccuccccugcacccucaucgcccucggccuccgccacgagaaggaggccaacgagcucauggaggaccucuucgagaccuuccaggacgagaugggcuucuccaacauggaggacgacggccccgaggaggaggagcgcgucgccgagccccaggccaacuucaacaccccccaggcccuccgcuucgaggagcuccucgccaaccuccucaacgagcagcaccagaucgccaaggagcucuucgagcagcucaagaugaagaagcccuccgccaagcagcagaaggaggucgagaaggucaagccccagugcaaggagguccaccagacccucauccucgaccccgcccagcgcaagcgccuccagcagcagaugcagcagcacguccagcuccucacccagauccaccuccucgccaccugcaaccccaaccucaaccccgaggccuccuccacccgcaucugccucaaggagcucggcaccuucgcccaguccuccaucgcccuccaccaccaguacaaccccaaguuccagacccucuuccagcccugcaaccucaugggcgccaugcagcucaucgaggacuucuccacccacgucuccaucgacugcuccccccacaagaccgucaagaagaccgccaacgaguuccccugccuccccaagcaggucgccuggauccucgccaccuccaaggucuucauguaccccgagcuccuccccgucugcucccucaaggccaagaacccccaggacaagauccucuucaccaaggccgaggacaaccuccucgcccucggccucaagcacuucgagggcaccgaguuccucaacccccucaucuccaaguaccuccucaccugcaagaccgcccgccagcucaccguccgcaucaagaaccucaacaugaaccgcgcccccgacaacaucaucaaguucuacaagaagaccaagcagcuccccguccucggcaagugcugcgaggagauccagccccaccaguggaagccccccaucgagcgcgaggagcaccgccuccccuucuggcucaaggccucccuccccuccauccaggaggagcuccgccacauggccgacggcgcccgcgaggucggcaacaugaccggcaccaccgagaucaacuccgaccagggccucgagaaggacaacuccgagcucggcuccgagacccgcuacccccuccuccuccccaagggcgucguccucaagcucaagcccgucgccgaccgcuuccccaagaaggccuggcgccagaagcgcuccuccguccucaagccccuccucauccagcccucccccucccuccagcccuccuucaaccccggcaagacccccgcccaguccacccacuccgaggccccccccuccaagaugguccuccgcaucccccaccccauccagcccgccaccguccuccagaccguccccggcguccccccccucggcgucuccggcggcgaguccuucgagucccccgccgcccuccccgccaugccccccgaggcccgcaccuccuucccccucuccgagucccagacccuccucuccuccgcccccguccccaaggucaugaugcccucccccgccuccuccauguuccgcaagcccuacguccgccgccgccccuccaagcgccgcggcgcccgcgccuuccgcugcaucaagcccgcccccgucauccaccccgccuccgucaucuucaccguccccgccaccaccgucaagaucgucucccucggcggcggcugcaacaugauccagcccgucaacgccgccgucgcccaguccccccagaccauccccaucgccacccuccucgucaaccccaccuccuuccccugcccccucaaccagccccucgucgccuccuccgucuccccccucaucgucuccggcaacuccgucaaccuccccauccccuccacccccgaggacaaggcccacaugaacgucgacaucgccugcgccgucgccgacggcgagaacgccuuccagggccucgagcccaagcucgagccccaggagcucuccccccucuccgccaccgucuuccccaaggucgagcacucccccggccccccccccgucgacaagcagugccaggagggccucuccgagaacuccgccuaccgcuggaccgucgucaagaccgaggagggccgccaggcccucgagccccucccccagggcauccaggagucccucaacaacuccucccccggcgaccucgaggaggucgucaagauggagcccgaggacgccaccgaggagaucuccggcuuccucuga

SEQ ID NO: 51896 - RNA, 1245 nt, Artificial Sequence
  derived and/or modified sequence opt2 from YY1__Homo_sapiens__NP_003394
auggccuccggcgacacccucuacaucgccaccgacggcuccgagaugcccgccgagaucgucgagcuccacgagaucgaggucgagaccauccccgucgagaccaucgagaccaccgucgucggcgaggaggaggaggaggacgacgacgacgaggacggcggcggcggcgaccacggcggcggcggcggccacggccacgccggccaccaccaccaccaccaccaccaccaccaccacccccccaugaucgcccuccagccccucgucaccgacgaccccacccagguccaccaccaccaggaggucauccucguccagacccgcgaggaggucgucggcggcgacgacuccgacggccuccgcgccgaggacggcuucgaggaccagauccucauccccguccccgcccccgccggcggcgacgacgacuacaucgagcagacccucgucaccgucgccgccgccggcaaguccggcggcggcggcuccuccuccuccggcggcggccgcgucaagaagggcggcggcaagaaguccggcaagaaguccuaccucuccggcggcgccggcgccgccggcggcggcggcgccgaccccggcaacaagaagugggagcagaagcagguccagaucaagacccucgagggcgaguucuccgucaccaugugguccuccgacgagaagaaggacaucgaccacgagaccgucgucgaggagcagaucaucggcgagaacuccccccccgacuacuccgaguacaugaccggcaagaagcucccccccggcggcauccccggcaucgaccucuccgaccccaagcagcucgccgaguucgcccgcaugaagccccgcaagaucaaggaggacgacgccccccgcaccaucgccugcccccacaagggcugcaccaagauguuccgcgacaacuccgccaugcgcaagcaccuccacacccacggcccccgcguccacgucugcgccgagugcggcaaggccuucgucgaguccuccaagcucaagcgccaccagcucguccacaccggcgagaagcccuuccagugcaccuucgagggcugcggcaagcgcuucucccucgacuucaaccuccgcacccacguccgcauccacaccggcgaccgccccuacgucugccccuucgacggcugcaacaagaaguucgcccaguccaccaaccucaagucccacauccucacccacgccaaggccaagaacaaccaguga

SEQ ID NO: 51897 - RNA, 1239 nt, Artificial Sequence
  derived and/or modified sequence opt2 from ZACN__Homo_sapiens__NP_851321
augauggcccucuggucccuccuccaccucaccuuccucggcuucuccaucacccuccuccucguccacggccagggcuuccagggcaccgccgccaucuggcccucccucuucaacgucaaccucuccaagaagguccaggaguccauccagauccccaacaacggcuccgccccccuccucgucgacguccgcgucuucgucuccaacgucuucaacgucgacauccuccgcuacaccauguccuccaugcuccuccuccgccucuccuggcucgacacccgccucgccuggaacaccuccgcccacccccgccacgccaucacccuccccugggagucccucuggaccccccgccucaccauccucgaggcccucugggucgacuggcgcgaccaguccccccaggcccgcgucgaccaggacggccacgucaagcucaaccucgcccucgccaccgagaccaacugcaacuucgagcuccuccacuucccccgcgaccacuccaacugcucccucuccuucuacgcccucuccaacaccgccauggagcucgaguuccaggcccacgucgucaacgagaucgucuccgucaagcgcgaguacgucgucuacgaccucaagacccagguccccccccagcagcucguccccugcuuccaggucacccuccgccucaagaacaccgcccucaaguccaucaucgcccuccucguccccgccgaggcccuccuccucgccgacgucugcggcggccuccucccccuccgcgccaucgagcgcaucggcuacaaggucacccuccuccucuccuaccucguccuccacuccucccucguccaggcccuccccuccuccuccuccugcaacccccuccucaucuacuacuucaccauccuccuccuccuccucuuccucuccaccaucgagaccguccuccucgccggccuccucgcccgcggcaaccucggcgccaaguccggccccucccccgccccccgcggcgagcagcgcgagcacggcaaccccggcccccaccccgccgaggagcccucccgcggcgucaagggcucccagcgcuccuggcccgagaccgccgaccgcaucuucuuccucgucuacgucgucggcguccucugcacccaguucgucuucgccggcaucuggaugugggccgccugcaaguccgacgccgcccccggcgaggccgccccccacggccgccgcccccgccucuga

SEQ ID NO: 51898 - RNA, 1368 nt, Artificial Sequence
  derived and/or modified sequence opt2 from ZAK__Homo_sapiens__NP_598407
auguccucccucggcgccuccuucguccagaucaaguucgacgaccuccaguucuucgagaacugcggcggcggcuccuucggcuccgucuaccgcgccaaguggaucucccaggacaaggaggucgccgucaagaagcuccucaagaucgagaaggaggccgagauccucuccguccucucccaccgcaacaucauccaguucuacggcgucauccucgagccccccaacuacggcaucgucaccgaguacgccucccucggcucccucuacgacuacaucaacuccaaccgcuccgaggagauggacauggaccacaucaugaccugggccaccgacgucgccaagggcaugcacuaccuccacauggaggcccccgucaaggucauccaccgcgaccucaagucccgcaacgucgucaucgccgccgacggcguccucaagaucugcgacuucggcgccucccgcuuccacaaccacaccacccacaugucccucgucggcaccuuccccuggauggcccccgaggucauccagucccuccccgucuccgagaccugcgacaccuacuccuacggcgucguccucugggagaugcucacccgcgagguccccuucaagggccucgagggccuccaggucgccuggcucgucgucgagaagaacgagcgccucaccauccccuccuccugcccccgcuccuucgccgagcuccuccaccagugcugggaggccgacgccaagaagcgccccuccuucaagcagaucaucuccauccucgaguccauguccaacgacaccucccuccccgacaagugcaacuccuuccuccacaacaaggccgaguggcgcugcgagaucgaggccacccucgagcgccucaagaagcucgagcgcgaccucuccuucaaggagcaggagcucaaggagcgcgagcgccgccucaagaugugggagcagaagcucaccgagcaguccaacaccccccuccuccucccccucgccgcccgcauguccgaggaguccuacuucgaguccaagaccgaggaguccaacuccgccgagauguccugccagaucaccgccaccuccaacggcgagggccacggcaugaaccccucccuccaggccaugaugcucaugggcuucggcgacaucuucuccaugaacaaggccggcgccgucaugcacuccggcaugcagaucaacaugcaggccaagcagaacuccuccaagaccaccuccaagcgccgcggcaagaaggucaacauggcccucggcuucuccgacuucgaccucuccgagggcgacgacgacgacgacgacgacggcgaggaggaggacaacgacauggacaacuccgaguga

SEQ ID NO: 51899 - RNA, 1860 nt, Artificial Sequence
  derived and/or modified sequence opt2 from ZAP70__Homo_sapiens__NP_001070
augcccgaccccgccgcccaccuccccuucuucuacggcuccaucucccgcgccgaggccgaggagcaccucaagcucgccggcauggccgacggccucuuccuccuccgccagugccuccgcucccucggcggcuacguccucucccucguccacgacguccgcuuccaccacuuccccaucgagcgccagcucaacggcaccuacgccaucgccggcggcaaggcccacugcggccccgccgagcucugcgaguucuacucccgcgaccccgacggccuccccugcaaccuccgcaagcccugcaaccgccccuccggccucgagccccagcccggcgucuucgacugccuccgcgacgccaugguccgcgacuacguccgccagaccuggaagcucgagggcgaggcccucgagcaggccaucaucucccaggccccccaggucgagaagcucaucgccaccaccgcccacgagcgcaugcccugguaccacuccucccucacccgcgaggaggccgagcgcaagcucuacuccggcgcccagaccgacggcaaguuccuccuccgcccccgcaaggagcagggcaccuacgcccucucccucaucuacggcaagaccgucuaccacuaccucaucucccaggacaaggccggcaaguacugcauccccgagggcaccaaguucgacacccucuggcagcucgucgaguaccucaagcucaaggccgacggccucaucuacugccucaaggaggccugccccaacuccuccgccuccaacgccuccggcgccgccgcccccacccuccccgcccaccccuccacccucacccacccccagcgccgcaucgacacccucaacuccgacggcuacacccccgagcccgcccgcaucaccucccccgacaagccccgccccaugcccauggacaccuccgucuacgagucccccuacuccgaccccgaggagcucaaggacaagaagcucuuccucaagcgcgacaaccuccucaucgccgacaucgagcucggcugcggcaacuucggcuccguccgccagggcgucuaccgcaugcgcaagaagcagaucgacgucgccaucaagguccucaagcagggcaccgagaaggccgacaccgaggagaugaugcgcgaggcccagaucaugcaccagcucgacaaccccuacaucguccgccucaucggcgucugccaggccgaggcccucaugcucgucauggagauggccggcggcggcccccuccacaaguuccucgucggcaagcgcgaggagauccccgucuccaacgucgccgagcuccuccaccaggucuccaugggcaugaaguaccucgaggagaagaacuucguccaccgcgaccucgccgcccgcaacguccuccucgucaaccgccacuacgccaagaucuccgacuucggccucuccaaggcccucggcgccgacgacuccuacuacaccgcccgcuccgccggcaaguggccccucaagugguacgcccccgagugcaucaacuuccgcaaguucuccucccgcuccgacgucugguccuacggcgucaccaugugggaggcccucuccuacggccagaagcccuacaagaagaugaagggccccgaggucauggccuucaucgagcagggcaagcgcauggagugcccccccgagugcccccccgagcucuacgcccucauguccgacugcuggaucuacaagugggaggaccgccccgacuuccucaccgucgagcagcgcaugcgcgccugcuacuacucccucgccuccaaggucgagggcccccccggcuccacccagaaggccgaggccgccugcgccuga

SEQ ID NO: 51900 - RNA, 1275 nt, Artificial Sequence
  derived and/or modified sequence opt2 from ZAR1__Homo_sapiens__NP_783318
auggccgcccucggcgacgagguccucgacggcuacgucuuccccgccugcccccccugcuccuaccgcuaccccuaccccgccgccaccaagggcaagggcgccgccggcggcuccuggcagcagcgcggccgcggcugccuccccgccuccucccccugcuccgccggcgccgccucccucuccuuccccggcugcggccgccucaccgccgccgaguacuucgacuccuaccagcgcgagcgccucauggcccuccucgcccaggucggccccggccucggcccccgcgcccgccgcgccggcuccugcgacgucgccguccaggucuccccccgcaucgacgccgccguccagugcucccucggccgccgcacccuccagcgccgcgcccgcgaccccgagucccccgccggccccggcgccgagggcaccaccggcggcggcuccuucucccagcagcccucccgccgcggccucgagcagggcuccccccagaacggcgccccccgccccaugcgcuucccccgcaccgucgccgucuacuccccccucgcccuccgccgccucaccgccuuccucgagggccccggccccgccgccggcgagcagcgcuccggcgccuccgacggcgagcgcggccccccccccgcccgccuccagggccccgaggagggcgaggucuggaccaagaaggccccccgccgcccccaguccgacgacgacggcgaggcccaggccgccguccgcgccuccugggagcagcccgccgacggccccgagcuccccccccgcgaggcccaggagggcgaggccgccccccgcuccgcccuccgcucccccggccagccccccuccgccggccgcgcccgcgacggcggcgacggccgcgaggccgccgucgccggcgagggccccuccccccgcucccccgagcucggcaaggagcgccuccgcuuccaguuccucgagcagaaguacggcuacuaccacugcaaggacugcaacauccgcugggaguccgccuacgucuggugcguccagggcaccaacaaggucuacuucaagcaguucugccgcaccugccagaaguccuacaaccccuaccgcgucgaggacaucaccugccaguccugcaagcagacccgcugcuccugccccgucaagcuccgccacgucgaccccaagcgcccccaccgccaggaccucugcggccgcugcaagggcaagcgccucuccugcgacuccaccuucuccuucaaguacaucaucuga

SEQ ID NO: 51901 - RNA, 966 nt, Artificial Sequence
  derived and/or modified sequence opt2 from ZAR1L__Homo_sapiens__NP_001130043
auggagcgcuucguccgcguccccuacggccucuaccagggcuacggcuccaccgucccccucggccagcccggccucuccggccacaagcagcccgacuggcgccagaacaugggcccccccaccuuccucgcccgccccggccuccucguccccgccaacgcccccgacuacugcaucgaccccuacaagcgcgcccagcucaaggccauccucucccagaugaaccccucccucuccccccgccucugcaagcccaacaccaaggaggucggcguccaggucuccccccgcgucgacaaggccguccagugcucccucggcccccgcacccucuccuccugcucccccugggacggccgcgacccccaggagccccuccccgccugcggcgucaccucccccgccaccggccgccgcggccucauccgccuccgccgcgacggcgacgaggccgaguccaaggcccuccccggccccgccgaggccucccagccccagccccccucccgccgcuccggcgccgaccgccaggaggagcccggccagcucgaggaguccggcgagaaggacgcccccugcccccaggagaccaaguccaagcagguccccggcgacgccgccuccgagccccuccgccgccccaacuuccaguuccucgagcccaaguacggcuacuuccacugcaaggacugcaagacccgcugggaguccgccuacgucuggugcaucuccggcaccaacaaggucuacuucaagcagcucugcugcaagugccagaaguccuucaaccccuaccgcgucgaggccauccagugccagaccugcuccaagucccacugcuccugcccccagaagaagcgccacaucgaccuccgccgcccccaccgccaggagcucugcggccgcugcaaggacaagcgcuucuccugcggcaacaucuacuccuucaaguacgucauguga

SEQ ID NO: 51902 - RNA, 507 nt, Artificial Sequence
  derived and/or modified sequence opt2 from ZASP__Homo_sapiens__NP_001276862
augcccgccucccacgcccccggcgccuccgccaacccccccugccaccuccccuccgucaucgccgacuccuuccucgccucccaccucucccccucccccgagcgcaccgucaugcucggcuccgcccccgacccccucccccaggccggcucccgccgcggccaccgcggcgaggccaaccccgcccccuccccccgcucccacugcgccucccccaccaccuccuggaagcgccgcggcccccgcgagggcgccucccccaccucccuccucuccuccacccccugcuggaccggccuccgcggcgagggcggcggcaccggccccaccccccccggcacccccggcgccgaggacgcccccggccuccgcgcccuccgcgaggcccgcggcgagggcggccucggccucggcacccucggccuccccgccuggcucccccucggcucccgcgucugggucgagggcccccgcgucucccaggucuccugccagccccaguga

SEQ ID NO: 51903 - RNA, 2085 nt, Artificial Sequence
  derived and/or modified sequence opt2 from ZBED1__Homo_sapiens__NP_001164606
auggagaacaagucccucgaguccucccagaccgaccucaagcucgucgcccacccccgcgccaaguccaaggucuggaaguacuucggcuucgacaccaacgccgagggcugcauccuccaguggaagaagaucuacugccgcaucugcauggcccagaucgccuacuccggcaacaccuccaaccucuccuaccaccucgagaagaaccaccccgaggaguucugcgaguucgucaaguccaacaccgagcagaugcgcgaggccuucgccaccgccuucuccaagcucaagcccgaguccucccagcagcccggccaggacgcccucgccgucaaggccggccacggcuacgacuccaagaagcagcaggagcucaccgccgccguccucggccucaucugcgagggccucuaccccgccuccaucgucgacgagcccaccuucaagguccuccucaagaccgccgacccccgcuacgagcuccccucccgcaaguacaucuccaccaaggccauccccgagaaguacggcgccguccgcgaggucauccucaaggagcucgccgaggccaccuggugcggcaucuccaccgacauguggcgcuccgagaaccagaaccgcgccuacgucacccucgccgcccacuuccucggccucggcgcccccaacugccucuccaugggcucccgcugccucaagaccuucgagguccccgaggagaacaccgccgagaccaucacccgcguccucuacgaggucuucaucgaguggggcaucuccgccaaggucuucggcgccaccaccaacuacggcaaggacaucgucaaggccugcucccuccucgacgucgccguccacaugcccugccucggccacaccuucaacgccggcauccagcaggccuuccagcuccccaagcucggcgcccuccucucccgcugccgcaagcucgucgaguacuuccagcaguccgccgucgccauguacaugcucuacgagaagcagaagcagcagaacgucgcccacugcaugcucgucuccaaccgcgucuccugguggggcuccacccucgccaugcuccagcgccucaaggagcagcaguucgucaucgccggcguccucgucgaggacuccaacaaccaccaccucaugcucgaggccuccgagugggccaccaucgagggccucgucgagcuccuccagcccuucaagcaggucgccgagaugcucuccgccucccgcuaccccaccaucuccauggucaagccccuccuccacaugcuccucaacaccacccucaacaucaaggagaccgacuccaaggagcucuccauggccaaggaggucaucgccaaggagcucuccaagaccuaccaggagacccccgagaucgacauguuccucaacgucgccaccuuccucgacccccgcuacaagcgccuccccuuccucuccgccuucgagcgccagcaggucgagaaccgcgucgucgaggaggccaagggccuccucgacaaggucaaggacggcggcuaccgccccgccgaggacaagaucuuccccguccccgaggagccccccgucaagaagcucaugcgcaccuccacccccccccccgccuccgucaucaacaacaugcucgccgagaucuucugccagaccggcggcgucgaggaccaggaggaguggcacgcccaggucgucgaggagcucuccaacuucaagucccagaagguccucggccucaacgaggacccccucaaguggugguccgaccgccucgcccucuucccccuccuccccaagguccuccagaaguacuggugcgucaccgccacccgcgucgcccccgagcgccucuucggcuccgccgccaacgucgucuccgccaagcgcaaccgccucgcccccgcccacgucgacgagcaggucuuccucuacgagaacgcccgcuccggcgccgaggccgagcccgaggaccaggacgagggcgaguggggccucgaccaggagcaggucuucucccucggcgacggcgucuccggcggcuucuucggcauccgcgacuccuccuuccucuga

SEQ ID NO: 51904 - RNA, 3516 nt, Artificial Sequence
  derived and/or modified sequence opt2 from ZBED4__Homo_sapiens__NP_055653
auggagaacaaccucaagaccugccccaaggaggacggcgacuucgucuccgacaagaucaaguucaagaucgaggaggaggacgacgacggcaucccccccgacucccucgagcgcauggacuucaaguccgagcaggaggacaugaagcagaccgacuccggcggcgagcgcgccggccucggcggcaccggcugcuccugcaagccccccggcaaguaccucuccgccgaguccgaggacgacuacggcgcccucuucucccaguacuccuccacccucuacgacgucgccauggaggccgucacccagucccuccucuccucccgcaacauguccucccgcaagaagucccccgccuggaagcacuucuucaucuccccccgcgacuccaccaaggccaucugcauguacugcgucaaggaguucucccgcggcaagaacgagaaggaccucuccaccuccugccucaugcgccacguccgccgcgcccaccccaccguccucauccaggagaacggcuccgucuccgccgucuccuccuuccccucccccucccuccuccuccccccccagcccgccgacgccggcgaccucuccaccauccucucccccaucaagcucguccagaaggucgccuccaagauccccucccccgaccgcaucaccgaggaguccgucuccgucgucuccuccgaggagaucuccuccgacauguccgucuccgagaagugcggccgcgaggaggcccucgucggcuccuccccccaccuccccgcccuccacuacgacgagcccgccgagaaccucgccgagaagucccucccccuccccaaguccaccuccggcucccgccgccgcuccgccgucuggaagcacuucuaccucuccccccucgacaacuccaaggccgucugcauccacugcaugaacgaguucucccgcggcaagaacggcaaggaccucggcaccuccugccucauccgccacauguggcgcgcccaccgcgccaucguccuccaggagaacggcggcaccggcauccccccccucuacuccaccccccccacccuccuccccucccuccucccccccgagggcgagcucuccuccgucuccuccucccccgucaagcccguccgcgagucccccuccgccuccuccucccccgaccgccucaccgaggaccuccagucccaccucaaccccggcgacggccucauggaggacgucgccgccuucuccuccuccgacgacaucggcgaggccuccgccuccucccccgagaagcagcaggccgacggccucuccccccgccucuucgaguccggcgccaucuuccagcagaacaagaaggucaugaagcgccucaaguccgaggucuggcaccacuucucccucgcccccauggacucccucaaggccgagugccgcuacugcggcugcgccaucucccgcggcaagaagggcgacgucggcaccuccugccucaugcgccaccucuaccgccgccaccccgaggucgucggcucccagaagggcuuccucggcgccucccucgccaacucccccuacgccacccucgccuccgccgaguccuccuccuccaagcucaccgaccuccccaccgucgucaccaagaacaaccaggucauguuccccgucaacuccaagaagaccuccaagcucuggaaccacuucuccaucugcuccgccgacuccaccaaggucgucugccuccacugcggccgcaccaucucccgcggcaagaagcccaccaaccucggcaccuccugccuccuccgccaccuccagcgcuuccacuccaacguccucaagaccgaggucuccgagaccgcccgccccuccucccccgacacccgcgucccccgcggcaccgagcucuccggcgccuccuccuucgacgacaccaacgagaaguucuacgacucccaccccgucgccaagaagaucaccucccucaucgccgagaugaucgcccucgaccuccagcccuacuccuucgucgacaacgucggcuucaaccgccuccucgaguaccucaagccccaguacucccuccccgcccccuccuacuucucccgcaccgccauccccggcauguacgacaacgucaagcagaucaucaugucccaccucaaggaggccgaguccggcgucauccacuucaccuccggcaucuggauguccaaccagacccgcgaguaccucacccucaccgcccacugggucuccuucgagucccccgcccgcccccgcugcgacgaccaccacugcuccgcccuccucgacgucucccaggucgacugcgacuacuccggcaacuccauccagaagcagcucgagugcuggugggaggccugggucaccuccaccggccuccaggucggcaucaccgucaccgacaacgccuccaucggcaagacccucaacgagggcgagcacuccuccguccagugcuucucccacaccgucaaccucaucgucuccgaggccaucaagucccagcgcaugguccagaaccuccucucccucgcccgcaagaucugcgagcgcguccaccgcucccccaaggccaaggagaagcucgccgagcuccagcgcgaguacgcccucccccagcaccaccucauccaggacguccccuccaagugguccaccuccuuccacaugcucgagcgccucaucgagcagaagcgcgccaucaacgagauguccgucgagugcaacuuccgcgagcucaucuccugcgaccagugggaggucaugcaguccgucugccgcgcccucaagcccuucgaggccgccucccgcgagauguccacccagauguccacccucucccaggucauccccaugguccacauccucaaccgcaaggucgagaugcucuucgaggagaccaugggcaucgacaccaugcuccgcucccucaaggaggccauggucucccgccucuccgccacccuccacgacccccgcuacgucuucgccacccuccucgacccccgcuacaaggccucccucuucaccgaggaggaggccgagcaguacaagcaggaccucauccgcgagcucgagcucaugaacuccaccuccgaggacgucgccgccucccaccgcugcgacgccggcucccccuccaaggacuccgccgccgaggagaaccucuggucccucgucgccaaggucaagaagaaggacccccgcgagaagcuccccgaggccaugguccucgccuaccucgaggaggagguccucgagcacuccugcgacccccucaccuacuggaaccucaagaaggccuccuggcccggccucuccgcccucgccguccgcuuccucggcugcccccccuccaucguccccuccgagaagcucuucaacacccccaccgagaacggcucccucggccagucccgccucaugauggagcacuucgagaagcucaucuuccucaaggucaaccucccccucaucuacuuccaguacuga

SEQ ID NO: 51905 - RNA, 2082 nt, Artificial Sequence
  derived and/or modified sequence opt2 from ZBED5__Homo_sapiens__NP_001137139
augaucgccccccuccucugcauccucuccuacaacuucaacaccuucgccauccucaacgucuacuccaagcucaccauguucugcaccaccaacucccuccccauggaccuccuccucaagcagggcucccucaagcaggaggucgaguccuucugcuaccagaucgucuccgaguccaacgaccagaaggucggcauccuccaguccgaggacaagcagcuccagcccuccgucuccaagaaguccgagggcgagcucucccgcgucaaguucaucuccaacuccaacaagaucaccuucuccaagaagcccaagcgccgcaaguacgacgaguccuaccucuccuucggcuucaccuacuucggcaaccgcgacgccccccacgcccagugcguccucugcaagaagauccucuccaacuccucccucgcccccuccaagcuccgccgccaccucgagaccaagcacgccgccuacaaggacaaggacaucuccuucuucaagcagcaccucgacucccccgagaacaacaagccccccacccccaagaucgucaacaccgacaacgaguccgccaccgaggccuccuacaacgucuccuaccacaucgcccucuccggcgaggcccacaccaucggcgagcuccucaucaagcccugcgccaaggacgucgucaugcgcauguucgacgagcaguacuccaagaagaucgacgccguccagcucuccaacuccaccgucgcccgccgcaucaaggaccucgccgccgacaucgaggaggagcucgucugccgccucaagaucugcgacggcuucucccuccagcucgacgaguccgccgacgucuccggccucgccguccuccucgucuucguccgcuaccgcuucaacaaguccaucgaggaggaccuccuccucugcgagucccuccaguccaacgccaccggcgaggagaucuucaacugcaucaacuccuucaugcagaagcacgagaucgagugggagaagugcgucgacgucugcuccgacgccucccgcgccgucgacggcaagaucgccgaggccgucacccucaucaaguacgucgcccccgaguccaccuccucccacugccuccucuaccgccacgcccucgccgucaagaucaugcccaccucccucaagaacguccucgaccaggccguccagaucaucaacuacaucaaggcccgcccccaccagucccgccuccucaagauccucugcgaggagaugggcgcccagcacaccgcccuccuccucaacaccgagguccgcuggcucucccgcggcaagguccucguccgccucuucgagcuccgccgcgagcuccucgucuucauggacuccgccuuccgccucuccgacugccucaccaacuccuccuggcuccuccgccucgccuaccucgccgacaucuucaccaagcucaacgaggucaaccucuccaugcagggcaagaacgucaccgucuucaccgucuucgacaagauguccucccuccuccgcaagcucgaguucugggccuccuccgucgaggaggagaacuucgacugcuuccccacccucuccgacuuccucaccgagaucaacuccaccgucgacaaggacaucugcuccgccaucguccagcaccuccgcggccuccgcgccacccuccucaaguacuuccccgucaccaacgacaacaacgccuggguccgcaaccccuucaccgucaccgucaagcccgccucccucgucgcccgcgacuacgagucccucaucgaccucaccuccgacucccaggucaagcagaacuucuccgagcucucccucaacgacuucugguccucccucauccaggaguaccccuccaucgcccgccgcgccguccgcguccuccuccccuucgccaccaugcaccucugcgagaccggcuucuccuacuacgccgccaccaagaccaaguaccgcaagcgccucgacgccgccccccacaugcgcauccgccucuccaacaucacccccaacaucaagcgcaucugcgacaagaagacccagaagcacugcucccacuga

SEQ ID NO: 51906 - RNA, 1065 nt, Artificial Sequence
  derived and/or modified sequence opt2 from ZBP1__Homo_sapiens__NP_001153890
auggcccaggcccccgccgaccccggccgcgaggccgagcgcccccagcagcacgccgccaccauccccgagacccccggcccccaguucucccagcagcgcgaggaggacaucuaccgcuuccucaaggacaacggcccccagcgcgcccucgucaucgcccaggcccucggcaugcgcaccgccaaggacgucaaccgcgaccucuaccgcaugaagucccgccaccuccucgacauggacgagcaguccaaggccuggaccaucuaccgccccgaggacuccggccgccgcgccaaguccgccuccaucaucuaccagcacaaccccaucaacaugaucugccagaacggccccaacuccuggaucuccaucgccaacuccgaggccauccagaucggccacggcaacaucaucacccgccagaccgucucccgcgaggacggcuccgccggcccccgccaccuccccuccauggcccccggcgacuccuccaccuggggcacccucgucgaccccuggggcccccaggacauccacauggagcaguccauccuccgccgcguccagcucggccacuccaacgagaugcgccuccacggcguccccuccgagggccccgcccacaucccccccggcuccccccccgucuccgccaccgccgccggccccgaggccuccuucgaggcccgcauccccucccccggcacccaccccgagggcgaggccgcccagcgcauccacaugaaguccugcuuccucgaggacgccaccaucggcaacuccaacaagauguccaucucccccggcgucgccggccccggcggcgucgccggcuccggcgagggcgagcccggcgaggacgccggccgccgccccgccgacacccagucccgcucccacuucccccgcgacaucggccagcccaucacccccucccacuccaagcucacccccaagcucgagaccaugacccucggcaaccgcucccacaaggccgccgagggcucccacuacgucgacgaggccucccacgagggcuccugguggggcggcggcaucuga

SEQ ID NO: 51907 - RNA, 2616 nt, Artificial Sequence
  derived and/or modified sequence opt2 from ZBTB10__Homo_sapiens__NP_001099009
auguccuucuccgagaugaaccgccgcacccucgccuuccgcggcggcggccucgucaccgccuccggcggcggcuccaccaacaacaacgccggcggcgaggccuccgccuggcccccccagccccagccccgccagccccccccccccgccccccccgcccuccagccccccaacggccgcggcgccgacgaggaggucgagcucgagggccucgagccccaggaccucgaggccuccgccggccccgccgccggcgccgccgaggaggccaaggagcuccuccucccccaggacgccggcggccccaccucccucggcggcggcgccggcggcccccuccucgccgagcgcaaccgccgcacccucgccuuccgcggcggcggcggcggcggccucggcaacaacggcuccucccgcggccgccccgagaccuccgucuggccccuccgccacuucaacggccgcggccccgccaccgucgaccucgagcucgacgcccucgagggcaaggagcucaugcaggacggcgccucccucuccgacuccaccgaggacgaggaggagggcgccucccucggcgacggcuccggcgccgagggcggcuccugcuccuccucccgccgcuccggcggcgacggcggcgacgaggucgagggcuccggcgucggcgccggcgagggcgagaccguccagcacuucccccucgcccgccccaagucccucaugcagaagcuccagugcuccuuccagaccuccuggcucaaggacuuccccuggcuccgcuacuccaaggacaccggccucauguccugcggcuggugccagaagacccccgccgacggcggcuccgucgaccucccccccgucggccacgacgagcucucccgcggcacccgcaacuacaagaagacccuccuccuccgccaccacgucuccaccgagcacaagcuccacgaggccaacgcccaggaguccgagauccccuccgaggagggcuacugcgacuucaacucccgccccaacgagaacuccuacugcuaccagcuccuccgccagcucaacgagcagcgcaagaagggcauccucugcgacgucuccaucgucgucuccggcaagaucuucaaggcccacaagaacauccucgucgccggcucccgcuucuucaagacccucuacugcuucuccaacaaggagucccccaaccagaacaacaccacccaccucgacaucgccgccguccagggcuucuccgucauccucgacuuccucuacuccggcaaccucguccucaccucccagaacgccaucgaggucaugaccgucgccuccuaccuccagauguccgaggucguccagaccugccgcaacuucaucaaggacgcccucaacaucuccaucaaguccgaggcccccgaguccgucgucgucgacuacaacaaccgcaagcccgucaaccgcgacggccucuccuccucccgcgaccagaagaucgccuccuucugggccacccgcaaccucaccaaccucgccuccaacgucaagaucgagaacgacggcugcaacgucgacgagggccagaucgagaacuaccagaugaacgacuccuccuggguccaggacggcucccccgagauggccgagaacgaguccgagggccagaccaaggucuucaucuggaacaacaugggcucccagggcauccaggagaccggcaagacccgccgcaagaaccagaccaccaagcgcuucaucuacaacaucccccccaacaacgagaccaaccucgaggacugcuccgucaugcagccccccgucgccuaccccgaggagaacacccuccucaucaaggaggagcccgaccucgacggcgcccuccucuccggccccgacggcgaccgcaacgucaacgccaaccuccucgccgaggccggcaccucccaggacggcggcgacgccggcaccucccacgacuucaaguacggccucaugcccggccccuccaacgacuucaaguacggccucauccccggcaccuccaacgacuucaaguacggccucauccccggcgccuccaacgacuucaaguacggccuccuccccgaguccuggcccaagcaggagaccugggagaacggcgaguccucccucaucaugaacaagcucaagugcccccacugcuccuacgucgccaaguaccgccgcacccucaagcgccaccuccucauccacaccggcguccgcuccuucuccugcgacaucugcggcaagcucuucacccgccgcgagcacgucaagcgccacucccucguccacaagaaggacaagaaguacaagugcauggucugcaagaagaucuucaugcucgccgccuccgucggcauccgccacggcucccgccgcuacggcgucugcgucgacugcgccgacaagucccagcccggcggccaggagggcgucgaccagggccaggacaccgaguucccccgcgacgaggaguacgaggagaacgaggucggcgaggccgacgaggagcucgucgacgacggcgaggaccagaacgaccccucccgcugggacgaguccggcgaggucugcaugucccucgacgacuga

SEQ ID NO: 51908 - RNA, 1380 nt, Artificial Sequence
  derived and/or modified sequence opt2 from ZBTB12__Homo_sapiens__NP_862825
auggccuccggcgucgagguccuccgcuuccagcuccccggccacgaggccgccacccuccgcaacaugaaccagcuccgcgccgaggagcgcuucugcgacgucaccaucgucgccgacucccucaaguuccgcggccacaaggucauccucgccgccugcucccccuuccuccgcgaccaguuccuccucaaccccuccuccgagcuccaggucucccucaugcacuccgcccgcaucgucgccgaccuccuccucuccugcuacaccggcgcccucgaguucgccguccgcgacaucgucaacuaccucaccgccgccuccuaccuccagauggagcacgucgucgagaagugccgcaacgcccucucccaguucaucgagcccaagaucggccucaaggaggacggcgucuccgaggccucccucgucuccuccaucuccgccaccaagucccuccucccccccgcccgcacccccaagcccgcccccaagcccccccccccccccccccucccccccccccuccuccgccccgucaagcucgaguucccccucgacgaggaccucgagcucaaggccgaggaggaggacgaggacgaggacgaggacgucuccgacaucugcaucgucaaggucgaguccgcccucgaggucgcccaccgccucaagccccccggcggccucggcggcggccucggcaucggcggcuccgucggcggccaccucggcgagcucgcccaguccuccgucccccccuccaccgucgcccccccccagggcgucgucaaggccugcuacucccucuccgaggacgccgagggcgagggccuccuccucauccccggcggccgcgccuccgucggcgccaccuccggccucgucgaggccgccgccgucgccauggccgcccgcggcgccggcggcucccucggcgccggcggcucccgcggcccccuccccggcggcuucuccggcggcaacccccucaagaacaucaagugcaccaagugccccgaggucuuccagggcgucgagaagcucgucuuccacaugcgcgcccagcacuucaucuucaugugcccccgcugcggcaagcaguucaaccacuccuccaaccucaaccgccacaugaacguccaccgcggcgucaagucccacuccugcggcaucugcggcaagugcuucacccagaaguccacccuccacgaccaccucaaccuccacuccggcgcccgccccuaccgcugcuccuacugcgacguccgcuucgcccacaagcccgccauccgccgccaccucaaggagcagcacggcaagaccaccgccgagaacguccucgaggccuccgucgccgagaucaacguccucauccgcuga

SEQ ID NO: 51909 - RNA, 1350 nt, Artificial Sequence
  derived and/or modified sequence opt2 from ZBTB14__Homo_sapiens__NP_001137295
auggaguucuucaucuccauguccgagaccaucaaguacaacgacgacgaccacaagacccucuuccucaagacccucaacgagcagcgccucgagggcgaguucugcgacaucgccaucgucgucgaggacgucaaguuccgcgcccaccgcugcguccucgccgccugcuccaccuacuucaagaagcucuucaagaagcucgaggucgacuccuccuccgucaucgagaucgacuuccuccgcuccgacaucuucgaggagguccucaacuacauguacaccgccaagaucuccgucaagaaggaggacgucaaccucaugauguccuccggccagauccucggcauccgcuuccucgacaagcucugcucccagaagcgcgacgucuccucccccgacgagaacaacggccaguccaaguccaaguacugccucaagaucaaccgccccaucggcgacgccgccgacacccaggacgacgacgucgaggagaucggcgaccaggacgacucccccuccgacgacaccgucgagggcaccccccccucccaggaggacggcaagucccccaccaccacccuccgcguccaggaggccauccucaaggagcucggcuccgaggagguccgcaaggucaacugcuacggccaggaggucgaguccauggagacccccgaguccaaggaccucggcucccagaccccccaggcccucaccuucaacgacggcauguccgaggucaaggacgagcagacccccggcuggaccaccgccgccuccgacaugaaguucgaguaccuccucuacggccaccaccgcgagcagaucgccugccaggccugcggcaagaccuucuccgacgagggccgccuccgcaagcacgagaagcuccacaccgccgaccgccccuucgucugcgagaugugcaccaagggcuucaccacccaggcccaccucaaggagcaccucaagauccacaccggcuacaagcccuacuccugcgaggucugcggcaaguccuucauccgcgcccccgaccucaagaagcacgagcgcguccacuccaacgagcgccccuucgccugccacaugugcgacaaggccuucaagcacaagucccaccucaaggaccacgagcgccgccaccgcggcgagaagcccuucgucugcggcuccugcaccaaggccuucgccaaggccuccgaccucaagcgccacgagaacaacaugcacuccgagcgcaagcaggucacccccuccgccauccaguccgagaccgagcagcuccaggccgccgccauggccgccgaggccgagcagcagcucgagaccaucgccugcuccuga

SEQ ID NO: 51910 - RNA, 2022 nt, Artificial Sequence
  derived and/or modified sequence opt2 from ZBTB16__Homo_sapiens__NP_001018011
auggaccucaccaagaugggcaugauccagcuccagaaccccucccaccccaccggccuccucugcaaggccaaccagaugcgccucgccggcacccucugcgacgucgucaucauggucgacucccaggaguuccacgcccaccgcaccguccucgccugcaccuccaagauguucgagauccucuuccaccgcaacucccagcacuacacccucgacuuccucucccccaagaccuuccagcagauccucgaguacgccuacaccgccacccuccaggccaaggccgaggaccucgacgaccuccucuacgccgccgagauccucgagaucgaguaccucgaggagcagugccucaagaugcucgagaccauccaggccuccgacgacaacgacaccgaggccaccauggccgacggcggcgccgaggaggaggaggaccgcaaggcccgcuaccucaagaacaucuucaucuccaagcacuccuccgaggaguccggcuacgccuccgucgccggccagucccuccccggccccauggucgaccagucccccuccgucuccaccuccuucggccucuccgccaugucccccaccaaggccgccgucgacucccucaugaccaucggccagucccuccuccagggcacccuccagccccccgccggccccgaggagcccacccucgccggcggcggccgccaccccggcgucgccgaggucaagaccgagaugaugcaggucgacgagguccccucccaggacucccccggcgccgccgaguccuccaucuccggcggcaugggcgacaaggucgaggagcgcggcaaggagggccccggcacccccacccgcuccuccgucaucaccuccgcccgcgagcuccacuacggccgcgaggaguccgccgagcagguccccccccccgccgaggccggccaggcccccaccggccgccccgagcaccccgcccccccccccgagaagcaccucggcaucuacuccguccuccccaaccacaaggccgacgccguccucuccaugcccuccuccgucaccuccggccuccacguccagcccgcccucgccgucuccauggacuucuccaccuacggcggccuccucccccagggcuucauccagcgcgagcucuucuccaagcucggcgagcucgccgucggcaugaaguccgagucccgcaccaucggcgagcagugcuccgucugcggcgucgagcuccccgacaacgaggccgucgagcagcaccgcaagcuccacuccggcaugaagaccuacggcugcgagcucugcggcaagcgcuuccucgacucccuccgccuccgcaugcaccuccucgcccacuccgccggcgccaaggccuucgucugcgaccagugcggcgcccaguucuccaaggaggacgcccucgagacccaccgccagacccacaccggcaccgacauggccgucuucugccuccucugcggcaagcgcuuccaggcccaguccgcccuccagcagcacauggagguccacgccggcguccgcuccuacaucugcuccgagugcaaccgcaccuuccccucccacaccgcccucaagcgccaccuccgcucccacaccggcgaccaccccuacgagugcgaguucugcggcuccugcuuccgcgacgaguccacccucaagucccacaagcgcauccacaccggcgagaagcccuacgagugcaacggcugcggcaagaaguucucccucaagcaccagcucgagacccacuaccgcguccacaccggcgagaagcccuucgagugcaagcucugccaccagcgcucccgcgacuacuccgccaugaucaagcaccuccgcacccacaacggcgccucccccuaccagugcaccaucugcaccgaguacugccccucccucuccuccaugcagaagcacaugaagggccacaagcccgaggagaucccccccgacuggcgcaucgagaagaccuaccucuaccucugcuacgucuga

SEQ ID NO: 51911 - RNA, 2205 nt, Artificial Sequence
  derived and/or modified sequence opt2 from ZBTB17__Homo_sapiens__XP_011540387
auguacaccgccaagcucucccucucccccgagaacgucgacgacguccucgccgucgccaccuuccuccagaugcaggacaucaucaccgccugccacgcccucaagucccucgccgagcccgccaccucccccggcggcaacgccgaggcccucgccaccgagggcggcgacaagcgcgccaaggaggagaaggucgccaccuccacccucucccgccucgagcaggccggccgcuccacccccaucggccccucccgcgaccucaaggaggagcgcggcggccaggcccaguccgccgccuccggcgccgagcagaccgagaaggccgacgccccccgcgagcccccccccgucgagcucaagcccgaccccaccuccggcauggccgccgccgaggccgaggccgcccucuccgaguccuccgagcaggagauggaggucgagcccgcccgcaagggcgaggaggagcagaaggagcaggaggagcaggaggaggagggcgccggccccgccgaggucaaggaggagggcucccagcucgagaacggcgaggcccccgaggagaacgagaacgaggaguccgccggcaccgacuccggccaggagcucggcuccgaggcccgcggccuccgcuccggcaccuacggcgaccgcaccgaguccaaggccuacggcuccgucauccacaagugcgaggacugcggcaaggaguucacccacaccggcaacuucaagcgccacauccgcauccacaccggcgagaagcccuucuccugccgcgagugcuccaaggccuucuccgaccccgccgccugcaaggcccacgagaagacccacuccccccucaagcccuacggcugcgaggagugcggcaaguccuaccgccucaucucccuccucaaccuccacaagaagcgccacuccggcgaggcccgcuaccgcugcgaggacugcggcaagcucuucaccaccuccggcaaccucaagcgccaccagcucguccacuccggcgagaagcccuaccagugcgacuacugcggccgcuccuucuccgaccccaccuccaagaugcgccaccucgagacccacgacaccgacaaggagcacaagugcccccacugcgacaagaaguucaaccaggucggcaaccucaaggcccaccucaagauccacaucgccgacggcccccucaagugccgcgagugcggcaagcaguucaccaccuccggcaaccucaagcgccaccuccgcauccacuccggcgagaagcccuacgucugcauccacugccagcgccaguucgccgaccccggcgcccuccagcgccacguccgcauccacaccggcgagaagcccugccagugcgucaugugcggcaaggccuucacccaggccuccucccucaucgcccacguccgccagcacaccggcgagaagcccuacgucugcgagcgcugcggcaagcgcuucguccaguccucccagcucgccaaccacauccgccaccacgacaacauccgcccccacaagugcuccgucugcuccaaggccuucgucaacgucggcgaccucuccaagcacaucaucauccacaccggcgagaagcccuaccucugcgacaagugcggccgcggcuucaaccgcgucgacaaccuccgcucccacgucaagaccguccaccagggcaaggccggcaucaagauccucgagcccgaggagggcuccgaggucuccgucgucaccgucgacgacauggucacccucgccaccgaggcccucgccgccaccgccgucacccagcucaccggccccgccacccuccccgccgucguccccgucggcgccgccgucaccgccgacgagaccgagguccucaaggccgagaucuccaaggccgucaagcagguccaggaggaggaccccaacacccacauccucuacgccugcgacuccugcggcgacaaguuccucgacgccaacucccucgcccagcacguccgcauccacaccgcccaggcccucgucauguuccagaccgacgccgacuucuaccagcaguacggccccggcggcaccuggcccgccggccagguccuccaggccggcgagcucgucuuccgcccccgcgacggcgccgagggccagcccgcccucgccgagaccucccccaccgcccccgagugccccccccccgccgaguga

SEQ ID NO: 51912 - RNA, 1596 nt, Artificial Sequence
  derived and/or modified sequence opt2 from ZBTB18__Homo_sapiens__NP_991331
augugccccaagggcuacgaggacuccauggaguuccccgaccacucccgccaccuccuccagugccucuccgagcagcgccaccagggcuuccucugcgacugcaccguccucgucggcgacgcccaguuccgcgcccaccgcgccguccucgccuccugcuccauguacuuccaccucuucuacaaggaccagcucgacaagcgcgacaucguccaccucaacuccgacaucgucaccgcccccgccuucgcccuccuccucgaguucauguacgagggcaagcuccaguucaaggaccuccccaucgaggacguccucgccgccgccuccuaccuccacauguacgacaucgucaaggucugcaagaagaagcucaaggagaaggccaccaccgaggccgacuccaccaagaaggaggaggacgccuccuccugcuccgacaaggucgagucccucuccgacggcuccucccacaucgccggcgaccuccccuccgacgaggacgagggcgaggacgagaagcucaacauccuccccuccaagcgcgaccucgccgccgagcccggcaacauguggaugcgccuccccuccgacuccgccggcaucccccaggccggcggcgaggccgagccccacgccaccgccgccggcaagaccgucgccucccccugcuccuccaccgagucccucucccagcgcuccgucaccuccguccgcgacuccgccgacgucgacugcguccucgaccucuccgucaaguccucccucuccggcgucgagaaccucaacuccuccuacuucuccucccaggacguccuccgcuccaaccucguccaggucaaggucgagaaggaggccuccugcgacgaguccgacgucggcaccaacgacuacgacauggagcacuccaccgucaaggaguccgucuccaccaacaaccgcguccaguacgagcccgcccaccucgccccccuccgcgaggacuccguccuccgcgagcucgaccgcgaggacaaggccuccgacgacgagaugaugacccccgaguccgagcgcguccaggucgagggcggcauggaguccucccuccuccccuacgucuccaacauccucucccccgccggccagaucuucaugugcccccucugcaacaaggucuuccccuccccccacauccuccagauccaccucuccacccacuuccgcgagcaggacggcauccgcuccaagcccgccgccgacgucaacguccccaccugcucccucugcggcaagaccuucuccugcauguacacccucaagcgccacgagcgcacccacuccggcgagaagcccuacaccugcacccagugcggcaaguccuuccaguacucccacaaccucucccgccacgccgucguccacacccgcgagaagccccacgccugcaaguggugcgagcgccgcuucacccaguccggcgaccucuaccgccacauccgcaaguuccacugcgagcucgucaacucccucuccgucaaguccgaggcccucucccuccccaccguccgcgacuggacccucgaggacuccucccaggagcucuggaaguga

SEQ ID NO: 51913 - RNA, 2226 nt, Artificial Sequence
  derived and/or modified sequence opt2 from ZBTB20__Homo_sapiens__NP_001157814
augcucgagcgcaagaagcccaagaccgccgagaaccagaaggccuccgaggagaacgagaucacccagcccggcggcuccuccgccaagcccggccuccccugccucaacuucgaggccguccucucccccgaccccgcccucauccacuccacccacucccucaccaacucccacgcccacaccggcuccuccgacugcgacaucuccugcaagggcaugaccgagcgcauccacuccaucaaccuccacaacuucuccaacuccguccucgagacccucaacgagcagcgcaaccgcggccacuucugcgacgucaccguccgcauccacggcuccaugcuccgcgcccaccgcugcguccucgccgccggcucccccuucuuccaggacaagcuccuccucggcuacuccgacaucgagauccccuccgucgucuccguccaguccguccagaagcucaucgacuucauguacuccggcguccuccgcgucucccaguccgaggcccuccagauccucaccgccgccuccauccuccagaucaagaccgucaucgacgagugcacccgcaucgucucccagaacgucggcgacgucuuccccggcauccaggacuccggccaggacaccccccgcggcacccccgaguccggcaccuccggccaguccuccgacaccgaguccggcuaccuccagucccacccccagcacuccgucgaccgcaucuacuccgcccucuacgccugcuccaugcagaacggcuccggcgagcgcuccuucuacuccggcgccgucgucucccaccacgagaccgcccucggccucccccgcgaccaccacauggaggaccccuccuggaucacccgcauccacgagcgcucccagcagauggagcgcuaccucuccaccacccccgagaccacccacugccgcaagcagccccgccccguccgcauccagacccucgucggcaacauccacaucaagcaggagauggaggacgacuacgacuacuacggccagcagcgcguccagauccucgagcgcaacgaguccgaggagugcaccgaggacaccgaccaggccgagggcaccgaguccgagcccaagggcgaguccuucgacuccggcgucuccuccuccaucggcaccgagcccgacuccgucgagcagcaguucggccccggcgccgcccgcgacucccaggccgagcccacccagcccgagcaggccgccgaggcccccgccgagggcggcccccagaccaaccagcucgagaccggcgccuccucccccgagcgcuccaacgaggucgagauggacuccaccgucaucaccgucuccaacuccuccgacaaguccguccuccagcagcccuccgucaacaccuccaucggccagccccuccccuccacccagcucuaccuccgccagaccgagacccucaccuccaaccuccgcaugccccucacccucaccuccaacacccaggucaucggcaccgccggcaacaccuaccuccccgcccucuucaccacccagcccgccggcuccggccccaagcccuuccucuucucccucccccagccccucgccggccagcagacccaguucgucaccgucucccagcccggccucuccaccuucaccgcccagcuccccgccccccagccccucgccuccuccgccggccacuccaccgccuccggccagggcgagaagaagcccuacgagugcacccucugcaacaagaccuucaccgccaagcagaacuacgucaagcacauguucguccacaccggcgagaagccccaccagugcuccaucugcuggcgcuccuucucccucaaggacuaccucaucaagcacauggucacccacaccggcguccgcgccuaccagugcuccaucugcaacaagcgcuucacccagaaguccucccucaacguccacaugcgccuccaccgcggcgagaaguccuacgagugcuacaucugcaagaagaaguucucccacaagacccuccucgagcgccacgucgcccuccacuccgccuccaacggcaccccccccgccggcaccccccccggcgcccgcgccggcccccccggcgucgucgccugcaccgagggcaccaccuacgucugcuccgucugccccgccaaguucgaccagaucgagcaguucaacgaccacaugcgcaugcacgucuccgacggcuga

SEQ ID NO: 51914 - RNA, 3201 nt, Artificial Sequence
  derived and/or modified sequence opt2 from ZBTB21__Homo_sapiens__NP_001091872
auggagggccuccuccacuacaucaaccccgcccacgccaucucccuccucuccgcccucaacgaggagcgccucaagggccagcucugcgacguccuccucaucgucggcgaccagaaguuccgcgcccacaagaacguccucgccgccuccuccgaguacuuccagucccucuucaccaacaaggagaacgagucccagaccgucuuccagcucgacuucugcgagcccgacgccuucgacaacguccucaacuacaucuacuccuccucccucuucgucgagaaguccucccucgccgccguccaggagcucggcuacucccucggcaucuccuuccucaccaacaucgucuccaagaccccccaggcccccuuccccaccugccccaaccgcaagaaggucuucgucgaggacgacgagaacuccucccagaagcgcuccgucaucgucugccagucccgcaacgaggcccagggcaagaccgucucccagaaccagcccgacgucucccacaccucccgccccucccccuccaucgccgucaaggccaacaccaacaagccccacguccccaagcccaucgagccccuccacaaccucucccucaccgagaaguccuggcccaaggacuccuccgucgucuacgccaagucccucgagcacuccggcucccucgacgaccccaaccgcaucucccucgucaagcgcaacgccguccuccccuccaagccccuccaggaccgcgaggccauggacgacaagcccggcgucuccggccagcuccccaagggcaaggcccucgagcucgcccucaagcgcccccgcccccccguccucuccgucugcuccuccuccgagacccccuaccuccucaaggagaccaacaagggcaacggccagggcgaggaccgcaaccuccucuacuacuccaagcucggccucgucauccccuccuccggcuccggcuccggcaaccaguccaucgaccgcuccggcccccucgucaagucccuccuccgccgcucccucuccauggacucccagguccccgucuacucccccuccaucgaccucaaguccucccagggcuccuccuccgucuccuccgacgcccccggcaacguccucugcgcccucucccagaaguccucccucaaggacugcuccgagaagaccgcccucgacgaccgcccccagguccuccagccccaccgccuccgcuccuucuccgccucccaguccaccgaccgcgagggcgccucccccgucaccgagguccgcaucaagaccgagcccuccuccccccucuccgaccccuccgacaucauccgcgucaccgucggcgacgccgccaccaccgccgccgccuccuccuccuccgucacccgcgaccucucccucaagaccgaggacgaccagaaggacaugucccgccuccccgccaagcgccgcuuccaggccgaccgccgccuccccuucaagaagcucaaggucaacgagcacggcucccccgucuccgaggacaacuucgaggagggcuccucccccacccuccucgacgccgacuuccccgacuccgaccucaacaaggacgaguucggcgagcucgagggcacccgccccaacaagaaguucaagugcaagcacugccucaagaucuuccgcuccaccgccggccuccaccgccacgucaacauguaccacaaccccgagaagcccuacgccugcgacaucugccacaagcgcuuccacaccaacuucaaggucuggacccacugccagacccagcacggcaucgucaagaaccccucccccgccuccuccucccacgccguccucgacgagaaguuccagcgcaagcucaucgacaucguccgcgagcgcgagaucaagaaggcccucaucaucaagcuccgccgcggcaagcccggcuuccagggccaguccuccucccaggcccagcaggucaucaagcgcaaccuccgcucccgcgccaagggcgccuacaucugcaccuacugcggcaaggccuaccgcuuccucucccaguucaagcagcacaucaagaugcaccccggcgagaagccccucggcgucaacaaggucgccaagcccaaggagcacgccccccucgccucccccgucgagaacaaggaggucuaccagugccgccucugcaacgccaagcucuccucccuccucgagcagggcucccacgagcgccucugccgcaacgccgccgucugccccuacugcucccuccgcuucuucucccccgagcucaagcaggagcacgaguccaagugcgaguacaagaagcucaccugccucgagugcaugcgcaccuucaaguccuccuucuccaucuggcgccaccaggucgagguccacaaccagaacaacauggcccccaccgagaacuucucccuccccguccucgaccacaacggcgacgucaccggcuccucccgcccccagucccagcccgagcccaacaaggucaaccacaucgucaccaccaaggacgacaacgucuucuccgacuccuccgagcaggucaacuucgacuccgaggacuccuccugccuccccgaggaccucucccucuccaagcagcucaagauccaggucaaggaggagcccgucgaggaggccgaggaggaggcccccgaggccuccaccgcccccaaggaggccggccccuccaaggaggccucccucuggcccugcgagaagugcggcaagauguucaccguccacaagcagcucgagcgccaccaggagcuccucugcuccgucaagcccuucaucugccacgucugcaacaaggccuuccgcaccaacuuccgccucuggucccacuuccagucccacaugucccaggccuccgaggaguccgcccacaaggaguccgaggucugccccguccccaccaacucccccuccccccccccccucccccccccccccccccuccccaagauccagccccucgagcccgacucccccaccggccucuccgagaaccccacccccgccaccgagaagcucuucgucccccaggaguccgacacccucuucuaccacgcccccccccucuccgccaucaccuucaagcgccaguucaugugcaagcucugccaccgcaccuucaagaccgccuucucccucuggucccacgagcagacccacaacuga

SEQ ID NO: 51915 - RNA, 1905 nt, Artificial Sequence
  derived and/or modified sequence opt2 from ZBTB22__Homo_sapiens__NP_001138810
auggagcccuccccccucucccccuccggcgccgcccucccccucccccucucccucgccccccccccccucccccuccccgccgccgccgucguccacgucuccuuccccgaggucaccuccgcccuccucgagucccucaaccagcagcgccuccagggccagcucugcgacgucuccauccgcguccagggccgcgaguuccgcgcccaccgcgccguccucgccgccuccucccccuacuuccacgaccagguccuccucaagggcaugaccuccaucucccuccccuccgucauggaccccggcgccuucgagaccguccucgccuccgccuacaccggccgccucuccauggccgccgccgacaucgucaacuuccucaccgucggcuccguccuccagauguggcacaucgucgacaagugcaccgagcuccuccgcgagggccgcgccuccgccaccaccaccaucaccaccgccgccgccaccuccgucaccguccccggcgccggcguccccuccggcuccggcggcaccgucgcccccgccaccaugggcuccgcccgcucccacgccuccucccgcgccuccgagaaccagucccccuccuccuccaacuacuucuccccccgcgaguccaccgacuucuccuccuccucccaggaggccuucgccgccuccgccgucggcuccggcgagcgccgcggcggcggccccgucuuccccgcccccgucgucggcuccggcggcgccaccuccggcaagcuccuccucgaggccgacgagcucugcgacgacggcggcgacggccgcggcgccgucguccccggcgccggccuccgccgccccaccuacaccccccccuccaucaugccccagaagcacugggucuacgucaagcgcggcggcaacugccccgcccccaccccccucgucccccaggaccccgaccucgaggaggaggaggaggaggaggaccucguccucaccugcgaggacgacgaggacgaggagcucggcggcuccucccgcguccccgucggcggcggccccgaggccacccucuccaucuccgacguccgcacccucuccgagccccccgacaagggcgaggagcaggucaacuucugcgaguccuccaacgacuucggccccuacgagggcggcggccccgucgccggccucgacgacuccggcggccccacccccuccuccuacgcccccucccaccccccccgcccccuccucccccucgacaugcagggcaaccagauccucgucuuccccuccuccuccuccuccuccuccucccaggcccccggccagccccccggcaaccaggccgagcacggcgccgucaccgucggcggcaccuccgucggcucccucggcguccccggcuccgucggcggcguccccggcggcaccggcuccggcgacggcaacaagaucuuccucugccacugcggcaaggccuucucccacaaguccaugcgcgaccgccacgucaacaugcaccucaaccuccgccccuucgacugccccgucugcaacaagaaguucaagaugaagcaccaccucaccgagcacaugaagacccacaccggccucaagcccuacgagugcggcgucugcgccaagaaguucauguggcgcgacuccuucaugcgccaccgcggccacugcgagcgccgccaccgccucggcggcgucggcgccguccccggccccggcacccccaccggccccucccuccccuccaagcgcgagucccccggcgucggcggcggcuccggcgacgaggccuccgccgccaccccccccuccucccgccgcgucuggucccccccccgcguccacaaggucgagaugggcuucggcggcggcggcggcgccaacuga

SEQ ID NO: 51916 - RNA, 2094 nt, Artificial Sequence
  derived and/or modified sequence opt2 from ZBTB24__Homo_sapiens__NP_055612
auggccgagaccucccccgagcccuccggccagcucgucguccacuccgacgcccacuccgacaccguccucgccuccuucgaggaccagcgcaagaagggcuuccucugcgacaucacccucaucgucgagaacguccacuuccgcgcccacaaggcccuccucgccgccuccuccgaguacuucuccaugauguucgccgaggagggcgagaucggccaguccaucuacaugcucgagggcauggucgccgacaccuucggcauccuccucgaguucaucuacaccggcuaccuccacgccuccgagaaguccaccgagcagauccucgccaccgcccaguuccucaaggucuacgaccucgucaaggccuacaccgacuuccagaacaaccacuccucccccaagcccaccacccucaacaccgccggcgcccccgucgucgucaucuccaacaagaagaacgacccccccaagcgcaagcgcggccgccccaagaaggucaacacccuccaggaggagaaguccgagcucgccgccgaggaggagauccagcuccgcgucaacaacuccguccagaaccgccagaacuucgucgucaagggcgacuccggcguccucaacgagcagaucgccgccaaggagaaggaggaguccgagcccaccugcgagcccucccgcgaggaggagaugcccgucgagaaggacgagaacuacgaccccaagaccgaggacggccaggccucccagucccgcuacuccaagcgccgcaucuggcgcuccgucaagcucaaggacuacaagcucgucggcgaccaggaggaccacggcuccgccaagcgcaucugcggccgccgcaagcgccccggcggccccgaggcccgcugcaaggacugcggcaaggucuucaaguacaaccacuuccucgccauccaccagcgcucccacaccggcgagcgccccuucaagugcaacgagugcggcaagggcuucgcccagaagcacucccuccagguccacacccgcaugcacaccggcgagcgccccuacaccugcaccgucugcuccaaggcccucaccaccaagcacucccuccucgagcacaugucccuccacuccggccagaaguccuucaccugcgaccagugcggcaaguacuucucccagaaccgccagcucaagucccacuaccgcguccacaccggccacucccuccccgagugcaaggacugccaccgcaaguucauggacgucucccagcucaagaagcaccuccgcacccacaccggcgagaagcccuucaccugcgagaucugcggcaaguccuucaccgccaaguccucccuccagacccacauccgcauccaccgcggcgagaagcccuacuccugcggcaucugcggcaaguccuucuccgacuccuccgccaagcgccgccacugcauccuccacaccggcaagaagcccuucuccugccccgagugcaaccuccaguucgcccgccucgacaaccucaaggcccaccucaagauccacuccaaggagaagcacgccuccgacgccuccuccaucuccggcuccuccaacaccgaggagguccgcaacauccuccagcuccagcccuaccagcucuccaccuccggcgagcaggagauccagcuccucgucaccgacuccguccacaacaucaacuucaugcccggccccucccagggcaucuccaucgucaccgccgaguccucccagaacaugaccgccgaccaggccgccaaccucacccuccucacccagcagcccgagcagcuccagaaccucauccucuccgcccagcaggagcagaccgagcacauccagucccucaacaugaucgagucccagaugggccccucccagaccgagcccguccacgucaucacccucuccaaggagacccucgagcaccuccacgcccaccaggagcagaccgaggagcuccaccucgccaccuccaccuccgaccccgcccagcaccuccagcucacccaggagcccggcccccccccccccacccaccacgucccccagcccaccccccucggccaggagcaguccuga

SEQ ID NO: 51917 - RNA, 1545 nt, Artificial Sequence
  derived and/or modified sequence opt2 from ZBTB2__Homo_sapiens__NP_065912
auggaccucgccaaccacggccucauccuccuccagcagcucaacgcccagcgcgaguucggcuuccucugcgacugcaccgucgccaucggcgacgucuacuucaaggcccacaaguccguccucgccuccuucuccaacuacuucaagaugcucuucguccaccagaccuccgagugcguccgccucaagcccaccgacauccagcccgacaucuucuccuaccuccuccaccucauguacaccggcaagauggccccccagcucaucgaccccguccgccucgagcagggcaucaaguuccuccacgccuacccccucauccaggaggccucccucgccucccagggcgccuucucccaccccgaccaggucuucccccucgccuccucccucuacggcauccagaucgccgaccaccagcuccgccaggccaccaagaucgccuccgcccccgagaagcucggccgcgacccccgcccccagaccucccgcaucucccaggagcagguccccgaggccucccagcucucccagcucaccuccaaccucgcccaggucaaccgcaccaacaugacccccuccgacccccuccagaccucccucucccccgagcucgucuccacccccguccccccccccccccccggcgaggagaccaaccucgaggccuccuccuccgacgagcagcccgccucccucaccaucgcccacgucaagcccuccaucaugaagcgcaacggcuccuuccccaaguacuacgccugccaccucugcggccgccgcuucacccuccgcuccucccuccgcgagcaccuccagauccacaccggcguccccuucaccuccucccagcagggcgagucccgcgucccccucacccucugcuccaacgccgccgaccucggcaaggacgccauggagguccccgaggccggcaugaucuccgacuccgagcuccagcacaucuccgacucccccaucaucgacggccagcagcaguccgagacccccccccccuccgacaucgccgacaucgacaaccucgagcaggccgaccaggagcgcgaggucaagcgccgcaaguacgagugcaccaucugcggccgcaaguucauccagaagucccacuggcgcgagcacauguacauccacaccggcaagcccuucaagugcuccaccugcgacaaguccuucugccgcgccaaccaggccgcccgccacgucugccucaaccaguccaucgacaccuacaccauggucgacaagcagacccucgagcucugcaccuucgaggagggcucccagauggacaacaugcucguccagaccaacaagcccuacaagugcaaccucugcgacaagaccuucuccacccccaacgaggucgucaagcacuccugccagaaccagaacuccgacgucuucgcccucgacgagggccgcuccauccuccucggcuccggcgacuccgaggucaccgagcccgaccaccccguccucgccuccaucaagaaggagcaggagaccguccuccucgacuga

SEQ ID NO: 51918 - RNA, 1464 nt, Artificial Sequence
  derived and/or modified sequence opt2 from ZBTB32__Homo_sapiens__NP_055198
augucccucccccccauccgccuccccucccccuacggcuccgaccgccucguccagcucgccgcccgccuccgccccgcccucugcgacacccucaucaccgucggcucccaggaguuccccgcccacucccucguccucgccggcgucucccagcagcucggccgccgcggccagugggcccucggcgagggcaucucccccuccaccuucgcccagcuccucaacuucgucuacggcgaguccgucgagcuccagcccggcgagcuccgcccccuccaggaggccgcccgcgcccucggcguccagucccucgaggaggccugcuggcgcgcccgcggcgaccgcgccaagaagcccgaccccggccucaagaagcaccaggaggagcccgagaagcccucccgcaaccccgagcgcgagcucggcgaccccggcgagaagcagaagcccgagcaggucucccgcaccggcggccgcgagcaggagaugcuccacaagcacucccccccccgcggccgccccgagauggccggcgccacccaggaggcccagcaggagcagacccgcuccaaggagaagcgccuccaggcccccgucggccagcgcggcgccgacggcaagcacggcguccucaccuggcuccgcgagaaccccggcggcuccgaggagucccuccgcaagcuccccggcccccucccccccgccggcucccuccagaccuccgucaccccccgccccuccugggccgaggcccccuggcucgucggcggccagcccgcccucugguccauccuccucaugcccccccgcuacggcauccccuucuaccacuccacccccaccaccggcgccuggcaggaggucuggcgcgagcagcgcaucccccucucccucaacgcccccaagggccucuggucccagaaccagcucgccuccuccucccccacccccggcucccucccccagggccccgcccagcucucccccggcgagauggaggaguccgaccagggccacaccggcgcccucgccaccugcgccggccacgaggacaaggccggcugccccccccgcccccaccccccccccgccccccccgcccgcucccgccccuacgccugcuccgucugcggcaagcgcuucucccucaagcaccagauggagacccacuaccgcguccacaccggcgagaagcccuucuccugcucccucugcccccagcgcucccgcgacuucuccgccaugaccaagcaccuccgcacccacggcgccgcccccuaccgcugcucccucugcggcgccggcugccccucccucgccuccaugcaggcccacaugcgcggccacucccccucccagcucccccccggcuggaccauccgcuccaccuuccucuacuccuccucccgccccucccgccccuccaccucccccugcugccccuccuccuccaccaccuga

SEQ ID NO: 51919 - RNA, 2019 nt, Artificial Sequence
  derived and/or modified sequence opt2 from ZBTB33__Homo_sapiens__NP_006768
auggagucccgcaagcucaucuccgccaccgacauccaguacuccggcucccuccucaacucccucaacgagcagcgcggccacggccucuucugcgacgucaccgucaucgucgaggaccgcaaguuccgcgcccacaagaacauccucuccgccuccuccaccuacuuccaccagcucuucuccgucgccggccaggucgucgagcucuccuucauccgcgccgagaucuucgccgagauccucaacuacaucuacuccuccaagaucguccgcguccgcuccgaccuccucgacgagcucaucaaguccggccagcuccucggcgucaaguucaucgccgagcucggcgucccccucucccaggucaaguccaucuccggcaccgcccaggacggcaacaccgagccccucccccccgacuccggcgacaagaaccucgucauccagaaguccaaggacgaggcccaggacaacggcgccaccaucaugcccaucaucaccgaguccuucucccucuccgccgaggacuacgagaugaagaagaucaucgucaccgacuccgacgacgacgacgacgacgucaucuucugcuccgagauccuccccaccaaggagacccuccccuccaacaacaccgucgcccagguccaguccaaccccggccccgucgccaucuccgacgucgcccccuccgccuccaacaacucccccccccucaccaacaucacccccacccagaagcuccccacccccgucaaccaggccacccucucccagacccagggcuccgagaagcuccucgucuccuccgcccccacccaccucacccccaacaucauccuccucaaccagaccccccucuccaccccccccaacgucuccuccucccuccccaaccacaugcccuccuccaucaaccuccucguccagaaccagcagacccccaacuccgccauccucaccggcaacaaggccaacgaggaggaggaggaggagaucaucgacgacgacgacgacaccaucuccuccucccccgacuccgccgucuccaacaccucccucgucccccaggccgacaccucccagaacaccuccuucgacggcucccucauccagaagaugcagauccccacccuccuccaggagccccucuccaacucccucaagaucuccgacaucaucacccgcaacaccaacgaccccggcgucggcuccaagcaccucauggagggccagaagaucaucacccucgacaccgccaccgagaucgagggccucuccaccggcugcaaggucuacgccaacaucggcgaggacaccuacgacaucgucauccccgucaaggacgaccccgacgagggcgaggcccgccucgagaacgagauccccaagaccuccggcuccgagauggccaacaagcgcaugaaggucaagcacgacgaccacuacgagcucaucgucgacggccgcgucuacuacaucugcaucgucugcaagcgcuccuacgucugccucaccucccuccgccgccacuucaacauccacuccugggagaagaaguaccccugccgcuacugcgagaaggucuucccccucgccgaguaccgcaccaagcacgagauccaccacaccggcgagcgccgcuaccagugccucgccugcggcaaguccuucaucaacuaccaguucauguccucccacaucaaguccguccacucccaggaccccuccggcgacuccaagcucuaccgccuccaccccugccgcucccuccagauccgccaguacgccuaccucuccgaccgcuccuccaccauccccgccaugaaggacgacggcaucggcuacaaggucgacaccggcaaggagccccccgucggcaccaccaccuccacccagaacaagcccaugaccugggaggacaucuucauccagcaggagaacgacuccaucuucaagcagaacgucaccgacggcuccaccgaguucgaguucaucauccccgaguccuacuga

SEQ ID NO: 51920 - RNA, 1503 nt, Artificial Sequence
  derived and/or modified sequence opt2 from ZBTB34__Homo_sapiens__NP_001092740
auggacuccuccuccuucauccaguucgacguccccgaguacuccuccaccguccucucccagcucaacgagcuccgccuccagggcaagcucugcgacaucaucguccacauccagggccagcccuuccgcgcccacaaggccguccucgccgccuccucccccuacuuccgcgaccacuccgcccucuccaccauguccggccucuccaucuccgucaucaagaaccccaacgucuucgagcagcuccucuccuucugcuacaccggccgcaugucccuccagcucaaggacgucgucuccuuccucaccgccgccuccuuccuccagaugcagugcgucaucgacaagugcacccagauccucgaguccauccacuccaagaucuccgucggcgacgucgacuccgucaccgucggcgccgaggagaaccccgagucccgcaacggcgucaaggacuccuccuucuucgccaaccccgucgagaucuccccccccuacugcucccagggccgccagcccaccgccuccuccgaccuccgcauggagaccacccccuccaaggcccuccgcucccgccuccaggaggagggccacuccgaccgcggcuccuccggcuccgucuccgaguacgagauccagaucgagggcgaccacgagcagggcgaccuccucguccgcgagucccagaucaccgaggucaaggucaagauggagaaguccgaccgccccuccugcuccgacuccuccucccucggcgacgacggcuaccacaccgagauggucgacggcgagcaggucgucgccgucaacgucggcuccuacggcuccguccuccagcacgccuacuccuacucccaggccgccucccagcccaccaacgucuccgaggccuucggcucccucuccaacuccucccccucccgcuccaugcucuccugcuuccgcggcggccgcgcccgccagaagcgcgcccucuccguccaccuccacuccgaccuccagggccucguccagggcuccgacuccgaggccaugaugaacaaccccggcuacgaguccuccccccgcgagcgcuccgcccgcggccacugguaccccuacaacgagcgccucaucugcaucuacugcggcaaguccuucaaccagaagggcucccucgaccgccacaugcgccuccacaugggcaucacccccuucgucugcaaguucugcggcaagaaguacacccgcaaggaccagcucgaguaccacauccgcggccacaccgacgacaagcccuuccgcugcgagaucugcggcaagugcuuccccuuccagggcacccucaaccagcaccuccgcaagaaccaccccggcgucgccgagguccgcucccgcaucgagucccccgagcgcaccgacgucuacgucgagcagaagcucgagaacgacgccuccgccuccgagaugggccucgacucccgcauggagauccacaccgucuccgacgcccccgacuga

SEQ ID NO: 51921 - RNA, 3588 nt, Artificial Sequence
  derived and/or modified sequence opt2 from ZBTB38__Homo_sapiens__NP_001073881
augaccgucaugucccucucccgcgaccucaaggacgacuuccacuccgacaccguccucuccauccucaacgagcagcgcauccgcggcauccucugcgacgucaccaucaucgucgaggacaccaaguucaaggcccacuccaacguccucgccgccuccucccucuacuucaagaacaucuucuggucccacaccaucugcaucuccucccacguccucgagcucgacgaccucaaggccgaggucuucaccgagauccucaacuacaucuacuccuccaccgucgucgucaagcgccaggagaccgucaccgaccucgccgccgccggcaagaagcucggcaucuccuuccucgaggaccucaccgaccgcaacuucuccaacucccccggccccuacgucuucugcaucaccgagaagggcgucgucaaggaggagaagaacgagaagcgccacgaggagcccgccaucaccaacggcccccgcaucaccaacgccuucuccaucaucgagaccgagaacuccaacaacauguucuccccccucgaccuccgcgccuccuucaagaaggucuccgacuccaugcgcaccgccucccucugccucgagcgcaccgacgucugccacgaggccgagcccguccgcacccucgccgagcacuccuacgccgucuccuccgucgccgaggccuaccgcucccagcccguccgcgagcacgacggcuccucccccggcaacaccggcaaggagaacugcgaggcccucgccgccaagcccaagaccugccgcaagcccaagaccuucuccaucccccaggacuccgacuccgccaccgagaacaucccccccccccccgucuccaaccucgaggucaaccaggagcgcuccccccagcccgccgccguccucacccgcuccaagucccccaacaacgagggcgacguccacuucucccgcgaggacgagaaccaguccuccgacguccccggcccccccgccgccgagguccccccccucgucuacaacugcuccugcugcuccaaggccuucgacuccuccacccuccucuccgcccacaugcagcuccacaagcccacccaggagccccucgucugcaaguacugcaacaagcaguucaccacccucaaccgccucgaccgccacgagcagaucugcaugcgcuccucccacaugcccauccccggcggcaaccagcgcuuccucgagaacuaccccaccaucggccagaacggcggcuccuucaccggccccgagccccuccucuccgagaaccgcaucggcgaguucuccuccaccggcuccacccuccccgacaccgaccacauggucaaguucgucaacggccagaugcucuacuccugcgucgucugcaagcgcuccuacgucacccucuccucccuccgccgccacgccaacguccacuccuggcgccgcaccuaccccugccacuacugcaacaaggucuucgcccucgccgaguaccgcacccgccacgagaucuggcacaccggcgagcgccgcuaccagugcaucuucugccucgagaccuucaugaccuacuacauccucaagaaccaccagaaguccuuccacgccaucgaccaccgccucuccaucuccaagaagaccgccaacggcggccucaagcccuccgucuaccccuacaagcucuaccgccuccuccccaugaagugcaagcgcgcccccuacaaguccuaccgcaacuccuccuacgagaacgcccgcgagaacucccagaugaacgaguccgcccccggcaccuacgucguccagaacccccacuccuccgagcuccccacccucaacuuccaggacaccgucaacacccucaccaacucccccgccaucccccucgagaccuccgccugccaggacauccccaccuccgccaacguccagaacgccgagggcaccaaguggggcgaggaggcccucaagauggaccucgacaacaacuucuacuccaccgaggucuccgucuccuccaccgagaacgccgucuccuccgaccuccgcgccggcgacguccccguccucucccucuccaacuccuccgagaacgccgccuccgucaucuccuacuccggcuccgcccccuccgucaucguccacuccucccaguucuccuccgucaucaugcacuccaacgccaucgccgccaugaccuccuccaaccaccgcgccuucuccgaccccgccgucucccagucccucaaggacgacuccaagcccgagcccgacaaggucggccgcuucgccucccgccccaaguccaucaaggagaagaagaagaccaccucccacacccgcggcgagauccccgaggaguccaacuacgucgccgaccccggcggcucccucuccaagaccaccaacaucgccgaggagaccuccaagaucgagaccuacaucgccaagcccgcccuccccggcaccuccaccaacuccaacgucgccccccucugccagaucaccgucaagaucggcaacgaggccaucgucaagcgccacauccucggcuccaagcucuucuacaagcgcggccgccgccccaaguaccagaugcaggaggagccccucccccagggcaacgaccccgagcccuccggcgacuccccccucggccucugccaguccgagugcauggagauguccgaggucuucgacgacgccuccgaccaggacuccaccgacaagcccuggcgccccuacuacaacuacaagcccaagaagaagucccgccagcucaagaagaugcgcaaggucaacuggcgcaaggagcacggcaaccgcucccccucccacaagugcaaguaccccgccgagcucgacugcgccgucggcaaggccccccaggacaagcccuucgaggaggaggagaccaaggagaugcccaagcuccagugcgagcucugcgacggcgacaaggccgucggcgccggcaaccagggccgcccccaccgccaccucaccucccgccccuacgccugcgagcucugcgccaagcaguuccagucccccuccacccucaagaugcacaugcgcugccacaccggcgagaagcccuaccagugcaagaccugcggccgcugcuucuccguccagggcaaccuccagaagcacgagcgcauccaccucggccucaaggaguucgucugccaguacugcaacaaggccuucacccucaacgagacccucaagauccacgagcgcauccacaccggcgagaagcgcuaccacugccaguucugcuuccagcgcuuccucuaccucuccaccaagcgcaaccacgagcagcgccacauccgcgagcacaacggcaagggcuacgccugcuuccagugccccaagaucugcaagaccgccgccgcccucggcaugcaccagaagaagcaccucuucaagucccccucccagcaggagaagaucggcgacgucugccacgagaacuccaacccccucgagaaccagcacuucaucggcuccgaggacaacgaccagaaggacaacauccagaccggcgucgagaacgucguccucuga

SEQ ID NO: 51922 - RNA, 2730 nt, Artificial Sequence
  derived and/or modified sequence opt2 from ZBTB41__Homo_sapiens__NP_919290
augaagaagcgccgcaaggucaccuccaaccucgagaagauccaccucggcuaccacaaggacuccuccgagggcaacgucgccgucgagugcgaccaggucaccuacacccacuccgccggccgccccacccccgaggcccuccacugcuaccaggagcucccccccucccccgaccagcgcaagcuccucuccucccuccaguacaacaagaaccuccucaaguaccucaacgacgaccgccagaagcagcccuccuucugcgaccuccucaucaucgucgagggcaaggaguucuccgcccacaaggucgucgucgccgucggcuccuccuacuuccacgccugccucuccaagaaccccuccaccgacgucgucacccucgaccacgucacccacuccgucuuccagcaccuccucgaguuccucuacaccuccgaguucuucgucuacaaguacgagaucccccucguccucgaggccgccaaguuccucgacaucaucgacgccgucaagcuccucaacaacgagaacgucgcccccuuccacuccgagcucaccgagaaguccucccccgaggagacccucaacgagcucaccggccgccucuccaacaaccaccagugcaaguucugcucccgccacuucugcuacaagaagucccucgagaaccaccucgccaagacccaccgcucccuccuccucggcaagaagcacggccucaagaugcucgagcgcuccuucuccgcccgccgcuccaagcgcaaccgcaagugccccgucaaguucgacgacaccuccgacgacgagcaggaguccggcgacggcuccgacaaccucaaccaggagaacuucgacaaggagaaguccgaccgcaacgacuccgaggaccccggcuccgaguacaacgccgaggaggacgagcucgaggaggagauguccgacgaguacuccgacaucgaggagcaguccgagaaggaccacaacgacgccgaggaggagcccgaggccggcgacuccgucggcaacguccacgagggccucacccccgucgucauccagaacuccaacaagaagauccuccagugccccaagugcgacaagaccuucgaccgcaucggcaaguacgagucccacacccgcguccacaccggcgagaagcccuucgagugcgacaucugccaccagcgcuacuccaccaaguccaaccucaccguccaccgcaagaagcacuccaacgagaccgaguuccacaagaaggagcacaagugccccuacugcaacaagcuccacgccuccaagaagacccucgccaagcacgucaagcgcuuccaccccgagaacgcccaggaguucaucuccaucaagaagaccaaguccgaguccuggaagugcgacaucugcaagaaguccuucacccgccgcccccaccucgaggagcacaugauccuccacucccaggacaagcccuucaagugcaccuacugcgaggagcacuucaagucccgcuucgcccgccucaagcaccaggagaaguuccaccucggccccuuccccugcgacaucugcggccgccaguucaacgacaccggcaaccucaagcgccacaucgagugcacccacggcggcaagcgcaaguggaccugcuucaucugcggcaaguccguccgcgagcgcaccacccucaaggagcaccuccgcauccacuccggcgagaagccccaccucugcuccaucugcggccaguccuuccgccacggcuccuccuaccgccuccaccuccgcguccaccacgacgacaagcgcuacgagugcgacgagugcggcaagaccuucauccgccacgaccaccucaccaagcacaagaagauccacuccggcgagaaggcccaccagugcgaggagugcggcaagugcuucggccgccgcgaccaccucaccguccacuacaaguccguccaccucggcgagaaggucuggcagaaguacaaggccaccuuccaccagugcgacgucugcaagaagaucuucaagggcaaguccucccucgagaugcacuuccgcacccacuccggcgagaagcccuacaagugccagaucugcaaccaguccuuccgcaucaagaagacccucaccaagcaccucgucauccacuccgacgcccgccccuucaacugccagcacugcaacgccaccuucaagcgcaaggacaagcucaaguaccacaucgaccacguccacgagaucaagucccccgacgacccccucuccaccuccgaggagaagcucgucucccuccccgucgaguacuccuccgacgacaagaucuuccagaccgagaccaagcaguacauggaccagcccaaggucuaccaguccgaggccaagaccaugcuccagaacgucuccgccgaggucugcguccccgucacccucguccccguccagaugcccgacacccccuccgaccucguccgccacaccaccacccucccccccuccucccacgagauccucuccccccagccccaguccaccgacuacccccgcgccgccgaccucgccuuccucgagaaguacacccucaccccccagcccgccaacaucguccaccccguccgccccgagcagaugcucgacccccgcgagcaguccuaccucggcacccuccucggccucgacuccaccaccggcguccagaacaucuccaccaacgagcaccacuccuga

SEQ ID NO: 51923 - RNA, 1770 nt, Artificial Sequence
  derived and/or modified sequence opt2 from ZBTB46__Homo_sapiens__XP_005260254
augaacaaccgcaaggaggacauggagaucaccucccacuaccgccaccuccuccgcgagcucaacgagcagcgccagcacggcguccucugcgacgucugcgucgucgucgagggcaaggucuucaaggcccacaagaacguccuccucggcuccucccgcuacuucaagacccucuacugccagguccagaagaccuccgagcaggccaccgucacccaccucgacaucgucaccgcccagggcuucaaggccaucaucgacuucauguacuccgcccaccucgcccucaccucccgcaacgucaucgaggucauguccgccgccuccuuccuccagaugaccgacaucguccaggccugccacgacuucaucaaggccgcccucgacaucuccaucaaguccgacgccuccgacgagcucgccgaguucgagaucggcgccuccuccuccuccuccaccgaggcccucaucuccgccgucauggccggccgcuccaucucccccuggcucgcccgccgcaccucccccgccaacuccuccggcgacuccgccaucgccuccugccacgacggcggcuccuccuacggcaaggaggaccaggagcccaaggccgacggccccgacgacgucuccucccagccccucuggcccggcgacgucggcuacggcccccuccgcaucaaggaggagcaggucucccccucccaguacggcggcuccgagcuccccuccgccaaggacggcgccguccagaacuccuucuccgagcaguccgccggcgacgccuggcagcccaccggccgccgcaagaaccgcaagaacaaggagaccguccgccacaucacccagcaggucgaggacgacucccgcgccuccucccccguccccuccuuccuccccaccuccggcuggcccuucuccucccgcgacuccaacgccgaccucuccgucaccgaggccuccuccuccgacucccgcggcgagcgcgccgagcucuacgcccaggucgaggagggccuccucggcggcgaggccuccuaccucggccccccccucacccccgagaaggacgacgcccuccaccaggccaccgccgucgccaaccuccgcgccgcccucauguccaagaacucccuccucucccucaaggccgacguccucggcgacgacggcucccuccucuucgaguaccucccccgcggcgcccacucccucucccucaacgaguucaccgucauccgcaagaaguucaagugccccuacugcuccuucuccgccaugcaccagugcauccucaagcgccacaugcgcucccacaccggcgagcgccccuaccccugcgagaucugcggcaagaaguucacccgccgcgagcacaugaagcgccacacccucguccacuccaaggacaagaaguacgucugcaaggucugcucccgcgucuucauguccgccgccuccgucggcauccgccacggcucccgccgccacggcgucugcaccgacugcgccggccgcggcauggccggcccccucgaccacggcggcggcggcggcgagggcucccccgaggcccucuuccccggcgacggccccuaccucgaggaccccgaggacccccgcggcgaggccgaggagcucggcgaggacgacgagggccucgcccccgaggacgcccuccucgccgacgacaaggacgaggaggacuccccccgcccccgcuccccccccggcggccccgacaaggacuucgccuggcucuccuga

SEQ ID NO: 51924 - RNA, 1140 nt, Artificial Sequence
  derived and/or modified sequence opt2 from ZBTB48__Homo_sapiens__XP_011539612
augcgcaagcacaccggcgagaagcccuucgagugccccaagugcggcaagugcuacuuccgcaaggagaaccuccucgagcacgaggcccgcaacugcaugaaccgcuccgagcaggucuucaccugcuccgucugccaggagaccuuccgccgccgcauggagcuccgcguccacauggucucccacaccggcgagaugcccuacaagugcuccuccugcucccagcaguucaugcagaagaaggaccuccagucccacaugaucaagcuccacggcgcccccaagccccacgccugccccaccugcgccaagugcuuccucucccgcaccgagcuccagcuccacgaggccuucaagcaccgcggcgagaagcucuucgucugcgaggagugcggccaccgcgccuccucccgcaacggccuccagaugcacaucaaggccaagcaccgcaacgagcgcccccacgucugcgaguucugcucccacgccuucacccagaaggccaaccucaacaugcaccuccgcacccacaccggcgagaagcccuuccagugccaccucugcggcaagaccuuccgcacccaggccucccucgacaagcacaaccgcacccacaccggcgagcgccccuucuccugcgaguucugcgagcagcgcuucaccgagaagggcccccuccuccgccacgucgccucccgccaccaggagggccgcccccacuucugccagaucugcggcaagaccuucaaggccgucgagcagcuccgcguccacguccgccgccacaagggcguccgcaaguucgagugcaccgagugcggcuacaaguucacccgccaggcccaccuccgccgccacauggagauccacgaccgcgucgagaacuacaacccccgccagcgcaagcuccgcaaccucaucaucgaggacgagaagauggucgucgucgcccuccagccccccgccgagcucgaggucggcuccgccgaggucaucgucgagucccucgcccagggcggccucgccucccagcuccccggccagcgccucugcgccgaggaguccuucaccggccccggcguccucgagcccucccucaucaucaccgccgccguccccgaggacugcgacaccuga

SEQ ID NO: 51925 - RNA, 2298 nt, Artificial Sequence
  derived and/or modified sequence opt2 from ZBTB49__Homo_sapiens__NP_660334
auggaccccgucgccacccacuccugccaccuccuccagcagcuccacgagcagcgcauccagggccuccucugcgacugcaugcucgucgucaagggcgucugcuucaaggcccacaagaacguccucgccgccuucucccaguacuuccgcucccucuuccagaacuccuccucccagaagaacgacgucuuccaccucgacgucaagaacgucuccggcaucggccagauccucgacuucauguacaccucccaccucgaccucaaccaggacaacauccaggucaugcucgacaccgcccagugccuccagguccagaacguccucucccucugccacaccuuccucaaguccgccaccgucguccagccccccggcaugcccugcaacuccacccucucccuccaguccacccucacccccgacgccaccugcgucaucuccgagaacuaccccccccaccuccuccaggagugcuccgccgacgcccagcagaacaagacccucgacgagucccacccccacgccucccccuccgucaaccgccaccacuccgccggcgagaucuccaagcaggcccccgacaccuccgacggcuccugcaccgagcuccccuucaagcagcccaacuacuacuacaagcuccgcaacuucuacuccaagcaguaccacaagcacgccgccggccccucccaggagcgcgucgucgagcagcccuucgccuucuccaccuccaccgaccucaccaccgucgagucccagcccugcgccgucucccacuccgagugcauccucgagucccccgagcaccuccccuccaacuuccucgcccagcccgucaacgacuccgccccccaccccgaguccgacgccaccugccagcagcccgucaagcagaugcgccucaagaaggccauccaccucaagaagcucaacuuccucaagucccagaaguacgccgagcaggucuccgagcccaaguccgacgacggccucaccaagcgccucgaguccgccuccaagaacacccucgagaaggccuccucccaguccgccgaggagaaggaguccgaggaggucgucuccugcgagaacuucaacugcaucuccgagaccgagcgccccgaggaccccgccgcccucgaggaccagucccagacccuccagucccagcgccaguacgccugcgagcucugcggcaagcccuucaagcaccccuccaaccucgagcuccacaagcgcucccacaccggcgagaagcccuucgagugcaacaucugcggcaagcacuucucccaggccggcaaccuccagacccaccuccgccgccacuccggcgagaagcccuacaucugcgagaucugcggcaagcgcuucgccgccuccggcgacguccagcgccacaucaucauccacuccggcgagaagccccaccucugcgacaucugcggccgcggcuucuccaacuucuccaaccucaaggagcacaagaagacccacaccgccgacaaggucuucaccugcgacgagugcggcaaguccuucaacaugcagcgcaagcucgucaagcaccgcauccgccacaccggcgagcgccccuacuccugcuccgccugcggcaagugcuucggcggcuccggcgaccuccgccgccacguccgcacccacaccggcgagaagcccuacaccugcgagaucugcaacaagugcuucacccgcuccgccguccuccgccgccacaagaagaugcacugcaaggccggcgacgagucccccgacguccucgaggagcucucccaggccaucgagaccuccgaccucgagaagucccaguccuccgacuccuucucccaggacaccuccgucacccucaugcccgucuccgucaagcuccccguccaccccgucgagaacuccgucgccgaguucgacucccacuccggcggcuccuacugcaagcuccgcuccaugauccagccccacggcgucuccgaccaggagaagcucucccucgaccccggcaagcucgccaagccccagaugcagcagacccagccccaggccuacgccuacuccgacgucgacacccccgccggcggcgagccccuccaggccgacggcauggccaugauccgcuccucccucgccgcccucgacaaccacggcggcgacccccucggcucccgcgccuccuccaccaccuaccgcaacuccgagggccaguucuucuccuccaugacccucuggggccucgccaugaagacccuccagaacgagaacgagcucgaccaguga

SEQ ID NO: 51926 - RNA, 3042 nt, Artificial Sequence
  derived and/or modified sequence opt2 from ZBTB4__Homo_sapiens__NP_065950
augcccccccccgccgaggucaccgaccccucccacgcccccgccguccuccgccagcucaacgagcagcgccuccgcggccucuucugcgacgucacccucaucgccggcgacaccaaguuccccgcccaccgcuccguccucgccgccuccucccccuucuuccgcgaggcccuccucaccuccgccccccucccccucccccccgccaccggcggcgccgcccccaaccccgccaccaccaccgccgccuccuccuccuccuccuccuccuccuccuccuccuccuccuccuccuccgccuccuccuccuccuccuccuccuccuccucccccccccccgccuccccccccgccuccucccccccccgcguccucgagcuccccggcguccccgccgccgccuucuccgacguccucaacuucaucuacuccgcccgccucgcccuccccggcggcggcggcgacggcgccgccgucgccgagaucggcgcccucggccgccgccucggcaucucccgccuccagggccucggcgagggcggcgacgccugggucccccccacccccgcccccauggccaccucccagcccgaggaggacuccuucggccccggcccccgccccgccggcgagugggagggcgaccgcgccgaggcccaggcccccgaccuccagugcucccucccccgccgcccccuccccugcccccagugcggcaaguccuucauccaccccaagcgccuccagacccacgaggcccagugccgccgcggcgccuccacccgcggcuccaccggccucggcgccggcggcgccggccccggcggccccgccggcgucgacgccuccgcccuccccccccccgucggcuuccgcggcggccccgagcacgucgucaaggucgucggcggccacguccucuacgucugcgccgccugcgagcgcuccuacgucacccucuccucccucaagcgccacuccaacguccacuccuggcgccgcaaguaccccugccgcuacugcgagaaggucuucgcccucgccgaguaccgcaccaagcacgaggucuggcacaccggcgagcgccgcuaccagugcaucuucugcugggagaccuucgucaccuacuacaaccucaagacccaccagcgcgccuuccacggcaucucccccggccuccucgccuccgagaagacccccaacggcggcuacaagcccaagcucaacacccucaagcucuaccgccuccuccccaugcgcgccgccaagcgccccuacaagaccuacucccagggcgcccccgaggccccccucucccccacccucaacacccccgcccccgucgccaugcccgccucccccccccccggccccccccccgcccccgagcccggccccccccccuccgucaucaccuucgcccaccccgcccccuccgucaucguccacggcggcuccuccuccggcggcggcggcuccggcaccgccuccaccggcggcucccaggccgccuccgucaucaccuacaccgcccccccccgcccccccaagaagcgcgaguaccccccccccccccccgagcccgccgccacccccaccucccccgccaccgccgucucccccgccaccgccgccggccccgccauggccaccaccaccgaggaggccaagggccgcaacccccgcgccggccgcacccucaccuacaccgccaagcccgucggcggcaucggcggcggcggcggcccccccaccggcgccggccgcggccccucccagcuccaggccccccccccccucugccagaucaccguccgcaucggcgaggaggccaucgucaagcgccgcaucuccgagaccgaccuccgccccggcgagcucuccggcgaggagauggaggaguccgaggaggacgaggaggaggaggacgaggaggaggaggaggaggacgaggaggaguccaaggccggcggcgaggaccagcucuggcgccccuacuacuccuacaagcccaagcgcaaggccggcgccgccggcggcgccuccgucggcggcuccggccucccccgcggccgccgccccccccgcuggcgccagaagcucgagcgccgcuccugggaggagacccccgccgccgagucccccgccggccgcgcccgcaccgagcgccgccaccgcugcggcgacugcgcccagaccuucaccacccuccgcaagcuccgcaagcaccaggaggcccacggcggcggcucccacuccucccgcgccggccgccgccccuccacccgcuucaccugcccccacugcgccaaggucugcaagaccgccgccgcccucucccgccacggccagcgccacgccgccgagcgccccggcggcacccccacccccgucaucgccuacuccaagggcuccgccggcacccgccccggcgacgucaaggaggaggccccccaggagaugcaggucuccuccuccuccggcgaggccggcggcggcuccaccgccgccgaggaggccuccgagaccgccucccuccaggaccccaucaucuccggcggcgaggagccccccgucgucgccuccggcggcuccuacgucuacccccccguccaggaguucccccucgcccucaucggcggcggccgcgagcccggcggcggccgcggcaaguccggcuccgagggccccgucggcgccggcgagggcgaccgcauggagggcaucggcgccgccaaggucaccuucuaccccgagcccuacccccucgucuacggcccccagcuccucgccgccuaccccuacaacuucuccaaccucgccgcccuccccgucgcccucaacaugguccuccccgacgagaagggcgccggcgcccuccccuuccuccccggcgucuucggcuacgccgucaacccccaggccgccccccccgccccccccaccccccccccccccacccuccccccccccaucccccccaagggcgagggcgagcgcgccggcgucgagcgcacccagaagggcgacgucggcuga

SEQ ID NO: 51927 - RNA, 2034 nt, Artificial Sequence
  derived and/or modified sequence opt2 from ZBTB5__Homo_sapiens__NP_055687
auggacuuccccggccacuucgagcagaucuuccagcagcucaacuaccagcgccuccacggccagcucugcgacugcgucaucgucgucggcaaccgccacuucaaggcccaccgcuccguccucgccgccugcuccacccacuuccgcgcccucuucuccgucgccgagggcgaccagaccaugaacaugauccagcucgacuccgaggucgucaccgccgaggccuucgccgcccucaucgacaugauguacaccuccacccucaugcucggcgaguccaacgucauggacguccuccucgccgccucccaccuccaccucaacuccgucgucaaggccugcaagcacuaccucaccacccgcacccuccccauguccccccccuccgagcgcguccaggagcaguccgcccgcaugcagcgcuccuucaugcuccagcagcucggccucuccaucgucuccuccgcccucaacuccucccagaacggcgaggagcagcccgcccccauguccuccuccaugcgcuccaaccucgaccagcgcacccccuuccccaugcgccgccuccacaagcgcaagcaguccgccgaggagcgcgcccgccagcgccuccgccccuccaucgacgaguccgccaucuccgacgucacccccgagaacggccccuccggcguccacucccgcgaggaguucuucucccccgacucccucaagaucgucgacaaccccaaggccgacggcaugaccgacaaccaggaggacuccgccaucauguucgaccaguccuucggcacccaggaggacgcccagguccccucccaguccgacaacuccgccggcaacauggcccagcucuccauggccucccgcgccacccaggucgagaccuccuucgaccaggaggccgcccccgagaaguccuccuuccagugcgagaaccccgaggucggccucggcgagaaggagcacaugcgcgucgucgucaaguccgagccccucuccucccccgagccccaggacgaggucuccgacgucaccucccaggccgagggcuccgaguccgucgaggucgagggcgucgucgucuccgccgagaagaucgaccucucccccgaguccuccgaccgcuccuucuccgacccccaguccuccaccgaccgcgucggcgacauccacauccucgaggucaccaacaaccucgagcacaaguccaccuucuccaucuccaacuuccucaacaagucccgcggcaacaacuucaccgccaaccagaacaacgacgacaacauccccaacaccaccuccgacugccgccucgaguccgaggcccccuaccuccucucccccgaggccggccccgccggcggccccuccuccgcccccggcucccacgucgagaaccccuucuccgagcccgccgacucccacuucguccgccccaugcaggaggucaugggccuccccugcguccagaccuccggcuaccagggcggcgagcaguucggcauggacuucucccgcuccggccucggccuccacuccuccuucucccgcgucaugaucggcuccccccgcggcggcgccuccaacuuccccuacuaccgccgcaucgcccccaagaugcccgucgucaccuccguccgcuccucccagauccccgagaacuccaccuccucccagcucaugaugaacggcgccaccuccuccuucgagaacggccaccccucccagcccggccccccccagcucacccgcgccuccgccgacguccucuccaagugcaagaaggcccucuccgagcacaacguccucgucgucgagggcgcccgcaaguacgccugcaagaucugcugcaagaccuuccucacccucaccgacugcaagaagcacauccgcguccacaccggcgagaagcccuacgccugccucaagugcggcaagcgcuucucccaguccucccaccucuacaagcacuccaagaccaccugccuccgcuggcaguccuccaaccuccccuccacccuccucuga

SEQ ID NO: 51928 - RNA, 1860 nt, Artificial Sequence
  derived and/or modified sequence opt2 from ZBTB7C__Homo_sapiens__NP_001034449
auggccaacgacaucgacgagcucaucggcauccccuuccccaaccacuccuccgagguccucugcucccucaacgagcagcgccacgacggccuccucugcgacguccuccucgucguccaggagcaggaguaccgcacccaccgcuccguccucgccgccugcuccaaguacuucaagaagcucuucaccgccggcacccucgccucccagcccuacgucuacgagaucgacuucguccagcccgaggcccucgccgccauccucgaguucgccuacaccuccacccucaccaucaccgccggcaacgucaagcacauccucaacgccgcccgcaugcucgagauccagugcaucgucaacgucugccucgagaucauggagcccggcggcgacggcggcgaggaggacgacaaggaggacgacgacgacgacgaggacgacgacgacgaggaggacgaggaggaggaggaggaggaggaggaggacgacgacgacgacaccgaggacuucgccgaccaggagaaccuccccgacccccaggacaucuccugccaccagucccccuccaagaccgaccaccucaccgagaaggccuacuccgacaccccccgcgacuuccccgacuccuuccaggccggcucccccggccaccucggcgucauccgcgacuucuccaucgagucccuccuccgcgagaaccucuaccccaaggccaacauccccgaccgccgccccucccucucccccuucgcccccgacuucuucccccaccucuggcccggcgacuucggcgccuucgcccagcuccccgagcagcccauggacuccggcccccucgaccucgucaucaagaaccgcaagaucaaggaggaggagaaggaggagcuccccccccccccccccccccccuuccccaacgacuucuucaaggacauguuccccgaccuccccggcggcccccucggccccaucaaggccgagaacgacuacggcgccuaccucaacuuccucuccgccacccaccucggcggccucuucccccccuggccccucgucgaggagcgcaagcucaagcccaaggccucccagcagugccccaucugccacaaggucaucaugggcgccggcaagcucccccgccacaugcgcacccacaccggcgagaagcccuacaugugcaccaucugcgagguccgcuucacccgccaggacaagcucaagauccacaugcgcaagcacaccggcgagcgccccuaccucugcauccacugcaacgccaaguucguccacaacuacgaccucaagaaccacaugcgcauccacaccggcguccgccccuaccagugcgaguucugcuacaaguccuucacccgcuccgaccaccuccaccgccacaucaagcgccaguccugccgcauggcccgcccccgccgcggccgcaagcccgccgccuggcgcgccgccucccuccucuucggccccggcggccccgcccccgacaaggccgccuucgucaugccccccgcccucggcgaggucggcggccaccucggcggcgccgccgucugccuccccggccccucccccgccaagcacuuccucgccgcccccaagggcgcccucucccuccaggagcucgagcgccaguucgaggagacccagaugaagcucuucggccgcgcccagcucgaggccgagcgcaacgccggcggccuccucgccuucgcccucgccgagaacgucgccgccgcccgccccuacuucccccuccccgaccccugggccgccggccucgccggccuccccggccucgccggccucaaccacgucgccuccauguccgaggccaacaacuga

SEQ ID NO: 51929 - RNA, 1422 nt, Artificial Sequence
  derived and/or modified sequence opt2 from ZBTB9__Homo_sapiens__NP_689948
auggagacccccaccccccucccccccguccccgccucccccaccugcaaccccgccccccgcaccauccagaucgaguucccccagcacuccuccucccuccucgagucccucaaccgccaccgccucgagggcaaguucugcgacgucucccuccucguccagggccgcgagcuccgcgcccacaaggccguccucgccgccgccucccccuacuuccacgacaagcuccuccucggcgacgccccccgccucacccuccccuccgucaucgaggccgacgccuucgagggccuccuccagcucaucuacuccggccgccuccgccucccccucgacgcccuccccgcccaccuccucgucgccuccggccuccagauguggcaggucgucgaccagugcuccgagauccuccgcgagcucgagaccuccggcggcggcaucuccgcccgcggcggcaacuccuaccacgcccuccucuccaccaccuccuccaccggcggcuggugcauccgcuccucccccuuccagacccccguccaguccuccgccuccaccgagucccccgccuccaccgagucccccgucggcggcgagggcuccgagcucggcgagguccuccagauccaggucgaggaggaggaggaggaggaggaggacgacgacgacgaggaccagggcuccgccacccucucccagaccccccagccccagcgcgucuccggcgucuucccccgcccccacggcccccacccccuccccaugaccgccaccccccgcaagcuccccgagggcgaguccgccccccucgagcuccccgccccccccgcccucccccccaagaucuucuacaucaagcaggagcccuucgagcccaaggaggagaucuccggcuccggcacccagcccggcggcgccaaggaggagaccaaggucuucuccggcggcgacaccgagggcaacggcgagcucggcuuccuccuccccuccggccccggccccaccuccggcggcggcggccccuccuggaagcccgucgaccuccacggcaacgagauccucuccggcggcggcggccccggcggcgccggccaggccguccacggccccgucaagcucggcggcaccccccccgccgacggcaagcgcuucggcugccucugcggcaagcgcuucgccgucaagcccaagcgcgaccgccacaucaugcucaccuucucccuccgccccuucggcugcggcaucugcaacaagcgcuucaagcucaagcaccaccucaccgagcacaugaagacccacgccggcgcccuccacgccugcccccacugcggccgccgcuuccgcguccacgccugcuuccuccgccaccgcgaccucugcaagggccagggcugggccaccgcccacuggaccuacaaguga

SEQ ID NO: 51930 - RNA, 669 nt, Artificial Sequence
  derived and/or modified sequence opt2 from ZC2HC1B__Homo_sapiens__NP_001013645
auggccggcgccgagcccuuccucgccgacggcaaccaggagcucuuccccugcgaggucugcggccgccgcuucgccgccgacguccucgagcgccacggccccaucugcaagaagcucuucaaccgcaagcgcaagcccuucuccucccucaagcagcgccuccagggcaccgacauccccaccgucaagaagaccccccaguccaaguccccccccguccgcaaguccaacuggcgccagcagcacgaggacuucaucaacgccauccgcuccgccaagcagugcaugcucgccaucaaggagggccgcccccucccccccccccccccccccucccucaaccccgacuacauccagcgccccuacugcaugcgccgcuucaacgaguccgccgccgagcgccacaccaacuucugcaaggaccaguccucccgccgcgucuucaaccccgcccagaccgccgccaagcucgccucccgcgcccagggccgcgcccagaugggccccaagaaggagcccaccgucaccuccgccgucggcgcccuccuccagaaccgcguccucgucgccaccaacgagguccccaccaaguccggccucgccauggaccccgccuccggcgccaagcuccgccagggcuucuccaaguccuccaagaaggacuga

SEQ ID NO: 51931 - RNA, 1305 nt, Artificial Sequence
  derived and/or modified sequence opt2 from ZC3H10__Homo_sapiens__NP_116175
augcccgaccgcgacuccuacgccaacggcaccggcuccuccggcggcggccccggcggcggcggcuccgaggaggccuccggcgccggcgucggcuccggcggcgccuccuccgacgccaucugccgcgacuuccuccgcaacgucugcaagcgcggcaagcgcugccgcuaccgccaccccgacauguccgaggucuccaaccucggcgucuccaagaacgaguucaucuucugccacgacuuccagaacaaggagugcucccgccccaacugccgcuucauccacggcuccaaggaggacgaggacggcuacaagaagaccggcgagcuccccccccgccuccgccagaaggucgccgccggccucggccucucccccgccgaccuccccaacggcaaggaggagguccccaucugccgcgacuuccucaagggcgacugccagcgcggcgccaagugcaaguuccgccaccuccagcgcgacuucgaguucgacgcccgcggcggcggcggcaccggcggcggcuccaccggcuccguccuccccggccgccgccacgaccucuacgacaucuacgaccuccccgaccgcggcuucgaggaccacgagcccggccccaagcgccgccgcggcggcugcugcccccccgacggcccccacuucgaguccuacgaguacucccucgcccccccccgcggcgucgagugccgccuccucgaggaggagaacgccaugcuccgcaagcgcgucgaggagcucaagaagcaggucuccaaccuccucgccaccaacgagguccuccucgagcagaacgcccaguuccgcaaccaggccaaggucaucacccucuccuccaccgcccccgccaccgagcagacccucgcccccaccgucggcaccgucgccaccuucaaccacggcaucgcccagacccacaccacccucuccucccaggcccuccagccccgccccgucucccagcaggagcucgucgcccccgccggcgcccccgccgccccccccaccaacgccgccccccccgccgcccccccccccccccccccccaccucacccccgagaucaccccccucuccgccgcccucgcccagaccaucgcccagggcauggcccccccccccgucuccauggcccccgucgccgucuccgucgcccccgucgcccccgucgccgucuccauggcccagccccucgccggcaucaccaugucccacaccaccacccccauggucaccuaccccaucgccucccaguccaugcgcaucaccgccaugccccacuga

SEQ ID NO: 51932 - RNA, 2433 nt, Artificial Sequence
  derived and/or modified sequence opt2 from ZC3H11A__Homo_sapiens__NP_055642
augcccaaccagggcgaggacugcuacuucuucuucuacuccaccugcaccaagggcgacuccugccccuuccgccacugcgaggccgccaucggcaacgagaccgucugcacccucuggcaggagggccgcugcuuccgccaggucugccgcuuccgccacauggagaucgacaagaagcgcuccgagauccccugcuacugggagaaccagcccaccggcugccagaagcucaacugcgccuuccaccacaaccgcggccgcuacgucgacggccucuuccucccccccuccaagaccguccuccccaccguccccgagucccccgaggaggaggucaaggccucccagcucuccguccagcagaacaagcucuccguccaguccaaccccuccccccagcuccgcuccgucaugaaggucgaguccuccgagaacguccccucccccacccacccccccgucgucaucaacgccgccgacgacgacgaggacgacgacgaccaguucuccgaggagggcgacgagaccaagacccccacccuccagcccacccccgagguccacaacggccuccgcgucaccuccguccgcaagcccgccgucaacaucaagcagggcgagugccucaacuucggcaucaagacccucgaggagaucaaguccaagaagaugaaggagaaguccaagaagcagggcgagggcuccuccggcgucuccucccuccuccuccaccccgagcccguccccggccccgagaaggagaacguccgcaccgucguccgcaccgucacccucuccaccaagcagggcgaggagccccucguccgccucucccucaccgagcgccucggcaagcgcaaguucuccgccggcggcgacuccgaccccccccucaagcgcucccucgcccagcgccucggcaagaaggucgaggcccccgagaccaacaucgacaagacccccaagaaggcccaggucuccaagucccucaaggagcgccucggcauguccgccgaccccgacaacgaggacgccaccgacaaggucaacaaggucggcgagauccacgucaagacccucgaggagauccuccucgagcgcgccucccagaagcgcggcgagcuccagaccaagcucaagaccgagggccccuccaagaccgacgacuccaccuccggcgcccgcuccuccuccaccauccgcaucaagaccuucuccgagguccucgccgagaagaagcaccgccagcaggaggccgagcgccagaaguccaagaaggacaccaccugcaucaagcucaagaucgacuccgagaucaagaagaccgucguccucccccccaucgucgccucccgcggccaguccgaggagcccgccggcaagaccaaguccaugcaggagguccacaucaagacccucgaggagaucaagcucgagaaggcccuccgcguccagcaguccuccgaguccuccaccuccucccccucccagcacgaggccacccccggcgcccgccgccuccuccgcaucaccaagcgcaccggcaugaaggaggagaagaaccuccaggagggcaacgaggucgacucccaguccuccauccgcaccgaggccaaggaggccuccggcgagaccaccggcgucgacaucaccaagauccaggucaagcgcugcgagaccaugcgcgagaagcacaugcagaagcagcaggagcgcgagaaguccguccucaccccccuccgcggcgacgucgccuccugcaacacccaggucgccgagaagcccguccucaccgccguccccggcaucacccgccaccucaccaagcgccuccccaccaaguccucccagaaggucgaggucgagaccuccggcaucggcgacucccuccucaacgucaagugcgccgcccagacccucgagaagcgcggcaaggccaagcccaaggucaacgucaagcccuccgucgucaaggucgucuccucccccaagcucgcccccaagcgcaaggccgucgagaugcacgccgccgucaucgccgccgucaagccccucuccuccuccuccguccuccaggagccccccgccaagaaggccgccgucgccgucgucccccucgucuccgaggacaaguccgucaccguccccgaggccgagaacccccgcgacucccucguccucccccccacccaguccuccuccgacuccuccccccccgaggucuccggccccuccuccucccagauguccaugaagacccgccgccucuccuccgccuccaccggcaagcccccccucuccgucgaggacgacuucgagaagcucaucugggagaucuccggcggcaagcucgaggccgagaucgaccucgaccccggcaaggacgaggacgaccuccuccucgagcucuccgagaugaucgacuccuga

SEQ ID NO: 51933 - RNA, 2652 nt, Artificial Sequence
  derived and/or modified sequence opt2 from ZC3H12C__Homo_sapiens__NP_203748
augcccggcggcggcucccaggaguacggcguccucugcauccaggaguaccgcaagaacuccaaggucgaguccuccacccgcaacaacuucaugggccucaaggaccaccucggccacgaccucggccaccucuacgucgaguccaccgacccccagcucucccccgccguccccugguccaccgucgagaaccccuccauggacaccgucaacgucggcaaggacgagaaggaggccuccgaggagaacgccuccuccggcgacuccgaggagaacaccaacuccgaccacgaguccgagcagcucggcuccaucuccgucgagcccggccucaucaccaagacccaccgccagcucugccgcucccccugccucgagccccacauccucaagcgcaacgagauccuccaggacuucaagcccgaggagucccagaccaccuccaaggaggccaagaagccccccgacgucguccgcgaguaccagaccaagcucgaguucgcccucaagcucggcuacuccgaggagcagguccagcucguccucaacaagcucggcaccgacgcccucaucaacgacauccucggcgagcucgucaagcucggcaacaaguccgaggccgaccagaccgucuccaccaucaacaccaucacccgcgagaccuccucccucgagucccagcgcuccgagucccccaugcaggagaucgucaccgacgacggcgagaaccuccgccccaucgucaucgacggcuccaacgucgccaugucccacggcaacaaggaggucuucuccugccgcggcaucaagcucgccgucgacugguuccucgagcgcggccacaaggacaucaccgucuucguccccgccuggcgcaaggagcagucccgccccgacgcccucaucaccgaccaggagauccuccgcaagcucgagaaggagaagauccucgucuucacccccucccgccgcguccagggccgccgcgucgucugcuacgacgaccgcuucaucgucaagcucgccuucgaguccgacggcaucaucgucuccaacgacaacuaccgcgaccucgccaacgagaagcccgaguggaagaaguucaucgacgagcgccuccucauguacuccuucgucaacgacaaguucaugccccccgacgacccccucggccgccacggccccucccucgacaacuuccuccgcaagaagcccaucguccccgagcacaagaagcagcccugccccuacggcaagaagugcaccuacggccacaagugcaaguacuaccaccccgagcgcggcucccagccccagcgcuccgucgccgacgagcuccgcgccaugucccgcaacaccgccgccaagaccgccaacgagggcggccucgucaaguccaacuccguccccugcuccaccaaggccgacuccaccuccgacgucaagcgcggcgcccccaagcgccaguccgaccccuccauccgcacccaggucuaccaggaccucgaggagaagcuccccaccaagaacaagcucgagacccgcuccguccccucccucgucuccauccccgccaccuccaccgccaagccccaguccaccaccucccucuccaacggccuccccuccggcguccacuuccccccccaggaccagcgcccccagggccaguaccccuccaugaugauggccaccaagaaccacggcacccccaugcccuacgagcaguaccccaagugcgacucccccgucgacaucggcuacuacuccaugcucaacgccuacuccaaccucucccucuccggcccccgcucccccgagcgccgcuucucccucgacaccgacuaccgcaucuccuccgucgccuccgacugcuccuccgagggcuccauguccugcggcuccuccgacuccuacgucggcuacaacgaccgcuccuacgucuccucccccgacccccagcucgaggagaaccucaagugccagcacaugcacccccacucccgccucaacccccagcccuuccuccagaacuuccacgacccccucacccgcggccaguccuacucccacgaggagcccaaguuccaccacaagcccccccucccccaccucgcccuccaccucccccacuccgccgucggcgcccgcuccuccugccccggcgacuaccccuccccccccuccuccgcccacuccaaggccccccaccucggccgcucccucgucgccacccgcaucgacuccaucuccgacucccgccucuacgacuccucccccucccgccagcgcaagcccuacucccgccaggagggccucggcuccugggagcgccccggcuacggcaucgacgccuacggcuaccgccagaccuacucccuccccgacaacuccacccagcccugcuacgagcaguucaccuuccagucccuccccgagcagcaggagcccgccuggcgcauccccuacugcggcaugccccaggaccccccccgcuaccaggacaaccgcgagaagaucuacaucaaccucugcaacaucuucccccccgaccucguccgcaucgucaugaagcgcaacccccacaugaccgacgcccagcagcucgccgccgccauccucgucgagaagucccagcucggcuacuga

SEQ ID NO: 51934 - RNA, 1584 nt, Artificial Sequence
  derived and/or modified sequence opt2 from ZC3H12D__Homo_sapiens__NP_997243
auggagcaccccuccaagauggaguucuuccagaagcucggcuacgaccgcgaggacguccuccgcguccucggcaagcucggcgagggcgcccucgucaacgacguccuccaggagcucauccgcaccggcucccgccccggcgcccucgagcaccccgccgccccccgccucgucccccgcggcuccugcggcguccccgacuccgcccagcgcggccccggcaccgcccucgaggaggacuuccgcacccucgccuccucccuccgccccaucgucaucgacggcuccaacgucgccaugucccacggcaacaaggagaccuucuccugccgcggcaucaagcucgccgucgacugguuccgcgaccgcggccacaccuacaucaaggucuucguccccuccuggcgcaaggaccccccccgcgccgacacccccauccgcgagcagcacguccucgccgagcucgagcgccaggccguccucgucuacacccccucccgcaagguccacggcaagcgccucgucugcuacgacgaccgcuacaucgucaaggucgccuacgagcaggacggcgucaucgucuccaacgacaacuaccgcgaccuccaguccgagaaccccgaguggaagugguucaucgagcagcgccuccucauguucuccuucgucaacgaccgcuucaugccccccgacgacccccucggccgccacggccccucccucuccaacuuccucucccgcaagcccaagccccccgagcccuccuggcagcacugccccuacggcaagaagugcaccuacggcaucaagugcaaguucuaccaccccgagcgcccccaccacgcccagcucgccgucgccgacgagcuccgcgccaagaccggcgcccgccccggcgccggcgccgaggagcagcgccccccccgcgcccccggcggcuccgccggcgcccgcgccgccccccgcgagcccuucgcccacucccucccccccgcccgcggcucccccgaccucgccgcccuccgcggcuccuucucccgccucgccuucuccgacgaccucggcccccucggccccccccuccccguccccgccugcucccucaccccccgccucggcggccccgacugggucuccgccggcggccgcguccccggcccccucucccuccccucccccgagucccaguucucccccggcgaccucccccccccccccggccuccagcuccagccccgcggcgagcaccgcccccgcgaccuccacggcgaccuccucuccccccgccgcccccccgacgaccccugggcccgccccccccgcuccgaccgcuuccccggccgcuccgucugggccgagcccgccuggggcgacggcgccaccggcggccucuccgucuacgccaccgaggacgacgagggcgacgcccgcgcccgcgcccgcaucgcccucuacuccgucuucccccgcgaccaggucgaccgcgucauggccgccuuccccgagcucuccgaccucgcccgccucauccuccucguccagcgcugccaguccgccggcgccccccucggcaagcccuga

SEQ ID NO: 51935 - RNA, 2208 nt, Artificial Sequence
  derived and/or modified sequence opt2 from ZC3H14__Homo_sapiens__NP_001153575
auggagaucggcaccgagaucucccgcaagauccgcuccgccaucaagggcaagcuccaggagcucggcgccuacgucgacgaggagcuccccgacuacaucauggucauggucgccaacaagaagucccaggaccagaugaccgaggaccucucccucuuccucggcaacaacaccauccgcuucaccgucuggcuccacggcguccucgacaagcuccgcuccgucaccaccgagcccuccucccucaaguccuccgacaccaacaucuucgacuccaacguccccuccaacaaguccaacuucucccgcggcgacgagcgccgccacgaggccgccguccccccccucgccauccccuccgcccgccccgagaagcgcgacucccgcgucuccaccuccucccaggaguccaagaccaccaacguccgccagaccuacgacgacggcgccgccacccgccucauguccaccgucaagccccuccgcgagcccgcccccuccgaggacgucaucgacaucaagcccgagcccgacgaccucaucgacgaggaccucaacuucguccaggagaacccccucucccagaagaagcccaccgucacccucaccuacggcuccucccgccccuccaucgagaucuaccgcccccccgccucccgcaacgccgacuccggcguccaccucaaccgccuccaguuccagcagcagcagaacuccauccacgccgccaagcagcucgacaugcaguccuccugggucuacgagaccggccgccucugcgagcccgagguccucaacucccucgaggagaccuacucccccuucuuccgcaacaacuccgagaagauguccauggaggacgagaacuuccgcaagcgcaagcuccccgucgucuccuccgucgucaaggucaagaaguucaaccacgacggcgaggaggaggaggaggacgacgacuacggcucccgcaccggcuccaucuccuccuccgucuccguccccgccaagcccgagcgccgccccucccucccccccuccaagcaggccaacaagaaccucauccucaaggccaucuccgaggcccaggaguccgucaccaagaccaccaacuacuccaccgucccccagaagcagacccuccccgucgccccccgcacccgcaccucccaggaggagcuccucgccgaggucguccagggccagucccgcaccccccgcaucuccccccccaucaaggaggaggagaccaagggcgacuccgucgagaagaaccagggcacccagcagcgccagcuccucucccgccuccagaucgaccccgucauggccgagacccuccagaugucccaggacuacuacgacauggaguccaugguccacgccgacacccgcuccuucauccucaagaagcccaagcucuccgaggaggucgucgucgcccccaaccaggaguccggcaugaagaccgccgacucccuccgcguccucuccggccaccucaugcagacccgcgaccucguccagcccgacaagcccgccucccccaaguucaucgucacccucgacggcguccccuccccccccggcuacauguccgaccaggaggaggacaugugcuucgagggcaugaagcccgucaaccagaccgccgccuccaacaagggccuccgcggccuccuccacccccagcagcuccaccuccucucccgccagcucgaggaccccaacggcuccuucuccaacgccgagauguccgagcucuccgucgcccagaagcccgagaagcuccucgagcgcugcaaguacuggcccgccugcaagaacggcgacgagugcgccuaccaccaccccaucucccccugcaaggccuuccccaacugcaaguucgccgagaagugccucuucguccaccccaacugcaaguacgacgccaagugcaccaagcccgacugccccuucacccacgucucccgccgcauccccguccucucccccaagcccgucgccccccccgccccccccuccuccucccagcucugccgcuacuuccccgccugcaagaagauggagugccccuucuaccaccccaagcacugccgcuucaacacccagugcacccgccccgacugcaccuucuaccaccccaccaucaacguccccccccgccacgcccucaaguggauccgcccccagaccuccgaguga

SEQ ID NO: 51936 - RNA, 1281 nt, Artificial Sequence
  derived and/or modified sequence opt2 from ZC3H15__Homo_sapiens__NP_060941
augccccccaagaagcaggcccaggccggcggcuccaagaaggccgagcagaagaagaaggagaagaucaucgaggacaagaccuucggccucaagaacaagaagggcgccaagcagcagaaguucaucaaggccgucacccaccaggucaaguucggccagcagaacccccgccaggucgcccaguccgaggccgagaagaagcucaagaaggacgacaagaagaaggagcuccaggagcucaacgagcucuucaagcccgucgucgccgcccagaagaucuccaagggcgccgaccccaaguccgucgucugcgccuucuucaagcagggccagugcaccaagggcgacaagugcaaguucucccacgaccucacccucgagcgcaagugcgagaagcgcuccgucuacaucgacgcccgcgacgaggagcucgagaaggacaccauggacaacugggacgagaagaagcucgaggaggucgucaacaagaagcacggcgaggccgagaagaagaagcccaagacccagaucgucugcaagcacuuccucgaggccaucgagaacaacaaguacggcugguucugggucugccccggcggcggcgacaucugcauguaccgccacgcccucccccccggcuucguccucaagaaggacaagaagaaggaggagaaggaggacgagaucucccucgaggaccucaucgagcgcgagcgcuccgcccucggccccaacgucaccaagaucacccucgaguccuuccucgccuggaagaagcgcaagcgccaggagaagaucgacaagcucgagcaggacauggagcgccgcaaggccgacuucaaggccggcaaggcccucgucaucuccggccgcgaggucuucgaguuccgccccgagcucgucaacgacgacgacgaggaggccgacgacacccgcuacacccagggcaccggcggcgacgaggucgacgacuccgucuccgucaacgacaucgaccucucccucuacaucccccgcgacgucgacgagaccggcaucaccgucgccucccucgagcgcuucuccaccuacaccuccgacaaggacgagaacaagcucuccgaggccuccggcggccgcgccgagaacggcgagcgcuccgaccucgaggaggacaacgagcgcgagggcaccgagaacggcgccaucgacgccguccccgucgacgagaaccucuucaccggcgaggaccucgacgagcucgaggaggagcucaacacccucgaccucgaggaguga

SEQ ID NO: 51937 - RNA, 2847 nt, Artificial Sequence
  derived and/or modified sequence opt2 from ZC3H3__Homo_sapiens__NP_055932
auggaggagaaggagauccuccgccgccagauccgccuccuccagggccucaucgacgacuacaagacccuccacggcaacgcccccgcccccggcacccccgccgccuccggcuggcagccccccaccuaccacuccggccgcgccuucuccgcccgcuacccccgccccucccgccgcggcuacuccucccaccacggccccuccuggcgcaagaaguacucccucgucaaccgcccccccggccccuccgacccccccgccgaccacgccguccgcccccuccacggcgcccgcggcggccagccccccgucccccagcagcacguccucgagcgccagguccagcucucccagggccagaacgucgucaucaaggucaagccccccuccaaguccggcuccgccuccgccuccggcgcccagcgcggcucccucgaggaguucgaggagacccccugguccgaccagcgcccccgcgagggcgagggcgagcccccccgcggccagcuccagcccucccgccccacccgcgcccgcggcaccugcuccgucgaggacccccuccucgucugccagaaggagcccggcaagccccgcauggucaaguccgucggcuccgucggcgacuccccccgcgagccccgccgcaccgucuccgaguccgucaucgccgucaaggccuccuuccccuccuccgcccuccccccccgcaccggcgucgcccucggccgcaagcucggcucccacuccgucgccuccugcgccccccagcuccucggcgaccgccgcgucgacgccggccacaccgaccagcccguccccuccggcuccgucggcggccccgcccgccccgccuccggcccccgccaggcccgcgaggccucccucgucgucaccugccgcaccaacaaguuccgcaagaacaacuacaagugggucgccgccuccuccaaguccccccgcgucgcccgccgcgcccucuccccccgcgucgccgccgagaacgucugcaaggccuccgccggcauggccaacaaggucgagaagccccagcucaucgccgaccccgagcccaagccccgcaagcccgccaccuccuccaagcccggcuccgcccccuccaaguacaaguggaaggccuccucccccuccgccuccuccuccuccuccuuccgcuggcaguccgaggccuccuccaaggaccacgccucccagcucucccccguccucucccgcucccccuccggcgaccgccccgccgucggccacuccggccucaagccccucuccggcgagaccccccucuccgccuacaaggucaagucccgcaccaagaucauccgccgccgcuccuccaccucccuccccggcgacaagaaguccggcaccucccccgccgccaccgccaagucccaccucucccuccgccgccgccaggcccuccgcggcaaguccucccccguccucaagaagacccccaacaagggccucguccaggucaccacccaccgccucugccgccucccccccucccgcgcccaccuccccaccaaggaggccuccucccuccacgccguccgcaccgcccccaccuccaaggucaucaagacccgcuaccgcaucgucaagaagacccccgccuccccccucuccgccccccccuucccccucucccuccccuccuggcgcgcccgccgccucucccucucccgcucccucguccucaaccgccuccgccccgucgccuccggcggcggcaaggcccagcccggcucccccugguggcgcuccaagggcuaccgcugcaucggcggcguccucuacaaggucuccgccaacaagcucuccaagaccuccggccagcccuccgacgccggcucccgcccccuccuccgcaccggccgccucgaccccgccggcuccugcucccgcucccucgccucccgcgccguccagcgcucccucgccaucauccgccaggcccgccagcgccgcgagaagcgcaaggaguacugcauguacuacaaccgcuucggccgcugcaaccgcggcgagcgcugccccuacauccacgaccccgagaaggucgccgucugcacccgcuucguccgcggcaccugcaagaagaccgacggcaccugccccuucucccaccacgucuccaaggagaagaugcccgucugcuccuacuuccucaagggcaucugcuccaacuccaacugccccuacucccacgucuacgucucccgcaaggccgaggucugcuccgacuuccucaagggcuacugcccccucggcgccaagugcaagaagaagcacacccuccucugccccgacuucgcccgccgcggcgccugcccccgcggcgcccagugccagcuccuccaccgcacccagaagcgccacucccgccgcgccgccaccucccccgcccccggccccuccgacgccaccgcccgcucccgcgucuccgccucccacggcccccgcaagcccuccgccucccagcgccccacccgccagacccccuccuccgccgcccucaccgccgccgccgucgccgcccccccccacugccccggcggcuccgccucccccuccuccuccaaggccuccuccuccuccuccuccuccuccuccccccccgccucccucgaccacgaggcccccucccuccaggaggccgcccucgccgccgccugcuccaaccgccucugcaagcuccccuccuucaucucccuccaguccucccccucccccggcgcccagccccgcguccgcgccccccgcgccccccucaccaaggacuccggcaagccccuccacaucaagccccgccucuga

SEQ ID NO: 51938 - RNA, 3912 nt, Artificial Sequence
  derived and/or modified sequence opt2 from ZC3H4__Homo_sapiens__NP_055983
auggaggccgcccccggcacccccccccccccccccuccgaguccccccccccccccuccccccccccccccuccacccccucccccccccccugcucccccgacgcccgccccgccaccccccaccuccuccaccaccgccucccccuccccgacgaccgcgaggacggcgagcucgaggagggcgagcucgaggacgacggcgccgaggagacccaggacaccuccggcggccccgagcgcucccgcaaggagaagggcgagaagcaccacuccgacuccgacgaggagaagucccaccgccgccucaagcgcaagcgcaagaaggagcgcgagaaggagaagcgccgcuccaagaagcgccgcaaguccaagcacaagcgccacgccuccuccuccgacgacuucuccgacuucuccgacgacuccgacuucucccccuccgagaagggccaccgcaaguaccgcgaguacuccccccccuacgcccccucccaccagcaguacccccccucccacgccaccccccuccccaagaaggccuacuccaagauggacuccaaguccuacggcauguacgaggacuacgagaacgagcaguacggcgaguacgagggcgacgaggaggaggacaugggcaaggaggacuacgacgacuucaccaaggagcucaaccaguaccgccgcgccaaggagggcuccucccgcggccgcggcucccgcggccgcggccgcggcuaccgcggccgcggcucccgcggcggcucccgcggccgcggcaugggccgcggcucccgcggccgcggccgcggcuccaugggcggcgaccaccccgaggacgaggaggacuucuacgaggaggagauggacuacggcgaguccgaggagcccaugggcgacgacgacuacgacgaguacuccaaggagcucaaccaguaccgccgcuccaaggacucccgcggccgcggccucucccgcggccgcggccgcggcucccgcggccgcggcaagggcaugggccgcggccgcggccgcggcggcucccgcggcggcaugaacaagggcggcaugaacgacgacgaggacuucuacgacgaggacaugggcgacggcggcggcggcuccuaccgcucccgcgaccacgacaagccccaccagcaguccgacaagaagggcaaggucaucugcaaguacuucgucgagggccgcugcaccuggggcgaccacugcaacuucucccacgacaucgagcuccccaagaagcgcgagcucugcaaguucuacaucaccggcuucugcgcccgcgccgagaacugccccuacaugcacggcgacuuccccugcaagcucuaccacaccaccggcaacugcaucaacggcgacgacugcauguucucccacgacccccucaccgaggagacccgcgagcuccucgacaagaugcucgccgacgacgccgaggccggcgccgaggacgagaaggaggucgaggagcucaagaagcagggcaucaacccccuccccaagcccccccccggcgucggccuccuccccacccccccccgcccccccggcccccaggcccccaccucccccaacggccgccccaugcagggcggcccccccccccccccccccccccccccccccccccccggccccccccagaugcccaugcccguccacgagccccucuccccccagcagcuccagcagcaggacauguacaacaagaagauccccucccucuucgagaucgucguccgccccaccggccagcucgccgagaagcucggcguccgcuuccccggccccggcggcccccccggccccaugggccccggccccaacaugggcccccccggccccaugggcggccccaugcaccccgacaugcaccccgacaugcaccccgacaugcaccccgacaugcacgccgacaugcacgccgacaugcccaugggccccggcaugaaccccggcccccccaugggccccggcggcccccccaugaugcccuacggccccggcgacuccccccacuccggcaugaugccccccaucccccccgcccagaacuucuacgagaacuucuaccagcagcaggagggcauggagauggagcccggccuccucggcgacgccgaggacuacggccacuacgaggagcuccccggcgagcccggcgagcaccucuuccccgagcacccccucgagcccgacuccuucuccgagggcggcccccccggccgccccaagcccggcgccggcguccccgacuuccuccccuccgcccagcgcgcccucuaccuccgcauccagcagaagcagcaggaggaggaggagcgcgcccgccgccucgccgaguccuccaagcaggaccgcgagaacgaggagggcgacaccggcaacugguacuccuccgacgaggacgagggcggcuccuccgucaccuccauccucaagacccuccgccagcagaccuccucccgcccccccgccuccgucggcgagcucuccuccuccggccucggcgacccccgccuccagaagggccaccccaccggcucccgccucgccgacccccgccucucccgcgacccccgccucacccgccacgucgaggccuccggcggcuccggccccggcgacuccggccccuccgacccccgccucgcccgcgcccuccccaccuccaagcccgagggcucccuccacuccucccccgucggccccuccuccuccaagggcuccggccccccccccaccgaggaggaggagggcgagcgcgcccuccgcgagaaggccgucaacaucccccucgacccccuccccggccacccccuccgcgacccccgcucccagcuccagcaguucucccacaucaagaaggacgucacccucuccaagcccuccuucgcccgcaccguccucuggaaccccgaggaccucaucccccuccccauccccaagcaggacgccgucccccccguccccgccgcccuccaguccaugcccacccucgacccccgccuccaccgcgccgccaccgccggcccccccaacgcccgccagcgccccggcgccuccaccgacuccuccacccagggcgccaaccuccccgacuucgagcuccucucccgcauccucaagaccgucaacgccaccggcuccuccgccgcccccggcuccuccgacaagcccuccgacccccgcguccgcaaggcccccaccgacccccgccuccagaagcccaccgacuccaccgccuccucccgcgccgccaagcccggccccgccgaggcccccucccccaccgccucccccuccggcgacgccuccccccccgccaccgcccccuacgacccccgcguccucgccgccggcggccucggccagggcggcggcggcggccaguccuccguccucuccggcaucucccucuacgacccccgcacccccaacgccggcggcaaggccaccgagcccgccgccgacaccggcgcccagcccaagggcgccgagggcaacggcaaguccuccgccuccaaggccaaggagccccccuucguccgcaaguccgcccucgagcagcccgagaccggcaaggccggcgccgacggcggcacccccaccgaccgcuacaacuccuacaaccgcccccgccccaaggccgccgccgcccccgccgccaccaccgccacccccccccccgagggcgcccccccccagcccggcguccacaaccuccccguccccacccucuucggcaccgucaagcagacccccaagaccggcuccggcucccccuucgccggcaacucccccgcccgcgagggcgagcaggacgccgccucccucaaggacgucuucaagggcuucgaccccaccgccucccccuucugccaguga

SEQ ID NO: 51939 - RNA, 2916 nt, Artificial Sequence
  derived and/or modified sequence opt2 from ZC3H7A__Homo_sapiens__NP_054872
auguccaacgucuccgaggagcgccgcaagcgccagcagaacaucaaggagggccuccaguucauccaguccccccucuccuaccccggcacccaggagcaguacgccgucuaccuccgcgcccucguccgcaaccucuucaacgagggcaacgacgucuaccgcgagcacgacuggaacaacuccaucucccaguacaccgaggcccucaacaucgccgacuacgccaaguccgaggagauccucauccccaaggagaucaucgagaagcucuacaucaaccgcaucgccugcuacuccaacaugggcuuccacgacaagguccucgaggacugcaacaucguccucucccucaacgccuccaacugcaaggcccucuaccgcaaguccaaggcccucuccgaccucggccgcuacaagaaggccuacgacgccgucgccaagugcucccucgccgucccccaggacgagcacgucaucaagcucacccaggagcucgcccagaagcucggcuucaagauccgcaaggccuacguccgcgccgagcucucccucaaguccguccccggcgacggcgccaccaaggcccucaaccacuccgucgaggacaucgagcccgaccuccucaccccccgccaggaggccguccccgucgucucccuccccgcccccuccuucucccacgaggucggcuccgagcucgccuccguccccgucaugccccucaccuccauccucccccuccaggucgaggaguccgcccuccccuccgccguccucgccaacggcggcaagaugcccuucaccaugcccgaggccuuccucgacgacggcgacaugguccucggcgacgagcucgacgaccuccucgacuccgcccccgagaccaacgagaccgucaugcccuccgcccucguccgcggcccccuccagaccgccuccgucucccccuccaugcccuucuccgccucccuccucggcacccuccccaucggcgcccgcuacgcccccccccccuccuucuccgaguucuaccccccccucaccuccucccucgaggacuucugcuccucccucaacuccuucuccauguccgaguccaagcgcgaccucuccaccuccaccucccgcgagggcaccccccucaacaacuccaacuccucccuccuccucaugaacggccccggcucccucuucgccuccgagaacuuccucggcaucuccucccagccccgcaacgacuucggcaacuucuucggcuccgccgucaccaagcccuccuccuccgucaccccccgccacccccucgagggcacccacgagcuccgccaggccugccagaucugcuucgucaaguccggccccaagcucauggacuucaccuaccacgccaacaucgaccacaagugcaagaaggacauccucaucggccgcaucaagaacgucgaggacaaguccuggaagaagauccgcccccgccccaccaagaccaacuacgagggccccuacuacaucugcaaggacgucgccgccgaggaggagugccgcuacuccggccacugcaccuucgccuacugccaggaggagaucgacgucuggacccucgagcgcaagggcgccuucucccgcgaggccuucuucggcggcaacggcaagaucaaccucaccgucuucaagcuccuccaggagcaccucggcgaguucaucuuccucugcgagaagugcuucgaccacaagccccgcaugaucuccaagcgcaacaaggacaacuccaccgccugcucccaccccgucaccaagcacgaguucgaggacaacaagugccucguccacauccuccgcgagaccaccgucaaguacuccaagauccgcuccuuccacggccagugccagcucgaccucugccgccacgagguccgcuacggcugccuccgcgaggacgagugcuucuacgcccacucccucgucgagcucaaggucuggaucaugcagaacgagaccggcaucucccacgacgccaucgcccaggaguccaagcgcuacuggcagaaccucgaggccaacguccccggcgcccagguccucggcaaccagaucaugcccggcuuccucaacaugaagaucaaguucgucugcgcccagugccuccgcaacggccaggucaucgagcccgacaagaaccgcaaguacugcuccgccaaggcccgccacuccuggaccaaggaccgccgcgccaugcgcgucauguccaucgagcgcaagaaguggaugaacauccgcccccuccccaccaagaagcagaugccccuccaguucgaccucugcaaccacaucgccuccggcaagaagugccaguacgucggcaacugcuccuucgcccacucccccgaggagcgcgaggucuggaccuacaugaaggagaacggcauccaggacauggagcaguucuacgagcucuggcucaagucccagaagaacgagaaguccgaggacaucgccucccaguccaacaaggagaacggcaagcagauccacaugcccaccgacuacgccgaggucaccgucgacuuccacugcuggaugugcggcaagaacugcaacuccgagaagcaguggcagggccacaucuccuccgagaagcacaaggagaaggucuuccacaccgaggacgaccaguacugcuggcagcaccgcuuccccaccggcuacuucuccaucugcgaccgcuacaugaacggcaccugccccgagggcaacuccugcaaguucgcccacggcaacgccgagcuccacgagugggaggagcgccgcgacgcccucaagaugaagcucaacaaggcccgcaaggaccaccucaucggccccaacgacaacgacuucggcaaguacuccuuccucuucaaggaccucaacuga

SEQ ID NO: 51940 - RNA, 2934 nt, Artificial Sequence
  derived and/or modified sequence opt2 from ZC3H7B__Homo_sapiens__NP_060060
auggagcgccagaagcgcaaggccgacaucgagaagggccuccaguucauccaguccacccucccccucaagcaggaggaguacgaggccuuccuccucaagcucguccagaaccucuucgccgagggcaacgaccucuuccgcgagaaggacuacaagcaggcccucguccaguacauggagggccucaacgucgccgacuacgccgccuccgaccaggucgcccucccccgcgagcuccucugcaagcuccacgucaaccgcgccgccugcuacuucaccaugggccucuacgagaaggcccucgaggacuccgagaaggcccucggccucgacuccgaguccauccgcgcccucuuccgcaaggcccgcgcccucaacgagcucggccgccacaaggaggccuacgagugcuccucccgcugcucccucgcccucccccacgacgaguccgucacccagcucggccaggagcucgcccagaagcucggccuccgcguccgcaaggccuacaagcgcccccaggagcucgagaccuucucccuccucuccaacggcaccgccgccggcgucgccgaccagggcaccuccaacggccucggcuccaucgacgacaucgagaccgacugcuacgucgacccccgcggcucccccgcccuccuccccuccacccccaccaugccccucuucccccacguccucgaccuccucgccccccucgacuccucccgcacccuccccuccaccgacucccucgacgacuucuccgacggcgacgucuucggccccgagcucgacacccuccucgacucccucucccucguccagggcggccucuccggcuccggcguccccuccgagcucccccagcucauccccgucuuccccggcggcaccccccuccucccccccgucgucggcggcuccauccccgucuccuccccccucccccccgccuccuucggccucgucauggaccccuccaagaagcucgccgccuccguccucgacgcccucgacccccccggccccacccucgacccccucgaccuccuccccuacuccgagacccgccucgacgcccucgacuccuucggcuccacccgcggcucccucgacaagcccgacuccuucauggaggagaccaacucccaggaccaccgcccccccuccggcgcccagaagcccgcccccucccccgagcccugcaugcccaacaccgcccuccucaucaagaacccccucgccgccacccacgaguucaagcaggccugccagcucugcuaccccaagaccggcccccgcgccggcgacuacaccuaccgcgagggccucgagcacaagugcaagcgcgacauccuccucggccgccuccgcuccuccgaggaccagaccuggaagcgcauccgcccccgccccaccaagaccuccuucgucggcuccuacuaccucugcaaggacaugaucaacaagcaggacugcaaguacggcgacaacugcaccuucgccuaccaccaggaggagaucgacgucuggaccgaggagcgcaagggcacccucaaccgcgaccuccucuucgacccccucggcggcgucaagcgcggcucccucaccaucgccaagcuccucaaggagcaccagggcaucuucaccuuccucugcgagaucugcuucgacuccaagccccgcaucaucuccaagggcaccaaggacucccccuccgucugcuccaaccucgccgccaagcacuccuucuacaacaacaagugccucguccacaucguccgcuccaccucccucaaguacuccaagauccgccaguuccaggagcacuuccaguucgacgucugccgccacgagguccgcuacggcugccuccgcgaggacuccugccacuucgcccacuccuucaucgagcucaaggucuggcuccuccagcaguacuccggcaugacccacgaggacaucguccaggaguccaagaaguacuggcagcagauggaggcccacgccggcaaggccuccuccuccaugggcgccccccgcacccacggccccuccaccuucgaccuccagaugaaguucgucugcggccagugcuggcgcaacggccaggucgucgagcccgacaaggaccucaaguacugcuccgccaaggcccgccacugcuggaccaaggagcgccgcguccuccucgucauguccaaggccaagcgcaagugggucuccguccgcccccuccccuccauccgcaacuucccccagcaguacgaccucugcauccacgcccagaacggccgcaagugccaguacgucggcaacugcuccuucgcccacucccccgaggagcgcgacauguggaccuucaugaaggagaacaagauccucgacaugcagcagaccuacgacauguggcucaagaagcacaaccccggcaagcccggcgagggcacccccaucuccucccgcgagggcgagaagcagauccagaugcccaccgacuacgccgacaucaugaugggcuaccacugcuggcucugcggcaagaacuccaacuccaagaagcaguggcagcagcacauccaguccgagaagcacaaggagaaggucuucaccuccgacuccgacgccuccggcugggccuuccgcuuccccaugggcgaguuccgccucugcgaccgccuccagaagggcaaggccugccccgacggcgacaagugccgcugcgcccacggccaggaggagcucaacgaguggcucgaccgccgcgagguccucaagcagaagcucgccaaggcccgcaaggacaugcuccucugcccccgcgacgacgacuucggcaaguacaacuuccuccuccaggaggacggcgaccucgccggcgccacccccgaggcccccgccgccgccgccaccgccaccaccggcgaguga

SEQ ID NO: 51941 - RNA, 2709 nt, Artificial Sequence
  derived and/or modified sequence opt2 from ZC3HAV1__Homo_sapiens__NP_064504
auggccgaccccgaggucugcugcuucaucaccaagauccucugcgcccacggcggccgcauggcccucgacgcccuccuccaggagaucgcccucuccgagccccagcucugcgagguccuccaggucgccggccccgaccgcuucgucguccucgagaccggcggcgaggccggcaucacccgcuccgucgucgccaccacccgcgcccgcgucugccgccgcaaguacugccagcgccccugcgacaaccuccaccucugcaagcucaaccuccucggccgcugcaacuacucccaguccgagcgcaaccucugcaaguacucccacgagguccucuccgaggagaacuucaagguccucaagaaccacgagcucuccggccucaacaaggaggagcucgccguccuccuccuccaguccgaccccuucuucaugcccgagaucugcaaguccuacaagggcgagggccgccagcagaucugcaaccagcagccccccugcucccgccuccacaucugcgaccacuucacccgcggcaacugccgcuuccccaacugccuccgcucccacaaccucauggaccgcaagguccucgccaucaugcgcgagcacggccucaaccccgacgucguccagaacauccaggacaucugcaacuccaagcacaugcagaagaacccccccggcccccgcgcccccuccucccaccgccgcaacauggccuaccgcgcccgcuccaagucccgcgaccgcuucuuccagggcucccaggaguuccucgccuccgccuccgccuccgccgagcgcuccugcacccccucccccgaccagaucucccaccgcgccucccucgaggacgcccccgucgacgaccucacccgcaaguucaccuaccucggcucccaggaccgcgcccgcccccccuccggcuccuccaaggccaccgaccucggcggcaccucccaggccggcaccucccagcgcuuccucgagaacggcucccaggaggaccuccuccacggcaaccccggcuccaccuaccucgccuccaacuccaccuccgcccccaacuggaagucccucaccuccuggaccaacgaccagggcgcccgccgcaagaccgucuucucccccacccuccccgccgcccgcuccucccucggcucccuccagacccccgaggccgucaccacccgcaagggcaccggccuccucuccuccgacuaccgcaucaucaacggcaaguccggcacccaggacauccagcccggcccccucuucaacaacaacgccgacggcgucgccaccgacaucaccuccacccgcucccucaacuacaaguccaccuccuccggccaccgcgagaucuccuccccccgcauccaggacgccggccccgccucccgcgacguccaggccaccggccgcaucgccgacgacgccgacccccgcgucgcccucgucaacgacucccucuccgacgucaccuccaccaccuccucccgcgucgacgaccacgacuccgaggagaucugccucgaccaccucugcaagggcugcccccucaacggcuccugcuccaagguccacuuccaccuccccuaccgcuggcagaugcucaucggcaagaccuggaccgacuucgagcacauggagaccaucgagaagggcuacugcaaccccggcauccaccucugcuccgucggcuccuacaccaucaacuuccgcgucauguccugcgacuccuuccccauccgccgccucuccacccccuccuccgucaccaagcccgccaacuccgucuucaccaccaaguggaucugguacuggaagaacgaguccggcaccuggauccaguacggcgaggagaaggacaagcgcaagaacuccaacgucgacuccuccuaccucgagucccucuaccaguccugcccccgcggcgucguccccuuccaggccggcucccgcaacuacgagcucuccuuccagggcaugauccagaccaacaucgccuccaagacccagaaggacgucauccgccgccccaccuucgucccccagugguacguccagcagaugaagcgcggccccgaccaccagcccgccaagaccuccuccgucucccucaccgccaccuuccgcccccaggaggacuucugcuuccucuccuccaagaaguacaagcucuccgagauccaccaccuccaccccgaguacguccgcgucuccgagcacuucaaggccuccaugaagaacuucaagaucgagaagaucaagaagaucgagaacuccgagcuccucgacaaguucaccuggaagaagucccagaugaaggaggagggcaagcuccucuucuacgccaccucccgcgccuacgucgaguccaucugcuccaacaacuucgacuccuuccuccacgagacccacgagaacaaguacggcaagggcaucuacuucgccaaggacgccaucuacucccacaagaacugccccuacgacgccaagaacgucgucauguucgucgcccagguccucgucggcaaguucaccgagggcaacaucaccuacaccuccccccccccccaguucgacuccugcgucgacacccgcuccaaccccuccgucuucgucaucuuccagaaggaccaggucuacccccaguacgucaucgaguacaccgaggacaaggccugcgucaucuccuga

SEQ ID NO: 51942 - RNA, 1446 nt, Artificial Sequence
  derived and/or modified sequence opt2 from ZC3HC1__Homo_sapiens__NP_001269119
augcgcggccucccccgcaagcgcgaggccuggacccagccccacccccucgaggcccucuacgagucccuccgcguccucgagaaggacaccuccgccaccucccaguccgucaacggcuccccccaggccgagcagcccucccucgaguccaccuccaaggaggccuucuucucccgcgucgagaccuucuccucccucaagugggccggcaagcccuucgagcucuccccccucgucugcgccaaguacggcugggucaccgucgagugcgacaugcucaagugcuccuccugccaggccuuccucugcgccucccuccagcccgccuucgacuucgaccgcuacaagcagcgcugcgccgagcucaagaaggcccucugcaccgcccacgagaaguucugcuucuggcccgacucccccucccccgaccgcuucggcaugcucccccucgacgagcccgccauccucgucuccgaguuccucgaccgcuuccagucccucugccaccucgaccuccagcuccccucccuccgccccgaggaccucaagaccaugugccucaccgaggacaagaucucccuccuccuccaccuccucgaggacgagcucgaccaccgcaccgacgagcgcaagaccaccaucaagcucggcuccgacauccagguccacgucaccgccugcauccucuccgucugcggcugggccugcuccuccucccucgaguccaugcagcucucccucaucaccugcucccagugcaugcgcaaggucggccucuggggcuuccagcagaucgaguccuccaugaccgaccucgacgccuccuucggccucaccuccucccccauccccggccucgagggccgccccgagcgccucccccucguccccgaguccccccgccgcaugaugacccgcucccaggacgccaccuucucccccggcuccgagcaggccgagaagucccccggccccaucgucucccgcacccgcuccugggacuccuccucccccgucgaccgccccgagcccgaggccgccucccccaccacccgcacccgccccgucacccgcuccaugggcaccggcgacacccccggccucgagguccccuccuccccccuccgcaaggccaagcgcgcccgccucugcuccuccuccuccuccgacaccuccucccgcuccuucuucgaccccaccucccagcaccgcgacuggugccccugggucaacaucacccucggcaaggagucccgcgagaacggcggcaccgagcccgacgccuccgcccccgccgagcccggcuggaaggccguccucaccauccuccucgcccacaagcaguccucccagcccgccgagaccgacuccaugucccucuccgagaagucccgcaaggucuuccgcaucuuccgccagugggagucccucugcuccugcuga

SEQ ID NO: 51943 - RNA, 531 nt, Artificial Sequence
  derived and/or modified sequence opt2 from ZC4H2__Homo_sapiens__NP_001171504
auggccgacgagcaggagaucaugugcaagcucgaguccaucaaggagauccgcaacaagacccuccagauggagaagaucaaggcccgccucaaggccgaguucgaggcccucgaguccgaggagcgccaccucaaggaguacaagcaggagauggaccuccuccuccaggagaagauggcccacgucgaggagcuccgccucauccacgccgacaucaacgucauggagaacaccaucaagcaguccgagaacgaccucaacaagcuccucgaguccacccgccgccuccacgacgaguacaagccccucaaggagcacgucgacgcccuccgcaugacccucggccuccagcgccuccccgaccucugcgaggaggaggagaagcucucccucgagcccgccugccacgucaccuccaaguucaccggcaugcaccucuacgcccucuucgcccgcccccgcgucggccccggcacccccaagucccgcaacggcucccgcaugaacaaggagcgcgaguccaccuga

SEQ ID NO: 51944 - RNA, 3915 nt, Artificial Sequence
  derived and/or modified sequence opt2 from ZCCHC11__Homo_sapiens__XP_011539402
auggaggaguccaagacccucaaguccgagaaccacgagcccaagaagaacgucaucugcgaggaguccaaggccguccaggucaucggcaaccagacccucaaggcccgcaacgacaaguccgucaaggagaucgagaacuccucccccaaccgcaacuccuccaagaagaacaagcagaacgacaucugcaucgagaagaccgaggucaaguccugcaaggucaacgccgccaaccuccccggccccaaggaccucggccucguccuccgcgaccagucccacugcaaggccaagaaguuccccaacucccccgucaaggccgagaaggccaccaucucccaggccaaguccgagaaggccaccucccuccaggccaaggccgagaagucccccaagucccccaacuccgucaaggccgagaaggccuccuccuaccagaugaaguccgagaagguccccuccucccccgccgaggccgagaagggccccucccuccuccucaaggacaugcgccagaagaccgagcuccagcagaucggcaagaagauccccuccuccuucaccuccgucgacaaggucaacaucgaggccgucggcggcgagaagugcgcccuccagaacuccccccgcucccagaagcagcagaccugcaccgacaacaccggcgacuccgacgacuccgccuccggcaucgaggacgucuccgacgaccucuccaagaugaagaacgacgaguccaacaaggagaacuccuccgagauggacuaccucgagaacgccaccgucaucgacgaguccgcccucacccccgagcagcgccucggccucaagcaggccgaggagcgccucgagcgcgaccacaucuuccgccucgagaagcgcucccccgaguacaccaacugccgcuaccucugcaagcucugccucauccacaucgagaacauccagggcgcccacaagcacaucaaggagaagcgccacaagaagaacauccucgagaagcaggaggaguccgagcuccgcucccuccccccccccucccccgcccaccucgccgcccucuccgucgccgucaucgagcucgccaaggagcacggcaucaccgacgacgaccuccgcguccgccaggagaucgucgaggagauguccaaggucaucaccaccuuccuccccgagugcucccuccgccucuacggcuccucccucacccgcuucgcccucaaguccuccgacgucaacaucgacaucaaguucccccccaagaugaaccaccccgaccuccucaucaagguccucggcauccucaagaagaacguccucuacgucgacgucgaguccgacuuccacgccaagguccccgucgucgucugccgcgaccgcaaguccggccuccucugccgcgucuccgccggcaacgacauggccugccucaccaccgaccuccucaccgcccucggcaagaucgagcccgucuucaucccccucguccucgccuuccgcuacugggccaagcucugcuacaucgacucccagaccgacggcggcauccccuccuacugcuucgcccucauggucauguucuuccuccagcagcgcaagcccccccuccuccccugccuccucggcuccuggaucgagggcuucgaccccaagcgcauggacgacuuccagcucaagggcaucgucgaggagaaguucgucaagugggagugcaacuccuccuccgccaccgagaagaacuccaucgccgaggagaacaaggccaaggccgaccagcccaaggacgacaccaagaagaccgagaccgacaaccaguccaacgccaugaaggagaagcacggcaaguccccccucgcccucgagacccccaaccgcgucucccucggccagcucuggcucgagcuccucaaguucuacacccucgacuucgcccucgaggaguacgucaucugcguccgcauccaggacauccucacccgcgagaacaagaacuggcccaagcgccgcaucgccaucgaggaccccuucuccgucaagcgcaacgucgcccgcucccucaacucccagcucgucuacgaguacgucgucgagcgcuuccgcgccgccuaccgcuacuucgccugcccccagaccaagggcggcaacaaguccaccgucgacuucaagaagcgcgagaagggcaagaucuccaacaagaagcccgucaaguccaacaacauggccaccaacggcugcauccuccucggcgagaccaccgagaagaucaacgccgagcgcgagcagcccguccagugcgacgagauggacugcaccucccagcgcugcaucaucgacaacaacaaccuccucgucaacgagcucgacuucgccgaccacggccaggacuccuccucccucuccaccuccaaguccuccgagaucgagcccaagcucgacaagaagcaggacgaccucgcccccuccgagaccugccucaagaaggagcucucccagugcaacugcaucgaccucuccaagucccccgaccccgacaaguccaccggcaccgacugccgcuccaaccucgagaccgaguccucccaccaguccgucugcaccgacaccuccgccaccuccugcaacugcaaggccaccgaggacgccuccgaccucaacgacgacgacaaccuccccacccaggagcucuacuacgucuucgacaaguucauccucaccuccggcaagccccccaccaucgucugcuccaucugcaagaaggacggccacuccaagaacgacugccccgaggacuuccgcaagaucgaccucaagccccucccccccaugaccaaccgcuuccgcgagauccucgaccucgucugcaagcgcugcuucgacgagcucuccccccccugcuccgagcagcacaaccgcgagcagauccucaucggccucgagaaguucauccagaaggaguacgacgagaaggcccgccucugccucuucggcuccuccaagaacggcuucggcuuccgcgacuccgaccucgacaucugcaugacccucgagggccacgagaacgccgagaagcucaacugcaaggagaucaucgagaaccucgccaagauccucaagcgccaccccggccuccgcaacauccuccccaucaccaccgccaagguccccaucgucaaguucgagcaccgccgcuccggccucgagggcgacaucucccucuacaacacccucgcccagcacaacacccgcaugcucgccaccuacgccgccaucgacccccgcguccaguaccucggcuacaccaugaaggucuucgccaagcgcugcgacaucggcgacgccucccgcggcucccucuccuccuacgccuacauccucaugguccucuacuuccuccagcagcgcaagccccccgucauccccguccuccaggagaucuucgacggcaagcagaucccccagcgcauggucgacggcuggaacgccuucuucuucgacaagaccgaggagcucaagaagcgccuccccucccucggcaagaacaccgagucccucggcgagcucuggcucggccuccuccgcuucuacaccgaggaguucgacuucaaggaguacgucaucuccauccgccagaagaagcuccucaccaccuucgagaagcaguggaccuccaagugcaucgccaucgaggaccccuucgaccucaaccacaaccucggcgccggcgucucccgcaagaugaccaacuucaucaugaaggccuucaucaacggccgcaagcucuucggcacccccuucuacccccucaucggccgcgaggccaccaucucccccaccaagaccggcuucauguccguccgcuucaccuacuuccaguacauccacuccgucuggcgcaucggcugcaccaaguga

SEQ ID NO: 51945 - RNA, 1209 nt, Artificial Sequence
  derived and/or modified sequence opt2 from ZCCHC12__Homo_sapiens__NP_776159
auggccuccaucaucgcccgcgucggcaacucccgccgccucaacgccccccucccccccugggcccacuccaugcuccgcucccucggccgcucccucggccccaucauggccuccauggccgaccgcaacaugaagcucuucuccggccgcgucguccccgcccagggcgaggagaccuucgagaacuggcucacccaggucaacggcguccuccccgacuggaacauguccgaggaggagaagcucaagcgccucaugaagacccuccgcggccccgcccgcgaggucaugcgcguccuccaggccaccaaccccaaccucuccgucgccgacuuccuccgcgccaugaagcucgucuucggcgaguccgaguccuccgucaccgcccacggcaaguucuucaacacccuccaggcccagggcgagaaggccucccucuacgucauccgccucgagguccagcuccagaacgccauccaggccggcaucaucgccgagaaggacgccaaccgcacccgccuccagcagcuccuccucggcggcgagcucucccgcgaccuccgccuccgccucaaggacuuccuccgcauguacgccaacgagcaggagcgccuccccaacuuccucgagcucauccgcaugguccgcgaggaggaggacugggacgacgccuucaucaagcgcaagcgccccaagcgcuccgaguccauggucgagcgcgccgucucccccgucgccuuccagggcuccccccccaucgucaucggcuccgccgacugcaacgucaucgagaucgacgacacccucgacgacuccgacgaggacgucauccucgucgagucccaggaccccccccuccccuccuggggcgcccccccccuccgcgaccgcgcccgcccccaggacgagguccucgucaucgacuccccccacaacucccgcgcccaguuccccuccaccuccggcggcuccggcuacaagaacaacggccccggcgagaugcgccgcgcccgcaagcgcaagcacaccauccgcugcuccuacugcggcgaggagggccacuccaaggagaccugcgacaacgaguccgacaaggcccaggucuucgagaaccucaucaucacccuccaggagcucacccacaccgagauggagcgcucccgcgucgcccccggcgaguacaacgacuucuccgagccccucuga

SEQ ID NO: 51946 - RNA, 2850 nt, Artificial Sequence
  derived and/or modified sequence opt2 from ZCCHC14__Homo_sapiens__NP_055959
auggccuccaaccaccccgccuucuccuuccaccagaagcagguccuccgccaggagcucacccagauccaguccucccucaacggcggcggcggccacggcggcaagggcgcccccggccccggcggcgcccuccccaccugccccgccugccacaagaucaccccccgcaccgaggcccccgucuccuccgucuccaacucccucgagaacgcccuccacaccuccgcccacuccaccgaggagucccuccccaagcgcccccucggcaagcacuccaaggucuccgucgagaagaucgaccucaagggccucucccacaccaagaacgaccgcaacgucgagugcuccuucgagguccucugguccgacuccuccaucaccuccgucaccaaguccuccuccgaggucaccgaguucaucuccaagcucugccagcucuaccccgaggagaaccucgagaagcucauccccugccucgccggccccgacgccuucuacgucgagcgcaaccacgucgaccucgacuccggccuccgcuaccucgccucccuccccucccacguccucaagaacgaccacguccgccgcuuccucuccaccuccucccccccccagcagcuccagucccccucccccggcaaccccucccucuccaaggucggcaccgucaugggcgucuccggccgccccgucugcggcgucgccggcauccccuccucccaguccggcgcccagcaccacggccagcaccccgccggcuccgccgccccccucccccacugcucccacgccggcuccgccggcuccgcccucgccuaccgcacccagauggacaccucccccgccauccucaugcccuccucccuccagaccccccagacccaggagcagaacggcauccucgacuggcuccgcaagcuccgccuccacaaguacuaccccgucuucaagcagcucuccauggagaaguuccucucccucaccgaggaggaccucaacaaguucgagucccucaccaugggcgccaagaagaagcucaagacccagcucgagcucgagaaggagaaguccgagcgccgcugccucaaccccuccgcccccccccucgucaccuccuccggcgucgcccgcgucccccccaccucccacgucggccccguccaguccggccgcggcucccacgccgccgagcuccgcgucgaggucgagcagccccaccaccagcucccccgcgagggcuccuccuccgaguacuccuccuccuccuccucccccaugggcguccaggcccgcgaggaguccuccgacuccgccgaggagaacgaccgccgcgucgagauccaccucgaguccuccgacaaggagaagcccgucaugcuccucaaccacuucaccuccuccuccgcccgccccaccgcccagguccuccccguccagaacgaggccuccuccaaccccuccggccaccacccccuccccccccagaugcucuccgccgccucccacaucacccccauccgcaugcucaacuccguccacaagcccgagcgcggcuccgccgacaugaagcuccucuccuccuccguccacucccuccucucccucgaggagcgcaacaagggcuccggcccccgcuccuccaugaaggucgacaaguccuucggcuccgccaugauggacguccuccccgccuccgccccccaccagcccguccagguccucuccggccucuccgaguccuccuccaugucccccaccgucuccuucggcccccgcaccaaggucguccacgccuccacccucgaccgcguccucaagaccgcccagcagcccgcccucgucgucgagaccuccaccgccgccaccggcacccccuccaccguccuccacgccgcccgcccccccaucaagcuccuccucuccuccuccguccccgccgacuccgccaucuccggccagaccuccugccccaacaacguccagaucuccgucccccccgccaucaucaacccccgcaccgcccucuacaccgccaacaccaaggucgccuucuccgccauguccuccaugcccgucggcccccuccagggcggcuucugcgccaacuccaacaccgccucccccuccucccaccccuccaccuccuucgccaacauggccacccuccccuccugccccgcccccuccuccucccccgcccucuccuccguccccgaguccuccuucuacuccuccuccggcggcggcggcuccaccggcaacauccccgccuccaaccccaaccaccaccaccaccaccaccaccagcagccccccgcccccccccagcccgccccccccccccccggcugcaucgucugcaccuccugcggcugcuccggcuccugcggcuccuccggccucaccgucuccuacgccaacuacuuccagcaccccuucuccggccccuccgucuucaccuuccccuuccuccccuucucccccaugugcuccuccggcuacgucuccgcccagcaguacggcggcggcuccaccuuccccgucguccacgcccccuacuccuccuccggcacccccgaccccguccucuccggccaguccaccuucgccgucccccccaugcagaacuucauggccggcaccgccggcgucuaccagacccagggccucgucggcuccuccaacggcuccucccacaagaaguccggcaaccucuccugcuacaacugcggcgccaccggccaccgcgcccaggacugcaagcagcccuccauggacuucaaccgccccggcaccuuccgccucaaguacgccccccccgccgagucccucgacuccaccgacuga

SEQ ID NO: 51947 - RNA, 3537 nt, Artificial Sequence
  derived and/or modified sequence opt2 from ZCCHC2__Homo_sapiens__NP_060212
augcuccgcaugaagcucccccucaagcccacccaccccgccgagcccccccccgaggccgaggagcccgaggccgacgcccgccccggcgccaaggcccccucccgccgccgccgcgacugccgcccccccccccccccccccccccccgccggccccucccgcggcccccuccccccccccccccccccccgcggccucggcccccccgucgccggcggcgccgccgccggcgccggcaugcccggcggcggcggcggccccuccgccgcccuccgcgagcaggagcgcgucuacgagugguucggccucguccucggcuccgcccagcgccucgaguucaugugcggccuccucgaccucugcaacccccucgagcuccgcuuccucggcuccugccucgaggaccucgcccgcaaggacuaccacuaccuccgcgacuccgaggccaaggccaacggccucuccgaccccggcccccucgccgacuuccgcgagcccgccguccgcucccgccucaucgucuaccucgcccuccucggcuccgagaaccgcgaggccgccggccgccuccaccgccuccucccccaggucgacuccguccucaagucccuccgcgccgcccgcggcgagggcucccgcggcggcgccgaggacgagcgcggcgaggacggcgacggcgagcaggacgccgagaaggacggcuccggccccgagggcggcaucgucgagccccgcgucggcggcggccucggcucccgcgcccaggaggagcuccuccuccucuucaccauggccucccuccaccccgccuucuccuuccaccagcgcgucacccuccgcgagcaccucgagcgccuccgcgccgcccuccgcggcggccccgaggacgccgaggucgaggucgagcccugcaaguucgccggcccccgcgcccagaacaacuccgcccacggcgacuacaugcagaacaacgaguccucccucaucgagcaggcccccaucccccaggacggccucaccgucgccccccaccgcgcccagcgcgaggccguccacaucgagaagaucaugcucaagggcguccagcgcaagcgcgccgacaaguacugggaguacaccuucaaggucaacugguccgaccucuccgucaccaccgucaccaagacccaccaggagcuccaggaguuccuccucaagcuccccaaggagcucuccuccgagaccuucgacaagaccauccuccgcgcccucaaccagggcucccucaagcgcgaggagcgccgccaccccgaccucgagcccauccuccgccagcucuucuccuccuccucccaggccuuccuccagucccagaagguccacuccuucuuccaguccaucuccuccgacucccuccacuccaucaacaaccuccaguccucccucaagaccuccaagauccucgagcaccucaaggaggacuccuccgaggccuccucccaggaggaggacguccuccagcacgccaucauccacaagaagcacaccggcaagucccccaucgucaacaacaucggcaccuccugcuccccccucgacggccucaccaugcaguacuccgagcagaacggcaucgucgacuggcgcaagcaguccugcaccaccauccagcaccccgagcacugcgucaccuccgccgaccagcacuccgccgagaagcgcucccucuccuccaucaacaagaagaagggcaagccccagaccgagaaggagaagaucaagaagaccgacaaccgccucaacucccgcaucaacggcauccgccucuccaccccccagcacgcccacggcggcaccgucaaggacgucaaccucgacaucggcuccggccacgacaccugcggcgagaccuccuccgaguccuacuccucccccuccuccccccgccacgacggccgcgaguccuucgaguccgaggaggagaaggaccgcgacaccgacuccaacuccgaggacuccggcaaccccuccaccacccgcuucaccggcuacggcuccgucaaccagaccgucaccgucaagccccccguccagaucgccucccucggcaacgagaacggcaaccuccucgaggacccccucaacucccccaaguaccagcacaucuccuucaugcccacccuccacugcgucaugcacaacggcgcccagaaguccgaggucgucguccccgcccccaagcccgccgacggcaagaccaucggcaugcucguccccucccccgucgccaucuccgccauccgcgaguccgccaacuccacccccgucggcauccucggccccaccgccugcaccggcgaguccgagaagcaccucgagcuccucgccuccccccuccccauccccuccaccuuccucccccacuccuccacccccgcccuccaccucaccguccagcgccucaagcucccccccccccagggcuccuccgaguccugcaccgucaacaucccccagcagccccccggcucccucuccaucgccucccccaacaccgccuucauccccauccacaaccccggcuccuuccccggcucccccgucgccaccaccgaccccaucaccaaguccgccucccaggucgucggccucaaccagauggucccccagaucgagggcaacaccggcaccgucccccagcccaccaacgucaaggucguccuccccgccgccggccucuccgccgcccagccccccgccuccuacccccuccccggcuccccccucgccgccggcguccuccccucccagaacuccuccguccucuccaccgccgccaccuccccccagcccgccuccgccggcaucucccaggcccaggccaccgucccccccgccguccccacccacacccccggccccgcccccucccccucccccgcccucacccacuccaccgcccaguccgacuccaccuccuacaucuccgccgucggcaacaccaacgccaacggcaccgucguccccccccagcagaugggcuccggccccugcggcuccugcggccgccgcugcuccugcggcaccaacggcaaccuccagcucaacuccuacuacuaccccaaccccaugcccggccccauguaccgcguccccuccuucuucacccuccccuccaucugcaacggcuccuaccucaaccaggcccaccaguccaacggcaaccagcuccccuucuuccucccccagacccccuacgccaacggccucguccacgaccccgucaugggcucccaggccaacuacggcaugcagcagauggccggcuucggccgcuucuaccccgucuaccccgcccccaacgucgucgccaacaccuccggcuccggccccaagaagaacggcaacgucuccugcuacaacugcggcgucuccggccacuacgcccaggacugcaagcaguccuccauggaggccaaccagcagggcaccuaccgccuccgcuacgcccccccccucccccccuccaacgacacccucgacuccgccgacuga

SEQ ID NO: 51948 - RNA, 1212 nt, Artificial Sequence
  derived and/or modified sequence opt2 from ZCCHC3__Homo_sapiens__NP_149080
auggccaccggcggcggcgccgaggaggagcgcaagcgcggccgcccccagcuccucccccccgcccgccccgccgcccgcggcgaggaggccgacggcggccgcgagaagaugggcugggcccaggucgucaagaaccucgccgagaagaagggcgaguuccgcgagccccgccccccccgccgcgaggaggaguccggcggcggcggcggcuccgccggccucggcggccccgccggccucgccgcccccgaccucggcgacuucccccccgccggccgcggcgaccccaagggccgccgccgcgaccccgccggcgaggccgucgacccccgcaagaagaagggcgccgccgaggccggccgccgcaagaaggccgaggccgccgccgccgccauggccacccccgcccgccccggcgaggccgaggacgccgccgagcgcccccuccaggacgagcccgccgccgccgccggccccggcaagggccgcuuccucguccgcaucugcuuccagggcgacgagggcgccugccccacccgcgacuucgucgucggcgcccucauccuccgcuccaucggcauggaccccuccgacaucuacgccgucauccagauccccggcucccgcgaguucgacgucuccuuccgcuccgccgagaagcucgcccucuuccuccgcgucuacgaggagaagcgcgagcaggaggacugcugggagaacuucgucguccucggccgcuccaaguccucccucaagacccucuucauccucuuccgcaacgagaccgucgacgucgaggacaucgucaccuggcucaagcgccacugcgacguccucgccguccccgucaaggucaccgaccgcuucggcaucuggaccggcgaguacaagugcgagaucgagcuccgccagggcgagggcggcguccgccaccuccccggcgccuucuuccucggcgccgagcgcggcuacuccugguacaagggccagcccaagaccugcuucaagugcggcucccgcacccacauguccggcuccugcacccaggaccgcugcuuccgcugcggcgaggagggccaccucucccccuacugccgcaagggcaucgucugcaaccucugcggcaagcgcggccacgccuucgcccagugccccaaggccguccacaacuccgucgccgcccagcucaccggcgucgccggccacuga

SEQ ID NO: 51949 - RNA, 4488 nt, Artificial Sequence
  derived and/or modified sequence opt2 from ZCCHC6__Homo_sapiens__NP_001171988
augggcgacaccgccaagcccuacuucgucaagcgcaccaaggaccgcggcaccauggacgacgacgacuuccgccgcggccacccccagcaggacuaccucaucaucgacgaccacgccaagggccacggcuccaagauggagaagggccuccagaagaagaagaucacccccggcaacuacggcaacaccccccgcaagggccccugcgccgucuccuccaaccccuacgccuucaagaaccccaucuacucccagcccgccuggaugaacgacucccacaaggaccaguccaagcgcuggcucuccgacgagcacaccggcaacuccgacaacuggcgcgaguucaagcccggcccccgcauccccgucaucaaccgccagcgcaaggacuccuuccaggagaacgaggacggcuaccgcuggcaggacacccgcggcugccgcaccguccgccgccucuuccacaaggaccucaccucccucgagaccaccuccgagauggaggccggcucccccgagaacaagaagcagcgcucccgcccccgcaagccccgcaagacccgcaacgaggagaacgagcaggacggcgaccucgagggccccgucaucgacgaguccguccucuccaccaaggagcuccucggccuccagcaggccgaggagcgccucaagcgcgacugcaucgaccgccucaagcgccgcccccgcaacuaccccaccgccaaguacaccugccgccucugcgacguccucaucgaguccaucgccuucgcccacaagcacaucaaggagaagcgccacaagaagaacaucaaggagaagcaggaggaggagcuccucaccacccuccccccccccacccccucccagaucaacgccgucggcaucgccaucgacaaggucguccaggaguucggccuccacaacgagaaccucgagcagcgccucgagaucaagcgcaucauggagaacgucuuccagcacaagcuccccgacugcucccuccgccucuacggcuccuccugcucccgccucggcuucaagaacuccgacgucaacaucgacauccaguuccccgccaucaugucccagcccgacguccuccuccucguccaggagugccucaagaacuccgacuccuucaucgacgucgacgccgacuuccacgcccgcguccccgucgucgucugccgcgagaagcaguccggccuccucugcaaggucuccgccggcaacgagaacgccugccucaccaccaagcaccucaccgcccucggcaagcucgagcccaagcucgucccccucgucaucgccuuccgcuacugggccaagcucugcuccaucgaccgccccgaggagggcggccucccccccuacgucuucgcccucauggccaucuucuuccuccagcagcgcaaggagccccuccuccccgucuaccucggcuccuggaucgagggcuucucccucuccaagcucggcaacuucaaccuccaggacaucgagaaggacgucgucaucugggagcacaccgacuccgccgccggcgacaccggcaucaccaaggaggaggccccccgcgagacccccaucaagcgcggccaggucucccucauccucgacgucaagcaccagcccuccguccccgucggccagcucugggucgagcuccuccgcuucuacgcccucgaguucaaccucgccgaccucgucaucuccauccgcgucaaggagcucgucucccgcgagcucaaggacuggcccaagaagcgcaucgccaucgaggaccccuacuccgucaagcgcaacgucgcccgcacccucaacucccagcccgucuucgaguacauccuccacugccuccgcaccaccuacaaguacuucgcccucccccacaagaucaccaaguccucccuccucaagccccucaacgccaucaccugcaucuccgagcacuccaaggaggucaucaaccaccaccccgacguccagaccaaggacgacaagcucaagaacuccguccucgcccagggccccggcgccaccuccuccgccgccaacaccugcaagguccagccccucacccucaaggagaccgccgaguccuucggcuccccccccaaggaggagaugggcaacgagcacaucuccguccaccccgagaacuccgacugcauccaggccgacgucaacuccgacgacuacaagggcgacaaggucuaccaccccgagaccggccgcaagaacgagaaggagaaggucggccgcaagggcaagcaccuccucaccgucgaccagaagcgcggcgagcacgucgucugcggcuccacccgcaacaacgaguccgaguccacccucgaccucgagggcuuccagaaccccaccgccaaggagugcgagggccucgccacccucgacaacaaggccgaccucgacggcgaguccaccgagggcaccgaggagcucgaggacucccucaaccacuucacccacuccguccagggccagaccuccgagaugauccccuccgacgaggaggaggaggacgacgaggaggaggaggaggaggaggagccccgccucaccaucaaccagcgcgaggacgaggacggcauggccaacgaggacgagcucgacaacaccuacaccggcuccggcgacgaggacgcccucuccgaggaggacgacgagcucggcgaggccgccaaguacgaggacgucaaggagugcggcaagcacgucgagcgcgcccuccucgucgagcucaacaagaucucccucaaggaggagaacgucugcgaggagaagaacucccccgucgaccaguccgacuucuucuacgaguucuccaagcucaucuucaccaagggcaagucccccaccgucgucugcucccucugcaagcgcgagggccaccucaagaaggacugccccgaggacuucaagcgcauccagcucgagccccuccccccccucacccccaaguuccucaacauccucgaccaggucugcauccagugcuacaaggacuucucccccaccaucaucgaggaccaggcccgcgagcacauccgccagaaccucgaguccuucauccgccaggacuuccccggcaccaagcucucccucuucggcuccuccaagaacggcuucggcuucaagcaguccgaccucgacgucugcaugaccaucaacggccucgagaccgccgagggccucgacugcguccgcaccaucgaggagcucgcccgcguccuccgcaagcacuccggccuccgcaacauccuccccaucaccaccgccaagguccccaucgucaaguucuuccaccuccgcuccggccucgaggucgacaucucccucuacaacacccucgcccuccacaacacccgccuccucuccgccuacuccgccaucgacccccgcgucaaguaccucugcuacaccaugaaggucuucaccaagaugugcgacaucggcgacgccucccgcggcucccucuccuccuacgccuacacccucaugguccucuacuuccuccagcagcgcaacccccccgucauccccguccuccaggagaucuacaagggcgagaagaagcccgagaucuucgucgacggcuggaacaucuacuucuucgaccagaucgacgagcuccccaccuacugguccgagugcggcaagaacaccgaguccgucggccagcucuggcucggccuccuccgcuucuacaccgaggaguucgacuucaaggagcacgucaucuccauccgccgcaagucccuccucaccaccuucaagaagcaguggaccuccaaguacaucgucaucgaggaccccuucgaccucaaccacaaccucggcgccggccucucccgcaagaugaccaacuucaucaugaaggccuucaucaacggccgccgcgucuucggcauccccgucaagggcuuccccaaggacuaccccuccaagauggaguacuucuucgaccccgacguccucaccgagggcgagcucgcccccaacgaccgcugcugccgcaucugcggcaagaucggccacuucaugaaggacugccccaugcgccgcaagguccgccgccgccgcgaccaggaggacgcccucaaccagcgcuaccccgagaacaaggagaagcgcuccaaggaggacaaggagauccacaacaaguacaccgagcgcgaggucuccaccaaggaggacaagcccauccagugcaccccccagaaggccaagcccaugcgcgccgccgccgaccucggccgcgagaagauccuccgcccccccgucgagaaguggaagcgccaggacgacaaggaccuccgcgagaagcgcugcuucaucugcggccgcgagggccacaucaagaaggagugcccccaguucaagggcuccuccggcucccucuccuccaaguacaugacccagggcaaggccuccgccaagcgcacccagcaggaguccuga

SEQ ID NO: 51950 - RNA, 2124 nt, Artificial Sequence
  derived and/or modified sequence opt2 from ZCCHC8__Homo_sapiens__NP_060082
auggccgccgaggucuacuucggcgaccucgagcucuucgagcccuucgaccaccccgaggaguccauccccaagcccguccacacccgcuucaaggacgacgacggcgacgaggaggacgagaacggcgucggcgacgccgagcuccgcgagcgccuccgccagugcgaggagaccaucgagcagcuccgcgccgagaaccaggagcucaagcgcaagcucaacauccucacccgccccuccggcauccucgucaacgacaccaagcucgacggccccauccuccagauccucuucaugaacaacgccaucuccaagcaguaccaccaggagaucgaggaguucgucuccaaccucgucaagcgcuucgaggagcagcagaagaacgacgucgagaagaccuccuucaaccuccucccccagcccuccuccaucguccucgaggaggaccacaaggucgaggaguccugcgccaucaagaacaacaaggaggccuucuccgucgucggcuccguccucuacuucaccaacuucugccucgacaagcucggccagccccuccucaacgagaacccccagcucuccgagggcugggagauccccaaguaccaccaggucuucucccacaucgucucccucgagggccaggagauccaggucaaggccaagcgccccaagccccacugcuucaacugcggcuccgaggagcaccagaugaaggacugccccaugccccgcaacgccgcccgcaucuccgagaagcgcaaggaguacauggacgccugcggcgaggccaacaaccagaacuuccagcagcgcuaccacgccgaggaggucgaggagcgcuucggccgcuucaagcccggcgucaucuccgaggagcuccaggacgcccucggcgucaccgacaagucccucccccccuucaucuaccgcaugcgccagcucggcuacccccccggcuggcucaaggaggccgagcucgagaacuccggccucgcccucuacgacggcaaggacggcaccgacggcgagaccgaggucggcgagauccagcagaacaaguccgucaccuacgaccucuccaagcucgucaacuaccccggcuucaacaucuccaccccccgcggcauccccgacgaguggcgcaucuucggcuccauccccaugcaggccugccagcagaaggacgucuucgccaacuaccucaccuccaacuuccaggcccccggcgucaaguccggcaacaagcgcuccuccucccacuccucccccggcucccccaagaagcagaagaacgaguccaacuccgccggcucccccgccgacauggagcucgacuccgacauggaggucccccacggcucccaguccuccgaguccuuccaguuccagcccccccucccccccgacacccccccccucccccgcggcacccccccccccgucuucacccccccccuccccaagggcacccccccccucacccccuccgacuccccccagacccgcaccgccuccggcgccgucgacgaggacgcccucacccucgaggagcucgaggagcagcagcgccgcaucugggccgcccucgagcaggccgaguccgucaacuccgacuccgacguccccgucgacaccccccucaccggcaacuccgucgccuccucccccugccccaacgagcucgaccuccccguccccgagggcaagaccuccgagaagcagacccucgacgagcccgagguccccgagaucuucaccaagaaguccgaggccggccacgccuccucccccgacuccgaggucaccucccucugccagaaggagaaggccgagcucgcccccgucaacaccgagggcgcccuccucgacaacggcuccgucguccccaacugcgacaucuccaacggcggcucccagaagcucuuccccgccgacaccucccccuccaccgccaccaagauccacucccccauccccgacauguccaaguucgccaccggcaucacccccuucgaguucgagaacauggccgaguccaccggcauguaccuccgcauccgcucccuccucaagaacuccccccgcaaccagcagaagaacaagaaggccuccgaguga

SEQ ID NO: 51951 - RNA, 654 nt, Artificial Sequence
  derived and/or modified sequence opt2 from ZCRB1__Homo_sapiens__NP_149105
auguccggcggccucgcccccuccaaguccaccgucuacgucuccaaccuccccuucucccucaccaacaacgaccucuaccgcaucuucuccaaguacggcaaggucgucaaggucaccaucaugaaggacaaggacacccgcaaguccaagggcgucgccuucauccucuuccucgacaaggacuccgcccagaacugcacccgcgccaucaacaacaagcagcucuucggccgcgucaucaaggccuccaucgccaucgacaacggccgcgccgccgaguucauccgccgccgcaacuacuucgacaaguccaagugcuacgagugcggcgaguccggccaccucuccuacgccugccccaagaacaugcucggcgagcgcgagccccccaagaagaaggagaagaagaagaagaagaaggcccccgagcccgaggaggagaucgaggaggucgaggaguccgaggacgagggcgaggaccccgcccucgacucccucucccaggccaucgccuuccagcaggccaagaucgaggaggagcagaagaaguggaagcccuccuccggcguccccuccaccuccgacgacucccgccgcccccgcaucaagaaguccaccuacuucuccgacgaggaggagcucuccgacuga

SEQ ID NO: 51952 - RNA, 1575 nt, Artificial Sequence
  derived and/or modified sequence opt2 from ZCWPW1__Homo_sapiens__NP_001244937
augaugaccacccuccagaacaaggaggagugcggcaagggccccaagcgcaucuucgccccccccgcccagaaguccuacucccuccuccccugcucccccaacucccccaaggaggagacccccggcaucuccucccccgagaccgaggcccgcaucucccuccccaaggccucccucaagaagaaggaggagaaggccaccaugaagaacguccccucccgcgagcaggagaagaagcgcaaggcccagaucaacaagcaggccgagaagaaggagaaggagaaguccucccucaccaacgccgaguucgaggagaucguccagaucguccuccagaagucccuccaggagugccucggcaugggcuccggccucgacuucgccgagaccuccugcgcccagcccgucgucuccacccaguccgacaaggagcccggcaucaccgccuccgccaccgacaccgacaacgccaacggcgaggaggucccccacacccaggagaucuccgucuccugggagggcgaggccgcccccgagauccgcaccuccaagcucggccagcccgaccccgcccccuccaagaagaaguccaaccgccucacccucuccaagcgcaagaaggaggcccaggacgagaaggucgagaagacccagggcggccacgagcaccgccaggaggaccgccucaagaagaccguccaggaccacucccagauccgcgaccagcagaagggcgagaucuccggcuucggccagugccucgucuggguccagugcuccuuccccaacugcggcaaguggcgccgccucugcggcaacaucgaccccuccguccuccccgacaacugguccugcgaccagaacaccgacguccaguacaaccgcugcgacauccccgaggagaccuggaccggccucgaguccgacgucgccuacgccuccuacauccccggcuccaucaucugggccaagcaguacggcuaccccugguggcccggcaugaucgaguccgaccccgaccucggcgaguacuuccucuucaccucccaccucgacucccuccccuccaaguaccacgucaccuucuucggcgagaccgucucccgcgccuggauccccgucaacaugcucaagaacuuccaggagcucucccucgagcucuccgucaugaagaagcgccgcaacgacugcucccagaagcucggcgucgcccucaugauggcccaggaggccgagcagaucuccauccaggagcgcgucaaccucuucggcuucuggucccgcuucaacggcuccaacuccaacggcgagcgcaaggaccuccagcucuccggccucaacucccccggcuccugccucgagaagaaggagaaggaggaggagcucgagaaggaggagggcgagaagaccgcccuccgcaagaaccucaagcucccccgcgcccgccccuggcagcccgccuuccagcgcgagaagaagcucgagcagugccagcgcaccugggccuaccagcgcguccgcggccccgccccccaccuccgcaagaagucccccgacaccggcaaccccuga

SEQ ID NO: 51953 - RNA, 7065 nt, Artificial Sequence
  derived and/or modified sequence opt2 from ZDBF2__Homo_sapiens__NP_065974
augcagaagcgccagggcuacugcuccuacugccgcguccaguacaacaaccucgagcagcaccucuucuccgcccagcaccgcucccucacccgccagucccgccgccagaucugcaccuccucccucauggagcgcuuccuccaggacguccuccagcaccaccccuaccacugccaggaguccuccuccacccaggacgagacccacgucaacaccggcuccuccuccgaggucguccaccucgacgacgccuucuccgaggaggaggaggaggacgaggacaaggucgaggacgaggacgccaccgaggagcgccccuccgaggucuccgagcccaucgaggagcuccacucccgcccccacaagucccaggagggcacccaggaggucuccguccgccccuccgucauccagaagcucgagaagggccagcagcagccccucgaguucguccacaagaucggcgccuccguccgcaagugcaaccucgucgacaucggccaggccaccaacaaccgcuccaaccucguccgcccccccgucaucugcaacgcccccgccuccugccuccccgaguccuccaacgaccgccccgucaccgccaacaccaccucccucccccccgccgcccaccucgacuccgucuccaagugcgaccccaacaaggucgagaaguaccucgagcagcccgacggcgccucccgcaaccccguccccuccucccacgucgagaccaccuccuucuccuaccagaagcacaaggaguccaaccgcaagucccuccgcaugaacuccgacaagcucguccucuggaaggacgucaagucccagggcaagacccucuccgccggccucaaguuccacgagcgcaugggcaccaagggcucccuccgcgucaagucccccuccaagcucgccgucaaccccaacaagaccgacaugcccuccaacaagggcaucuucgaggacaccaucgccaagaaccacgaggaguucuucuccaacauggacugcacccaggaggagaagcaccucgucuucaacaagaccgccuucugggagcagaagugcuccgucuccuccgagaugaaguucgacugcaucucccuccaguccgccuccgaccagccccaggagaccgcccaggaccucucccucuggaaggaggagcagaucgaccaggaggacaacuacgagucccgcggcuccgagauguccuucgacugcuccuccuccuuccacucccucaccgaccaguccaaggucuccgccaaggaggucaaccucuccaaggagguccgcaccgacguccaguacaagaacaacaaguccuacgucuccaagaucuccuccgacugcgacgacauccuccaccucgucaccaaccagucccagaugaucgucaaggagaucucccuccagaacgcccgccacaucucccucgucgaccaguccuacgaguccuccuccuccgagaccaacuucgacugcgacgccuccccccaguccaccuccgacuacccccagcaguccgucaccgaggucaaccuccccaaggagguccacaucggccucgucgacaagaacuacggcuccuccuccuccgaggucuccgccgacuccgucuucccccuccaguccgucgucgaccgcccccccgucgccgucaccgagaccaagcuccgcaagaaggcccacaccucccucgucgacaacuacggcuccuccugcuccgagaccuccuucgacugcgacgucucccucgaguccgucgucgaccacccccagcucaccgucaagggccgcaaccucaagggccgccagguccaccucaagcacaagaagcgcaagcccuccuccgccaaggcccaccucgacugcgacgucucccucggcaccgucgccgacgagucccagcgcgccgucgagaagaucaaccuccucaaggagaagaacgccgaccucauggacaugaacugcgagucccacggccccgagaugggcuuccaggccgacgcccagcucgccgaccagucccaggucgccgagaucgagcgccagaaggucgacgucgaccucgagaacaaguccguccaguccucccgcuccucccucuccuccgacucccccgccucccucuaccacuccgcccacgacgagccccaggaggcccucgacgaggucaaccucaaggagcucaacaucgacauggagguccgcuccuacgacugcuccuccuccgagcucaccuucgacuccgaccccccccuccucuccgucaccgagcagucccaccucgacgccgagggcaaggagcgccacaucgaccucgaggacgaguccugcgaguccgacuccuccgagaucaccuucgacuccgacaucccccucuacuccgucaucgaccagcccgaggucgccgucuacgaggaggagaccgucgaccucgaguccaaguccaacgaguccugcgucuccgagaucaccuucgacuccgacaucccccuccacuccggcaacgaccaccccgaggucgccgucaaggaggucauccagaaggaggaguacauccaccucgagcgcaagaacgacgagcccuccggcuccgagaucuccuccgacucccacgccccccuccacuccgucaccaacucccccgaggucgccgucaagaagcucaacccccagaaggaggagcagguccaccucgagaacaaggagaacgagcccaucgacuccgaggucucccucgacuacaacaucaucuuccacuccgucaccggccgcuccgaggaccccaucaaggagaucucccuccacaccaaggagcacauguaccucgagaacaaguccgucuucgagaccucccucgacuccgacgucccccuccaggccgccacccacaagcccgaggucaucgucaaggagaccuggcuccagcgcgagaagcacgccgaguuccagggccgcuccaccgaguucuccggcuccaagaccucccucgacuccggcgucccccacuacuccgucaccgagccccaggucgccgucaacaagaucaaccgcaagaagcaguacguccucgagaacaagaacgacaagugcuccggcuccgagaucauccucgacuccaacguccccccccaguccaugaccgaccagccccagcucgccuuccucaaggagaagcacgucaaccucaaggacaagaacuccaaguccggcgacuccaagaucaccuucgacuccgagcagcuccaggaggccgucaagaagaucgaccaguggaaggaggaggucaucggccucaagaacaagaucaacgagcccuccaccuacaagcucauccaccaccccgacgucuccguccaguccgucgccgaccagcccaaggucgccaucaagcacgucaaccucggcaacgagaaccacauguaccucgaggucaagaacucccaguacuccugcuccgagaugaaccucgacuccggcuuccucggccaguccaucgucaaccgcccccagaucaccauccucgagcaggagcacaucgagcucgagggcaagcacaaccagugcugcggcuccgaggucuccuucgacuccgacgacccccuccaguccgucgccgaccgccuccgcgagaccgucaaggagaucucccucuggaaggacgaggaggucgacaccgaggaccgccgcaacgaggccaagggcuucgagaucauguacgacuccgacguccuccagcccgucgccggccagcccgaggaggucgucaaggaggucucccucuggaaggagcacgucgaccucgagaacaagaucgucaagcccaccgacucccgcaucaacuucgacucccacgagccccuccaguccgucaccaacaagauccccggcgccaacaaggagaucaaccuccuccgcgaggagcacgucugccucgacgacaagggcuacguccccuccgacuccgagaucaucuacgucuccaacaucccccuccaguccgucaucaagcagccccacauccucgaggaggagcacgccucccucgaggacaaguccuccaacuccuacucccccgaggaguccuccgacuccaacgacuccuuccaggccgccgccgacgagcuccagaagcccgucaaggagaucaaccucuggaaggaggaccacaucuaccucgaggacaaguccuacaagcucggcgacuucgacgucuccuacgccucccacauccccguccaguucgucaccgaccaguccuccguccccgucaaggagaucaaccuccagaagaaggaccacaacgaccucgagaacaagaacugcgaggucugcggcuccgagaucaagugccacuccugcguccaccuccaguccgaggucgaccagccccaggucuccuacaaggaggccgaccuccagaaggaggagcacgucgucauggaggagaagaccgaccagcccuccgacuccgagaugauguacgacuccgacguccccuuccagaucgucgucaaccaguuccccggcuccgucaaggagacccaccuccccaaggucguccucgucgaccucguccccggcgacuccgacuacgaggucaucuccgacgacaucccccuccagcucgucaccgaccccccccagcucaccgucaaggacaucuccugcaucaacaccgagugcaucgacaucgaggacaaguccugcgacuucuucggcuccgagguccgcugcaacugcaaggccuccacccccuccaugaccaaccagugcaaggagaccuucaagaucaucaaccgcaagaaggacuacaucauccucggcgagcccuccugccaguccugcggcuccgagaugaacuucaacgucgacgccuccgaccaguccaugaccuacgagucccagggccccgacgagaagauggucaaguacaucgacuccgaggacaaguccugcggcuacaacggcuccaagggcaaguucaaccucgaggacaccucccaccgcaccacccaccgccuccagaaggcccacaaggaggccucccuccgcaaggacccccgcaacgccggccucaagggcaaguccugccaguccuccgccuccgccgucgacuucggcgccuccuccaaguccgcccuccaccgccgcgccgacaagaagaagcgcuccaagcucaagcaccgcgaccucgaggucuccugcgagcccgacggcuucgagaugaacuuccagugcgcccccccccuccccuccgacaccgaccagccccaggagaccgucaagaagcgccaccccugcaagaaggucuccuccgaccucaaggagaagaaccacgacucccaguccuccuccguccucaaggucgacuccguccgcaaccucaagaaggccaaggacgucaucgaggacaaccccgacgagcccguccucgaggcccucccccacgucccccccuccuucgucggcaagaccuggucccagaucaugcgcgaggacgacaucaagaucaacgcccucgucaaggaguuccgcgagggccgcuuccacugcuacuucgacgacgacugcgagaccaagaaggucuccuccaagggcaagaagaaggucaccugggccgaccuccagggcaaggaggacaccgcccccacccaggccgucuccgaguccgacgacaucgucugcggcaucuccgacaucgacgaccucuccgucgcccucgacaagcccugccaccgccacccccccgccgagcgcccccccaagcagaagggccgcgucgccucccagugccagaccgccaagaucucccacuccacccagaccuccugcaagaacuaccccgucaugaagcgcaagaucauccgccaggaggaggacccccccaaguccaagugcucccgccuccaggacgaccgcaagaccaagaagaaggucaagaucggcaccgucgaguuccccgccuccugcaccaagguccucaagcccaugcagcccaaggcccucgucugcguccucuccucccucaacaucaagcucaaggagggcgagggccuccccuuccccaagaugcgccaccacuccugggacaacgacauccgcuucaucugcaaguacaagcgcaacaucuucgacuacuacgagccccucaucaagcagaucgucaucucccccccccucuccgucaucguccccgaguucgagcgccgcaacugggucaagauccacuucaaccgcuccaaccagaacuccuccgccggcgacaacgacgccgacggccagggcuccgccuccgccccccucauggccguccccgcccgcuacggcuucaacucccaccagggcaccuccgacuccucccucuuccucgaggaguccaagguccuccacgcccgcgagcuccccaagaagcgcaacuuccagcucaccuuccucaaccacgacgucgucaagaucucccccaaguccguccgcaacaagcuccucgagucccaguccaagaagaagauccacggcaagcgcgucaccaccuccuccaacaagcucggcuuccccaagaaggucuacaagcccaucauccuccagcagaagccccgcaaggccuccgagaagcaguccaucuggauccgcaccaagcccuccgacaucauccgcaaguacaucuccaaguacuccgucuuccuccgccaccgcuaccagucccgcuccgccuuccucggccgcuaccucaagaagaagaaguccgucgucucccgccucaagaaggccaagcgcaccgccaagguccuccucaacuccuccgucccccccgccggcgccgaggagcucuccuccgccauggccaaccccccccccaagcgccccguccgcgccuccugccgcgucgcccgccgccgcaagaagaccgacgaguccuaccacggccgccagaagggccccuccacccccguccgcgccuacgaccuccgcuccuccuccugccuccagcagcgcgagcgcaugaugacccgccucgccaacaagcuccgcggcaacgaggucaaguga

SEQ ID NO: 51954 - RNA, 1239 nt, Artificial Sequence
  derived and/or modified sequence opt2 from ZDHHC11__Homo_sapiens__NP_079062
auggacacccgcuccggcucccagugcuccgucacccccgaggccauccucaacaacgagaagcucguccuccccccccgcaucucccgcgucaacggcuggucccucccccuccacuacuuccaggucgucaccugggccgucuucgucggccucuccuccgccaccuucggcaucuucauccccuuccucccccacgccuggaaguacaucgccuacgucgucaccggcggcaucuucuccuuccaccucgucguccaccucaucgccuccugcaucgaccccgccgacuccaacguccgccucaugaagaacuacucccagcccaugccccucuucgaccgcuccaagcacgcccacgucauccagaaccaguucugccaccucugcaaggucaccgucaacaagaagaccaagcacugcaucuccugcaacaagugcgucuccggcuucgaccaccacugcaaguggaucaacaacugcgucggcucccgcaacuacugguucuucuucuccaccgucgccuccgccaccgccggcaugcucugccucaucgccauccuccucuacguccucguccaguaccucgucaaccccggcguccuccgcaccgacccccgcuacgaggacgucaagaacaugaacaccuggcuccucuuccucccccucuuccccguccagguccagacccucaucgucgucaucaucggcaugcucguccuccuccucgacuuccucggccucguccaccucggccagcuccucaucuuccacaucuaccucaaggccaagaagaugaccaccuucgaguaccucaucaacaaccgcaaggaggaguccuccaagcaccaggccguccgcaaggaccccuacguccagauggacaagggcguccuccagcagggcgccggcgcccucggcuccuccgcccagggcgucaaggccaaguccucccuccucauccacaagcaccucugccacuucugcaccuccgucaaccaggacggcgacuccaccgcccgcgagggcgacgaggaccccugccccuccgcccucggcgccaaggcccgcaacucccgccucaucugccgccgccucugccaguucuccacccgcguccaccccgacggcggcuccauggcccaggaggccgacgacgcccccuccaucuccacccucggccuccagcaggagaccaccgagcccaugaagaccgacuccgccgaguccgaggacuga

SEQ ID NO: 51955 - RNA, 804 nt, Artificial Sequence
  derived and/or modified sequence opt2 from ZDHHC12__Homo_sapiens__NP_116188
auggcccccugggcccuccucucccccggcguccucguccgcaccggccacaccguccucaccuggggcaucacccucguccucuuccuccacgacaccgagcuccgccagugggaggagcagggcgagcuccuccucccccucaccuuccuccuccucguccucggcucccuccuccucuaccucgccgucucccucauggaccccggcuacgucaacguccagccccagccccaggaggagcucaaggaggagcagaccgccauggucccccccgccaucccccuccgccgcugccgcuacugccucguccuccagccccuccgcgcccgccacugccgcgagugccgccgcugcguccgccgcuacgaccaccacugccccuggauggagaacugcgucggcgagcgcaaccacccccucuucgucgucuaccucgcccuccagcucgucguccuccucuggggccucuaccucgccugguccggccuccgcuucuuccagcccuggggccucuggcuccgcuccuccggccuccucuucgccaccuuccuccuccucucccucuucucccucgucgccucccuccuccucgucucccaccucuaccucgucgccuccaacaccaccaccugggaguucaucuccucccaccgcaucgccuaccuccgccagcgccccuccaaccccuucgaccgcggccucacccgcaaccucgcccacuucuucugcggcuggcccuccggcuccugggagacccucugggccgaggaggaggaggagggcuccucccccgccgucuga

SEQ ID NO: 51956 - RNA, 1479 nt, Artificial Sequence
  derived and/or modified sequence opt2 from ZDHHC13__Homo_sapiens__NP_001001483
auggucauccuccuccuccagcacggcgccgaccccacccucaucgacggcgagggcuucuccuccauccaccucgccguccucuuccagcacaugcccaucaucgccuaccucaucuccaagggccaguccgucaacaugaccgacgucaacggccagaccccccucaugcucuccgcccacaaggucaucggccccgagcccaccggcuuccuccucaaguucaaccccucccucaacgucgucgacaagauccaccagaacaccccccuccacugggccgucgccgccggcaacgucaacgccgucgacaagcuccucgaggccggcuccucccucgacauccagaacgucaagggcgagaccccccucgacauggcccuccagaacaagaaccagcucaucauccacaugcucaagaccgaggccaagaugcgcgccaaccagaaguuccgccucuggcgcuggcuccagaagugcgagcucuuccuccuccucaugcucuccgucaucaccaugugggccaucggcuacauccucgacuucaacuccgacuccuggcuccucaagggcugccuccucgucacccucuucuuccucaccucccucuucccccgcuuccucgucggcuacaagaaccucgucuaccuccccaccgccuuccuccucuccuccgucuucuggaucuucaugaccugguucauccucuucuuccccgaccucgccggcgcccccuucuacuucuccuucaucuucuccaucgucgccuuccucuacuucuucuacaagaccugggccaccgaccccggcuucaccaaggccuccgaggaggagaagaaggucaacaucaucacccucgccgagaccggcucccucgacuuccgcaccuucugcaccuccugccucauccgcaagccccuccgcucccuccacugccacgucugcaacugcugcgucgcccgcuacgaccagcacugccucuggaccggccgcugcaucggcuucggcaaccaccacuacuacaucuucuuccucuucuuccucuccauggucugcggcuggaucaucuacggcuccuucaucuaccucuccucccacugcgccaccaccuucaaggaggacggccucuggaccuaccucaaccagaucgucgccugcucccccuggguccucuacauccucaugcucgccaccuuccacuucuccugguccaccuuccuccuccucaaccagcucuuccagaucgccuuccucggccucaccucccacgagcgcaucucccuccagaagcaguccaagcacaugaagcagacccucucccuccgcaagacccccuacaaccucggcuucaugcagaaccucgccgacuucuuccagugcggcugcuucggccucgucaagcccugcgucgucgacuggaccucccaguacaccauggucuuccaccccgcccgcgagaagguccuccgcuccgucuga

SEQ ID NO: 51957 - RNA, 1467 nt, Artificial Sequence
  derived and/or modified sequence opt2 from ZDHHC14__Homo_sapiens__NP_078906
augccccccggcggcggcggccccaugaaggacugcgaguacucccagaucuccacccacuccuccucccccauggaguccccccacaagaagaagaagaucgccgcccgccgcaagugggaggucuuccccggccgcaacaaguucuucugcaacggccgcaucaugauggcccgccagaccggcgucuucuaccucacccucguccucauccucgucaccuccggccucuucuucgccuucgacugccccuaccucgccgucaagaucacccccgccauccccgccgucgccggcauccucuucuucuucgucaugggcacccuccuccgcaccuccuucuccgaccccggcguccucccccgcgccacccccgacgaggccgccgaccucgagcgccagaucgacaucgccaacggcaccuccuccggcggcuaccgcccccccccccgcaccaaggaggucaucaucaacggccagaccgucaagcucaaguacugcuucaccugcaagaucuuccgccccccccgcgccucccacugcucccucugcgacaacugcgucgagcgcuucgaccaccacugccccugggucggcaacugcgucggcaagcgcaacuaccgcuucuucuacauguucauccucucccucuccuuccucaccgucuucaucuucgccuucgucaucacccacgucauccuccgcucccagcagaccggcuuccucaacgcccucaaggacucccccgccuccguccucgaggccgucgucugcuucuucuccgucugguccaucgucggccucuccggcuuccacaccuaccucaucuccuccaaccagaccaccaacgaggacaucaagggcuccugguccaacaagcgcggcaaggagaacuacaaccccuacuccuacggcaacaucuucaccaacugcugcgucgcccucugcggccccaucucccccucccucaucgaccgccgcggcuacauccagcccgacaccccccagcccgccgcccccuccaacggcaucaccauguacggcgccacccagucccaguccgacaugugcgaccaggaccagugcauccaguccaccaaguucguccuccaggccgccgccaccccccuccuccaguccgagcccucccucaccuccgacgagcuccaccuccccggcaagcccggccucggcacccccugcgccucccucacccucggcccccccaccccccccgccuccaugcccaaccucgccgaggccacccucgccgacgucaugccccgcaaggacgagcacaugggccaccaguuccucacccccgacgaggcccccucccccccccgccuccucgccgccggcuccccccucgcccacucccgcaccaugcacguccucggccucgccucccaggacucccuccacgaggacuccguccgcggccucgucaagcucuccuccgucuga

SEQ ID NO: 51958 - RNA, 987 nt, Artificial Sequence
  derived and/or modified sequence opt2 from ZDHHC15__Homo_sapiens__NP_001139728
augcgccgcggcuggaagauggcccucuccggcggccuccgcugcugccgccgcguccucuccuggguccccguccucgucaucguccucgucguccucugguccuacuacgccuacgucuucgagcucugccucgucaucuaccucauccucuaccacgccaucuucgucuucuucaccuggaccuacuggaaguccaucuucacccucccccagcagcccaaccagaaguuccaccucuccuacaccgacaaggagcgcuacgagaacgaggagcgccccgagguccagaagcagaugcucgucgacauggccaagaagcuccccgucuacacccgcaccggcuccggcgccguccgcuucugcgaccgcugccaccucaucaagcccgaccgcugccaccacugcuccgucugcgccaugugcguccucaagauggaccaccacugccccugggucaacaacugcaucggcuucuccaacuacaaguucuuccuccaguuccucgccuacuccguccucuacugccucuacaucgccaccaccgucuucuccuacuucaucaaguacuggcgcggcgagcuccccuccguccgcuccaaguuccacguccucuuccuccucuucgucgccugcauguucuucgucucccucgucauccucuucggcuaccacugcuggcucgucucccgcaacaagaccacccucgaggccuucugcacccccgucuucaccuccggccccgagaagaacggcuucaaccucggcuucaucaagaacauccagcaggucuucggcgacaagaagaaguucuggcucauccccaucggcuccucccccggcgacggccacuccuuccccaugcgcuccaugaacgagucccagaacccccuccucgccaacgaggagaccugggaggacaacgaggacgacaaccaggacuaccccgagggcuccuccucccucgccgucgagaccgagaccuga

SEQ ID NO: 51959 - RNA, 1899 nt, Artificial Sequence
  derived and/or modified sequence opt2 from ZDHHC17__Homo_sapiens__NP_056151
augcagcgcgaggagggcuucaacaccaagauggccgacggccccgacgaguacgacaccgaggccggcugcgucccccuccuccaccccgaggagaucaagccccagucccacuacaaccacggcuacggcgagccccucggccgcaagacccacaucgacgacuacuccaccugggacaucgucaaggccacccaguacggcaucuacgagcgcugccgcgagcucgucgaggccggcuacgacguccgccagcccgacaaggagaacgucacccuccuccacugggccgccaucaacaaccgcaucgaccucgucaaguacuacaucuccaagggcgccaucgucgaccagcucggcggcgaccucaacuccaccccccuccacugggccacccgccagggccaccucuccauggucguccagcucaugaaguacggcgccgaccccucccucaucgacggcgagggcugcuccugcauccaccucgccgcccaguucggccacaccuccaucgucgccuaccucaucgccaagggccaggacgucgacaugauggaccagaacggcaugaccccccucaugugggccgccuaccgcacccacuccgucgaccccacccgccuccuccucaccuucaacgucuccgucaaccucggcgacaaguaccacaagaacaccgcccuccacugggccguccucgccggcaacaccaccgucaucucccuccuccucgaggccggcgccaacgucgacgcccagaacaucaagggcgaguccgcccucgaccucgccaagcagcgcaagaacgucuggaugaucaaccaccuccaggaggcccgccaggccaagggcuacgacaaccccuccuuccuccgcaagcucaaggccgacaaggaguuccgccagaaggucaugcucggcacccccuuccucgucaucuggcucgucggcuucaucgccgaccucaacaucgacuccuggcucaucaagggccucauguacggcggcgucugggccaccguccaguuccucuccaaguccuucuucgaccacuccaugcacuccgcccucccccucggcaucuaccucgccaccaaguucuggauguacgucaccugguucuucugguucuggaacgaccucaacuuccucuucauccaccuccccuuccucgccaacuccgucgcccucuucuacaacuucggcaaguccuggaaguccgaccccggcaucaucaaggccaccgaggagcagaagaagaagaccaucgucgagcucgccgagaccggcucccucgaccucuccaucuucugcuccaccugccucauccgcaagcccguccgcuccaagcacugcggcgucugcaaccgcugcaucgccaaguucgaccaccacugccccugggucggcaacugcgucggcgccggcaaccaccgcuacuucaugggcuaccucuucuuccuccucuucaugaucugcuggaugaucuacggcugcaucuccuacuggggccuccacugcgagaccaccuacaccaaggacggcuucuggaccuacaucacccagaucgccaccugcucccccuggauguucuggauguuccucaacuccgucuuccacuucaugugggucgccguccuccucaugugccagauguaccagaucuccugccucggcaucaccaccaacgagcgcaugaacgcccgccgcuacaagcacuucaaggucaccaccaccuccaucgagucccccuucaaccacggcugcguccgcaacaucaucgacuucuucgaguuccgcugcugcggccucuuccgccccgucaucgucgacuggacccgccaguacaccaucgaguacgaccagaucuccggcuccggcuaccagcucgucuga

SEQ ID NO: 51960 - RNA, 1458 nt, Artificial Sequence
  derived and/or modified sequence opt2 from ZDHHC1__Homo_sapiens__NP_037436
auguacaagaugaacaucugcaacaagcccuccaacaagaccgcccccgagaaguccgucuggaccgcccccgcccagcccuccggccccucccccgagcuccagggccagcgcucccgccgcaacggcugguccuggcccccccacccccuccagaucgucgccuggcuccucuaccucuucuucgccgucaucggcuucggcauccucgucccccuccucccccaccacuggguccccgccggcuacgccugcaugggcgccaucuucgccggccaccucgucguccaccucaccgccgucuccaucgaccccgccgacgccaacguccgcgacaaguccuacgccggcccccuccccaucuucaaccgcucccagcacgcccacgucaucgaggaccuccacugcaaccucugcaacgucgacgucuccgcccgcuccaagcacugcuccgccugcaacaagugcgucugcggcuucgaccaccacugcaaguggcucaacaacugcgucggcgagcgcaacuaccgccucuuccuccacuccgucgccuccgcccuccucggcguccuccuccucguccucgucgccaccuacgucuucgucgaguucuucgucaaccccaugcgccuccgcaccaaccgccacuucgagguccucaagaaccacaccgacgucugguucgucuuccuccccgccgcccccgucgagacccaggcccccgccauccucgcccucgccgcccuccucauccuccucggccuccucuccaccgcccuccucggccaccuccucugcuuccacaucuaccucauguggcacaagcucaccaccuacgaguacaucguccagcaccgccccccccaggaggccaagggcguccaccgcgagcucgaguccugcccccccaagaugcgccccauccaggagauggaguucuacaugcgcaccuuccgccacaugcgccccgagccccccggccaggccggccccgccgccgucaacgccaagcacucccgccccgccucccccgaccccacccccggccgccgcgacugcgccggcccccccguccaggucgagugggaccgcaagaagccccuccccuggcgcuccccccuccuccuccucgccauguggggcccccaggccccccccugccucugccgcaagcgcggccgcggcgccugcaucaagugcgagcgccuccgcccccgcauccgccgccgcggccucggcccccccgccgccgcccccgcccgccgccgcaucccccgcacccccgcccucugcaccccccucgcccuccccgcccccaccacccgccgccgccagucccccuggacccgcuuccaguggcgccgccgcgccugggccgccccccucuggcccccccgcggcgccggcgccgacuccccccgcuggcgcggccgccgcguccgcccccccuucuccuga

SEQ ID NO: 51961 - RNA, 1104 nt, Artificial Sequence
  derived and/or modified sequence opt2 from ZDHHC2__Homo_sapiens__NP_057437
auggcccccuccggccccggcuccuccgcccgccgccgcugccgccgcguccucuacuggauccccgucgucuucaucacccuccuccucggcugguccuacuacgccuacgccauccagcucugcaucgucuccauggagaacaccggcgagcaggucgucugccucauggccuaccaccuccucuucgccauguucgucugguccuacuggaagaccaucuucacccuccccaugaaccccuccaaggaguuccaccucuccuacgccgagaaggaccuccucgagcgcgagccccgcggcgaggcccaccaggagguccuccgccgcgccgccaaggaccuccccaucuacacccgcaccauguccggcgccauccgcuacugcgaccgcugccagcucaucaagcccgaccgcugccaccacugcuccgucugcgacaagugcauccucaagauggaccaccacugccccugggucaacaacugcgucggcuucuccaacuacaaguucuuccuccucuuccucgccuacucccuccucuacugccucuucaucgccgccaccgaccuccaguacuucaucaaguucuggaccaacggccuccccgacacccaggccaaguuccacaucauguuccucuucuucgccgccgccauguucuccgucucccucuccucccucuucggcuaccacugcuggcucgucuccaagaacaaguccacccucgaggccuuccgcucccccgucuuccgccacggcaccgacaagaacggcuucucccucggcuucuccaagaacaugcgccaggucuucggcgacgagaagaaguacuggcuccuccccaucuucuccucccucggcgacggcugcuccuuccccaccugccucgucaaccaggaccccgagcaggccuccacccccgccggccucaacuccaccgccaagaaccucgagaaccaccaguuccccgccaagccccuccgcgagucccagucccaccuccucaccgacucccaguccuggaccgaguccuccaucaaccccggcaagugcaaggccggcauguccaaccccgcccucaccauggagaacgagaccuga

SEQ ID NO: 51962 - RNA, 1038 nt, Artificial Sequence
  derived and/or modified sequence opt2 from ZDHHC7__Homo_sapiens__NP_001139020
augcagcccuccggccaccgccuccgcgacgucgagcaccacccccuccucgccgagaacgacaacuacgacuccuccuccuccuccuccuccgaggccgacgucgccgaccgcgucugguucauccgcgacggcugcggcaugaucugcgccgucaugaccuggcuccucgucgccuacgccgacuucgucgucaccuucgucaugcuccuccccuccaaggacuucugguacuccgucgucaacggcgucaucuucaacugccucgccguccucgcccucuccucccaccuccgcaccaugcucaccgaccccgagaaguccuccgacugccgccccuccgccugcaccgucaagaccggccucgaccccacccucgucggcaucugcggcgagggcaccgaguccguccagucccuccuccucggcgccguccccaagggcaacgccaccaaggaguacauggagucccuccagcucaagcccggcgaggucaucuacaagugccccaagugcugcugcaucaagcccgagcgcgcccaccacugcuccaucugcaagcgcugcauccgcaagauggaccaccacugccccugggucaacaacugcgucggcgagaagaaccagcgcuucuucguccucuucaccauguacaucgcccucuccuccguccacgcccucauccucugcggcuuccaguucaucuccugcguccgcggccaguggaccgagugcuccgacuucuccccccccaucaccgucauccuccucaucuuccucugccucgagggccuccucuucuucaccuucaccgccgucauguucggcacccagauccacuccaucugcaacgacgagaccgagaucgagcgccucaaguccgagaagcccaccugggagcgccgccuccgcugggagggcaugaaguccgucuucggcggcccccccucccuccucuggaugaaccccuucgucggcuuccgcuuccgccgccuccccacccgcccccgcaagggcggccccgaguucuccgucuga

SEQ ID NO: 51963 - RNA, 2298 nt, Artificial Sequence
  derived and/or modified sequence opt2 from ZDHHC8__Homo_sapiens__NP_037505
augccccgcucccccggcacccgccucaagcccgccaaguacauccccgucgccaccgccgccgcccuccucgucggcuccuccacccucuucuucgucuucaccugccccuggcucacccgcgccgucucccccgccguccccgucuacaacggcaucaucuuccucuucguccucgccaacuucuccauggccaccuucauggaccccggcgucuucccccgcgccgacgaggacgaggacaaggaggacgacuuccgcgccccccucuacaagaacgucgacguccgcggcauccagguccgcaugaaguggugcgccaccugccacuucuaccgccccccccgcugcucccacugcuccgucugcgacaacugcgucgaggacuucgaccaccacugccccugggucaacaacugcaucggccgccgcaacuaccgcuacuucuuccucuuccuccucucccucuccgcccacauggucggcgucgucgccuucggccucgucuacguccucaaccacgccgagggccucggcgccgcccacaccaccaucaccauggccgucaugugcgucgccggccucuucuucauccccgucaucggccucaccggcuuccacgucguccucgucacccgcggccgcaccaccaacgagcaggucaccggcaaguuccgcggcggcgucaaccccuucacccgcggcugcugcggcaacgucgagcacguccucugcuccccccucgccccccgcuacgucgucgagcccccccgccucccccucgccgucucccucaagccccccuuccuccgccccgagcuccucgaccgcgccgccccccucaaggucaagcucuccgacaacggccucaaggccggccucggccgcuccaaguccaagggcucccucgaccgccucgacgagaagccccucgaccucggccccccccucccccccaagaucgaggccggcaccuucuccuccgaccuccagaccccccgccccggcuccgccgaguccgcccucuccguccagcgcaccuccccccccacccccgccauguacaaguuccgccccgccuuccccaccggccccaagguccccuucugcggccccggcgagcagguccccggccccgacucccucacccucggcgacgacuccauccgcucccucgacuucgucuccgagcccucccucgaccuccccgacuacggccccggcggccuccacgccgccuacccccccucccccccccucuccgccuccgacgccuucuccggcgcccuccgcucccucucccucaaggccuccucccgccgcggcggcgaccacgucgcccuccagccccuccgcuccgagggcggcccccccaccccccaccgcuccaucuucgccccccacgcccuccccaaccgcaacggcucccucuccuacgacucccuccucaaccccggcucccccggcggccacgccugccccgcccaccccgccgucggcgucgccggcuaccacucccccuaccuccaccccggcgccaccggcgaccccccccgcccccucccccgcuccuucucccccguccucggcccccgcccccgcgagcccucccccguccgcuacgacaaccucucccgcaccaucauggccuccauccaggagcgcaaggaccgcgaggagcgcgagcgccuccuccgcucccaggccgacucccucuucggcgacuccggcgucuacgacgcccccuccuccuacucccuccagcaggccuccguccucuccgagggcccccgcggccccgcccuccgcuacggcucccgcgacgaccucgucgccggccccggcuucggcggcgcccgcaaccccgcccuccagaccucccucuccucccucuccuccuccgucucccgcgccccccgcaccuccuccuccucccuccaggccgaccaggccuccuccaacgcccccggcccccgccccuccuccggcucccaccgcucccccgcccgccagggccuccccuccccccccggcaccccccacucccccuccuacgccggccccaaggccgucgccuucauccacaccgaccuccccgagcccccccccucccucaccguccagcgcgaccacccccagcucaagaccccccccuccaagcucaacggccagucccccggccucgcccgccucggccccgccaccggcccccccggccccuccgccucccccacccgccacacccucgucaagaaggucuccggcgucggcggcaccaccuacgagaucuccgucuga

SEQ ID NO: 51964 - RNA, 1095 nt, Artificial Sequence
  derived and/or modified sequence opt2 from ZDHHC9__Homo_sapiens__NP_001008223
auguccgucauggucguccgcaagaaggucacccgcaagugggagaagcuccccggccgcaacaccuucugcugcgacggccgcgucaugauggcccgccagaagggcaucuucuaccucacccucuuccucauccucggcaccugcacccucuucuucgccuucgagugccgcuaccucgccguccagcucucccccgccauccccgucuucgccgccaugcucuuccucuucuccauggccacccuccuccgcaccuccuucuccgaccccggcgucaucccccgcgcccuccccgacgaggccgccuucaucgagauggagaucgaggccaccaacggcgccgucccccagggccagcgcccccccccccgcaucaagaacuuccagaucaacaaccagaucgucaagcucaaguacugcuacaccugcaagaucuuccgccccccccgcgccucccacugcuccaucugcgacaacugcgucgagcgcuucgaccaccacugccccugggucggcaacugcgucggcaagcgcaacuaccgcuacuucuaccucuucauccucucccucucccuccucaccaucuacgucuucgccuucaacaucgucuacgucgcccucaagucccucaagaucggcuuccucgagacccucaaggagacccccggcaccguccucgagguccucaucugcuucuucacccucugguccgucgucggccucaccggcuuccacaccuuccucgucgcccucaaccagaccaccaacgaggacaucaagggcuccuggaccggcaagaaccgcguccagaaccccuacucccacggcaacaucgucaagaacugcugcgagguccucugcggcccccucccccccuccguccucgaccgccgcggcauccucccccucgaggaguccggcucccgcccccccuccacccaggagaccuccuccucccuccucccccagucccccgcccccaccgagcaccucaacuccaacgagaugcccgaggacuccuccacccccgaggagaugcccccccccgagccccccgagcccccccaggaggccgccgaggccgagaaguga

SEQ ID NO: 51965 - RNA, 3327 nt, Artificial Sequence
  derived and/or modified sequence opt2 from ZEB1__Homo_sapiens__NP_001121600
augaaggucaccaacuacaacaccgucgucgagaccaacuccgacuccgacgacgaggacaagcuccacaucgucgaggaggaguccgucaccgacgccgccgacugcgagggcguccccgaggacgaccuccccaccgaccagaccguccuccccggccgcuccuccgagcgcgagggcaacgccaagaacugcugggaggacgacaccggcaaggagggccaggagauccucggccccgaggcccaggccgacgaggccggcugcaccgucaaggacgacgagugcgaguccgacgccgagaacgagcagaaccacgaccccaacgucgaggaguuccuccagcagcaggacaccgccgucaucuuccccgaggcccccgaggaggaccagcgccagggcacccccgaggccuccggccacgacgagaacggcacccccgacgccuucucccagcuccucaccugccccuacugcgaccgcggcuacaagcgcuucaccucccucaaggagcacaucaaguaccgccacgagaagaacgaggacaacuucuccugcucccucugcuccuacaccuucgccuaccgcacccagcucgagcgccacaugaccucccacaaguccggccgcgaccagcgccacgucacccaguccggcugcaaccgcaaguucaagugcaccgagugcggcaaggccuucaaguacaagcaccaccucaaggagcaccuccgcauccacuccggcgagaagcccuacgagugccccaacugcaagaagcgcuucucccacuccggcuccuacuccucccacaucuccuccaagaagugcaucucccucauccccgucaacggccgcccccgcaccggccucaagaccucccagugcuccucccccucccucuccgccucccccggcucccccacccgcccccagauccgccagaagaucgagaacaagccccuccaggagcagcucuccgucaaccagaucaagaccgagcccgucgacuacgaguucaagcccaucgucgucgccuccggcaucaacugcuccaccccccuccagaacggcgucuucaccggcggcggcccccuccaggccaccuccuccccccagggcaugguccaggccgucguccuccccaccgucggccucgucucccccaucuccaucaaccucuccgacauccagaacguccucaaggucgccgucgacggcaacgucauccgccagguccucgagaacaaccaggccaaccucgccuccaaggagcaggagaccaucaacgccucccccauccagcagggcggccacuccgucaucuccgccaucucccucccccucgucgaccaggacggcaccaccaagaucaucaucaacuacucccucgagcagcccucccagcuccaggucgucccccagaaccucaagaaggagaaccccgucgccaccaacuccugcaaguccgagaagcuccccgaggaccucaccgucaaguccgagaaggacaaguccuucgagggcggcgucaacgacuccaccugccuccucugcgacgacugccccggcgacaucaacgcccuccccgagcucaagcacuacgaccucaagcagcccacccagccccccccccuccccgccgccgaggccgagaagcccgaguccuccgucuccuccgccaccggcgacggcaaccucucccccucccagcccccccucaagaaccuccucucccuccucaaggccuacuacgcccucaacgcccagcccuccgccgaggagcucuccaagaucgccgacuccgucaaccucccccucgacgucgucaagaagugguucgagaagaugcaggccggccagaucuccguccaguccuccgagcccuccucccccgagcccggcaaggucaacauccccgccaagaacaacgaccagccccaguccgccaacgccaacgagccccaggacuccaccgucaaccuccaguccccccucaagaugaccaacucccccguccuccccgucggcuccaccaccaacggcucccgcuccuccacccccucccccuccccccucaaccucuccuccucccgcaacacccagggcuaccucuacaccgccgagggcgcccaggaggagccccaggucgagccccucgaccucucccuccccaagcagcagggcgagcuccucgagcgcuccaccaucaccuccgucuaccagaacuccgucuacuccguccaggaggagccccucaaccucuccugcgccaagaaggagccccagaaggacuccugcgucaccgacuccgagcccgucgucaacgucaucccccccuccgccaaccccaucaacaucgccauccccaccgucaccgcccagcuccccaccaucgucgccaucgccgaccagaacuccguccccugccuccgcgcccucgccgccaacaagcagaccauccucaucccccaggucgccuacaccuacuccaccaccgucucccccgccguccaggagcccccccucaaggucauccagcccaacggcaaccaggacgagcgccaggacaccuccuccgagggcgucuccaacgucgaggaccagaacgacuccgacuccaccccccccaagaagaagaugcgcaagaccgagaacggcauguacgccugcgaccucugcgacaagaucuuccagaaguccuccucccuccuccgccacaaguacgagcacaccggcaagcgcccccacgagugcggcaucugcaagaaggccuucaagcacaagcaccaccucaucgagcacaugcgccuccacuccggcgagaagcccuaccagugcgacaagugcggcaagcgcuucucccacuccggcuccuacucccagcacaugaaccaccgcuacuccuacugcaagcgcgaggccgaggagcgcgacuccaccgagcaggaggaggccggccccgagauccucuccaacgagcacgucggcgcccgcgccucccccucccagggcgacuccgacgagcgcgagucccucacccgcgaggaggacgaggacuccgagaaggaggaggaggaggaggacaaggagauggaggagcuccaggaggagaaggagugcgagaagccccagggcgacgaggaggaggaggaggaggaggaggaggucgaggaggaggaggucgaggaggccgagaacgagggcgaggaggccaagaccgagggccucaugaaggacgaccgcgccgagucccaggccuccucccucggccagaaggucggcgaguccuccgagcaggucuccgaggagaagaccaacgaggccuga

SEQ ID NO: 51966 - RNA, 3573 nt, Artificial Sequence
  derived and/or modified sequence opt2 from ZEB2__Homo_sapiens__NP_001165124
augaagcagcccaucauggccgacggcccccgcugcaagcgccgcaagcaggccaacccccgccgcaagaacgucgucaacuacgacaacgucgucgacaccggcuccgagaccgacgaggaggacaagcuccacaucgccgaggacgacggcaucgccaacccccucgaccaggagaccucccccgccuccguccccaaccacgaguccuccccccacgucucccaggcccuccucccccgcgaggaggaggaggacgagauccgcgagggcggcgucgagcaccccuggcacaacaacgagauccuccaggccuccgucgacggccccgucaagaacgccaacugcaccuccgacuucgaggaguacuucgccaagcgcaagcucgaggagcgcgacggccacgccgucuccaucgaggaguaccuccagcgcuccgacaccgccaucaucuaccccgaggcccccgaggagcucucccgccucggcacccccgaggccaacggccaggaggagaacgaccucccccccggcacccccgacgccuucgcccagcuccucaccugccccuacugcgaccgcggcuacaagcgccucaccucccucaaggagcacaucaaguaccgccacgagaagaacgaggagaacuucuccugcccccucugcuccuacaccuucgccuaccgcacccagcucgagcgccacauggucacccacaagcccggcaccgaccagcaccagaugcucacccagggcgccggcaaccgcaaguucaagugcaccgagugcggcaaggccuucaaguacaagcaccaccucaaggagcaccuccgcauccacuccggcgagaagcccuacgagugccccaacugcaagaagcgcuucucccacuccggcuccuacuccucccacaucuccuccaagaagugcaucggccucaucuccgucaacggccgcaugcgcaacaacaucaagaccggcuccucccccaacuccgucuccuccucccccaccaacuccgccaucacccagcuccgcaacaagcucgagaacggcaagccccucuccauguccgagcagaccggccuccucaagaucaagaccgagccccucgacuucaacgacuacaagguccucauggccacccacggcuucuccggcaccucccccuucaugaacggcggccucggcgccaccuccccccucggcguccaccccuccgcccagucccccaugcagcaccucggcgucggcauggaggccccccuccucggcuuccccaccaugaacuccaaccucuccgagguccagaagguccuccagaucgucgacaacaccgucucccgccagaagauggacugcaaggccgaggagaucuccaagcucaagggcuaccacaugaaggaccccugcucccagcccgaggagcagggcgucaccucccccaacaucccccccgucggccuccccgucgucucccacaacggcgccaccaaguccaucaucgacuacacccucgagaaggucaacgaggccaaggccugccuccagucccucaccaccgacucccgccgccagaucuccaacaucaagaaggagaagcuccgcacccucaucgaccucgucaccgacgacaagaugaucgagaaccacaacaucuccacccccuucuccugccaguucugcaaggaguccuuccccggccccaucccccuccaccagcacgagcgcuaccucugcaagaugaacgaggagaucaaggccguccuccagccccacgagaacaucguccccaacaaggccggcgucuucgucgacaacaaggcccuccuccucuccuccguccucuccgagaagggcaugaccucccccaucaaccccuacaaggaccacauguccguccucaaggccuacuacgccaugaacauggagcccaacuccgacgagcuccucaagaucuccaucgccgucggccucccccaggaguucgucaaggagugguucgagcagcgcaaggucuaccaguacuccaacucccgcucccccucccucgagcgcuccuccaagccccucgcccccaacuccaacccccccaccaaggacucccuccucccccgcucccccgucaagcccauggacuccaucaccucccccuccaucgccgagcuccacaacuccgucaccaacugcgaccccccccuccgccucaccaagcccucccacuucaccaacaucaagcccgucgagaagcucgaccacucccgcuccaacacccccuccccccucaaccucuccuccaccuccuccaagaacucccacuccuccuccuacacccccaacuccuucuccuccgaggagcuccaggccgagccccucgaccucucccuccccaagcagaugaaggagcccaaguccaucaucgccaccaagaacaagaccaaggccuccuccaucucccucgaccacaacuccgucuccuccuccuccgagaacuccgacgagccccucaaccucaccuucaucaagaaggaguucuccaacuccaacaaccucgacaacaaguccaccaaccccgucuucuccaugaaccccuucuccgccaagccccucuacaccgcccuccccccccaguccgccuucccccccgccaccuucaugccccccguccagaccuccauccccggccuccgccccuaccccggccucgaccagauguccuuccucccccacauggccuacaccuaccccaccggcgccgccaccuucgccgacaugcagcagcgccgcaaguaccagcgcaagcagggcuuccagggcgagcuccucgacggcgcccaggacuacauguccggccucgacgacaugaccgacuccgacuccugccucucccgcaagaagaucaagaagaccgaguccggcauguacgccugcgaccucugcgacaagaccuuccagaaguccuccucccuccuccgccacaaguacgagcacaccggcaagcgcccccaccagugccagaucugcaagaaggccuucaagcacaagcaccaccucaucgagcacucccgccuccacuccggcgagaagcccuaccagugcgacaagugcggcaagcgcuucucccacuccggcuccuacucccagcacaugaaccaccgcuacuccuacugcaagcgcgaggccgaggagcgcgaggccgccgagcgcgaggcccgcgagaagggccaccucgagcccaccgagcuccucaugaaccgcgccuaccuccaguccaucaccccccagggcuacuccgacuccgaggagcgcgaguccaugccccgcgacggcgaguccgagaaggagcacgagaaggagggcgaggacggcuacggcaagcucggccgccaggacggcgacgaggaguucgaggaggaggaggaggaguccgagaacaaguccauggacaccgaccccgagaccauccgcgacgaggaggagaccggcgaccacuccauggacgacuccuccgaggacggcaagauggagaccaaguccgaccacgaggaggacaacauggaggacggcauguga

SEQ ID NO: 51967 - RNA, 684 nt, Artificial Sequence
  derived and/or modified sequence opt2 from ZFAND3__Homo_sapiens__NP_068762
augggcgacgccggcuccgagcgcuccaaggcccccucccuccccccccgcugccccugcggcuucuggggcuccuccaagaccaugaaccucugcuccaagugcuucgccgacuuccagaagaagcagcccgacgacgacuccgcccccuccaccuccaacucccaguccgaccucuucuccgaggagaccaccuccgacaacaacaacaccuccaucaccacccccacccucucccccucccagcagccccuccccaccgagcucaacgucaccucccccuccaaggaggagugcggccccugcaccgacaccgcccacgucucccucaucacccccaccaagcgcuccugcggcaccgacucccaguccgagaacgaggccucccccgucaagcgcccccgccuccucgagaacaccgagcgcuccgaggagaccucccgcuccaagcagaagucccgccgccgcugcuuccagugccagaccaagcucgagcucguccagcaggagcucggcuccugccgcugcggcuacgucuucugcaugcuccaccgccuccccgagcagcacgacugcaccuucgaccacaugggccgcggccgcgaggaggccaucaugaagauggucaagcucgaccgcaaggucggccgcuccugccagcgcaucggcgagggcugcuccuga

SEQ ID NO: 51968 - RNA, 642 nt, Artificial Sequence
  derived and/or modified sequence opt2 from ZFAND5__Homo_sapiens__NP_001095891
auggcccaggagaccaaccagacccccggccccaugcucugcuccaccggcugcggcuucuacggcaacccccgcaccaacggcaugugcuccgucugcuacaaggagcaccuccagcgccagcagaacuccggccgcaugucccccaugggcaccgccuccggcuccaacucccccaccuccgacuccgccuccguccagcgcgccgacaccucccucaacaacugcgagggcgccgccggcuccaccuccgagaagucccgcaacguccccgucgccgcccuccccgucacccagcagaugaccgagauguccaucucccgcgaggacaagaucaccacccccaagaccgaggucuccgagcccgucgucacccagcccucccccuccgucucccagcccuccaccucccaguccgaggagaaggcccccgagcuccccaagcccaagaagaaccgcugcuucaugugccgcaagaaggucggccucaccggcuucgacugccgcugcggcaaccucuucugcggccuccaccgcuacuccgacaagcacaacugccccuacgacuacaaggccgaggccgccgccaagauccgcaaggagaaccccgucgucgucgccgagaagauccagcgcaucuga

SEQ ID NO: 51969 - RNA, 591 nt, Artificial Sequence
  derived and/or modified sequence opt2 from ZFAND6__Homo_sapiens__NP_001229846
auggcccaggagaccaaccacucccagguccccaugcucugcuccaccggcugcggcuucuacggcaacccccgcaccaacggcaugugcuccgucugcuacaaggagcaccuccagcgccagaacuccuccaacggccgcaucuccccccccguccagugcaccgacggcuccguccccgaggcccaguccgcccucgacuccaccuccuccuccaugcagcccucccccgucuccaaccagucccuccucuccgaguccgucgccuccucccagcucgacuccaccuccgucgacaaggccguccccgagaccgaggacguccaggccuccgucuccgacaccgcccagcagcccuccgaggagcaguccaagucccucgagaagcccaagcagaagaagaaccgcugcuucaugugccgcaagaaggucggccucaccggcuucgagugccgcugcggcaacgucuacugcggcguccaccgcuacuccgacguccacaacugcuccuacaacuacaaggccgacgccgccgagaagauccgcaaggagaaccccgucgucgucggcgagaagauccagaagaucuga

SEQ ID NO: 51970 - RNA, 3696 nt, Artificial Sequence
  derived and/or modified sequence opt2 from ZFAT__Homo_sapiens__NP_001025110
augugcaagugcugcaaccucuucucccccaaccaguccgagcuccucucccacgucuccgagaagcacauggaggagggcgucaacgucgacgagaucaucaucccccuccgcccccucuccacccccgagccccccaacuccuccaagaccggcgacgaguuccucgucaugaagcgcaagcgcggccgccccaagggcuccaccaagaaguccuccaccgaggaggagcucgccgagaacaucgucucccccaccgaggacuccccccucgcccccgaggagggcaacucccucccccccuccucccucgagugcuccaagugcugccgcaaguucuccaacacccgccagcuccgcaagcacaucugcaucaucguccucaaccucggcgaggaggagggcgaggccggcaacgaguccgaccucgagcucgagaagaagugcaaggaggacgaccgcgagaaggccuccaagcgcccccgcucccagaagaccgagaagguccagaagaucuccggcaaggaggcccgccagcucuccggcgccaagaagcccaucaucuccgucguccucaccgcccacgaggccauccccggcgccaccaagaucguccccgucgaggccggcccccccgagaccggcgccaccaacuccgagaccaccuccgccgaccucgucccccgccgcggcuaccaggaguacgccauccagcagacccccuacgagcagcccaugaaguccucccgccucggccccacccagcucaagaucuucaccugcgaguacugcaacaaggucuucaaguucaagcacucccuccaggcccaccuccgcauccacaccaacgagaagcccuacaagugcccccagugcuccuacgccuccgccaucaaggccaaccucaacguccaccuccgcaagcacaccggcgagaaguucgccugcgacuacugcuccuucaccugccucuccaagggccaccucaagguccacaucgagcgcguccacaagaagaucaagcagcacugccgcuucugcaagaagaaguacuccgacgucaagaaccucaucaagcacauccgcgacgcccacgacccccaggacaagaaggucaaggaggcccucgacgagcucugccucaugacccgcgagggcaagcgccagcuccucuacgacugccacaucugcgagcgcaaguucaagaacgagcucgaccgcgaccgccacaugcucguccacggcgacaaguggcccuucgccugcgagcucugcggccacggcgccaccaaguaccaggcccucgagcuccacguccgcaagcaccccuucgucuacgucugcgccgucugccgcaagaaguucgucuccuccauccgccuccgcacccacaucaaggagguccacggcgccgcccaggaggcccucgucuucaccuccuccaucaaccaguccuucugccuccucgagcccggcggcgacauccagcaggaggcccucggcgaccagcuccagcucgucgaggaggaguucgcccuccagggcgucaacgcccucaaggaggaggccugccccggcgacacccagcucgaggagggccgcaaggagcccgaggcccccggcgagaugcccgcccccgccguccaccucgccuccccccaggccgaguccaccgcccucccccccugcgagcucgagaccaccgucgucuccuccuccgaccuccacucccaggaggucgucuccgacgacuuccuccucaagaacgacaccuccuccgccgaggcccacgccgcccccgagaagccccccgacaugcagcaccgcuccuccguccagacccagggcgaggucaucacccuccuccucuccaaggcccaguccgccggcuccgaccaggagucccacggcgcccaguccccccucggcgagggccagaacauggccguccucuccgccggcgaccccgaccccucccgcugccuccgcuccaaccccgccgaggccuccgaccuccucccccccgucgccggcggcggcgacaccaucacccaccagcccgacuccugcaaggccgcccccgagcaccgcuccggcaucaccgccuucaugaagguccucaacucccuccagaagaagcagaugaacaccucccucugcgagcgcauccgcaaggucuacggcgaccucgagugcgaguacugcggcaagcucuucugguaccagguccacuucgacaugcacguccgcacccacacccgcgagcaccucuacuacugcucccagugccacuacuccuccaucaccaagaacugccucaagcgccacgucauccagaagcacuccaacauccuccucaagugccccaccgacggcugcgacuacuccacccccgacaaguacaagcuccaggcccaccucaagguccacaccgcccucgacaagcgcuccuacuccugccccgucugcgagaaguccuucuccgaggaccgccucaucaagucccacaucaagaccaaccaccccgaggucuccauguccaccaucuccgagguccucggccgccgcguccagcucaagggccucaucggcaagcgcgccaugaagugccccuacugcgacuucuacuucaugaagaacggcuccgaccuccagcgccacaucugggcccacgagggcgucaagcccuucaagugcucccucugcgaguacgccacccgcuccaaguccaaccucaaggcccacaugaaccgccacuccaccgagaagacccaccucugcgacaugugcggcaagaaguucaaguccaagggcacccucaagucccacaagcuccuccacaccgccgacggcaagcaguucaagugcaccgucugcgacuacaccgccgcccagaagccccagcuccuccgccacauggagcagcacgucuccuucaagcccuuccgcugcgcccacugccacuacuccugcaacaucuccggcucccucaagcgccacuacaaccgcaagcaccccaacgaggaguacgccaacgucggcaccggcgagcucgccgccgagguccucauccagcagggcggccucaagugccccgucugcuccuucgucuacggcaccaagugggaguucaaccgccaccucaagaacaagcacggccucaaggucgucgagaucgacggcgaccccaagugggagaccgccaccgaggcccccgaggagcccuccacccaguaccuccacaucaccgaggccgaggaggacguccagggcacccaggccgccgucgccgcccuccaggaccuccgcuacaccuccgaguccggcgaccgccucgaccccaccgccgucaacauccuccagcagaucaucgagcucggcgccgagacccacgacgccaccgcccucgccuccgucgucgccauggcccccggcaccgucaccgucgucaagcaggucaccgaggaggagcccuccuccaaccacaccgucaugauccaggagaccguccagcaggccuccgucgagcucgccgagcagcaccaccucgucgucuccuccgacgacgucgagggcaucgagaccgucaccgucuacacccagggcggcgaggccuccgaguucaucgucuacguccaggaggccaugcagcccgucgaggagcaggccgucgagcagcccgcccaggagcucuga

SEQ ID NO: 51971 - RNA, 5970 nt, Artificial Sequence
  derived and/or modified sequence opt2 from ZFC3H1__Homo_sapiens__NP_659419
auggccaccgccgacacccccgcccccgccuccuccggccucucccccaaggaggagggcgagcucgaggacggcgagaucuccgacgacgacaacaacucccagauccgcucccgcuccuccuccuccuccuccggcggcggccuccuccccuacccccgccgccgccccccccacuccgcccgcggcggcggcuccggcggcggcggcggcuccuccuccuccuccuccuccucccagcagcagcuccgcaacuucucccgcucccgccacgccuccgagcgcggccaccuccgcggccccuccuccuaccgccccaaggagcccuuccgcucccacccccccuccguccgcaugcccuccuccucccucuccgaguccuccccccgccccuccuucugggagcgcucccaccucgcccucgaccgcuuccgcuuccgcggccgccccuaccgcggcggcucccgcuggucccgcggccgcggcgucggcgagcgcggcggcaagcccggcugccgccccccccucggcggcggcgccggcuccggcuucuccuccucccaguccuggcgcgagcccucccccccccgcaaguccuccaaguccuucggccgcucccccucccgcaagcagaacuacuccuccaagaacgagaacugcgucgaggagaccuucgaggaccuccuccucaaguacaagcagauccagcucgagcucgagugcaucaacaaggacgagaagcucgcccucuccuccaaggaggagaacguccaggaggaccccaagacccucaacuucgaggaccagaccuccaccgacaacgucuccaucaccaaggacuccuccaaggaggucgcccccgaggagaagacccaggucaagaccuuccaggccuucgagcucaagccccuccgccagaagcucacccuccccggcgacaagaaccgccucaagaaggucaaggacggcgccaagccccucucccucaaguccgacaccaccgacuccucccagggccuccaggacaaggagcagaaccucacccgccgcaucuccaccuccgacauccucuccgagaagaagcucggcgaggacgaggaggagcucuccgagcuccagcuccgccuccucgcccuccaguccgccuccaagaaguggcagcagaaggagcagcaggucaugaaggaguccaaggagaagcucaccaagaccaagaccguccagcagaaggucaagaccuccaccaagacccacuccgccaagaaggucuccaccaccgccaagcaggcccuccgcaagcagcagaccaaggccuggaagaagcuccagcagcagaaggagcaggagcgccagaaggaggaggaccagcgcaagcaggccgaggaggaggagcgccgcaagcgcgaggaggagauccgcaagauccgcgaccucuccaaccaggaggagcaguacaaccgcuucaugaagcucgucggcggcaagcgccgcucccgcuccaaguccuccgaccccgaccuccgccgcucccucgacaagcagcccaccgacuccggcggcggcaucuaccaguacgacaacuacgaggaggucgccauggacaccgacuccgagaccuccucccccgcccccucccccguccagccccccuucuucuccgagugcucccucggcuacuucucccccgcccccucccucucccuccccccccccccccaggucuccucccuccccccccucucccagcccuacgucgagggccucugcgucucccucgagccccuccccccccuccccccccuccccccccucccccccgaggaccccgagcagccccccaagccccccuucgccgacgaggaggaggaggaggagaugcuccuccgcgaggagcuccucaagucccucgccaacaagcgcgccuucaagcccgaggagaccuccuccaacuccgacccccccuccccccccguccucaacaacucccaccccgucccccgcuccaaccucuccaucgucuccaucaacaccgucucccagccccgcauccagaaccccaaguuccaccgcggcccccgccucccccgcaccgucaucucccuccccaagcacaaguccgucgucgucacccucaacgacuccgacgacuccgaguccgacggcgaggccuccaaguccaccaacuccgucuucggcggccucgaguccaugaucaaggaggcccgccgcaccgccgagcaggccuccaagcccaaggucccccccaaguccgagaaggagaacgacccccuccgcacccccgaggcccuccccgaggagaagaagaucgaguaccgccuccucaaggaggagaucgccaaccgcgagaagcagcgccucaucaaguccgaccagcucaagaccuccuccuccucccccgccaacuccgacgucgagaucgacggcaucggccgcaucgccauggucaccaagcaggucaccgacgccgaguccaagcucaagaagcaccgcauccuccucaugaaggacgaguccguccucaagaaccucguccagcaggaggccaagaagaaggaguccguccgcaacgccgaggccaagaucaccaagcucaccgagcagcuccaggccaccgagaagauccucaacgucaaccgcauguuccucaagaagcuccaggagcagauccaccgcguccagcagcgcgucaccaucaagaaggcccucacccucaaguacggcgaggagcucgcccgcgccaaggccgucgccuccaaggagaucggcaagcgcaagcucgagcaggaccgcuucggccccaacaagaugaugcgccucgacuccucccccgucuccuccccccgcaagcacuccgccgagcucaucgccauggagaagcgccgccuccagaagcucgaguacgaguacgcccucaagauccagaagcucaaggaggcccgcgcccucaaggccaaggagcagcagaacaucucccccgucgucgaggaggagcccgaguucucccucccccagcccucccuccacgaccucacccaggacaagcucacccucgacaccgaggagaacgacgucgacgacgagauccucuccggcuccucccgcgagcgccgccgcuccuuccucgaguccaacuacuucaccaagcccaaccucaagcacaccgacaccgccaacaaggagugcaucaacaagcucaacaagaacaccgucgagaagcccgagcucuuccucggccucaagaucggcgagcuccagaagcucuacuccaaggccgacucccucaagcagcucauccucaagaccaccaccggcaucaccgagaagguccuccacggccaggagaucuccgucgacgucgacuucgucaccgcccaguccaagaccauggaggucaagcccugccccuuccgccccuaccacuccccccuccucgucuucaaguccuaccgcuucucccccuacuaccgcaccaaggagaagcucccccucuccuccgucuccuacuccaacaugaucgagcccgaccagugcuucugccgcuucgaccucaccggcaccugcaacgacgacgacugccaguggcagcacauccaggacuacacccucucccgcaagcagcucuuccaggacauccucuccuacaaccucucccucaucggcugcgccgagaccuccaccaacgaggagaucaccgccuccgccgagaaguacgucgagaagcucuucggcgucaacaaggaccgcauguccauggaccagauggccguccuccucgucuccaacaucaacgaguccaagggccacaccccccccuucaccaccuacaaggacaagcgcaaguggaagcccaaguucuggcgcaagcccaucuccgacaacuccuucuccuccgacgaggagcaguccaccggccccaucaaguacgccuuccagcccgagaaccagaucaacguccccgcccucgacaccgucgucacccccgacgacguccgcuacuucaccaacgagaccgacgacaucgccaaccucgaggccuccguccucgagaaccccucccacguccagcucuggcucaagcucgccuacaaguaccucaaccagaacgagggcgagugcuccgagucccucgacuccgcccucaacguccucgcccgcgcccucgagaacaacaaggacaaccccgagaucuggugccacuaccuccgccucuucuccaagcgcggcaccaaggacgagguccaggagaugugcgagaccgccgucgaguacgcccccgacuaccaguccuucuggaccuuccuccaccucgaguccaccuucgaggagaaggacuacgucugcgagcgcaugcucgaguuccucaugggcgccgccaagcaggagaccuccaacauccucuccuuccagcuccucgaggcccuccucuuccgcguccagcuccacaucuucaccggccgcugccaguccgcccucgccauccuccagaacgcccucaaguccgccaacgacggcaucgucgccgaguaccucaagaccuccgaccgcugccucgccuggcucgccuacauccaccucaucgaguucaacauccuccccuccaaguucuacgaccccuccaacgacaaccccucccgcaucgucaacaccgaguccuucgucaugcccuggcaggccguccaggacgucaagaccaaccccgacaugcuccucgccgucuucgaggacgccgucaaggccugcaccgacgagucccucgccgucgaggagcgcaucgaggccugccucccccucuacaccaacaugaucgcccuccaccagcuccucgagcgcuacgaggccgccauggagcucugcaagucccuccucgaguccugccccaucaacugccagcuccucgaggcccucgucgcccucuaccuccagaccaaccagcacgacaaggcccgcgccgucuggcucaccgccuucgagaagaacccccagaacgccgaggucuucuaccacaugugcaaguucuucauccuccagaaccgcggcgacaaccuccuccccuuccuccgcaaguucaucgccuccuucuucaagcccggcuucgagaaguacaacaaccucgaccucuuccgcuaccuccucaacauccccggccccaucgacauccccucccgccucugcaagggcaacuucgacgacgacauguucaaccaccagguccccuaccucuggcucaucuacugccucugccacccccuccaguccuccaucaaggagaccgucgaggccuacgaggccgcccucggcgucgccaugcgcugcgacaucguccagaagaucuggauggacuaccucgucuucgccaacaaccgcgccgccggcucccgcaacaagguccaggaguucaaguucuucaccgaccucgucaaccgcugccucgucaccguccccgcccgcuaccccauccccuucuccuccgccgacuacugguccaacuacgaguuccacaaccgcgucaucuucuucuaccucuccugcguccccaagacccagcacuccaagacccucgagcgcuucugcuccgucaugcccgccaacuccggccucgcccuccgccuccuccagcacgagugggaggaguccaacguccagauccucaagcuccaggccaagauguucaccuacaacauccccaccugccucgccaccuggaagaucgccaucgccgccgagaucguccucaagggccagcgcgagguccaccgccucuaccagcgcgcccuccagaagcucccccucugcgccucccucuggaaggaccagcuccucuucgaggccuccgagggcggcaagaccgacaaccuccgcaagcucgucuccaagugccaggagaucggcgucucccucaacgagcuccucaaccucaacuccaacaagaccgaguccaagaaccacuga

SEQ ID NO: 51972 - RNA, 4569 nt, Artificial Sequence
  derived and/or modified sequence opt2 from ZFHX2__Homo_sapiens__XP_006720345
augaccuucaccaccaagguccucuccgcccccacccucuccccccucgacaacggccaggagccccccacccacggccccgagcccacccccucccgcgaccaggccgccgagggccccaaccucacccccgaggccucccccgacccccuccccgagcccccccucgccuccgucgagguccccgacaagcccuccggcucccccggccagccccccucccccgcccccucccccguccccgagcccgacgcccaggccgaggacgucgcccccccccccaccauggccgaggaggaggagggcaccaccggcgagcuccgcuccgccgagcccgcccccgccgacucccgccacccccucaccuaccgcaagaccaccaacuucgcccucgacaaguuccucgaccccgcccgccccuacaagugcaccgucugcaaggaguccuucacccagaagaacauccuccucguccacuacaacuccgucucccaccuccacaagaugaagaaggccgccaucgaccccuccgcccccgcccgcggcgaggccggcgccccccccaccaccaccgccgccaccgacaagcccuucaagugcaccgucugccgcgucuccuacaaccaguccuccacccucgagauccacaugcgcuccguccuccaccagacccgcucccgcggcaccaagaccgacuccaagaucgagggccccgagcgcucccaggaggagcccaaggagggcgagaccgagggcgaggucggcaccgagaagaagggccccgacaccuccggcuucaucuccggccuccccuuccucuccccccccccccccccccucgaccuccaccgcuuccccgccccccucuucaccccccccguccucccccccuucccccucguccccgagucccuccucaagcuccagcagcagcagcuccuccuccccuucuaccuccacgaccucaaggucggccccaagcucacccucgccggccccgcccccguccucucccuccccgccgccaccccccccccccccccccagccccccaaggccgagcucgccgagcgcgagugggagcgcccccccauggccaaggagggcaacgaggccggccccuccuccccccccgacccccuccccaacgaggccgcccgcaccgccgccaaggcccuccucgagaacuucggcuucgagcucgucauccaguacaacgagggcaagcaggccgucccccccccccccaccccccccccccccgaggcccucggcggcggcgacaagcucgccugcggcgccugcggcaagcucuucuccaacaugcucauccucaagacccacgaggagcacguccaccgccgcuuccuccccuucgaggcccucucccgcuacgccgcccaguuccgcaaguccuacgacucccucuaccccccccucgccgagccccccaagccccccgacggcucccucgacucccccgucccccaccucggcccccccuuccucguccccgagcccgaggccggcggcacccgcgcccccgaggagcgcucccgcgccggcggccacuggcccaucgaggaggaggaguccucccgcggcaaccuccccccccucguccccgccggccgccgcuucucccgcaccaaguucaccgaguuccagacccaggcccuccaguccuucuucgagaccuccgccuaccccaaggacggcgaggucgagcgccucgccucccuccucggccucgccucccgcgucgucgucgucugguuccagaacgcccgccagaaggcccgcaagaacgccugcgagggcggcuccaugcccaccggcggcggcaccggcggcgccuccggcugccgccgcugccacgccaccuucuccugcgucuucgagcucguccgccaccucaagaagugcuacgacgaccagacccucgaggaggaggaggaggaggccgagcgcggcgaggaggaggaggaggucgaggaggaggaggucgaggaggagcagggccucgagccccccgccggccccgagggcccccuccccgagccccccgacggcgaggagcucucccaggccgaggccaccaaggccggcggcaaggagcccgaggagaaggccacccccucccccucccccgcccacaccugcgaccagugcgccaucuccuucuccucccaggaccuccucaccucccaccgccgccuccacuuccuccccucccuccagcccuccgcccccccccagcuccucgaccucccccuccucgucuucggcgagcgcaacccccucgucgccgccaccucccccaugcccggccccccccucaagcgcaagcacgaggacggcucccucucccccaccggcuccgaggccggcggcggcggcgagggcgagcccccccgcgacaagcgccuccgcaccaccauccuccccgagcagcucgagauccucuaccgcugguacaugcaggacuccaaccccacccgcaagaugcucgacugcaucuccgaggaggucggccucaagaagcgcgucguccaggucugguuccagaacacccgcgcccgcgagcgcaagggccaguuccgcuccacccccggcggcguccccucccccgccgucaagccccccgccaccgccacccccgccucccuccccaaguucaaccuccuccucggcaaggucgacgacggcaccggccgcgaggcccccaagcgcgaggcccccgccuuccccuaccccaccgccacccucgccuccggcccccagcccuuccucccccccggcaaggaggccaccacccccacccccgagcccccccucccccuccuccccccccccccccccuccgaggaggagggccccgaggagccccccaaggccucccccgaguccgaggccugcucccucuccgccggcgaccucuccgacuccuccgccuccucccucgccgagcccgagucccccggcgccggcggcaccuccggcggccccggcggcggcaccggcguccccgacggcaugggccagcgccgcuaccgcacccagauguccucccuccagcucaagaucaugaaggccugcuacgaggccuaccgcacccccaccaugcaggagugcgagguccucggcgaggagaucggccuccccaagcgcgucauccaggucugguuccagaacgcccgcgccaaggagaagaaggccaagcuccagggcaccgccgccggcuccaccggcggcuccuccgagggccuccucgccgcccagcgcaccgacugccccuacugcgacgucaaguacgacuucuacgucuccugccgcggccaccucuucucccgccagcaccucgccaagcucaaggaggccguccgcgcccagcucaaguccgaguccaagugcuacgaccucgcccccgcccccgaggccccccccgcccucaaggccccccccgccaccacccccgccuccaugccccucggcgccgcccccacccucccccgccucgcccccguccuccucuccggccccgcccucgcccagcccccccucggcaaccucgcccccuucaacuccggccccgccgccuccuccggccuccucggccucgccaccuccguccuccccaccaccaccgucguccagaccgccggccccggccgcccccucccccagcgccccaugcccgaccagaccaacaccuccaccgccggcaccaccgaccccguccccggcccccccaccgagccccucggcgacaaggucuccuccgagcgcaagcccgucgccggccccaccuccuccuccaacgacgcccucaagaaccucaaggcccucaagaccaccguccccgcccuccucggcggccaguuccuccccuucccccucccccccgccggcggcaccgccccccccgccgucuucggcccccagcuccagggcgccuacuuccagcagcucuacggcaugaagaagggccucuuccccaugaaccccaugaucccccagacccucaucggccuccuccccaacgcccuccuccagccccccccccagccccccgagcccaccgccaccgccccccccaagccccccgagcuccccgcccccggcgagggcgaggccggcgaggucgacgagcuccucaccggcuccaccggcaucuccaccgucgacgucacccaccgcuaccucugccgccagugcaagauggccuucgacggcgaggcccccgccaccgcccaccagcgcuccuucugcuucuucggccgcggcuccggcggcuccaugccccccccccuccgcguccccaucugcaccuaccacugccucgccugcgagguccuccucuccggccgcgaggcccucgccucccaccuccgcuccuccgcccaccgccgcaaggccgcccccccccagggcggcccccccaucuccaucaccaacgccgccaccgccgccuccgccgccgucgccuucgccaaggaggaggcccgccucccccacaccgacuccaaccccaagaccaccaccaccuccacccuccucgcccucuga

SEQ ID NO: 51973 - RNA, 8370 nt, Artificial Sequence
  derived and/or modified sequence opt2 from ZFHX3__Homo_sapiens__NP_001158238
augcgccucggcggcggccagcucgucuccgaggagcucaugaaccucggcgaguccuucauccagaccaacgaccccucccucaagcucuuccagugcgccgucugcaacaaguucaccaccgacaaccucgacaugcucggccuccacaugaacgucgagcgcucccucuccgaggacgaguggaaggccgucaugggcgacuccuaccagugcaagcucugccgcuacaacacccagcucaaggccaacuuccagcuccacugcaagaccgacaagcacguccagaaguaccagcucgucgcccacaucaaggagggcggcaaggccaacgaguggcgccucaagugcgucgccaucggcaaccccguccaccucaagugcaacgccugcgacuacuacaccaacucccucgagaagcuccgccuccacaccgucaacucccgccacgaggccucccucaagcucuacaagcaccuccagcagcacgaguccggcgucgagggcgaguccugcuacuaccacugcguccucugcaacuacuccaccaaggccaagcucaaccucauccagcacguccgcuccaugaagcaccagcgcuccgagucccuccgcaagcuccagcgccuccagaagggccuccccgaggaggacgaggaccucggccagaucuucaccauccgccgcugccccuccaccgaccccgaggaggccaucgaggacgucgagggccccuccgagaccgccgccgaccccgaggagcucgccaaggaccaggagggcggcgccuccuccucccaggccgagaaggagcucaccgacucccccgccaccuccaagcgcaucuccuuccccggcuccuccgaguccccccucuccuccaagcgccccaagaccgccgaggagaucaagcccgagcagauguaccagugccccuacugcaaguacuccaacgccgacgucaaccgccuccgcguccacgccaugacccagcacuccguccagcccaugcuccgcugcccccucugccaggacaugcucaacaacaagauccaccuccagcuccaccucacccaccuccacuccgucgcccccgacugcgucgagaagcucaucaugaccgucaccacccccgagauggucaugcccuccuccauguuccuccccgccgccguccccgaccgcgacggcaacuccaaccucgaggaggccggcaagcagcccgagaccuccgaggaccucggcaagaacauccuccccuccgccuccaccgagcaguccggcgaccucaagcccucccccgccgaccccggcuccguccgcgaggacuccggcuucaucugcuggaagaagggcugcaaccaggucuucaagaccuccgccgcccuccagacccacuucaacgagguccacgccaagcgcccccagcuccccgucuccgaccgccacgucuacaaguaccgcugcaaccagugcucccucgccuucaagaccaucgagaagcuccagcuccacucccaguaccacgucauccgcgccgccaccaugugcugccucugccagcgcuccuuccgcaccuuccaggcccucaagaagcaccucgagaccucccaccucgagcucuccgaggccgacauccagcagcucuacggcggccuccucgccaacggcgaccuccucgccaugggcgaccccacccucgccgaggaccacaccaucaucgucgaggaggacaaggaggaggaguccgaccucgaggacaagcagucccccaccggcuccgacuccggcuccguccaggaggacuccggcuccgagcccaagcgcgcccuccccuuccgcaagggccccaacuucaccauggagaaguuccucgaccccucccgccccuacaagugcaccgucugcaaggaguccuucacccagaagaacauccuccucguccacuacaacuccgucucccaccuccacaagcucaagcgcgcccuccaggaguccgccaccggccagcccgagcccaccuccucccccgacaacaagcccuucaagugcaacaccugcaacgucgccuacucccaguccuccacccucgagauccacaugcgcuccguccuccaccagaccaaggcccgcgccgccaagcucgaggccgccuccggcuccuccaacggcaccggcaacuccuccuccaucucccucuccuccuccacccccucccccgucuccaccuccggcuccaacaccuucaccaccuccaaccccuccuccgccggcaucgcccccuccuccaaccuccucucccagguccccaccgaguccgucggcaugcccccccucggcaaccccaucggcgccaacaucgccucccccuccgagcccaaggaggccaaccgcaagaagcucgccgacaugaucgccucccgccagcagcagcagcagcagcagcagcagcagcagcagcagcagcagcagcagcagcaggcccagacccucgcccaggcccaggcccagguccaggcccaccuccagcaggagcuccagcagcaggccgcccucauccagucccagcucuucaaccccacccuccucccccacuuccccaugaccaccgagacccuccuccagcuccagcagcagcagcaccuccucuuccccuucuacauccccuccgccgaguuccagcucaaccccgaggucucccuccccgucaccuccggcgcccucacccucaccggcaccggccccggccuccucgaggaccucaaggcccagguccaggucccccagcagucccaccagcagauccucccccagcagcagcagaaccagcucuccaucgcccagucccacuccgcccuccuccagcccucccagcaccccgagaagaagaacaagcucgucaucaaggagaaggagaaggagucccagcgcgagcgcgacuccgccgagggcggcgagggcaacaccggccccaaggagacccuccccgacgcccucaaggccaaggagaagaaggagcucgcccccggcggcggcuccgagcccuccaugcuccccccccgcaucgccuccgacgcccgcggcaacgccaccaaggcccuccucgagaacuucggcuucgagcucgucauccaguacaacgagaacaagcagaagguccagaagaagaacggcaagaccgaccagggcgagaaccucgagaagcucgagugcgacuccugcggcaagcucuucuccaacauccucauccucaagucccaccaggagcacguccaccagaacuacuuccccuucaagcagcucgagcgcuucgccaagcaguaccgcgaccacuacgacaagcucuacccccuccgcccccagacccccgagcccccccccccccccccccccccccccccccccccccuccccgccgcccccccccagcccgccuccacccccgccauccccgccuccgccccccccaucaccucccccaccaucgcccccgcccagcccuccgucccccucacccagcucuccaugcccauggagcuccccaucuucuccccccucaugaugcagaccaugccccuccagacccuccccgcccagcuccccccccagcucggccccgucgagccccuccccgccgaccucgcccagcucuaccagcaccagcucaaccccacccuccuccagcagcagaacaagcgcccccgcacccgcaucaccgacgaccagcuccgcguccuccgccaguacuucgacaucaacaacucccccuccgaggagcagaucaaggagauggccgacaaguccggccucccccagaaggucaucaagcacugguuccgcaacacccucuucaaggagcgccagcgcaacaaggacucccccuacaacuucuccaacccccccaucaccucccucgaggagcucaagaucgacucccgcccccccucccccgagccccccaagcaggaguacuggggcuccaagcgcuccucccgcacccgcuucaccgacuaccagcuccgcguccuccaggacuucuucgacgccaacgccuaccccaaggacgacgaguucgagcagcucuccaaccuccucaaccuccccacccgcgucaucgucgucugguuccagaacgcccgccagaaggcccgcaagaacuacgagaaccagggcgagggcaaggacggcgagcgccgcgagcucaccaacgaccgcuacauccgcaccuccaaccucaacuaccagugcaagaagugcucccucgucuuccagcgcaucuucgaccucaucaagcaccagaagaagcucugcuacaaggacgaggacgaggagggccaggacgacucccagaacgaggacuccauggacgccauggagauccucacccccaccuccuccuccugcuccacccccaugcccucccaggccuacuccgcccccgcccccuccgccaacaacaccgccuccuccgccuuccuccagcucaccgccgaggccgaggagcucgccaccuucaacuccaagaccgaggccggcgacgagaagcccaagcucgccgaggcccccuccgcccagcccaaccagacccaggagaagcagggccagcccaagcccgagcuccagcagcaggagcagcccgagcagaagaccaacaccccccagcagaagcucccccagcucgucucccuccccucccucccccagccccccccccaggccccccccccccagugcccccucccccaguccucccccucccccucccagcucucccaccucccccucaagccccuccacaccuccaccccccagcagcucgccaaccuccccccccagcucauccccuaccagugcgaccagugcaagcucgccuuccccuccuucgagcacuggcaggagcaccagcagcuccacuuccucuccgcccagaaccaguucauccacccccaguuccucgaccgcucccucgacaugcccuucaugcucuucgaccccuccaacccccuccucgccucccagcuccucuccggcgccaucccccagauccccgccuccuccgccaccucccccuccacccccaccuccaccaugaacacccucaagcgcaagcucgaggagaaggccuccgccucccccggcgagaacgacuccggcaccggcggcgaggagccccagcgcgacaagcgccuccgcaccaccaucacccccgagcagcucgagauccucuaccagaaguaccuccucgacuccaaccccacccgcaagaugcucgaccacaucgcccacgaggucggccucaagaagcgcgucguccaggucugguuccagaacacccgcgcccgcgagcgcaagggccaguuccgcgccgucggccccgcccaggcccaccgccgcugccccuucugccgcgcccucuucaaggccaagaccgcccucgaggcccacauccgcucccgccacuggcacgaggccaagcgcgccggcuacaaccucacccucuccgccaugcuccucgacugcgacggcggccuccagaugaagggcgacaucuucgacggcaccuccuucucccaccucccccccuccuccuccgacggccagggcgucccccucucccccgucuccaagaccauggagcucuccccccgcacccuccucucccccuccuccaucaaggucgagggcaucgaggacuucgagucccccuccauguccuccgucaaccucaacuucgaccagaccaagcucgacaacgacgacugcuccuccgucaacaccgccaucaccgacaccaccaccggcgacgagggcaacgccgacaacgacuccgccaccggcaucgccaccgagaccaaguccuccuccgcccccaacgagggccucaccaaggccgccaugauggccauguccgaguacgaggaccgccucuccuccggccucgucucccccgcccccuccuucuacuccaaggaguacgacaacgagggcaccgucgacuacuccgagaccuccucccucgccgaccccugcucccccucccccggcgccuccggcuccgccggcaaguccggcgacuccggcgaccgccccggccagaagcgcuuccgcacccagaugaccaaccuccagcucaagguccucaaguccugcuucaacgacuaccgcacccccaccaugcucgagugcgagguccucggcaacgacaucggccuccccaagcgcgucguccaggucugguuccagaacgcccgcgccaaggagaagaaguccaagcucuccauggccaagcacuucggcaucaaccagaccuccuacgagggccccaagaccgagugcacccucugcggcaucaaguacuccgcccgccucuccguccgcgaccacaucuucucccagcagcacaucuccaaggucaaggacaccaucggcucccagcucgacaaggagaaggaguacuucgaccccgccaccguccgccagcucauggcccagcaggagcucgaccgcaucaagaaggccaacgagguccucggccucgccgcccagcagcagggcauguucgacaacaccccccuccaggcccucaaccuccccaccgccuaccccgcccuccagggcaucccccccguccuccuccccggccucaacucccccucccuccccggcuucacccccuccaacaccgcccucaccucccccaagcccaaccucaugggccuccccuccaccaccguccccucccccggccuccccaccuccggccuccccaacaagcccuccuccgccucccucuccucccccacccccgcccaggccaccauggccaugggcccccagcagcccccccagcagcagcagcagcagcagcagccccagguccagcagcccccccccccccccgccgcccagcccccccccaccccccagcucccccuccagcagcagcagcagcgcaaggacaaggacuccgagaaggucaaggagaaggagaaggcccacaagggcaagggcgagccccuccccguccccaagaaggagaagggcgaggcccccaccgccaccgccgccaccaucuccgccccccuccccaccauggaguacgccgucgaccccgcccagcuccaggcccuccaggccgcccucaccuccgaccccaccgcccuccucaccucccaguuccuccccuacuucguccccggcuucucccccuacuacgccccccagauccccggcgcccuccaguccggcuaccuccagcccauguacggcauggagggccucuuccccuacucccccgcccucucccaggcccucaugggccucucccccggcucccuccuccagcaguaccagcaguaccagcagucccuccaggaggccauccagcagcagcagcagcgccagcuccagcagcagcagcagcagaagguccagcagcagcagcccaaggccucccagacccccgucccccccggcgcccccucccccgacaaggaccccgccaaggagucccccaagcccgaggagcagaagaacaccccccgcgaggucuccccccuccuccccaagcuccccgaggagcccgaggccgaguccaaguccgccgacucccucuacgaccccuucaucguccccaagguccaguacaagcucgucugccgcaagugccaggccggcuucuccgacgaggaggccgcccgcucccaccucaagucccucugcuucuucggccaguccgucgucaaccuccaggagaugguccuccacguccccaccggcggcggcggcggcggcuccggcggcggcggcggcggcggcggcggcggcggcggcggcggcuccuaccacugccucgccugcgaguccgcccucugcggcgaggaggcccucucccagcaccucgaguccgcccuccacaagcaccgcaccaucacccgcgccgcccgcaacgccaaggagcaccccucccuccucccccacuccgccugcuuccccgaccccuccaccgccuccaccucccaguccgccgcccacuccaacgacuccccccccccccccuccgccgccgcccccuccuccgccuccccccacgccucccgcaaguccuggccccaggucgucucccgcgccuccgccgccaagccccccuccuuccccccccucuccuccuccuccaccgucaccuccuccuccugcuccaccuccggcguccagcccuccaugcccaccgacgacuacuccgaggaguccgacaccgaccucucccagaaguccgacggccccgccucccccgucgagggccccaaggaccccuccugccccaaggacuccggccucaccuccgucggcaccgacaccuuccgccucuga

SEQ ID NO: 51974 - RNA, 10851 nt, Artificial Sequence
  derived and/or modified sequence opt2 from ZFHX4__Homo_sapiens__XP_011515897
auggagaccugcgacuccccccccaucucccgccaggagaacggccaguccaccuccaagcucugcggcaccacccagcucgacaacgagguccccgagaaggucgccggcauggagcccgaccgcgagaacuccuccaccgacgacaaccucaagaccgacgagcgcaaguccgaggcccuccucggcuucuccgucgagaacgccgccgccacccaggucaccuccgccaaggagauccccugcaacgagugcgccaccuccuuccccucccuccagaaguacauggagcaccacugccccaacgcccgccuccccguccucaaggacgacaacgaguccgagaucuccgagcucgaggacuccgacgucgagaaccucaccggcgagaucgucuaccagcccgacggcuccgccuacaucaucgaggacuccaaggaguccggccagaacgcccagaccggcgccaacuccaagcucuucuccaccgccauguuccucgacucccucgccuccgccggcgagaaguccgaccaguccgccuccgcccccauguccuucuacccccagaucaucaacaccuuccacaucgccuccucccucggcaagcccuucaccgccgaccaggccuuccccaacaccuccgcccucgccggcgucggccccguccuccacuccuuccgcgucuacgaccuccgccacaagcgcgagaaggacuaccucaccuccgacggcuccgccaagaacuccugcgucuccaaggacguccccaacaacgucgaccucuccaaguucgacggcugcgucuccgacggcaagcgcaagcccguccucaugugcuuccucugcaagcucuccuucggcuacauccgcuccuucgucacccacgccguccacgaccaccgcaugacccucaacgacgaggagcagaagcuccucuccaacaagugcgucuccgccaucauccagggcaucggcaaggacaaggagccccucaucuccuuccucgagcccaagaaguccaccuccgucuacccccacuucuccaccaccaaccucaucggccccgaccccaccuuccgcggccucugguccgccuuccacgucgagaacggcgacucccuccccgccggcuucgccuuccucaagggcuccgccuccaccuccuccuccgccgagcagccccucggcaucacccagaugcccaaggccgaggucaaccucggcggccucuccucccucgucgucaacacccccaucaccuccgucucccucucccacuccuccuccgaguccuccaagauguccgaguccaaggaccaggagaacaacugcgagcgccccaaggaguccaacguccuccaccccaacggcgagugccccgucaaguccgagcccaccgagcccggcgacgaggacgaggaggacgccuacuccaacgagcucgacgacgaggagguccucggcgagcucaccgacuccaucggcaacaaggacuucccccuccucaaccaguccaucuccccccucuccuccuccguccucaaguucaucgagaagggcaccuccuccuccuccgccaccgucuccgacgacaccgagaagaagaagcagaccgccgccguccgcgccuccggcuccgucgccuccaacuacggcaucuccggcaaggacuucgccgacgccuccgccuccaaggacuccgccaccgccgcccaccccuccgagaucgcccgcggcgacgaggacuccuccgccaccccccaccagcacggcuucacccccuccacccccggcacccccggccccggcggcgacggcucccccggcuccggcaucgagugccccaagugcgacaccguccucggcuccucccgcucccucggcggccacaugaccaugaugcacucccgcaacuccugcaagacccucaagugccccaagugcaacuggcacuacaaguaccagcagacccucgaggcccacaugaaggagaagcaccccgagcccggcggcuccugcgucuacugcaagaccggccagccccacccccgccucgcccgcggcgaguccuacaccugcggcuacaagcccuuccgcugcgaggucugcaacuacuccaccaccaccaagggcaaccucuccauccacaugcaguccgacaagcaccucaacaacguccagaaccuccagaacggcaacggcgagcaggucuucggccacuccgcccccgcccccaacaccucccucuccggcugcggcacccccucccccuccaagcccaagcagaagcccaccuggcgcugcgaggucugcgacuacgagaccaacgucgcccgcaaccuccgcauccacaugaccuccgagaagcacaugcacaacaugaugcuccuccagcagaacaugaagcagauccagcacaaccuccaccucggccucgcccccgccgaggccgagcucuaccaguacuaccucgcccagaacaucggccucaccggcaugaagcucgagaaccccgccgacccccagcucaugaucaaccccuuccagcucgaccccgccaccgccgccgcccucgcccccggccucgucaacaacgagcucccccccgagauccgccucgccuccggccagcucaugggcgacgaccucucccuccucaccgccggcgagcucucccccuacaucuccgaccccgcccucaagcucuuccagugcgccgucugcaacaaguucaccuccgacucccucgaggcccucuccguccacgucuccuccgagcgcucccuccccgaggaggaguggcgcgccgucaucggcgacaucuaccagugcaagcucugcaacuacaacacccagcucaaggccaacuuccagcuccacugcaagaccgacaagcacaugcagaaguaccagcucgucgcccacaucaaggagggcggcaaguccaacgaguggcgccucaagugcaucgccaucggcaaccccguccaccucaagugcaacgccugcgacuacuacaccaacuccgucgacaagcuccgccuccacaccaccaaccaccgccacgaggccgcccucaagcucuacaagcaccuccagaagcaggagggcgccgucaaccccgaguccugcuacuacuacugcgccgucugcgacuacaccaccaaggucaagcucaaccucguccagcacguccgcuccgucaagcaccagcagaccgagggccuccgcaagcuccagcuccaccagcagggccucgcccccgaggaggacaaccucuccgagaucuucuucgucaaggacugcccccccaacgagcucgagaccgccucccucggcgcccgcaccugcgacgacgaccucaccgagcagcagcuccgcuccaccuccgaggagcaguccgaggaggccgagggcgccaucaagcccaccgccgucgccgaggacgacgagaaggacaccuccgagcgcgacaacuccgagggcaagaacuccaacaaggacuccggcaucaucacccccgagaaggagcucaaggucuccgucgccggcggcacccagccccuccuccucgccaaggaggaggacgucgccaccaagcgcuccaagcccaccgaggacaacaaguucugccacgagcaguucuaccagugccccuacugcaacuacaacucccgcgaccagucccgcauccagaugcacguccucucccagcacuccguccagcccgucaucugcugcccccucugccaggacguccucuccaacaagaugcaccuccagcuccaccucacccaccuccacuccgucucccccgacugcgucgagaagcuccucaugaccguccccguccccgacgucaugaugcccaacuccaugcuccuccccgccgccgccuccgagaaguccgagcgcgacacccccgccgccgucaccgccgagggcuccggcaaguacuccggcgagucccccauggacgacaaguccauggccggccucgaggacuccaaggccaacgucgaggucaagaacgaggagcagaagcccaccaaggagccccucgaggucuccgaguggaacaagaacuccuccaaggacgucaagauccccgacacccuccaggaccagcucaacgagcagcagaagcgccagccccucuccgucuccgaccgccacgucuacaaguaccgcugcaaccacugcucccucgccuucaagaccaugcagaagcuccagauccacucccaguaccacgccauccgcgccgccaccaugugcaaccucugccagcgcuccuuccgcaccuuccaggcccucaagaagcaccucgaggccggccaccccgagcucuccgaggccgagcuccagcagcucuacgccucccuccccgucaacggcgagcucugggccgaguccgagaccaugucccaggacgaccacggccucgagcaggagauggagcgcgaguacgaggucgaccacgagggcaaggccucccccgucggcuccgacuccuccuccauccccgacgacaugggcuccgagcccaagcgcacccuccccuuccgcaagggccccaacuucaccauggagaaguuccucgaccccucccgccccuacaagugcaccgucugcaaggaguccuucacccagaagaacauccuccucguccacuacaacuccgucucccaccuccacaagcucaagaagguccuccaggaggccuccucccccgucccccaggagaccaacuccaacaccgacaacaagcccuacaagugcuccaucugcaacgucgccuacucccaguccuccacccucgagauccacaugcgcuccguccuccaccagaccaaggcccgcgccgccaagcucgagcccuccggccacgucgccggcggccacuccaucgccgccaacgucaacucccccggccagggcaugcucgacuccaugucccucgccgccgucaacuccaaggacacccaccucgacgccaaggagcucaacaagaagcagacccccgaccucaucuccgcccagcccgcccaccaccccccccagucccccgcccagauccagaugcagcuccagcacgagcuccagcagcaggccgccuucuuccagccccaguuccucaaccccgccuuccucccccacuuccccaugacccccgaggcccuccuccaguuccagcagccccaguuccucuuccccuucuacauccccggcaccgaguucucccucggccccgaccucggccuccccggcuccgccaccuucggcaugcccggcaugaccggcauggccggcucccuccucgaggaccucaagcagcagauccagacccagcaccacgucggccagacccagcuccagauccuccagcagcaggcccagcaguaccaggccacccagccccagcuccagccccagaagcagcagcagcagcccccccccccccagcagcagcagcagcagcaggccuccaagcuccucaagcaggagcaguccaacaucgucuccgccgacugccagaucaugaaggacguccccuccuacaaggaggccgaggacaucuccgagaagcccgagaagcccaagcaggaguucaucuccgagggcgagggccucaaggagggcaaggacaccaagaagcagaagucccucgagcccuccaucccccccccccgcaucgccuccggcgcccgcggcaacgccgccaaggcccuccucgagaacuucggcuucgagcucgucauccaguacaacgagaaccgccagaagguccagaagaagggcaaguccggcgagggcgagaacaccgacaagcucgagugcggcaccugcggcaagcucuucuccaacguccucauccucaagucccaccaggagcacguccacggccaguucuuccccuacgccgcccucgagaaguucgcccgccaguaccgcgaggccuacgacaagcucuaccccaucucccccuccucccccgagaccccccccccccccccccccccccccccccucccccccgcccccccccagcccuccuccaugggccccgucaagauccccaacaccgucuccaccccccuccaggcccccccccccaccccccccccccccccccccccccccccccccccccccccccccccccccccccccccccccuccgcccccccccagguccagcuccccgucucccucgaccucccccucuuccccuccaucaugaugcagcccguccagcaccccgcccuccccccccagcucgcccuccagcucccccagauggacgcccucuccgccgaccucacccagcucugccagcagcagcucggccucgaccccaacuuccuccgccacucccaguucaagcgcccccgcacccgcaucaccgacgaccagcucaagauccuccgcgccuacuucgacaucaacaacucccccuccgaggagcagauccaggagauggccgagaaguccggccucucccagaaggucaucaagcacugguuccgcaacacccucuucaaggagcgccagcgcaacaaggacucccccuacaacuucuccaacccccccaucaccguccucgaggacauccgcaucgacccccagcccaccucccucgagcacuacaaguccgacgccuccuucuccaagcgcuccucccgcacccgcuucaccgacuaccagcuccgcguccuccaggacuucuucgacaccaacgccuaccccaaggacgacgagaucgagcagcucuccaccguccucaaccuccccacccgcgucaucgucgucugguuccagaacgcccgccagaaggcccgcaaguccuacgagaaccaggccgagaccaaggacaacgagaagcgcgagcucaccaacgagcgcuacauccgcaccuccaacaugcaguaccagugcaagaagugcaacgucgucuucccccgcaucuucgaccucaucacccaccagaagaagcagugcuacaaggacgaggacgacgacgcccaggacgagucccagaccgaggacuccauggacgccaccgaccaggucgucuacaagcacugcaccgucuccggccagaccgacgccgccaagaacgccgccgcccccgccgccuccuccggcuccggcaccuccaccccccucauccccucccccaagcccgagcccgagaagaccucccccaagcccgaguaccccgccgagaagcccaagcaguccgaccccuccccccccucccagggcaccaagcccgcccucccccucgccuccaccuccuccgaccccccccaggccuccaccgcccagccccagccccagccccagccccccaagcagccccagcucaucggccgcccccccuccgccucccagacccccguccccuccuccccccuccagaucuccaugaccucccuccagaacucccuccccccccagcuccuccaguaccagugcgaccagugcaccgucgccuuccccacccucgagcucuggcaggagcaccagcacaugcacuuccucgccgcccagaaccaguuccuccacucccccuuccucgagcgccccauggacaugcccuacaugaucuucgaccccaacaacccccucaugaccggccagcuccucggcuccucccucacccagaugcccccccaggccuccuccucccacaccaccgcccccaccaccgucgccgccucccucaagcgcaagcucgacgacaaggaggacaacaacugcuccgagaaggagggcggcaacuccggcgaggaccagcaccgcgacaagcgccuccgcaccaccaucacccccgagcagcucgagauccucuacgagaaguaccuccucgacuccaaccccacccgcaagaugcucgaccacaucgcccgcgaggucggccucaagaagcgcgucguccaggucugguuccagaacacccgcgcccgcgagcgcaagggccaguuccgcgccgucggccccgcccagucccacaagcgcugccccuucugccgcgcccucuucaaggccaaguccgcccucgagucccacauccgcucccgccacuggaacgagggcaagcaggccggcuacucccucccccccuccccccucaucuccaccgaggacggcggcgaguccccccagaaguacaucuacuucgacuaccccucccucccccucaccaagaucgaccucuccuccgagaacgagcucgccuccaccgucuccacccccgucuccaagaccgccgagcucucccccaagaaccuccucucccccuccuccuucaaggccgagugcuccgaggacgucgagaaccucaacgccccccccgccgaggccggcuacgaccagaacaagaccgacuucgacgagaccuccuccaucaacaccgccaucuccgacgccaccaccggcgacgagggcaacaccgagauggaguccaccaccggcuccuccggcgacgucaagcccgcccucucccccaaggagcccaagacccucgacacccuccccaagcccgccaccacccccaccaccgaggucugcgacgacaaguuccucuucucccucaccucccccuccauccacuucaacgacaaggacggcgaccacgaccaguccuucuacaucaccgacgaccccgacgacaacgccgaccgcuccgagaccuccuccaucgccgaccccuccucccccaaccccuucggcuccuccaaccccuucaaguccaaguccaacgaccgccccggccacaagcgcuuccgcacccagauguccaaccuccagcucaagguccucaaggccugcuucuccgacuaccgcacccccaccaugcaggagugcgagaugcucggcaacgagaucggccuccccaagcgcgucguccaggucugguuccagaacgcccgcgccaaggagaagaaguucaagaucaacaucggcaagcccuucaugaucaaccagggcggcaccgagggcaccaagcccgagugcacccucugcggcgucaaguacuccgcccgccucuccauccgcgaccacaucuucuccaagcagcacaucuccaagguccgcgagaccgucggcucccagcucgaccgcgagaaggacuaccucgcccccaccaccguccgccagcucauggcccagcaggagcucgaccgcaucaagaaggccuccgacguccucggccucaccguccagcagcccggcaugauggacuccuccucccuccacggcaucucccuccccaccgccuaccccggccuccccggccucccccccguccuccuccccggcaugaacggccccuccucccuccccggcuucccccagaacuccaacacccucaccccccccggcgccggcaugcucggcuuccccaccuccgccaccuccucccccgcccucucccucuccuccgcccccaccaagccccuccuccagaccccccccccccccccccccccccccccccccccccccuccuccucccucuccggccagcagaccgagcagcagaacaaggaguccgagaagaagcagaccaagcccaacaaggucaagaagaucaaggaggaggagcucgaggccaccaagcccgagaagcaccccaagaaggaggagaagaucuccuccgcccucuccguccucggcaaggucgucggcgagacccacgucgaccccauccagcuccaggcccuccagaacgccaucgccggcgaccccgccuccuucaucggcggccaguuccuccccuacuucauccccggcuucgccuccuacuucaccccccagcuccccggcaccguccagggcggcuacuucccccccgucugcggcauggagucccucuuccccuacggccccaccaugccccagacccucgccggccucucccccggcgcccuccuccagcaguaccagcaguaccagcagaaccuccaggagucccuccagaagcagcagaagcagcagcaggagcagcagcagaagcccguccaggccaagaccuccaaggucgaguccgaccagccccagaacuccaacgacgccuccgagaccaaggaggacaaguccaccgccaccgaguccaccaaggaggagccccagcucgaguccaaguccgccgacuucuccgacaccuacgucguccccuucgucaaguacgaguucaucugccgcaagugccagaugauguucaccgacgaggacgccgccgucaaccaccagaaguccuucugcuacuucggccagccccucaucgacccccaggagaccguccuccgcguccccgucuccaaguaccagugccucgccugcgacgucgccaucuccggcaacgaggcccucucccagcaccuccaguccucccuccacaaggagaagaccaucaagcaggccaugcgcaacgccaaggagcacguccgccuccucccccacuccgucugcucccccaaccccaacaccaccuccaccucccaguccgccgccuccuccaacaacaccuacccccaccucuccugcuucuccaugaaguccuggcccaacauccucuuccaggccuccgcccgccgcgccgccuccccccccuccuccccccccucccucucccuccccuccaccgucaccuccucccucugcuccaccuccggcguccagaccucccuccccaccgaguccugcuccgacgaguccgacuccgagcucucccagaagcucgaggaccucgacaacucccucgaggucaaggccaagcccgccuccggccucgacggcaacuucaacuccauccgcauggacauguucuccgucuga

SEQ ID NO: 51975 - RNA, 1302 nt, Artificial Sequence
  derived and/or modified sequence opt2 from ZFP1__Homo_sapiens__XP_011521223
augcacugcuacggcgccuucaagauguggcucuccuccgccuucaucguccucugccucugccccaagcuccagaagaugaacaagucccagggcuccgucuccuucaccgacgucaccgucgacuucacccaggaggagugggagcagcucgaccccucccagcgcauccucuacauggacgucaugcucgagaacuacuccaaccuccucuccgucgaggucuggaaggccgacgaccagauggagcgcgaccaccgcaaccccgacgagcaggcccgccaguuccucauccucaagaaccagacccccaucgaggagcgcggcgaccucuucggcaaggcccucaaccucaacaccgacuucgucucccuccgccagguccccuacaaguacgaccucuacgagaagacccucaaguacaacuccgaccuccucaacuccaaccgcuccuacgccggcaagcagaccgacgagugcaacgaguucggcaaggcccuccucuaccucaagcaggagaagacccacuccggcgucgaguacuccgaguacaacaaguccggcaaggcccucucccacaaggccgccaucuucaagcaccagaagaucaagaaccucguccagcccuucaucugcaccuacugcgacaaggccuucuccuucaagucccuccucaucucccacaagcgcauccacaccggcgagaagcccuacgagugcaacgucugcaagaagaccuucucccacaaggccaaccucaucaagcaccagcgcauccacaccggcgagaagcccuucgagugccccgagugcggcaaggccuucacccaccaguccaaccucaucguccaccagcgcgcccacauggagaagaagcccuacgagugcuccgagugcggcaagaccuucgcccagaaguucgagcucaccacccaccagcgcauccacaccggcgagcgccccuacgagugcaacgagugcgccaagaccuucuucaagaaguccaaccucaucauccaccagaagauccacaccggcgagaagcgcuacgagugcuccgagugcggcaaguccuucauccagaacucccagcucaucauccacaugcgcacccacaccggcgagaagcccuacgagugcaccgagugcggcaagaccuucucccagcgcuccacccuccgccuccaccuccgcauccacaccggcgagaagcccuacgagugcuccgagugcggcaaggccuucucccgcaagucccgccucuccguccaccagcgcguccacaucggcgagaagcccuga

SEQ ID NO: 51976 - RNA, 1560 nt, Artificial Sequence
  derived and/or modified sequence opt2 from ZFP30__Homo_sapiens__NP_055713
auggcccgcgaccucgucauguuccgcgacgucgccgucgacuucucccaggaggagugggagugccucaacuccuaccagcgcaaccucuaccgcgacgucauccucgagaacuacuccaaccucgucucccucgccggcugcuccaucuccaagcccgacgucaucacccuccucgagcagggcaaggagcccuggauggucguccgcgacgagaagcgccgcuggacccucgaccucgagucccgcuacgacaccaagaagcucuuccagggcaaggacaucuacgagaugaaccucucccaguggaaggucauggagcgcaucaaguccugcggccucgaggagcaggaguccccccacgaggucugcuuccgccaggucaccaagaccaccuccgagaagaugcccaccuaccgcaagcucaccucccucccccucuaccagaagucccacaaccgcgagaagcccuacgagugcggcgagugcggcaaggccuuccgcguccgccagcagcucaccuuccaccagcgcauccacaccggcgagaagcccuacgagugcaaggagugcggcaaggccuuccgccagugcgcccaccucucccgccaccagcgcauccacaccuccgacaagcucuacgagugcaagaagugcggcaagaucuucaccugcggcuccgaccuccgcguccaccagcgcauccacaucggcgagaagcccuacgagugcaaggagugcggcaaggccuuccgcguccgcggccagcucaaccuccaccagcgcauccacaccggcgagaagcccuacgagugcaaggagugcggcaaggccuuccgccaguacgcccaccucacccgccaccagcgccucaacaucgccgagaagugcuacgagugcaaggagugcggccaggccuuccucugcuccaccggccuccgccuccaccacaagcuccacaccggcgagaagcccuacgagugcaaggagugcggcaaggccuuccgcguccgccagcagcucacccuccaccagcgcauccacaccggcgagaagcccuacgacugcaaggagugcggcaagaccuucucccgcggcuaccaccucacccuccaccagcgcauccacaccggcgagaagcccuacgagugcaaggagugccagaaguucuuccgccgcuacuccgagcucaucucccaccagggcauccacaucggcgagaagcccuacgagugcaaggagugcggcaaggccuuccgccucuucucccagcucacccagcaccaguccauccacuucggcgagaagcccuucaagugcaaggagugcgagaagaccuuccgccuccucucccagcucacccagcaccaguccauccacaccggcgagaagcccuacgacugcaaggagugcggcaaggccuuccgccuccacuccucccucauccagcaccagcgcauccacuccggcgagaagcccuacaagugcaaggagugcaagaaggccuuccgccagcacucccaccucaccuaccaccagcgcauccacaacgucaccuga

SEQ ID NO: 51977 - RNA, 999 nt, Artificial Sequence
  derived and/or modified sequence opt2 from ZFP36__Homo_sapiens__NP_003398
auggccaaccgcuacaccauggaccucaccgccaucuacgagucccuccucucccucucccccgacguccccguccccuccgaccacggcggcaccgaguccucccccggcuggggcuccuccggccccuggucccucucccccuccgacuccucccccuccggcgucaccucccgccuccccggccgcuccaccucccucgucgagggccgcuccugcggcugggucccccccccccccggcuucgccccccucgccccccgccucggccccgagcucucccccucccccaccucccccaccgccaccuccaccacccccucccgcuacaagaccgagcucugccgcaccuucuccgaguccggccgcugccgcuacggcgccaagugccaguucgcccacggccucggcgagcuccgccaggccaaccgccaccccaaguacaagaccgagcucugccacaaguucuaccuccagggccgcugccccuacggcucccgcugccacuucauccacaaccccuccgaggaccucgccgcccccggccacccccccguccuccgccaguccaucuccuucuccggccuccccuccggccgccgcaccuccccccccccccccggccucgccggccccucccucuccuccuccuccuucucccccuccuccuccccccccccccccggcgaccucccccucucccccuccgccuucuccgccgcccccggcaccccccucgcccgccgcgaccccacccccgucugcugccccuccugccgccgcgccacccccaucuccgucuggggcccccucggcggccucguccgcacccccuccguccagucccucggcuccgaccccgacgaguacgccuccuccggcuccucccucggcggcuccgacucccccgucuucgaggccggcgucuucgcccccccccagcccgucgccgccccccgccgccuccccaucuucaaccgcaucuccgucuccgaguga

SEQ ID NO: 51978 - RNA, 1224 nt, Artificial Sequence
  derived and/or modified sequence opt2 from ZFP36L1__Homo_sapiens__NP_001231630
augggccgcgcccgcaaguccggccucggccagcgcucccgccccaccgccucccgcuccgaggccgccguccagcccggcguccgcaaggcccgcggcgccggcaacuggcgcgucggccuccagaccggcgaggccgcccccuccccccaccgcgaccuccgcgacacccccgacccccgccccuggcucgcccgcacccaccgcaugaccaccacccucgucuccgccaccaucuucgaccucuccgagguccucugcaagggcaacaagaugcucaacuacuccgcccccuccgccggcggcugccuccucgaccgcaaggccgucggcacccccgccggcggcggcuucccccgccgccacuccgucacccuccccuccuccaaguuccaccagaaccagcuccucuccucccucaagggcgagcccgcccccgcccucuccucccgcgacucccgcuuccgcgaccgcuccuucuccgagggcggcgagcgccuccuccccacccagaagcagcccggcggcggccaggucaacuccucccgcuacaagaccgagcucugccgccccuucgaggagaacggcgccugcaaguacggcgacaagugccaguucgcccacggcauccacgagcuccgcucccucacccgccaccccaaguacaagaccgagcucugccgcaccuuccacaccaucggcuucugccccuacggcccccgcugccacuucauccacaacgccgaggagcgccgcgcccucgccggcgcccgcgaccucuccgccgaccgcccccgccuccagcacuccuucuccuucgccggcuuccccuccgccgccgccaccgccgccgccaccggccuccucgacucccccaccuccaucacccccccccccauccucuccgccgacgaccuccucggcucccccacccuccccgacggcaccaacaaccccuucgccuucuccucccaggagcucgccucccucuucgcccccuccaugggccuccccggcggcggcucccccaccaccuuccucuuccgccccauguccgaguccccccacauguucgacuccccccccuccccccaggacucccucuccgaccaggagggcuaccucuccuccuccuccuccucccacuccggcuccgacucccccacccucgacaacucccgccgccuccccaucuucucccgccucuccaucuccgacgacuga

SEQ ID NO: 51979 - RNA, 1485 nt, Artificial Sequence
  derived and/or modified sequence opt2 from ZFP36L2__Homo_sapiens__NP_008818
auguccaccacccuccucuccgccuucuacgacgucgacuuccucugcaagaccgagaagucccucgccaaccucaaccucaacaacaugcucgacaagaaggccgucggcacccccgucgccgccgcccccuccuccggcuucgcccccggcuuccuccgccgccacuccgccuccaaccuccacgcccucgcccaccccgcccccucccccggcuccugcucccccaaguuccccggcgccgccaacggcuccuccugcggcuccgccgccgccggcggccccaccuccuacggcacccucaaggagcccuccggcggcggcggcaccgcccuccucaacaaggagaacaaguuccgcgaccgcuccuucuccgagaacggcgaccgcucccagcaccuccuccaccuccagcagcagcagaagggcggcggcggcucccagaucaacuccacccgcuacaagaccgagcucugccgccccuucgaggaguccggcaccugcaaguacggcgagaagugccaguucgcccacggcuuccacgagcuccgcucccucacccgccaccccaaguacaagaccgagcucugccgcaccuuccacaccaucggcuucugccccuacggcccccgcugccacuucauccacaacgccgacgagcgccgccccgcccccuccggcggcgccuccggcgaccuccgcgccuucggcacccgcgacgcccuccaccucggcuucccccgcgagccccgccccaagcuccaccacucccucuccuucuccggcuuccccuccggccaccaccagccccccggcggccucgaguccccccuccuccucgacucccccaccucccgcaccccccccccccccuccugcuccuccgccuccuccugcuccuccuccgccuccuccugcuccuccgccuccgccgccuccacccccuccggcgcccccaccugcugcgccuccgccgccgccgccgccgccgccgcccuccucuacggcaccggcggcgccgaggaccuccucgcccccggcgcccccugcgccgccugcuccuccgccuccugcgccaacaacgccuucgccuucggccccgagcucuccucccucaucaccccccucgccauccagacccacaacuucgccgccgucgccgccgccgccuacuaccgcucccagcagcagcagcagcagcagggccucgccccccccgcccagccccccgccccccccuccgccacccuccccgccggcgccgccgccccccccuccccccccuucuccuuccagcucccccgccgccucuccgacucccccgucuucgacgccccccccuccccccccgacucccucuccgaccgcgacuccuaccucuccggcucccucuccuccggcucccucuccggcuccgagucccccucccucgaccccggccgccgccuccccaucuucucccgccucuccaucuccgacgacuga

SEQ ID NO: 51980 - RNA, 1938 nt, Artificial Sequence
  derived and/or modified sequence opt2 from ZFP37__Homo_sapiens__NP_001269444
auguccgucuccuccggcguccagauccucaccaagcccgagaccgucgaccgccgccgcuccgccgagaccaccaaggaggccggccgcccccucgagauggccgucuccgagcccgaggccuccgccgccgucuccgucaccuucaagcacgucaccauggccuucacccagaaggaguggaagcagcucgaccccgcccaguccaaccucuacaacgacgucaugcucgagaacuacugcaaccaggccuccaugggcugccaggcccccaagcccgacaugaucuccaagcucgagaagggcgaggcccccuggcucggcaagggcaagcgccccucccagggcugccccuccaagaucgcccgccccaagcagaaggagaccgacggcaagguccagaaggacgacgaccagcucgagaacauccagaagucccagaacaagcuccuccgcgaggucgccgucaagaagaagacccaggccaagaagaacggcuccgacugcggcucccucggcaagaagaacaaccuccacaagaagcacguccccuccaagaagcgccuccucaaguucgaguccugcggcaagauccucaagcagaaccucgaccuccccgaccacucccgcaacugcgucaagcgcaaguccgacgccgccaaggagcacaagaaguccuucaaccacucccucuccgacacccgcaagggcaagaagcagaccggcaagaagcacgagaagcucuccucccacuccuccuccgacaagugcaacaagaccggcaagaagcacgacaagcucugcugccacuccuccucccacaucaagcaggacaagauccagaccggcgagaagcacgagaagucccccucccucuccuccuccaccaagcacgagaagccccaggccugcgucaagcccuacgagugcaaccagugcggcaagguccucucccacaagcagggccucaucgaccaccagcgcguccacaccggcgagaagcccuacgagugcaacgagugcggcaucgccuucucccagaagucccaccucgucguccaccagcgcacccacaccggcgagaagcccuacgagugcauccagugcggcaaggcccacggccacaagcacgcccucaccgaccaccuccgcauccacaccggcgagaagcccuacgagugcgccgagugcggcaagaccuuccgccacuccuccaaccucauccagcacguccgcucccacaccggcgagaagcccuacgagugcaaggagugcggcaaguccuuccgcuacaacuccucccucaccgagcacguccgcacccacaccggcgagauccccuacgagugcaacgagugcggcaaggccuucaaguacuccuccucccucaccaagcacaugcgcauccacaccggcgagaagcccuucgagugcaacgagugcggcaaggccuucuccaagaagucccaccucaucauccaccagcgcacccacaccaaggagaagcccuacaagugcaacgagugcggcaaggccuucggccacuccuccucccucaccuaccacaugcgcacccacaccggcgagucccccuucgagugcaaccagugcggcaagggcuucaagcagaucgagggccucacccagcaccagcgcguccacaccggcgagaagcccuacgagugcaacgagugcggcaaggccuucucccagaagucccaccucaucguccaccagcgcacccacaccggcgagaagcccuacgagugcaacgagugcgagaaggccuucaacgccaagucccagcucgucauccaccagcgcucccacaccggcgagaagcccuacgagugcaacgagugcggcaagaccuucaagcagaacgccucccucaccaagcacgucaagacccacuccgaggacaagucccacgaguga

SEQ ID NO: 51981 - RNA, 933 nt, Artificial Sequence
  derived and/or modified sequence opt2 from ZFP42__Homo_sapiens__NP_001291287
augucccagcagcucaagaagcgcgccaagacccgccaccagaagggccucggcggccgcgcccccuccggcgccaagccccgccagggcaaguccucccaggaccuccaggccgagaucgagcccgucuccgccgucugggcccucugcgacggcuacgucugcuacgagcccggcccccaggcccucggcggcgacgacuucuccgacugcuacaucgagugcgucauccgcggcgaguucucccagcccauccucgaggaggacucccucuucgagucccucgaguaccucaagaagggcuccgagcagcagcucucccagaaggucuucgaggccuccucccucgagugcucccucgaguacaugaagaagggcgucaagaaggagcucccccagaagaucgucggcgagaacucccucgaguacuccgaguacaugaccggcaagaagcucccccccggcggcauccccggcaucgaccucuccgaccccaagcagcucgccgaguucgcccgcaagaagccccccaucaacaaggaguacgacucccucuccgccaucgccugcccccaguccggcugcacccgcaagcuccgcaaccgcgccgcccuccgcaagcaccuccucauccacggcccccgcgaccacgucugcgccgagugcggcaaggccuucgucgaguccuccaagcucaagcgccacuuccucguccacaccggcgagaagcccuuccgcugcaccuucgagggcugcggcaagcgcuucucccucgacuucaaccuccgcacccacguccgcauccacaccggcgagaagcgcuucgucugccccuuccagggcugcaaccgccgcuucauccaguccaacaaccucaaggcccacauccucacccacgccaacaccaacaagaacgagcaggagggcaaguga

SEQ ID NO: 51982 - RNA, 1395 nt, Artificial Sequence
  derived and/or modified sequence opt2 from ZFP57__Homo_sapiens__XP_006715150
auguccgagaccuucaagaaccucaccuccgucgcccgcaucuuccuccacaagcccgagcucaucaccaagcucgagcaggaggaggagcaguggcgcgaguucguccaccuccccaacaccgagggccucuccgagggcaagaagaaggagcuccgcgagcagcaccccucccuccgcgacgagggcaccuccgacgacaaggucuuccucgccugccgcggcgccggccagugcccccucuccgcccccgccggcaccauggaccgcacccgcguccuccaggccucccaggccggcccccccuucuucugcuacaccugcggcaagugcuucucccgccgcuccuaccucuacucccaccaguucguccacaaccccaagcucaccaacuccugcucccagugcggcaagcucuuccgcucccccaagucccucuccuaccaccgccgcaugcaccucggcgagcgccccuucugcugcacccucugcgacaagaccuacugcgacgccuccggccucucccgccaccgccgcguccaccucggcuaccgcccccacuccugcuccgucugcggcaaguccuuccgcgaccaguccgagcucaagcgccaccagaagauccaccagaaccaggagcccgucgacggcaaccaggagugcacccuccgcauccccggcacccaggccgaguuccagacccccaucgcccgcucccagcgcuccauccagggccuccucgacgucaaccacgcccccgucgcccgcucccaggagcccaucuuccgcaccgagggccccauggcccagaaccaggccuccguccucaagaaccaggcccccgucacccgcacccaggcccccaucaccggcacccucugccaggacgcccgcuccaacucccaccccgucaagcccucccgccucaacgucuucugcugcccccacugcucccucaccuucuccaagaaguccuaccucucccgccaccagaaggcccaccucaccgagccccccaacuacugcuuccacugcuccaaguccuucuccuccuucucccgccucguccgccaccagcagacccacuggaagcagaaguccuaccucugccccaucugcgaccucuccuucggcgagaaggagggccucauggaccacuggcgcggcuacaagggcaaggaccucugccaguccucccaccacaagugccgcgucauccucggccaguggcucggcuucucccacgacguccccaccauggccggcgaggaguggaagcacggcggcgaccagucccccccccgcauccacaccccccgccgccgcggccuccgcgagaaggccugcaagggcgacaagaccaaggaggccgucuccauccucaagcacaaguga

SEQ ID NO: 51983 - RNA, 2046 nt, Artificial Sequence
  derived and/or modified sequence opt2 from ZFP64__Homo_sapiens__NP_060667
augaacgccuccuccgagggcgaguccuucgccggcuccguccagauccccggcggcaccaccguccucgucgagcucacccccgacauccacaucugcggcaucugcaagcagcaguucaacaaccucgacgccuucgucgcccacaagcaguccggcugccagcucaccggcaccuccgccgccgcccccuccaccguccaguucgucuccgaggagaccguccccgccacccagacccagaccaccacccgcaccaucaccuccgagacccagaccaucaccgucuccgcccccgaguucgucuucgagcacggcuaccagaccuaccuccccaccgaguccaacgagaaccagaccgccaccgucaucucccuccccgccaagucccgcaccaagaagcccaccaccccccccgcccagaagcgccucaacugcugcuaccccggcugccaguucaagaccgccuacggcaugaaggacauggagcgccaccucaagauccacaccggcgacaagccccacaagugcgaggucugcggcaagugcuucucccgcaaggacaagcucaagacccacaugcgcugccacaccggcgucaagcccuacaagugcaagaccugcgacuacgccgccgccgacuccuccucccucaacaagcaccuccgcauccacuccgacgagcgccccuucaagugccagaucugccccuacgccucccgcaacuccucccagcucaccguccaccuccgcucccacaccggcgacgcccccuuccagugcuggcucugcuccgccaaguucaagaucuccuccgaccucaagcgccacaugcgcguccacuccggcgagaagcccuucaagugcgaguucugcaacguccgcugcaccaugaagggcaaccucaagucccacauccgcaucaagcacuccggcaacaacuucaagugcccccacugcgacuuccucggcgacuccaaggccacccuccgcaagcacucccgcguccaccaguccgagcaccccgagaagugcuccgagugcuccuacuccugcuccuccaaggccgcccuccgcauccacgagcgcauccacugcaccgaccgccccuucaagugcaacuacugcuccuucgacaccaagcagcccuccaaccucuccaagcacaugaagaaguuccacggcgacauggucaagaccgaggcccucgagcgcaaggacaccggccgccaguccucccgccaggucgccaagcucgacgccaagaaguccuuccacugcgacaucugcgacgccuccuucaugcgcgaggacucccuccgcucccacaagcgccagcacuccgaguacuccgaguccaagaacuccgacgucaccguccuccaguuccagaucgaccccuccaagcagcccgccaccccccucaccgucggccaccuccaggucccccuccagcccucccaggucccccaguucuccgagggccgcgucaagaucaucgucggccaccaggucccccaggccaacaccaucguccaggccgccgccgccgccgucaacaucgucccccccgcccucgucgcccagaaccccgaggagcuccccggcaacucccgccuccagauccuccgccaggucucccucaucgcccccccccaguccucccgcugccccuccgaggccggcgccaugacccagcccgccguccuccucaccacccacgagcagaccgacggcgccacccuccaccagacccucauccccaccgccuccggcggcccccaggagggcuccggcaaccagaccuucaucaccuccuccggcaucaccugcaccgacuucgagggccucaacgcccucauccaggagggcaccgccgaggucaccgucgucuccgacggcggccagaacaucgccgucgccaccaccgccccccccgucuucuccuccuccucccagcaggagcuccccaagcagaccuacuccaucauccagggcgccgcccaccccgcccuccucugccccgccgacuccauccccgacuga

SEQ ID NO: 51984 - RNA, 1599 nt, Artificial Sequence
  derived and/or modified sequence opt2 from ZFP82__Homo_sapiens__NP_597723
auggcccuccgcuccgucauguucuccgacgucuccaucgacuucucccccgaggagugggaguaccucgaccucgagcagaaggaccucuaccgcgacgucaugcucgagaacuacuccaaccucgucucccucggcugcuucaucuccaagcccgacgucaucuccucccucgagcagggcaaggagcccuggaaggucguccgcaagggccgccgccaguaccccgaccucgagaccaaguacgagaccaagaagcucucccucgagaacgacaucuacgagaucaaccucucccaguggaagaucauggagcgcaucgagaaccacggccucaagggccucauccucaagaacgacugggaguccaccggcaagaucgagggccaggagcgcccccaggagggcuacuucuccuccgucaagaugcccuccgagaaggucuccuccuaccagaagcgcaccuccgucaccccccaccagcgccuccacuucgucgacaagcccuacgagugcaaggagugcggcaaggccuuccgcguccgccagcagcucaccuuccaccaccgcauccacaccggcgagaagcccuacgagugcaaggagugcggcauggccuuccgccagaccgcccaccucacccgccaccagcgccuccacuccggcgagaagcucuacgagugcaaggagugcggcgaggccuucaucugcggcgccgaccuccgcguccaccagaagaugcacaucggcgagaagcccuacgagugcaaggagugcggcaaggccuuccgcguccgcggccagcucacccuccaccagcgcauccacaccggcgagaagcccuacgucugcaaggagugcggcaaggccuuccgccaguacgcccaccucacccgccaccagaagcucaacuccgccgaccgccucuacgagugcaaggagugcggcaaggccuuccucugcggcuccggccuccgcguccaccacaagcuccacaccggcgagaagcccuacgagugcaaggagugcggcaaggccuuccgcguccgccagcagcucacccuccaccagcgcauccacaccggcgagaagcccuacgagugcaaggagugcggcaagaccuucucccgcggcuaccaccucauccuccaccaccgcauccacaccggcgagaagcccuacgagugcaaggagugcuggaaggccuucucccgcuacucccagcucaucucccaccaguccauccacaucggcgucaagcccuacgacugcaaggagugcggcaaggccuuccgccuccucucccagcucacccagcaccaguccauccacaucggcgagaagcccuacaagugcaaggagugcggcaaggccuuccgccuccgccagaagcucacccuccaccaguccauccacaccggcgagaagcccuucgagugcaaggagugccgcaaggccuuccgccucaacuccucccucauccagcaccuccgcauccacuccggcgagaagcccuacgagugcaaggagugcaagaaggccuuccgccagcacucccaccucacccaccaccucaagauccacaacgucaagaucuga

SEQ ID NO: 51985 - RNA, 1713 nt, Artificial Sequence
  derived and/or modified sequence opt2 from ZFP91__Homo_sapiens__NP_444251
augcccggcgagaccgaggagccccgcccccccgagcagcaggaccaggagggcggcgaggccgccaaggccgcccccgaggagccccagcagcgcccccccgaggccgucgccgccgcccccgccggcaccaccuccucccgcguccuccgcggcggccgcgaccgcggccgcgccgccgccgccgccgccgccgccgccgucucccgccgccgcaaggccgaguacccccgccgccgccgcuccucccccuccgcccgcccccccgacguccccggccagcagccccaggccgccaagucccccucccccguccagggcaagaaguccccccgccuccucugcaucgagaaggucaccaccgacaaggaccccaaggaggagaaggaggaggaggacgacuccgcccucccccaggaggucuccaucgccgccucccgccccucccgcggcuggcgcuccucccgcaccuccgucucccgccaccgcgacaccgagaacacccgcuccucccgcuccaagaccggcucccuccagcucaucugcaaguccgagcccaacaccgaccagcucgacuacgacgucggcgaggagcaccagucccccggcggcaucuccuccgaggaggaggaggaggaggaggaggagaugcucaucuccgaggaggagauccccuucaaggacgacccccgcgacgagaccuacaagccccaccucgagcgcgagacccccaagccccgccgcaaguccggcaaggucaaggaggagaaggagaagaaggagaucaaggucgaggucgaggucgaggucaaggaggaggagaacgagauccgcgaggacgaggagcccccccgcaagcgcggccgccgccgcaaggacgacaaguccccccgccuccccaagcgccgcaagaagccccccauccaguacguccgcugcgagauggagggcugcggcaccguccucgcccacccccgcuaccuccagcaccacaucaaguaccagcaccuccucaagaagaaguacgucugcccccaccccuccugcggccgccucuuccgccuccagaagcagcuccuccgccacgccaagcaccacaccgaccagcgcgacuacaucugcgaguacugcgcccgcgccuucaaguccucccacaaccucgccguccaccgcaugauccacaccggcgagaagccccuccagugcgagaucugcggcuucaccugccgccagaaggccucccucaacuggcacaugaagaagcacgacgccgacuccuucuaccaguucuccugcaacaucugcggcaagaaguucgagaagaaggacuccgucgucgcccacaaggccaagucccaccccgagguccucaucgccgaggcccucgccgccaacgccggcgcccucaucaccuccaccgacauccucggcaccaaccccgagucccucacccagcccuccgacggccagggccucccccuccuccccgagccccucggcaacuccaccuccggcgagugccuccuccucgaggccgagggcauguccaaguccuacugcuccggcaccgagcgcgucucccucauggccgacggcaagaucuucgucggcuccggcuccuccggcggcaccgagggccucgucaugaacuccgacauccucggcgccaccaccgagguccucaucgaggacuccgacuccgccggccccuga

SEQ ID NO: 51986 - RNA, 3021 nt, Artificial Sequence
  derived and/or modified sequence opt2 from ZFPM1__Homo_sapiens__NP_722520
augucccgccgcaagcaguccaacccccgccagaucaagcgcucccucggcgacauggaggcccgcgaggagguccagcucgucggcgccucccacauggagcagaaggccaccgcccccgaggcccccuccccccccuccgccgacgucaacuccccccccccccuccccccccccaccucccccggcggccccaaggagcucgagggccaggagcccgagccccgccccaccgaggaggagcccggcucccccugguccggccccgacgagcucgagcccgucguccaggacggccagcgccgcauccgcgcccgccucucccucgccaccggccucuccuggggccccuuccacggcuccguccagacccgcgccuccuccccccgccaggccgagcccucccccgcccucacccuccuccucgucgacgaggccugcuggcuccgcacccucccccaggcccucaccgaggccgaggccaacaccgagauccaccgcaaggacgacgcccucuggugccgcgucaccaagcccguccccgccggcggccuccucuccguccuccucaccgccgagccccacuccacccccggccaccccgucaagaaggagcccgccgagcccaccugccccgcccccgcccacgaccuccagcuccucccccagcaggccggcauggccuccauccucgccaccgccgucaucaacaaggacgucuuccccugcaaggacugcggcaucugguaccgcuccgagcgcaaccuccaggcccaccuccucuacuacugcgccucccgccagggcaccggcucccccgccgccgccgccaccgacgagaagcccaaggagaccuaccccaacgagcgcgucugccccuucccccagugccgcaaguccugccccuccgccuccucccucgagauccacaugcgcucccacuccggcgagcgccccuucgucugccucaucugccucuccgccuucaccaccaaggccaacugcgagcgccaccucaagguccacaccgacacccucuccggcgucugccacuccugcggcuucaucuccaccacccgcgacauccucuacucccaccucgucaccaaccacauggucugccagcccggcuccaagggcgagaucuacucccccggcgccggccaccccgccaccaagcucccccccgacucccucggcuccuuccagcagcagcacaccgcccuccagggcccccucgccuccgccgaccucggccucgcccccacccccucccccggccucgaccgcaaggcccucgccgaggccaccaacggcgaggcccgcgccgagccccucgcccagaacggcggcuccuccgagccccccgccgccccccgcuccaucaaggucgaggccgucgaggagcccgaggccgcccccauccucggccccggcgagcccggcccccaggcccccucccgcacccccuccccccgcucccccgcccccgcccgcgucaaggccgagcucuccucccccacccccggcuccucccccguccccggcgagcucggccucgccggcgcccucuuccucccccaguacgucuucggccccgacgccgccccccccgccuccgagauccucgccaagauguccgagcucguccacucccgccuccagcagggcgccggcgccggcgccggcggcgcccagaccggccucuuccccggcgcccccaagggcgccaccugcuucgagugcgagaucaccuucuccaacgucaacaacuacuacguccacaagcgccucuacugcuccggccgccgcgcccccgaggacgcccccgccgcccgccgccccaaggccccccccggccccgcccgcgccccccccggccagcccgccgagcccgacgccccccgcuccucccccggccccggcgcccgcgaggagggcgccggcggcgccgccacccccgaggacggcgccggcggccgcggcuccgagggcucccagucccccggcuccuccgucgacgacgccgaggacgaccccucccgcacccucugcgaggccugcaacauccgcuucucccgccacgagaccuacaccguccacaagcgcuacuacugcgccucccgccacgacccccccccccgccgccccgccgccccccccggcccccccggccccgccgccccccccgcccccucccccgccgcccccguccgcacccgccgccgccgcaagcucuacgagcuccacgccgccggcgccccccccccccccccccccggccacgcccccgcccccgaguccccccgccccggcuccggcuccggcuccggccccggccucgcccccgcccgcucccccggccccgccgccgacggccccaucgaccucuccaagaagccccgccgcccccuccccggcgcccccgcccccgcccucgccgacuaccacgagugcaccgccugccgcgucuccuuccacucccucgaggccuaccucgcccacaagaaguacuccugccccgccgcccccccccccggcgcccucggccuccccgccgccgccugccccuacugcccccccaacggccccguccgcggcgaccuccucgagcacuuccgccucgcccacggccuccuccucggcgccccccucgccggccccggcgucgaggcccgcacccccgccgaccgcggccccucccccgcccccgcccccgccgccuccccccagcccggcucccgcggcccccgcgacggccucggccccgagccccaggagcccccccccggccccccccccucccccgccgccgcccccgaggccgucccccccccccccgccccccccuccuacuccgacaagggcguccagacccccuccaagggcacccccgccccccuccccaacggcaaccaccgcuacugccgccucugcaacaucaaguucuccucccucuccaccuucaucgcccacaagaaguacuacugcuccucccacgccgccgagcacgucaaguga

SEQ ID NO: 51987 - RNA, 3456 nt, Artificial Sequence
  derived and/or modified sequence opt2 from ZFPM2__Homo_sapiens__NP_036214
augucccgccgcaagcaguccaagccccgccagaucaagcgcccccucgaggacgccaucgaggacgaggaggaggagugccccuccgaggagaccgacaucaucuccaagggcgacuucccccucgaggaguccuucuccaccgaguucggccccgagaaccucuccugcgaggaggucgaguacuucugcaacaagggcgacgacgagggcauccaggagaccgccgaguccgacggcgacacccaguccgagaagcccggccagcccggcgucgagaccgacgacugggacggccccggcgagcucgaggucuuccagaaggacggcgagcgcaagauccagucccgccagcagcuccccgucggcaccaccuggggccccuuccccggcaagauggaccucaacaacaacucccucaagaccaaggcccagguccccaugguccucaccgccggccccaaguggcuccucgacgucaccuggcagggcgucgaggacaacaagaacaacugcaucgucuacuccaagggcggccagcucuggugcaccaccaccaaggccaucuccgagggcgaggagcucaucgccuucgucgucgacuucgacucccgccuccaggccgccucccagaugacccucaccgagggcauguaccccgcccgccuccucgacuccauccagcuccucccccagcaggccgccauggccuccauccuccccaccgccaucgucaacaaggacaucuuccccugcaaguccugcggcaucugguaccgcuccgagcgcaaccuccaggcccaccucauguacuacugcuccggccgccagcgcgaggccgcccccgucuccgaggagaacgaggacuccgcccaccagaucuccucccucugccccuucccccagugcaccaaguccuucuccaacgcccgcgcccucgagaugcaccucaacucccacuccggcgucaagauggaggaguuccucccccccggcgccucccucaagugcaccgucugcuccuacaccgccgacuccgucaucaacuuccaccagcaccucuucucccaccucacccaggccgccuuccgcugcaaccacugccacuucggcuuccagacccagcgcgagcuccuccagcaccaggagcuccacguccccuccggcaagcucccccgcgaguccgacauggagcacucccccuccgccaccgaggacucccuccagcccgccaccgaccuccucacccgcuccgagcucccccagucccagaaggccaugcagaccaaggacgccuccuccgacaccgagcucgacaagugcgagaagaagacccagcucuuccucaccaaccagcgccccgagauccagcccaccaccaacaagcaguccuucuccuacaccaagaucaaguccgagcccuccuccccccgccucgccuccucccccguccagcccaacaucggccccuccuuccccgucggccccuuccucucccaguucuccuucccccaggacaucaccauggucccccaggccuccgagauccucgccaagauguccgagcucguccaccgccgccuccgccacggcuccuccuccuacccccccgucaucuacuccccccucaugcccaagggcgccaccugcuucgagugcaacaucaccuucaacaaccucgacaacuaccucguccacaagaagcacuacugcuccucccgcuggcagcagauggccaagucccccgaguuccccuccgucuccgagaagaugcccgaggcccucucccccaacaccggccagaccuccaucaaccuccucaaccccgccgcccacuccgccgaccccgagaacccccuccuccagaccuccugcaucaacuccuccaccguccucgaccucaucggccccaacggcaagggccacgacaaggacuucuccacccagaccaagaagcucuccaccuccuccaacaacgacgacaagaucaacggcaagcccgucgacgucaagaaccccuccgucccccucgucgacggcgaguccgaccccaacaagaccaccugcgaggccugcaacaucaccuucucccgccacgagaccuacaugguccacaagcaguacuacugcgccacccgccacgaccccccccucaagcgcuccgccuccaacaagguccccgccaugcagcgcaccaugcgcacccgcaagcgccgcaagauguacgagaugugccuccccgagcaggagcagcgccccccccucguccagcagcgcuuccucgacgucgccaaccucaacaaccccugcaccuccacccaggagcccaccgagggccucggcgagugcuaccacccccgcugcgacaucuuccccggcaucgucuccaagcaccucgagaccucccucaccaucaacaagugcguccccgucuccaagugcgacaccacccacuccuccgucuccugccucgagauggacguccccaucgaccucuccaagaagugccucucccaguccgagcgcaccaccaccucccccaagcgccuccucgacuaccacgagugcaccgucugcaagaucuccuucaacaaggucgagaacuaccucgcccacaagcagaacuucugccccgucaccgcccaccagcgcaacgaccucggccagcucgacggcaaggucuuccccaaccccgaguccgagcgcaacucccccgacgucuccuacgagcgcuccaucaucaagugcgagaagaacggcaaccucaagcagcccucccccaacggcaaccucuucuccucccaccucgccacccuccagggccucaaggucuucuccgaggccgcccagcucaucgccaccaaggaggagaaccgccaccucuuccucccccagugccucuaccccggcgccaucaagaaggccaagggcgccgaccagcucucccccuacuacggcaucaagcccuccgacuacaucuccggcucccucgucauccacaacaccgacaucgagcagucccgcaacgccgagaacgagucccccaagggccaggccuccuccaacggcugcgccgcccucaagaaggacucccucccccuccuccccaagaaccgcggcauggucaucgucaacggcggccucaagcaggacgagcgccccgccgccaacccccagcaggagaacaucucccagaacccccagcacgaggacgaccacaagucccccuccuggaucuccgagaacccccucgccgccaacgagaacgucucccccggcauccccuccgccgaggagcagcucuccuccaucgccaagggcgucaacggcuccucccaggcccccaccuccggcaaguacugccgccucugcgacauccaguucaacaaccucuccaacuucaucacccacaagaaguucuacugcuccucccacgccgccgagcacgucaaguga

SEQ ID NO: 51988 - RNA, 213 nt, Artificial Sequence
  derived and/or modified sequence opt2 from ZFR2__Homo_sapiens__NP_001139112
auggccaccucccaguacuucgacuucgcccagggcggcggcccccaguacucccccgaggucgagaccaccccccccgcccucgccuccggccuccccugcgcccuccccuggaccgucggcugcuccggcuccgacgccgucaccgcccucugccccucccuccgcggccucgccugcaucugcuccauccucugggaccccgccugguga

SEQ ID NO: 51989 - RNA, 3225 nt, Artificial Sequence
  derived and/or modified sequence opt2 from ZFR__Homo_sapiens__NP_057191
augauccccaucugccccgucgucuccuucaccuacguccccucccgccucggcgaggacgccaagauggccaccggcaacuacuucggcuucacccacuccggcgccgccgccgccgccgccgccgcccaguacucccagcagcccgccuccggcgucgccuacucccaccccaccaccgucgccuccuacaccguccaccaggcccccgucgccgcccacaccgucaccgccgccuacgcccccgccgccgccaccgucgccgucgcccgccccgcccccgucgccgucgccgccgccgccaccgccgccgccuacggcggcuaccccaccgcccacaccgccaccgacuacggcuacacccagcgccagcaggaggccccccccccccccccccccgccaccacccagaacuaccaggacuccuacuccuacguccgcuccaccgcccccgccgucgccuacgacuccaagcaguacuaccagcagcccaccgccaccgccgccgccgucgccgccgccgcccagccccagcccuccgucgccgagaccuacuaccagaccgcccccaaggccggcuacucccagggcgccacccaguacacccaggcccagcagacccgccaggucaccgccaucaagcccgccacccccucccccgccaccaccaccuucuccaucuaccccgucuccuccaccguccagcccgucgccgccgccgccaccgucguccccuccuacacccaguccgccaccuacuccaccaccgccgucaccuacuccggcaccuccuacuccggcuacgaggccgccgucuacuccgccgccuccuccuacuaccagcagcagcagcagcagcagaagcaggccgccgccgccgccgccgccgccgccgccaccgccgccuggaccggcaccaccuucaccaagaaggcccccuuccagaacaagcagcucaagcccaagcagccccccaagcccccccagauccacuacugcgacgucugcaagaucuccugcgccggcccccagaccuacaaggagcaccucgagggccagaagcacaagaagaaggaggccgcccucaaggccucccagaacaccuccuccuccaacuccuccacccgcggcacccagaaccagcuccgcugcgagcucugcgacgucuccugcaccggcgccgacgccuacgccgcccacauccgcggcgccaagcaccagaaggucgucaagcuccacaccaagcucggcaagcccauccccuccaccgagcccaacgucgucucccaggccaccuccuccaccgccgucuccgccuccaagcccaccgccucccccuccuccaucgccgccaacaacugcaccgucaacaccuccuccgucgccaccuccuccaugaagggccucaccaccaccggcaacuccucccucaacuccaccuccaacaccaaggucuccgccguccccaccaacauggccgccaagaagaccuccacccccaagaucaacuucgucggcggcaacaagcuccaguccaccggcaacaaggccgaggacaucaagggcaccgagugcgucaaguccacccccgucaccuccgccguccagauccccgaggucaagcaggacaccgucuccgagcccgucacccccgccucccucgccgcccuccaguccgacguccagcccgucggccacgacuacgucgaggagguccgcaacgacgagggcaaggucauccgcuuccacugcaagcucugcgagugcuccuucaacgaccccaacgccaaggagaugcaccucaagggccgccgccaccgccuccaguacaagaagaaggucaaccccgaccuccaggucgaggucaagcccuccauccgcgcccgcaagauccaggaggagaagaugcgcaagcagaugcagaaggaggaguacuggcgccgccgcgaggaggaggagcgcuggcgcauggagaugcgccgcuacgaggaggacauguacuggcgccgcauggaggaggagcagcaccacugggacgaccgccgccgcaugcccgacggcggcuacccccacggcccccccggcccccucggccuccucggcguccgccccggcaugcccccccagccccagggccccgccccccuccgccgccccgacuccuccgacgaccgcuacgucaugaccaagcacgccaccaucuaccccaccgaggaggagcuccaggccguccagaagaucgucuccaucaccgagcgcgcccucaagcucgucuccgacucccucuccgagcacgagaagaacaagaacaaggagggcgacgacaagaaggagggcggcaaggaccgcgcccucaagggcguccuccgcgucggcguccucgccaagggccuccuccuccgcggcgaccgcaacgucaaccucguccuccucugcuccgagaagcccuccaagacccuccucucccgcaucgccgagaaccuccccaagcagcucgccgucaucucccccgagaaguacgacaucaagugcgccgucuccgaggccgccaucauccucaacuccugcgucgagcccaagaugcaggucaccaucacccucaccucccccaucauccgcgaggagaacaugcgcgagggcgacgucaccuccggcauggucaaggacccccccgacguccucgaccgccagaagugccucgacgcccucgccgcccuccgccacgccaagugguuccaggcccgcgccaacggccuccaguccugcgucaucaucauccgcauccuccgcgaccucugccagcgcguccccaccugguccgacuuccccuccugggccauggagcuccucgucgagaaggccaucuccuccgccuccuccccccagucccccggcgacgcccuccgccgcgucuucgagugcaucuccuccggcaucauccucaagggcucccccggccuccucgaccccugcgagaaggaccccuucgacacccucgccaccaugaccgaccagcagcgcgaggacaucaccuccuccgcccaguucgcccuccgccuccucgccuuccgccagauccacaagguccucggcauggacccccucccccagaugucccagcgcuucaacauccacaacaaccgcaagcgccgccgcgacuccgacggcgucgacggcuucgaggccgagggcaagaaggacaagaaggacuacgacaacuucuga

SEQ ID NO: 51990 - RNA, 1731 nt, Artificial Sequence
  derived and/or modified sequence opt2 from ZFX__Homo_sapiens__NP_001171557
augaccauggacaccgaguccgagaucgaccccugcaaggucgacggcaccugccccgaggucaucaaggucuacaucuucaaggccgaccccggcgaggacgaccucggcggcaccgucgacaucgucgaguccgagcccgagaacgaccacggcgucgagcuccucgaccagaacuccuccauccgcgucccccgcgagaagauggucuacaugaccgucaacgacucccagcccgaggacgaggaccucaacgucgccgagaucgccgacgaggucuacauggaggucaucgucggcgaggaggacgccgccgccgccgccgccgccgccgccguccacgagcagcagauggacgacaacgagaucaagaccuucaugcccaucgccugggccgccgccuacggcaacaacuccgacggcaucgagaaccgcaacggcaccgccuccgcccuccuccacaucgacgaguccgccggccucggccgccucgccaagcagaagcccaagaagcgccgccgccccgacucccgccaguaccagaccgccaucaucaucggccccgacggccacccccucaccgucuaccccugcaugaucugcggcaagaaguucaagucccgcggcuuccucaagcgccacaugaagaaccaccccgagcaccucgccaagaagaaguaccgcugcaccgacugcgacuacaccaccaacaagaagaucucccuccacaaccaccucgagucccacaagcucaccuccaaggccgagaaggccaucgagugcgacgagugcggcaagcacuucucccacgccggcgcccucuucacccacaagaugguccacaaggagaagggcgccaacaagaugcacaagugcaaguucugcgaguacgagaccgccgagcagggccuccucaaccgccaccuccucgccguccacuccaagaacuucccccacaucugcgucgagugcggcaagggcuuccgccaccccuccgagcucaagaagcacaugcgcauccacaccggcgagaagcccuaccagugccaguacugcgaguaccgcuccgccgacuccuccaaccucaagacccacgucaagaccaagcacuccaaggagaugcccuucaagugcgacaucugccuccucaccuucuccgacaccaaggagguccagcagcacgcccucauccaccaggaguccaagacccaccagugccuccacugcgaccacaaguccuccaacuccuccgaccucaagcgccacaucaucuccguccacaccaaggacuacccccacaagugcgacaugugcgacaagggcuuccaccgccccuccgagcucaagaagcacgucgccgcccacaagggcaagaagaugcaccagugccgccacugcgacuucaagaucgccgaccccuucguccucucccgccacauccucuccguccacaccaaggaccuccccuuccgcugcaagcgcugccgcaagggcuuccgccagcaguccgagcucaagaagcacaugaagacccacuccggccgcaaggucuaccagugcgaguacugcgaguacuccaccaccgacgccuccggcuucaagcgccacgucaucuccauccacaccaaggacuacccccaccgcugcgaguacugcaagaagggcuuccgccgccccuccgagaagaaccagcacaucaugcgccaccacaaggaggucggccuccccuga

SEQ ID NO: 51991 - RNA, 2175 nt, Artificial Sequence
  derived and/or modified sequence opt2 from ZFY__Homo_sapiens__NP_001138747
auggacggcgaccagaucgucgucgagauccaggaggccgucuucgucuccaacaucgucgacuccgacaucaccguccacaacuucguccccgacgaccccgacuccgucgucauccaggacgucgucgaggacgucgucaucgaggaggacguccagugcuccgacauccucgaggaggccgacgucuccgagaacgucaucauccccgagcagguccucgacuccgacgucaccgaggaggucucccucccccacugcaccguccccgacgacguccucgccuccgacaucaccuccaccuccauguccaugcccgagcacguccucaccuccgaguccaugcacgucugcgacaucggccacgucgagcacaugguccacgacuccgucgucgaggccgagaucaucaccgacccccucaccuccgacaucgucuccgaggagguccucgucgccgacugcgcccccgaggccgucaucgacgccuccggcaucuccgucgaccagcaggacaacgacaaggccuccugcgaggacuaccucaugaucucccucgacgacgccggcaagaucgagcacgacggcuccaccggcgucaccaucgacgccgaguccgagauggaccccugcaaggucgacuccaccugccccgaggucaucaaggucuacaucuucaaggccgaccccggcgaggacgaccucggcggcaccgucgacaucgucgaguccgagcccgagaacgaccacggcgucgagcuccucgaccagaacuccuccauccgcgucccccgcgagaagauggucuacaugaccgucaacgacucccagcaggaggacgaggaccucuccaacaacuccgacggcaucgagaaccgcaacggcaccgccuccgcccuccuccacaucgacgaguccgccggccucggccgccucgccaagcagaagcccaagaagaagcgccgccccgacucccgccaguaccagaccgccaucaucaucggccccgacggccacccccucaccgucuaccccugcaugaucugcggcaagaaguucaagucccgcggcuuccucaagcgccacaugaagaaccaccccgagcaccucgccaagaagaaguaccacugcaccgacugcgacuacaccaccaacaagaagaucucccuccacaaccaccucgagucccacaagcucaccuccaaggccgagaaggccaucgagugcgacgagugcggcaagcacuucucccacgccggcgcccucuucacccacaagaugguccacaaggagaagggcgccaacaagaugcacaagugcaaguucugcgaguacgagaccgccgagcagggccuccucaaccgccaccuccucgccguccacuccaagaacuucccccacaucugcgucgagugcggcaagggcuuccgccaccccuccgagcuccgcaagcacaugcgcauccacaccggcgagaagcccuaccagugccaguacugcgaguaccgcuccgccgacuccuccaaccucaagacccacaucaagaccaagcacuccaaggagaugcccuucaagugcgacaucugccuccucaccuucuccgacaccaaggagguccagcagcacacccucguccaccaggaguccaagacccaccagugccuccacugcgaccacaaguccuccaacuccuccgaccucaagcgccacgucaucuccguccacaccaaggacuacccccacaagugcgagaugugcgagaagggcuuccaccgccccuccgagcucaagaagcacgucgccguccacaagggcaagaagaugcaccagugccgccacugcgacuucaagaucgccgaccccuucguccucucccgccacauccucuccguccacaccaaggaccuccccuuccgcugcaagcgcugccgcaagggcuuccgccagcagaacgagcucaagaagcacaugaagacccacuccggccgcaaggucuaccagugcgaguacugcgaguacuccaccaccgacgccuccggcuucaagcgccacgucaucuccauccacaccaaggacuacccccaccgcugcgaguacugcaagaagggcuuccgccgccccuccgagaagaaccagcacaucaugcgccaccacaaggaggucggccuccccuga

SEQ ID NO: 51992 - RNA, 1416 nt, Artificial Sequence
  derived and/or modified sequence opt2 from ZFYVE19__Homo_sapiens__NP_001070736
augaacuacgacucccagcagcccccccuccccccccuccccuacgccggcugccgccgcgccuccggcuuccccgcccucggccgcggcggcaccguccccgucggcgucuggggcggcgccggccagggccgcgagggccgcuccuggggcgagggcccccgcggccccggccucggccgccgcgaccucuccuccgccgaccccgccguccucggcgccaccauggagucccgcugcuacggcugcgccgucaaguucacccucuucaagaaggaguacggcugcaagaacugcggccgcgccuucugcuccggcugccucuccuucuccgccgccgucccccgcaccggcaacacccagcagaaggucugcaagcagugccacgagguccucacccgcggcuccuccgccaacgccuccaaguggucccccccccagaacuacaagaagcgcgucgccgcccucgaggccaagcagaagcccuccaccucccagucccagggccucacccgccaggaccagaugaucgccgagcgccucgcccgccuccgccaggagaacaagcccaagcucguccccucccaggccgagaucgaggcccgccucgccgcccucaaggacgagcgccagggcuccauccccuccacccaggagauggaggcccgccucgccgcccuccagggccgcguccuccccucccagaccccccagcccgcccaccacacccccgacacccgcacccaggcccagcagacccaggaccuccucacccagcucgccgccgaggucgccaucgacgaguccuggaagggcggcggccccgccgccucccuccagaacgaccucaaccagggcggccccggcuccaccaacuccaagcgccaggccaacuggucccucgaggaggagaagucccgccuccucgccgaggccgcccucgagcuccgcgaggagaacacccgccaggagcgcauccucgcccucgccaagcgccucgccaugcuccgcggccaggaccccgagcgcgucacccuccaggacuaccgccuccccgacuccgacgacgacgaggacgaggagaccgccauccagcgcguccuccagcagcucaccgaggaggccucccucgacgaggccuccggcuucaacauccccgccgagcaggccucccgccccuggacccagccccgcggcgccgagcccgaggcccaggacgucgacccccgccccgaggccgaggaggaggagcuccccuggugcugcaucugcaacgaggacgccacccuccgcugcgccggcugcgacggcgaccucuucugcgcccgcugcuuccgcgagggccacgacgccuucgagcucaaggagcaccagaccuccgccuacucccccccccgcgccggccaggagcacuga

SEQ ID NO: 51993 - RNA, 759 nt, Artificial Sequence
  derived and/or modified sequence opt2 from ZFYVE21__Homo_sapiens__NP_001185882
auguccuccgaggucuccgcccgccgcgacgccaagaagcucguccgcucccccuccggccuccgcaugguccccgagcaccgcgccuucggcucccccuucggccucgaggagccccaguggguccccgacaaggagugccgccgcugcaugcagugcgacgccaaguucgacuuccucacccgcaagcaccacugccgccgcugcggcaagugcuucugcgaccgcugcugcucccagaaggucccccuccgccgcaugugcuucgucgaccccguccgccagugcgccgagugcgcccucgucucccucaaggaggccgaguucuacgacaagcagcucaagguccuccucuccggcgccaccuuccucgucaccuucggcaacuccgagaagcccgagaccaugaccugccgccucuccaacaaccagcgcuaccucuuccucgacggcgacucccacuacgagaucgagaucguccacaucuccaccguccagauccucaccgagggcuucccccccggcgagaaggacauccacgccuacaccucccuccgcggcucccagcccgccuccgagggcggcaacgcccgcgccaccggcauguuccuccaguacaccguccccggcaccgagggcgucacccagcucaagcucaccgucgucgaggacgucaccgucggccgccgccaggccgucgccuggcucgucgccaugcacaaggccgccaagcuccucuacgagucccgcgaccaguga

SEQ ID NO: 51994 - RNA, 7620 nt, Artificial Sequence
  derived and/or modified sequence opt2 from ZFYVE26__Homo_sapiens__NP_056161
augaaccaccccuucggcaaggaggaggccgccucccagaagcagcucuucggcuucuucugcgagugccuccgccgcggcgagugggagcucgcccaggccugcgucccccagcuccaggagggccagggcgacauccccaagcgcgucgaggacauccuccaggcccucgucgucugccccaaccuccuccgcugcggccaggacaucaacccccagcgcgucgccugggucuggcuccucguccucgagaaguggcucgcccgcgagaagaagcuccuccccgucgucuuccgccgcaagcucgaguuccuccuccucuccgaggaccuccagggcgacauccccgagaacauccucgaggagcucuacgagacccucacccagggcgccgucggccacguccccgacggcaacccccgccgcgaguccuggaccccccgccucuccuccgaggccgucuccguccucugggaccuccuccgccaguccccccagcccgcccaggcccuccucgagcuccuccucgaggaggacgacggcaccggccucugccacuggccccuccagaacgcccucgucgaccucauccgcaaggcccuccgcgcccuccagggccccgacuccgucccccccggcgucgucgacgccaucuacggcgcccuccgcacccuccgcugccccgccgagccccucggcgucgagcuccaccuccucugcgaggagcuccucgaggccugccgcaccgagggcuccccccuccgcgaggagcgccuccucuccugccuccuccacaaggccucccgcggccuccucucccucuacggccacaccuacgccgagaaggucaccgagaagcccccccgcgccaccgccuccggcaaggucucccccgaccaccucgaccccgagcgcgccaugcucgcccucuucuccaaccccaaccccgccgaggccuggaaggucgccuacuucuacugccucuccaacaacaagcacuuccucgagcagauccucgucaccgcccucacccuccucaaggaggaggacuuccccaaccucggcugccuccucgaccgcgaguuccgcccccucuccugccuccucguccuccucggcuggacccacugccagucccucgaguccgccaagcgccuccuccagacccuccaccgcacccagggccccggcugcgacgagcuccuccgcgacgccugcgacggccucugggcccaccucgagguccucgaguggugcauccagcaguccuccaaccccauccccaagcgcgaccuccucuaccaccuccacggcggcgacucccacuccguccucuacacccuccaccaccucaccaaccuccccgcccuccgcgaggaggacguccucaagcuccuccagaagguccccgccaaggacccccagcaggagcccgacgccgucgacgcccccguccccgagcaccucucccagugccagaaccucacccucuaccagggcuucugcgccaugaaguacgccaucuacgcccucugcgucaacucccaccagcacucccagugccaggacugcaaggacucccucuccgaggaccucgccuccgccaccgagcccgccaacgacucccucuccucccccggcgccgccaaccucuucuccaccuaccucgcccgcugccagcaguaccucugcuccauccccgacucccucugccucgagcuccucgagaacaucuucucccuccuccucaucaccuccgccgaccuccaccccgagccccaccuccccgaggacuacgccgaggacgacgacaucgagggcaagucccccuccggccuccgcucccccuccgaguccccccagcacaucgcccaccccgagcgcaaguccgagcgcggcucccucggcguccccaagacccucgccuacaccaugcccucccacgucaaggccgagcccaaggacuccuaccccggcccccaccgccacuccuuccucgaccucaagcacuucaccuccggcaucuccggcuuccucgccgacgaguucgccaucggcgccuuccuccgccuccuccaggagcagcucgacgagaucuccucccgcuccccccccgagaagcccaagcaggagucccaguccugcuccggcucccgcgacggccuccagucccgccuccaccgccucuccaaggucgucuccgaggcccaguggcgccacaaggucgucaccuccaaccaccgcuccgaggagcagcccucccgccgcuaccagcccgccacccgccaccccucccuccgccgcggccgccgcacccgccgcucccaggccgacggccgcgaccgcggcuccaaccccucccucgaguccaccuccuccgagcucuccaccuccaccuccgagggcucccucuccgccauguccggccgcaacgagcuccacucccgccuccacccccacccccaguccucccucauccccaugauguucuccccccccgagucccuccucgccuccugcauccuccgcggcaacuucgccgaggcccaccagguccucuucaccuucaaccucaaguccucccccuccuccggcgagcucauguucauggagcgcuaccaggaggucauccaggagcucgcccaggucgagcacaagaucgagaaccagaacuccgacgccggcuccuccaccauccgccgcaccggcuccggccgcuccacccuccaggccaucggcuccgccgccgccgccggcauggucuucuacuccaucuccgacgucaccgacaagcuccucaacaccuccggcgaccccauccccaugcuccaggaggacuucuggaucuccaccgcccucgucgagcccaccgccccccuccgcgagguccucgaggaccucuccccccccgccauggccgccuucgaccucgccugcucccagugccagcucuggaagaccugcaagcagcuccucgagaccgccgagcgccgccucaacuccucccucgagcgccgcggccgccgcaucgaccacguccuccucaacgccgacggcauccgcggcuuccccgucguccuccagcagaucuccaagucccucaacuaccuccucauguccgccucccagaccaaguccgaguccgucgaggagaagggcggcggccccccccgcugcuccaucaccgagcuccuccagaugugcuggcccucccucuccgaggacugcgucgccucccacaccacccucucccagcagcucgaccagguccuccagucccuccgcgaggcccucgagcuccccgagccccgcacccccccccucuccucccucgucgagcaggccgcccagaaggcccccgaggccgaggcccaccccguccagauccagacccagcuccuccagaagaaccucggcaagcagacccccuccggcucccgccagauggacuaccucggcaccuucuucuccuacugcuccacccucgccgccguccuccuccagucccucuccuccgagcccgaccacgucgaggucaaggucggcaaccccuucguccuccuccagcaguccuccucccagcucgucucccaccuccucuucgagcgccaggucccccccgagcgccucgccgcccuccucgcccaggagaaccucucccucuccgucccccaggucaucgucuccugcugcugcgagccccucgcccucugcuccucccgccagucccagcagaccuccucccuccucacccgccucggcacccucgcccagcuccacgccucccacugccucgacgaccucccccucuccacccccuccuccccccgcaccaccgagaaccccacccucgagcgcaagcccuacuccuccccccgcgacuccucccuccccgcccucaccuccuccgcccucgccuuccucaagucccgcuccaagcuccucgccaccgucgccugccucggcgccuccccccgccucaaggucuccaagcccucccucuccuggaaggagcuccgcggccgccgcgaggucccccucgccgccgagcaggucgcccgcgagugcgagcgccuccucgagcaguucccccucuucgaggccuuccuccucgccgccugggagccccuccgcggcucccuccagcagggccagucccucgccgucaaccucugcggcugggccucccucuccaccguccuccucggccuccacucccccaucgcccucgacguccucuccgaggccuucgaggagucccucgucgcccgcgacuggucccgcgcccuccagcucaccgaggucuacggccgcgacgucgacgaccucuccuccaucaaggacgccguccucuccugcgccgucgccugcgacaaggagggcuggcaguaccucuuccccgucaaggacgccucccuccgcucccgccucgcccuccaguucgucgaccgcuggccccucgaguccugccucgagauccucgccuacugcaucuccgacaccgccguccaggagggccucaagugcgagcuccagcgcaagcucgccgagcuccaggucuaccagaagauccucggccuccaguccccccccgucuggugcgacuggcagacccuccgcuccugcugcgucgaggaccccuccaccgucaugaacaugauccucgaggcccaggaguacgagcucugcgaggaguggggcugccucuaccccaucccccgcgagcaccucaucucccuccaccagaagcaccuccuccaccuccucgagcgccgcgaccacgacaaggcccuccagcuccuccgccgcauccccgaccccaccaugugccucgaggucaccgagcagucccucgaccagcacaccucccucgccaccucccacuuccucgccaacuaccucaccacccacuucuacggccagcucaccgccguccgccaccgcgagauccaggcccucuacgucggcuccaagauccuccucacccuccccgagcagcaccgcgccuccuacucccaccucuccuccaacccccucuucaugcucgagcagcuccucaugaacaugaaggucgacugggccaccgucgccguccagacccuccagcagcuccucgucggccaggagaucggcuucaccauggacgaggucgacucccuccucucccgcuacgccgagaaggcccucgacuuccccuacccccagcgcgagaagcgcuccgacuccgucauccaccuccaggagaucguccaccaggccgccgaccccgagacccucccccgcucccccuccgccgaguucucccccgccgccccccccggcaucuccuccauccacucccccucccuccgcgagcgcuccuucccccccacccagcccucccaggaguucgucccccccgccaccccccccgcccgccaccaguggguccccgacgagaccgaguccaucugcauggucugcugccgcgagcacuucaccauguucaaccgccgccaccacugccgccgcugcggccgccucgucugcuccuccugcuccaccaagaagauggucgucgagggcugccgcgagaaccccgcccgcgucugcgaccagugcuacuccuacugcaacaaggacguccccgaggagcccuccgagaagcccgaggcccucgacuccuccaagaacgaguccccccccuacuccuucgucguccgcguccccaaggccgacgaggucgaguggauccucgaccucaaggaggaggagaacgagcucguccgcuccgaguucuacuacgagcaggcccccuccgccucccucugcaucgccauccucaaccuccaccgcgacuccaucgccugcggccaccagcucaucgagcacugcugccgccucuccaagggccucaccaaccccgaggucgacgccggccuccucaccgacaucaugaagcagcuccucuucuccgccaagaugauguucgucaaggccggccagucccaggaccucgcccucugcgacuccuacaucuccaaggucgacguccucaacauccucgucgccgccgccuaccgccacguccccucccucgaccagauccuccagcccgccgccgucacccgccuccgcaaccagcuccucgaggccgaguacuaccagcucggcgucgaggucuccaccaagaccggccucgacaccaccggcgccuggcacgccuggggcauggccugccucaaggccggcaaccucaccgccgcccgcgagaaguucucccgcugccucaagccccccuucgaccucaaccagcucaaccacggcucccgccucguccaggacgucgucgaguaccucgaguccaccguccgccccuucgucucccuccaggacgacgacuacuucgccacccuccgcgagcucgaggccacccuccgcacccagucccucucccucgccgucauccccgagggcaagaucaugaacaacaccuacuaccaggagugccucuucuaccuccacaacuacuccaccaaccucgccaucaucuccuucuacguccgccacuccugccuccgcgaggcccuccuccaccuccucaacaaggaguccccccccgaggucuucaucgagggcaucuuccagcccuccuacaaguccggcaagcuccacacccucgagaaccuccucgaguccaucgaccccacccucgaguccuggggcaaguaccucaucgccgccugccagcaccuccagaagaagaacuacuaccacauccucuacgagcuccagcaguucaugaaggaccagguccgcgccgccaugaccugcauccgcuucuucucccacaaggccaaguccuacaccgagcucggcgagaagcucuccuggcuccucaaggccaaggaccaccucaagaucuaccuccaggagaccucccgcuccuccggccgcaagaagaccaccuucuuccgcaagaagaugaccgccgccgacgucucccgccacaugaacacccuccagcuccagauggaggucacccgcuuccuccaccgcugcgaguccgccggcaccucccagaucaccacccucccccuccccacccucuucggcaacaaccacaugaagauggacgucgccugcaaggucaugcucggcggcaagaacgucgaggacggcuucggcaucgccuuccgcguccuccaggacuuccagcucgacgccgccaugaccuacugccgcgccgcccgccagcucgucgagaaggagaaguacuccgagauccagcagcuccucaagugcgucuccgaguccggcauggccgccaaguccgacggcgacaccauccuccucaacugccucgaggccuucaagcgcauccccccccaggagcucgagggccucauccaggccauccacaacgacgacaacaagguccgcgccuaccucaucugcugcaagcuccgcuccgccuaccucaucgccgucaagcaggagcacucccgcgccaccgcccucguccagcagguccagcaggccgccaaguccuccggcgacgccgucguccaggacaucugcgcccaguggcuccucaccucccacccccgcggcgcccacggccccggcucccgcaaguga

SEQ ID NO: 51995 - RNA, 1251 nt, Artificial Sequence
  derived and/or modified sequence opt2 from ZFYVE27__Homo_sapiens__NP_001002261
augcagaccuccgagcgcgagggcuccggccccgagcucucccccuccgucaugcccgaggccccccucgaguccccccccuuccccaccaagucccccgccuucgaccucuucaaccucguccucuccuacaagcgccucgagaucuaccucgagccccucaaggacgccggcgacggcguccgcuaccuccuccgcuggcagaugccccucugcucccuccucaccugccucggccucaacguccucuuccucacccucaacgagggcgccugguacuccgucggcgcccucaugaucuccguccccgcccuccucggcuaccuccaggaggucugccgcgcccgccuccccgacuccgagcucaugcgccgcaaguaccacuccguccgccaggaggaccuccagcgcggccgccucucccgccccgaggccgucgccgaggucaaguccuuccucauccagcucgaggccuuccucucccgccucugcugcaccugcgaggccgccuaccgcguccuccacugggagaaccccgucgucuccucccaguucuacggcgcccuccucggcaccgucugcaugcucuaccuccucccccucugcuggguccucacccuccucaacuccacccucuuccucggcaacgucgaguucuuccgcgucgucuccgaguaccgcgccucccuccagcagcgcaugaaccccaagcaggaggagcacgccuucgaguccccccccccccccgacgucggcggcaaggacggccucauggacuccacccccgcccucacccccaccgagucccucuccucccaggaccucacccccggcuccgucgaggaggccgaggaggccgagcccgacgaggaguucaaggacgccaucgaggagacccaccucgucguccucgaggacgacgagggcgcccccugccccgccgaggacgagcucgcccuccaggacaacggcuuccucuccaagaacgagguccuccgcuccaaggucucccgccucaccgagcgccuccgcaagcgcuaccccaccaacaacuucggcaacugcaccggcugcuccgccaccuucuccguccucaagaagcgccgcuccugcuccaacugcggcaacuccuucugcucccgcugcugcuccuucaagguccccaaguccuccaugggcgccaccgcccccgaggcccagcgcgagaccgucuucgucugcgccuccugcaaccagacccucuccaaguga

SEQ ID NO: 51996 - RNA, 2574 nt, Artificial Sequence
  derived and/or modified sequence opt2 from ZFYVE28__Homo_sapiens__NP_001166127
augaugaaccgcuuccgcaaguggcucuacaagcccaagcgcuccgacccccagcuccucgcccgcuucuacuacgccgacgaggagcucaaccaggucgccgccgagcucgacucccucgacggccgcaaggacccccagcgcugcacccuccucgucucccaguuccgcuccugccaggacaacguccucaacaucaucaaccagaucauggacgagugcaucccccaggaccgcgccccccgcgacuucugcgucaaguuccccgaggagauccgccacgacaaccucgccggccagcucugguucggcgccgagugccucgccgccggcuccaucaucaugaaccgcgagcucgaguccauggccaugcgcccccucgccaaggagcucacccgcucccucgaggacguccgcggcgcccuccgcgaccaggcccuccgcgaccucaacaccuacaccgagaagaugcgcgaggcccuccgccacuucgacguccucuucgccgaguucgagcucuccuacgucuccgccaugguccccgucaaguccccccgcgaguacuacguccagcaggaggucaucguccucuucugcgagaccgucgaguccggccucgucgucuacgccgacggcccccucaaccucgaccgcaaggucgaggacauguccgagcucuuccgccccuuccacacccuccuccgcaagauccgcgaccuccuccagacccucaccgaggaggagcuccacacccucgagcgcaaccucugcaucucccaggacgucgaguuccccauccgcgccgacguccagggccccgccgcccucgcccccgcccucuccgccccccucccccccgagggcccccucuccgccaaggccaaggaccccgacgccgagcucgccugcuccaugcaguacgacgaccaggagcucgagcagcucucccgcaugguccaccgcgccggcgacgagauguccucccuccucuccccccccaucgccugccagucccccgcccaccgccccggcgccgagggcucccccggcggcgaggccucccccggccgcccccgccuccgcuccggcuccgacgaggaggagcgcgucuucuucauggacgacgucgagggcaccgccgaggcccucgcccgccccgagucccccgccggccccuucggcugggccggcuccaccugggccgacccccaggagaagggccagggcggccccggcggcgccgccggcaucucccuccccgccuccgagaaggaggaggaccucuccaacaacaaccucgaggccgagggcaccgacggcgccucccucgccggcaccuccuccugcuccugccucgacucccgccuccaccucgacggcugggaggucggcgccgacgacgccgagaccgccgagaugaucgcccaccgcaccggcggcaugaagcucuccgccaccgucaucuucaaccccaagucccccaccucccucgacuccgccgucgccacccaggaggccgccuccgagcccgucgccgagggcauggacggcggcccccacaagcucuccaccggcgccaccaacugccuccuccacuccugcgucugcugcggcuccugcggcgacucccgcgaggacgucgucgagcgccuccgcgagaagugcucccccggcggcgucaucggcgccuccuacgccgccggccucgccaaggccuccgaccgcgcccccgagcgccaggaggaggcccccccccccuccgaggacgccuccaacggccgcgagcccaaggcccccaccuccgacaagugccucccccacaccuccggcucccaggucgacaccgccuccggccuccagggcgaggccggcgucgccggccagcaggagcccgaggcccgcgagcuccacgccggcucccccuccgcccacgaggccccccaggcccucuccggcuccuccuccuccaccgccggcuccugcuccuccgacaagaugggccccgaggccgcccccgccgccacccacgccgccccccaggccacccgcgagaagauccgcucccgcuuccacggcucccacgaccucauccaccgccucuucgucugcaucuccggcgucgccgaccagcuccagaccaacuacgccuccgaccuccgcuccauccucaagacccucuucgaggucauggccaccaagcccgagaccgacgacaaggagaagcuccgcaaggucacccagacccuccgcuccgccgcccucgaggacugcgcccucugccaggagacccucuccuccuccgagcucgccgccaagacccgcgacggcgacuucgaggacccccccgaguggguccccgacgaggccugcggcuucugcaccgccugcaaggcccccuucaccgucauccgccgcaagcaccacugccgcuccugcggcaagaucuucugcucccgcugcuccucccacuccgccccccucccccgcuacggccaggucaagcccguccgcgucugcacccacugcuacauguuccacgucacccccuucuacuccgacaaggccggccucuga

SEQ ID NO: 51997 - RNA, 4278 nt, Artificial Sequence
  derived and/or modified sequence opt2 from ZFYVE9__Homo_sapiens__XP_011540739
auggagaacuacuuccaggccgaggccuacaaccucgacaagguccucgacgaguucgagcagaacgaggacgagaccgucuccuccacccuccucgacaccaaguggaacaagauccucgacccccccucccaccgccucuccuucaaccccacccucgccuccgucaacgaguccgccgucuccaacgagucccagccccagcucaaggucuucucccucgcccacuccgccccccucaccaccgaggaggaggaccacugcgccaacggccaggacugcaaccucaaccccgagaucgccaccauguggaucgacgagaacgccgucgccgaggaccagcucaucaagcgcaacuacuccugggacgaccagugcuccgccgucgaggucggcgagaagaagugcggcaaccucgccugccuccccgacgagaagaacguccucgucgucgccgucaugcacaacugcgacaagcgcacccuccagaacgaccuccaggacugcaacaacuacaacucccagucccucauggacgccuucuccugcucccucgacaacgagaaccgccagaccgaccaguucuccuucuccaucaacgaguccaccgagaaggacaugaacuccgagaagcagauggacccccucaaccgccccaagaccgagggccgcuccgucaaccaccucugccccaccuccuccgacucccucgccuccgucugcucccccucccagcucaaggacgacggcuccaucggccgcgaccccuccauguccgccaucaccucccucaccgucgacuccgucaucuccucccagggcaccgacggcugccccgccgucaagaagcaggagaacuacauccccgacgaggaccucaccggcaagaucuccuccccccgcaccgaccucggcucccccaacuccuucucccacauguccgagggcauccucaugaagaaggagcccgccgaggaguccaccaccgaggagucccuccgcuccggccucccccuccuccucaagcccgacaugcccaacggcuccggccgcaacaacgacugcgagcgcugcuccgacugccucguccccaacgagguccgcgccgacgagaacgagggcuacgagcacgaggagacccucggcaccaccgaguuccucaacaugaccgagcacuucuccgagucccaggacaugaccaacuggaagcucaccaagcucaacgagaugaacgacucccaggucaacgaggagaaggagaaguuccuccagaucucccagcccgaggacaccaacggcgacuccggcggccagugcgucggccucgccgacgccggccucgaccucaagggcaccugcaucuccgaguccgaggagugcgacuucuccaccgucaucgacacccccgccgccaacuaccucuccaacggcugcgacuccuacggcaugcaggaccccggcgucuccuucguccccaagacccuccccuccaaggaggacuccgucaccgaggagaaggagaucgaggaguccaaguccgagugcuacuccaacaucuacgagcagcgcggcaacgaggccaccgagggcuccggccuccuccucaacuccaccggcgaccucaugaagaagaacuaccuccacaacuucugcucccagguccccuccguccucggccaguccucccccaaggucgucgccucccuccccuccaucuccguccccuucggcggcgcccgccccaagcagcccuccaaccucaagcuccagauccccaagccccucuccgaccaccuccagaacgacuuccccgccaacuccggcaacaacaccaagaacaagaacgacauccucggcaaggccaagcucggcgagaacuccgccaccaacgucugcucccccucccucggcaacaucuccaacgucgacaccaacggcgagcaccucgaguccuacgaggccgagaucuccacccgccccugccucgcccucgcccccgacucccccgacaacgaccuccgcgccggccaguucggcaucuccgcccgcaagcccuucaccacccucggcgaggucgcccccgucuggguccccgacucccaggcccccaacugcaugaagugcgaggcccgcuucaccuucaccaagcgccgccaccacugccgcgccugcggcaaggucuucugcgccuccugcugcucccucaagugcaagcuccucuacauggaccgcaaggaggcccgcgucugcgucaucugccacuccguccucaugaacgcccaggccugggagaacaugauguccgccuccucccagucccccaaccccaacaaccccgccgaguacugcuccaccauccccccccuccagcaggcccaggccuccggcgcccucuccucccccccccccaccgucaugguccccgucggcguccucaagcaccccggcgccgaggucgcccagccccgcgagcagcgccgcgucugguucgccgacggcauccuccccaacggcgaggucgccgacgccgccaagcucaccaugaacggcaccuccuccgccggcacccucgccgucucccacgaccccgucaagcccgucaccaccuccccccuccccgccgagaccgacaucugccucuucuccggcuccaucacccaggucggcucccccgucggcuccgccaugaaccucauccccgaggacggccucccccccauccucaucuccaccggcgucaagggcgacuacgccgucgaggagaagcccucccagaucuccgucaugcagcagcucgaggacggcggccccgacccccucgucuucguccucaacgccaaccuccucuccauggucaagaucgucaacuacgucaaccgcaagugcuggugcuucaccaccaagggcaugcacgccgucggccaguccgagaucgucauccuccuccagugccuccccgacgagaagugccuccccaaggacaucuucaaccacuucguccagcucuaccgcgacgcccucgccggcaacgucgucuccaaccucggccacuccuucuucucccaguccuuccucggcuccaaggagcacggcggcuuccucuacgucaccuccaccuaccagucccuccaggaccucguccuccccaccccccccuaccucuucggcauccucauccagaagugggagacccccugggccaaggucuuccccauccgccucaugcuccgccucggcgccgaguaccgccucuaccccugcccccucuucuccguccgcuuccgcaagccccucuucggcgagaccggccacaccaucaugaaccuccucgccgacuuccgcaacuaccaguacacccuccccgucguccagggccucgucgucgacauggagguccgcaagaccuccaucaagauccccuccaaccgcuacaacgagaugaugaaggccaugaacaaguccaacgagcacguccucgccggcggcgccugcuucaacgagaaggccgacucccaccucgucugcguccagaacgacgacggcaacuaccagacccaggccaucuccauccacaaccagccccgcaaggucaccggcgccuccuucuucgucuucuccggcgcccucaaguccuccuccggcuaccucgccaaguccuccaucgucgaggacggcgucaugguccagaucaccgccgagaacauggacucccuccgccaggcccuccgcgagaugaaggacuucaccaucaccugcggcaaggccgacgccgaggagccccaggagcacauccacauccagugggucgacgacgacaagaacgucuccaagggcgucgucucccccaucgacggcaaguccauggagaccaucaccaacgucaagaucuuccacggcuccgaguacaaggccaacggcaaggucauccgcuggaccgaggucuucuuccucgagaacgacgaccagcacaacugccucuccgaccccgccgaccacucccgccucaccgagcacgucgccaaggccuucugccucgcccucugcccccaccucaagcuccucaaggaggacggcaugaccaagcucggccuccgcgucacccucgacuccgaccaggucggcuaccaggccggcuccaacggccagccccuccccucccaguacaugaacgaccucgacuccgcccucguccccgucauccacggcggcgccugccagcucuccgagggccccgucgucauggagcucaucuucuacauccucgagaacaucgucuga

SEQ ID NO: 51998 - RNA, 627 nt, Artificial Sequence
  derived and/or modified sequence opt2 from ZG16B__Homo_sapiens__NP_660295
augggcgcccagggcgcccaggaguccaucaaggccauguggcgcguccccggcaccacccgccgccccgucaccggcgagucccccggcaugcaccgccccgaggccaugcuccuccuccucacccucgcccuccucggcggccccaccugggccggcaagauguacggccccggcggcggcaaguacuucuccaccaccgaggacuacgaccacgagaucaccggccuccgcgucuccgucggccuccuccucgucaaguccguccaggucaagcucggcgacuccugggacgucaagcucggcgcccucggcggcaacacccaggaggucacccuccagcccggcgaguacaucaccaaggucuucgucgccuuccaggccuuccuccgcggcauggucauguacaccuccaaggaccgcuacuucuacuucggcaagcucgacggccagaucuccuccgccuaccccucccaggagggccagguccucgucggcaucuacggccaguaccagcuccucggcaucaaguccaucggcuucgaguggaacuacccccucgaggagcccaccaccgagccccccgucaaccucaccuacuccgccaacucccccgucggccgcuga

SEQ ID NO: 51999 - RNA, 816 nt, Artificial Sequence
  derived and/or modified sequence opt2 from ZGLP1__Homo_sapiens__NP_001096637
augaccgagccccaggucggcugcgucgccugcccccgcguccacaaggagcccgcccaggucggcacccccuggcccgccaagccccgcucccacccccgcaagcgcgaccccaccgcccuccucccccgcucccucuggcccgccugccaggaguccgucaccgcccucugcuuccuccaggagaccgucgagcgccucggccagucccccgcccaggacacccccguccucggccccugcugggaccccauggcccucggcacccagggccgccuccuccucgaccgcgacuccaaggacacccagacccgcaucucccagaagggccgccgccuccagccccccggcacccccuccgcccccccccagcgccgcccccgcaagcagcucaaccccugccgcggcaccgagcgcgucgaccccggcuucgagggcgucacccucaaguuccagaucaagcccgacuccucccuccagaucauccccaccuacucccuccccugcuccucccgcucccaggagucccccgccgacgccgucggcggccccgccgcccaccccggcggcaccgaggcccacuccgccggcuccgaggcccucgagccccgccgcugcgccuccugccgcacccagcgcaccccccucuggcgcgacgccgaggacggcaccccccucugcaacgccugcggcauccgcuacaagaaguacggcacccgcugcuccuccugcuggcucgucccccgcaagaacguccagcccaagcgccucugcggccgcugcggcgucucccucgaccccauccaggagggcuga

SEQ ID NO: 52000 - RNA, 1536 nt, Artificial Sequence
  derived and/or modified sequence opt2 from ZGPAT__Homo_sapiens__NP_001076582
auggacgaggagucccucgaguccgcccuccagaccuaccgcgcccagcuccagcaggucgagcucgcccucggcgccggccucgacuccuccgagcaggccgaccuccgccagcuccagggcgaccucaaggagcucaucgagcucaccgaggccucccucgucuccguccgcaaguccucccuccucgccgcccucgacgaggagcgccccggccgccaggaggacgccgaguaccaggccuuccgcgaggccaucaccgaggccgucgaggcccccgccgccgcccgcggcuccggcuccgagaccguccccaaggccgaggccggccccgaguccgccgccggcggccaggaggaggaggagggcgaggacgaggaggagcucuccggcaccaaggucuccgcccccuacuacuccuccuggggcacccucgaguaccacaacgccauggucgucggcaccgaggaggccgaggacggcuccgccggcguccgcguccucuaccucuaccccacccacaagucccucaagcccugccccuucuuccucgagggcaagugccgcuucaaggagaacugccgcuucucccacggccaggucgucucccucgacgagcuccgccccuuccaggaccccgaccucuccucccuccaggccggcuccgccugccucgccaagcaccaggacggccucuggcacgccgcccgcaucaccgacgucgacaacggcuacuacaccgucaaguucgacucccuccuccuccgcgaggccgucgucgagggcgacggcauccuccccccccuccgcaccgaggccaccgaguccgacuccgacuccgacggcaccggcgacuccuccuacgcccgcgucgucggcuccgacgccgucgacuccggcaccugcuccuccgccuucgccggcugggagguccacacccgcggcaucggcucccgccuccucaccaagaugggcuacgaguucggcaagggccucggccgccacgccgagggccgcgucgagcccauccacgccgucguccucccccgcggcaagucccucgaccagugcgucgagacccuccagaagcagacccgcgucggcaaggccggcaccaacaagcccccccgcugccgcggccgcggcgcccgccccggcggccgccccgccccccgcaacgucuucgacuuccucaacgagaagcuccagggccaggcccccggcgcccucgaggccggcgccgcccccgccggccgccgcuccaaggacauguaccacgccuccaaguccgccaagcgcgcccucucccuccgccucuuccagaccgaggagaagaucgagcgcacccagcgcgacauccgcuccauccaggaggcccucgcccgcaacgccggccgccacuccgucgccuccgcccagcuccaggagaagcucgccggcgcccagcgccagcucggccagcuccgcgcccaggaggccggccuccagcaggagcagcgcaaggccgacacccacaagaagaugaccgaguucuga

SEQ ID NO: 52001 - RNA, 2622 nt, Artificial Sequence
  derived and/or modified sequence opt2 from ZHX1__Homo_sapiens__NP_009153
auggccucccgccgcaaguccaccacccccugcaugguccucgccuccgagcaggaccccgaccucgagcucaucuccgaccucgacgagggcccccccguccucacccccgucgagaacacccgcgccgaguccaucuccuccgacgaggagguccacgaguccgucgacuccgacaaccagcagaacaagaaggucgagggcggcuacgagugcaaguacugcaccuuccagacccccgaccucaacauguucaccuuccacgucgacuccgagcaccccaacgucguccucaacuccuccuacgucugcgucgagugcaacuuccucaccaagcgcuacgacgcccucuccgagcacaaccucaaguaccaccccggcgaggagaacuucaagcucaccauggucaagcgcaacaaccagaccaucuucgagcagaccaucaacgaccucaccuucgacggcuccuucgucaaggaggagaacgccgagcaggccgaguccaccgaggucuccuccuccggcaucuccaucuccaagacccccaucaugaagaugaugaagaacaaggucgagaacaagcgcaucgccguccaccacaacuccgucgaggacguccccgaggagaaggagaacgagaucaagcccgaccgcgaggagaucgucgagaaccccuccuccuccgccuccgaguccaacaccuccaccuccaucgucaaccgcauccaccccuccaccgccuccaccgucgucacccccgccgccguccuccccggccucgcccaggucaucaccgccgucuccgcccagcagaacuccaaccucauccccaagguccucauccccgucaacuccauccccaccuacaacgccgcccucgacaacaacccccuccuccucaacaccuacaacaaguuccccuaccccaccauguccgagaucaccguccucuccgcccaggccaaguacaccgaggagcagaucaagaucugguucuccgcccagcgccucaagcacggcgucuccuggacccccgaggaggucgaggaggcccgccgcaagcaguucaacggcaccguccacaccgucccccagaccaucaccgucauccccacccacaucuccaccggcuccaacggccuccccuccauccuccagaccugccagaucgucggccagcccggccucguccucacccaggucgccggcaccaacacccuccccgucaccgcccccaucgcccucaccgucgccggcguccccucccagaacaacauccagaagucccagguccccgccgcccagcccaccgccgagaccaagcccgccaccgccgccguccccaccucccaguccgucaagcacgagaccgcccucgucaaccccgacuccuucggcauccgcgccaagaagaccaaggagcagcucgccgagcucaaggucuccuaccucaagaaccaguucccccacgacuccgagaucauccgccucaugaagaucaccggccucaccaagggcgagaucaagaagugguucuccgacacccgcuacaaccagcgcaacuccaaguccaaccagugccuccaccucaacaacgacuccuccaccaccaucaucaucgacuccuccgacgagaccaccgagucccccaccgucggcaccgcccagcccaagcaguccuggaaccccuuccccgacuucaccccccagaaguucaaggagaagaccgccgagcagcuccgcguccuccaggccuccuuccucaacuccuccguccucaccgacgaggagcucaaccgccuccgcgcccagaccaagcucacccgccgcgagaucgacgccugguucaccgagaagaagaaguccaaggcccucaaggaggagaagauggagaucgacgaguccaacgccggcuccuccaaggaggaggccggcgagaccucccccgccgacgaguccggcgcccccaaguccggcuccaccggcaagaucugcaagaagacccccgagcagcuccacaugcucaaguccgccuucguccgcacccaguggcccucccccgaggaguacgacaagcucgccaaggaguccggccucgcccgcaccgacaucgucuccugguucggcgacacccgcuacgccuggaagaacggcaaccucaagugguacuacuacuaccaguccgccaacuccuccuccaugaacggccucuccucccuccgcaagcgcggccgcggccgccccaagggccgcggccgcggccgcccccgcggccgcccccgcggcuccaagcgcaucaacaacugggaccgcggccccucccucaucaaguucaagaccggcaccgccauccucaaggacuacuaccucaagcacaaguuccucaacgagcaggaccucgacgagcucgucaacaagucccacaugggcuacgagcagguccgcgagugguucgccgagcgccagcgccgcuccgagcucggcaucgagcucuucgaggagaacgaggaggaggacgaggucaucgacgaccaggaggaggacgaggaggagaccgacgacuccgacaccugggagcccccccgccacgucaagcgcaagcucuccaaguccgacgacuga

SEQ ID NO: 52002 - RNA, 2514 nt, Artificial Sequence
  derived and/or modified sequence opt2 from ZHX2__Homo_sapiens__XP_011515234
auggccuccaagcgcaaguccaccacccccugcaugguccgcaccucccaggucgucgagcaggacguccccgaggaggucgaccgcgccaaggagaagggcaucggcaccccccagcccgacgucgccaaggacuccugggccgccgagcucgagaacuccuccaaggagaacgaggucaucgaggucaaguccaugggcgagucccaguccaagaagcuccagggcggcuacgagugcaaguacugccccuacuccacccagaaccucaacgaguucaccgagcacgucgacaugcagcaccccaacgucauccucaacccccucuacgucugcgccgagugcaacuucaccaccaagaaguacgacucccucuccgaccacaacuccaaguuccaccccggcgaggccaacuucaagcucaagcucaucaagcgcaacaaccagaccguccucgagcaguccaucgagaccaccaaccacgucgucuccaucaccaccuccggccccggcaccggcgacuccgacuccggcaucuccgucuccaagacccccaucaugaagcccggcaagcccaaggccgacgccaagaagguccccaagaagcccgaggagaucacccccgagaaccacgucgagggcaccgcccgccucgucaccgacaccgccgagauccucucccgccucggcggcgucgagcuccuccaggacacccucggccacgucaugcccuccguccagcucccccccaacaucaaccucguccccaagguccccgucccccucaacaccaccaaguacaacuccgcccucgacaccaacgccaccaugaucaacuccuucaacaaguuccccuaccccacccaggccgagcucuccuggcucaccgccgccuccaagcaccccgaggagcacauccgcaucugguucgccacccagcgccucaagcacggcaucuccuggucccccgaggaggucgaggaggcccgcaagaagauguucaacggcaccauccaguccgucccccccaccaucaccguccuccccgcccagcucgcccccaccaaggucacccagcccauccuccagaccgcccuccccugccagauccucggccagaccucccucguccucacccaggucaccuccggcuccaccaccgucuccugcucccccaucacccucgccgucgccggcgucaccaaccacggccagaagcgcccccucgucaccccccaggccgcccccgagcccaagcgcccccacaucgcccagguccccgagcccccccccaaggucgccaaccccccccucacccccgccuccgaccgcaagaagaccaaggagcagaucgcccaccucaaggccuccuuccuccagucccaguuccccgacgacgccgaggucuaccgccucaucgaggucaccggccucgcccgcuccgagaucaagaagugguucuccgaccaccgcuaccgcugccagcgcggcaucguccacaucaccuccgagucccucgccaaggaccagcucgccaucgccgccucccgccacggccgcaccuaccacgccuaccccgacuucgccccccagaaguucaaggagaagacccagggccaggucaagauccucgaggacuccuuccucaaguccuccuuccccacccaggccgagcucgaccgccuccgcgucgagaccaagcucucccgccgcgagaucgacuccugguucuccgagcgccgcaagcuccgcgacuccauggagcaggccguccucgacuccaugggcuccggcaagaagggccaggacgucggcgcccccaacggcgcccucucccgccucgaccagcucuccggcgcccagcucaccuccucccuccccucccccucccccgccaucgccaagucccaggagcagguccaccuccuccgcuccaccuucgcccgcacccaguggcccaccccccaggaguacgaccagcucgccgccaagaccggccucguccgcaccgagaucguccgcugguucaaggagaaccgcugccuccucaagaccggcaccgucaaguggauggagcaguaccagcaccagcccauggccgacgaccacggcuacgacgccgucgcccgcaaggccaccaagcccauggccgagucccccaagaacggcggcgacgucgucccccaguacuacaaggaccccaagaagcucugcgaggaggaccucgagaagcucgucacccgcgucaaggucggcuccgagcccgccaaggacugccuccccgccaagcccuccgaggccaccuccgaccgcuccgagggcuccucccgcgacggccagggcuccgacgagaacgaggaguccuccgucgucgacuacgucgaggucaccgucggcgaggaggacgccaucuccgaccgcuccgacuccuggucccaggccgccgccgagggcgucuccgagcucgccgaguccgacuccgacugcguccccgccgaggccggccaggccuga

SEQ ID NO: 52003 - RNA, 1344 nt, Artificial Sequence
  derived and/or modified sequence opt2 from ZIC1__Homo_sapiens__NP_003403
augcuccucgacgccggcccccaguaccccgccaucggcgucaccaccuucggcgccucccgccaccacuccgccggcgacgucgccgagcgcgacgucggccucggcaucaaccccuucgccgacggcaugggcgccuucaagcucaaccccuccucccacgagcucgccuccgccggccagaccgccuucaccucccaggcccccggcuacgccgccgccgccgcccucggccaccaccaccaccccggccacgucggcuccuacuccuccgccgccuucaacuccacccgcgacuuccucuuccgcaaccgcggcuucggcgacgccgccgccgccgccuccgcccagcacucccucuucgccgccuccgccggcggcuucggcggcccccacggccacaccgacgccgccggccaccuccucuuccccggccuccacgagcaggccgccggccacgccucccccaacgucgucaacggccagaugcgccucggcuucuccggcgacauguacccccgccccgagcaguacggccaggucaccuccccccgcuccgagcacuacgccgccccccagcuccacggcuacggccccaugaacgucaacauggccgcccaccacggcgccggcgccuucuuccgcuacaugcgccagcccaucaagcaggagcucaucugcaaguggaucgagcccgagcagcucgccaaccccaagaaguccugcaacaagaccuucuccaccaugcacgagcucgucacccacgucaccgucgagcacgucggcggccccgagcaguccaaccacaucugcuucugggaggagugcccccgcgagggcaagcccuucaaggccaaguacaagcucgucaaccacauccgcguccacaccggcgagaagcccuuccccugccccuuccccggcugcggcaaggucuucgcccgcuccgagaaccucaagauccacaagcgcacccacaccggcgagaagcccuucaagugcgaguucgagggcugcgaccgccgcuucgccaacuccuccgaccgcaagaagcacaugcacguccacaccuccgacaagcccuaccucugcaagaugugcgacaaguccuacacccaccccuccucccuccgcaagcacaugaagguccacgaguccuccucccagggcucccagcccucccccgccgccuccuccggcuacgaguccuccaccccccccaccaucgucucccccuccaccgacaaccccaccaccuccucccucucccccuccuccuccgccguccaccacaccgccggccacuccgcccucuccuccaacuucaacgagugguacgucuga

SEQ ID NO: 52004 - RNA, 1599 nt, Artificial Sequence
  derived and/or modified sequence opt2 from ZIC2__Homo_sapiens__NP_009060
augcuccucgacgccggcccccaguuccccgccaucggcgucggcuccuucgcccgccaccaccaccacuccgccgccgccgccgccgccgccgccgccgagaugcaggaccgcgagcucucccucgccgccgcccagaacggcuucgucgacuccgccgccgcccacaugggcgccuucaagcucaaccccggcgcccacgagcucucccccggccaguccuccgccuucaccucccagggccccggcgccuaccccggcuccgccgccgccgccgccgccgccgccgcccucggcccccacgccgcccacgucggcuccuacuccggcccccccuucaacuccacccgcgacuuccucuuccgcucccgcggcuucggcgacuccgcccccggcggcggccagcacggccucuucggccccggcgccggcggccuccaccacgcccacuccgacgcccagggccaccuccucuuccccggccuccccgagcagcacggcccccacggcucccagaacguccucaacggccagaugcgccucggccuccccggcgaggucuucggccgcuccgagcaguaccgccaggucgccuccccccgcaccgaccccuacuccgccgcccagcuccacaaccaguacggccccaugaacaugaacaugggcaugaacauggccgccgccgccgcccaccaccaccaccaccaccaccaccaccccggcgccuucuuccgcuacaugcgccagcagugcaucaagcaggagcucaucugcaaguggaucgaccccgagcagcucuccaaccccaagaaguccugcaacaagaccuucuccaccaugcacgagcucgucacccacgucuccgucgagcacgucggcggccccgagcaguccaaccacgucugcuucugggaggagugcccccgcgagggcaagcccuucaaggccaaguacaagcucgucaaccacauccgcguccacaccggcgagaagcccuuccccugccccuuccccggcugcggcaaggucuucgcccgcuccgagaaccucaagauccacaagcgcacccacaccggcgagaagcccuuccagugcgaguucgagggcugcgaccgccgcuucgccaacuccuccgaccgcaagaagcacaugcacguccacaccuccgacaagcccuaccucugcaagaugugcgacaaguccuacacccaccccuccucccuccgcaagcacaugaagguccacgaguccuccccccagggcuccgaguccucccccgccgccuccuccggcuacgaguccuccaccccccccggccucgucucccccuccgccgagccccaguccuccuccaaccucucccccgccgccgccgccgccgccgccgccgccgccgccgccgccgccgccgucuccgccguccaccgcggcggcggcuccggcuccggcggcgccggcggcggcuccggcggcggcuccggcuccggcggcggcggcggcggcgccggcggcggcggcggcggcuccuccggcggcggcuccggcaccgccggcggccacuccggccucuccuccaacuucaacgagugguacgucuga

SEQ ID NO: 52005 - RNA, 1404 nt, Artificial Sequence
  derived and/or modified sequence opt2 from ZIC3__Homo_sapiens__NP_003404
augaccaugcuccucgacggcggcccccaguuccccggccucggcgucggcuccuucggcgccccccgccaccacgagaugcccaaccgcgagcccgccggcaugggccucaaccccuucggcgacuccacccacgccgccgccgccgccgccgccgccgccgccuucaagcucucccccgccgccgcccacgaccucuccuccggccaguccuccgccuucaccccccagggcuccggcuacgccaacgcccucggccaccaccaccaccaccaccaccaccaccaccacaccucccagguccccuccuacggcggcgccgccuccgccgccuucaacuccacccgcgaguuccucuuccgccagcgcuccuccggccucuccgaggccgccuccggcggcggccagcacggccucuucgccggcuccgccuccucccuccacgcccccgccggcauccccgagccccccuccuaccuccucuuccccggccuccacgagcagggcgccggccaccccucccccaccggccacgucgacaacaaccagguccaccucggccuccgcggcgagcucuucggccgcgccgaccccuaccgccccgucgccuccccccgcaccgaccccuacgccgccggcgcccaguuccccaacuacucccccaugaacaugaacaugggcgucaacgucgccgcccaccacggccccggcgccuucuuccgcuacaugcgccagcccaucaagcaggagcucuccugcaaguggaucgacgaggcccagcucucccgccccaagaaguccugcgaccgcaccuucuccaccaugcacgagcucgucacccacgucaccauggagcacgucggcggccccgagcagaacaaccacgucugcuacugggaggagugcccccgcgagggcaaguccuucaaggccaaguacaagcucgucaaccacauccgcguccacaccggcgagaagcccuuccccugccccuuccccggcugcggcaagaucuucgcccgcuccgagaaccucaagauccacaagcgcacccacaccggcgagaagcccuucaagugcgaguucgagggcugcgaccgccgcuucgccaacuccuccgaccgcaagaagcacaugcacguccacaccuccgacaagcccuacaucugcaaggucugcgacaaguccuacacccaccccuccucccuccgcaagcacaugaagguccacgagucccagggcuccgacuccucccccgccgccuccuccggcuacgaguccuccaccccccccgccaucgccuccgccaacuccaaggacaccaccaagacccccuccgccguccagaccuccaccucccacaaccccggccucccccccaacuucaacgagugguacgucuga

SEQ ID NO: 52006 - RNA, 1155 nt, Artificial Sequence
  derived and/or modified sequence opt2 from ZIC4__Homo_sapiens__NP_001161850
augccccccuucugccgcaacgccaagcucggccuccucuccuuccucaucugcgccggccgcucccuccucccccucggcaagaacgccuucuggcucgagcgcaucgagaacaacaacacccucugggagaaggcccagucccagaagaugcgcuacaagaccucccucgucaugcgcaagcgccuccgccucuaccgcaacacccucaaggaguccuccuccuccuccggccaccacggcccccagcucaccgccgccuccucccccuccgucuuccccggccuccacgaggagcccccccaggccucccccucccgcccccucaacggccuccuccgccucggccuccccggcgacauguacgcccgccccgagcccuucccccccggccccgccgcccgcuccgacgcccucgccgccgccgccgcccuccacggcuacggcggcaugaaccucaccgucaaccucgccgccccccacggccccggcgccuucuuccgcuacaugcgccagcccaucaagcaggagcucaucugcaaguggcucgccgccgacggcaccgccacccccucccucugcuccaagaccuucuccaccaugcacgagcucgucacccacgucaccgucgagcacgucggcggccccgagcaggccaaccacaucugcuucugggaggagugcccccgccagggcaagcccuucaaggccaaguacaagcucgucaaccacauccgcguccacaccggcgagaagcccuuccccugccccuuccccggcugcggcaaggucuucgcccgcuccgagaaccucaagauccacaagcgcacccacaccggcgagaagcccuuccgcugcgaguucgagggcugcgagcgccgcuucgccaacuccuccgaccgcaagaagcacucccacguccacaccuccgacaagcccuacaccugcaagguccgcggcugcgacaagugcuacacccaccccuccucccuccgcaagcacaugaagguccacggccgcucccccccccccuccuccggcuacgacuccgccacccccuccgcccucgucucccccuccuccgacugcggccacaagucccaggucgccuccuccgccgccgucgccgcccgcaccgccgaccucuccgaguga

SEQ ID NO: 52007 - RNA, 1992 nt, Artificial Sequence
  derived and/or modified sequence opt2 from ZIC5__Homo_sapiens__NP_149123
auguuccucaaggccggccgcggcaacaaggucccccccguccgcgucuacggccccgacugcgucguccucauggagcccccccucuccaagcgcaacccccccgcccuccgccucgccgaccucgccaccgcccagguccagccccuccagaacaugaccggcuuccccgcccucgccggcccccccgcccacucccagcuccgcgccgccgucgcccaccuccgccuccgcgaccucggcgccgaccccggcgucgccaccaccccccucggccccgagcacauggcccaggccuccacccucggccucuccccccccucccaggccuuccccgcccaccccgaggcccccgccgccgccgcccgcgccgccgcccucgucgcccaccccggcgccggcuccuaccccugcggcggcggcuccuccggcgcccagcccuccgccccccccccccccgcccccccccucccccccacccccucccccccccccccccccccccccccccccccccccgcccucuccggcuacaccaccaccaacuccggcggcggcggcuccuccggcaagggccacucccgcgacuucguccuccgccgcgaccucuccgccaccgcccccgccgccgccaugcacggcgccccccucggcggcgagcagcgcuccggcaccggcuccccccagcaccccgccccccccccccacuccgccggcauguucaucuccgccuccggcaccuacgccggccccgacggcuccggcggccccgcccucuuccccgcccuccacgacacccccggcgcccccggcggccacccccacccccucaacggccagaugcgccucggccucgccgccgccgccgccgccgccgccgccgagcucuacggccgcgccgagccccccuucgccccccgcuccggcgacgcccacuacggcgccgucgccgccgccgccgccgccgcccuccacggcuacggcgccgucaaccucaaccucaaccucgccgccgccgccgccgccgccgccgccggccccggcccccaccuccagcaccacgcccccccccccgcccccccccccccccccgcccccgcccagcacccccaccagcaccacccccaccuccccggcgccgccggcgccuuccuccgcuacaugcgccagcccaucaagcaggagcucaucugcaaguggaucgaccccgacgagcucgccggccuccccccccccccccccccccccccccccccccccccccccccccccgccggcggcgccaagcccugcuccaagaccuucggcaccaugcacgagcucgucaaccacgucaccgucgagcacgucggcggccccgagcaguccucccacgucugcuucugggaggacugcccccgcgagggcaagcccuucaaggccaaguacaagcucaucaaccacauccgcguccacaccggcgagaagcccuuccccugccccuuccccggcugcggcaaggucuucgcccgcuccgagaaccucaagauccacaagcgcacccacaccggcgagaagcccuucaagugcgaguucgacggcugcgaccgcaaguucgccaacuccuccgaccgcaagaagcacucccacguccacaccuccgacaagcccuacuacugcaagauccgcggcugcgacaaguccuacacccaccccuccucccuccgcaagcacaugaagauccacugcaagucccccccccccucccccggcccccucggcuacuccuccgucggcacccccgucggcgccccccucucccccguccucgaccccgcccgcucccacuccuccacccucuccccccaggucaccaaccucaacgagugguacgucugccaggccuccggcgcccccucccaccuccacacccccuccuccaacggcaccaccuccgagaccgaggacgaggagaucuacggcaaccccgaggucguccgcaccauccacuga

SEQ ID NO: 52008 - RNA, 1464 nt, Artificial Sequence
  derived and/or modified sequence opt2 from ZIK1__Homo_sapiens__NP_001010879
auggccgccgccgcccuccgcgcccccacccaggucaccgucucccccgagacccacauggaccucaccaagggcugcgucaccuucgaggacaucgccaucuacuucucccaggacgaguggggccuccucgacgaggcccagcgccuccucuaccucgaggucaugcucgagaacuucgcccucgucgccucccucggcugcggccacggcaccgaggacgaggagacccccuccgaccagaacgucuccgucggcgucucccaguccaaggccggcuccuccacccagaagacccaguccugcgagaugugcguccccguccucaaggacauccuccaccucgccgaccuccccggccagaagcccuaccucgucggcgagugcaccaaccaccaccagcaccagaagcaccacuccgccaagaagucccucaagcgcgacauggaccgcgccuccuacgucaagugcugccucuucugcaugucccucaagcccuuccgcaagugggaggucggcaaggaccuccccgccaugcuccgccuccuccgcucccucgucuuccccggcggcaagaagcccggcaccaucaccgagugcggcgaggacauccgcucccagaagucccacuacaaguccggcgagugcggcaaggccucccgccacaagcacacccccgucuaccacccccgcgucuacaccggcaagaagcucuacgagugcuccaagugcggcaaggccuuccgcggcaaguacucccucguccagcaccagcgcguccacaccggcgagcgccccugggagugcaacgagugcggcaaguucuucucccagaccucccaccucaacgaccaccgccgcauccacaccggcgagcgccccuacgagugcuccgagugcggcaagcucuuccgccagaacuccucccucgucgaccaccagaagauccacaccggcgcccgccccuacgagugcucccagugcggcaaguccuucucccagaaggccacccucgucaagcaccagcgcguccacaccggcgagcgccccuacaagugcggcgagugcggcaacuccuucucccaguccgccauccucaaccagcaccgccgcauccacaccggcgccaagcccuacgagugcggccagugcggcaaguccuucucccagaaggccacccucaucaagcaccagcgcguccacaccggcgagcgccccuacaagugcggcgacugcggcaaguccuucucccaguccuccauccucauccagcaccgccgcauccacaccggcgcccgccccuacgagugcggccagugcggcaaguccuucucccagaaguccggccucauccagcaccaggucguccacaccggcgagcgccccuacgagugcaacaagugcggcaacuccuucucccagugcuccucccucauccaccaccagaagugccacaacaccuga

SEQ ID NO: 52009 - RNA, 1584 nt, Artificial Sequence
  derived and/or modified sequence opt2 from ZIM2__Homo_sapiens__NP_001139799
auguaccagcccgaggacgacaacaacuccgacgucaccuccgacgacgacaugacccgcaaccgccgcgaguccucccccccccacuccguccacuccuucuccggcgaccgcgacugggaccgccgcggccgcucccgcgacauggagccccgcgaccgcuggucccacacccgcaacccccgcucccgcaugcccccccgcgaccucucccuccccgucgucgccaagaccuccuucgagauggaccgcgaggacgaccgcgacucccgcgccuacgagucccgcucccaggacgccgaguccuaccagaacgucgucgaccucgccgaggaccgcaagccccacaacaccauccaggacaacauggagaacuaccgcaagcuccucucccucggcuuccucgcccaggacuccguccccgccgagaagcgcaacaccgagaugcucgacaaccuccccuccgccggcucccaguuccccgacuucaagcaccucggcaccuuccucgucuucgaggagcucgucaccuucgaggacguccucgucgacuucucccccgaggagcucuccucccucuccgccgcccagcgcaaccucuaccgcgaggucaugcucgagaacuaccgcaaccucgucucccucggccaccaguucuccaagcccgacaucaucucccgccucgaggaggaggaguccuacgccauggagaccgacucccgccacaccgucaucugccagggcgagucccacgacgacccccucgagccccaccagggcaaccaggagaagcuccucacccccaucaccaugaacgaccccaagacccucacccccgagcgcuccuacggcuccgacgaguucgagcgcuccuccaaccucuccaagcaguccaaggacccccucggcaaggacccccaggagggcaccgcccccggcaucugcaccuccccccaguccgccucccaggagaacaagcacaaccgcugcgaguucugcaagcgcaccuucuccacccaggucgcccuccgccgccacgagcgcauccacaccggcaagaagcccuacgagugcaagcagugcgccgaggccuucuaccucaugccccaccucaaccgccaccagaagacccacuccggccgcaagaccuccggcugcaacgagggccgcaagcccuccguccagugcgccaaccucugcgagcgcguccgcauccacucccaggaggacuacuucgagugcuuccagugcggcaaggccuuccuccagaacguccaccuccuccagcaccucaaggcccacgaggccgcccgcguccucccccccggccucucccacuccaagaccuaccucauccgcuaccagcgcaagcacgacuacgucggcgagcgcgccugccagugcugcgacugcggccgcgucuucucccgcaacuccuaccucauccagcacuaccgcacccacacccaggagcgccccuaccagugccagcucugcggcaagugcuucggccgccccuccuaccucacccagcacuaccagcuccacucccaggagaagaccgucgagugcgaccacugcuga

SEQ ID NO: 52010 - RNA, 1584 nt, Artificial Sequence
  derived and/or modified sequence opt2 from ZKSCAN1__Homo_sapiens__NP_001273983
auguggggccaggacuccacccuccaggacacccccccccccgaccccgagaucuuccgccagcgcuuccgccgcuucugcuaccagaacaccuucggcccccgcgaggcccucucccgccucaaggagcucugccaccaguggcuccgccccgagaucaacaccaaggagcagauccucgagcuccucguccucgagcaguuccucuccauccuccccaaggagcuccaggucuggcuccaggaguaccgccccgacuccggcgaggaggccgucacccuccucgaggaccucgagcucgaccucuccggccagcagguccccggccagguccacggccccgagaugcucgcccgcggcauggucccccucgaccccguccaggaguccuccuccuucgaccuccaccacgaggccacccagucccacuucaagcacuccucccgcaagccccgccuccuccagucccgcgcccuccccgccgcccacauccccgcccccccccacgagggcuccccccgcgaccaggccauggccuccgcccucuucaccgccgacucccaggccauggucaagaucgaggacauggccgucucccucauccucgaggaguggggcugccagaaccucgcccgccgcaaccucucccgcgacaaccgccaggagaacuacggcuccgccuucccccagggcggcgagaaccgcaacgagaacgaggaguccaccuccaaggccgagaccuccgaggacuccgccucccgcggcgagaccaccggccgcucccagaaggaguucggcgagaagcgcgaccaggagggcaagaccggcgagcgccagcagaagaaccccgaggagaagacccgcaaggagaagcgcgacuccggccccgccaucggcaaggacaagaagaccaucaccggcgagcgcggcccccgcgagaagggcaagggccucggccgcuccuucucccucuccuccaacuucaccacccccgaggagguccccaccggcaccaagucccaccgcugcgacgagugcggcaagugcuucacccgcuccuccucccucauccgccacaagaucauccacaccggcgagaagcccuacgagugcuccgagugcggcaaggccuucucccucaacuccaaccucguccuccaccagcgcauccacaccggcgagaagccccacgagugcaacgagugcggcaaggccuucucccacuccuccaaccucauccuccaccagcgcauccacuccggcgagaagcccuacgagugcaacgagugcggcaaggccuucucccaguccuccgaccucaccaagcaccagcgcauccacaccggcgagaagcccuacgagugcuccgagugcggcaaggccuucaaccgcaacuccuaccucauccuccaccgccgcauccacacccgcgagaagcccuacaagugcaccaagugcggcaaggccuucacccgcuccuccacccucacccuccaccaccgcauccacgcccgcgagcgcgccuccgaguacucccccgccucccucgacgccuucggcgccuuccucaaguccugcgucuga

SEQ ID NO: 52011 - RNA, 1173 nt, Artificial Sequence
  derived and/or modified sequence opt2 from ZKSCAN3__Homo_sapiens__NP_001229824
auggcccuccucacccccgcccccggcucccaguccucccaguuccagcucaugaaggcccuccucaagcacgaguccgucggcucccagccccuccaggaccgcguccuccagguccccguccucgcccacggcggcugcugccgcgaggacaaggucgucgccucccgccucacccccgagucccagggccuccucaaggucgaggacgucgcccucacccucacccccgaguggacccagcaggacuccucccagggcaaccucugccgcgacgagaagcaggagaaccacggcucccucgucucccucggcgacgagaagcagaccaagucccgcgaccucccccccgccgaggagcuccccgagaaggagcacggcaagaucuccugccaccuccgcgaggacaucgcccagauccccaccugcgccgaggccggcgagcaggagggccgccuccagcgcaagcagaagaacgccaccggcggccgccgccacaucugccacgagugcggcaaguccuucgcccaguccuccggccucuccaagcaccgccgcauccacaccggcgagaagcccuacgagugcgaggagugcggcaaggccuucaucggcuccuccgcccucgucauccaccagcgcguccacaccggcgagaagcccuacgagugcgaggagugcggcaaggccuucucccacuccuccgaccucaucaagcaccagcgcacccacaccggcgagaagcccuacgagugcgacgacugcggcaagaccuucucccaguccugcucccuccucgagcaccaccgcauccacaccggcgagaagcccuaccagugcuccaugugcggcaaggccuuccgccgcuccucccaccuccuccgccaccagcgcauccacaccggcgacaagaacguccaggagcccgagcagggcgaggccuggaagucccgcauggagucccagcucgagaacgucgagacccccauguccuacaagugcaacgagugcgagcgcuccuucacccagaacaccggccucaucgagcaccagaagauccacaccggcgagaagcccuaccagugcaacgccugcggcaagggcuucacccgcaucuccuaccucguccagcaccagcgcucccacgucggcaagaacauccucucccaguga

SEQ ID NO: 52012 - RNA, 831 nt, Artificial Sequence
  derived and/or modified sequence opt2 from ZKSCAN7__Homo_sapiens__NP_001275520
augaccaccgccggccgcggcaaccucggccucaucccccgcuccaccgccuuccagaagcaggagggccgccucaccgucaagcaggagcccgccaaccagaccuggggccagggcuccucccuccagaagaacuacccccccgucugcgagaucuuccgccuccacuuccgccagcucugcuaccacgagauguccggcccccaggaggcccucucccgccuccgcgagcucugccgcugguggcucaugcccgagguccacaccaaggagcagauccucgagcuccucguccucgagcaguuccucuccauccuccccggcgagcuccgcaccuggguccagcuccaccaccccgaguccggcgaggaggccgucgccgucgucgaggacuuccagcgccaccucuccggcuccgaggaggucuccgcccccgcccagaagcaggagaugcacuucgaggagaccaccgcccucggcaccaccaaggaguccccccccaccuccccccucuccggcggcuccgcccccggcgcccaccucgagccccccuacgaccccggcacccaccaccuccccuccggcgacuucgcccagugcaccucccccguccccacccucccccaggucggcaacuccggcgaccaggccggcgccaccguccuccgcaugguccgcccccaggacaccgucgccuacgaggaccucuccgucgacuacacccagaagaaguggaagucccucacccucucccagcgcgcccuccaguggaacaugaugcccgagaaccaccacuccauggccucccucggcugguccaccauggccuga

SEQ ID NO: 52013 - RNA, 867 nt, Artificial Sequence
  derived and/or modified sequence opt2 from ZMAT3__Homo_sapiens__XP_005247763
augauccuccuccagcacgccguccuccccccccccaagcagcccucccccuccccccccauguccgucgccacccgcuccaccggcacccuccagcuccccccccagaagcccuucggccaggaggccucccucccccucgccggcgaggaggagcucuccaagggcggcgagcaggacugcgcccucgaggagcucugcaagccccucuacugcaagcucugcaacgucacccucaacuccgcccagcaggcccaggcccacuaccagggcaagaaccacggcaagaagcuccgcaacuacuacgccgccaacuccugccccccccccgcccgcauguccaacgucgucgagcccgccgccacccccgucguccccguccccccccagaugggcuccuucaagcccggcggccgcgucauccucgccaccgagaacgacuacugcaagcucugcgacgccuccuucuccucccccgccgucgcccaggcccacuaccagggcaagaaccacgccaagcgccuccgccucgccgaggcccaguccaacuccuucuccgaguccuccgagcucggccagcgccgcgcccgcaaggagggcaacgaguucaagaugaugcccaaccgccgcaacauguacaccguccagaacaacuccggccccuacuucaacccccgcucccgccagcgcaucccccgcgaccucgccaugugcgucacccccuccggccaguucuacugcuccaugugcaacgucggcgccggcgaggagauggaguuccgccagcaccucgaguccaagcagcacaaguccaaggucuccgagcagcgcuaccgcaacgagauggagaaccucggcuacgucuga

SEQ ID NO: 52014 - RNA, 462 nt, Artificial Sequence
  derived and/or modified sequence opt2 from ZMAT4__Homo_sapiens__NP_001129203
augaaguccuccgacaucgaccaggaccucuucaccgacuccuacugcaaggucugcuccgcccagcucaucuccgagucccagcgcgucgcccacuacgagucccgcaagcacgccuccaagguccgccucuacuacaugcuccacccccgcgacggcggcugccccgccaagcgccuccgcuccgagaacggcuccgacgccgacauggucgacaagaacaagugcugcacccucugcaacauguccuucaccuccgccgucgucgccgacucccacuaccagggcaagauccacgccaagcgccucaagcuccuccucggcgagaagaccccccucaagaccaccggccuccgccgcaacuaccgcugcaccaucugcuccgucucccucaacuccaucgagcaguaccacgcccaccucaagggcuccaagcaccagaccaaccucaagaacaaguga

SEQ ID NO: 52015 - RNA, 3204 nt, Artificial Sequence
  derived and/or modified sequence opt2 from ZMIZ1__Homo_sapiens__NP_065071
augaacuccauggaccgccacauccagcagaccaacgaccgccuccagugcaucaagcagcaccuccagaaccccgccaacuuccacaacgccgccaccgagcuccucgacuggugcggcgacccccgcgccuuccagcgccccuucgagcagucccucaugggcugccucaccgucgucucccgcgucgccgcccagcagggcuucgaccucgaccucggcuaccgccuccucgccgucugcgccgccaaccgcgacaaguucacccccaaguccgccgcccuccucuccuccuggugcgaggagcucggccgccuccuccuccuccgccaccagaagucccgccaguccgacccccccggcaagcuccccaugcagcccccccucuccuccauguccuccaugaagcccacccucucccacuccgacggcuccuuccccuacgacuccguccccuggcagcagaacaccaaccagccccccggcucccucuccgucgucaccaccgucuggggcgucaccaacaccucccagucccagguccucggcaaccccauggccaacgccaacaaccccaugaaccccggcggcaaccccauggccuccggcaugaccaccuccaaccccggccucaacuccccccaguucgccggccagcagcagcaguucuccgccaaggccggccccgcccagcccuacauccagcaguccauguacggccgccccaacuaccccggcuccggcggcuucggcgccuccuaccccggcggccccaacgcccccgccggcaugggcauccccccccacacccgcccccccgccgacuucacccagcccgccgccgccgccgccgccgccgccgucgccgccgccgccgccaccgccaccgccaccgccaccgccaccgucgccgcccuccaggagacccagaacaaggacaucaaccaguacggccccaugggccccacccaggccuacaacucccaguucaugaaccagcccggcccccgcggccccgccuccaugggcggcuccaugaaccccgccuccauggccgccggcaugacccccuccggcauguccggcccccccaugggcaugaaccagccccgcccccccggcaucucccccuucggcacccacggccagcgcaugccccagcagaccuaccccggcccccgcccccagucccuccccauccagaacaucaagcgccccuaccccggcgagcccaacuacggcaaccagcaguacggccccaacucccaguuccccacccagcccggccaguaccccgcccccaaccccccccgcccccucaccucccccaacuaccccggccagcgcaugcccucccagcccuccuccggccaguaccccccccccaccgucaacaugggccaguacuacaagcccgagcaguucaacggccagaacaacaccuucuccggcuccuccuacuccaacuacucccagggcaacgucaaccgccccccccgccccguccccgucgccaacuacccccacucccccguccccggcaaccccaccccccccaugacccccggcuccuccaucccccccuaccucucccccucccaggacgucaagccccccuucccccccgacaucaagcccaacauguccgcccucccccccccccccgccaaccacaacgacgagcuccgccucaccuuccccguccgcgacggcgucguccucgagcccuuccgccucgagcacaaccucgccgucuccaaccacgucuuccaccuccgccccaccguccaccagacccucauguggcgcuccgaccucgagcuccaguucaagugcuaccaccacgaggaccgccagaugaacaccaacuggcccgccuccguccaggucuccgucaacgccaccccccucaccaucgagcgcggcgacaacaagaccucccacaagccccuccaccucaagcacgucugccagcccggccgcaacaccauccagaucaccgucaccgccugcugcugcucccaccucuucguccuccagcucguccaccgccccuccguccgcuccguccuccagggccuccucaagaagcgccuccuccccgccgagcacugcaucaccaagaucaagcgcaacuucuccuccgucgccgccuccuccggcaacaccacccucaacggcgaggacggcgucgagcagaccgccaucaaggucucccucaagugccccaucaccuuccgccgcauccagcuccccgcccgcggccacgacugcaagcacguccagugcuucgaccucgaguccuaccuccagcucaacugcgagcgcggcaccuggcgcugccccgucugcaacaagaccgcccuccucgagggccucgaggucgaccaguacauguggggcauccucaacgccauccagcacuccgaguucgaggaggucaccaucgaccccaccugcuccuggcgccccguccccaucaaguccgaccuccacaucaaggacgaccccgacggcauccccuccaagcgcuucaagaccaugucccccucccagaugaucaugcccaacgucauggagaugaucgccgcccucggccccggccccucccccuacccccucccccccccccccggcggcaccaacuccaacgacuacuccucccagggcaacaacuaccagggccacggcaacuucgacuucccccacggcaaccccggcggcaccuccaugaacgacuucaugcacggccccccccagcucucccacccccccgacaugcccaacaacauggccgcccucgagaagccccucucccaccccaugcaggagaccaugccccacgccggcuccuccgaccagccccaccccuccauccagcagggccuccacgucccccaccccuccucccaguccggccccccccuccaccacuccggcgcccccccccccccccccucccagcccccccgccagcccccccaggccgcccccuccucccacccccacuccgaccucaccuucaaccccuccuccgcccucgagggccaggccggcgcccagggcgccuccgacaugcccgagcccucccucgaccuccuccccgagcucaccaaccccgacgagcuccucuccuaccucgacccccccgaccuccccuccaacuccaacgacgaccuccucucccucuucgagaacaacuga

SEQ ID NO: 52016 - RNA, 4200 nt, Artificial Sequence
  derived and/or modified sequence opt2 from ZMYM2__Homo_sapiens__XP_011533519
augugcauccuccucuccgccgucgucaccuggauccccucccucgaccuccucgucuucuucggcauggacaccuccuccgucggcggccucgagcucaccgaccagacccccguccuccucggcuccaccgccauggccaccucccucaccaacgucggcaacuccuucuccggccccgccaacccccucgucucccgcuccaacaaguuccagaacuccuccgucgaggacgacgacgacgucgucuucaucgagcccguccagccccccccccccuccguccccgucgucgccgaccagcgcaccaucaccuucaccuccuccaagaacgaggagcuccagggcaacgacuccaagaucacccccuccuccaaggagcucgccucccagaagggcuccgucuccgagaccaucgucaucgacgacgaggaggacauggagaccaaccagggccaggagaagaacuccuccaacuucaucgagcgccgcccccccgagaccaagaaccgcaccaacgacgucgacuucuccaccuccuccuucucccgcuccaaggucaacgccggcaugggcaacuccggcaucaccaccgagcccgacuccgagauccagaucgccaacgucaccacccucgagaccggcgucuccuccgucaacgacggccagcucgagaacaccgacggccgcgacaugaaccucaugaucacccacgucaccucccuccagaacaccaaccucggcgacgucuccaacggccuccaguccuccaacuucggcgucaacauccagaccuacacccccucccucaccucccagaccaagaccggcgucggccccuucaaccccggccgcaugaacgucgccggcgacgucuuccagaacggcgaguccgccacccaccacaaccccgacuccuggaucucccaguccgccuccuucccccgcaaccagaagcagcccggcgucgacucccucucccccgucgccucccuccccaagcagaucuuccagcccuccguccagcagcagcccaccaagcccgucaaggucaccugcgccaacugcaagaagccccuccagaagggccagaccgccuaccagcgcaagggcuccgcccaccucuucugcuccaccaccugccucuccuccuucucccacaagcccgcccccaagaagcucugcgucaugugcaagaaggacaucaccaccaugaagggcaccaucgucgcccaggucgacuccuccgaguccuuccaggaguucugcuccaccuccugccucucccucuacgaggacaagcagaaccccaccaagggcgcccucaacaagucccgcugcaccaucugcggcaagcucaccgagauccgccacgaggucuccuucaagaacaugacccacaagcucugcuccgaccacugcuucaaccgcuaccgcauggccaacggccucaucaugaacugcugcgagcagugcggcgaguaccuccccuccaagggcgccggcaacaacguccucgucaucgacggccagcagaagcgcuucugcugccaguccugcgucuccgaguacaagcaggucggcucccaccccuccuuccucaaggagguccgcgaccacaugcaggacuccuuccucaugcagcccgagaaguacggcaagcucaccaccugcaccggcugccgcacccagugccgcuucuucgacaugacccagugcaucggccccaacggcuacauggagcccuacugcuccaccgccugcaugaacucccacaagaccaaguacgccaagucccagucccucggcaucaucugccacuucugcaagcgcaacucccucccccaguaccaggccaccaugcccgacggcaagcucuacaacuucugcaacuccuccugcgucgccaaguuccaggcccucuccaugcaguccucccccaacggccaguucgucgcccccuccgacauccagcucaagugcaacuacugcaagaacuccuucugcuccaagcccgagauccucgagugggagaacaagguccaccaguucugcuccaagaccugcuccgacgacuacaagaagcuccacugcaucgucaccuacugcgaguacugccaggaggagaagacccuccacgagaccgucaacuucuccggcgucaagcgccccuucugcuccgagggcugcaagcuccucuacaagcaggacuucgcccgccgccucggccuccgcugcgucaccugcaacuacugcucccagcucugcaagaagggcgccaccaaggagcucgacggcgucguccgcgacuucugcuccgaggacugcugcaagaaguuccaggacugguacuacaaggccgcccgcugcgacugcugcaagucccagggcacccucaaggagcgcguccaguggcgcggcgagaugaagcacuucugcgaccagcacugccuccuccgcuucuacugccagcagaacgagcccaacaugaccacccagaagggccccgagaaccuccacuacgaccagggcugccagaccucccgcaccaagaugaccggcuccgcccccccccccucccccacccccaacaaggagaugaagaacaaggccguccucugcaagccccucaccaugaccaaggccaccuacugcaagccccacaugcagaccaaguccugccagaccgacgacaccuggcgcaccgaguacguccccguccccauccccguccccgucuacauccccguccccaugcacauguacucccagaacauccccguccccaccaccguccccguccccguccccguccccgucuuccuccccgccccccucgacuccuccgagaagauccccgccgccaucgaggagcucaaguccaaggucuccuccgacgcccucgacaccgagcuccucaccaugaccgacaugauguccgaggacgagggcaagaccgagaccaccaacaucaacuccgucaucaucgagaccgacaucaucggcuccgaccuccucaagaacuccgaccccgagacccaguccuccaugcccgacguccccuacgagcccgaccucgacaucgagaucgacuucccccgcgccgccgaggagcucgacauggagaacgaguuccuccucccccccgucuucggcgaggaguacgaggagcagccccgcccccgcuccaagaagaagggcgccaagcgcaaggccgucuccggcuaccagucccacgacgacuccuccgacaacuccgagugcuccuuccccuucaaguacaccuacggcgucaacgccuggaagcacugggucaagacccgccagcucgacgaggaccuccucguccucgacgagcucaaguccuccaaguccgucaagcucaaggaggaccuccucucccacaccaccgccgagcucaacuacggccucgcccacuucgucaacgagauccgccgccccaacggcgagaacuacgcccccgacuccaucuacuaccucugccucggcauccaggaguaccucugcggcuccaaccgcaaggacaacaucuucaucgaccccggcuaccagaccuucgagcaggagcucaacaagauccuccgcuccuggcagcccuccauccuccccgacggcuccaucuucucccgcgucgaggaggacuaccucuggcgcaucaagcagcucggcucccacucccccgucgcccuccucaacacccucuucuacuucaacaccaaguacuucggccucaagaccgucgagcagcaccuccgccucuccuucggcaccgucuuccgccacuggaagaagaacccccucaccauggagaacaaggccugccuccgcuaccaggucuccucccucugcggcaccgacaacgaggacaagaucaccaccggcaagcgcaagcacgaggacgacgagcccgucuucgagcagaucgagaacaccgccaaccccucccgcugccccgucaagauguucgagugcuaccucuccaaguccccccagaaccucaaccagcgcauggacgucuucuaccuccagcccgagugcuccuccuccaccgacucccccgucugguacaccuccaccucccucgaccgcaacacccucgagaacaugcucguccgcguccuccucgucaaggacaucuacgacaaggacaacuacgagcucgacgaggacaccgacuga

SEQ ID NO: 52017 - RNA, 4077 nt, Artificial Sequence
  derived and/or modified sequence opt2 from ZMYM3__Homo_sapiens__NP_001164633
auggaccccuccgacuuccccucccccuucgacccccucacccuccccgagaagccccucgccggcgaccuccccgucgacauggaguucggcgaggaccuccucgagucccagaccgcccccacccgcggcugggccccccccggccccucccccuccuccggcgcccucgaccuccucgacacccccgccggccucgagaaggaccccggcguccucgacggcgccaccgagcuccucggccucggcggccuccucuacaaggcccccuccccccccgaggucgaccacggccccgagggcacccucgccugggacgccggcgaccagacccucgagcccggccccggcggccagacccccgaggucgucccccccgaccccggcgccggcgccaacuccugcucccccgagggccuccucgagccccucgcccccgacucccccaucacccuccaguccccccacaucgaggaggaggagaccaccuccaucgccaccgcccgccgcggcucccccggccaggaggaggagcucccccagggccagccccagucccccaacgccccccccucccccuccgucggcgagacccucggcgacggcaucaacuccucccagaccaagcccggcggcuccuccccccccgcccaccccucccuccccggcgacggccucaccgccaaggccuccgagaagccccccgagcgcaagcgcuccgagcgcguccgccgcgccgagccccccaagcccgaggucgucgacuccaccgaguccauccccgucuccgacgaggacuccgacgccauggucgacgaccccaacgacgaggacuucguccccuuccgcccccgccgcuccccccgcaugucccuccgcuccuccgucucccagcgcgccggccgcuccgccgucggcaccaagaugaccugcgcccacugccgcaccccccuccagaagggccagaccgccuaccagcgcaagggccucccccagcucuucugcuccuccuccugccucaccaccuucuccaagaagcccuccggcaagaagaccugcaccuucugcaagaaggagaucuggaacaccaaggacuccgucgucgcccagaccggcuccggcggcuccuuccacgaguucugcaccuccgucugccucucccucuacgaggcccagcagcagcgccccaucccccaguccggcgaccccgccgacgccacccgcugcuccaucugccagaagaccggcgagguccuccacgaggucuccaacggcuccgucguccaccgccucugcuccgacuccugcuucuccaaguuccgcgccaacaagggccucaagaccaacugcugcgaccagugcggcgccuacaucuacaccaagaccggcucccccggccccgagcuccucuuccacgagggccagcagaagcgcuucugcaacaccaccugccucggcgccuacaagaagaagaacacccgcgucuaccccugcgucuggugcaagacccucugcaagaacuucgagaugcucucccacgucgaccgcaacggcaagaccucccucuucugcucccucugcugcaccaccuccuacaaggucaagcaggccggccucaccggccccccccgccccugcuccuucugccgccgcucccucuccgaccccugcuacuacaacaaggucgaccgcaccgucuaccaguucugcucccccuccugcuggaccaaguuccagcgcaccucccccgagggcggcauccaccucuccugccacuacugccacucccucuucuccggcaagcccgagguccucgacuggcaggaccaggucuuccaguucugcugccgcgacugcugcgaggacuucaagcgccuccgcggcgucgucucccagugcgagcacugccgccaggagaagcuccuccacgagaagcuccgcuucuccggcgucgagaaguccuucugcuccgagggcugcguccuccucuacaagcaggacuucaccaagaagcucggccucugcugcaucaccugcaccuacugcucccagaccugccagcgcggcgucaccgagcagcucgacggcuccaccugggacuucugcuccgaggacugcaaguccaaguaccuccucugguacugcaaggccgcccgcugccacgccugcaagcgccagggcaagcuccucgagaccauccacuggcgcggccagauccgccacuucugcaaccagcagugccuccuccgcuucuacucccagcagaaccagcccaaccucgacacccaguccggccccgagucccuccucaacucccagucccccgaguccaagccccagacccccucccagaccaaggucgagaacuccaacaccauccccgucaagacccgcuccgcccccaccgcccccacccccccccccccccccccccccgccaccccccgcaagaacaaggccgccaugugcaagccccucaugcagaaccgcggcgucuccugcaaggucgagaugaaguccaagggcucccagaccgaggaguggaagccccaggucaucguccuccccauccccguccccaucuucguccccguccccaugcaccucuacugccagaagguccccguccccuucuccaugcccauccccguccccguccccauguuccuccccaccacccucgaguccaccgacaagaucgucgagaccaucgaggagcucaaggucaagauccccuccaacccccucgaggccgacauccucgccauggccgagaugaucgccgaggccgaggagcucgacaaggccuccuccgaccucugcgaccucgucuccaaccaguccgccgagggccuccucgaggacugcgaccucuucggccccgcccgcgacgacguccucgccauggccgucaagauggccaacguccucgacgagcccggccaggaccucgaggccgacuuccccaagaacccccucgacaucaaccccuccgucgacuuccucuucgacugcggccucgucggccccgaggacgucuccaccgagcaggaccucccccgcaccaugcgcaagggccagaagcgccucguccucuccgaguccugcucccgcgacuccauguccucccagcccuccugcaccggccucaacuacuccuacggcgucaacgccuggaagugcuggguccaguccaaguacgccaacggcgagaccuccaagggcgacgagcuccgcuucggccccaagcccaugcgcaucaaggaggacauccucgccugcuccgccgccgagcucaacuacggccucgcccaguucguccgcgagaucacccgccccaacggcgagcgcuacgagcccgacuccaucuacuaccucugccucggcauccagcaguaccuccucgagaacaaccgcauggucaacaucuucaccgaccucuacuaccucaccuucguccaggagcucaacaagucccucuccaccuggcagcccacccuccuccccaacaacaccgucuucucccgcgucgaggaggagcaccucugggagugcaagcagcucggcgucuacucccccuucguccuccucaacacccucauguucuucaacaccaaguucuucggccuccagaccgccgaggagcacaugcagcucuccuucaccaacgucguccgccagucccgcaagugcaccaccccccgcggcaccaccaaggucgucuccauccgcuacuacgcccccguccgccagcgcaagggccgcgacaccggccccggcaagcgcaagcgcgaggacgaggcccccauccucgagcagcgcgagaaccgcaugaacccccuccgcugccccgucaaguucuacgaguucuaccucuccaagugccccgagucccuccgcacccgcaacgacgucuucuaccuccagcccgagcgcuccugcaucgccgaguccccccucugguacuccgucauccccauggaccgcuccaugcucgaguccaugcucaaccgcauccucgccguccgcgagaucuacgaggagcucggccgccccggcgaggaggaccucgacuga

SEQ ID NO: 52018 - RNA, 4551 nt, Artificial Sequence
  derived and/or modified sequence opt2 from ZMYM4__Homo_sapiens__XP_011540726
auggacaccgagauguccgaggacaucgaccacaaccucacccccacccucgacuccauguccuacggcaugcccaaccagaccggcuccgagaacucccuccucgacgaggacgacuacuuccucaacuccggcgaccucgccggcauccccgucgucggcuccgacaacgaggacgagcaggacuucuccuccaaggacaaccucgucuccuccauccacaccgacgacucccucgaggucgagcgccgcgucacccagcacgaguccgacaacgagaacgagauccagauccagaacaagcucaagaaggacuuccccaagcaguucgaccaggucuccgucuucaaguccauccgcaaggacuucucccucguccgcgagaacuccaaggagaccuucuccggcaaggagaagaaccgcgaccucaccuacgagcgcgagaagcgccucgacaagccccacaaggaccucgacucccgccucaaguccuccuucuucgacaaggccgccaaccaggucgaggagacccuccacacccaccucccccagacccccgagaccaacuuccgcgacuccuccuaccccuucgccaacaaggaguccaucggcuccgagcucggcaacuccuucgccuccaacauccgcaucaaggaggagccccucgacgacgaguacgacaaggccauggccccccagcagggccuccucgacaagaucaaggacgagcccgacaacgcccaggaguacucccacggccagcagcagaagacccaggagggcgagcucaagaucuccgccgucuucuccgucuccggcuccccccucgccccccagcucaccaccggcuuccagcccucccucgccuccuccggcaugaacaagaugcuccccuccguccccgccaccgccguccgcgucuccugcuccggcugcaagaagauccuccagaagggccagaccgccuaccagcgcaagggcuccacccagcucuucugcuccacccucugccucaccggcuacaccgucccccccgcccgccccccccccccccucaccaagaagaccugcuccuccugcuccaaggacauccucaaccccaaggacgucaucuccgcccaguucgagaacaccaccaccuccaaggacuucugcucccaguccugccucuccaccuacgagcucaagaagaagcccaucgucaccaucaacaccaacuccaucuccaccaagugcuccaugugccagaagaacgccgucauccgccacgaggucaacuaccagaacgucguccacaagcucugcuccgacgccugcuucuccaaguuccgcuccgccaacaaccucaccaugaacugcugcgagaacugcggcggcuacugcuacuccggcuccggccagugccacaugcuccagaucgagggccaguccaagaaguucugcuccuccuccugcaucaccgccuacaagcagaaguccgccaagaucacccccugcgcccucugcaagucccuccgcuccuccgccgagaugaucgagaacaccaacucccucggcaagaccgagcucuucugcuccgucaacugccucuccgccuaccgcgucaagauggucaccuccgccggcguccagguccagugcaacuccugcaagaccuccgccaucccccaguaccaccucgccauguccgacggcuccauccgcaacuucugcuccuacuccugcgucgucgccuuccagaaccucuucaacaagcccaccggcaugaacuccuccgucgucccccucucccagggccaggucaucgucuccauccccaccggcuccaccgucuccgccggcggcggcuccaccuccgccgucucccccaccuccaucuccuccuccgccgccgccggccuccagcgccucgccgcccagucccagcacgucggcuucgcccgcuccgucgucaagcucaagugccagcacugcaaccgccucuucgccaccaagcccgagcuccucgacuacaagggcaagauguuccaguucugcggcaagaacugcuccgacgaguacaagaagaucaacaacgucauggccaugugcgaguacugcaagaucgagaagaucgucaaggagaccguccgcuucuccggcgccgacaaguccuucugcuccgagggcugcaagcuccucuacaagcacgaccucgccaagcgcuggggcaaccacugcaagaugugcuccuacugccuccagaccucccccaagcucguccagaacaaccucggcggcaaggucgaggaguucugcugcgaggagugcauguccaaguacaccguccucuucuaccagauggccaagugcgacgccugcaagcgccagggcaagcucuccgagucccucaaguggcgcggcgagaugaagcacuucugcaaccuccucugcauccucauguucugcaaccagcaguccgucugcgacccccccucccagaacaacgccgccaacaucuccaugguccaggccgccuccgccggcccccccucccuccgcaaggacuccacccccgucaucgccaacgucgucucccucgccuccgcccccgccgcccagcccaccgucaacuccaacuccguccuccagggcgccguccccaccgucaccgccaagaucaucggcgacgccuccacccagaccgacgcccucaagcucccccccucccagcccccccgccuccucaagaacaaggcccuccucugcaagcccaucacccagaccaaggccaccuccugcaagccccacacccagaacaaggagugccagaccgaggacacccccucccagccccagaucaucgucguccccguccccguccccgucuucguccccaucccccuccaccucuacacccaguacgcccccguccccuucggcauccccguccccaugcccguccccaugcucauccccuccuccauggacuccgaggacaaggucaccgaguccaucgaggacaucaaggagaagcuccccacccaccccuucgaggccgaccuccucgagauggccgagaugaucgccgaggacgaggagaagaagacccucucccagggcgagucccagaccuccgagcacgagcucuuccucgacaccaagaucuucgagaaggaccagggcuccaccuacuccggcgaccucgaguccgaggccgucuccaccccccacuccugggaggaggagcucaaccacuacgcccucaaguccaacgccguccaggaggccgacuccgagcucaagcaguucuccaagggcgagaccgagcaggaccucgaggccgacuuccccuccgacuccuucgacccccucaacaagggccagggcauccaggcccgcucccgcacccgccgccgccaccgcgacggcuucccccagccccgccgccgcggccgcaagaaguccaucgucgccgucgagccccgcucccucauccagggcgccuuccagggcugcuccgucuccggcaugacccucaaguacauguacggcgucaacgccuggaagaacuggguccaguggaagaacgccaaggaggagcagggcgaccucaagugcggcggcgucgagcaggccuccuccuccccccgcuccgacccccucggcuccacccaggaccacgcccucucccaggaguccuccgagcccggcugccgcguccgcuccaucaagcucaaggaggacauccucuccugcaccuucgccgagcucucccucggccucugccaguucauccaggagguccgccgccccaacggcgagaaguacgaccccgacuccauccucuaccucugccucggcauccagcaguaccucuucgagaacggccgcaucgacaacaucuucaccgagcccuacucccgcuucaugaucgagcucaccaagcuccucaagaucugggagcccaccauccuccccaacggcuacauguucucccgcaucgaggaggagcaccucugggagugcaagcagcucggcgccuacucccccaucguccuccucaacacccuccucuucuucaacaccaaguacuuccagcucaagaacgucaccgagcaccucaagcucuccuucgcccacgucaugcgccgcacccgcacccucaaguacuccaccaagaugaccuaccuccgcuucuuccccccccuccagaagcaggaguccgagcccgacaagcucaccgucggcaagcgcaagcgcaacgaggacgacgagguccccgucggcgucgagauggccgagaacaccgacaacccccuccgcugccccguccgccucuacgaguucuaccucuccaagugcuccgaguccgucaagcagcgcaacgacgucuucuaccuccagcccgagcgcuccugcguccccaacucccccaugugguacuccaccuuccccaucgaccccggcacccucgacaccaugcucacccgcauccucaugguccgcgagguccacgaggagcucgccaaggccaaguccgaggacuccgacgucgagcucuccgacuga

SEQ ID NO: 52019 - RNA, 627 nt, Artificial Sequence
  derived and/or modified sequence opt2 from ZMYM5__Homo_sapiens__NP_001034738
auggagaagugcuccgucggcggccucgagcucaccgagcagacccccgcccuccucggcaacauggccauggccaccucccucauggacaucggcgacuccuucggccaccccgccugcccccucgucucccgcucccgcaacucccccgucgaggacgacgacgacgacgacgacgucgucuucaucgaguccauccagccccccuccaucuccgcccccgccaucgccgaccagcgcaacuucaucuucgccuccuccaagaacgagaagccccagggcaacuacuccgucaucccccccuccucccgcgaccucgccucccagaagggcaacaucuccgagaccaucgucaucgacgacgaggaggacaucgagaccaacggcggcgccgagaagaaguccuccugcuucaucgaguggggccuccccggcaccaagaacaagaccaacgaccucgacuucuccaccuccucccucucccgcuccaagaccaagaccggcguccgccccuucaaccccggccgcaugaacgucgccggcgaccucuuccagaacggcgaguucgccacccaccacucccccgagaugcaccuccagcgccgccucauguccuucuuccaguga

SEQ ID NO: 52020 - RNA, 1323 nt, Artificial Sequence
  derived and/or modified sequence opt2 from ZMYND10__Homo_sapiens__NP_056980
augggcgaccucgagcuccuccuccccggcgaggccgagguccucguccgcggccuccgcuccuucccccuccgcgagaugggcuccgagggcuggaaccagcagcacgagaaccucgagaagcucaacaugcaggccauccucgacgccaccgucucccagggcgagcccauccaggagcuccucgucacccacggcaagguccccacccucgucgaggagcucaucgccgucgagauguggaagcagaaggucuuccccgucuucugccgcgucgaggacuucaagccccagaacaccuuccccaucuacauggucguccaccacgaggccuccaucaucaaccuccucgagaccgucuucuuccacaaggaggucugcgaguccgccgaggacaccguccucgaccucgucgacuacugccaccgcaagcucacccuccucgucgcccaguccggcugcggcggcccccccgagggcgagggcucccaggacuccaaccccaugcaggagcuccagaagcaggccgagcucauggaguucgagaucgcccucaaggcccucuccguccuccgcuacaucaccgacugcgucgacucccucucccucuccacccucucccgcaugcucuccacccacaaccuccccugccuccucgucgagcuccucgagcacucccccuggucccgccgcgagggcggcaagcuccagcaguucgagggcucccgcuggcacaccgucgcccccuccgagcagcagaagcucuccaagcucgacggccaggucuggaucgcccucuacaaccuccuccucucccccgaggcccaggcccgcuacugccucaccuccuucgccaagggccgccuccucaagcuccgcgccuuccucaccgacacccuccucgaccagcuccccaaccucgcccaccuccaguccuuccucgcccaccucacccucaccgagacccagccccccaagaaggaccucguccucgagcagauccccgagaucugggagcgccucgagcgcgagaaccgcggcaaguggcaggccaucgccaagcaccagcuccagcacgucuucucccccuccgagcaggaccuccgccuccaggcccgccgcugggccgagaccuaccgccucgacguccucgaggccgucgcccccgagcgcccccgcugcgccuacugcuccgccgaggccuccaagcgcugcucccgcugccagaacgagugguacugcugccgcgagugccaggucaagcacugggagaagcacggcaagaccugcguccucgccgcccagggcgaccgcgccaaguga

SEQ ID NO: 52021 - RNA, 1554 nt, Artificial Sequence
  derived and/or modified sequence opt2 from ZMYND11__Homo_sapiens__NP_001189394
auggcccgccucaccaagcgccgccaggccgacaccaaggccauccagcaccucugggccgccaucgagaucauccgcaaccagaagcagaucgccaacaucgaccgcaucaccaaguacaugucccgcguccacggcaugcaccccaaggagaccacccgccagcucucccucgccgucaaggacggccucaucgucgagacccucaccgucggcugcaagggcuccaaggccggcaucgagcaggagggcuacuggcuccccggcgacgagaucuccaucaagaagaagaacaccaacaagcaggagaugggcaccuaccuccgcuucaucgucucccgcaugaaggagcgcaaggucaacgagggcaaguaccgcuccuacgaggaguucaaggccgacgcccagcuccuccuccacaacaccgucaucuucuacggcgccgacuccgagcaggccgacaucgcccgcaugcucuacaaggacaccugccacgagcucgacgagcuccagcucugcaagaacugcuucuaccucuccaacgcccgccccgacaacugguucugcuaccccugcauccccaaccacgagcucgucugggccaagaugaagggcuucggcuucuggcccgccaaggucaugcagaaggaggacaaccaggucgacguccgcuucuucggccaccaccaccagcgcgccuggauccccuccgagaacauccaggacaucaccgucaacauccaccgccuccacgucaagcgcuccaugggcuggaagaaggccugcgacgagcucgagcuccaccagcgcuuccuccgcgagggccgcuucuggaaguccaagaacgaggaccgcggcgaggaggaggccgaguccuccaucuccuccaccuccaacgagcagcucaaggucacccaggagccccgcgccaagaagggccgccgcaaccaguccgucgagcccaagaaggaggagcccgagcccgagaccgaggccgucuccuccucccaggagauccccaccaugccccagcccaucgagaaggucuccgucuccacccagaccaagaagcucuccgccuccuccccccgcaugcuccaccgcuccacccagaccaccaacgacggcgucugccaguccaugugccacgacaaguacaccaagaucuucaacgacuucaaggaccgcaugaaguccgaccacaagcgcgagaccgagcgcgucguccgcgaggcccucgagaagcuccgcuccgagauggaggaggagaagcgccaggccgucaacaaggccgucgccaacaugcagggcgagauggaccgcaagugcaagcaggucaaggagaagugcaaggaggaguucgucgaggagaucaagaagcucgccacccagcacaagcagcucaucucccagaccaagaagaagcaguggugcuacaacugcgaggaggaggccauguaccacugcugcuggaacaccuccuacugcuccaucaagugccagcaggagcacuggcacgccgagcacaagcgcaccugccgccgcaagcgcuga

SEQ ID NO: 52022 - RNA, 465 nt, Artificial Sequence
  derived and/or modified sequence opt2 from ZMYND8__Homo_sapiens__NP_001268698
augcacccccagucccucgccgaggaggagaucaagaccgagcaggaggucgucgagggcauggacaucuccacccgcuccaaggaccccggcuccgccgagcgcaccgcccagaagcgcaaguuccccucccccccccacuccuccaacggccacuccccccaggacaccuccaccucccccaucaagaagaagaagaagcccggccuccucaacuccaacaacaaggagcaguccgagcuccgccacggccccuucuacuacaugaagcagccccucaccaccgaccccgucgacgucgucccccaggacggccgcaacgacuucuacugcugggucugccaccgcgagggccagguccucugcugcgagcucugcccccgcgucuaccacgccaagugccuccgccucaccuccgagcccgagggcgacugguucugccccgagugcgaggucuccuccuga

SEQ ID NO: 52023 - RNA, 3336 nt, Artificial Sequence
  derived and/or modified sequence opt2 from ZNF106__Homo_sapiens__NP_001271236
augguccgcgagcgcaagugcauccucugccacaucgucuacuccuccaagaaggagauggacgagcacaugcgcuccaugcuccaccaccgcgagcucgagaaccucaagggccgcuucggcaucgagauggucccccucguccagaacgagcaggaggcccucgaccucgacggcgagcccgaccucuccucccucgagggcuuccagugggagggcgucuccaucuccuccucccccggccucgcccgcaagcgcucccucuccgaguccuccgucaucauggaccgcgcccccuccgucuacuccuucuucuccgaggagggcaccggcaaggagaacgagccccagcagauggucucccccuccaacucccuccgcgccggccagucccagaaggccaccaugcaccucaagcaggaggucaccccccgcgccgccucccuccgcaccggcgagcgcgccgagaacgucgccacccagcgccgccacuccgcccagcucuccuccgaccacaucaucccccucaugcaccucgccaaggaccucaacucccaggagcgcuccaucccccccuccgagaaccagaacucccaggaguccaacggcgagggcaacugccucuccuccuccgccuccuccgcccucgccaucuccucccucgccgacgccgccaccgacuccuccugcaccuccggcgccgagcagaacgacggccaguccauccgcaagaagcgccgcgccaccggcgacggcuccucccccgagcuccccucccucgagcgcaagaacaagcgccgcaagaucaagggcaagaaggagcgcucccaggucgaccagcuccucaacaucucccuccgcgaggaggagcucuccaagucccuccagugcauggacaacaaccuccuccaggcccgcgccgcccuccagaccgccuacgucgagguccagcgccuccucaugcucaagcagcagaucaccauggagauguccgcccuccgcacccaccgcauccagauccuccagggccuccaggagaccuacgagcccuccgagcaccccgaccagguccccugcucccucacccgcgagcgccgcaacucccgcucccagaccuccaucgacgccgcccuccuccccacccccuucuucccccucuuccucgagccccccuccucccacgucucccccucccccaccggcgccucccuccagaucaccaccucccccaccuuccagacccacggcuccguccccgcccccgacuccuccguccagaucaagcaggagcccaugucccccgagcaggacgagaacgucaacgccgucccccccuccuccgccugcaacgucuccaaggagcuccucgaggccaaccgcgagaucuccgacuccugccccgucuaccccgucaucaccgcccgccucucccuccccgaguccaccgaguccuuccacgagcccucccaggagcucaaguucuccgucgagcagcgcaacacccgcaaccgcgagaacucccccuccucccaguccgccggccucuccuccaucaacaaggagggcgaggagcccaccaagggcaacuccggcuccgaggccugcaccuccuccuuccuccgccucuccuucgccuccgagaccccccucgagaaggagccccacucccccgccgaccagcccgagcagcaggccgaguccacccucaccuccgccgagacccgcggcuccaagaagaagaagaagcuccgcaagaagaagucccuccgcgccgcccacguccccgagaacuccgacaccgagcaggacguccucaccgucaagcccguccgcaaggucaaggccggcaagcucaucaagggcggcaaggucaccaccuccaccugggaggacucccgcaccggccgcgagcaggaguccguccgcgacgagcccgacuccgacuccucccucgagguccucgagauccccaacccccagcucgaggucgucgccaucgacuccuccgaguccggcgaggagaagcccgacucccccuccaagaaggacaucuggaacuccaccgagcagaacccccucgagaccucccgcuccggcugcgacgaggucuccuccaccuccgagaucggcacccgcuacaaggacggcauccccgucuccgucgccgagacccagaccgucaucuccuccaucaagggcuccaagaacuccuccgagaucuccuccgagcccggcgacgacgacgagcccaccgagggcuccuucgagggccaccaggccgccgucaacgccauccagaucuucggcaaccuccucuacaccugcuccgccgacaagaccguccgcgucuacaaccucgucucccgcaagugcaucggcgucuucgagggccacaccuccaaggucaacugccuccucgucacccagaccuccggcaagaacgccgcccucuacaccggcuccuccgaccacaccauccgcugcuacaacgucaagucccgcgagugcgucgagcagcuccagcucgaggaccgcguccucugccuccacucccgcuggcgcauccucuacgccggccucgccaacggcaccgucgucaccuucaacaucaagaacaacaagcgccucgagaucuucgagugccacggcccccgcgccgucuccugccucgccaccgcccaggagggcgcccgcaagcuccucgucgucggcuccuacgacugcaccaucuccguccgcgacgcccgcaacggccuccuccuccgcacccucgagggccacuccaagaccauccucugcaugaaggucgucaacgaccucgucuucuccggcuccuccgaccaguccguccacgcccacaacauccacaccggcgagcucguccgcaucuacaagggccacaaccacgccgucaccgucgucaacauccucggcaaggucauggucaccgccugccucgacaaguucguccgcgucuacgagcuccagucccacgaccgccuccaggucuacggcggccacaaggacaugaucaugugcaugaccauccacaaguccaugaucuacaccggcugcuacgacggcuccauccaggccguccgccucaaccucaugcagaacuaccgcugcugguggcacggcugcucccucaucuucggcgucgucgaccaccucaagcagcaccuccucaccgaccacaccaaccccaacuuccagacccucaagugccgcuggaagaacugcgacgccuucuucaccgcccgcaagggcuccaagcaggacgccgccggccacaucgagcgccacgccgaggacgacuccaagaucgacuccuga

SEQ ID NO: 52024 - RNA, 2352 nt, Artificial Sequence
  derived and/or modified sequence opt2 from ZNF107__Homo_sapiens__NP_001013768
auggucgccaagccccccgucauguccuuccacuucgcccaggaccucuggcccgagcagaacaucaaggacuccuuccagaaggucacccuccgccgcuacggcaagugcgaguacgagaaccuccagcuccgcaagggcugcaagcacgucgacgagugcaccggccacaagggcggccacaacaccgucaaccagugccucaccgccacccccuccaagaucuuccagugcaacaaguacgucaaggucuucgacaaguucuccaacuccaaccgcuacaagcgccgccacaccggcaacaagcacuucaagugcaaggagugcuccaaguccuucugcguccucucccagcucacccagcaccgccgcauccacacccgcgucaacuccuacaagugcgaggagugcggcaaggccuucaacugguucuccacccucaccaagcacaagcgcauccacaccggcgagaagcccuacaagugcgaggagugcggcaaggccuucaaccaguccucccagcucacccgccacaagaucauccacaccgaggagaagcccaacaagugcgaggagugcggcaaggccuucaagcaggccucccaccucaccauccacaagaucauccacaccggcgagaagcccuacaaguacgaggagugcggcaaggucuucucccaguccucccaccucaccacccagaagauccuccacaccggcgagaaccucuacaagugcaaggagugcggcaaggccuucaaccucuucuccaaccucaccaaccacaagcgcauccacgccggcgagaagcccuacaagugcaaggagugcggccgcgccuucaacaucuccuccaaccucaacaagcaggagaagauccacaccggcggcaagcucaacaagugcgaggagugcgacaaggccuucaaccgcucccucaagcucaccgcccacaagaagauccucauggaggagaagcccuacaagugcgaggagugcggcaaggucuucaaccaguucuccacccucacccgccacaagaucauccacaccggcgagaagcccuacaagugcaaggagugcggcaaggccuucaaccaguccuccaaccucaccgagcacaagaagauccacaccgccgagaaguccuacaagugcgaggagugcggcaaggccuucaaccagcacuccaaccucaucaaccaccgcaagaucuacuccggcgagaagcccuacaagugcgaggagugcggcaaggccuucaaccgcuccuccacccucacccgccacaagaagauccacaccggcgagaagcccuacaagugcgaggagugcgaccgcgccuucucccaguccuccaaccucaccgagcacaagaagauccacaccggcgagaagcccuacaagugcgaggagugcggcaaggccuucaaccgcuucuccacccucaccaagcacaagcgcauccacaccggcgagaagcccuacaagugcgaggagugcggcaaggccuucaaccaguccuaccagcucacccgccacaagaucguccacaccaaggagaagcucaacaagugcgaggaguucggcaaggccuucaagcaguccucccaccgcaccauccacaagaucauccacaccggcgagaagcccuacaagugcgaggagcacggcaaggucuucaaccaguccuccaaccucaccacccagaagaucauccacaccggcgagaaccucuacaaguucgaggagcacggcaaggccuucaaccucuucuccaacaucaccaaccacaagaucaucuacaccggcgagaagccccacaagugcgaggagugcggcaaggccuacaaccgcuucuccaaccucaccauccacaagcgcauccacaccggcgagaagcccuaccagugcgccgagugcggcaaggccuucaacugcuccuccacccucaaccgccacaagaucauccacaccggcgagaagcccuacaagugcaaggagugcggcaaggccuucaaccucuccuccacccucaccgcccacaagaagauccacaccggcgagaagcccuacaagugcgaggagugcggcaaggccuucaaccaguccuccaaccucaccacccacaagaagauccacaccuccgagaagcccuacaagugcgaggagugcggcaaguccuucaaccaguucuccucccucaacauccacaagaucauccacaccggcgagaagcccuacaagugcggcgacuacggccgcgccuucaaccucuccuccaaccucaccacccacaagaagauccacaccggcgagaagcccuacaagugcgaguacggcaagaccuga

SEQ ID NO: 52025 - RNA, 1722 nt, Artificial Sequence
  derived and/or modified sequence opt2 from ZNF10__Homo_sapiens__NP_056209
auggacgccaagucccucaccgccuggucccgcacccucgucaccuucaaggacgucuucgucgacuucacccgcgaggaguggaagcuccucgacaccgcccagcagaucgucuaccgcaacgucaugcucgagaacuacaagaaccucgucucccucggcuaccagcucaccaagcccgacgucauccuccgccucgagaagggcgaggagcccuggcucgucgagcgcgagauccaccaggagacccaccccgacuccgagaccgccuucgagaucaaguccuccgucuccucccgcuccaucuucaaggacaagcaguccugcgacaucaagauggagggcauggcccgcaacgaccucugguaccucucccucgaggaggucuggaagugccgcgaccagcucgacaaguaccaggagaaccccgagcgccaccuccgccaggucgccuucacccagaagaagguccucacccaggagcgcgucuccgaguccggcaaguacggcggcaacugccuccuccccgcccagcucguccuccgcgaguacuuccacaagcgcgacucccacaccaagucccucaagcacgaccucguccucaacggccaccaggacuccugcgccuccaacuccaacgagugcggccagaccuucugccagaacauccaccucauccaguucgcccgcacccacaccggcgacaaguccuacaagugccccgacaacgacaacucccucacccacggcuccucccucggcaucuccaagggcauccaccgcgagaagcccuacgagugcaaggagugcggcaaguucuucuccuggcgcuccaaccucacccgccaccagcucauccacaccggcgagaagcccuacgagugcaaggagugcggcaaguccuucucccgcuccucccaccucaucggccaccagaagacccacaccggcgaggagcccuacgagugcaaggagugcggcaaguccuucuccugguucucccaccucgucacccaccagcgcacccacaccggcgacaagcucuacaccugcaaccagugcggcaaguccuucguccacuccucccgccucauccgccaccagcgcacccacaccggcgagaagcccuacgagugccccgagugcggcaaguccuuccgccaguccacccaccucauccuccaccagcgcacccacguccgcguccgccccuacgagugcaacgagugcggcaaguccuacucccagcgcucccaccucgucguccaccaccgcauccacaccggccucaagcccuucgagugcaaggacugcggcaagugcuucucccgcuccucccaccucuacucccaccagcgcacccacaccggcgagaagcccuacgagugccacgacugcggcaaguccuucucccaguccuccgcccucaucguccaccagcgcauccacaccggcgagaagcccuacgagugcugccagugcggcaaggccuucauccgcaagaacgaccucaucaagcaccagcgcauccacgucggcgaggagaccuacaagugcaaccagugcggcaucaucuucucccagaacucccccuucaucguccaccagaucgcccacaccggcgagcaguuccucaccugcaaccagugcggcaccgcccucgucaacaccuccaaccucaucggcuaccagaccaaccacauccgcgagaacgccuacuga

SEQ ID NO: 52026 - RNA, 2742 nt, Artificial Sequence
  derived and/or modified sequence opt2 from ZNF112__Homo_sapiens__NP_001076804
augaccaaguuccaggagauggucaccuucaaggacgucgccgucgucuucaccgaggaggagcucggccuccucgacuccguccagcgcaagcucuaccgcgacgucaugcucgagaacuuccgcaaccuccuccucgucgcccaccagcccuucaagcccgaccucaucucccagcucgagcgcgaggagaagcuccucauggucgagaccgagaccccccgcgacggcugcuccggccgcaagaaccagcagaagauggaguccauccaggaggucaccgucuccuacuucucccccaaggagcucuccucccgccagaccuggcagcaguccgccggcggccucauccgcugccaggacuuccucaaggucuuccagggcaagaacucccagcuccaggagcagggcaacucccucggccaggucugggccggcauccccguccagaucuccgaggacaagaacuacaucuucacccacaucggcaacggcuccaacuacaucaagucccagggcuaccccuccuggcgcgcccaccacuccuggcgcaagauguaccucaaggagucccacaacuaccagugccgcugccagcagaucuccaugaagaaccacuucugcaagugcgacuccgucuccuggcucucccaccacaacgacaagcucgagguccaccgcaaggagaacuacuccugccacgacugcggcgaggacaucaugaaggucucccuccucaaccaggaguccauccagaccgaggagaagcccuaccccugcaccggcuaccgcaaggccuucuccaacgacuccuccuccgagguccaccagcaguuccaccucgagggcaagcccuacaccuacuccuccugcggcaagggcugcaacuacuccucccuccuccacauccaccagaacaucgagcgcgaggacgacaucgagaacucccaccucaaguccuaccagcgcguccacaccgaggagaagcccugcaagugcggcgaguacggcgagaacuucaaccacugcuccccccucaacaccuacgagcucauccacaccggcgagauguccuaccgccacaacaucuacgagaaggccuucucccacucccucgaccucaacuccaucuuccgcguccacacccgcgacgagccccacgaguacgaggagaacgagaacgucuucaaccaguccuccugccuccagguccaccagaagauccacaccgaggagaagcucuacaccgacaucgaguacggcaaguccuucaucugcuccuccaaccucgacauccagcaccgcguccacauggaggagaacuccuacaacuccgaggagugcggcaacggcuucucccucgccucccacuuccaggaccuccagaucguccacaccaaggagcagcccuacaagcgcuacgucugcuccaacuccuucucccacaaccucuaccuccagggccaccccaagauccacaucggcgagaagccccgcaaggagcacggcaacggcuucaacugguccuccaagcucaaggaccaccagcgcguccacaccggccagaagcccuacaagugcaacaucugcggcaagggcuucaaccaccgcuccguccucaacguccaccagcgcguccacaccggcgagaagcccuacaagugcgaggagugcgacaagggcuucucccgcuccuccuaccuccaggcccaccagcgcguccacaccggcgagaagcccuacaagugcgaggagugcggcaagggcuucucccgcaacuccuaccuccagggccaccagcgcguccacaccggcgagaagcccuacaagugcgaggagugcggcaagggcuucucccgcuccucccaccuccagggccaccagcgcguccacaccggcgagaagcccuucaagugcgaggagugcggcaagggcuucuccugguccuucaaccuccagauccaccagcgcguccacaccggcgagaagcccuacaagugcgaggagugcggcaagggcuucuccaaggccuccacccuccucgcccaccagcgcguccacaccggcgagaagcccuaccagugcgacgagugcggcaaguccuucucccagcgcuccuaccuccagucccaccaguccguccacuccggcgagcgccccuacaucugcgaggucugcggcaagggcuucucccagcgcgccuaccuccagggccaccagcgcguccacacccgcgucaagcccuacaagugcgagaugugcggcaagggcuucucccaguccucccgccucgaggcccaccgccgcguccacaccggcggcaagcccuacaagugcgaggucugcaccaagggcuucuccgaguccucccgccuccaggcccaccagcgcguccacgucgagggccgccccuacaagugcgagcagugcggcaagggcuucuccggcuacuccucccuccaggcccaccaccgcguccacaccggcgagaagcccuacaagugcgaggucugcggcaagggcuucucccagcgcuccaaccuccaggcccaccagcgcguccacaccggcgagaagcccuacaagugcgacgccugcggcaagggcuuccgcugguccuccggccuccucauccaccagcgcguccacuccuccgacaaguucuacaaguccgaggacuacggcaaggacuaccccuccuccgagaaccuccaccgcaacgaggacuccguccucuucuga

SEQ ID NO: 52027 - RNA, 1299 nt, Artificial Sequence
  derived and/or modified sequence opt2 from ZNF121__Homo_sapiens__XP_011526569
auguacuucgucaccgagcacggcgccaucggccucggcuccuuccgcaacggcaagcucaagcccaagugccagcaccucaacaacaucuucuucuggcucaacaagaccuccaacggcauccagauggccgagauccacaacggcggcgagcucugcgacuucauggagaacggcgagaucuucuccgagcacuccugccucaacgcccacaugggcaccgagaacaccggcgacaccuacgacugcgacgaguacggcgagaacuuccccaugcuccacaacuccgcccccgccggcgagacccucuccguccucaaccagugccgcaaggccuucucccucccccccaacguccaccagcgcaccuggaucggcgacaaguccuucgaguacuccgacugcgaggaggccuucgucgaccagucccaccuccaggccaaccgcaucacccacaacggcgagacccucuacgagcagaagcagugcggccgcgccuucaccuacuccaccucccacgccgucuccgucaagaugcacaccgucgagaagcccuacgagugcaaggagugcggcaaguucuuccgcuacuccuccuaccucaacucccacaugcgcacccacaccggcgagaagcccuacgagugcaaggagugcggcaagugcuucaccgucuccucccaccucgucgagcacguccgcauccacaccggcgagaagcccuaccagugcaaggagugcggccgcgccuucgccggccgcuccggccucaccaagcacguccgcauccacaccggcgagaagcccuacgagugcaacgagugcggcaaggccuacaaccgcuucuaccuccucaccgagcacuucaagacccacaccgaggagaagcccuucgagugcaaggucugcggcaaguccuuccgcuccuccuccugccucaagaaccacuuccgcauccacaccggcaucaagcccuacaagugcaaggagugcggcaaggccuucaccgucuccuccucccuccacaaccacgucaagauccacaccggcgagaagcccuacgagugcaaggacugcggcaaggccuucgccaccuccucccagcucaucgagcacauccgcacccacaccggcgagaagcccuacaucugcaaggagugcggcaagaccuuccgcgccuccucccaccuccagaagcacguccgcauccacaccggcgagaagcccuacaucugcaacgagugcggcaaggccuacaaccgcuucuaccuccucaccaagcaccucaagacccacuga

SEQ ID NO: 52028 - RNA, 1872 nt, Artificial Sequence
  derived and/or modified sequence opt2 from ZNF131__Homo_sapiens__NP_001284477
auggaggccgaggagaccauggagugccuccaggaguuccccgagcaccacaagaugauccucgaccgccucaacgagcagcgcgagcaggaccgcuucaccgacaucacccucaucgucgacggccaccacuucaaggcccacaaggccguccucgccgccugcuccaaguucuucuacaaguucuuccaggaguucacccaggagccccucgucgagaucgagggcgucuccaagauggccuuccgccaccucaucgaguucaccuacaccgccaagcucaugauccagggcgaggaggaggccaacgacgucuggaaggccgccgaguuccuccagaugcucgaggccaucaaggcccucgagguccgcaacaaggagaacuccgccccccucgaggagaacaccaccggcaagaacgaggccaagaagcgcaagaucgccgagaccuccaacgucaucaccgagucccuccccuccgccgaguccgagcccgucgagaucgaggucgagaucgccgagggcaccaucgaggucgaggacgagggcaucgagacccucgaggaggucgccuccgccaagcaguccgucaaguacauccaguccaccggcuccuccgacgacuccgcccucgcccuccucgccgacaucaccuccaaguaccgccagggcgaccgcaagggccagaucaaggaggacggcugccccuccgaccccaccuccaagcaggucgagggcaucgagaucgucgagcuccagcucucccacgucaaggaccucuuccacugcgagaagugcaaccgcuccuucaagcucuucuaccacuucaaggagcacaugaagucccacuccaccgaguccuucaagugcgagaucugcaacaagcgcuaccuccgcgaguccgccuggaagcagcaccucaacugcuaccaccucgaggagggcggcgucuccaagaagcagcgcaccggcaagaagauccacgucugccaguacugcgagaagcaguucgaccacuucggccacuucaaggagcaccuccgcaagcacaccggcgagaagcccuucgagugccccaacugccacgagcgcuucgcccgcaacuccacccucaagugccaccucaccgccugccagaccggcgucggcgccaagaagggccgcaagaagcucuacgagugccaggucugcaacuccgucuucaacuccugggaccaguucaaggaccaccucgucauccacaccggcgacaagcccaaccacugcacccucugcgaccucugguucaugcagggcaacgagcuccgccgccaccucuccgacgcccacaacaucuccgagcgccucgucaccgaggagguccucuccgucgagacccgcguccagaccgagcccgucaccuccaugaccaucaucgagcaggucggcaagguccacguccucccccuccuccagguccaggucgacuccgcccaggucaccgucgagcagguccaccccgaccuccuccaggacucccagguccacgacucccacauguccgagcuccccgagcagguccaggucuccuaccucgaggucggccgcauccagaccgaggagggcaccgagguccacgucgaggagcuccacgucgagcgcgucaaccagaugcccgucgagguccagaccgagcuccucgaggccgaccucgaccacgucacccccgagaucaugaaccaggaggagcgcgaguccucccaggccgacgccgccgaggccgcccgcgaggaccacgaggacgccgaggaccucgagaccaagcccaccgucgacuccgaggccgagaaggccgagaacgaggaccgcaccgcccuccccguccucgaguga

SEQ ID NO: 52029 - RNA, 2121 nt, Artificial Sequence
  derived and/or modified sequence opt2 from ZNF132__Homo_sapiens__NP_003424
auggcccuccccuccccccagguccucaugggccuccccgcccuccucaugggccccgcccagcacaccuccuggcccugcggcuccgccguccccacccucaaguccauggucaccuucgaggacgucgccgucuacuucucccaggaggagugggagcuccucgacgccgcccagcgccaccucuaccacuccgucaugcucgagaaccucgagcucgucaccucccucggcuccuggcacggcgucgagggcgagggcgcccaccccaagcagaacgucuccgucgagguccuccagguccgcauccccaacgccgaccccuccaccaagaaggccaacuccugcgacaugugcggccccuuccucaaggacauccuccaccucgccgagcaccagggcacccaguccgaggagaagcccuacaccugcggcgccugcggccgcgacuucuggcucaacgccaaccuccaccagcaccagaaggagcacuccggcggcaagcccuuccgcugguacaaggaccgcgacgcccucaugaaguccuccaagguccaccucuccgagaaccccuucaccugccgcgagggcggcaaggucauccucggcuccugcgaccuccuccagcuccaggccgucgacuccggccagaagcccuacuccaaccucggccagcuccccgaggucugcaccacccagaagcucuucgagugcuccaacugcggcaaggccuuccucaaguccuccacccuccccaaccaccuccgcacccacuccgaggagauccccuucaccugccccaccggcggcaacuuccucgaggagaaguccauccucggcaacaagaaguuccacaccggcgagaucccccacgucugcaaggagugcggcaaggccuucucccacuccuccaagcuccgcaagcaccagaaguuccacaccgaggucaaguacuacgagugcaucgccugcggcaagaccuucaaccacaagcucaccuucguccaccaccagcgcauccacuccggcgagcgccccuacgagugcgacgagugcggcaaggccuucuccaaccgcucccaccucauccgccacgagaagguccacaccggcgagcgccccuucgagugccucaagugcggccgcgccuucucccaguccuccaacuuccuccgccaccagaagguccacacccagguccgccccuacgagugcucccagugcggcaaguccuucucccgcuccuccgcccucauccagcacuggcgcguccacaccggcgagcgccccuacgagugcuccgagugcggccgcgccuucaacaacaacuccaaccucgcccagcaccagaagguccacaccggcgagcgccccuucgagugcuccgagugcggccgcgacuucucccaguccucccaccuccuccgccaccagaagguccacaccggcgagcgccccuucgagugcugcgacugcggcaaggccuucuccaacuccuccacccucauccagcaccagaagguccacaccggccagcgccccuacgagugcuccgagugccgcaaguccuucucccgcuccuccucccucauccagcacuggcgcauccacaccggcgagaagcccuacgagugcuccgagugcggcaaggccuucgcccacuccuccacccucaucgagcacuggcgcguccacaccaaggagcgccccuacgagugcaacgagugcggcaaguucuucucccagaacuccauccucaucaagcaccagaagguccacaccggcgagaagcccuacaagugcuccgagugcggcaaguucuucucccgcaaguccucccucaucugccacuggcgcguccacaccggcgagcgccccuacgagugcuccgagugcggccgcgccuucuccuccaacucccaccucguccgccaccagcgcguccacacccaggagcgccccuacgagugcauccagugcggcaaggccuucuccgagcgcuccacccucguccgccaccagaagguccacacccgcgagcgcaccuacgagugcucccagugcggcaagcucuucucccaccucugcaaccucgcccagcacaagaagauccacaccuga

SEQ ID NO: 52030 - RNA, 2016 nt, Artificial Sequence
  derived and/or modified sequence opt2 from ZNF133__Homo_sapiens__NP_001269925
auggcccacauggccuuccgcgacgucgccgucgacuucacccaggacgaguggcgccuccucucccccgcccagcgcacccucuaccgcgaggucaugcucgagaacuacuccaaccucgucucccucggcaucuccuucuccaagcccgagcucaucacccagcucgagcagggcaaggagaccuggcgcgaggagaagaagugcucccccgccaccugccccgaccaccaggaguacggcaacaacugcgaccuccagaaggaggccgaccccgagcccgagcucuaccucgaccccuucugcccccccggcuucuccucccagaaguuccccaugcagcacguccucugcaaccacccccccuggaucuucaccugccucugcgccgagggcaacauccagcccggcgaccccggccccggcgaccaggagaagcagcagcaggccuccgagggccgccccugguccgaccaggccgagggccccgagggcgagggcgccaugccccucuucggccgcaccaagaagcgcacccucggcgccuucucccgccccccccagcgccagcccgucuccucccgcaacggccuccgcggcgucgagcucgaggccucccccgcccagaccggcaaccccgaggagaccgacaagcuccucaagcgcaucgagguccucggcuucggcaccgucaacugcggcgagugcggccucuccuucuccaagaugaccaaccuccucucccaccagcgcauccacuccggcgagaagcccuacgucugcggcgucugcgagaagggcuucucccucaagaagucccucgcccgccaccagaaggcccacuccggcgagaagcccaucgucugccgcgagugcggccgcggcuucaaccgcaaguccacccucaucauccacgagcgcacccacuccggcgagaagcccuacaugugcuccgagugcggccgcggcuucucccagaaguccaaccucaucauccaccagcgcacccacuccggcgagaagcccuacgucugccgcgagugcggcaagggcuucucccagaaguccgccgucguccgccaccagcgcacccaccucgaggagaagaccaucgucugcuccgacugcggccucggcuucuccgaccgcuccaaccucaucucccaccagcgcacccacuccggcgagaagcccuacgccugcaaggagugcggccgcugcuuccgccagcgcaccacccucgucaaccaccagcgcacccacuccaaggagaagcccuacgucugcggcgucugcggccacuccuucucccagaacuccacccucaucucccaccgccgcacccacaccggcgagaagcccuacgucugcggcgucugcggccgcggcuucucccucaagucccaccucaaccgccaccagaacauccacuccggcgagaagcccaucgucugcaaggacugcggccgcggcuucucccagcaguccaaccucauccgccaccagcgcacccacuccggcgagaagcccauggucugcggcgagugcggccgcggcuucucccagaaguccaaccucgucgcccaccagcgcacccacuccggcgagcgccccuacgucugccgcgagugcggccgcggcuucucccaccaggccggccucauccgccacaagcgcaagcacucccgcgagaagcccuacaugugccgccagugcggccucggcuucggcaacaaguccgcccucaucacccacaagcgcgcccacuccgaggagaagcccugcgucugccgcgagugcggccagggcuuccuccagaagucccaccucacccuccaccagaugacccacaccggcgagaagcccuacgucugcaagaccugcggccgcggcuucucccucaagucccaccucucccgccaccgcaagaccaccuccguccaccaccgccuccccguccagcccgaccccgagcccugcgccggccagcccuccgacucccucuacucccucuga

SEQ ID NO: 52031 - RNA, 1425 nt, Artificial Sequence
  derived and/or modified sequence opt2 from ZNF141__Homo_sapiens__NP_003432
auggagcuccucaccuuccgcgacgucgccaucgaguucucccccgaggaguggaagugccucgaccccgaccagcagaaccucuaccgcgacgucaugcucgagaacuaccgcaaccucgucucccucggcgucgccaucuccaaccccgaccucgucaccugccucgagcagcgcaaggagcccuacaacgucaagauccacaagaucgucgcccgcccccccgccaugugcucccacuucacccaggaccacuggcccguccagggcaucgaggacuccuuccacaagcucauccuccgccgcuacgagaagugcggccacgacaaccuccagcuccgcaagggcugcaagucccucaacgagugcaagcuccagaagggcggcuacaacgaguucaacgagugccucuccaccacccaguccaagauccuccagugcaaggccuccgucaaggucgucuccaaguucuccaacuccaacaagcgcaagacccgccacaccggcgagaagcacuucaaggagugcggcaaguccuuccagaaguucucccaccucacccagcacaaggucauccacgccggcgagaagcccuacaccugcgaggagugcggcaaggccuucaaguggucccucaucuucaacgagcacaagcgcauccacaccggcgagaagcccuucaccugcgaggagugcggcuccaucuucaccaccuccucccacuucgccaagcacaagaucauccacaccggcgagaagcccuacaagugcgaggagugcggcaaggccuucaaccgcuucaccacccucaccaagcacaagcgcauccacgccggcgagaagcccaucaccugcgaggagugccgcaagaucuucaccuccuccuccaacuucgccaagcacaagcgcauccacaccggcgagaagcccuacaagugcgaggagugcggcaaggccuucaaccgcuccaccacccucaccaagcacaagcgcauccacaccggcgagaagcccuacaccugcgaggagugcggcaaggccuuccgccaguccuccaagcucaacgagcacaagaagguccacaccggcgagcgccccuacaagugcgacgagugcggcaaggccuucggccgcucccgcguccucaacgagcacaagaagauccacaccggcgagaagcccuacaagugcgaggagugcggcaaggccuuccgccgcuccaccgaccgcucccagcacaagaagauccacuccgccgacaagcccuacaagugcaaggagugcgacaaggccuucaagcaguucucccuccucucccagcacaagaagauccacaccgucgacaagcccuacaagugcaaggacugcgacaaggccuucaagcgcuucucccaccucaacaagcacaagaagauccacaccuga

SEQ ID NO: 52032 - RNA, 1914 nt, Artificial Sequence
  derived and/or modified sequence opt2 from ZNF143__Homo_sapiens__NP_001269585
augcuccucgcccagaucaaccgcgacucccagggcaugaccgaguuccccggcggcggcauggaggcccagcacgucacccucugccucaccgaggccgucaccgucgccgacggcgacaaccucgagaacauggagggcgucucccuccaggccgucacccucgccgacggcuccaccgccuacauccagcacaacuccaaggacgccaagcucaucgacggccaggucauccagcucgaggacggcuccgccgccuacguccagcacguccccauccccaagucccgcgacucccuccgccucgaggacggccaggccguccagcucgaggacggcaccaccgccuucauccaccacaccuccaaggacuccuacgaccaguccgcccuccaggccguccagcucgaggacggcaccaccgccuacauccaccacgccguccaggucccccaguccgacaccauccucgccauccaggccgacggcaccgucgccggccuccacaccggcgacgccaccaucgaccccgacaccaucuccgcccucgagcaguacgccgccaaggucuccaucgacggcuccgaguccgucgccggcaccggcaugaucggcgagaacgagcaggagaagaagaugcagaucguccuccagggccacgccacccgcgucaccgccaagucccagcaguccggcgagaaggccuuccgcugcgaguacgacggcugcggcaagcucuacaccaccgcccaccaccucaagguccacgagcgcucccacaccggcgaccgccccuaccagugcgagcacgccggcugcggcaaggccuucgccaccggcuacggccucaagucccacguccgcacccacaccggcgagaagcccuaccgcugcuccgaggacaacugcaccaaguccuucaagaccuccggcgaccuccagaagcacauccgcacccacaccggcgagcgccccuucaagugccccuucgagggcugcggccgcuccuucaccaccuccaacauccgcaagguccacguccgcacccacaccggcgagcgccccuacuacugcaccgagcccggcugcggccgcgccuucgccuccgccaccaacuacaagaaccacguccgcauccacaccggcgagaagcccuacgucugcaccguccccggcugcgacaagcgcuucaccgaguacuccucccucuacaagcaccacgucguccacacccacuccaagcccuacaacugcaaccacugcggcaagaccuacaagcagaucuccacccucgccaugcacaagcgcaccgcccacaacgacaccgagcccaucgaggaggagcaggaggccuucuucgagcccccccccggccagggcgaggacguccucaagggcucccagaucaccuacgucaccggcgucgagggcgacgacgucgucuccacccaggucgccaccgucacccaguccggccucucccagcaggucacccucaucucccaggacggcacccagcacgucaacaucucccaggccgacaugcaggccaucggcaacaccaucaccauggucacccaggacggcacccccaucaccguccccgcccacgacgccgucaucuccuccgccggcacccacuccgucgccauggucaccgccgagggcaccgagggcgagcaggucgccaucgucgcccaggaccucgccgccuuccacaccgccuccuccgagaugggccaccagcagcacucccaccaccucgucaccaccgagacccgcccccucacccucgucgccaccuccaacggcacccagaucgccguccagcucggcgagcagcccucccucgaggaggccauccgcaucgccucccgcauccagcagggcgagacccccggccucgacgacuga

SEQ ID NO: 52033 - RNA, 879 nt, Artificial Sequence
  derived and/or modified sequence opt2 from ZNF146__Homo_sapiens__XP_005259271
augucccaccucucccagcagcgcaucuacuccggcgagaaccccuucgccugcaaggucugcggcaaggucuucucccacaaguccaaccucaccgagcacgagcacuuccacacccgcgagaagcccuucgagugcaacgagugcggcaaggccuucucccagaagcaguacgucaucaagcaccagaacacccacaccggcgagaagcucuucgagugcaacgagugcggcaaguccuucucccagaaggagaaccuccucacccaccagaagauccacaccggcgagaagcccuucgagugcaaggacugcggcaaggccuucauccagaaguccaaccucauccgccaccagcgcacccacaccggcgagaagcccuucgucugcaaggagugcggcaagaccuucuccggcaaguccaaccucaccgagcacgagaagauccacaucggcgagaagcccuucaagugcuccgagugcggcaccgccuucggccagaagaaguaccucaucaagcaccagaacauccacaccggcgagaagcccuacgagugcaacgagugcggcaaggccuucucccagcgcaccucccucaucguccacguccgcauccacuccggcgacaagcccuacgagugcaacgucugcggcaaggccuucucccaguccuccucccucaccguccacguccgcucccacaccggcgagaagcccuacggcugcaacgagugcggcaaggccuucucccaguucuccacccucgcccuccaccuccgcauccacaccggcaagaagcccuaccagugcuccgagugcggcaaggccuucucccagaagucccaccacauccgccaccagaagauccacacccacuga

SEQ ID NO: 52034 - RNA, 2385 nt, Artificial Sequence
  derived and/or modified sequence opt2 from ZNF148__Homo_sapiens__NP_068799
augaacaucgacgacaagcucgagggccucuuccucaagugcggcggcaucgacgagaugcaguccucccgcaccauggucgucaugggcggcgucuccggccaguccaccgucuccggcgagcuccaggacuccguccuccaggaccgcuccaugccccaccaggagauccucgccgccgacgagguccuccaggaguccgagaugcgccagcaggacaugaucucccacgacgagcucaugguccacgaggagaccgucaagaacgacgaggagcagauggagacccacgagcgccucccccagggccuccaguacgcccucaacguccccaucuccgucaagcaggagaucaccuucaccgacgucuccgagcagcucaugcgcgacaagaagcagauccgcgagcccgucgaccuccagaagaagaagaagcgcaagcagcgcucccccgccaagauccucaccaucaacgaggacggcucccucggccucaagacccccaagucccacgucugcgagcacugcaacgccgccuuccgcaccaacuaccaccuccagcgccacgucuucauccacaccggcgagaagcccuuccagugcucccagugcgacaugcgcuucauccagaaguaccuccuccagcgccacgagaagauccacaccggcgagaagcccuuccgcugcgacgagugcggcaugcgcuucauccagaaguaccacauggagcgccacaagcgcacccacuccggcgagaagcccuaccagugcgaguacugccuccaguacuucucccgcaccgaccgcguccucaagcacaagcgcaugugccacgagaaccacgacaagaagcucaaccgcugcgccaucaagggcggccuccucaccuccgaggaggacuccggcuucuccaccucccccaaggacaacucccuccccaagaagaagcgccagaagaccgagaagaaguccuccggcauggacaaggaguccgcccucgacaaguccgaccucaagaaggacaagaacgacuaccucccccucuacuccuccuccaccaaggucaaggacgaguacauggucgccgaguacgccgucgagaugccccacuccuccgucggcggcucccaccucgaggacgccuccggcgagauccacccccccaagcucguccucaagaagaucaacuccaagcgcucccucaagcagccccucgagcagaaccagaccaucuccccccucuccaccuacgaggaguccaaggucuccaaguacgccuucgagcucgucgacaagcaggcccuccucgacuccgagggcaacgccgacaucgaccaggucgacaaccuccaggagggccccuccaagcccguccacuccuccaccaacuacgacgacgccaugcaguuccucaagaagaagcgcuaccuccaggccgccuccaacaacucccgcgaguacgcccucaacgucggcaccaucgccucccagcccuccgucacccaggccgccgucgccuccgucaucgacgaguccaccaccgccuccauccucgagucccaggcccucaacgucgagaucaaguccaaccacgacaagaacgucauccccgacgagguccuccagacccuccucgaccacuacucccacaaggccaacggccagcacgagaucuccuucuccgucgccgacaccgaggucaccuccuccaucuccaucaacuccuccgagguccccgaggucacccccuccgagaacgucggcuccuccucccaggccuccuccuccgacaaggccaacaugcuccaggaguacuccaaguuccuccagcaggcccucgaccgcaccucccagaacgacgccuaccucaacucccccucccucaacuucgucaccgacaaccagacccuccccaaccagcccgccuucuccuccaucgacaagcaggucuacgccaccaugcccaucaacuccuuccgcuccggcaugaacuccccccuccgcaccacccccgacaagucccacuucggccucaucgucggcgacucccagcacuccuuccccuucuccggcgacgagaccaaccacgccuccgccaccuccacccaggacuuccucgaccaggucaccucccagaagaaggccgaggcccagcccguccaccaggccuaccagauguccuccuucgagcagcccuuccgcgcccccuaccacggcucccgcgccggcaucgccacccaguucuccaccgccaacggccaggucaaccuccgcggccccggcaccuccgccgaguucuccgaguucccccucgucaacgucaacgacaaccgcgccggcaugaccuccucccccgacgccaccaccggccagaccuucggcuga

SEQ ID NO: 52035 - RNA, 1314 nt, Artificial Sequence
  derived and/or modified sequence opt2 from ZNF154__Homo_sapiens__NP_001078853
auggccgccgccacccuccgcacccccacccagggcaccgucaccuucgaggacgucgccguccacuucuccugggaggaguggggccuccucgacgaggcccagcgcugccucuaccgcgacgucaugcucgagaaccucgcccuccucaccucccucgacguccaccaccagaagcagcaccucggcgagaagcacuuccgcuccaacgucggccgcgcccucuucgucaagaccugcaccuuccacgucuccggcgagcccuccaccugccgcgaggucggcaaggacuuccucgccaagcucggcuuccuccaccagcaggccgcccacaccggcgagcaguccaacuccaaguccgacggcggcgccaucucccaccgcggcaagacccacuacaacugcggcgagcacaccaaggccuucuccggcaagcacacccucguccagcagcagcgcacccucaccaccgagcgcugcuacaucugcuccgagugcggcaaguccuucuccaaguccuacucccucaacgaccacuggcgccuccacaccggcgagaagcccuacgagugccgcgagugcggcaaguccuuccgccaguccuccucccucauccagcaccgccgcguccacaccgccguccgcccccacgagugcgacgagugcggcaagcucuucuccaacaaguccaaccucaucaagcaccgccgcguccacaccggcgagcgccccuacgagugcuccgagugcggcaaguccuucucccagcgcuccgcccuccuccagcaccgcggcguccacaccggcgagcgccccuacgagugcuccgagugcggcaaguucuucaccuaccacuccucccucaucaagcaccagaagguccacuccggcucccgccccuacgagugcuccgagugcggcaaguccuucucccagaacuccucccucaucgagcaccaccgcguccacaccggcgagcgccccuacaagugcuccgagugcggcaaguccuucucccagcgcuccgcccuccuccagcaccgcggcguccacaccggcgagcgccccuacgagugcuccgagugcggcaaguucuuccccuacuccuccucccuccgcaagcaccagcgcguccacaccggcucccgccccuacgagugcuccgagugcggcaaguccuucacccagaacuccggccucaucaagcaccgccgcguccacaccggcgagaagcccuacgagugcaccgagugcggcaaguccuucucccacaacuccucccucaucaagcaccagcgcauccacucccgcuga

SEQ ID NO: 52036 - RNA, 2349 nt, Artificial Sequence
  derived and/or modified sequence opt2 from ZNF160__Homo_sapiens__XP_005259436
augcucgagaacuacuggaaccucgucucccucggccucugccacuucgacaugaacaucaucuccaugcucgaggagggcaaggagcccuggaccgucaaguccugcgucaagaucgcccgcaagccccgcacccccgagugcgucaagggcgucgucaccgacaucccccccaagugcaccaucaaggaccuccuccccaaggagaaguccuccaccgaggccgucuuccacaccgucguccucgagcgccacgagucccccgacaucgaggacuucuccuucaaggagccccagaagaacguccacgacuucgagugccaguggcgcgacgacaccggcaacuacaagggcguccucauggcccagaaggagggcaagcgcgaccagcgcgaccgccgcgacaucgagaacaagcucaugaacaaccagcucggcgucuccuuccacucccaccuccccgagcuccagcucuuccagggcgagggcaagauguacgagugcaaccaggucgagaaguccaccaacaacggcuccuccgucuccccccuccagcagauccccuccuccguccagacccaccgcuccaagaaguaccacgagcucaaccacuucucccuccucacccagcgccgcaaggccaacuccugcggcaagcccuacaagugcaacgagugcggcaaggccuucacccagaacuccaaccucaccucccaccgccgcauccacuccggcgagaagcccuacaagugcuccgagugcggcaagaccuucaccguccgcuccaaccucaccauccaccaggucauccacaccggcgagaagcccuacaagugccacgagugcggcaaggucuuccgccacaacuccuaccucgccacccaccgccgcauccacaccggcgagaagcccuacaagugcaacgagugcggcaaggccuuccgcggccacuccaaccucaccacccaccagcucauccacaccggcgagaagcccuucaagugcaacgagugcggcaagcucuucacccagaacucccaccucaucucccacuggcgcauccacaccggcgagaagcccuacaagugcaacgagugcggcaaggccuucuccguccgcuccucccucgccauccaccagaccauccacaccggcgagaagcccuacaagugcaacgagugcggcaaggucuuccgcuacaacuccuaccucggccgccaccgccgcguccacaccggcgagaagcccuacaagugcaacgagugcggcaaggccuucuccaugcacuccaaccucgccacccaccaggucauccacaccggcaccaagcccuucaagugcaacgagugcuccaaggucuucacccagaacucccagcucgccaaccaccgccgcauccacaccggcgagaagcccuacaagugcaacgagugcggcaaggccuucuccguccgcuccucccucaccacccaccaggccauccacuccggcgagaagcccuacaagugcaucgagugcggcaaguccuucacccagaagucccaccuccgcucccaccgcggcauccacuccggcgagaagcccuacaagugcaacgagugcggcaaggucuucgcccagaccucccagcucgcccgccacuggcgcguccacaccggcgagaagcccuacaagugcaacgacugcggccgcgccuucuccgaccgcuccucccucaccuuccaccaggccauccacaccggcgagaagcccuacaagugccacgagugcggcaaggucuuccgccacaacuccuaccucgccacccaccgccgcauccacaccggcgagaagcccuacaagugcaacgagugcggcaaggccuucuccaugcacuccaaccucaccacccacaaggucauccacaccggcgagaagcccuacaagugcaaccagugcggcaaggucuucacccagaacucccaccucgccaaccaccagcgcacccacaccggcgagaagcccuaccgcugcaacgagugcggcaaggccuucuccguccgcuccucccucaccacccaccaggccauccacaccggcaagaagcccuacaagugcaacgagugcggcaaggucuucacccagaacgcccaccucgccaaccaccgccgcauccacaccggcgagaagcccuaccgcugcaccgagugcggcaaggccuuccgcguccgcuccucccucaccacccacauggccauccacaccggcgagaagcgcuacaagugcaacgagugcggcaaggucuuccgccaguccuccaaccucgccucccaccaccgcaugcacaccggcgagaagcccuacaaguga

SEQ ID NO: 52037 - RNA, 1815 nt, Artificial Sequence
  derived and/or modified sequence opt2 from ZNF169__Homo_sapiens__NP_003439
augucccccggccuccucaccacccgcaaggaggcccucauggccuuccgcgacgucgccgucgccuucacccagaaggaguggaagcuccucuccuccgcccagcgcacccucuaccgcgaggucaugcucgagaacuacucccaccucgucucccucggcaucgccuucuccaagcccaagcucaucgagcagcucgagcagggcgacgagcccuggcgcgaggagaacgagcaccuccucgaccucugccccgccgagccccgcaccgaguuccagcccuccuucccccaccucgucgccuucuccuccucccagcuccuccgccaguacgcccucuccggccaccccacccagaucuuccccuccuccuccgccggcggcgacuuccagcucgaggccccccgcugcuccuccgagaagggcgaguccggcgagaccgagggccccgacuccucccuccgcaagcgccccucccgcaucucccgcaccuucuucuccccccaccagggcgaccccgucgagugggucgagggcaaccgcgagggcggcaccgaccuccgccucgcccagcgcaugucccucggcggcuccgacaccaugcucaagggcgccgacaccuccgaguccggcgccgucauccgcggcaacuaccgccucggccucuccaagaaguccucccucuucucccaccagaagcaccacgucugccccgagugcggccgcggcuucugccagcgcuccgaccucaucaagcaccagcgcacccacaccggcgagaagcccuaccucugccccgagugcggccgccgcuucucccagaaggccucccucuccauccaccagcgcaagcacuccggcgagaagcccuacgucugccgcgagugcggccgccacuuccgcuacaccuccucccucaccaaccacaagcgcauccacuccggcgagcgccccuucgucugccaggagugcggccgcggcuuccgccagaagaucgcccuccuccuccaccagcgcacccaccucgaggagaagcccuucgucugccccgagugcggccgcggcuucugccagaaggccucccuccuccagcaccaguccucccacaccggcgagcgccccuuccucugccucgagugcggccgcuccuuccgccagcagucccuccuccucucccaccaggucacccacuccggcgagaagcccuacgucugcgccgagugcggccacuccuuccgccagaaggucacccucauccgccaccagcgcacccacaccggcgagaagcccuaccucugcccccagugcggccgcggcuucucccagaaggucacccucaucggccaccagcgcacccacaccggcgagaagcccuaccucugccccgacugcggccgcggcuucggccagaaggucacccucauccgccaccagcgcacccacaccggcgagaagcccuaccucugccccaagugcggccgcgccuucggcuucaagucccuccucacccgccaccagcgcacccacuccgaggaggagcucuacgucgaccgcgucugcggccagggccucggccagaagucccaccucaucuccgaccagcgcacccacuccggcgagaagcccugcaucugcgacgagugcggccgcggcuucggcuucaaguccgcccucauccgccaccagcgcacccacuccggcgagaagcccuacgucugccgcgagugcggccgcggcuucucccagaagucccaccuccaccgccaccgccgcaccaaguccggccaccagcuccucccccaggaggucuucuga

SEQ ID NO: 52038 - RNA, 2136 nt, Artificial Sequence
  derived and/or modified sequence opt2 from ZNF175__Homo_sapiens__NP_009078
augcccgccgacgucaaccucucccagaagccccagguccucggccccgagaagcaggacggcuccugcgaggccuccgucuccuucgaggacgucaccgucgacuucucccgcgaggaguggcagcagcucgaccccgcccagcgcugccucuaccgcgacgucaugcucgagcucuacucccaccucuucgccgucggcuaccacauccccaaccccgaggucaucuuccgcaugcucaaggagaaggagccccgcgucgaggaggccgaggucucccaccagcgcugccaggagcgcgaguucggccucgagaucccccagaaggagaucuccaagaaggccuccuuccagaaggacauggucggcgaguucacccgcgacggcuccuggugcuccauccucgaggagcuccgccucgacgccgaccgcaccaagaaggacgagcagaaccagauccagcccaugucccacuccgccuucuucaacaagaagacccucaacaccgaguccaacugcgaguacaaggaccccggcaagaugauccgcacccgcccccaccucgccuccucccagaagcagccccagaagugcugccucuucaccgagucccucaagcucaaccucgaggucaacggccagaacgaguccaacgacaccgagcagcucgacgacgucgucggcuccggccagcucuucucccacuccuccuccgacgccugcuccaagaacauccacaccggcgagaccuucugcaagggcaaccagugccgcaaggucugcggccacaagcagucccucaagcagcaccagauccacacccagaagaagcccgacggcugcuccgagugcggcggcuccuucacccagaagucccaccucuucgcccagcagcgcauccacuccgucggcaaccuccacgagugcggcaagugcggcaaggccuucaugccccagcucaagcucuccgucuaccucaccgaccacaccggcgacauccccugcaucugcaaggagugcggcaaggucuucauccagcgcuccgagcuccucacccaccagaagacccacacccgcaagaagcccuacaagugccacgacugcggcaaggccuucuuccagaugcucucccucuuccgccaccagcgcacccacucccgcgagaagcucuacgagugcuccgagugcggcaagggcuucucccagaacuccacccucaucauccaccagaagauccacaccggcgagcgccaguacgccugcuccgagugcggcaaggccuucacccagaaguccacccucucccuccaccagcgcauccacuccggccagaaguccuacgucugcaucgagugcggccaggccuucauccagaaggcccaccucaucguccaccagcgcucccacaccggcgagaagcccuaccagugccacaacugcggcaaguccuucaucuccaagucccagcucgacauccaccaccgcauccacaccggcgagaagcccuacgagugcuccgacugcggcaagaccuucacccagaagucccaccucaacauccaccagaagauccacaccggcgagcgccaccacgucugcuccgagugcggcaaggccuucaaccagaaguccauccucuccaugcaccagcgcauccacaccggcgagaagcccuacaagugcuccgagugcggcaaggccuucaccuccaagucccaguucaaggagcaccagcgcauccacaccggcgagaagcccuacgucugcaccgagugcggcaaggccuucaacggccgcuccaacuuccacaagcaccagaucacccacacccgcgagcgccccuucgucugcuacaagugcggcaaggccuucguccagaaguccgagcucaucacccaccagcgcacccacaugggcgagaagcccuacgagugccucgacugcggcaaguccuucuccaagaagccccagcucaagguccaccagcgcauccacaccggcgagcgccccuacgucugcuccgagugcggcaaggccuucaacaaccgcuccaacuucaacaagcaccagaccacccacacccgcgacaaguccuacaagugcuccuacuccgucaagggcuucaccaagcaguga

SEQ ID NO: 52039 - RNA, 1446 nt, Artificial Sequence
  derived and/or modified sequence opt2 from ZNF177__Homo_sapiens__NP_001166122
auggccgccggcuggcucaccaccuggucccagaacuccgucaccuuccaggaggucgccgucgacuucucccaggaggagugggcccuccucgaccccgcccagaagaaccucuacaaggacgucaugcucgagaacuuccgcaaccucgccuccgucggcuaccagcucugccgccacucccucaucuccaaggucgaccaggagcagcucaagaccgacgagcgcggcauccuccagggcgacugcgccgacugggagacccagcucaagcccaaggacaccaucgccaugcagaacauccccggcggcaagaccuccaacggcaucaacaccgccgagaaccagcccggcgagcacucccucgagugcaaccacugcggcaaguuccgcaagaacacccgcuucaucugcacccgcuacugcaagggcgagaagugcuacaaguacaucaaguacuccaaggucuucaaccaccccuccacccuccgcucccacgucuccauccacaucggcgagaagacccucgaguucaccgacugccgcaaggccuucaaccaggaguccucccuccgcaagcaccuccgcacccccaccggccagaaguuccaggaguacgagcagugcgacauguccuucucccuccacuccuccugcuccguccgcgagcagauccccaccggcgagaagggcgacgagugcuccgacuacggcaagaucuccccccucuccguccacaccaagaccggcuccgucgaggagggccucgagugcaacgagcacgagaagaccuucaccgacccccucucccuccagaacugcguccgcacccacuccggcgagaugcccuacgagugcuccgacugcggcaaggccuucaucuuccaguccucccucaagaagcacaugcgcucccacaccggcgagaagcccuacgagugcgaccacugcggcaaguccuucucccaguccucccaccucaacguccacaagcgcacccacaccggcgagaagcccuacgacugcaaggagugcggcaaggccuucaccguccccuccucccuccagaagcacguccgcacccacaccggcgagaagcccuacgagugcuccgacugcggcaaggccuucaucgaccaguccucccucaagaagcacacccgcucccacaccggcgagaagcccuacgagugcaaccagugcggcaaguccuucuccaccggcuccuaccucaucguccacaagcgcacccacaccggcgagaagaccuacgagugcaaggagugcggcaaggccuuccgcaacuccuccugccuccgcguccacguccgcacccacaccggcgagaagcccuacaagugcauccagugcgagaaggccuucuccaccuccaccaaccucaucaugcacaagcgcauccacaacggccagaagcuccacgaguga

SEQ ID NO: 52040 - RNA, 1863 nt, Artificial Sequence
  derived and/or modified sequence opt2 from ZNF182__Homo_sapiens__NP_001007089
auggccaagccccagggccucgucaccuucgaggacgucgccgucgacuucacccaggaggaguggcaguaccucaaccccccccagcgcacccucuaccgcgacgucaugcucgagaccuacuccaaccucgucuucgucggccagcaggucaccaagcccaaccucauccucaagcucgaggucgaggagugccccgccgagggcaagauccccuucuggaacuuccccgaggucugccaggucgacgagcagaucgagcgccagcaccaggacgaccaggacaagugccuccucaugcaggucggcuucuccgacaagaagaccaucaucaccaaguccgcccgcgacugccacgaguucggcaacauccuccaccucuccaccaaccucgucgccuccauccagcgccccgacaagcacgaguccuucggcaacaacauggucgacaaccucgaccucuucucccgcuccuccgccgagaacaaguacgacaacggcugcgccaagcucuucuuccacaccgaguacgagaagaccaaccccggcaugaagcccuacggcuacaaggagugcggcaagggccuccgccgcaagaagggccucucccuccaccagcgcaucaagaacggcgagaagcccuucgagugcaccgccugccgcaagaccuucuccaagaagucccaccucaucguccacuggcgcacccacaccggcgagaagcccuucggcugcaccgagugcggcaaggccuucucccagaagucccagcucaucauccaccuccgcacccacaccggcgagcgccccuucgagugccccgagugcggcaaggccuuccgcgagaaguccaccgucaucauccacuaccgcacccacaccggcgagaagcccuacgagugcaacgagugcggcaaggccuucacccagaaguccaaccucaucguccaccagaagacccacaccggcgagaagaccuacgagugcaccaagugcggcgaguccuucauccagaagcucgaccucaucauccaccacuccacccacaccggcaagaagccccacgagugcaacgagugcaagaagaccuucuccgacaaguccacccucaucauccaccagcgcacccacaccggcgagaagccccacaagugcaccgagugcggcaaguccuucaacgagaaguccacccucaucguccaccagcgcacccacaccggcgagaagcccuacgagugcgacgucugcggcaagaccuucacccagaaguccaaccucggcguccaccagcgcacccacuccggcgagaagcccuucgagugcaacgagugcgagaaggccuucucccagaaguccuaccucaugcuccaccagcgcggccacaccggcgagaagcccuacgagugcaacgagugcgagaaggccuucucccagaaguccuaccucaucauccaccagcgcacccacaccgaggagaagcccuacaagugcaacgagugcggcaaggccuuccgcgagaaguccaagcucaucauccaccagcgcauccacaccggcgagaagcccuacgagugccccgucugcuggaaggccuucucccagaagucccagcucaucauccaccagcgcacccacaccggcgagaagcccuacgccugcaccgagugcggcaaggccuuccgcgagaaguccaccuucaccguccaccagcgcacccacaccggcgagaagcccuacaagugcaccgagugcggcaaggccuucacccagaaguccaaccucaucguccaccagcgcacccacgccggcaagaaggcccacggccgcggccacacccgcaaguccaaguucauggcccacuga

SEQ ID NO: 52041 - RNA, 2256 nt, Artificial Sequence
  derived and/or modified sequence opt2 from ZNF184__Homo_sapiens__NP_009080
auggaggaccucuccucccccgacuccacccuccuccagggcggccacaaccuccucuccuccgccuccuuccaggaggccgucaccuucaaggacgucaucgucgacuucacccaggaggaguggaagcagcucgaccccggccagcgcgaccucuuccgcgacgucacccucgagaacuacacccaccucgucuccaucggccuccaggucuccaagcccgacgucaucucccagcucgagcagggcaccgagcccuggaucauggagcccuccauccccgucggcaccugcgccgacugggagacccgccucgagaacuccgucuccgcccccgagcccgacaucuccgaggaggagcucucccccgaggucaucgucgagaagcacaagcgcgacgacuccugguccuccaaccuccucgaguccugggaguacgagggcucccucgagcgccagcaggccaaccagcagacccuccccaaggagaucaaggucaccgagaagaccauccccuccugggagaagggccccgucaacaacgaguucggcaaguccgucaacgucuccuccaaccucgucacccaggagcccucccccgaggagaccuccaccaagcgcuccaucaagcagaacuccaaccccgucaagaaggagaaguccugcaagugcaacgagugcggcaaggccuucuccuacugcuccgcccucauccgccaccagcgcacccacaccggcgagaagcccuacaagugcaacgagugcgagaaggccuucucccgcuccgagaaccucaucaaccaccagcgcauccacaccggcgacaagcccuacaagugcgaccagugcggcaagggcuucaucgagggccccucccucacccagcaccagcgcauccacaccggcgagaagcccuacaagugcgacgagugcggcaaggccuucucccagcgcacccaccucguccagcaccagcgcauccacaccggcgagaagcccuacaccugcaacgagugcggcaaggccuucucccagcgcggccacuucauggagcaccagaagauccacaccggcgagaagcccuucaagugcgacgagugcgacaagaccuucacccgcuccacccaccucacccagcaccagaagauccacaccggcgagaagaccuacaagugcaacgagugcggcaaggccuucaacggccccuccaccuucauccgccaccacaugauccacaccggcgagaagcccuacgagugcaacgagugcggcaaggccuucucccagcacuccaaccucacccagcaccagaagacccacaccggcgagaagcccuacgacugcgccgagugcggcaaguccuucuccuacugguccucccucgcccagcaccucaagauccacaccggcgagaagcccuacaagugcaacgagugcggcaaggccuucuccuacugcuccucccucacccagcaccgccgcauccacacccgcgagaagcccuucgagugcuccgagugcggcaaggccuucuccuaccucuccaaccucaaccagcaccagaagacccacacccaggagaaggccuacgagugcaaggagugcggcaaggccuucauccgcuccuccucccucgccaagcacgagcgcauccacaccggcgagaagcccuaccagugccacgagugcggcaagaccuucuccuacggcuccucccucauccagcaccgcaagauccacaccggcgagcgccccuacaagugcaacgagugcggccgcgccuucaaccagaacauccaccucacccagcacaagcgcauccacaccggcgccaagcccuacgagugcgccgagugcggcaaggccuuccgccacugcuccucccucgcccagcaccagaagacccacaccgaggagaagcccuaccagugcaacaagugcgagaagaccuucucccaguccucccaccucacccagcaccagcgcauccacaccggcgagaagcccuacaagugcaacgagugcgacaaggccuucucccgcuccacccaccucaccgagcaccagaacacccacaccggcgagaagcccuacaacugcaacgagugccgcaagaccuucucccaguccaccuaccucauccagcaccagcgcauccacuccggcgagaagcccuucggcugcaacgacugcggcaaguccuuccgcuaccgcuccgcccucaacaagcaccagcgccuccaccccggcaucuga

SEQ ID NO: 52042 - RNA, 984 nt, Artificial Sequence
  derived and/or modified sequence opt2 from ZNF185__Homo_sapiens__NP_001171586
auggccgcccgcgacgagcucggccucggcggcgacucccucgaggccaugcccguccccgccgcccgcggccgcccccgcaucaccaacggccccgaggagcucgccgcccccucccccgccgcccucgccgacuacgagggcaaggacgucgccacccgcgucggcgaggccuggcaggagcgccccggcgccccccgcggcggccagggcgaccccgccguccccgcccagcagcccgccgaccccuccacccccgagcgccaguccucccccuccggcuccgagcagcucguccgccgcgaguccugcggcuccuccguccucaccgacuucgagggcaaggacgucgccaccaaggucggcgaggccuggcaggaccgccccggcgccccccgcggcggccagggcgaccccgccguccccacccagcagcccgccgaccccuccacccccgagcagcagaacucccccuccggcuccgagcaguucguccgccgcgaguccugcaccucccgcguccgcucccccuccuccugcauggucaccgucaccgucaccgccaccuccgagcagccccacaucuacauccccgcccccgccuccgagcucgacuccuccuccaccaccaagggcauccucuucgucaaggaguacgucaacgccuccgaggucuccuccggcaagcccgucuccgcccgcuacuccaacgucuccuccaucgaggacuccuucgccauggagaagaagccccccugcggcuccacccccuacuccgagcgcaccaccggcggcaucugcaccuacugcaaccgcgagauccgcgacugccccaagaucacccucgagcaccucggcaucugcugccacgaguacugcuucaagugcggcaucugcuccaagcccaugggcgaccuccucgaccagaucuucauccaccgcgacaccauccacugcggcaagugcuacgagaagcucuucuga

SEQ ID NO: 52043 - RNA, 1839 nt, Artificial Sequence
  derived and/or modified sequence opt2 from ZNF189__Homo_sapiens__NP_001265160
auggccucccccucccccccccccgaguccaaggaggagugggacuaccucgaccccgcccagcgcucccucuacaaggacgucaugauggagaacuacggcaaccucgucucccucgacguccucaaccgcgacaaggacgaggagcccaccgucaagcaggagaucgaggagaucgaggaggaggucgagccccagggcgucaucgucacccgcaucaaguccgagaucgaccaggaccccaugggccgcgagaccuucgagcucgucggccgccucgacaagcagcgcggcaucuuccucugggagaucccccgcgagucccucacccaggagcagcgcauguuccgcgagaacaccaacaucauccgcaagcgccccaacuccgaggagaagugccacaagugcgaggagugcggcaagggcuucguccgcaaggcccacuucauccagcaccagcgcguccacaccggcgagaagcccuuccagugcaacgagugcggcaaguccuucucccgcuccuccuucgucaucgagcaccagcgcauccacaccggcgagcgccccuacgagugcaacuacugcggcaagaccuucuccgucuccuccacccucauccgccaccagcgcauccacaccggcgagcgccccuaccagugcaaccagugcaagcaguccuucucccagcgccgcucccucgucaagcaccagcgcauccacaccggcgagaagccccacaagugcuccgacugcggcaaggccuucuccuggaagucccaccucaucgagcaccagcgcacccacaccggcgagaagcccuaccacugcaccaagugcaagaaguccuucucccgcaacucccuccucgucgagcaccagcgcauccacaccggcgagcgcccccacaagugcggcgagugcggcaaggccuuccgccucuccaccuaccucauccagcaccagaagauccacaccggcgagaagcccuuccucugcaucgagugcggcaaguccuucucccgcuccuccuuccucaucgagcaccagcgcauccacaccggcgagcgccccuaccagugcaaggagugcggcaaguccuucucccagcucugcaaccucacccgccaccagcgcauccacaccggcgacaagccccacaagugcgaggagugcggcaaggccuucucccgcuccuccggccucauccagcaccagcgcauccacacccgcgagaagaccuaccccuacaacgagaccaaggaguccuucgaccccaacugcucccucgucauccagcaggaggucuaccccaaggagaaguccuacaagugcgacgagugcggcaagaccuucuccgucuccgcccaccucguccagcaccagcgcauccacaccggcgagaagcccuaccucugcaccgucugcggcaaguccuucucccgcuccuccuuccucaucgagcaccagcgcauccacaccggcgagcgccccuaccucugccgccagugcggcaaguccuucucccagcucugcaaccucauccgccaccagggcguccacaccggcaacaagccccacaagugcgacgagugcggcaaggccuucucccgcaacuccggccucauccagcaccagcgcauccacaccggcgagaagcccuacaagugcgagaagugcgacaaguccuucucccagcagcgcucccucgucaaccaccagaagauccacgccgaggucaagacccaggagacccacgagugcgacgccugcggcgaggccuucaacugccgcaucucccucauccagcaccagaagcuccacaccgccuggaugcaguga

SEQ ID NO: 52044 - RNA, 804 nt, Artificial Sequence
  derived and/or modified sequence opt2 from ZNF197__Homo_sapiens__NP_001020026
augacccgcgagaacgucgcccacaacgcccuccgccaggagggccucgucaagggcaaggacgacaccuggaaguggggcaccuccuuccagggcuccuccuccuccgucugggagaccucccaccuccacuuccgccagcuccgcuaccacgagaccuccggcccccaggaggcccucucccgccuccgcgagcucugccgccgcuggcuccgccccgaggcccgcaccaaggcccagauccucgagcuccucguccucgagcaguuccucuccauccuccccggcgagauccgcaccuggguccagcuccaccaccccggcuccggcgaggaggccgucgcccucgucgaggagcuccagaaggaccucgacggccccgccauccagguccccguccucgucaaggaccaggacacccuccagaaggucgucuccgcccccggcaccacccucccccccguccuccccggcucccacaucgccgccgagaucugcccccacccccccaccgaccucgucgccuucaaccuccaggacccccagcacgacucccccgcccccgaggccuccgcccucucccaggaggagaacccccgcaaccagcucauggcccucaugcuccucaccgcccagccccaggagcucgucauguucgaggaggucuccgucugcuucaccuccgaggagugggccugccucggccccauccagcgcgcccucuacugggacgucaugcucgagaacuacggcaacgucaccucccucggcuaccgcaaguaccgccgccagcgcaacaaguga

SEQ ID NO: 52045 - RNA, 1947 nt, Artificial Sequence
  derived and/or modified sequence opt2 from ZNF202__Homo_sapiens__NP_001288709
auggccaccgccgucgagcccgaggaccaggaccucugggaggaggagggcauccucauggucaagcucgaggacgacuucaccugccgccccgaguccguccuccagcgcgacgaccccguccucgagaccucccaccagaacuuccgccgcuuccgcuaccaggaggccgccuccccccgcgaggcccucauccgccuccgcgagcucugccaccaguggcuccgccccgagcgccgcaccaaggagcagauccucgagcuccucguccucgagcaguuccucaccguccuccccggcgagcuccaguccuggguccgcggccagcgccccgaguccggcgaggaggccgucacccucgucgagggccuccagaagcagccccgccgcccccgccgcugggucaccguccacguccacggccaggagguccucuccgaggagaccguccaccucggcgucgagcccgagucccccaacgagcuccaggaccccguccaguccuccacccccgagcagucccccgaggagaccacccagucccccgaccucggcgcccccgccgagcagcgcccccaccaggaggaggagcuccagacccuccaggaguccgagguccccguccccgaggaccccgaccuccccgccgagcgcuccuccggcgacuccgagauggucgcccuccucaccgcccucucccagggccucgucaccuucaaggacgucgccgucugcuucucccaggaccagugguccgaccucgaccccacccagaaggaguucuacggcgaguacguccucgaggaggacugcggcaucgucgucucccucuccuuccccaucccccgccccgacgagaucucccagguccgcgaggaggagcccuggguccccgacauccaggagccccaggagacccaggagcccgagauccucuccuucaccuacaccggcgaccgcuccaaggacgaggaggagugccucgagcaggaggaccucucccucgaggacauccaccgccccguccucggcgagcccgagauccaccagacccccgacugggagaucgucuucgaggacaaccccggccgccucaacgagcgccgcuucggcaccaacaucucccaggucaacuccuucgucaaccuccgcgagaccacccccguccacccccuccucggccgccaccacgacugcuccgucugcggcaaguccuucaccugcaacucccaccucguccgccaccuccgcacccacaccggcgagaagcccuacaagugcauggagugcggcaaguccuacacccgcuccucccaccucgcccgccaccagaagguccacaagaugaacgcccccuacaaguacccccucaaccgcaagaaccucgaggagaccucccccgucacccaggccgagcgcacccccuccgucgagaagcccuaccgcugcgacgacugcggcaagcacuuccgcuggaccuccgaccucguccgccaccagcgcacccacaccggcgagaagcccuucuucugcaccaucugcggcaaguccuucucccagaaguccguccucaccacccaccagcgcauccaccucggcggcaagcccuaccucugcggcgagugcggcgaggacuucuccgagcaccgccgcuaccucgcccaccgcaagacccacgccgccgaggagcucuaccucugcuccgagugcggccgcugcuucacccacuccgccgccuucgccaagcaccuccgcggccacgccuccguccgccccugccgcugcaacgagugcggcaaguccuucucccgccgcgaccaccucguccgccaccagcgcacccacaccggcgagaagcccuucaccugccccaccugcggcaaguccuucucccgcggcuaccaccucauccgccaccagcgcacccacuccgagaagaccuccuga

SEQ ID NO: 52046 - RNA, 1665 nt, Artificial Sequence
  derived and/or modified sequence opt2 from ZNF205__Homo_sapiens__XP_005255615
auguccgccgacggcggcggcauccaggacacccaggacaaggagaccccccccgagguccccgaccgcggccacccccaccaggagaugcccuccaagcucggcgaggccguccccuccggcgacacccaggagucccuccacaucaagauggagcccgaggagccccacuccgagggcgccucccaggaggacggcgcccagggcgccuggggcugggccccccucucccacggcuccaaggagaaggcccucuuccuccccggcggcgcccuccccuccccccgcauccccguccucucccgcgagggccgcacccgcgaccgccagauggccgccgcccuccucaccgccuggucccagaugcccgucaccuucgaggacgucgcccucuaccucucccgcgaggaguggggccgccucgaccacacccagcagaacuucuaccgcgacguccuccagaagaagaacggccucucccucggcuuccccuucucccgccccuucugggccccccaggcccacggcaagggcgaggccuccggcuccucccgccaggccggcgacgagaaggaguggcgcggcgccugcaccggcgccgucgaggucggccagcgcguccagaccuccuccgucgccgcccucggcaacgucaagcccuuccgcacccgcgccggccgcguccaguggggcgucccccagugcgcccaggaggccgccugcggccgcuccuccggccccgccaaggacuccggccagcccgccgagcccgaccgcacccccgacgccgccccccccgaccccucccccaccgagccccaggaguaccgcguccccgagaagcccaacgaggaggagaagggcgcccccgaguccggcgaggagggccucgcccccgacuccgaggucggccgcaaguccuaccgcugcgagcagugcggcaagggcuucuccuggcacucccaccucgucacccaccgccgcacccacaccggcgagaagcccuacgccugcaccgacugcggcaagcgcuucggccgcuccucccaccucauccagcaccagaucauccacaccggcgagaagcccuacaccugccccgccugccgcaaguccuucucccaccacuccacccucauccagcaccagcgcauccacaccggcgagaagcccuacgucugcgaccgcugcgccaagcgcuucacccgccgcuccgaccucgucacccaccagggcacccacaccggcgccaagccccacaagugccccaucugcgccaagugcuucacccaguccuccgcccucgucacccaccagcgcacccacaccggcgucaagcccuaccccugccccgagugcggcaagugcuucucccagcgcuccaaccucaucgcccacaaccgcacccacaccggcgagaagcccuaccacugccucgacugcggcaaguccuucucccacuccucccaccucaccgcccaccagcgcacccaccgcggcguccgccccuacgccugcccccucugcggcaaguccuucucccgccgcuccaaccuccaccgccacgagaagauccacaccaccggccccaaggcccucgccaugcucaugcucggcgccgccgccgccggcgcccucgccacccccccccccgcccccaccuga

SEQ ID NO: 52047 - RNA, 1599 nt, Artificial Sequence
  derived and/or modified sequence opt2 from ZNF20__Homo_sapiens__NP_066966
augauguuccaggacuccgucgccuucgaggacgucgccgucuccuucacccaggaggagugggcccuccucgaccccucccagaagaaccucuaccgcgacgucaugcaggagaccuucaagaaccucaccuccgucggcaagaccuggaagguccagaacaucgaggacgaguacaagaacccccgccgcaaccucucccucaugcgcgagaagcucugcgaguccaaggagucccaccacugcggcgaguccuucaaccagaucgccgacgacaugcucaaccgcaagacccuccccggcaucacccccugcgaguccuccgucugcggcgaggucggcaccggccacuccucccucaacacccacauccgcgccgacaccggccacaaguccuccgaguaccaggaguacggcgagaaccccuaccgcaacaaggagugcaagaaggccuucuccuaccucgacuccuuccagucccacgacaaggccugcaccaaggagaagcccuacgacggcaaggagugcaccgagaccuucaucucccacuccugcauccagcgccaccgcgucaugcacuccggcgacggccccuacaagugcaaguucugcggcaaggccuucuacuuccucaaccucugccucauccacgagcgcauccacaccggcgucaagcccuacaagugcaagcagugcggcaaggccuucacccgcuccaccacccuccccguccacgagcgcacccacaccggcgucaacgccgacgagugcaaggagugcggcaacgccuucuccuuccccuccgagauccgccgccacaagcgcucccacaccggcgagaagcccuacgagugcaagcagugcggcaaggucuucaucuccuucuccuccauccaguaccacaagaugacccacaccggcgagaagcccuacgagugcaagcagugcggcaaggccuuccgcugcggcucccaccuccagaagcacggccgcacccacaccggcgagaagcccuacgagugccgccagugcggcaaggccuuccgcugcaccuccgaccuccagcgccacgagaagacccacaccgaggacaagcccuacggcugcaagcagugcggcaagggcuuccgcugcgccucccagcuccagauccacgagcgcacccacuccggcgagaagccccacgagugcaaggagugcggcaaggucuucaaguacuucuccucccuccgcauccacgagcgcacccacaccggcgagaagccccacgagugcaagcagugcggcaaggccuuccgcuacuucuccucccuccacauccacgagcgcacccacaccggcgacaagcccuacgagugcaaggucugcggcaaggccuucaccugcuccuccuccauccgcuaccacgagcgcacccacaccggcgagaagcccuacgagugcaagcacugcggcaaggccuucaucuccaacuacauccgcuaccacgagcgcacccacaccggcgagaagcccuaccagugcaagcagugcggcaaggccuucauccgcgccuccuccugccgcgagcacgagcgcacccacaccaucaaccgcuga

SEQ ID NO: 52048 - RNA, 1488 nt, Artificial Sequence
  derived and/or modified sequence opt2 from ZNF212__Homo_sapiens__NP_036388
auggccgaguccgcccccgcccgccaccgccgcaagcgccgcuccaccccccucaccuccuccacccuccccucccaggccaccgagaaguccuccuacuuccagaccaccgagaucucccucuggaccgucgucgccgccauccaggccgucgagaagaagauggagucccaggccgcccgccuccagucccucgagggccgcaccggcaccgccgagaagaagcucgccgacugcgagaagauggccgucgaguucggcaaccagcucgagggcaagugggccguccucggcacccuccuccaggaguacggccuccuccagcgccgccucgagaacgucgagaaccuccuccgcaaccgcaacuucuggauccuccgccucccccccggcuccaagggcgaggcccccaaggucucccgcucccucgagaacgacggcgucugcuucaccgagcaggagugggagaaccucgaggacuggcagaaggagcucuaccgcaacgucauggaguccaacuacgagacccucgucucccucaagguccucggccagaccgagggcgaggccgagcucggcaccgagaugcucggcgaccucgaggaggagggccccggcggcgcccaccccgccggcggcgucaugaucaagcaggagcuccaguacacccaggagggccccgccgaccuccccggcgaguucuccugcaucgccgaggagcaggccuuccucucccccgagcagaccgagcucuggggcggccagggcuccuccguccuccucgagaccggccccggcgacuccacccucgaggagcccgucggcucccgcguccccuccuccucccgcaccgucggcugccccaagcagaagucccaccgccagguccagcucgaccaggagugcggccagggccucaagcucaagaaggacaccucccgccccuacgagugcuccgagugcgagaucaccuuccgcuacaagcagcagcucgccacccaccuccgcucccacuccggcuggggcuccugcacccccgaggagcccgaggagucccuccgcccccgcccccgccucaagccccagaccaagaaggccaagcuccaccagugcgacgucugccuccgcuccuucuccugcaaggucucccucgucacccaccagcgcugccaccuccaggagggccccuccgccggccagcacguccaggagcgcuucucccccaacucccucgucgcccuccccggccacauccccuggcgcaagucccgcuccucccucaucugcggcuacugcggcaaguccuucucccaccccuccgaccucguccgccaccagcgcauccacaccggcgagcgccccuacuccugcaccgagugcgagaaguccuucguccagaagcagcaccuccuccagcaccagaagauccaccagcgcgagcgcggcggccucgcccucgagcccggccgccccaacggccuccucuga

SEQ ID NO: 52049 - RNA, 1821 nt, Artificial Sequence
  derived and/or modified sequence opt2 from ZNF214__Homo_sapiens__XP_006718371
auggccgucaccuucgaggacgucaccaucaucuucaccugggaggaguggaaguuccucgacuccucccagaagcgccucuaccgcgaggucaugugggagaacuacaccaacgucauguccgucgagaacuggaacgaguccuacaagucccaggaggagaaguuccgcuaccucgaguacgagaacuucuccuacuggcagggcugguggaacgccggcgcccagauguacgagaaccagaacuacggcgagaccguccagggcaccgacuccaaggaccucacccagcaggaccgcucccagugccaggaguggcucauccucuccacccagguccccggcuacggcaacuacgagcucaccuucgaguccaagucccuccgcaaccucaaguacaagaacuucaugcccuggcagucccucgagaccaagaccacccaggacuacggccgcgagaucuacauguccggcucccacggcuuccagggcggccgcuaccgccucggcaucucccgcaagaaccucuccauggagaaggagcagaagcucaucguccagcacuccuacauccccgucgaggaggcccucccccaguacgucggcgucaucugccaggaggaccuccuccgcgacuccauggaggagaaguacugcggcugcaacaagugcaagggcaucuacuacuggaacucccgcugcgucuuccacaagcgcaaccagcccggcgagaaccucugccagugcuccaucugcaaggccugcuucucccagcgcuccgaccucuaccgccacccccgcaaccacaucggcaagaagcucuacggcugcgacgaggucgacggcaacuuccaccaguccuccggcguccacuuccaccagcgcguccacaucggcgagguccccuacuccugcaacgccugcggcaaguccuucucccagaucuccucccuccacaaccaccagcgcguccacaccgaggagaaguucuacaagaucgagugcgacaaggaccucucccgcaacucccuccuccacauccaccagcgccuccacaucggcgagaagcccuucaagugcaaccagugcggcaaguccuucaaccgcuccuccguccuccacguccaccagcgcguccacaccggcgagaagcccuacaagugcgacgagugcggcaagggcuucucccaguccuccaaccuccgcauccaccagcucguccacaccggcgagaaguccuacaagugcgaggacugcggcaagggcuucacccagcgcuccaaccuccagauccaccagcgcguccacaccggcgagaagcccuacaagugcgacgacugcggcaaggacuucucccacuccuccgaccuccgcauccaccagcgcguccacaccggcgagaagcccuacaccugccccgagugcggcaagggcuucuccaaguccuccaagcuccacacccaccagcgcguccacaccggcgagaagcccuacaagugcgaggagugcggcaagggcuucucccagcgcucccaccuccucauccaccagcgcguccacaccggcgagaagcccuacaagugccacgacugcggcaagggcuucucccacuccuccaaccuccacauccaccagcgcguccacaccggcgagaagcccuaccagugcgccaagugcggcaagggcuucucccacuccuccgcccuccgcauccaccagcgcguccacgccggcgagaagcccuacaagugccgcgaguacuacaagggcuucgaccacaacucccaccuccacaacaaccaccgccgcggcaaccucuga

SEQ ID NO: 52050 - RNA, 1554 nt, Artificial Sequence
  derived and/or modified sequence opt2 from ZNF215__Homo_sapiens__NP_037382
augcagccccucuccaagcucauggccaucuccaagccccgcaaccucucccuccgcgagcagcgcgagguccuccgcgccgacauguccuggcagcaggagaccaaccccgucgucgagacccacgacuccgaggccucccgccagaaguuccgccacuuccaguaccucaaggucuccggcccccacgaggcccucucccagcucugggagcucugccuccaguggcuccgccccgagauccacaccaagaagcagaucaucgagcuccucguccucgagcaguuccucgccauccuccccgaggagguccgcaccugggucaaccuccagcaccccaacaacuccaaggacauggucacccucaucgaggacgucaucgagaugcucgaggacgaggacaugcccugcaaggacuccgcccuccagaugggcuccaucaaggagaagaugaaggccggcucccgcaccggcaagccccaggagcccgucaccuucaaggacgucgucgucgaguucuccaaggaggaguggggccagcucgacuccgccgucaagaaccucuaccgcaacgucaugcucgagaacuuccgcaaccucaacucccuccgcaaggcccaccuccucuccaagcccuucgagucccucaagcucgaguccaagaagaagcgcuggaucauggagaaggagaucccccgcaagaccaucuucgacaugaaguccaucuccggcgaggaguccucccacggcgucaucaugacccgccucaccgaguccggccaccccuccuccgacgccuggaagggcgagaacuggcucuaccgcaaccagaagaagugggacaucaaccucccccaggaggccuucauccccgagaccaucuacaccgaggaggaggacuucgagugcuccgagaacaagaaguccuucgacaucaacuccgucuccuccaucugcgccauccaggucggcauccccucccgcaagggcucccccaagugcgacaaguucaagaccuacuucaaguucaaccucgacuccgucggcaagcagcacuccgaguacgaguacggcaacgaccucucccucuccaccgacauccgccaccagaagucccacaccaccaugaacuccuacgagugcuaccagugcggcaaggccuucugccgcuccuccucccucauccgccaccagaucauccacaccggcgagaagcccuacaagugcuccgagugcggccgcuucuucaaccgccgcaccaaccucaccaagcaccagaagcuccacgccgaggccaaggccugcaccuccaacaagugcggcaaggccuucuccaaguccgaggacuccaacaaccccacccuccacuucggcaacaacuucuaccagugcgucaacugcggcaaguccuucaaccgcuccuccucccucauccgccaccagaugauccacaccggcgagaagcccuucaagugcaaggagugcuccaaggccuucaaccgcuccuccaaccucgucaagcaccagaagcuccacacccgcgacaaguccuga

SEQ ID NO: 52051 - RNA, 3147 nt, Artificial Sequence
  derived and/or modified sequence opt2 from ZNF217__Homo_sapiens__NP_006517
augcaguccaaggucaccggcaacaugcccacccagucccuccucauguacauggacggccccgaggucaucggcuccucccucggcucccccauggagauggaggacgcccucuccaugaagggcaccgccgucguccccuuccgcgccacccaggagaagaacgucauccagaucgagggcuacaugccccucgacugcauguucugcucccagaccuucacccacuccgaggaccucaacaagcacguccucaugcagcaccgccccacccucugcgagcccgccguccuccgcgucgaggccgaguaccucuccccccucgacaagucccagguccgcaccgagccccccaaggagaagaacugcaaggagaacgaguucuccugcgaggucugcggccagaccuuccgcgucgccuucgacgucgagauccacaugcgcacccacaaggacuccuucaccuacggcugcaacaugugcggccgccgcuucaaggagcccugguuccucaagaaccacaugcgcacccacaacggcaaguccggcgcccgcuccaagcuccagcagggccucgaguccucccccgccaccaucaacgaggucguccagguccacgccgccgaguccaucuccucccccuacaagaucugcauggucugcggcuuccucuuccccaacaaggagucccucaucgagcaccgcaagguccacaccaagaagaccgccuucggcaccuccuccgcccagaccgacuccccccagggcggcaugcccuccucccgcgaggacuuccuccagcucuucaaccuccgccccaagucccaccccgagaccggcaagaagcccguccgcugcaucccccagcucgaccccuucaccaccuuccaggccuggcagcucgccaccaagggcaaggucgccaucugccaggaggucaaggaguccggccaggagggcuccaccgacaacgacgacuccuccuccgagaaggagcucggcgagaccaacaagggcuccugcgccggccucucccaggagaaggagaagugcaagcacucccacggcgaggcccccuccgucgacgccgaccccaagcuccccuccuccaaggagaagcccacccacugcuccgagugcggcaaggccuuccgcaccuaccaccagcucguccuccacucccgcguccacaagaaggaccgccgcgccggcgccgagucccccaccauguccgucgacggccgccagcccggcaccugcucccccgaccucgccgccccccucgacgagaacggcgccgucgaccgcggcgagggcggcuccgaggacggcuccgaggacggccuccccgagggcauccaccucgacaagaacgacgacggcggcaagaucaagcaccucaccuccucccgcgagugcuccuacugcggcaaguucuuccgcuccaacuacuaccucaacauccaccuccgcacccacaccggcgagaagcccuacaagugcgaguucugcgaguacgccgccgcccagaagaccucccuccgcuaccaccucgagcgccaccacaaggagaagcagaccgacgucgccgccgaggucaagaacgacggcaagaaccaggacaccgaggacgcccuccucaccgccgacuccgcccagaccaagaaccucaagcgcuucuucgacggcgccaaggacgucaccggcuccccccccgccaagcagcucaaggagaugcccuccgucuuccagaacguccucggcuccgccguccucucccccgcccacaaggacacccaggacuuccacaagaacgccgccgacgacuccgccgacaaggucaacaagaaccccacccccgccuaccucgaccuccucaagaagcgcuccgccgucgagacccaggccaacaaccucaucugccgcaccaaggccgacgucacccccccccccgacggcuccaccacccacaaccucgaggucucccccaaggagaagcagaccgagaccgccgccgacugccgcuaccgccccuccgucgacugccacgagaagccccucaaccucuccgucggcgcccuccacaacugccccgccaucucccucuccaagucccucauccccuccaucaccugccccuucugcaccuucaagaccuucuaccccgagguccucaugaugcaccagcgccucgagcacaaguacaaccccgacguccacaagaacugccgcaacaagucccuccuccgcucccgccgcaccggcugcccccccgcccuccucggcaaggacguccccccccucuccuccuucugcaagcccaagcccaaguccgccuuccccgcccaguccaagucccuccccuccgccaagggcaagcaguccccccccggccccggcaaggccccccucaccuccggcaucgacuccuccacccucgcccccuccaaccucaagucccaccgcccccagcagaacgucggcguccagggcgccgccacccgccagcagcaguccgagauguuccccaagaccuccgucucccccgcccccgacaagaccaagcgccccgagaccaagcucaagccccuccccgucgcccccucccagcccacccucggcuccuccaacaucaacggcuccaucgacuaccccgccaagaacgacucccccugggccccccccggccgcgacuacuucugcaaccgcuccgccuccaacaccgccgccgaguucggcgagccccuccccaagcgccucaaguccuccgucgucgcccucgacgucgaccagcccggcgccaacuaccgccgcggcuacgaccuccccaaguaccacaugguccgcggcaucaccucccuccucccccaggacugcgucuaccccucccaggcccucccccccaagccccgcuuccucuccuccuccgaggucgacucccccaacguccucaccguccagaagcccuacggcggcuccggcccccucuacaccugcguccccgccggcucccccgccuccuccuccacccucgagggcaagcgccccgucuccuaccagcaccucuccaacuccauggcccagaagcgcaacuacgagaacuucaucggcaacgcccacuaccgccccaacgacaagaagaccuga

SEQ ID NO: 52052 - RNA, 2124 nt, Artificial Sequence
  derived and/or modified sequence opt2 from ZNF224__Homo_sapiens__XP_005259278
augaccaccuucaaggaggccaugaccuucaaggacgucgccgucgucuucaccgaggaggagcucggccuccucgaccucgcccagcgcaagcucuaccgcgacgucaugcucgagaacuuccgcaaccuccucuccgucggccaccaggccuuccaccgcgacaccuuccacuuccuccgcgaggagaagaucuggaugaugaagaccgccauccagcgcgagggcaacuccggcgacaagauccagaccgagauggagaccgucuccgaggccggcacccaccaggagugguccuuccagcagaucugggagaagaucgccuccgaccucacccgcucccaggaccucaugaucaacuccucccaguucuccaaggagggcgacuuccccugccagaccgaggccggccucuccgucauccacacccgccagaaguccucccagggcaacggcuacaagcccuccuucuccgacgucucccacuucgacuuccaccagcagcuccacuccggcgagaagucccacaccugcgacgagugcggcaagaacuucugcuacaucuccgcccuccgcauccaccagcgcguccacaugggcgagaagugcuacaagugcgacgucugcggcaaggaguucucccaguccucccaccuccagacccaccagcgcguccacaccggcgagaagcccuucaagugcgucgagugcggcaagggcuucucccgccgcuccgcccucaacguccaccacaagcuccacaccggcgagaagcccuacaacugcgaggagugcggcaaggccuucauccacgacucccagcuccaggagcaccagcgcauccacaccggcgagaagcccuucaagugcgacaucugcggcaaguccuucugcggccgcucccgccucaaccgccacuccaugguccacaccgccgagaagcccuuccgcugcgacaccugcgacaaguccuuccgccagcgcuccgcccucaacucccaccgcaugauccacaccggcgagaagcccuacaagugcgaggagugcggcaagggcuucaucugccgccgcgaccucuacacccaccacaugguccacaccggcgagaagcccuacaacugcaaggagugcggcaaguccuuccgcugggccuccugccuccucaagcaccagcgcguccacuccggcgagaagcccuucaagugcgaggagugcggcaagggcuucuacaccaacucccagugcuacucccaccagcgcucccacuccggcgagaagcccuacaagugcgucgagugcggcaagggcuacaagcgccgccucgaccucgacuuccaccagcgcguccacaccggcgagaagcucuacaacugcaaggagugcggcaaguccuucucccgcgcccccugccuccucaagcacgagcgccuccacuccggcgagaagcccuuccagugcgaggagugcggcaagcgcuucacccagaacucccaccuccacucccaccagcgcguccacaccggcgagaagcccuacaagugcgagaagugcggcaagggcuacaacuccaaguucaaccucgacaugcaccagaagguccacaccggcgagcgccccuacaacugcaaggagugcggcaaguccuucggcugggccuccugccuccucaagcaccagcgccuccacuccggcgagaagcccuucaagugcgaggagugcggcaagcgcuucacccagaacucccagcuccacucccaccagcgcguccacaccggcgagaagcccuacaagugcgacgagugcggcaagggcuucuccugguccuccacccgccucacccaccagcgccgccacucccgcgagaccccccucaagugcgagcagcacggcaagaacaucguccagaacuccuucuccaagguccaggagaagguccacuccgucgagaagcccuacaagugcgaggacugcggcaagggcuacaaccgccgccucaaccucgacaugcaccagcgcguccacaugggcgagaagaccuggaagugccgcgagugcgacaugugcuucucccaggccuccucccuccgccuccaccagaacguccacgucggcgagaagcccuga

SEQ ID NO: 52053 - RNA, 675 nt, Artificial Sequence
  derived and/or modified sequence opt2 from ZNF22__Homo_sapiens__NP_008894
augcgccucgccaagcccaaggccggcaucucccgcuccuccucccagggcaaggccuacgagaacaagcgcaagaccggccgccagcgccagaaguggggcaugaccauccgcuucgacuccuccuucucccgccuccgccgcucccucgacgacaagcccuacaagugcaccgagugcgagaaguccuucucccaguccuccacccucuuccagcaccagaagauccacaccggcaagaagucccacaagugcgccgacugcggcaaguccuucuuccaguccuccaaccucauccagcaccgccgcauccacaccggcgagaagcccuacaagugcgacgagugcggcgaguccuucaagcaguccuccaaccucauccagcaccagcgcauccacaccggcgagaagcccuaccagugcgacgagugcggccgcugcuucucccaguccucccaccucauccagcaccagcgcacccacaccggcgagaagcccuaccagugcuccgagugcggcaagugcuucucccaguccucccaccuccgccagcacaugaagguccacaaggaggagaagccccgcaagacccgcggcaagaacauccgcgucaagacccaccuccccuccuggaaggccggcaccggccgcaaguccgucgccggccuccgcuga

SEQ ID NO: 52054 - RNA, 1425 nt, Artificial Sequence
  derived and/or modified sequence opt2 from ZNF230__Homo_sapiens__XP_011525595
augaccaccuucaaggaggccgucaccuucaaggacgucgccgucuucuucaccgaggaggagcucggccuccucgaccccgcccagcgcaagcucuaccaggacgucaugcucgagaacuucaccaaccuccucuccgucggccaccagcccuuccaccccuuccacuuccuccgcgaggagaaguucuggaugauggagaccgccacccagcgcgagggcaacuccggcggcaagaccaucgccgaggccggcccccacgaggacugccccugccagcagaucugggagcagaccgccuccgaccucacccagucccaggacuccaucaucaacaacucccacuucuucgagcagggcgacguccccucccaggucgaggccggccucuccaucauccacaccggccagaagcccucccagaacggcaagugcaagcaguccuucuccgacgucgccaucuucgaccccccccagcaguuccacuccggcgagaagucccacaccugcaacgagugcggcaaguccuucugcuacaucuccgcccuccgcauccaccagcgcguccaccuccgcgagaagcucuccaagugcgacaugcgcggcaaggaguucucccaguccuccugccuccagacccgcgagcgcguccacaccggcgagaagcccuucaagugcgagcagugcggcaagggcuuccgcugccgcgccauccuccagguccacugcaagcuccacaccggcgagaagcccuacaucugcgagaagugcggccgcgccuucauccacgacuuccagcuccagaagcaccagaucauccacaccggcgagaagcccuucaagugcgagaucugcggcaaguccuucugccuccgcuccucccucaaccgccacugcaugguccacaccgccgagaagcucuacaaguccgaggagugcggcaagggcuucaccgacucccucgaccuccacaagcaccagaucauccacaccggccagaagcccuacaacugcaaggagugcggcaaguccuuccgcugguccuccuaccuccucauccaccagcgcauccacuccggcgagaagcccuaccgcugcgaggagugcggcaagggcuacaucuccaaguccggccucaaccuccaccagcgcguccacaccggcgagcgccccuacaacugcaaggagugcggcaaguccuucucccgcgccuccuccauccucaaccacaagaagcuccacugccgcaagaagcccuucaagugcgaggacugcggcaagcgccucguccaccgcuccuucugcaaggaccagcagggcgaccacaacggcgagaacuccuccaagugcgaggacugcggcaagcgcuacaagcgccgccucaaccucgacaucauccucucccucuuccucaacgacauguga

SEQ ID NO: 52055 - RNA, 5538 nt, Artificial Sequence
  derived and/or modified sequence opt2 from ZNF236__Homo_sapiens__NP_031371
augggccucugcggccuccucgagcgcugcuggcuccaccacgaccccgacggcguccucacccucaacgccgagaacaccaacuacgccuaccagguccccaacuuccacaagugcgagaucugccuccucuccuuccccaaggagucccaguuccagcgccacaugcgcgaccacgagcgcaacgacaagccccaccgcugcgaccagugcccccagaccuucaacgucgaguucaaccucacccuccacaagugcacccacuccggcgaggaccccaccugccccgucugcaacaagaaguucucccgcgucgccucccucaaggcccacaucaugcuccacgagaaggaggagaaccucaucugcuccgagugcggcgacgaguucacccuccagucccagcucgccguccacauggaggagcaccgccaggagcucgccggcacccgccagcacgccugcaaggccugcaagaaggaguucgagaccuccuccgagcucaaggagcacaugaagacccacuacaagauccgcgucuccuccacccgcuccuacaaccgcaacaucgaccgcuccggcuucaccuacuccugcccccacugcggcaagaccuuccagaagcccucccagcucacccgccacauccgcauccacaccggcgagcgccccuucaagugcuccgagugcggcaaggccuucaaccagaagggcgcccuccagacccacaugaucaagcacaccggcgagaagccccacgccugcgccuucugccccgccgccuucucccagaagggcaaccuccagucccacguccagcgcguccacuccgaggucaagaacggccccaccuacaacugcaccgagugcuccugcgucuucaagucccucggcucccucaacacccacaucuccaagaugcacaugggcggcccccagaacuccaccuccuccaccgagaccgcccacguccucaccgccacccucuuccagacccucccccuccagcagaccgaggcccaggccaccuccgccuccucccagcccuccucccaggccgucuccgacgucauccagcagcuccucgagcucuccgagcccgcccccgucgaguccggccaguccccccagcccggccagcagcucuccaucaccgucggcaucaaccaggacauccuccagcaggcccucgagaacuccggccucuccuccauccccgccgccgcccaccccaacgacuccugccacgccaagaccuccgccccccacgcccagaaccccgacgucuccuccgucuccaacgagcagaccgaccccaccgacgccgagcaggagaaggagcaggagucccccgagaagcucgacaagaaggagaagaagaugaucaagaagaagucccccuuccuccccggcuccauccgcgaggagaacggcguccgcuggcacgucugccccuacugcgccaaggaguuccgcaagcccuccgaccucguccgccacauccgcauccacacccacgagaagcccuucaagugcccccagugcuuccgcgccuucgccgucaaguccacccucaccgcccacaucaagacccacaccggcaucaaggccuucaagugccaguacugcaugaaguccuucuccaccuccggcucccucaagguccacauccgccuccacaccggcguccgccccuucgccugcccccacugcgacaagaaguuccgcaccuccggccaccgcaagacccacaucgccucccacuucaagcacaccgagcuccgcaagaugcgccaccagcgcaagcccgccaagguccgcgucggcaagaccaacauccccguccccgacaucccccuccaggagcccauccucaucaccgaccucggccucauccagcccauccccaagaaccaguucuuccaguccuacuucaacaacaacuucgucaacgaggccgaccgccccuacaagugcuucuacugccaccgcgccuacaagaaguccugccaccucaagcagcacauccgcucccacaccggcgagaagcccuucaagugcucccagugcggccgcggcuucgucuccgccggcguccucaaggcccacauccgcacccacaccggccucaaguccuucaagugccucaucugcaacggcgccuucaccaccggcggcucccuccgccgccacaugggcauccacaacgaccuccgccccuacaugugccccuacugccagaagaccuucaagaccucccucaacugcaagaagcacaugaagacccaccgcuacgagcucgcccagcagcuccagcagcaccagcaggccgccuccaucgacgacuccaccgucgaccagcaguccaugcaggccuccacccagaugcaggucgagaucgaguccgacgagcucccccagaccgccgaggucgucgccgccaaccccgaggccaugcucgaccucgagccccagcacgucgucggcaccgaggaggccggccucggccagcagcucgccgaccagccccucgaggccgacgaggacggcuucgucgccccccaggacccccuccgcggccacgucgaccaguucgaggagcagucccccgcccagcaguccuucgagcccgccggccucccccagggcuucaccgucaccgacaccuaccaccagcagccccaguucccccccguccagcagcuccaggacuccuccacccucgagucccaggcccucuccaccuccuuccaccagcagucccuccuccaggcccccuccuccgacggcaugaacgucaccacccgccucauccaggaguccucccaggaggagcucgaccuccaggcccagggcucccaguuccucgaggacaacgaggaccagucccgccgcuccuaccgcugcgacuacugcaacaagggcuucaagaaguccucccaccucaagcagcacguccgcucccacaccggcgagaagcccuacaagugcaagcucugcggccgcggcuucgucuccuccggcguccucaagucccacgagaagacccacaccggcgucaaggccuucuccugcuccgucugcaacgccuccuucaccaccaacggcucccucacccgccacauggccacccacauguccaugaagcccuacaagugccccuucugcgaggagggcuuccgcaccaccguccacugcaagaagcacaugaagcgccaccagaccguccccuccgccgucuccgccaccggcgagaccgagggcggcgacaucugcauggaggaggaggaggagcacuccgaccgcaacgccucccgcaagucccgccccgaggucaucaccuucaccgaggaggagaccgcccagcucgccaagauccgcccccaggaguccgccaccgucuccgagaagguccucguccaguccgccgccgagaaggaccgcaucuccgagcuccgcgacaagcaggccgagcuccaggacgagcccaagcacgccaacugcugcaccuacugccccaaguccuucaagaagcccuccgaccucguccgccacguccgcauccacaccggcgagaagcccuacaagugcgacgagugcggcaaguccuucaccgucaaguccacccucgacugccacgucaagacccacaccggccagaagcucuucuccugccacgucugcuccaacgccuucuccaccaagggcucccucaagguccacaugcgccuccacaccggcgccaagcccuucaagugcccccacugcgagcuccgcuuccgcaccuccggccgccgcaagacccacaugcaguuccacuacaagcccgaccccaagaaggcccgcaagcccaugacccgcuccuccuccgagggccuccagcccgucaaccuccucaacuccuccuccaccgaccccaacgucuucaucaugaacaacuccguccucaccggccaguucgaccagaaccuccuccagcccggccucgucggccaggccauccuccccgccuccgucuccgccggcggcgaccucaccgucucccucaccgacggcucccucgccacccucgagggcauccagcuccagcucgccgccaaccucgucggccccaacguccagaucuccggcaucgacgccgccuccaucaacaacaucacccuccagaucgaccccuccauccuccagcagacccuccagcagggcaaccuccucgcccagcagcucaccggcgagcccggccucgccccccagaacuccucccuccagaccuccgacuccaccguccccgccuccgucgucauccagcccaucuccggccucucccuccagcccaccgucaccuccgccaaccucaccaucggcccccucuccgagcaggacuccguccucaccaccaacuccuccggcacccaggaccucacccaggucaugaccucccagggccucgucucccccuccggcggcccccacgagaucacccucaccaucaacaacuccucccucucccagguccucgcccaggccgccggccccaccgccaccuccuccuccggcuccccccaggagaucacccucaccaucuccgagcucaacaccaccuccggcucccuccccuccaccacccccaugucccccuccgccaucuccacccagaaccucgucauguccuccuccggcgucggcggcgacgccuccgucacccucacccucgccgacacccagggcaugcucuccggcggccucgacaccgucacccucaacaucaccucccagggccagcaguuccccgcccuccucaccgaccccucccucuccggccagggcggcgccggcuccccccaggucauccucgucucccacaccccccaguccgccuccgccgccugcgaggagaucgccuaccaggucgccggcgucuccggcaaccucgcccccggcaaccagcccgagaaggagggccgcgcccaccagugccucgagugcgaccgcgccuucuccuccgccgccguccucaugcaccacuccaaggagguccacggccgcgagcgcauccacggcugccccgucugccgcaaggccuucaagcgcgccacccaccucaaggagcacaugcagacccaccaggccggccccucccucuccucccagaagccccgcgucuucaagugcgacaccugcgagaaggccuucgccaagcccucccagcucgagcgccacucccgcauccacaccggcgagcgccccuuccacugcacccucugcgagaaggccuucaaccagaaguccgcccuccagguccacaugaagaagcacaccggcgagcgccccuacaagugcgccuacugcgucaugggcuucacccagaaguccaacaugaagcuccacaugaagcgcgcccacuccuacgccggcgcccuccaggaguccgccggccaccccgagcaggacggcgaggagcucucccgcacccuccaccucgaggaggucguccaggaggccgccggcgaguggcaggcccucacccacgucuucuga

SEQ ID NO: 52056 - RNA, 1809 nt, Artificial Sequence
  derived and/or modified sequence opt2 from ZNF239__Homo_sapiens__XP_011538534
augggccacgcccuccucaaggacgucgucauggagcucgagggcuccaaccucugcuucugccucuucguccccccccuccuccgcggccucucccuccucuuccagcccuccuccuccgaguggcgccccgucacccucaaccgcaagcucggccgccagcaccccucccuccccuccucccuccccuccuccuuccccaccggcgacaagcucggcaccuccuacauccagggcugccucugcggccuccaccgcggcggcguccgcucccccggccucugcucccaggaggccguccgcuccugcgacgccggccagcuccagaagcucggccucggcgaccucaacgagaacuccgucgagaaccuccagcagaagacccuccaggaccuccuccacgagcucuccuccuggcucguccucgagggcauggccuccaccaucaccggcucccaggacugcaucgucaaccaccgcggcgaggucgacggcgagcccgagcucgacaucucccccugccagcaguggggcgaggccuccucccccaucucccgcaaccgcgacuccgucaugacccuccaguccggcugcuucgagaacaucgaguccgagaccuaccucccccucaaggucuccucccagaucgacacccaggacuccuccgucaaguucugcaagaacgagccccaggaccaccaggagucccgccgccucuucgucauggaggaguccaccgagcgcaaggucaucaagggcgaguccugcuccgagaaccuccaggucaagcucgucuccgacggccaggagcucgccuccccccuccucaacggcgaggccaccugccagaacggccagcucaaggagucccucgaccccaucgacugcaacugcaaggacauccacggcuggaagucccaggucgucuccugcucccagcagcgcgcccacaccgaggagaagcccugcgaccacaacaacugcggcaagauccucaacaccucccccgacggccaccccuacgagaagauccacaccgccgagaagcaguacgagugcucccagugcggcaagaacuucucccaguccuccgagcuccuccuccaccagcgcgaccacaccgaggagaagcccuacaagugcgagcagugcggcaagggcuucacccgcuccuccucccuccucauccaccaggccguccacaccgacgagaagcccuacaagugcgacaagugcggcaagggcuucacccgcuccuccucccuccucauccaccacgccguccacaccggcgagaagcccuacaagugcgacaagugcggcaagggcuucucccaguccuccaagcuccacauccaccagcgcguccacaccggcgagaagcccuacgagugcgaggagugcggcauguccuucucccagcgcuccaaccuccacauccaccagcgcguccacaccggcgagcgccccuacaagugcggcgagugcggcaagggcuucucccaguccuccaaccuccacauccaccgcugcauccacaccggcgagaagcccuaccagugcuacgagugcggcaagggcuucucccaguccuccgaccuccgcauccaccuccgcguccacaccggcgagaagcccuaccacugcggcaagugcggcaagggcuucucccaguccuccaagcuccucauccaccagcgcguccacaccggcgagaagcccuacgagugcuccaagugcggcaagggcuucucccaguccuccaaccuccacauccaccagcgcguccacaagaaggacccccgcuga

SEQ ID NO: 52057 - RNA, 1932 nt, Artificial Sequence
  derived and/or modified sequence opt2 from ZNF23__Homo_sapiens__NP_001291421
augcucgagaacuacggcaacgucgccucccucggcuucccccuccucaagcccgccgucaucucccagcucgagggcggcuccgagcucggcggcuccuccccccucgccgccggcaccggccuccagggccuccagaccgacauccagaccgacaacgaccucaccaaggagauguacgagggcaaggagaacgucuccuucgagcuccagcgcgacuucucccaggagaccgacuucuccgaggccucccuccucgagaagcagcaggagguccacuccgccggcaacaucaagaaggagaaguccaacaccaucgacggcaccgucaaggacgagaccucccccgucgaggagugcuucuucucccaguccuccaacuccuaccagugccacaccaucaccggcgagcagcccuccggcugcaccggccucggcaaguccaucuccuucgacaccaagcucgucaagcacgagaucaucaacuccgaggagcgccccuucaagugcgaggagcucgucgagcccuuccgcugcgacucccagcucauccagcaccaggagaacaacaccgaggagaagcccuaccagugcuccgagugcggcaaggccuucuccaucaacgagaagcucaucuggcaccagcgccuccacuccggcgagaagcccuucaagugcgucgagugcggcaaguccuucuccuacuccucccacuacaucacccaccagaccauccacuccggcgagaagcccuaccagugcaagaugugcggcaaggccuucuccgucaacggcucccucucccgccaccagcgcauccacaccggcgagaagcccuaccagugcaaggagugcggcaacggcuucuccugcuccuccgccuacaucacccaccagcgcguccacaccggcgagaagcccuacgagugcaacgacugcggcaaggccuucaacgucaacgccaagcucauccagcaccagcgcauccacaccggcgagaagcccuacgagugcaacgagugcggcaagggcuuccgcugcuccucccagcuccgccagcaccaguccauccacaccggcgagaagcccuaccagugcaaggagugcggcaagggcuucaacaacaacaccaagcucauccagcaccagcgcauccacaccggcgagaagcccuacgagugcaccgagugcggcaaggccuucuccgucaagggcaagcucauccagcaccagcgcauccacaccggcgagaagcccuacgagugcaacgagugcggcaaggccuuccgcugcaacucccaguuccgccagcaccuccgcauccacaccggcgagaagcccuacgagugcaacgagugcggcaaggccuucuccgucaacggcaagcucaugcgccaccagcgcauccacaccggcgagaagcccuucgagugcaacgagugcggccgcugcuucaccuccaagcgcaaccuccucgaccaccaccgcauccacaccggcgagaagcccuaccagugcaaggagugcggcaaggccuucuccaucaacgccaagcucacccgccaccagcgcauccacaccggcgagaagcccuucaagugcauggagugcgagaaggccuucuccugcuccuccaacuacaucguccaccagcgcauccacaccggcgagaagcccuuccagugcaaggagugcggcaaggccuuccacgucaacgcccaccucauccgccaccagcgcucccacaccggcgagaagcccuuccgcugcgucgagugcggcaagggcuucuccuucuccuccgacuacaucauccaccagaccguccacaccuggaagaagcccuacaugugcuccgucugcggcaaggccuuccgcuucuccuuccagcucucccagcaccaguccguccacuccgagggcaaguccuga

SEQ ID NO: 52058 - RNA, 1740 nt, Artificial Sequence
  derived and/or modified sequence opt2 from ZNF248__Homo_sapiens__XP_011517899
augaacaagucccaggagcaggucuccuucaaggacgucugcgucgacuucacccaggaggagugguaccuccucgaccccgcccagaagauccucuaccgcgacgucauccucgagaacuacuccaaccucgucuccgucggcuacugcaucaccaagcccgaggucaucuucaagaucgagcagggcgaggagcccuggauccucgagaagggcuuccccucccagugccaccccgagcgcaaguggaaggucgacgacguccucgaguccucccaggagaacgaggacgaccacuucugggagcuccucuuccacaacaacaagaccgucuccgucgagaacggcgaccgcggcuccaagaccuucaaccucggcaccgaccccgucucccuccgcaacuaccccuacaagaucugcgacuccugcgagaugaaccucaagaacaucuccggccucaucaucuccaagaagaacugcucccgcaagaagcccgacgaguucaacgucugcgagaagcuccuccucgacauccgccacgagaagauccccaucggcgagaaguccuacaaguacgaccagaagcgcaacgccaucaacuaccaccaggaccucucccagcccuccuucggccaguccuucgaguacuccaagaacggccagggcuuccacgacgaggccgccuucuucaccaacaagcgcucccagaucggcgagaccgucugcaaguacaacgagugcggccgcaccuucaucgagucccucaagcucaacaucucccagcgcccccaccucgagauggagcccuacggcugcuccaucugcggcaaguccuucugcaugaaccuccgcuucggccaccagcgcgcccucaccaaggacaaccccuacgaguacaacgaguacggcgagaucuucugcgacaacuccgccuucaucauccaccagggcgccuacacccgcaagauccuccgcgaguacaaggucuccgacaagaccugggagaaguccgcccuccucaagcaccagaucguccacaugggcggcaaguccuacgacuacaacgagaacggcuccaacuucuccaagaagucccaccucacccagcuccgccgcgcccacaccggcgagaagaccuucgagugcggcgagugcggcaagaccuucugggagaaguccaaccucacccagcaccagcgcacccacaccggcgagaagcccuacgagugcaccgagugcggcaaggccuucugccagaagccccaccucaccaaccaccagcgcacccacaccggcgagaagcccuacgagugcaagcagugcggcaagaccuucugcgucaaguccaaccucaccgagcaccagcgcacccacaccggcgagaagcccuacgagugcaacgccugcggcaaguccuucugccaccgcuccgcccucaccguccaccagcgcacccacaccggcgagaagcccuucaucugcaacgagugcggcaaguccuucugcgucaaguccaaccucaucguccaccagcgcacccacaccggcgagaagcccuacaagugcaacgagugcggcaagaccuucugcgagaaguccgcccucaccaagcaccagcgcacccacaccggcgagaagcccuacgagugcaacgccugcggcaagaccuucucccagcgcuccguccucaccaagcaccagcgcauccacacccgcgucaaggcccucuccaccuccuga

SEQ ID NO: 52059 - RNA, 1107 nt, Artificial Sequence
  derived and/or modified sequence opt2 from ZNF24__Homo_sapiens__NP_008896
auguccgcccaguccgucgaggaggacuccauccucaucauccccacccccgacgaggaggagaagauccuccgcgucaagcucgaggaggaccccgacggcgaggagggcuccuccauccccuggaaccaccuccccgaccccgagaucuuccgccagcgcuuccgccaguucggcuaccaggacucccccggcccccgcgaggccgucucccagcuccgcgagcucugccgccucuggcuccgccccgagacccacaccaaggagcagauccucgagcucgucguccucgagcaguucgucgccauccuccccaaggagcuccagaccuggguccgcgaccaccaccccgagaacggcgaggaggccgucaccguccucgaggaccucgaguccgagcucgacgaccccggccagcccgucucccuccgccgccgcaagcgcgagguccucgucgaggacauggucucccaggaggaggcccagggccuccccuccuccgagcucgacgccgucgagaaccagcucaagugggccuccugggagcuccacucccuccgccacugcgacgacgacggccgcaccgagaacggcgcccucgcccccaagcaggagcuccccuccgcccucgagucccacgagguccccggcacccucaacaugggcgucccccagaucuucaaguacggcgagaccugcuuccccaagggccgcuucgagcgcaagcgcaaccccucccgcaagaagcagcacaucugcgacgagugcggcaagcacuucucccagggcuccgcccucauccuccaccagcgcauccacuccggcgagaagcccuacggcugcgucgagugcggcaaggccuucucccgcuccuccauccucguccagcaccagcgcguccacaccggcgagaagcccuacaagugccucgagugcggcaaggccuucucccagaacuccggccucaucaaccaccagcgcauccacaccggcgagaagcccuacgagugcguccagugcggcaaguccuacucccaguccuccaaccucuuccgccaccagcgccgccacaacgccgagaagcuccucaacgucgucaaggucuga

SEQ ID NO: 52060 - RNA, 1500 nt, Artificial Sequence
  derived and/or modified sequence opt2 from ZNF253__Homo_sapiens__NP_066385
augggcccccuccaguuccgcgacgucgccaucgaguucucccucgaggaguggcacugccucgacaccgcccagcgcaaccucuaccgcgacgucaugcucgagaacuaccgcaaccucgucuuccucggcaucgucgucuccaagcccgaccucgucaccugccucgagcagggcaagaagccccucaccauggagcgccacgagaugaucgccaagccccccgucauguccucccacuucgcccaggaccucuggcccgagaacauccagaacuccuuccagaucggcaugcuccgccgcuacgaggagugccgccacgacaaccuccagcucaagaagggcugcaaguccgucggcgagcacaagguccacaagggcggcuacaacggccucaaccagugccucaccaccacccagaaggagaucuuccagugcgacaaguacggcaaggucuuccacaaguucuccaacuccaacaccuacaagacccgccacaccggcaucaaccucuucaagugcaucaucugcggcaaggccuucaagcgcuccuccacccucaccacccacaagaagauccacaccggcgagaagcccuaccgcugcgaggagugcggcaaggccuucaaccaguccgccaaccucaccacccacaagcgcauccacaccggcgagaagcccuaccgcugcgaggagugcggcaaggccuucaagcaguccuccaaccucaccacccacaagaagauccacaccggcgagaagcccuacaagugcgaggagugcggcaaggccuucaaccgcuccaccgaccucaccacccacaagaucguccacaccggcgagaagcccuacaagugcgaggagugcggcaaggccuucaagcaccccucccacgucaccacccacaagaagauccacacccgcggcaagcccuacaacugcgaggagugcggcaaguccuucaagcacugcuccaaccucaccauccacaagcgcauccacaccggcgagaagcccuacaagugcgaggagugcggcaaggccuuccaccucuccucccaccucaccacccacaagauccuccacaccggcgagaagcccuaccgcugccgcgagugcggcaaggccuucaaccacuccaccacccucuucucccacgagaagauccacaccggcgagaagcccuacaagugcgacgagugcggcaagaccuucaccuggcccuccauccucuccaagcacaagcgcacccacaccggcgagaagcccuacaagugcgaggagugcggcaaguccuucaccgccuccuccacccucaccacccacaagcgcauccacaccggcgagaagcccuacaagugcgaggagugcggcaaggccuucaacugguccuccgaccucaacaagcacaagaagauccacaucgagcgcaagcccuacaucgucaagaacgucaccgaccuccucaacguccccccccuccucaucuccauccgcuga

SEQ ID NO: 52061 - RNA, 1239 nt, Artificial Sequence
  derived and/or modified sequence opt2 from ZNF260__Homo_sapiens__NP_001012774
augaucggcaugcucgagucccuccagcacgaguccgaccuccuccagcacgaccagauccacaccggcgagaagcccuacgagugcaacgagugccgcaagaccuucucccucaagcagaaccucgucgagcacaagaagaugcacaccggcgagaagucccacgagugcaccgagugcggcaaggucugcucccgcgucuccucccucacccuccaccuccgcucccacaccggcaagaaggccuacaagugcaacaagugcggcaaggccuucucccagaaggagaacuuccucucccaccagaagcaccacaccggcgagaagcccuacgagugcgagaaggucuccauccagaugcccaccaucauccgccaccagaagaaccacaccggcaccaagcccuacgccugcaaggagugcggcaaggccuucaacggcaaggccuaccucaccgagcacgagaagauccacaccggcgagaagcccuucgagugcaaccagugcggccgcgccuucucccagaagcaguaccucaucaagcaccagaacauccacaccggcaagaagcccuucaagugcuccgagugcggcaaggccuucucccagaaggagaaccucaucauccaccagcgcauccacaccggcgagaagcccuacgagugcaagggcugcggcaaggccuucauccagaaguccucccucauccgccaccagcgcucccacaccggcgagaagcccuacaccugcaaggagugcggcaaggccuucuccggcaaguccaaccucaccgagcacgagaagauccacaucggcgagaagcccuacaagugcaacgagugcggcaccaucuuccgccagaagcaguaccucaucaagcaccacaacauccacaccggcgagaagcccuacgagugcaacaagugcggcaaggccuucucccgcaucaccucccucaucguccacguccgcauccacaccggcgacaagcccuacgagugcaaggucugcggcaaggccuucugccaguccuccucccucaccguccacaugcgcucccacaccggcgagaagcccuacggcugcaacgagugcggcaaggccuucucccaguucuccacccucgcccuccacaugcgcauccacaccggcgagaagcccuaccagugcuccgagugcggcaaggccuucucccagaagucccaccacauccgccaccagcgcauccacacccacuga

SEQ ID NO: 52062 - RNA, 2052 nt, Artificial Sequence
  derived and/or modified sequence opt2 from ZNF263__Homo_sapiens__NP_005732
auggccuccggccccggcucccaggagcgcgagggccuccucaucgucaagcucgaggaggacugcgccuggucccaggagcuccccccccccgaccccggccccucccccgaggccucccaccuccgcuuccgccgcuuccgcuuccaggaggccgccggcccccgcgaggcccucucccgccuccaggagcucugccacggcuggcuccgccccgagaugcgcaccaaggagcagauccucgagcuccucguccucgagcaguuccucaccauccucccccaggagauccagucccgcguccaggagcuccaccccgaguccggcgaggaggccgucacccucgucgaggacaugcagcgcgagcucggccgccuccgccagcaggucaccaaccacggccgcggcaccgagguccuccucgaggagccccucccccucgagaccgcccgcgagucccccuccuucaagcucgagcccauggagaccgagcgcucccccggcccccgccuccaggagcuccucggccccuccccccagcgcgacccccaggccgucaaggagcgcgcccucuccgcccccuggcucucccucuucccccccgagggcaacauggaggacaaggagaugaccggcccccagcuccccgagucccucgaggacgucgccauguacaucucccaggaggaguggggccaccaggaccccuccaagcgcgcccucucccgcgacaccguccaggaguccuacgagaacgucgacucccucgagucccacauccccucccaggagguccccggcacccaggucggccagggcggcaagcucugggaccccuccguccaguccugcaaggagggccucuccccccgcggccccgcccccggcgaggagaaguucgagaaccucgagggcguccccuccgucugcuccgagaacauccacccccagguccuccuccccgaccaggcccgcggcgagguccccuggucccccgagcucggccgcccccacgaccgcucccagggcgacugggcccccccccccgagggcggcauggagcaggcccucgccggcgccuccuccggccgcgagcucggccgccccaaggagcuccagcccaagaagcuccaccucugcccccucugcggcaagaacuucuccaacaacuccaaccucauccgccaccagcgcauccacgccgccgagcgccucugcaugggcgucgacugcaccgagaucuucggcggcaacccccgcuuccucucccuccaccgcgcccaccucggcgaggaggcccacaagugccucgagugcggcaagugcuucucccagaacacccaccucacccgccaccagcgcacccacaccggcgagaagcccuaccagugcaacaucugcggcaagugcuucuccugcaacuccaaccuccaccgccaccagcgcacccacaccggcgagaagcccuacaagugccccgagugcggcgagaucuucgcccacuccuccaaccuccuccgccaccagcgcauccacaccggcgagcgccccuacaagugccccgagugcggcaaguccuucucccgcuccucccaccucgucauccacgagcgcacccacgagcgcgagcgccucuaccccuucuccgagugcggcgaggccgucuccgacuccacccccuuccucaccaaccacggcgcccacaaggccgagaagaagcucuucgagugccucaccugcggcaaguccuuccgccagggcaugcaccucacccgccaccagcgcacccacaccggcgagaagcccuacaagugcacccucugcggcgagaacuucucccaccgcuccaaccucauccgccaccagcgcauccacaccggcgagaagcccuacaccugccacgagugcggcgacuccuucucccacuccuccaaccgcauccgccaccuccgcacccacaccggcgagcgccccuacaagugcuccgagugcggcgaguccuucucccgcuccucccgccucaugucccaccagcgcacccacaccggcuga

SEQ ID NO: 52063 - RNA, 1884 nt, Artificial Sequence
  derived and/or modified sequence opt2 from ZNF264__Homo_sapiens__NP_003408
auggccgccgccguccucaccgaccgcgcccaggucuccgucaccuucgacgacgucgccgucaccuucaccaaggaggaguggggccagcucgaccucgcccagcgcacccucuaccaggaggucaugcucgagaacugcggccuccucgucucccucggcugccccguccccaaggccgagcucaucugccaccucgagcacggccaggagcccuggacccgcaaggaggaccucucccaggacaccugccccggcgacaagggcaagcccaagaccaccgagcccaccaccugcgagcccgcccucuccgagggcaucucccuccagggccaggucacccagggcaacuccgucgacucccagcucggccaggccgaggaccaggacggccucuccgagaugcaggagggccacuuccgccccggcaucgacccccaggagaagucccccggcaagaugucccccgagugcgacggccucggcaccgccgacggcgucugcucccgcaucggccaggagcaggucucccccggcgaccgcguccgcucccacaacuccugcgaguccggcaaggaccccaugauccaggaggaggagaacaacuucaagugcuccgagugcggcaaggucuucaacaagaagcaccuccucgccggccacgagaagauccacuccggcgucaagcccuacgagugcaccgagugcggcaagaccuucaucaaguccacccaccuccuccagcaccacaugauccacaccggcgagcgccccuacgagugcauggagugcggcaaggccuucaaccgcaaguccuaccucacccagcaccagcgcauccacuccggcgagaagcccuacaagugcaacgagugcggcaaggccuucacccaccgcuccaacuucguccuccacaaccgccgccacaccggcgagaaguccuucgucugcaccgagugcggccaggucuuccgccaccgccccggcuuccuccgccacuacgucguccacuccggcgagaaccccuacgagugccucgagugcggcaaggucuucaagcaccgcuccuaccucauguggcaccagcagacccacaccggcgagaagcccuacgagugcuccgagugcggcaaggucuuccucgaguccgccgcccucauccaccacuacgucauccacaccggcgagaagcccuucgagugccucgagugcggcaaggccuucaaccaccgcuccuaccucaagcgccaccagcgcauccacaccggcgagaagcccuucgucugcuccgagugcggcaaggccuucacccacugcuccaccuucauccuccacaagcgcgcccacaccggcgagaagcccuucgagugcaaggagugcggcaaggccuucuccaaccgcaaggaccucauccgccacuucuccauccacaccggcgagaagcccuacgagugcgucgagugcggcaaggccuucacccgcauguccggccucacccgccacaagcgcauccacuccggcgagaagcccuacgagugcgucgagugcggcaaguccuucugcugguccaccaaccucauccgccacgccaucauccacaccggcgagaagcccuacaagugcuccgagugcggcaaggccuucucccgcuccuccucccucacccagcaccagcgcaugcacaccggcaagaaccccaucuccgucaccgacgucggccgccccuucaccuccggccagaccuccgucacccuccgcgagcuccuccucggcaaggacuuccucaacgucaccaccgaggccaacauccuccccgaggagaccuccuccuccgccuccgaccagcccuaccagcgcgagaccccccaggucuccucccucuga

SEQ ID NO: 52064 - RNA, 1650 nt, Artificial Sequence
  derived and/or modified sequence opt2 from ZNF266__Homo_sapiens__NP_006622
augcucgagaacuacaagaaccucgccaccgucggcuaccagcucuucaagcccucccucaucuccuggcucgagcaggaggagucccgcaccguccagcgcggcgacuuccaggccuccgaguggaagguccagcucaagaccaaggagcucgcccuccagcaggacguccucggcgagcccaccuccuccggcauccagaugaucggcucccacaacggcggcgaggucuccgacgucaagcagugcggcgacgucuccuccgagcacuccugccucaagacccacguccgcacccagaacuccgagaacaccuucgagugcuaccucuacggcgucgacuuccucacccuccacaagaagaccuccaccggcgagcagcgcuccgucuucucccagugcggcaaggccuucucccucaaccccgacgucgucugccagcgcaccugcaccggcgagaaggccuucgacugcuccgacuccggcaaguccuucaucaaccacucccaccuccagggccaccuccgcacccacaacggcgagucccuccacgaguggaaggagugcggccgcggcuucauccacuccaccgaccucgccguccgcauccagacccaccgcuccgagaagcccuacaagugcaaggagugcggcaagggcuuccgcuacuccgccuaccucaacauccacaugggcacccacaccggcgacaaccccuacgagugcaaggagugcggcaaggccuucacccgcuccugccagcucacccagcaccgcaagacccacaccggcgagaagcccuacaagugcaaggacugcggccgcgccuucaccgucuccuccugccucucccagcacaugaagauccacgucggcgagaagcccuacgagugcaaggagugcggcaucgccuucacccgcuccucccagcucaccgagcaccucaagacccacaccgccaaggaccccuucgagugcaagaucugcggcaaguccuuccgcaacuccuccugccucuccgaccacuuccgcauccacaccggcaucaagcccuacaagugcaaggacugcggcaaggccuucacccagaacuccgaccucaccaagcacgcccgcacccacuccggcgagcgccccuacgagugcaaggagugcggcaaggccuucgcccgcuccucccgccucuccgagcacacccgcacccacaccggcgagaagcccuucgagugcgucaagugcggcaaggccuucgccaucuccuccaaccucuccggccaccuccgcauccacaccggcgagaagcccuucgagugccucgagugcggcaaggccuucacccacuccuccucccucaacaaccacaugcgcacccacuccgccaagaagcccuucaccugcauggagugcggcaaggccuucaaguuccccaccugcgucaaccuccacaugcgcauccacaccggcgagaagcccuacaagugcaagcagugcggcaaguccuucuccuacuccaacuccuuccagcuccacgagcgcacccacaccggcgagaagcccuacgagugcaaggagugcggcaaggccuucuccuccuccuccuccuuccgcaaccacgagcgccgccacgccgacgagcgccucuccgccuga

SEQ ID NO: 52065 - RNA, 2136 nt, Artificial Sequence
  derived and/or modified sequence opt2 from ZNF267__Homo_sapiens__NP_001252517
augcucgagaacuaccgcaaccucgucucccucggccucgucgucuccaagcccgaccucaucaccuuccucgagcagcgcaaggagcccuggaacgucaaguccgaggagaccgucgccauccagcccgacgucuucucccacuacaacaaggaccuccucaccgagcacugcaccgaggccuccuuccagaaggucaucucccgccgccacggcuccugcgaccucgagaaccuccaccuccgcaagcgcuggaagcgcgaggagugcgagggccacaacggcugcuacgacgagaagaccuucaaguacgaccaguucgacgaguccuccgucgagucccucuuccaccagcagauccucuccuccugcgccaaguccuacaacuucgaccaguaccgcaaggucuucacccacuccucccuccucaaccagcaggaggagaucgacaucuggggcaagcaccacaucuacgacaagaccuccguccucuuccgccaggucuccacccucaacuccuaccgcaacgucuucaucggcgagaagaacuaccacugcaacaacuccgagaagacccucaaccaguccuccucccccaagaaccaccaggagaacuacuuccucgagaagcaguacaagugcaaggaguucgaggaggucuuccuccaguccaugcacggccaggagaagcaggagcaguccuacaagugcaacaagugcgucgaggucugcacccagucccucaagcacauccagcaccagaccauccacauccgcgagaacuccuacuccuacaacaaguacgacaaggaccucucccaguccuccaaccuccgcaagcagaucauccacaacgaggagaagcccuacaagugcgagaagugcggcgacucccucaaccacucccuccaccucacccagcaccagaucauccccaccgaggagaagcccuacaaguggaaggagugcggcaaggucuucaaccucaacugcucccucuaccucaccaagcagcagcagaucgacaccggcgagaaccucuacaagugcaaggccugcuccaaguccuucacccgcuccuccaaccucaucguccaccagcgcauccacaccggcgagaagcccuacaagugcaaggagugcggcaaggccuuccgcugcuccuccuaccucaccaagcacaagcgcauccacaccggcgagaagcccuacaagugcaaggagugcggcaaggccuucaaccgcuccuccugccucacccagcaccagaccacccacaccggcgagaagcucuacaagugcaaggucugcuccaaguccuacgcccgcuccuccaaccucaucaugcaccagcgcguccacaccggcgagaagcccuacaagugcaaggagugcggcaaggucuucucccgcuccuccugccucacccagcaccgcaagauccacaccggcgagaaccucuacaagugcaaggucugcgccaagcccuucaccugcuucuccaaccucaucguccacgagcgcauccacaccggcgagaagcccuacaagugcaaggagugcggcaaggccuuccccuacuccucccaccucauccgccaccaccgcauccacaccggcgagaagcccuacaagugcaaggccugcuccaaguccuucuccgacuccuccggccucaccguccaccgccgcacccacaccggcgagaagcccuacaccugcaaggagugcggcaaggccuucuccuacuccuccgacgucauccagcaccgccgcauccacaccggccagcgccccuacaagugcgaggagugcggcaaggccuucaacuaccgcuccuaccucaccacccaccagcgcucccacaccggcgagcgccccuacaagugcgaggagugcggcaaggccuucaacucccgcuccuaccucaccacccaccgccgccgccacaccggcgagcgccccuacaagugcgacgagugcggcaaggccuucuccuaccgcuccuaccucaccacccaccgccgcucccacuccggcgagcgccccuacaagugcgaggagugcggcaaggccuucaacucccgcuccuaccucaucgcccaccagcgcucccacacccgcgagaagcucuga

SEQ ID NO: 52066 - RNA, 2844 nt, Artificial Sequence
  derived and/or modified sequence opt2 from ZNF268__Homo_sapiens__NP_001159353
auggccacccgcguccgcaccgccuccaucuggguccccccccuccaggagcgcaacuccuccugggaccgcauccgcaagcuccagggccaggaguccauccucggccagggcacccccggccuccagccccuccccggcaccccccgccagaagcagaagucccgccgcaucgagaagguccucgaguggcucuucaucucccaggagcagcccaagaucaccaaguccuggggcccccucuccuucauggacgucuucgucgacuucaccugggaggaguggcagcuccucgaccccgcccagaagugccucuaccgcuccgucaugcucgagaacuacuccaaccucgucucccucggcuaccagcacaccaagcccgacaucaucuucaagcucgagcagggcgaggagcucugcaugguccaggcccagguccccaaccagaccugccccaacaccgucuggaagaucgacgaccucauggacuggcaccaggagaacaaggacaagcucggcuccaccgccaaguccuucgagugcaccaccuucggcaagcucugccuccucuccaccaaguaccucucccgccagaagccccacaagugcggcacccacggcaagucccucaaguacaucgacuucaccuccgacuacgcccgcaacaaccccaacggcuuccagguccacggcaaguccuucuuccacuccaagcacgagcagaccgucaucggcaucaaguacugcgaguccaucgaguccggcaagaccgucaacaagaagucccagcucaugugccagcagauguacaugggcgagaagcccuucggcugcuccugcugcgagaaggccuucuccuccaaguccuaccuccucguccaccagcagacccacgccgaggagaagcccuacggcugcaacgagugcggcaaggacuucuccuccaaguccuaccucaucguccaccagcgcauccacaccggcgagaagcuccacgagugcuccgagugccgcaagaccuucuccuuccacucccagcucgucauccaccagcgcauccacaccggcgagaaccccuacgagugcugcgagugcggcaaggucuucucccgcaaggaccagcucgucucccaccagaagacccacuccggccagaagcccuacgucugcaacgagugcggcaaggccuucggccucaagucccagcucaucauccacgagcgcauccacaccggcgagaagcccuacgagugcaacgagugccagaaggccuucaacaccaaguccaaccucaugguccaccagcgcacccacaccggcgagaagcccuacgucugcuccgacugcggcaaggccuucaccuucaagucccagcucaucguccaccagggcauccacaccggcgucaagcccuacggcugcauccagugcggcaagggcuucucccucaagucccagcucaucguccaccagcgcucccacaccggcaugaagcccuacgucugcaacgagugcggcaaggccuuccgcuccaaguccuaccucaucauccacacccgcacccacaccggcgagaagcuccacgagugcaacaacugcggcaaggccuucuccuucaagucccagcucaucauccaccagcgcauccacaccggcgagaaccccuacgagugccacgagugcggcaaggccuucucccgcaaguaccagcucaucucccaccagcgcacccacgccggcgagaagcccuacgagugcaccgacugcggcaaggccuucggccucaagucccagcucaucauccaccagcgcacccacaccggcgagaagcccuucgagugcuccgagugccagaaggccuucaacaccaaguccaaccucaucguccaccagcgcacccacaccggcgagaagcccuacuccugcaacgagugcggcaaggccuucaccuucaagucccagcucaucguccacaagggcguccacaccggcgucaagcccuacggcugcucccagugcgccaagaccuucucccucaagucccagcucaucguccaccagcgcucccacaccggcgucaagcccuacggcugcuccgagugcggcaaggccuuccgcuccaaguccuaccucaucauccacaugcgcacccacaccggcgagaagccccacgagugccgcgagugcggcaaguccuucuccuucaacucccagcucaucguccaccagcgcauccacaccggcgagaaccccuacgagugcuccgagugcggcaaggccuucaaccgcaaggaccagcucaucucccaccagcgcacccacgccggcgagaagcccuacggcugcuccgagugcggcaaggccuucuccuccaaguccuaccucaucauccacaugcgcacccacuccggcgagaagcccuacgagugcaacgagugcggcaaggccuucaucuggaagucccuccucaucguccacgagcgcacccacgccggcgucaaccccuacaagugcucccagugcgagaaguccuucuccggcaagcuccgccuccucguccaccagcgcaugcacacccgcgagaagcccuacgagugcuccgagugcggcaaggccuucauccgcaacucccagcucaucguccaccagcgcacccacuccggcgagaagcccuacggcugcaacgagugcggcaagaccuucucccagaaguccauccucuccgcccaccagcgcacccacaccggcgagaagcccugcaagugcaccgagugcggcaaggccuucugcuggaagucccagcucaucaugcaccagcgcacccacgucgacgacaagcacuga

SEQ ID NO: 52067 - RNA, 1710 nt, Artificial Sequence
  derived and/or modified sequence opt2 from ZNF273__Homo_sapiens__NP_066971
auguccuccgccccccgcggcccccccuccgucgccccccuccccgccggcaucggccgcuccaccgccaagacccccggccuccccggcucccucgagaugggcccccucaccuuccgcgacgucgccaucgaguucucccucgaggaguggcagugccucgacaccucccagcagaaccucuaccgcaacgucaugcucgacaacuaccgcaaccucgucuuccucggcaucgccgucuccaagcccgaccucaucaccugccucgagcagggcaaggagcccugcaacaugaagcgccacgccauggucgccaagccccccgucgucugcucccacuucgcccaggaccucuggcccaagcagggccucaaggacuccuuccagaaggucauccuccgccgcuacggcaaguacggccacgagaaccuccagcuccgcaagggcugcaaguccgccgacgagcacaagguccacaagcgcggcuacaacggccucaaccagugccucaccaccacccaguccaagaucuuccagugcgacaaguacgucaagguccuccacaaguucuccaacuccaacauccacaagaagcgccagaccggcaagaagcccuucaagugcaaggagugcggcaaguccugcugcauccucucccagcucacccagcacaagaagaccgccacccgcgucaacuucuacaagugcaagaccugcggcaaggccuucaaccaguucuccaaccucaccaagcacaagaucauccaccccgaggucaaccccuacaagugcgaggagugcggcaaggccuucaaccagucccucacccucaccaagcacaagaagauccacaccgaggagaagcccuacaagugcgaggacugcggcaaggucuucuccgucuucuccguccucaccaagcacaagaucauccacaccggcaccaagcccuacaacugcgaggagugcggcaagggcuucuccaucuucuccacccucaccaagcacaagaucauccacaccggcgagaagcccuacaagugcaacgagugcggcaaggccuucaacugguccuccacccucaccaagcacaagcgcauccacaccggcgagaagcccuacaagugcgaggagugcggcaaggccuucaaccaguccuccacccucacccgccacaagaucguccacaccggcgagaagcccuacaagugcgaggagugcggcaaggccuucaagcgcuccaccacccucaccaagcacaagcgcaucuacaccaaggagaagcccuacaagugcgaggagugcggcaaggccuucuccgucuucuccacccucaccaagcacaagaucauccacaccggcgccaagcccuacaagugcgaggagugcggcuccgccuuccgcgccuucuccacccucaccgagcacaagcgcguccacaccggcgagaagcccuacaagugcaacgagugcggcaaggccuucaacugguccuccacccucaccaagcacaagcgcauccacaccggcgagaagcccuacaagugcgaggagugcggcaaggccuucaaccgcuccuccaaccucacccgccacaagaagauccacaccggcgagaagcccuacaagcccaagcgcugcgacuccgccuucgacaacacccccaacuucucccgccacaagcgcaaccacaugggcgagaaguccuga

SEQ ID NO: 52068 - RNA, 1866 nt, Artificial Sequence
  derived and/or modified sequence opt2 from ZNF274__Homo_sapiens__NP_057409
auggccucccgccuccccaccgccugguccugcgagcccgucaccuucgaggacgucacccucggcuucacccccgaggaguggggccuccucgaccucaagcagaagucccucuaccgcgaggucaugcucgagaacuaccgcaaccucgucuccgucgaguaccccgagcuccagcucgaccccaagcucgacccccuccccgccgaguccccccucaugaacaucgaggucgucgagguccucacccucaaccaggaggucgccggcccccgcaacgcccagauccaggcccucuacgccgaggacggcucccucuccgccgacgcccccuccgagcagguccagcagcagggcaagcaccccggcgaccccgaggccgcccgccagcgcuuccgccaguuccgcuacaaggacaugaccggcccccgcgaggcccucgaccagcuccgcgagcucugccaccaguggcuccagcccaaggcccgcuccaaggagcagauccucgagcuccucguccucgagcaguuccucggcgcccuccccgucaagcuccgcaccugggucgagucccagcaccccgagaacugccaggaggucgucgcccucgucgagggcgucaccuggauguccgaggaggagguccuccccgccggccagcccgccgagggcaccaccugcugccucgaggucaccgcccagcaggaggagaagcaggaggacgccgccaucugccccgucaccguccuccccgaggagcccgucaccuuccaggacgucgccgucgacuucucccgcgaggaguggggccuccucggccccacccagcgcaccgaguaccgcgacgucaugcucgagaccuucggccaccucgucuccgucggcugggagaccacccucgagaacaaggagcucgcccccaacuccgacauccccgaggaggagcccgcccccucccucaagguccaggaguccucccgcgacugcgcccucuccuccacccucgaggacacccuccagggcggcguccaggagguccaggacaccguccucaagcagauggaguccgcccaggagaaggaccucccccagaagaagcacuucgacaaccgcgagucccaggccaacuccggcgcccucgacaccaaccaggucucccuccagaagaucgacaaccccgagucccaggccaacuccggcgcccucgacaccaaccagguccuccuccacaagauccccccccgcaagcgccuccgcaagcgcgacucccaggucaaguccaugaagcacaacucccgcgucaagauccaccagaaguccugcgagcgccagaaggccaaggagggcaacggcugccgcaagaccuucucccgcuccaccaagcagaucaccuucauccgcauccacaagggcucccaggucugccgcugcuccgagugcggcaagaucuuccgcaacccccgcuacuucuccguccacaagaagauccacaccggcgagcgccccuacgucugccaggacugcggcaagggcuucguccaguccuccucccucacccagcaccagcgcguccacuccggcgagcgccccuucgagugccaggagugcggccgcaccuucaacgaccgcuccgccaucucccagcaccuccgcacccacaccggcgccaagcccuacaagugccaggacugcggcaaggccuuccgccaguccucccaccucauccgccaccagcgcacccacaccggcgagcgccccuacgccugcaacaagugcggcaaggccuucacccaguccucccaccucaucggccaccagcgcacccacaaccgcaccaagcgcaagaagaagcagcccaccuccuga

SEQ ID NO: 52069 - RNA, 1845 nt, Artificial Sequence
  derived and/or modified sequence opt2 from ZNF276__Homo_sapiens__NP_001106997
augaagcgcgaccgccucggccgcuuccucucccccggcuccucccgccagugcggcgccuccgacggcggcggcggcgucucccgcacccgcggccgccccucccucuccggcggcccccgcgucgacggcgccaccgcccgccgcgccuggggccccgucggcuccugcggcgacgccggcgaggacggcgccgacgaggccggcgccggccgcgcccucgccaugggccacugccgccucugccacggcaaguucuccucccgcucccuccgcuccaucuccgagcgcgcccccggcgccuccauggagcgccccuccgccgaggagcgcguccucguccgcgacuuccagcgccuccucggcgucgccguccgccaggaccccacccucucccccuucgucugcaaguccugccacgcccaguucuaccagugccacucccuccucaaguccuuccuccagcgcgucaacgccucccccgccggccgccgcaagcccugcgccaaggucggcgcccagccccccaccggcgccgaggagggcgccugccucgucgaccucaucaccuccuccccccagugccuccacggccucgucggcuggguccacggccacgccgccuccugcggcgcccucccccaccuccagcgcacccucuccuccgaguacugcggcgucauccaggucgucuggggcugcgaccagggccacgacuacaccauggacaccuccuccuccugcaaggccuuccuccucgacuccgcccucgccgucaaguggcccugggacaaggagaccgccccccgccucccccagcaccgcggcuggaaccccggcgacgccccccagaccucccagggccgcggcaccggcacccccgucggcgccgagaccaagacccuccccuccaccgacgucgcccagccccccuccgacuccgacgccgucggcccccgcuccggcuuccccccccagcccucccucccccucugccgcgcccccggccagcucggcgagaagcagcuccccuccuccaccuccgacgaccgcgucaaggacgaguucuccgaccucuccgagggcgacguccucuccgaggacgagaacgacaagaagcagaacgcccaguccuccgacgaguccuucgagcccuaccccgagcgcaaggucuccggcaagaaguccgaguccaaggaggccaagaaguccgaggagccccgcauccgcaagaagcccggccccaagcccggcuggaagaagaagcuccgcugcgagcgcgaggagcuccccaccaucuacaagugccccuaccagggcugcaccgccgucuaccgcggcgccgacggcaugaagaagcacaucaaggagcaccacgaggagguccgcgagcgccccugcccccaccccggcugcaacaaggucuucaugaucgaccgcuaccuccagcgccacgucaagcucauccacaccgagguccgcaacuacaucugcgacgagugcggccagaccuucaagcagcgcaagcaccuccucguccaccagaugcgccacuccggcgccaagccccuccagugcgaggucugcggcuuccagugccgccagcgcgccucccucaaguaccacaugaccaagcacaaggccgagaccgagcucgacuucgccugcgaccagugcggccgccgcuucgagaaggcccacaaccucaacguccacauguccaugguccacccccucacccagacccaggacaaggcccucccccucgaggccgagcccccccccggcccccccucccccuccgucaccaccgagggccaggccgucaagcccgagcccaccuga

SEQ ID NO: 52070 - RNA, 1353 nt, Artificial Sequence
  derived and/or modified sequence opt2 from ZNF277__Homo_sapiens__NP_068834
auggccgccuccaagacccagggcgccgucgcccgcaugcaggaggaccgcgacggcuccugcuccaccgucggcggcgucggcuacggcgacuccaaggacugcauccucgagccccucucccuccccgagucccccggcggcaccaccacccucgagggcucccccuccguccccugcaucuucugcgaggagcacuuccccgucgccgagcaggacaagcuccucaagcacaugaucaucgagcacaagaucgucaucgccgacgucaagcucgucgccgacuuccagcgcuacauccucuacuggcgcaagcgcuucaccgagcagcccaucaccgacuucugcuccgucauccgcaucaacuccaccgcccccuucgaggagcaggagaacuacuuccuccucugcgacguccuccccgaggaccgcauccuccgcgaggagcuccagaagcagcgccuccgcgagauccucgagcagcagcagcaggagcgcaacgacaccaacuuccacggcgucugcauguucugcaacgaggaguuccucggcaaccgcuccgucauccucaaccacauggcccgcgagcacgccuucaacaucggccuccccgacaacaucgucaacugcaacgaguuccucugcacccuccagaagaagcucgacaaccuccagugccucuacugcgagaagaccuuccgcgacaagaacacccucaaggaccacaugcgcaagaagcagcaccgcaagaucaaccccaagaaccgcgaguacgaccgcuucuacgucaucaacuaccucgagcucggcaaguccugggaggagguccagcucgaggacgaccgcgagcuccucgaccaccaggaggacgacugguccgacugggaggagcaccccgccuccgccgucugccucuucugcgagaagcaggccgagaccaucgagaagcucuacguccacauggaggacgcccacgaguucgaccuccucaagaucaaguccgagcucggccucaacuucuaccagcaggucaagcucgucaacuucauccgccgccagguccaccagugccgcugcuacggcugccacgucaaguucaaguccaaggccgaccuccgcacccacauggaggagaccaagcacaccucccuccuccccgaccgcaagaccugggaccagcucgaguacuacuuccccaccuacgagaacgacacccuccucugcacccucuccgacuccgaguccgaccucaccgcccaggagcagaacgagaacguccccaucaucuccgaggacaccuccaagcucuacgcccucaagcaguccuccauccucaaccagcuccuccucuga

SEQ ID NO: 52071 - RNA, 1632 nt, Artificial Sequence
  derived and/or modified sequence opt2 from ZNF280B__Homo_sapiens__XP_011545198
auggagcaguccugcgaggaggagaaggagcccgagccccagaagaacauccaggagaccaagcaggucgacgacgaggacgccgagcucaucuucgucggcgucgagcacgucaacgaggacgccgagcucaucuucgucggcgucaccuccaacuccaagcccgucgucuccaacauccucaaccgcgucacccccggcuccuggucccgccgcaagaaguacgaccaccuccgcaaggacaccgcccgcaagcuccagcccaagucccacgagaccgucaccuccgaggccgucaccguccuccccgccucccagcucgagucccgcuccaccgacucccccaucaucaucgagccccucuccaagcccgacuaccgcaacuccuccccccaggucguccccaacaacuccuccgagcuccccuccccccucaucaccuucaccgacucccuccaccaccccgucuccaccgcccucuccgucggcggcaucaacgaguccccccgcgucuccaagcagcucuccaccuucgaggucaacuccaucaaccccaagcgcgccaagcuccgcgacggcaucaucgagggcaacuccuccgccuccuuccccuccgacaccuuccacaccaugaacacccagcaguccacccccuccaacaacguccacaccucccucucccacguccagaacggcgcccccuuccccgccgccuuccccaaggacaacauccacuucaagcccaucaacaccaaccucgaccgcgccaacgagcucgccaagaccgacauccucucccucaccucccagaacaagaccuucgaccccaagaaggagaaccccaucguccuccucuccgacuucuacuacggccagcacaagggcgagggccagcccgagcagaagacccacaccaccuucaagugccucuccugcgucaagguccucaagaacgucaaguucaugaaccacgucaagcaccaccucgaguucgagaagcagcgcaacgacuccugggagaaccacaccaccugccagcacugccaccgccaguuccccacccccuuccagcuccagugccacaucgagaacguccacaccgcccaggagcccuccaccgucugcaagaucugcgagcucuccuucgagaccgaccagguccuccuccagcacaugaaggaccaccacaagcccggcgagaugcccuacgucugccaggucugccacuaccgcuccuccgucuucgccgacgucgagacccacuuccgcaccugccacgagaacaccaagaaccuccucugccccuucugccucaagaucuucaagaccgccacccccuacaugugccacuaccgcggccacuggggcaaguccgcccaccagugcuccaagugccgccuccaguuccucaccuucaaggagaagauggagcacaagacccagugccaccagauguucaagaagcccaagcagcucgagggccucccccccgagaccaaggucaccauccaggucucccucgagccccuccagcccggcuccgucgacgucgccuccaucaccgucuccaccuccgacuccgagcccucccucccccgcuccaaguccaagaucuccaagaagucccacuga

SEQ ID NO: 52072 - RNA, 2901 nt, Artificial Sequence
  derived and/or modified sequence opt2 from ZNF280D__Homo_sapiens__NP_001002843
auggccgagcucuucauggagugcgaggaggaggagcucgagcccuggcagaagaaggucaaggaggucgaggacgacgacgacgacgagcccaucuucgucggcgagaucuccuccuccaagcccgccaucuccaacauccucaaccgcgucaaccccuccuccuacucccgcggccucaagaacggcgcccucucccgcggcaucaccgccgccuucaagcccaccucccagcacuacaccaaccccaccuccaaccccguccccgccucccccaucaacuuccaccccgagucccgcuccuccgacuccuccgucaucguccagcccuucuccaagcccggcuacaucaccaacuccucccgcgucgucuccaacaaguccuccgagcuccucuucgaccucacccaggacaccggccucucccacuaccagggcggccccacccucuccauggccggcauguccgaguccuccuuccucuccaagcgccccuccaccuccgaggucaacaacgucaaccccaagaagcccaagcccuccgaguccgucuccggcgccaacuccuccgccguccuccccuccgucaagucccccuccgucaccuccucccaggccaugcucgccaagggcaccaacaccuccuccaaccaguccaagaacggcacccccuucccccgcgccugccccaagugcaacauccacuucaaccuccucgacccccucaagaaccacaugaaguacugcugccccgacaugaucaacaacuuccucggccucgccaagaccgaguucuccuccaccgucaacaagaacaccaccaucgacuccgagaagggcaagcucaucaugcucgucaacgacuucuacuacggcaagcacgagggcgacguccaggaggagcagaagacccacaccaccuucaagugcuucuccugccucaagauccucaagaacaacauccgcuucaugaaccacaugaagcaccaccucgagcucgagaagcaguccuccgaguccugggagaaccacaccaccugccagcacugcuaccgccaguuccccacccccuuccagcuccagugccacaucgaguccacccacaccccccacgaguucuccaccaucugcaagaucugcgagcucuccuucgagaccgagcacguccuccuccagcacaugaaggacaaccacaagcccggcgagaugcccuacgucugccaggucugcaacuaccgcuccuccuccuucuccgacgucgagacccacuuccgcaccucccacgagaacaccaagaaccuccucugccccuucugccucaaggucaucaagaucgccacccccuacaugcaccacuacaugaagcaccagaagaagggcauccaccgcugcaccaagugccgccuccaguuccucaccugcaaggagaagauggaccacaagacccagcaccaccgcaccuucaucaagcccaagcagcucgagggccucccccccggcaccaaggucaccauccgcgccuccgucggcccccuccaguccggcgccucccccacccccuccaucuccgccuccgccuccacccuccagcucucccccccccgcaccaagaacaucaccgccaagaaccccgccaaguccaacaccuccaagcccaacaccgucaaguccaacgccuccaagcccaacaccuccaagcccaacggcuccaaguccaaguacaagcccaagaucuccaacaugcagaagaagcaguccacccucgccuccuccaacaagaaguccaaggucaacaccgcccuccgcaaccuccgcuaccgccgcggcauccacaagugcaucgagugcugcuccgagaucaaggacuucgccaaccacuuccccaccuacguccacugcuccuucugccgcuacaacaccuccugcuccaaggccuacgucaaccacaugauguccuuccacuccaaccgccccuccaagcgcuucugcaucuucaagaagcacuccgagaaccuccgcggcaucacccucgucugccucaacugcgacuuccucuccgacgucuccggccucgacaacauggccacccaccucucccagcacaagacccacaccugccaggucgucaugcagaaggucuccgucugcauccccaccuccgagcaccucuccgagcucaagaaggaggcccccgccaaggagcaggagcccgucuccaaggagaucgcccgccccaacauggccgagcgcgagaccgagaccuccaacuccgaguccaagcaggacaaggccgccuccuccaaggagaagaacggcugcaacgccaacuccuucgagggcuccuccaccaccaaguccgaggaguccaucaccgucuccgacaaggagaacgagaccugccucgccgaccaggagaccggcuccaagaacaucgucuccugcgacuccaacaucggcgccgacaaggucgagaagaagaagcagauccagcacgucugccaggagauggagcucaagaugugccaguccuccgagaacaucauccucuccgaccagaucaaggaccacaacuccuccgaggcccgcuucuccuccaagaacaucaaggaccuccgccucgccuccgacaacgucuccaucgaccaguuccuccgcaagcgccacgagcccgaguccgucuccuccgacgucuccgagcagggcuccauccaccucgagccccucacccccuccgagguccucgaguacgaggccaccgagauccuccagaagggcuccggcgaccccuccgccaagaccgacgaggucgucuccgaccagaccgacgacauccccggcggcaacaaccccuccaccaccgaggccaccgucgaccucgaggacgagaaggagcgcuccuga

SEQ ID NO: 52073 - RNA, 2688 nt, Artificial Sequence
  derived and/or modified sequence opt2 from ZNF281__Homo_sapiens__NP_001268222
augaagaucggcuccggcuuccucuccggcggcggcggcaccggcuccuccggcggcuccggcuccggcggcggcggcuccggcggcggcggcggcggcggcuccuccggccgccgcgccgagauggagcccaccuucccccagggcauggucauguucaaccaccgccucccccccgucaccuccuucacccgccccgccggcuccgccgccccccccccccagugcguccucuccuccuccaccuccgccgcccccgccgccgagcccccccccccccccgcccccgacaugaccuucaagaaggagcccgccgccuccgccgccgccuuccccucccagcgcaccuccuggggcuuccuccagucccucgucuccaucaagcaggagaagcccgccgaccccgaggagcagcagucccaccaccaccaccaccaccaccacuacggcggccucuucgccggcgccgaggagcgcucccccggccucggcggcggcgagggcggcucccacggcgucauccaggaccucuccauccuccaccagcacguccagcagcagcccgcccagcaccaccgcgacguccuccucuccuccuccucccgcaccgacgaccaccacggcaccgaggagcccaagcaggacaccaacgucaagaaggccaagcgccccaagcccgagucccagggcaucaaggccaagcgcaagcccuccgccuccuccaagcccucccucgucggcgacggcgagggcgccauccucucccccucccagaagccccacaucugcgaccacugcuccgccgccuuccgcuccuccuaccaccuccgccgccacguccucauccacaccggcgagcgccccuuccagugcucccagugcuccaugggcuucauccagaaguaccuccuccagcgccacgagaagauccacucccgcgagaagcccuucggcugcgaccagugcuccaugaaguucauccagaaguaccacauggagcgccacaagcgcacccacuccggcgagaagcccuacaagugcgacaccugccagcaguacuucucccgcaccgaccgccuccucaagcaccgccgcaccugcggcgaggucaucgucaagggcgccaccuccgccgagcccggcuccuccaaccacaccaacaugggcaaccucgccguccucucccagggcaacaccuccuccucccgccgcaagaccaaguccaaguccaucgccaucgagaacaaggagcagaagaccggcaagaccaacgagucccagaucuccaacaacaucaacaugcaguccuacuccgucgagaugcccaccgucuccuccuccggcggcaucaucggcaccggcaucgacgagcuccagaagcgcguccccaagcucaucuucaagaagggcucccgcaagaacaccgacaagaacuaccucaacuucgucuccccccuccccgacaucgucggccagaagucccucuccggcaagcccuccggcucccucggcaucgucuccaacaacuccgucgagaccaucggccuccuccaguccaccuccggcaagcagggccagaucuccuccaacuacgacgacgccaugcaguucuccaagaagcgccgcuaccuccccaccgccuccuccaacuccgccuucuccaucaacgucggccacauggucucccagcaguccgucauccaguccgccggcgucuccguccucgacaacgaggccccccucucccucaucgacuccuccgcccucaacgccgagaucaaguccugccacgacaaguccggcauccccgacgagguccuccaguccauccucgaccaguacuccaacaaguccgagucccagaaggaggaccccuucaacaucgccgagccccgcgucgaccuccacaccuccggcgagcacuccgagcucguccaggaggagaaccucucccccggcacccagacccccuccaacgacaaggccuccaugcuccaggaguacuccaaguaccuccagcaggccuucgagaaguccaccaacgccuccuucacccucggccacggcuuccaguucgucucccucuccuccccccuccacaaccacacccucuuccccgagaagcagaucuacaccaccuccccccucgagugcggcuucggccaguccgucaccuccguccuccccuccucccuccccaagccccccuucggcaugcucuucggcucccagcccggccucuaccucuccgcccucgacgccacccaccagcagcucacccccucccaggagcucgacgaccucaucgacucccagaagaaccucgagaccuccuccgccuuccaguccuccucccagaagcucaccucccagaaggagcagaagaaccucgaguccuccaccggcuuccagauccccucccaggagcucgccucccagaucgacccccagaaggacaucgagccccgcaccaccuaccagaucgagaacuucgcccaggccuucggcucccaguucaaguccggcucccgcguccccaugaccuucaucaccaacuccaacggcgaggucgaccaccgcguccgcaccuccgucuccgacuucuccggcuacaccaacaugauguccgacgucuccgagcccugcuccacccgcgucaagacccccaccucccaguccuaccgcuga

SEQ ID NO: 52074 - RNA, 1392 nt, Artificial Sequence
  derived and/or modified sequence opt2 from ZNF282__Homo_sapiens__NP_001290410
augcaguucgucuccacccgcccccagccccagcagcucggcauccagggccucggccucgacuccggcuccugguccugggcccaggcccucccccccgaggaggucugccaccaggagcccgcccuccgcggcgagauggccgagggcaugccccccaugcaggcccaggagugggacauggacgcccgccgccccaugcccuuccaguucccccccuuccccgaccgcgcccccgucuuccccgaccgcaugaugcgcgagccccagcuccccaccgccgagaucucccucuggaccgucgucgccgccauccaggccgucgagcgcaaggucgacgcccaggccucccagcuccucaaccucgagggccgcaccggcaccgccgagaagaagcucgccgacugcgagaagaccgccgucgaguucggcaaccacauggaguccaagugggccguccucggcacccuccuccaggaguacggccuccuccagcgccgccucgagaaccucgagaaccuccuccgcaaccgcaacuucuggguccuccgccucccccccggcuccaagggcgaggcccccaagguccccgucaccuucgucgacaucgccgucuacuucuccgaggacgaguggaagaaccucgacgaguggcagaaggagcucuacaacaaccucgucaaggagaacuacaagacccucaugucccucgacgccgagggcuccguccccaagcccgacgcccccguccaggccgagccccgcgaggagcccugcgucugggagcagcgccaccccgaggagcgcgagauccccauggaccccgaggccggcgccgagccccucguccccgcccaggacgccuccucccaggucaagcgcgaggacacccucugcguccgcggccagcgcggccucgaggagcgcgccauccccaccgaguccaucaccgacucccccaucuccgcccaggaccuccucucccgcaucaagcaggaggagcaccagugcgucugggaccagcaggaccucgccgaccgcgacauccccaccgaccccaacuccgagucccucaucuccgcccacgacauccucuccuggaucaagcaggaggagcagcccuaccccuggggcccccgcgacuccauggacggcgagcucggccucgacuccggccccuccgacucccuccucauggucaagaaccccccccccgcccccccccagccccagccccagccccagcccccccagccccagcuccagucccagccccagccccagucccucccccccaucgccgucgccgagaaccccggcggcccccccucccgcggccuccucgacgacggcuuccagccccaccagggcgccgcccuccgcguccgcuga

SEQ ID NO: 52075 - RNA, 1569 nt, Artificial Sequence
  derived and/or modified sequence opt2 from ZNF286B__Homo_sapiens__NP_001138517
auggagaccgaccucgccgagaugcccgagaagggcguccucuccucccaggacuccccccacuuccaggagaaguccaccgaggagggcgaggucgccgcccuccgccucaccgcccgcucccaggccgccgccgccgccgccgcccccggcucccgcucccuccgcggcguccacgucccccccccccuccaccccgcccccgcccgcgaggagaucaaguccaccugcucccucaaggccugcuucucccucucccucacccucaccuacuaccgcaccgccuuccuccucuccaccgagaacgagggcaaccuccacuuccagugccccuccgacgucgagacccgcccccaguccaaggacuccaccuccguccaggacuucuccaaggccgaguccugcaaggucgccaucaucgaccgccucacccgcaacuccgucuacgacuccaaccucgaggccgcccucgagugcgagaacuggcucgagaagcagcagggcaaccaggagcgccaccuccgcgagauguucacccacaugaacucccucuccgaggagaccgaccacgagcacgacgucuacuggaaguccuucaaccagaaguccguccucaucaccgaggaccgcguccccaagggcuccuacgccuuccacacccucgagaagucccucaagcagaaguccaaccucaugaagaagcagcgcaccuacaaggagaagaagccccacaagugcaacgacugcggcgagcucuucaccugccacuccguccacauccagcaccagcgcguccacaccggcgagaagcccuacaccugcaacgagugcggcaaguccuucucccaccgcgccaaccucaccaagcaccagcgcacccacacccgcauccucuucgagugccgcgagugcaagaagaccuucaccgaguccuccucccucgccacccaccagcgcauccacgucggcgagcgccccuacgagugcaacgagugcggcaagggcuucaaccgcuccacccaccucguccagcaccagcucauccacaccggcguccgccccuacgagugcaacgagugcgacaaggccuucauccacuccuccgcccucaucaagcaccagcgcacccacaccggcgagaagcccuacaagugccaggagugcggcaaggccuucucccacugcuccucccucaccaagcaccagcgcguccacaccggcgagaagcccuacgagugcuccgagugcggcaagaccuucucccaguccacccaccucguccagcaccagcgcauccacaccggcgagaagcccuacgagugcuccgagugcggcaagaccuucucccaguccuccaacuucgccaagcaccagcgcauccacaucggcaagaagcccuacaagugcuccgagugcggcaaggccuucauccacuccuccgcccucauccagcaccagcgcacccacaccggcgagaagcccuuccgcugcaacgagugcggcaaguccuucaagugcuccuccucccucauccgccaccagcgcguccacaccgaggagcagcccuga

SEQ ID NO: 52076 - RNA, 1428 nt, Artificial Sequence
  derived and/or modified sequence opt2 from ZNF296__Homo_sapiens__NP_660331
augucccgccgcaaggccggcuccgccccccgccgcgucgagcccgcccccgccgccaaccccgacgacgagauggagaugcaggaccucgucaucgagcucaagcccgagcccgacgcccagccccagcaggccccccgccucggccccuucucccccaaggaggucuccuccgccggccgcuucggcggcgagccccaccacucccccggccccaugcccgccggcgccgcccuccucgcccucggcccccgcaaccccuggacccucuggaccccccucacccccaacuaccccgaccgccagcccuggaccgacaagcaccccgaccuccucaccugcggccgcugccuccagaccuucccccucgaggccaucaccgccuucauggaccacaagaagcucggcugccagcucuuccgcggccccucccgcggccagggcuccgagcgcgaggagcucaaggcccucuccugccuccgcugcggcaagcaguucaccgucgccuggaagcuccuccgccacgcccagugggaccacggccucuccaucuaccagaccgaguccgaggcccccgaggccccccuccucggccucgccgaggucgccgccgccgucuccgccgucgucggccccgccgccgaggccaaguccccccgcgccuccggcuccggccucacccgccgcucccccaccugccccgucugcaagaagacccucuccuccuucuccaaccucaagguccacaugcgcucccacaccggcgagcgccccuacgccugcgaccagugccccuacgccugcgcccaguccuccaagcucaaccgccacaagaagacccaccgccagguccccccccaguccccccucauggccgacaccucccaggagcaggccuccgccgccccccccgagcccgccguccacgccgccgcccccaccuccacccuccccugcuccggcggcgagggcgccggcgccgccgccaccgccggcguccaggagcccggcgcccccggcuccggcgcccaggccggccccggcggcgacaccuggggcgccaucaccaccgagcagcgcaccgaccccgccaacucccagaaggccucccccaagaagaugcccaaguccggcggcaagucccgcggccccggcggcuccugcgaguucugcggcaagcacuucaccaacuccuccaaccucaccguccaccgccgcucccacaccggcgagcgccccuacaccugcgaguucugcaacuacgccugcgcccaguccuccaagcucaaccgccaccgccgcaugcacggcaugacccccggcuccacccgcuucgagugcccccacugccacguccccuucggccuccgcgccacccucgacaagcaccuccgccagaagcaccccgaggccgccggcgaggccuga

SEQ ID NO: 52077 - RNA, 1152 nt, Artificial Sequence
  derived and/or modified sequence opt2 from ZNF2__Homo_sapiens__NP_001017396
augcucgagaacuacaacuccaucgucucccucggccuccccgucccccagcccgacgucaucuuccagcucaagcgcggcgacaagcccuggauggucgaccuccacggcuccgaggagcgcgaguggcccgaguccgucucccucgacugggagaccaagcccgagauccacgacgccuccgacaagaaguccgagggcucccuccgcgagugccucggccgccaguccccccucugccccaaguucgagguccacacccccaacggccgcaugggcaccgagaagcagucccccuccggcgagacccgcaagaagucccucucccgcgacaagggccuccgccgccgcuccgcccucucccgcgagauccucaccaaggagcgccaccaggagugcuccgacugcggcaagaccuucuucgaccacuccucccucacccgccaccagcgcacccacaccggcgagaagcccuacgacugccgcgagugcggcaaggccuucucccaccgcuccucccucucccgccaccucaugucccacaccggcgagucccccuacgagugcuccgucugcuccaaggccuucuucgaccgcuccucccucaccguccaccagcgcauccacaccggcgagaagcccuuccagugcaacgagugcggcaaggccuucuucgaccgcuccucccucacccgccaccagcgcauccacaccggcgagucccccuacgagugccaccagugcggcaaggccuucucccagaaguccauccucacccgccaccagcucauccacaccggccgcaagcccuacgagugcaacgagugcggcaaggccuucuacggcgucuccucccucaaccgccaccagaaggcccacgccggcgacccccgcuaccagugcaacgagugcggcaaggccuucuucgaccgcuccucccucacccagcaccagaagauccacaccggcgacaagcccuacgagugcuccgagugcggcaaggccuucucccagcgcugccgccucacccgccaccagcgcguccacaccggcgagaagcccuucgagugcaccgucugcggcaaggucuucuccuccaaguccuccgucauccagcaccagcgccgcuacgccaagcagggcaucgacuga

SEQ ID NO: 52078 - RNA, 1863 nt, Artificial Sequence
  derived and/or modified sequence opt2 from ZNF300__Homo_sapiens__NP_001166302
augguccccgccgagaccuccuccuccggccuccucgaggagcagaagaugaugaagucccagggccucgucuccuucaaggacgucgccgucgacuucacccaggaggaguggcagcagcucgaccccucccagcgcacccucuaccgcgacgucaugcucgagaacuacucccaccucgucuccaugggcuaccccgucuccaagcccgacgucaucuccaagcucgagcagggcgaggagcccuggaucaucaagggcgacaucuccaacuggaucuaccccgacgaguaccaggccgacggccgccaggaccgcaaguccaaccuccacaacucccaguccugcauccucggcaccgucuccuuccaccacaagauccucaagggcgucacccgcgacggcucccucugcuccauccucaaggucugccagggcgacggccagcuccagcgcuuccucgagaaccaggacaagcucuuccgccaggucaccuucgucaacuccaagaccgucaccgaggccuccggccacaaguacaacccccucggcaagaucuuccaggagugcaucgagaccgacaucuccauccagcgcuuccacaaguacgacgccuucaagaagaaccucaagcccaacaucgaccuccccuccugcuacaaguccaacucccgcaagaagcccgaccaguccuucggcggcggcaaguccuccucccaguccgagcccaacuccaaccucgagaagauccacaacggcgucauccccuucgacgacaaccagugcggcaacgucuuccgcaacacccagucccucauccaguaccagaacgucgagaccaaggagaaguccugcgucugcgucaccugcggcaaggccuucgccaagaagucccagcucaucguccaccagcgcauccacaccggcaagaagcccuacgacugcggcgccugcggcaaggccuucuccgagaaguuccaccucgucguccaccagcgcacccacaccggcgagaagcccuacgacugcuccgagugcggcaaggccuucucccagaaguccucccucaucauccaccagcgcguccacaccggcgagaagcccuacgagugcuccgagugcggcaaggccuucucccagaaguccccccucaucauccaccagcgcauccacaccggcgagaagcccuacgagugccgcgagugcggcaaggccuucucccagaagucccagcucaucauccaccaccgcgcccacaccggcgagaagcccuacgagugcaccgagugcggcaaggccuucugcgagaagucccaccucaucauccacaagcgcauccacaccggcgagaagcccuacaagugcgcccagugcgaggaggccuucucccgcaagaccgagcucaucacccaccagcucguccacaccggcgagaagcccuacgagugcaccgagugcggcaagaccuucucccgcaagucccagcucaucauccaccagcgcacccacaccggcgagaagcccuacaagugcuccgagugcggcaaggccuucugccagaagucccaccucaucggccaccagcgcauccacaccggcgagaagcccuacaucugcaccgagugcggcaaggccuucucccagaagucccaccuccccggccaccagcgcauccacaccggcgagaagcccuacaucugcgccgagugcggcaaggccuucucccagaaguccgaccucguccuccaccagcgcauccacaccggcgagcgccccuaccagugcgccaucugcggcaaggccuucauccagaagucccagcucaccguccaccagcgcauccacaccgucgucaaguccuga

SEQ ID NO: 52079 - RNA, 2001 nt, Artificial Sequence
  derived and/or modified sequence opt2 from ZNF311__Homo_sapiens__NP_001010877
augcaggaggucguccuccucgacgaguccuccggcccccccucccagcuccucuggacccgccaggacacccagcucccccaggaguccgcccuccuccccgcccccuaccccgccuucaccaaggacggcucccagggcaaccucccccaggccgacaucacccucaugucccaggcccaggaguccgucaccuucgaggacgucgccgucaacuucaccaaccgcgaguggcagugccucaccuacgcccagcgccaccucuacaaggacgucaugcucgagaacuacggcaacauggucucccucggcuuccccuuccccaagcccccccucaucucccaccucgagcgcgaggucgaccccugcguccaggacccccaggaccgcgagucccucuccugcuccuaccccgucuccgccgacaagauguggcccgagaacgagaaggccuccucccagcaggagaucuucgagaacggcgaggccuacuggaugaaguucaacucccuccucaaggucgacucccgcgaccccaagguccgcgaggucugcguccaggacgucaagcucgagaaccagugggagaccuccauccgcgagaagcuccgcgaggagaaggagggcuccgaggaggucaccugcaagaagggcaagaaccagaagguccucuccaagaaccucaaccccaacuccaagcacucccagugcaacaagguccucaucgcccagaagcuccacgagugcgcccgcugcggcaagaacuucuccuggcacuccgaccucauccuccacgagcagauccacuccggcgagaagccccacgucugcaacgagugcggcaaggccuucaagacccgcaaccagcucuccaugcaccgcaucauccacaccggcgagaagcccuucaacugcacccagugcggcaaggccuucaacucccgcuccgcccucugccgccacaagaagacccacuccggcgagaagccccacgagugccgcgacugcggcaaggccuucaagacccgcaaccgccucugcaugcaccagcucauccacaccggcgagaagcccuacaagugcaacugcugcggcaaggccuuccaguucaagcacucccucaccauccacggccgcauccacaccggcgagaagcccuacgagugcgaggagugcggcaaggccuucuccggcuccuccgaccucaccaagcacauccgcauccacaccggcgagcgccccuacgagugcuccaagugcggccgcgccuucucccgcuccuccgaccucuccaagcacaagcgcauccacacccgcgagaagcacuacggcugcccccagugcggcaaggacuucuccaucaaggccgagcucaccaagcaccgccgcauccacaccgaggagaagcgcuaccgcugcgaggagugcggcaaggccuuccgccacaacugcaagcgccgcgcccacgagcgcgagcacaccggcgagaagcccuaccagugccgcgacugcggcaagaccuuccaggacaagcacugccucaccauccaccagcgcauccacaccggcgagaagcccuacaagugccucgagugcggcaaggccuucuccggcaaguccaaccucaccaaccaccgccgcauccacaccggcgagaagccccacaagugcgaggucugcggcauggccuuccaccacuccuccguccuccgccagcacaagcgcauccacaccggcgagaagcccuacaccugcuccgagugcggcaccuccuuccgccagggcuccgcccucaucggccacaagcgcguccacaccggcgagaagcccuacgagugcgaggagugcggcaaggccuuccgcgucuccuccaaccucaccggccacaagaagcgcaagcaccaggucugguccacccacgagcucgacggcucccgcaagucccucucccccgucaccgucucccagaccuccgucgucuccauccucaccuccgccuga

SEQ ID NO: 52080 - RNA, 6840 nt, Artificial Sequence
  derived and/or modified sequence opt2 from ZNF318__Homo_sapiens__NP_055160
auguaccgcuccuccgcccgcuccuccgucuccucccaccgccccaaggacgacggcggcggcggcccccgcuccggccgcuccuccggcuccuccuccggccccgcccgccgcuccucccccccccccccccccuccggcuccuccucccgcacccccgcccgccgcccccgcucccccuccggccaccgcggccgccgcgccucccccucccccccccgcggccgccgcgucucccccucccccccccgcgcccgccgcggcucccccucccccccccgcggccgccgccucuucccccccggccccgccggcuuccgcggcuccucccgcggcgagucccgcgccgacuacgcccgcgacggccgcggcgaccaccccggcgacuccggcucccgccgccgcucccccggccucugcuccgacucccucgagaagucccuccgcaucaccgucggcaacgaccacuucugcgucuccacccccgagcgccgccgccucuccgaccgccucggcucccccgucgacaaccucgaggacauggaccgcgacgaccucaccgacgacuccgucuucacccgcuccucccagugcucccgcggccucgagcgcuacaucucccaggaggagggcccccucucccccuuccucggccagcucgacgaggacuaccgcaccaaggagaccuuccuccaccgcuccgacuacuccccccacaucuccugccacgacgagcuccuccgcggcaccgagcgcaaccgcgagaagcucaagggcuacuccauccgcuccgaggagcgcucccgcgaggccaagcgcccccgcuacgacgacaccgucaagaucaacuccaugggcggcgaccaccccuccuucaccuccggcacccgcaacuaccgccagcgccgccgcucccccuccccccgcuuccucgaccccgaguuccgcgagcucgaccucgcccgccgcaagcgcgaggaggaggaggagcgcucccgcucccucucccaggagcucgucggcgucgacggcggcggcaccggcugcuccauccccggccucuccggcguccucaccgccuccgagcccggcuacucccuccaccgccccgaggaggucuccgucaugcccaagaaguccauccucaagaagcgcaucgaggucgacaucauggagcccuccaugcagcucgaguccuucuccuccuccaccuccuccucccaggaccacccccucuacuccggccaccccucccucccccucuccggcgccaucgccgccuucgccuccgagaucgagaacaagggcaccauggucgagaccgcccucaaggagccccagggcaaccucuaccaguggggcccccuccccggcauccccaaggacaacuccccccuccgcgagaaguucggcuccuuccucugccacaaggacaaccucgaccucaaggccgagggccccgagcgccacaccgacuuccuccucccccacgagcgcgccucccaggacggcuccggcuucucccgcauccucuccaugcucgccgacuccaccuccacccaggagaagcgccgccgcuccuuccccgacaucgaggacgaggagaaguuccucuacggcgacgaggaggaggaccucaaggccgaguccguccccaagccccucggcuccuccgaguccgaggucaugcgccagaaggccuccucccuccccuccuccgcccccgccgucaagcucgagucccucgaggagaccaaccccgaguacgccaagauccacgaccuccucaagaccaucggccucgacaucggcgucgccgagaucucccagcucgccgcccgcacccaggagcgccuccacggcaagaagcccucccuccgcuccuccgccgaccgccgcuccuccgucgaccgcuacuucuccgccgaccacugcuccuccgucgaccaccgcuucuccgccgaccgcugcuccuccgucgaccacugcuucuccgccgaccgccgcuccuccgacccccaccgccucgagucccgcgaggcccaccacuccaacacccacucccccgaggucucccacccccacccccccucccccgucgaccccuaccuccucaccaagaacuccccccccuuccucaaguccgaccaccccgucggccacaucuccggccccgaggucgucggcuccggcuuccaguccuccgucgccguccgcugcaugcuccccuccgcccccuccgcccccauccgccucccccacaccgccgcccucucccaguuccacaugccccgcgccucccaguucgccgccgcccgcaucccccccaacuaccagggccccgccaucccccccgccuccuucgacgccuaccgccacuacauggccuacgccgccucccgcuggcccauguaccccaccucccagcccuccaaccaccccguccccgagccccaccgcaucaugcccaucaccaagcaggccacccgcucccgccccaaccuccgcgucauccccaccgucacccccgacaagcccaagcagaaggagucccuccgcggcuccauccccgccgcccagguccccguccaggucuccauccccucccucauccgcuacaaccccgagaagaucuccgacgagaagaaccgcgccucccagaagcagaaggucaucgaggagcgcgagaagcucaagaacgaccgcgaggcccgccagaagaagauguacuaccuccgcaccgagcucgagcgccuccacaagcagcagggcgagaugcuccgcaagaagcgccgcgagaaggacggccacaaggacccccuccucgucgaggucucccgccuccaggacaacaucaugaaggacaucgccgagcuccgccaggaggccgaggaggccgagaagaagcaguccgagcucgacaaggucgcccagauccucggcaucaacaucuucgacaagucccagaagucccucuccgacucccgcgagcccaccgagaagcccggcaaggccgagaaguccaagucccccgagaaggucuccuccuucuccaacuccuccuccaacaaggaguccaaggucaacaacgagaaguuccgcaccaagucccccaagcccgccgaguccccccaguccgccaccaagcagcucgaccagcccaccgccgccuacgaguacuacgacgccggcaaccacuggugcaaggacugcaacaccaucugcggcaccauguucgacuucuucacccacaugcacaacaagaagcacacccagacccucgaccccuacaaccgccccugggccuccaagacccaguccgaggccaagcaggacgccaucaagcgcaccgacaagaucaccguccccgccaagggcuccgaguuccucguccccaucuccggcuucuacugccagcucugcgaggaguuccucggcgaccccaucuccggcgagcagcacgucaagggccaccagcacaacgagaaguacaagaaguacgucgacgagaacccccucuacgaggagcgccgcaaccucgaccgccaggccggccucgccgucguccucgagaccgagcgccgccgccaguccgagcucaagcgcaagcucuccgagaagcccaaggaggagaagaaggagaagaaggccaaggccgucaaggaggucaaggaggacgacaaggucuccgagaagcucgaggaccagcucuccgagggccgcaacucccccgagaaggccgagaacaagcgcaacaccggcaucaagcuccagcucaaggaggaggucaagaaggagucccccaccuccuccuccuucggcaaguucuccuggaagaagcccgagaaggaggaggagaaguccucccucgucacccccuccaucuccaaggaggagauccucgaguccuccaaggacaaggaggacggcaagaccgaggccggcaaggccaagcccaucaagaucaagcucuccggcaagaccgucgucgcccacaccucccccuggaugcccgucgucaccaccuccacccagaccaagauccgccccaaccuccccauccccuccaccguccuccgcaaguccugcuccgccaccauguccaagcccgccccccucaacaccuuccucuccaucaaguccuccggcaccaccgccaagccccuccccgucgucaaggaguccuccgccgaccuccuccucccccccgacaucaucuccaaggccuucggcggcgaggaggucauccucaagggcucccccgaggagaaggucguccucgccgagaaguccgagcccucccaccuccccgagcagauccuccccccccccccccccccccccccccccccccccccccccccccccgucaucccccaccccgccgcccccuccgccgcccaggccaacgccauccucgcccccgucaaguccaaccccgucgucucccagacccucucccccggcuucgucggccccaacauccucaaccccguccuccccgucgccaucauggccuccgcccagcccgccgccauccccuccgacgagaccgcccccggcgucuccgaguccgaccgcgaccagacccucuucuccguccucguccgccccccccccccccucuccuccgucuucuccgagcaggccaagaagcucgagaagcgcaacuccugccucgccaccgccaacgccaaggaccucuacgacaucuucuacuccuccggcggcaagggcgcccccgagaccaagggcgcccccgagaccaagcucuccggcggcccccucgccaacggcgagaacuccaaccucucccgcaccaaguccuccgacaccuccuccaccuccccccucaacuccuccgccucccaggaggagcuccaccaggacgagggccucgucgccgcccccaucgucuccaacuccgagaagcccaucgccaagacccucgucgcccucggcaagugguccgucgucgagcacgucggccccaaguccaccggcuccaccuacggcuuccuccagccccucacccgccucugccagucccgccccuacgagaccaucacccccaagaccgacacccucgccaucuggaccuccuccuccuuccaguccgacaccucccgcgacaucucccccgagaaguccgagcucgaccucggcgagcccggcccccccggcgucgagccccccccccagcuccucgacauccagugcaaggagucccagaagcucgucgagauccaccuccgcgaguccgucaaccaggacaaggagucccaggagcuccgcaaguccgaggacugccgcgaguccgagaucgagaccaacaccgagcucaaggagcgcgucaaggagcucuccgagggcaucgucgacgagggcgucuccaccuccaucggcccccacuccaucgacgacuccaaccucaaccacggcaaccgcuacaugugggagggcgaggucaagcagcccaaccuccucaugaucgacaaggaggccgagcaguccaacaagcucaugaccggcuccgagacccccuccaaggucgucaucaagcucuccccccaggccugcuccuucaccaaggccaagcucgacuccuuccucuccgaggcccgcucccuccucaacccccaggacacccccgucaagaucuccgcccccgagcuccuccuccacucccccgcccgcuccgccaugugccucaccggcuccccccaggagcagggcgucuccgucgucuccgaggagggccucgagaacuccgcccccgaguccgccucccgcaccucccgcuaccgcucccucaagcucaagcgcgagcgcuccaaggacuuccaggucaagaagaucuacgagcucgccgucugggacgagaacaagaagcgccccgagaccugggagucccccgagaagcccaagaccgaggcccucgagcuccaggacguccaccccgagcucaccgucaccaucgaguccaaggcccucgaggacuucgaggccaccgaccucaaggucgaggagcucaccgcccucggcaaccucggcgacaugcccgucgacuucugcaccacccgcgucucccccgcccaccgcucccccaccguccucugccagaaggucugcgaggagaacuccgucucccccaucggcugcaacuccuccgaccccgccgacuucgagcccauccccuccuucuccggcuucccccucgacucccccaagacccucguccucgacuucgagaccgagggcgagcgcaacucccccaacccccgcuccguccgcauccccucccccaacauccucaagaccggccucaccgagaacgucgaccgcggccucggcggccucgagggcacccaccaggcccucgaccuccucgccggcggcaugaugcccgaggaggucaaggaguccucccagcucgacaagcaggagucccucggccucgagcucaagaccaucaacuccgccggccucggccccucccccugccuccccgaccucgucgacuucgucacccgcaccuccggcguccagaaggacaagcucugcuccccccucuccgagcccggcgaccccuccaagugcuccucccucgagcucggcccccuccagcucgagaucuccaacgccuccaccaccgaggucgccauccuccaggucgacgacgacuccggcgacccccucaaccucgucaaggcccccgucucccgcucccccccccgcgagcaggucaucgaggacaacauggucccccagggcaugcccgagcaggagaccaccgucggcgccauccaggaccacaccgaguccuccguccacaacuga

SEQ ID NO: 52081 - RNA, 1530 nt, Artificial Sequence
  derived and/or modified sequence opt2 from ZNF320__Homo_sapiens__NP_997216
auggcccucucccagggccuccucaccuuccgcgacgucgccaucgaguucucccaggaggaguggaagugccucgaccccgcccagcgcacccucuaccgcgacgucaugcucgagaacuaccgcaaccucgucucccucgacaucuccuccaagugcaugaugaacacccucuccuccaccggccagggcaacaccgaggucauccacaccggcacccuccagcgccaggccuccuaccacaucggcgccuucugcucccaggagaucgagaaggacauccacgacuucgucuuccaguggcaggaggacgagaccaacgaccacgaggcccccaugaccgagaucaagaagcucaccuccuccaccgaccgcuacgaccagcgccacgccggcaacaagcccaucaagggccagcucgagucccgcuuccaccuccaccuccgccgccaccgccgcauccacaccggcgagaagcccuacaagugcgaggagugcgagaaggucuucuccugcaagucccaccucgagauccaccgcaucauccacaccggcgagaagcccuacaagugcaaggucugcgacaaggccuucaagcacgacucccaccucgccaagcacacccgcauccaccgcggcgacaagcacuacaccugcaacgagugcggcaaggucuucgaccagaaggccacccucgccugccaccaccgcucccacaccggcgagaagcccuacaagugcaacgagugcggcaagaccuucucccagaccucccaccucgucuaccaccaccgccuccacaccggcgagaagcccuacaagugcaacgagugcggcaagaccuucgcccgcaacuccguccucgucauccacaaggccguccacaccgccgagaagcccuacaagugcaacgagugcggcaaggucuucaagcagcgcgccacccucgccggccaccgccgcguccacaccggcgagaagcccuaccgcugcgaggagugcgacaaggucuucucccgcaagucccaccucgagcgccaccgccgcauccacaccggcgagaagcccuacaagugcaaggucugcgacaaggccuuccgcuccgacucccgccucgccgagcaccagcgcguccacaccggcgagcgccccuacaccugcaacgagugcggcaaggucuucuccaccaaggccuaccucgccugccaccagaagcuccacaccggcgagaagcucuacgagugcgaggagugcgacaaggucuacauccgcaagucccaccucgagcgccaccgccgcauccacaccggcgagaagccccacaagugcggcgacugcggcaaggccuucaacucccccucccaccucauccgccaccagcgcauccacaccggccagaaguccuacaagugccaccagugcggcaaggucuucucccuccgcucccuccucgccgagcaccagaagauccccuucggcgacaacugcuucaagugcaacgaguacuccaagcccuccuccaucaacuga

SEQ ID NO: 52082 - RNA, 1209 nt, Artificial Sequence
  derived and/or modified sequence opt2 from ZNF322__Homo_sapiens__NP_001229728
auguacaccuccgaggagaagugcaaccagcgcacccagaagcgcaagaucuacaacgucugcccccgcaagggcaagaagaucuucauccacaugcacgagaucauccagaucgacggccacaucuaccagugccucgagugcaagcagaacuucugcgagaaccucgcccucaucaugugcgagcgcacccacaccggcgagaagcccuacaagugcgacaugugcgagaagaccuucguccaguccuccgaccucaccucccaccagcgcauccacaacuacgagaagcccuacaagugcuccaagugcgagaaguccuucuggcaccaccucgcccucuccggccaccagcgcacccacgccggcaagaaguucuacaccugcgacaucugcggcaagaacuucggccaguccuccgaccuccucguccaccagcgcucccacaccggcgagaagcccuaccucugcuccgagugcgacaagugcuucucccgcuccaccaaccucauccgccaccgccgcacccacaccggcgagaagcccuucaagugccucgagugcgagaaggccuucuccggcaaguccgaccucaucucccaccagcgcacccacaccggcgagcgccccuacaagugcaacaagugcgagaaguccuaccgccaccgcuccgccuucaucguccacaagcgcguccacaccggcgagaagcccuacaagugcggcgccugcgagaagugcuucggccagaaguccgaccucaucguccaccagcgcguccacaccggcgagaagcccuacaagugccucgagugcaugcgcuccuucacccgcuccgccaaccucauccgccaccaggccacccacacccacaccuucaagugccucgaguacgagaaguccuucaacugcuccuccgaccucaucguccaccagcgcauccacauggaggagaagccccaccagugguccgccugcgaguccggcuuccuccucggcauggacuucgucgcccagcagaagaugcgcacccagaccgaggagcuccacuacaaguacaccgucugcgacaaguccuuccaccaguccuccgcccuccuccagcaccagaccguccacaucggcgagaagcccuucgucugcaacgucuccgagaagggccucgagcucucccccccccacgccuccgaggccucccagauguccuga

SEQ ID NO: 52083 - RNA, 822 nt, Artificial Sequence
  derived and/or modified sequence opt2 from ZNF32__Homo_sapiens__NP_001005368
auguucggcuuccccaccgccacccuccucgacugccacggccgcuacgcccagaacgucgccuucuucaacgucaugaccgaggcccaccacaaguacgaccacuccgaggccaccggcuccuccuccugggacauccagaacuccuuccgccgcgagaagcucgagcagaagucccccgacuccaagacccuccaggaggacucccccggcguccgccagcgcgucuacgagugccaggagugcggcaaguccuuccgccagaagggcucccucacccuccacgagcgcauccacaccggccagaagcccuucgagugcacccacugcggcaaguccuuccgcgccaagggcaaccucgucacccaccagcgcauccacaccggcgagaagcccuaccagugcaaggagugcggcaaguccuucucccagcgcggcucccucgccguccacgagcgccuccacaccggccagaagcccuacgagugcgccaucugccagcgcuccuuccgcaaccaguccaaccucgccguccaccgccgcguccacuccggcgagaagcccuaccgcugcgaccagugcggcaaggccuucucccagaagggcucccucaucguccacauccgcguccacaccggccucaagcccuacgccugcacccagugccgcaaguccuuccacacccgcggcaacugcauccuccacggcaagauccacaccggcgagacccccuaccucugcggccagugcggcaaguccuucacccagcgcggcucccucgccguccaccagcgcuccugcucccagcgccucacccucuga

SEQ ID NO: 52084 - RNA, 783 nt, Artificial Sequence
  derived and/or modified sequence opt2 from ZNF330__Homo_sapiens__NP_001278931
augccccaguggaacgucaccuccguccgcggcaagaccaagugcaugaugaaguccuccgacugcgucaucaagcacgccggcgucuacuccaccggccucgccauggucggcgccaucugcgacuucugcgaggccugggucugccacggccgcaagugccucuccacccacgccugcgccugcccccucaccgacgccgagugcgucgagugcgagcgcggcgucugggaccacggcggccgcaucuucuccugcuccuucugccacaacuuccucugcgaggacgaccaguucgagcaccaggccuccugccagguccucgaggccgagaccuucaagugcgucuccugcaaccgccucggccagcacuccugccuccgcugcaaggccugcuucugcgacgaccacacccgcuccaaggucuucaagcaggagaagggcaagcagccccccugccccaagugcggccacgagacccaggagaccaaggaccucuccauguccacccgcucccucaaguucggccgccagaccggcggcgaggagggcgacggcgccuccggcuacgacgccuacuggaagaaccucuccuccgacaaguacggcgacaccuccuaccacgacgaggaggaggacgaguacgaggccgaggacgacgaggaggaggaggacgagggccgcaaggacuccgacaccgaguccuccgaccucuucaccaaccucaaccucggccgcaccuacgccuccggcuacgcccacuacgaggagcaggagaacuga

SEQ ID NO: 52085 - RNA, 1392 nt, Artificial Sequence
  derived and/or modified sequence opt2 from ZNF331__Homo_sapiens__NP_061025
auggcccagggccucgucaccuucgccgacgucgccaucgacuucucccaggaggagugggccugccucaacuccgcccagcgcgaccucuacugggacgucaugcucgagaacuacuccaaccucgucucccucgaccucgaguccgccuacgagaacaagucccuccccaccgagaagaacauccacgagauccgcgccuccaagcgcaacuccgaccgccgcuccaagucccucggccgcaacuggaucugcgagggcacccucgagcgcccccagcgcucccgcggccgcuacgucaaccagaugaucaucaacuacgucaagcgccccgccacccgcgagggcacccccccccgcacccaccagcgccaccacaaggagaacuccuucgagugcaaggacugcggcaaggccuucucccgcggcuaccagcucucccagcaccagaagauccacaccggcgagaagcccuacgagugcaaggagugcaagaaggccuuccgcuggggcaaccagcucacccagcaccagaagauccacaccggcgagaagcccuacgagugcaaggacugcggcaaggccuuccgcuggggcuccucccucgucauccacaagcgcauccacaccggcgagaagcccuacgagugcaaggacugcggcaaggccuuccgccgcggcgacgagcucacccagcaccagcgcuuccacaccggcgagaaggacuacgagugcaaggacugcggcaagaccuucucccgcgucuacaagcucauccagcacaagcgcauccacuccggcgagaagcccuacgagugcaaggacugcggcaaggccuucaucugcggcuccucccucauccagcacaagcgcauccacaccggcgagaagcccuacgagugccaggagugcggcaaggccuucacccgcgucaacuaccucacccagcaccagaagauccacaccggcgagaagccccacgagugcaaggagugcggcaaggccuuccgcuggggcuccucccucgucaagcacgagcgcauccacaccggcgagaagcccuacaagugcaccgagugcggcaaggccuucaacugcggcuaccaccucacccagcacgagcgcauccacaccggcgagacccccuacaagugcaaggagugcggcaaggccuucaucuacggcuccucccucgucaagcacgagcgcauccacaccggcgucaagcccuacggcugcaccgagugcggcaaguccuucucccacggccaccagcucacccagcaccagaagacccacuccggcgccaaguccuacgagugcaaggagugcggcaaggccugcaaccaccucaaccaccuccgcgagcaccagcgcauccacaacuccuga

SEQ ID NO: 52086 - RNA, 2112 nt, Artificial Sequence
  derived and/or modified sequence opt2 from ZNF334__Homo_sapiens__XP_011527196
augugcgucuuccuccaccuccucuccuacaucaaggacaccuccuucauccccggccccgacugcgagcuccacccccgcggcauggccgccaccggccccugcuccgaggcccccguccagggcugcgacgccggcgagcuccagcagcucggccucugcggcgucuccgacguccagcgcuccugguccaaguucugcaacuucccccucaccggcuaccacgucuccaagcccgacgucaucuucaagcucgagcagggcgaggagcccuggaucgucgaggaguucuccaaccagaacuaccccgacaucgacgacgcccucgagaagaacaaggagauccaggacaagcaccucacccagaccgucuucuucuccaacaagacccucaucaccgagcgcgagaacgucuucggcaagacccucaaccucggcaugaacuccguccccucccgcaagaugcccuacaagugcaaccccggcggcaacucccucaagaccaacuccgaggucaucgucgccaagaaguccaaggagaaccgcaagauccccgacggcuacuccggcuucggcaagcacgagaagucccaccucggcaugaagaaguaccgcuacaaccccaugcgcaaggccuccaaccagaacgagaaccucauccuccaccagaacauccagauccucaagcagcccuucgacuacaacaagugcggcaagaccuucuucaagcgcgccauccucaucacccagaagggccgccagaccgagcgcaagcccaacgagugcaacgagugccgcaagaccuucuccaagcgcuccacccucaucguccaccagcgcauccacaccggcgagaagcccuacgucugcuccgacugccgcaagaccuuccgcgucaagaccucccucacccgccaccgccgcauccacaccggcgagcgccccuacgagugcuccgagugccgcaagaccuucaucgacaaguccgcccucaucguccaccagaagauccacggcggcgagaaguccuacgagugcaacgagugcggcaagaccuucuuccgcaaguccgcccucgccgagcacuuccgcucccacaccggcgagaagcccuacgagugcaaggagugcggcaacgccuucuccaagaaguccuaccucgucguccaccagcgcacccaccgcggcgagaagcccaacgagugcaaggagugcggcaagaccuucuucugccaguccgcccucaccgcccaccagcgcauccacaccggcgagaagcccuacgagugcuccgagugcgagaagaccuucuucugccaguccgcccucaacguccaccgccgcucccacaccggcgagaagcccuacgagugcucccagugcggcaaguuccucugcaccaaguccgcccucaucgcccaccagaucacccaccgcggcaagaaguccuacgagugcaacgagugcggcaaguucuucugccacaaguccacccucaccauccaccagcgcacccacaccggcgagaagcacggcgucuucaacaagugcggccgcaucuccaucgucaaguccaacugcucccagugcaagcgcaugaacaccaaggagaaccucuacgagugcuccgagcacggccacgccgucuccaagaacucccaccucaucguccaccagcgcaccaucugggagcgccccuacgagugcaacgagugcggccgcaccuacugccgcaaguccgcccucacccaccaccagcgcacccacaccggccagcgccccuacgagugcaacgagugcggcaagaccuucugccagaaguucuccuucgucgagcaccagcgcacccacaccggcgagaagcccuacgagugcaacgagugcggcaaguccuucugccacaaguccgccuuccgcguccaccgccgcauccacaccggcgagaagcccuacgagugcaaccagugcggcaagaccuaccgccgccucuggacccucaccgagcaccagaagauccacaccggcgagaagcccuacgagugcaacaagugcgagaagaccuuccgccacaaguccaacuuccuccuccaccagaagucccacaaggaguga

SEQ ID NO: 52087 - RNA, 4029 nt, Artificial Sequence
  derived and/or modified sequence opt2 from ZNF335__Homo_sapiens__NP_071378
auggaggagaacgaggucgaguccuccuccgacgccgcccccggccccggccgccccgaggagcccuccgaguccggccucggcgucggcaccuccgaggccgucuccgccgacuccuccgacgccgccgccgcccccggccaggccgaggccgacgacuccggcgucggccaguccuccgaccgcggcucccgcucccaggaggaggucuccgaguccuccuccuccgccgacccccuccccaacuccuaccuccccgacuccuccuccgucucccacggccccgucgccggcgucaccggcggcccccccgcccucguccacuccuccgcccuccccgaccccaacaugcucgucuccgacugcaccgccuccuccuccgaccucggcuccgccaucgacaagaucaucgaguccaccaucggccccgaccucauccagaacugcaucaccgucaccuccgccgaggacggcggcgccgagaccacccgcuaccucauccuccagggccccgacgacggcgcccccaugaccucccccauguccuccuccacccucgcccacucccucgccgccaucgaggcccucgccgacggccccaccuccaccuccaccugccucgaggcccagggcggccccuccucccccguccagcucccccccgccuccggcgccgaggagcccgaccuccagucccucgaggccaugauggaggucgucgucguccagcaguucaagugcaagaugugccaguaccgcuccuccaccaaggccacccuccuccgccacaugcgcgagcgccacuuccgccccgucgccgccgccgccgccgccgccggcaagaagggccgccuccgcaagugguccaccuccaccaagucccaggaggaggagggccccgaggaggaggacgacgacgacaucgucgacgccggcgccaucgacgaccucgaggaggacuccgacuacaaccccgccgaggacgagccccgcggccgccagcuccgccuccagcgccccacccccuccaccccccgcccccgccgccgccccggccgcccccgcaagcucccccgccucgagaucuccgaccuccccgacggcgucgagggcgagccccucgucuccucccaguccggccaguccccccccgagccccaggaccccgaggcccccuccuccuccggccccggccaccucgucgccaugggcaaggucucccgcacccccgucgaggccggcgucucccaguccgacgccgagaacgccgcccccuccugccccgacgagcacgacacccucccccgccgccgcggccgccccucccgccgcuuccucggcaagaaguaccgcaaguacuacuacaagucccccaagccccuccuccgccccuuccucugccgcaucugcggcucccgcuuccucucccacgaggaccuccgcuuccacgucaacucccacgaggccggcgacccccagcucuucaagugccuccagugcuccuaccgcucccgccgcugguccucccucaaggagcacauguucaaccacgucggcuccaagcccuacaagugcgacgagugcuccuacaccuccgucuaccgcaaggacgucauccgccacgccgccguccacucccgcgaccgcaagaagcgccccgaccccacccccaagcucuccuccuuccccugccccgucugcggccgcgucuaccccaugcagaagcgccucacccagcacaugaagacccacuccaccgagaagccccacaugugcgacaagugcggcaaguccuucaagaagcgcuacaccuucaagaugcaccuccucacccacauccaggccgucgccaaccgccgcuucaagugcgaguucugcgaguucgucugcgaggacaagaaggcccuccucaaccaccagcucucccacgucuccgacaagcccuucaagugcuccuucugccccuaccgcaccuuccgcgaggacuuccuccucucccacgucgccgucaagcacaccggcgccaagcccuucgccugcgaguacugccacuucuccacccgccacaagaagaaccuccgccuccacguccgcugccgccacgccuccuccuucgaggaguggggccgccgccaccccgaggagccccccucccgccgccgccccuucuucucccuccagcagaucgaggagcucaagcagcagcacuccgccgcccccggccccccccccuccucccccggcccccccgagaucccccccgaggccaccaccuuccaguccuccgaggcccccucccuccucugcuccgacacccucggcggcgccaccaucaucuaccagcagggcgccgaggaguccaccgccauggccacccagaccgcccucgaccuccuccucaacauguccgcccagcgcgagcucggcggcaccgcccuccaggucgccgucgucaaguccgaggacgucgaggccggccucgccucccccggcggccagcccucccccgagggcgccaccccccaggucgucacccuccacgucgccgagcccggcggcggcgccgccgccgagucccagcucggcccccccgaccucccccagaucacccucgcccccggccccuucggcggcaccggcuacuccgucaucaccgccccccccauggaggagggcaccuccgcccccggcacccccuacuccgaggagcccgccggcgaggccgcccaggccgucgucgucuccgacacccucaaggaggccggcacccacuacaucauggccaccgacggcacccagcuccaccacaucgagcucaccgccgacggcuccaucuccuuccccucccccgacgcccucgccuccggcgccaaguggccccuccuccagugcggcggccucccccgcgacggccccgagccccccucccccgccaagacccacugcgucggcgacucccaguccuccgccuccuccccccccgccaccuccaaggcccucggccucgccgucccccccuccccccccuccgccgccaccgccgccuccaagaaguucuccugcaagaucugcgccgaggccuuccccggccgcgccgagauggagucccacaagcgcgcccacgccggccccggcgccuucaagugccccgacugccccuucuccgcccgccaguggcccgagguccgcgcccacauggcccagcacuccucccuccgcccccaccagugcucccagugcuccuucgccuccaagaacaagaaggaccuccgccgccacaugcucacccacaccaaggagaagcccuucgccugccaccucugcggccagcgcuucaaccgcaacggccaccucaaguuccacauccagcgccuccacucccccgacggccgcaaguccggcacccccaccgcccgcgcccccacccagacccccacccagaccaucauccucaacuccgacgacgagacccucgccacccuccacaccgcccuccaguccucccacggcguccucggccccgagcgccuccagcaggcccucucccaggagcacaucaucgucgcccaggagcagaccgucaccaaccaggaggaggccgccuacauccaggagaucaccaccgccgacggccagaccguccagcaccucgucaccuccgacaaccagguccaguacaucaucucccaggacggcguccagcaccuccucccccaggaguacgucgucguccccgagggccaccacauccagguccaggagggccagaucacccacauccaguacgagcagggcgcccccuuccuccaggagucccagauccaguacguccccgucucccccggccagcagcucgucacccaggcccagcucgaggccgccgcccacuccgccgucaccgccgucgccgacgccgccauggcccaggcccagggccucuucggcaccgacgagaccguccccgagcacauccagcagcuccagcaccagggcaucgaguacgacgucaucacccucgccgacgacuga

SEQ ID NO: 52088 - RNA, 1800 nt, Artificial Sequence
  derived and/or modified sequence opt2 from ZNF343__Homo_sapiens__NP_001269424
augaugcuccccuaccccuccgcccucggcgaccaguacugggaggagauccuccuccccaagaacggcgagaacgucgagaccaugaagaagcucacccagaaccacaaggccaagggccuccccuccaacgacaccgacugcccccagaagaaggagggcaaggcccagaucgucguccccgucaccuuccgcgacgucaccgucaucuucaccgaggccgaguggaagcgccucucccccgagcagcgcaaccucuacaaggaggucaugcucgagaacuaccgcaaccuccucucccucgccgagcccaagcccgagaucuacaccugcuccuccugccuccucgccuucuccugccagcaguuccucucccagcacguccuccagaucuuccucggccucugcgccgagaaccacuuccaccccggcaacuccucccccggccacuggaagcagcagggccagcaguacucccacgucuccugcugguucgagaacgccgagggccaggagcgcggcggcggcuccaagcccugguccgcccgcaccgaggagcgcgagaccucccgcgccuuccccuccccccuccagcgccaguccgccuccccccgcaagggcaacauggucgucgagaccgagcccuccuccgcccagcgccccaaccccguccagcucgacaagggccucaaggagcucgagacccuccgcuucggcgccaucaacugccgcgaguacgagcccgaccacaaccucgaguccaacuucaucaccaacccccgcacccuccucggcaagaagcccuacaucugcuccgacugcggccgcuccuucaaggaccgcuccacccucauccgccaccaccgcauccacuccauggagaagcccuacgucugcuccgagugcggccgcggcuucucccagaaguccaaccucucccgccaccagcgcacccacuccgaggagaagcccuaccucugccgcgagugcggccaguccuuccgcuccaaguccauccucaaccgccaccaguggacccacuccgaggagaagcccuacgucugcuccgagugcggccgcggcuucuccgagaaguccuccuucauccgccaccagcgcacccacuccggcgagaagcccuacgucugccucgagugcggccgcuccuucugcgacaaguccacccuccgcaagcaccagcgcauccacuccggcgagaagcccuacgucugccgcgagugcggccgcggcuucucccagaacuccgaccucaucaagcaccagcgcacccaccucgacgagaagcccuacgucugccgcgagugcggccgcggcuucugcgacaaguccacccucaucauccacgagcgcacccacuccggcgagaagcccuacgucugcggcgagugcggccgcggcuucucccgcaagucccuccuccucguccaccagcgcacccacuccggcgagaagcacuacgucugccgcgagugccgccgcggcuucucccagaaguccaaccucauccgccaccagcgcacccacuccaacgagaagcccuacaucugccgcgagugcggccgcggcuucugcgacaaguccacccucaucguccacgagcgcacccacuccggcgagaagcccuacgucugcuccgagugcggccgcggcuucucccgcaagucccuccuccucguccaccagcgcacccacuccggcgagaagcacuacgucugccgcgagugcggccgcggcuucucccacaaguccaaccucauccgccaccagcgcacccacuga

SEQ ID NO: 52089 - RNA, 1599 nt, Artificial Sequence
  derived and/or modified sequence opt2 from ZNF350__Homo_sapiens__NP_067645
augauccaggcccaggaguccaucacccucgaggacgucgccgucgacuucaccugggaggaguggcagcuccucggcgccgcccagaaggaccucuaccgcgacgucaugcucgagaacuacuccaaccucgucgccgucggcuaccaggccuccaagcccgacgcccucuucaagcucgagcagggcgagcagcucuggaccaucgaggacggcauccacuccggcgccugcuccgacaucuggaaggucgaccacguccucgagcgccuccaguccgagucccucgucaaccgccgcaagcccugccacgagcacgacgccuucgagaacaucguccacugcuccaagucccaguuccuccucggccagaaccacgacaucuucgaccuccgcggcaagucccucaaguccaaccucacccucgucaaccaguccaagggcuacgagaucaagaacuccgucgaguucaccggcaacggcgacuccuuccuccacgccaaccacgagcgccuccacaccgccaucaaguuccccgccucccagaagcucaucuccaccaagucccaguucaucucccccaagcaccagaagacccgcaagcucgagaagcaccacgucugcuccgagugcggcaaggccuucaucaagaaguccuggcucaccgaccaccaggucaugcacaccggcgagaagccccaccgcugcucccucugcgagaaggccuucucccgcaaguucaugcucaccgagcaccagcgcacccacaccggcgagaagcccuacgagugccccgagugcggcaaggccuuccucaagaagucccgccucaacauccaccagaagacccacaccggcgagaagcccuacaucugcuccgagugcggcaagggcuucauccagaagggcaaccucaucguccaccagcgcauccacaccggcgagaagcccuacaucugcaacgagugcggcaagggcuucauccagaagaccugccucaucgcccaccagcgcuuccacaccggcaagacccccuucgucugcuccgagugcggcaaguccugcucccagaaguccggccucaucaagcaccagcgcauccacaccggcgagaagcccuucgagugcuccgagugcggcaaggccuucuccaccaagcagaagcucaucguccaccagcgcacccacaccggcgagcgccccuacggcugcaacgagugcggcaaggccuucgccuacauguccugccucgucaagcacaagcgcauccacacccgcgagaagcaggaggccgccaaggucgagaacccccccgccgagcgccacuccucccuccacaccuccgacgucaugcaggagaagaacuccgccaacggcgccaccacccagguccccuccgucgccccccagaccucccucaacaucuccggccuccucgccaaccgcaacgucguccucgucggccagcccgucguccgcugcgccgccuccggcgacaaccgcggcuucgcccaggaccgcaaccucgucaacgccgucaacgucgucguccccuccgucaucaacuacguccucuucuacgucaccgagaaccccuga

SEQ ID NO: 52090 - RNA, 1818 nt, Artificial Sequence
  derived and/or modified sequence opt2 from ZNF354A__Homo_sapiens__NP_005640
auggccgccggccagcgcgaggcccgcccccaggucucccucaccuucgaggacgucgccguccucuucacccgcgacgaguggcgcaagcucgcccccucccagcgcaaccucuaccgcgacgucaugcucgagaacuaccgcaaccucgucucccucggccuccccuucaccaagcccaaggucaucucccuccuccagcagggcgaggaccccugggaggucgagaaggacggcuccggcgucuccucccucggcuccaaguccucccacaagaccaccaaguccacccagacccaggacuccuccuuccagggccucauccucaagcgcuccaaccgcaacguccccugggaccucaagcucgagaagcccuacaucuacgagggccgccucgagaagaagcaggacaagaagggcuccuuccagaucgucuccgccacccacaagaagauccccaccaucgagcgcucccacaagaacaccgagcucucccagaacuucucccccaaguccguccucauccgccagcagauccucccccgcgagaagaccccccccaagugcgagauccagggcaacucccucaagcagaacucccagcuccucaaccagcccaagaucaccgccgacaagcgcuacaagugcucccucugcgagaagaccuucaucaacaccuccucccuccgcaagcacgagaagaaccacuccggcgagaagcucuucaagugcaaggagugcuccaaggccuucucccaguccuccgcccucauccagcaccagaucacccacaccggcgagaagcccuacaucugcaaggagugcggcaaggccuucacccucuccaccucccucuacaagcaccuccgcacccacaccgucgagaaguccuaccgcugcaaggagugcggcaaguccuucucccgccgcuccggccucuucauccaccagaagauccacgccgaggagaaccccugcaaguacaaccccggccgcaaggccuccuccugcuccaccucccucuccggcugccagcgcauccacucccgcaagaaguccuaccucugcaacgagugcggcaacaccuucaaguccuccuccucccuccgcuaccaccagcgcauccacaccggcgagaagcccuucaagugcuccgagugcggccgcgccuucucccaguccgccucccucauccagcacgagcgcauccacaccggcgagaagcccuaccgcugcaacgagugcggcaagggcuucaccuccaucucccgccucaaccgccaccgcaucauccacaccggcgagaaguucuacaacugcaacgagugcggcaaggcccucuccucccacuccacccucaucauccacgagcgcauccacaccggcgagaagcccugcaagugcaaggucugcggcaaggccuuccgccaguccuccgcccucauccagcaccagcgcaugcacaccggcgagcgccccuacaagugcaacgagugcggcaagaccuuccgcugcaacuccucccucuccaaccaccagcgcauccacaccggcgagaagcccuaccgcugcgaggagugcggcaucuccuucggccaguccuccgcccucauccagcaccgccgcauccacaccggcgagaagcccuucaagugcaacaccugcggcaagaccuuccgccaguccuccucccgcaucgcccaccagcgcauccacaccggcgagaagcccuacgagugcaacaccugcggcaagcucuucaaccaccgcuccucccucaccaaccacuacaagauccacaucgaggaggaccccuga

SEQ ID NO: 52091 - RNA, 1584 nt, Artificial Sequence
  derived and/or modified sequence opt2 from ZNF35__Homo_sapiens__NP_003411
augaccgccgagcuccgcgaggccauggcccucgcccccuggggccccgucaaggucaagaaggaggaggaggaggaggagaacuuccccggccaggccuccucccagcagguccacuccgagaacaucaaggucugggcccccguccagggccuccagaccggccucgacggcuccgaggaggaggagaagggccagaacaucuccugggacauggccgucguccucaaggccacccaggaggcccccgccgccuccacccucggcuccuacucccuccccggcacccucgccaaguccgagauccucgagacccacggcaccaugaacuuccucggcgccgagaccaagaaccuccagcuccucguccccaagaccgagaucugcgaggaggccgagaagccccucaucaucuccgagcgcauccagaaggccgacccccagggccccgagcucggcgaggccugcgagaagggcaacaugcucaagcgccagcgcaucaagcgcgagaagaaggacuuccgccaggucaucgucaacgacugccaccuccccgaguccuucaaggaggaggagaaccagaagugcaagaaguccggcggcaaguacucccucaacuccggcgccgucaagaaccccaagacccagcucggccagaagcccuucaccugcuccgucugcggcaagggcuucucccaguccgccaaccucgucguccaccagcgcauccacaccggcgagaagcccuucgagugccacgagugcggcaaggccuucauccaguccgccaaccucgucguccaccagcgcauccacaccggccagaagcccuacgucugcuccaagugcggcaaggccuucacccaguccuccaaccucaccguccaccagaagauccacucccucgagaagaccuucaagugcaacgagugcgagaaggccuucuccuacuccucccagcucgcccgccaccagaagguccacaucaccgagaagugcuacgagugcaacgagugcggcaagaccuucacccgcuccuccaaccucaucguccaccagcgcauccacaccggcgagaagcccuucgccugcaacgacugcggcaaggccuucacccaguccgccaaccucaucguccaccagcgcucccacaccggcgagaagcccuacgagugcaaggagugcggcaaggccuucuccugcuucucccaccucaucguccaccagcgcauccacaccgccgagaagcccuacgacugcuccgagugcggcaaggccuucucccagcucuccugccucaucguccaccagcgcauccacuccggcgaccuccccuacgucugcaacgagugcggcaaggccuucaccugcuccuccuaccuccucauccaccagcgcauccacaacggcgagaagcccuacaccugcaacgagugcggcaaggccuuccgccagcgcuccucccucaccguccaccagcgcacccacaccggcgagaagcccuacgagugcgagaagugcggcgccgccuucaucuccaacucccaccucaugcgccaccaccgcacccaccucgucgaguga

SEQ ID NO: 52092 - RNA, 1224 nt, Artificial Sequence
  derived and/or modified sequence opt2 from ZNF365__Homo_sapiens__NP_055766
augcagcagaaggccuucgaggagucccgcuaccccuggcaggaguccuucgagaacgucgccgucugccucccccuccgcugcccccgcugcggcgaccacacccgcuuccgcucccucuccucccuccgcgcccaccucgaguucucccacuccuacgaggagcgcacccuccucaccaagugcucccucuuccccucccucaaggacaccgaccucgucaccuccuccgagcuccucaagcccggcaagcuccaguccuccggcaacgucgucaagcagaagcccuccuacgucaaccucuacuccaucucccacgagcacuccaaggaccgcaagcccuucgaggucgucgccgagcgccccgucuccuacguccagaccuacaccgccauggaccuccacgccgacucccucgacggcacccgcuccggccccggccuccccaccuccgacaccaaggccuccuucgaggcccacguccgcgagaaguucaaccgcauggucgaggccgucgaccgcaccaucgagaagcgcaucgacaagcucaccaaggagcucgcccagaagaccgccgagcuccucgagguccgcgccgccuucguccagcucacccagaagaagcaggagguccagcgccgcgagcgcgcccucaaccgccaggucgacgucgccgucgagaugaucgccguccuccgccagcgccucaccgaguccgaggaggagcuccuccgcaaggaggaggaggucgucaccuucaaccacuuccucgaggccgccgccgagaaggagguccagggcaaggcccgccuccaggacuucaucgagaaccuccuccagcgcgucgagcucgccgagaagcagcucgaguacuaccagucccagcaggccuccggcuucguccgcgaccucuccggccacguccucaccgacaucuccuccaaccgcaagcccaagugccucucccgcggccacccccacuccgucugcaaccaccccgaccucaaggcccacuuccaccccaagggccgcaaccaccucaagaaggccaaggacgaccgcgccuccaugcagcccgccaaggccauccacgagcaggccgaguccucccgcgaccucugccgcccccccaagaagggcgagcuccucggcuucggccgcaagggcaacauccgccccaagauggccaagaagaagcccaccgccaucgucaacaucaucuga

SEQ ID NO: 52093 - RNA, 2235 nt, Artificial Sequence
  derived and/or modified sequence opt2 from ZNF366__Homo_sapiens__NP_689838
augcagaaggagaugaagaugaucaaggacgaggacguccacuucgaccucgccgucaagaagacccccuccuucccccacugccuccagcccgucgccucccgcggcaaggccccccagcgccaccccuuccccgaggcccuccgcggccccuucucccaguuccgcuacgagcccccccccggcgaccucgacggcuuccccggcgucuucgagggcgccggcucccgcaagcgcaaguccaugcccaccaagaugcccuacaaccaccccgccgaggaggucacccucgcccuccacuccgaggagaacaagaaccacggccuccccaaccucccccuccucuucccccagcccccccgccccaaguacgacucccagaugaucgaccucugcaacgucggcuuccaguucuaccgcucccucgagcacuucggcggcaagcccgucaagcaggagcccaucaagcccuccgccgucuggccccagcccacccccacccccuuccuccccacccccuaccccuacuaccccaagguccaccccggccucauguuccccuucuucguccccuccuccucccccuuccccuucucccgccacaccuuccuccccaagcagccccccgagccccuccucccccgcaaggccgagccccaggaguccgaggagaccaagcagaaggucgagcgcgucgacgucaacguccagaucgacgacuccuacuacgucgacgucggcggcucccagaagcgcuggcagugccccaccugcgagaaguccuacaccuccaaguacaaccucgucacccacauccucggccacuccggcaucaagccccacgccugcacccacugcggcaagcucuucaagcagcucucccaccuccacacccacaugcucacccaccagggcacccgcccccacaagugccaggucugccacaaggccuucacccagaccucccaccucaagcgccacaugaugcagcacuccgaggucaagccccacaacugccgcgucugcggccgcggcuucgccuaccccuccgagcucaaggcccacgaggccaagcacgccuccggccgcgagaacaucugcgucgagugcggccucgacuuccccacccucgcccagcucaagcgccaccucaccacccaccgcggccccauccaguacaacugcuccgagugcgacaagaccuuccaguaccccucccagcuccagaaccacaugaugaagcacaaggacauccgccccuacaucugcuccgagugcggcauggaguucguccagccccaccaccucaagcagcacucccucacccacaagggcgucaaggagcacaagugcggcaucugcggccgcgaguucacccuccucgccaacaugaagcgccacguccucauccacaccaacauccgcgccuaccagugccaccucugcuacaaguccuucguccagaagcagacccucaaggcccacaugaucguccacuccgacgucaagcccuucaagugcaagcucugcggcaaggaguucaaccgcaugcacaaccucaugggccacaugcaccuccacuccgacuccaagcccuucaagugccucuacugccccuccaaguucacccucaagggcaaccucacccgccacaugaaggucaagcacggcgucauggagcgcggccuccacucccagggccucggccgcggccgcaucgcccucgcccagaccgccggcguccuccgcucccucgagcaggaggagcccuucgaccucucccagaagcgccgcgccaagguccccgucuuccaguccgacggcgaguccgcccagggcucccacugccacgaggaggaggaggaggacaacugcuacgaggucgagcccuacucccccggccucgccccccagucccagcagcucugcacccccgaggaccucuccaccaaguccgagcacgcccccgagguccucgaggaggccugcaaggaggagaaggaggacgccuccaagggcgagugggagaagcgcuccaagggcgaccucggcgccgagggcggccaggagcgcgacugcgccggccgcgacgagugccucucccuccgcgccuuccaguccacccgccgcggccccuccuucuccgacuaccucuacuucaagcaccgcgacgagucccucaaggagcuccucgagcgcaagauggagaagcaggccguccuccucggcaucuga

SEQ ID NO: 52094 - RNA, 1053 nt, Artificial Sequence
  derived and/or modified sequence opt2 from ZNF367__Homo_sapiens__NP_710162
augauccgcggcuucgaggcccccauggccgagaaccccccccccccccccccccccgucaucuucugccacgacucccccaagcgcguccucgucuccgucauccgcaccacccccaucaagcccaccugcggcggcggcggcgagcccgagcccccccccccccucauccccaccucccccggcuucuccgacuucauggucuaccccuggcgcuggggcgagaacgcccacaacgucacccucucccccggcgccgccggcgccgccgccuccgccgcccuccccgccgccgccgccgccgagcacuccggccuccgcggccgcggcgcccccccccccgccgccuccgccuccgccgccgccuccggcggcgaggacgaggaggaggccuccucccccgacuccggccaccucaaggacggcauccgccgcggccgcccccgcgccgacaccguccgcgaccucaucaacgagggcgagcacuccuccucccgcauccgcugcaacaucugcaaccgcgucuucccccgcgagaagucccuccaggcccacaagcgcacccacaccggcgagcgccccuaccucugcgacuaccccgacugcggcaaggccuucguccaguccggccagcucaagacccaccagcgccuccacaccggcgagaagcccuucgucugcuccgagaacggcugccucucccgcuucacccacgccaaccgccacugccccaagcaccccuacgcccgccucaagcgcgaggagcccaccgacacccucuccaagcaccaggccgccgacaacaaggccgccgccgaguggcucgcccgcuacugggagaugcgcgagcagcgcacccccacccucaagggcaagcucguccagaaggccgaccaggagcagcaggacccccucgaguaccuccaguccgacgaggaggacgacgagaagcgcggcgcccagcgccgccuccaggagcagcgcgagcgccuccacggcgcccucgcccucaucgagcucgccaaccucaccggcgccccccuccgccaguga

SEQ ID NO: 52095 - RNA, 1650 nt, Artificial Sequence
  derived and/or modified sequence opt2 from ZNF382__Homo_sapiens__NP_001243767
augucccagggcuccgucuccuucaaggacgucaccgucgacuucacccaggaggaguggcagcagcucgaccccgcccagaaggcccucuaccgcgacgucaugcucgagaacuacugccacuucgucuccgucggcuuccacauggccaagcccgacaugauccgcaagcucgagcagggcgaggagcucuggacccagcgcaucuuccccuccuacuccuaccucgaggaggacggcaagaccgaggacguccucgucaaguucaaggaguaccaggaccgccacucccgcccccucaucuucaucaaccacaagaagcucaucaaggagcgcuccaacaucuacggcaagaccuucacccucggcaagaaccgcaucuccaagaccauccucugcgaguacaagcccgacggcaagguccucaagaacaucuccgagcucgucauccgcaacaucucccccaucaaggagaaguucggcgacuccaccggcugggagaagucccuccucaacaccaagcacgagaagauccaccccgccgucaaccuccacaagcagaccgagcgcguccucuccggcaagcaggagcucauccagcaccagaagguccaggcccccgagcagcccuucgaccacaacgagugcgagaaguccuuccucaugaagggcaugcucuucacccacacccgcgcccaccgcggcgagcgcaccuucgaguacaacaaggacggcaucgccuucaucgagaaguccucccucuccguccaccccuccaaccucauggagaagaagcccuccgccuacaacaaguacggcaaguuccucugccgcaagcccgucuucaucaugccccagcgcccccagaccgaggagaagcccuuccacugccccuacugcggcaacaacuuccgccgcaaguccuaccucaucgagcaccagcgcauccacaccggcgagaagcccuacgucugcaaccagugcggcaaggccuuccgccagaagaccgcccucacccuccacgagaagacccacaucgagggcaagcccuucaucugcaucgacugcggcaaguccuuccgccagaaggccacccucacccgccaccacaagacccacaccggcgagaaggccuacgagugcccccagugcggcuccgccuuccgcaagaaguccuaccucaucgaccaccagcgcacccacaccggcgagaagcccuaccagugcaacgagugcggcaaggccuucauccagaagaccacccucaccguccaccagcgcacccacaccggcgagaagcccuacaucugcaacgagugcggcaaguccuucugccagaagaccacccucacccuccaccagcgcauccacaccggcgagaagcccuacaucugcaacgagugcggcaaguccuuccgccagaaggccauccucaccguccaccaccgcauccacaccggcgagaaguccaacggcugcccccagugcggcaaggccuucucccgcaaguccaaccucauccgccaccagaagacccacaccggcgagaagcccuacgagugcaagcagugcggcaaguucuucuccugcaaguccaaccucaucguccaccagaagacccacaaggucgagaccaccggcauccaguga

SEQ ID NO: 52096 - RNA, 1428 nt, Artificial Sequence
  derived and/or modified sequence opt2 from ZNF383__Homo_sapiens__XP_011524892
auggccgagggcuccgucauguucuccgacgucuccaucgacuucucccaggaggagugggacugccucgaccccguccagcgcgaccucuaccgcgacgucaugcucgagaacuacggcaaccucgucuccaugggccucuacacccccaagccccaggucaucucccuccucgagcagggcaaggagcccuggauggucggccgcgagcucacccgcggccucugcuccgaccucgaguccaugugcgagaccaagcuccucucccucaagaaggaggucuacgagaucgagcucugccagcgcgagaucaugggccucaccaagcacggccucgaguacuccuccuucggcgacguccucgaguaccgcucccaccucgccaagcagcucggcuaccccaacggccacuucucccaggagaucuucacccccgaguacaugcccaccuucauccagcagaccuuccucacccuccaccagaucaucaacaacgaggaccgccccuacgagugcaagaagugcggcaaggccuucucccagaacucccaguucauccagcaccagcgcauccacaucggcgagaaguccuacgagugcaaggagugcggcaaguucuucuccugcggcucccacgucacccgccaccucaagauccacaccggcgagaagcccuucgagugcaaggagugcggcaaggccuucuccugcuccuccuaccucucccagcaccagcgcauccacaccggcaagaagcccuacgagugcaaggagugcggcaaggccuucuccuacugcuccaaccucaucgaccaccagcgcauccacaccggcgagaagcccuacgagugcaaggucugcggcaaggccuucaccaaguccucccagcucuuccagcacgcccgcauccacaccggcgagaagcccuacgagugcaaggagugcggcaaggccuucacccaguccuccaagcucguccagcaccagcgcauccacaccggcgagaagcccuacgagugcaaggagugcggcaaggccuucuccuccggcuccgcccucaccaaccaccagcgcauccacaccggcgagaagcccuacgacugcaaggagugcggcaaggccuucacccaguccucccagcuccgccagcaccagcgcauccacgccggcgagaagcccuucgagugccucgagugcggcaaggccuucacccagaacucccagcucuuccagcaccagcgcauccacaccgacgagaagcccuacgagugcaacgagugcggcaaggccuucaacaagugcuccaaccucacccgccaccuccgcauccacaccggcgagaagcccuacaacugcaaggagugcggcaaggccuucuccuccggcuccgaccucauccgccaccagggcauccacaccaacaaguga

SEQ ID NO: 52097 - RNA, 1386 nt, Artificial Sequence
  derived and/or modified sequence opt2 from ZNF384__Homo_sapiens__NP_001035009
auggaggagucccacuucaacuccaaccccuacuucuggcccuccauccccaccgucuccggccagaucgagaacaccauguucaucaacaagaugaaggaccagcuccuccccgagaagggcugcggccucgcccccccccacuaccccacccuccucaccguccccgccuccgucucccuccccuccggcaucuccauggacaccgaguccaaguccgaccagcucaccccccacucccaggccuccgucacccagaacaucaccgucguccccguccccuccaccggccucaugaccgccgcccuccaggucguccccgaccucuccaagaaggucgccuccacccucaccgaggagggcggcggcggcggcggcggcggcggcuccgucgcccccaagcccccccgcggccgcaagaagaagcgcaugcucgaguccggccuccccgagaugaacgaccccuacguccucucccccgaggacgacgacgaccaccagaaggacggcaagaccuaccgcugccgcaugugcucccucaccuucuacuccaaguccgagaugcagauccacuccaagucccacaccgagaccaagccccacaagugcccccacugcuccaagaccuucgccaacuccuccuaccucgcccagcacauccgcauccacuccggcgccaagcccuacuccugcaacuucugcgagaaguccuuccgccagcucucccaccuccagcagcacacccgcauccacaccggcgaccgccccuacaagugcgcccaccccggcugcgagaaggccuucacccagcucuccaaccuccagucccaccgccgccagcacaacaaggacaagcccuucaagugccacaacugccaccgcgccuacaccgacgccgccucccucgagguccaccucuccacccacaccgucaagcacgccaaggucuacaccugcaccaucugcucccgcgccuacaccuccgagaccuaccucaugaagcacaugcgcaagcacaacccccccgaccuccagcagcagguccaggccgccgccgccgccgccgccgucgcccaggcccaggcccaggcccaggcccaggcccaggcccaggcccaggcccaggcccaggcccaggccucccaggccucccagcagcagcagcagcagcagcagcagcagcagcagcagcagcagcagccccccccccacuuccagucccccggcgccgccccccagggcggcggcggcggcgacuccaaccccaacccccccccccagugcuccuucgaccucacccccuacaagaccgccgagcaccacaaggacaucugccucaccgucaccaccuccaccauccaggucgagcaccucgccuccuccuga

SEQ ID NO: 52098 - RNA, 1161 nt, Artificial Sequence
  derived and/or modified sequence opt2 from ZNF385A__Homo_sapiens__NP_001124439
augauccucggcucccucucccgcgccggcccccucccccuccuccgccagccccccaucaugcagcccccccucgaccucaagcagauccuccccuucccccucgagcccgcccccacccucggccucuucuccaacuacuccaccauggaccccguccagaaggccguccucucccacaccuucggcggcccccuccucaagaccaagcgccccgucaucuccugcaacaucugccagauccgcuucaacucccagucccaggccgaggcccacuacaagggcaaccgccacgcccgccgcgucaagggcaucgaggccgccaagacccgcggccgcgagcccggcguccgcgagcccggcgaccccgccccccccggcuccacccccaccaacggcgacggcgucgccccccgccccgucuccauggagaacggccucggccccgcccccggcucccccgagaagcagcccggcucccccuccccccccuccauccccgagaccggccagggcgucaccaagggcgagggcggcacccccgcccccgccucccuccccggcggcuccaaggaggaggaggagaaggccaagcgccuccucuacugcgcccucugcaaggucgccgucaacucccucucccagcucgaggcccacaacaagggcaccaagcacaagaccauccucgaggcccgcuccggccucggccccaucaaggccuacccccgccucggcccccccacccccggcgagcccgaggcccccgcccaggaccgcaccuuccacugcgagaucugcaacgucaaggucaacuccgagguccagcucaagcagcacaucuccucccgccgccaccgcgacggcgucgccggcaagcccaacccccuccucucccgccacaagaagucccgcggcgccggcgagcucgccggcacccucaccuucuccaaggagcuccccaagucccucgccggcggccuccuccccuccccccucgccgucgccgccgucauggccgccgccgccggcuccccccucucccuccgccccgcccccgccgccccccuccuccagggcccccccaucacccacccccuccuccaccccgcccccggccccauccgcaccgcccacggccccauccucuucucccccuacuga

SEQ ID NO: 52099 - RNA, 1188 nt, Artificial Sequence
  derived and/or modified sequence opt2 from ZNF385B__Homo_sapiens__NP_001106868
augugguccggccuccccucccgcggcuccaccugccacaccaccacccuccccgcccucguccgcacccccacccucaugaugcagcccucccucgacaucaagcccuucauguccuuccccgucgacuccuccuccgccgucggccucuuccccaacuucaacaccauggaccccguccagaaggccgucaucaaccacaccuucggcgucuccaucccccccaagaagaagcaggucaucuccugcaacgucugccagcuccgcuucaacuccgacucccaggccgaggcccacuacaagggcuccaagcacgccaagaaggucaaggcccucgacgccaccaagaacaagcccaagaugguccccuccaaggacuccgccaaggccaaccccuccugcuccaucacccccaucaccggcaacaacuccgacaaguccgaggacaagggcaagcucaaggccuccuccuccucccagcccuccuccuccgaguccggcuccuuccuccucaaguccggcaccaccccccucccccccggcgccgccaccucccccuccaaguccaccaacggcgcccccggcaccgucgucgaguccgaggaggagaaggccaagaagcuccucuacugcucccucugcaaggucgccgucaacucccucucccagcucgaggcccacaacaccggcuccaagcacaagaccauggucgaggcccgcaacggcgccggccccaucaaguccuacccccgccccggcucccgccucaagaugcagaacggcuccaagggcuccggccuccagaacaagaccuuccacugcgagaucugcgacguccacgucaacuccgagauccagcucaagcagcacaucuccucccgccgccacaaggaccgcgucgccggcaagccccucaagcccaaguacucccccuacaacaagcuccagcgcucccccuccauccucgccgccaagcucgccuuccagaaggacaugaugaagccccucgcccccgccuuccucuccuccccccucgccgccgccgccgccgucuccuccgcccucucccuccccccccgccccuccgccucccucuuccaggcccccgccaucccccccgcccuccuccgccccggccacggccccauccgcgccacccccgccuccauccucuucgcccccuacuga

SEQ ID NO: 52100 - RNA, 1188 nt, Artificial Sequence
  derived and/or modified sequence opt2 from ZNF385D__Homo_sapiens__NP_078973
augcgcaacaucauguacuucggcggcaccugccagucccccgcccuccccgcccucguccgcccccccgcccccccccuccagcccucccucgacaucaagcccuuccuccccuucccccucgacaccgccgccgccgucaaccucuuccccaacuucaacgccauggaccccauccagaaggccgucaucaaccacaccuucggcgucccccucccccaccgccgcaagcagaucaucuccugcaacaucugccagcuccgcuucaacuccgacucccaggccgccgcccacuacaagggcaccaagcacgccaagaagcucaaggcccucgaggccaugaagaacaagcagaaguccgucaccgccaaggacuccgccaagaccaccuucaccuccaucaccaccaacaccaucaacaccuccuccgacaagaccgacggcaccgccggcacccccgccaucuccaccaccaccaccgucgagauccgcaaguccuccgucaugaccaccgagaucaccuccaaggucgagaagucccccaccaccgccaccggcaacuccuccugccccuccaccgagaccgaggaggagaaggccaagcgccuccucuacugcucccucugcaaggucgccgucaacuccgccucccagcucgaggcccacaacuccggcaccaagcacaagaccaugcucgaggcccgcaacggcuccggcaccaucaaggccuucccccgcgccggcgucaagggcaagggccccgucaacaagggcaacaccggccuccagaacaagaccuuccacugcgagaucugcgacguccacgucaacuccgagacccagcucaagcagcacaucuccucccgccgccacaaggaccgcgccgccggcaagccccccaagcccaaguacucccccuacaacaagcuccagaagaccgcccacccccucggcgucaagcucgucuucuccaaggagcccuccaagccccucgccccccgcauccuccccaacccccucgccgccgccgccgccgccgccgccgucgccgucuccucccccuucucccuccgcaccgcccccgccgccacccucuuccagaccuccgcccucccccccgcccuccuccgccccgcccccggccccauccgcaccgcccacacccccguccucuucgcccccuacuga

SEQ ID NO: 52101 - RNA, 1077 nt, Artificial Sequence
  derived and/or modified sequence opt2 from ZNF391__Homo_sapiens__XP_011512871
auggagucccuccgcggcaacaccgcccagggccccaccaacgaggaggacuacaagaacgagggccagcucucccgccagaccaagugccccgcccagaagaaguccuccuucgagaacaccgucguccgcaaggucuccgucacccucaaggagaucuucaccggcgaggagggccccgaguccuccgaguucucccucucccccaaccucgacgcccagcagaagauccccaagggccacggcucccccaucucccgcaagaacuccaaggacaacuccgaccucaucaagcaccagcgccucuucucccagcgcaagcccugcaagugcaacgagugcgagaaggccuucuccuaccaguccgaccuccucguccacucccgcauccacggcggcgagaagcccuucgagugcaacaagugcggcaaguccuucucccgcuccacccaccucaucgagcaccagcgcacccacaccggcgagaagcccuacgagugcaacgagugcggcaaggccuucucccgcuccacccaccucucccuccaccagcgcauccacaccggcgagaagcccuacgagugcuccgagugcggcaaggccuucucccgcuccaccaaccucucccagcaccagcgcacccacacccaggagcgccccuacaagugcaacgagugcggcaaggccuucggcgaccgcuccaccaucauccagcaccagcgcauccacaccggcgagaaccccuacgagugcuccaagugcggcaaggccuucuccuggaucuccucccucaccgagcaccagcgcacccacaccggcgagaaccccuacgagugcuccgagugcggcaaggucuucucccgcuccuccucccucaccgagcaccagcgcauccacuccggcgagaagccccacgagugccgcgucugcggcaagggcuucucccgcuccuccucccucaucauccaccagcgcacccacaccggcgagaagcccuacaagugcaacgacugcggcaaggccuucugccaguccuccacccucauccgccaccagcaccuccacaccaaggaguga

SEQ ID NO: 52102 - RNA, 1542 nt, Artificial Sequence
  derived and/or modified sequence opt2 from ZNF395__Homo_sapiens__NP_061130
auggccuccguccucucccgccgccucggcaagcgcucccuccucggcgcccgcguccucggccccuccgccuccgagggccccuccgccgccccccccuccgagccccuccucgagggcgccgccccccagcccuucaccaccuccgacgacacccccugccaggagcagcccaaggagguccucaaggcccccuccaccuccggccuccagcaggucgccuuccagcccggccagaaggucuacgucugguacggcggccaggagugcaccggccucgucgagcagcacuccuggauggagggccaggucaccgucuggcuccucgagcagaagcuccaggucugcugccgcgucgaggaggucuggcucgccgagcuccagggccccugcccccaggcccccccccucgagcccggcgcccaggcccucgccuaccgccccgucucccgcaacaucgacguccccaagcgcaaguccgacgccgucgagauggacgagaugauggccgccaugguccucaccucccucuccugcucccccgucguccaguccccccccggcaccgaggccaacuucuccgccucccgcgccgccugcgaccccuggaaggaguccggcgacaucuccgacuccggcuccuccaccaccuccggccacugguccggcuccuccggcgucuccacccccucccccccccacccccaggccucccccaaguaccucggcgacgccuucggcuccccccagaccgaccacggcuucgagaccgaccccgaccccuuccuccucgacgagcccgccccccgcaagcgcaagaacuccgucaaggucauguacaagugccucuggcccaacugcggcaagguccuccgcuccaucgucggcaucaagcgccacgucaaggcccuccaccucggcgacaccgucgacuccgaccaguucaagcgcgaggaggacuucuacuacaccgagguccagcucaaggaggaguccgccgccgccgccgccgccgccgccgccggcacccccguccccggcacccccaccuccgagcccgcccccacccccuccaugaccggccucccccucuccgcccucccccccccccuccacaaggcccaguccuccggccccgagcaccccggccccgaguccucccuccccuccggcgcccucuccaaguccgcccccggcuccuucuggcacauccaggccgaccacgccuaccaggcccuccccuccuuccagauccccgucuccccccacaucuacaccuccgucuccugggccgccgcccccuccgccgccugcucccucucccccguccgcucccgcucccucuccuucuccgagccccagcagcccgcccccgccaugaagucccaccucaucgucaccucccccccccgcgcccaguccggcgcccgcaaggcccgcggcgaggccaagaagugccgcaaggucuacggcaucgagcaccgcgaccaguggugcaccgccugccgcuggaagaaggccugccagcgcuuccucgacuga

SEQ ID NO: 52103 - RNA, 1416 nt, Artificial Sequence
  derived and/or modified sequence opt2 from ZNF398__Homo_sapiens__NP_065832
augaagggcaacuacgagucccucaucuccauggacuacgccaucaaccagcccgacguccucucccagauccagcccgagggcgagcacaacaccgaggaccaggccggccccgaggaguccgagauccccaccgaccccuccgaggagcccggcaucuccaccuccgacauccucuccuggaucaagcaggaggaggagccccaggucggcgccccccccgaguccaaggaguccgacgucuacaaguccaccuacgccgacgaggagcucgucaucaaggccgagggccucgcccgcuccucccucugccccgagguccccguccccuucuccuccccccccgccgccgccaaggacgccuucuccgacgucgccuucaagucccagcaguccaccuccaugacccccuucggccgccccgccaccgaccuccccgaggccuccgagggccaggucaccuucacccagcucggcuccuacccccuccccccccccgucggcgagcaggucuucuccugccaccacugcggcaagaaccucucccaggacaugcuccucacccaccagugcucccacgccaccgagcacccccuccccugcgcccagugccccaagcacuucaccccccaggccgaccucuccuccaccucccaggaccacgccuccgagaccccccccaccugcccccacugcgcccgcaccuucacccaccccucccgccucaccuaccaccuccgcguccacaacuccaccgagcgccccuuccccugccccgacugccccaagcgcuucgccgaccaggcccgccucaccucccaccgccgcgcccacgccuccgagcgccccuuccgcugcgcccagugcggccgcuccuucucccucaagaucucccuccuccuccaccagcgcggccacgcccaggagcgccccuucuccugcccccagugcggcaucgacuucaacggccacuccgcccucauccgccaccagaugauccacaccggcgagcgccccuaccccugcaccgacugcuccaaguccuucaugcgcaaggagcaccuccucaaccaccgccgccuccacaccggcgagcgccccuucuccugcccccacugcggcaaguccuucauccgcaagcaccaccucaugaagcaccagcgcauccacaccggcgagcgccccuaccccugcuccuacugcggccgcuccuuccgcuacaagcagacccucaaggaccaccuccgcuccggccacaacggcggcugcggcggcgacuccgaccccuccggccagccccccaacccccccggcccccucaucaccggccucgagaccuccggccucggcgucaacaccgagggccucgagaccaaccagugguacggcgagggcuccggcggcggcguccucuga

SEQ ID NO: 52104 - RNA, 5448 nt, Artificial Sequence
  derived and/or modified sequence opt2 from ZNF407__Homo_sapiens__NP_001139661
augauggacuccgagaacaagcccgagaacgacgaggacgagaagaucaacaaggaggcccaggaccucaccaagcucuccucccacaacgaggacggcggccccgucuccgacgucaucgccuccuuccccgagaacuccaugggcaagcgcggcuucuccgaguccuccaacuccgacuccgucgucaucggcgaggaccgcaacaagcacgccuccaagcgccgcaagcucgacgaggccgagccccucaaguccggcaagcagggcaucugccgccucgagaccuccgaguccuccgucaccgagggcggcaucgcccucgacgagaccggcaaggagaccuuccucuccgacugcaccgucggcggcaccugccuccccaacgcccucucccccuccugcaacuucuccaccaucgacgucgucucccucaagaccgacaccgagaagaccuccgcccaggagauggucucccucgaccucgagcgcgagucccccuucccccccaaggagaucuccgucuccugcaccaucggcaacgucgacaccguccucaagugcuccaucugcggccaccucuucuccuccugcuccgaccucgagaagcacgccgagucccacaugcagcagcccaaggagcacaccugcugccacugcucccacaaggccgaguccuccuccgcccuccacaugcacaucaagcaggcccacggcccccagaaggucuucuccugcgaccucugcggcuuccagugcuccgaggagaaccuccucaacgcccacuaccucggcaagacccaccuccgccgccagaaccucgccgcccgcggcggcuucguccagauccucaccaagcagcccuuccccaagaagucccgcaccauggccaccaagaacguccacuccaagccccgcaccuccaaguccaucgccaagaacuccgacuccaagggccuccgcaacgucggcuccaccuucaaggacuuccgcggcuccaucuccaagcaguccggcuccuccuccgagcuccucgucgagaugaugcccucccgcaacacccucucccaggaggucgagaucgucgaggagcacgucaccucccucggccucgcccagaaccccgagaaccagucccgcaagcucgacacccucgucaccuccgagggccuccucgagaagcucgaguccaccaagaacacccuccaggccgcccacggcaacuccgucaccucccgcccccgccccgagcgcaacauccucguccucggcaacuccuuccgccgccgcuccuccaccuucacccucaagggccaggccaagaagcgcuucaaccuccucggcaucaagcgcggcaccuccgagacccagcgcauguacaugaagcaccuccgcacccagaugaagacccacgacgccgaguccguccucaagcaccucgaggccugcuccuccguccagcgcgucugcgucaccaccuccgagacccaggaggccgagcagggccagggcuccgcccgcccccccgacuccggccuccacucccucaccgucaagcccgccuccggcucccagacccucugcgccugcaccgacugcggccaggucgccaccaaccgcaccgaccucgagauccacgucaagcgcugccacgcccgcgagaugaaguucuacugccgcaccugcgacuucuccuccaugucccgccgcgaccucgacgagcaccuccacuccaaccagcaccagcagaccgccuccguccucuccugccagugcugcuccuucaucucccucgacgagaucaaccuccgcgaccacaugaaggagaagcacaacaugcacuuccucugcacccccugcaaccucuucuuccucuccgagaaggacgucgaggagcacaaggccaccgagaagcacaucaacucccucguccagcccaagacccuccaguccuccaacuccgaccucguccuccagacccucccccucuccacccucgaguccgagaacgccaaggaguccauggacgacuccggcaaggccucccaggaggagccccucaagucccgcgucucccacggcaacgagguccgccacuccuccaagccccaguuccagugcaagaagugcuucuacaagacccgcuccuccaccguccucacccgccacaucaagcuccgccacggccaggacuaccacuuccucugcaaggccugcaaccucuacucccucuccaaggagggcauggagaagcacaucaagcgcuccaagcaccucgagaacgccaagaagaacaacaucggccucuccuucgaggagugcaucgagcgcgucugcaucggcgccaacgacaagaaggaggaguucgacgucuccggcaacggccgcaucgagggccacaucggcguccagcuccaggagcacuccuaccucgagaagggcaugcucgccuccgaggagcucucccaguccggcggcuccaccaaggacgacgagcucgccuccaccaccacccccaagcgcggccgccccaagggcaacaucucccgcaccugcucccacugcggccuccucgccuccuccaucaccaaccucaccguccacauccgccgcaagcacucccaccaguacuccuaccucugcaaggucugcaaguacuacaccgucaccaagggcgacauggagcgccacugcgccaccaagaagcacaagggccgcgucgagaucgaggccuccggcaagcacuccuccgacaucaucgucggccccgagggcggcucccucgaggccggcaagaagaacgccggcuccgccgucaccauguccgacgagcacgccaacaagcccgccgagucccccaccuccguccucgagaagcccgaccgcggcaacuccaucgaggccgaggucgagaacgucuuccacucccucgacggcgaggucaacucccaccuccucgacaagaaggagcagaucuccuccgagcccgaggacuucgcccagcccggcgacgucuacucccagcgcgacgucaccggcaccggcgagaacaagugccuccacugcgaguucuccgcccacuccuccgccucccucgagcuccacgucaagcgcaagcacaccaaggaguucgaguucuacugcauggccugcgacuacuacgccgucacccgccgcgagaugacccgccacgccgccaccgagaagcacaagaugaagcgccaguccuaccucaacuccgccaacgucgaggccggcuccgccgacauguccaagaacaucaucaugcccgaggaggagcaccagcagaacuccgaggaguuccagaucaucuccggccagcccuccgacacccucaagucccgcaacgccgccgacugcuccauccucaacgagaacaccaaccucgacauguccaagguccucugcgccgccgacuccgucgaggucgagaccgaggaggaguccaacuucaacgaggaccacuccuucugcgagaccuuccagcaggcccccgucaaggacaagguccgcaagcccgaggagaugaugucccucaccauguccuccaacuacggcucccccucccgcuuccagaacgagaacuccggcuccuccgcccucaacugcgagaccgccaagaagaaccacgagaucuccaacgacgccggcgagcuccgcguccacugcgagggcgagggcggcaacgccggcgacggcggcggcgucgucccccaccgccaccucugccccgucacccucgacggcgagcgcuccgccgagucccccguccucgucgucacccgcaucacccgcgagcagggcaaccucgaguccggcggccagaaccgcgucgcccgcggccacggccucgaggaccucaagggcguccaggaggaccccguccucggcaacaaggagauccucaugaacucccagcacgagaccgaguucauccucgaggaggacggccccgccuccgacuccaccgucgaguccuccgacgucuacgagaccaucaucuccaucgacgacaagggccaggccauguacuccuucggccgcuucgacuccuccaucauccgcaucaagaaccccgaggacggcgagcucaucgaccaguccgaggagggccucaucgccaccggcguccgcaucuccgagcucccccucaaggacugcgcccagggcgucaagaagaagaaguccgagggcuccuccaucggcgaguccacccgcauccgcugcgacgacugcggcuuccucgccgacggccucuccggccucaacguccacaucgccaugaagcaccccaccaaggagaagcacuuccacugccuccucugcggcaaguccuucuacaccgaguccaaccuccaccagcaccucgccuccgccggccacaugcgcaacgagcaggccuccgucgaggagcuccccgagggcggcgccaccuucaagugcgucaagugcaccgagcccuucgacuccgagcagaaccucuuccuccacaucaagggccagcacgaggagcuccuccgcgaggucaacaaguacaucgucgaggacaccgagcagaucaaccgcgagcgcgaggagaaccagggcaacgucugcaaguacugcggcaagaugugccgcuccuccaacuccauggccuuccucgcccacauccgcacccacaccggcuccaagcccuucaagugcaagaucugccacuucgccaccgcccagcucggcgacgcccgcaaccacgucaagcgccaccucggcaugcgcgaguacaagugccacgucugcggcgucgccuucgucaugaagaagcaccucaacacccaccuccucggcaagcacggcgucggcacccccaaggagcgcaaguucaccugccaccucugcgaccgcuccuucaccgagaagugggcccucaacaaccacaugaagcuccacaccggcgagaagcccuucaagugcaccuggcccaccugccacuacuccuuccucaccgccuccgccaugaaggaccacuaccgcacccacaccggcgagaaguccuuccucugcgaccucugcggcuucgccggcggcacccgccacgcccucaccaagcaccgccgccagcacaccggcgagaagcccuucaagugcgacgagugcaacuucgccuccaccacccagucccaccucacccgccacaagcgcguccacaccggcgagaagcccuaccgcugccccuggugcgacuaccgcuccaacugcgccgagaacauccgcaagcacauccuccacaccggcaagcacgagggcgucaagauguacaacugccccaagugcgacuacggcaccaacguccccgucgaguuccgcaaccaccucaaggagcagcaccccgacaucgagaaccccgaccucgccuaccuccacgccggcaagggccagaagcucuga

SEQ ID NO: 52105 - RNA, 1551 nt, Artificial Sequence
  derived and/or modified sequence opt2 from ZNF410__Homo_sapiens__NP_001229853
augcucuccgacgagcucgaguccaagcccgagcuccucguccaguucguccagaacaccuccaucccccucggccagggccucgucgaguccgaggccaaggacaucaccugccucucccuccuccccgucaccgaggccuccgagugcucccgccucaugcuccccgagcccguccccuggcgcgaggaggacggcaaguccggcugcuccgaccucaacgacaccaccaaccacuccaacuccuccaaggagguccccuccuccgccguccuccgcucccuccgcgucaacgucggccccgacggcgaggagacccgcgcccagaccguccagaagucccccgaguuccucuccaccuccgaguccuccucccuccuccaggaccuccagcccuccgacuccaccuccuucauccuccucaaccucacccgcgccggccucggcuccuccgccgagcaccucgucuucguccaggacgaggccgaggacuccggcaacgacuuccucuccuccgaguccaccgacuccuccauccccugguuccuccgcguccaggagcucgcccacgacucccucaucgccgccacccgcgcccagcucgccaagaacgccaagaccuccuccaacggcgagaacguccaccucggcuccggcgacggccaguccaaggacuccggcccccucccccaggucgagaagaagcucaagugcaccgucgagggcugcgaccgcaccuucgucuggcccgcccacuucaaguaccaccucaagacccaccgcaacgaccgcuccuucaucugccccgccgagggcugcggcaaguccuucuacguccuccagcgccucaagguccacaugcgcacccacaacggcgagaagcccuucaugugccacgaguccggcugcggcaagcaguucaccaccgccggcaaccucaagaaccaccgccgcauccacaccggcgagaagcccuuccucugcgaggcccagggcugcggccgcuccuucgccgaguacuccucccuccgcaagcaccucgucguccacuccggcgagaagccccaccagugccaggucugcggcaagaccuucucccaguccggcucccgcaacguccacaugcgcaagcaccaccuccagcucggcgccgccggcucccaggagcaggagcagaccgccgagccccucaugggcuccucccuccucgaggaggccuccguccccuccaagaaccucgucuccaugaacucccagcccucccucggcggcgagucccucaaccuccccaacaccaacuccauccucggcgucgacgacgagguccucgccgagggcuccccccgcucccucuccuccguccccgacgucacccaccaccucgucaccaugcaguccggccgccaguccuacgaggucuccguccucaccgccgucaacccccaggagucccucgccccccucccccgccucgagugcuccggcgccuucuccgcccacugcaaccucugccuccccggcuccuccgacucccccgccuccgccuccuga

SEQ ID NO: 52106 - RNA, 1668 nt, Artificial Sequence
  derived and/or modified sequence opt2 from ZNF415__Homo_sapiens__NP_001129510
auggacggcgacggccucaccuuccgcgacgucgccaucgaguucucccaggacgaguggaagugccucaacuccacccagcgcacccucuaccgcgacgucaugcucgagaacuaccgcaaccucgucucccucgaccucucccgcaacugcgucaucaaggagcucgccccccagcaggagggcaaccccggcgaggucuuccacaccgucacccucgagcagcacgagaagcacgacaucgaggaguucugcuuccgcgagaucaagaagaagauccacgacuucgacugccaguggcgcgacgacgagcgcaacugcaacaaggucaccaccgcccccaaggagaaccucaccugccgccgcgaccagcgcgaccgccgcggcaucggcaacaaguccaucaagcaccagcucggccucuccuuccucccccacccccacgagcuccagcaguuccaggccgagggcaagaucuacgagugcaaccacgucgagaaguccgucaaccacggcuccuccgucucccccccccagaucaucuccuccaccaucaagacccacgucuccaacaaguacggcaccgacuucaucugcuccucccuccucacccaggagcagaaguccugcauccgcgagaagcccuaccgcuacaucgagugcgacaaggcccucaaccacggcucccacaugaccguccgccaggucucccacuccggcgagaagggcuacaagugcgaccucugcggcaaggucuucucccagaaguccaaccucgcccgccacuggcgcguccacaccggcgagaagcccuacaagugcaacgagugcgaccgcuccuucucccgcaacuccugccucgcccuccaccgccgcguccacaccggcgagaagcccuacaagugcuacgagugcgacaaggucuucucccgcaacuccugccucgcccuccaccagaagacccacaucggcgagaagcccuacaccugcaaggagugcggcaaggccuucuccguccgcuccacccucaccaaccaccaggucauccacuccggcaagaagcccuacaagugcaacgagugcggcaaggucuucucccagaccuccucccucgccacccaccagcgcauccacaccggcgagaagcccuacaagugcaacgagugcggcaaggucuucucccagaccuccucccucgcccgccacuggcgcauccacaccggcgagaagcccuacaagugcaacgagugcggcaaggucuucuccuacaacucccaccucgccucccaccgccgcguccacaccggcgagaagcccuacaagugcaacgagugcggcaaggccuucuccguccacuccaaccucaccacccaccaggucauccacaccggcgagaagcccuacaagugcaaccagugcggcaagggcuucuccguccacuccucccucaccacccaccaggucauccacaccggcgagaagcccuacaagugcaacgagugcggcaaguccuucuccguccgccccaaccucacccgccaccagaucauccacaccggcaagaagcccuacaagugcuccgacugcggcaaguccuucuccguccgccccaaccucuuccgccaccagaucauccacaccaaggagaagcccuacaagcgcaacuga

SEQ ID NO: 52107 - RNA, 1536 nt, Artificial Sequence
  derived and/or modified sequence opt2 from ZNF419__Homo_sapiens__NP_001091961
auggccgccgccgcccuccgcgaccccgcccagguccccgucgccgccgaccuccucaccgaccacgaggagcagggcuacgucaccuucgaggacgucgccgucuacuucucccaggaggaguggcgccuccucgacgacgcccagcgccuccucuaccgcaacgucaugcucgagaacuucacccuccucgccucccucggccucgccuccuccaagacccacgagaucacccagcucgaguccugggaggagcccuucaugcccgccugggaggucgucaccuccgccaucccccgcggcugcuggcacggcgccgaggccgaggaggcccccgagcagaucgccuccgucggccuccucuccuccaacauccagcagcaccagaagcagcacugcggcgagaagccccucaagcgccaggagggccgcguccccguccuccgcuccugcaagguccaccucuccgagaagucccuccagucccgcgaggucggcaaggcccuccucaucuccuccggcguccucaagcaccaggucacccacaccggcgagaagucccaccgcuccuccaagucccgcgaggccuuccacgccggcaagcgccacuacaagugcuccgagugcggcaaggccuucggccagaaguaccuccucguccagcaccagcgccuccacgccggcaagaagaccuacgagugcuccgagugcggcaagcucuuccgcgacauguccaaccucuucauccaccagaucguccacaccggcgagcgccccuacggcugcuccaacugcggcaaguccuucucccgcaacgcccaccucaucgagcaccagcgcguccacaccggcgagaagcccuucaccugcuccgagugcggcaaggccuuccgccacaacuccacccucguccagcaccacaagauccacaccggcguccgccccuacgagugcuccgagugcggcaagcucuucuccuucaacuccucccucaugaagcaccagcgcauccacaccggcgagcgccccuacaagugcuccgagugcggcaaguucuacucccacaaguccaaccucaucaagcacuggcgcguccacaccggcgagcgccccuacaagugcuccgacugcggcaaguucuucacccagugcuccucccucaugcagcaccagaagguccacaccggcgagaagcccuucaagugcaacgagugcggccgcuucuuccgcgagaacuccacccucguccgccaccagcgcguccacaccggcgccaagcccuacgagugccgcgagugcggcaaguucuucucccaguccuccacccucaugcagcaccgcaagguccacaucggcgagaagcccuucaagugcaacgagugcggccgccucuuccgcgagaacuccucccucgucaagcaccagcgcguccacaccggcgccaagcccuacgagugccgcgagugcggcaaguucuuccgccacaacuccucccucuucaagcaccgccgcauccacaccggcgagaugcaguga

SEQ ID NO: 52108 - RNA, 2340 nt, Artificial Sequence
  derived and/or modified sequence opt2 from ZNF41__Homo_sapiens__NP_700359
auggccgccaacggcgacuccccccccuggucccccgcccucgccgccgagggccgcggcuccuccugcgaggccuccgucuccuucgaggacgucaccgucgacuucuccaaggaggaguggcagcaccucgaccccgcccagcgccgccucuacugggacgucacccucgagaacuacucccaccuccucuccgucggcuaccagauccccaaguccgaggccgccuucaagcucgagcagggcgagggccccuggaugcucgagggcgaggccccccaccaguccugcuccggcgaggccaucggcaagaugcagcagcagggcauccccggcggcaucuucuuccacugcgagcgcuucgaccagcccaucggcgaggacucccucugcuccauccucgaggagcucuggcaggacaacgaccagcucgagcagcgccaggagaaccagaacaaccuccucucccacgucaagguccucaucaaggagcgcggcuacgagcacaagaacaucgagaagaucauccacgucaccaccaagcucguccccuccaucaagcgccuccacaacugcgacaccauccucaagcacacccucaacucccacaaccacaaccgcaacuccgccaccaagaaccucggcaagaucuucggcaacggcaacaacuucccccacucccccuccuccaccaagaacgagaacgccaagaccggcgccaacuccugcgagcacgaccacuacgagaagcaccucucccacaagcaggcccccacccaccaccagaagauccaccccgaggagaagcucuacgucugcaccgagugcgucaugggcuucacccagaagucccaccucuucgagcaccagcgcauccacgccggcgagaagucccgcgagugcgacaaguccaacaaggucuucccccagaagccccaggucgacguccaccccuccgucuacaccggcgagaagcccuaccucugcacccagugcggcaaggucuucacccucaaguccaaccucaucacccaccagaagauccacaccggccagaagcccuacaagugcuccgagugcggcaaggccuucuuccagcgcuccgaccucuuccgccaccuccgcauccacaccggcgagaagcccuacgagugcuccgagugcggcaagggcuucucccagaacuccgaccucuccauccaccagaagacccacaccggcgagaagcacuacgagugcaacgagugcggcaaggccuucacccgcaaguccgcccuccgcaugcaccagcgcauccacaccggcgagaagcccuacgucugcgccgacugcggcaaggccuucauccagaagucccacuucaacacccaccagcgcauccacaccggcgagaagcccuacgagugcuccgacugcggcaaguccuucaccaagaagucccagcuccacguccaccagcgcauccacaccggcgagaagcccuacaucugcaccgagugcggcaaggucuucacccaccgcaccaaccucaccacccaccagaagacccacaccggcgagaagcccuacaugugcgccgagugcggcaaggccuucaccgaccaguccaaccucaucaagcaccagaagacccacaccggcgagaagcccuacaagugcaacggcugcggcaaggccuucaucuggaagucccgccucaagauccaccagaagucccacaucggcgagcgccacuacgagugcaaggacugcggcaaggccuucauccagaaguccacccucuccguccaccagcgcauccacaccggcgagaagcccuacgucugccccgagugcggcaaggccuucauccagaagucccacuucaucgcccaccaccgcauccacaccggcgagaagcccuacgagugcuccgacugcggcaagugcuucaccaagaagucccagcuccgcguccaccagaagauccacaccggcgagaagcccaacaucugcgccgagugcggcaaggccuucaccgaccgcuccaaccucaucacccaccagaagauccacacccgcgagaagcccuacgagugcggcgacugcggcaagaccuucaccuggaagucccgccucaacauccaccagaagucccacaccggcgagcgccacuacgagugcuccaagugcggcaaggccuucauccagaaggccacccucuccaugcaccagaucauccacaccggcaagaagcccuacgccugcaccgagugccagaaggccuucaccgaccgcuccaaccucaucaagcaccagaagaugcacuccggcgagaagcgcuacaaggccuccgacuga

SEQ ID NO: 52109 - RNA, 3675 nt, Artificial Sequence
  derived and/or modified sequence opt2 from ZNF423__Homo_sapiens__NP_001258549
auggaggacgaguccaucuacaccugcgaccacugccagcaggacuucgagucccucgccgaccucaccgaccaccgcgcccaccgcugccccggcgacggcgacgacgacccccagcucuccugggucgccuccucccccuccuccaaggacgucgccucccccacccagaugaucggcgacggcugcgaccucggccucggcgaggaggagggcggcaccggccuccccuaccccugccaguucugcgacaaguccuucauccgccucuccuaccucaagcgccacgagcagauccacuccgacaagcuccccuucaagugcaccuacugcucccgccucuucaagcacaagcgcucccgcgaccgccacaucaagcuccacaccggcgacaagaaguaccacugccacgagugcgaggccgccuucucccgcuccgaccaccucaagauccaccucaagacccacuccuccuccaagcccuucaagugcaccgucugcaagcgcggcuucuccuccaccuccucccuccagucccacaugcaggcccacaagaagaacaaggagcaccucgccaaguccgagaaggaggccaagaaggacgacuucaugugcgacuacugcgaggacaccuucucccagaccgaggagcucgagaagcacguccucacccgccacccccagcucuccgagaaggccgaccuccagugcauccacugccccgaggucuucgucgacgagaacacccuccucgcccacauccaccaggcccacgccaaccagaagcacaagugccccaugugccccgagcaguucuccuccgucgagggcgucuacugccaccucgacucccaccgccagcccgacuccuccaaccacuccgucucccccgaccccguccucggcuccgucgccuccauguccuccgccacccccgacuccuccgccuccgucgagcgcggcuccacccccgacuccacccucaagccccuccgcggccagaagaagaugcgcgacgacggccagggcuggaccaaggucgucuacuccugccccuacugcuccaagcgcgacuucaacucccucgccguccucgagauccaccucaagaccauccacgccgacaagccccagcagucccacaccugccagaucugccucgacuccaugcccacccucuacaaccucaacgagcacguccgcaagcuccacaagaaccacgccuaccccgucaugcaguucggcaacaucuccgccuuccacugcaacuacugccccgagauguucgccgacaucaacucccuccaggagcacauccgcgucucccacugcggccccaacgccaaccccuccgacggcaacaacgccuucuucugcaaccagugcuccaugggcuuccucaccgaguccucccucaccgagcacauccagcaggcccacugcuccgucggcuccgccaagcucgagucccccgucguccagcccacccaguccuucauggaggucuacuccugccccuacugcaccaacucccccaucuucggcuccauccucaagcucaccaagcacaucaaggagaaccacaagaacaucccccucgcccacuccaagaaguccaaggccgagcagucccccgucuccuccgacgucgaggucuccucccccaagcgccagcgccucuccgccuccgccaacuccaucuccaacggcgaguaccccugcaaccagugcgaccucaaguucuccaacuucgaguccuuccagacccaccucaagcuccaccucgagcuccuccuccgcaagcaggccugcccccagugcaaggaggacuucgacucccaggagucccuccuccagcaccucaccguccacuacaugaccaccuccacccacuacgucugcgaguccugcgacaagcaguucuccuccgucgacgaccuccagaagcaccuccucgacaugcacaccuucguccucuaccacugcacccucugccaggaggucuucgacuccaaggucuccauccagguccaccucgccgucaagcacuccaacgagaagaagauguaccgcugcaccgccugcaacugggacuuccgcaaggaggccgaccuccagguccacgucaagcacucccaccucggcaaccccgccaaggcccacaagugcaucuucugcggcgagaccuucuccaccgaggucgagcuccagugccacaucaccacccacuccaagaaguacaacugcaaguucugcuccaaggccuuccacgccaucauccuccucgagaagcaccuccgcgagaagcacugcgucuucgacgccgccaccgagaacggcaccgccaacggcgucccccccauggccaccaagaaggccgagcccgccgaccuccagggcaugcuccucaagaaccccgaggcccccaacucccacgaggccuccgaggacgacgucgacgccuccgagcccauguacggcugcgacaucugcggcgccgccuacaccauggagguccuccuccagaaccaccgccuccgcgaccacaacauccgccccggcgaggacgacggcucccgcaagaaggccgaguucaucaagggcucccacaagugcaacgucugcucccgcaccuucuucuccgagaacggccuccgcgagcaccuccagacccaccgcggccccgccaagcacuacaugugccccaucugcggcgagcgcuuccccucccuccucacccucaccgagcacaaggucacccacuccaagucccucgacaccggcaccugccgcaucugcaagaugccccuccaguccgaggaggaguucaucgagcacugccagaugcaccccgaccuccgcaacucccucaccggcuuccgcugcgucgucugcaugcagaccgucaccuccacccucgagcucaagauccacggcaccuuccacaugcagaagcucgccggcuccuccgccgccuccucccccaacggccagggccuccagaagcucuacaagugcgcccucugccucaaggaguuccgcuccaagcaggaccucgucaagcucgacgucaacggccuccccuacggccucugcgccggcugcauggcccgcuccgccaacggccaggucggcggccucgccccccccgagcccgccgaccgccccugcgccggccuccgcugccccgagugcuccgucaaguucgaguccgccgaggaccucgagucccacaugcaggucgaccaccgcgaccucacccccgagaccuccggcccccgcaagggcacccagaccucccccgucccccgcaagaagaccuaccagugcaucaagugccagaugaccuucgagaacgagcgcgagauccagauccacgucgccaaccacaugaucgaggagggcaucaaccacgagugcaagcucugcaaccagauguucgacucccccgccaagcuccucugccaccucaucgagcacuccuucgagggcaugggcggcaccuucaagugccccgucugcuucaccgucuucguccaggccaacaagcuccagcagcacaucuucgccguccacggccaggaggacaagaucuacgacugcucccagugcccccagaaguucuucuuccagaccgagcuccagaaccacaccaugucccagcacgcccaguga

SEQ ID NO: 52110 - RNA, 1710 nt, Artificial Sequence
  derived and/or modified sequence opt2 from ZNF430__Homo_sapiens__NP_001166142
auggagaaccucaaguccggcgucuacccccucaaggaggccuccggcugccccggcgccgaccgcaaccuccucgucuacuccuucuacgagaagggcccccucaccuuccgcgacgucgccaucgaguucucccucgaggaguggcagugccucgacaccgcccagcaggaccucuaccgcaaggucaugcucgagaacuaccgcaaccucgucuuccucggcaucgccgucuccaagcccgaccucaucaccugccucgagcagggcaaggagcccuggaacaugaagcgccacgccauggucgaccagccccccgucaccuacucccacuucgcccaggaccucuggcccgagcagggcaucaaggacuccuuccaggaggucauccuccgccgcuacggcaagugcggccacgaggaccuccagcuccgcaccggcugcaaguccgucgacgagugcaaccuccacaaggagugcuacgacgagcucaaccagugccucaccaccacccaguccgagaucuuccaguacgacaaguacgucaacgucuucuacaaguucuccaaccccaacauccagaagauccgccacaccggcaagaagcccuucaagugcaagaagugcgacaaguccuucugcaugcuccuccaccucacccagcacaagcgcauccacauccgcgagaacuccuaccagugcgaggagugcggcaaggucuucaacugguucuccacccucacccgccaccgccgcauccacaccggcgagaagcccuacaagugcgagcagugcggcaaggccuucaagcaguccuccacccucaccacccacaagaucauccacaccggcgagaagcccuaccgcugcgaggagugcggcaagaccuucaaccgcuccucccaccucaccacccacaagcgcauccacaccggcgagaagcccuaccgcugcgaggagugcggccgcgccuucaaccgcuccucccaccucaccacccacaagaucauccacaccggcgagaagcccuacaagugcgaggagugcggcaaggccuucaaccaguccuccacccucaccacccacaagaucauccacgccggcgagaagcccuacaagugcgaggagugcggcaaggccuucuaccgcuucuccuaccucaccaagcacaagaucauccacaccggcgagaaguucuacaagugcgaggagugcggcaagggcuucaacugguccuccacccucaccaagcacaagcgcauccacaccggcgagaagcccuacaagugcgagcagugcggcaaggccuucaacgaguccuccaaccucaccgcccacaagaucauccacaccggcgagaagcccuacaagugcgaggagugcggcaaggccuucaaccgcucccccaagcucaccgcccacaaggucauccacuccggcgagaagcccuacaagugcgaggagugcggcaaggccuucaaccaguucuccaaccucaccaagcacaagaucacccacaucggcgacaccuccuacaaguaccucgagugcgacaaggccuucucccaguccuccacccucaccaagcacaaggucauccacaccggcgagaagcccuacaacugcgaggaguacggcaaggccuucaaccaguccuccaaccucaucgagcaguccaacuccuacuggcgcgagacccuccagauguga

SEQ ID NO: 52111 - RNA, 1959 nt, Artificial Sequence
  derived and/or modified sequence opt2 from ZNF432__Homo_sapiens__XP_011525850
augaucaacgcccaggagcuccucacccucgaggacgucaccgucgaguucaccugggaggaguggcagcuccucggccccuuccagaaggaccucuaccgcgacgucaugcucgagaucuacuccaaccuccucuccaugggcuaccaggucuccaagcccgacgcccucuccaagcucgagcgcggcgaggagcccuggaccauggaggacgagcgccacucccgcaucugccccgagaacaacgaggucgacgaccaccuccaggaccaccucgagaaccagcgcaugcucaaguccgucgagcaguaccacgagcacaacgccuucggcaacaccgccucccagaccaagucccucugccucuuccgcgagaaccacgacaccuucgagcucuacaucaagacccucaaguccaaccucucccucgucaaccagaacaaguccugcgagaucaacaacuccaccaaguucuccggcgacggcaaguccuuccuccacggcaacuacgaggagcucuacuccgccgccaaguucuccgucuccaccaaggccaacuccaccaagucccaggucuccaagcaccagcgcacccacgagaucgagaagaaccacgucugcuccgagugcggcaaggccuucgucaagaagucccagcucaccgaccacgagcgcguccacaccggcgagaagcccuacggcugcacccucugcgccaaggucuucucccgcaagucccgccucaacgagcaccagcgcauccacaagcgcgagaaguccuucaucugcuccgagugcggcaaggucuucaccaugaagucccgccucaucgagcaccagcgcacccacaccggcgagaagcccuacaucugcaacgagugcggcaagggcuuccccggcaagcgcaaccucaucguccaccagcgcaaccacaccggcgagaaguccuacaucugcuccgagugcggcaagggcuucaccggcaaguccaugcucaucauccaccagcgcacccacaccggcgagaagcccuacaucugcuccgagugcggcaagggcuucaccaccaagcacuacgucaucauccaccagcgcaaccacaccggcgagaagcccuacaucugcaacgagugcggcaagggcuucaccaugaagucccgcaugaucgagcaccagcgcacccacaccggcgagaagcccuacaucugcuccgagugcggcaagggcuucccccgcaaguccaaccucaucguccaccagcgcaaccacaccgucgagaaguccuaccucugcuccgagugcggcaagggcuucaccgucaaguccaugcucaucauccaccagcgcacccacaccggcgagaagcccuacaccugcuccgagugcggcaagggcuucccccucaagucccgccucaucguccaccagcgcacccacaccggcgagaagcccuaccgcugcuccgagugcggcaagggcuucaucgucaacuccggccucaugcuccaccagcgcacccacaccggcgagaagcccuacaucugcaacgagugcggcaagggcuucgccuucaaguccaaccucgucguccaccagcgcacccacaccggcgagaagcccuucaugugcuccgagugcggcaagggcuucaccaugaagcgcuaccucaucguccaccagcagauccacaccgaggagaaguccugcaucugcuccgagugcggccgcggcuucgccaaggagaccgagcucgcccuccacaagcagguccacaccggcgagaagcccuacggcugcaacgagugcggcaagggcuucaccaugaagucccgccucaucguccaccagcgcacccacaccggcgagaagcccuucgucugcuccgagugccgcaaggccuucuccuccaagcgcaaccucaucguccaccagcgcacccacaacggcaacaagcccuga

SEQ ID NO: 52112 - RNA, 2022 nt, Artificial Sequence
  derived and/or modified sequence opt2 from ZNF433__Homo_sapiens__NP_001073880
augauguuccaggacuccgucgccuucgaggacgucgccgucaccuucacccaggaggagugggcccuccucgaccccucccagaagaaccucugccgcgacgucaugcaggagaccuuccgcaaccucgccuccaucggcaagaaguggaagccccagaacaucuacgucgaguacgagaaccuccgccgcaaccuccgcaucgucggcgagcgccucuucgaguccaaggagggccaccagcacggcgagauccucacccagguccccgacgacaugcucaagaagaccaccaccggcgucaaguccugcgaguccuccgucuacggcgaggucggcuccgcccacuccucccucaaccgccacauccgcgacgacaccggccacaaggccuacgaguaccaggaguacggccagaagcccuacaagugcaaguacugcaagaagcccuucaacugccucuccuccguccagacccacgagcgcgcccacuccggccgcaagcucuacgucugcgaggagugcggcaagaccuucaucucccacuccaaccuccagcgccaccgcaucaugcaccgcggcgacggccccuacaagugcaaguucugcggcaaggcccucauguuccucucccucuaccucauccacaagcgcacccacaccggcgagaagcccuaccagugcaagcagugcggcaaggccuucucccacuccuccucccuccgcauccacgagcgcacccacaccggcgagaagcccuacaagugcaacgagugcggcaaggccuuccacuccuccaccugccuccacgcccacaagcgcacccacaccggcgagaagcccuacgagugcaagcagugcggcaaggccuucuccuccucccacuccuuccagauccacgagcgcacccacaccggcgagaagcccuacgagugcaaggagugcggcaaggccuucaagugccccuccuccguccgccgccacgagcgcacccacucccgcaagaagcccuacgagugcaagcacugcggcaagguccucuccuaccucaccuccuuccagaaccaccucggcaugcacaccggcgagaucucccacaagugcaagaucugcggcaaggccuucuacucccccuccucccuccagacccacgagaagacccacaccggcgagaagcccuacaagugcaaccagugcggcaaggccuucaacuccuccuccuccuuccgcuaccacgagcgcacccacaccggcgagaagcccuacgagugcaagcagugcggcaaggccuuccgcuccgccucccuccuccagacccacggccgcacccacaccggcgagaagcccuacgccugcaaggagugcggcaagcccuucuccaacuucuccuucuuccagauccacgagcgcaugcaccgcgaggagaagcccuacgagugcaagggcuacggcaagaccuucucccuccccucccucuuccaccgccacgagcgcacccacaccggcggcaagaccuacgagugcaagcagugcggccgcuccuucaacugcuccuccuccuuccgcuaccacggccgcacccacaccggcgagaagcccuacgagugcaagcagugcggcaaggccuuccgcuccgccucccagcuccagauccacggccgcacccacaccggcgagaagcccuacgagugcaagcagugcggcaaggccuucggcuccgccucccaccuccagaugcacggccgcacccacaccggcgagaagcccuacgagugcaagcagugcggcaaguccuucggcugcgccucccgccuccagaugcacggccgcacccacaccggcgagaagcccuacaagugcaagcagugcggcaaggccuucggcugccccuccaaccuccgccgccacggccgcacccacaccggcgagaagcccuacaagugcaaccagugcggcaaggucuuccgcugcuccucccagcuccagguccacggccgcgcccacugcaucgacacccccuga

SEQ ID NO: 52113 - RNA, 2487 nt, Artificial Sequence
  derived and/or modified sequence opt2 from ZNF438__Homo_sapiens__NP_001137240
augcagaacuccgucuccgucccccccaaggacgagggcgaguccaacauccccuccggcaccauccagucccgcaagggccuccagaacaagucccaguuccgcaccaucgcccccaagaucguccccaagguccucaccucccgcaugcuccccugccacucccccucccgcuccgaccaggucaaccucggccccuccaucaacuccaagcuccucggcauguccacccagaacuacgcccucaugcaggucgccggccaggagggcaccuucucccucgucgcccucccccacgucgccuccgcccagcccauccagaagccccgcaugucccuccccgagaaccucaagcuccccaucccccgcuaccagcccccccgcaacuccaaggccucccgcaagaagcccauccucaucuuccccaaguccggcugcuccaaggcccccgcccagacccagaugugcccccagaugucccccucccccccccaccaccccgagcuccucuacaagcccucccccuucgaggagguccccucccucgagcaggcccccgccuccaucuccaccgccgcccucaccaacggcuccgaccacggcgaccuccgcccccccgucaccaacacccacggcucccucaacccccccgccacccccgccuccuccacccccgaggagcccgccaagcaggaccucaccgcccucuccggcaaggcccacuucgucuccaagaucaccuccuccaagcccuccgccgucgccuccgagaaguucaaggagcaggucgaccucgccaagaccaugaccaaccucucccccaccauccucggcaacgccguccagcucaucuccuccguccccaagggcaagcuccccaucccccccuacucccgcaugaagaccauggaggucuacaagaucaaguccgacgccaacaucgccggcuucucccuccccggccccaaggccgacugcgacaagauccccuccaccaccgagggcuucaacgccgccaccaaggucgccucccgccuccccgucccccaggucucccagcaguccgccugcgaguccgccuucugcccccccaccaagcucgaccucaaccacaagaccaagcucaacuccggcgccgccaagcgcaagggccgcaagcgcaagguccccgacgagauccucgccuuccagggcaagcgccgcaaguacaucaucaacaagugccgcgacggcaaggagcgcgucaagaacgacccccaggaguuccgcgaccagaagcucggcacccucaagaaguaccgcuccaucaugcccaagcccaucauggucauccccacccucgccucccucgccucccccaccacccuccagucccagaugcucggcggccucggccaggacguccuccucaacaacucccucacccccaaguaccucggcugcaagcaggacaacuccuccucccccaagcccuccuccgucuuccgcaacggcuucuccggcaucaagaagcccuggcaccgcugccacgucugcaaccaccacuuccaguucaagcagcaccuccgcgaccacaugaacacccacaccaaccgccgccccuacuccugccgcaucugccgcaaguccuacguccgccccggcucccucuccacccacaugaagcuccaccacggcgagaaccgccucaagaagcucaugugcugcgaguucugcgccaaggucuucggccacauccgcgucuacuucggccaccucaaggagguccaccgcgucgucaucuccaccgagcccgcccccuccgagcuccagcccggcgacauccccaagaaccgcgacauguccguccgcggcauggagggcucccucgagcgcgagaacaaguccaaccucgaggaggacuuccuccucaaccaggccgacgaggucaagcuccagaucaagugcggccgcugccagaucaccgcccaguccuucgccgagaucaaguuccaccuccucgacguccacggcgaggagaucgagggccgccuccaggagggcaccuuccccggcuccaagggcacccaggaggagcucguccagcacgccucccccgacuggaagcgccaccccgagcgcggcaagcccgagaagguccacuccuccuccgaggagucccacgccugcccccgccucaagcgccagcuccaccuccaccagaacggcgucgagaugcucauggagaacgagggcccccaguccggcaccaacaagccccgcgagaccugccagggccccgagugccccggccuccacaccuuccuccucuggucccacuccggcuucaacugccuccucugcgccgagaugcucggccgcaaggaggaccuccuccaccacuggaagcaccagcacaacugcgaggaccccuccaagcucugggccauccucaacaccgucuccaaccagggcgucaucgagcucuccuccgaggccgagaaguga

SEQ ID NO: 52114 - RNA, 2016 nt, Artificial Sequence
  derived and/or modified sequence opt2 from ZNF443__Homo_sapiens__NP_005806
auggccuccgucgcccucgaggacgucgccgucaacuucacccgcgaggagugggcccuccucggccccugccagaagaaccucuacaaggacgucaugcaggagaccauccgcaaccucgacugcgucgucaugaaguggaaggaccagaacaucgaggaccaguaccgcuacccccgcaagaaccuccgcugccgcaugcucgagcgcuucgucgaguccaaggacggcacccagugcggcgagaccuccucccagauccaggacuccaucgucaccaagaacacccuccccggcgucggccccugcgaguccuccaugcgcggcgagaaggucaugggccacuccucccucaacugcuacauccgcgucggcgccggccacaagccccacgaguaccacgagugcggcgagaagcccgacacccacaagcagcgcggcaaggccuucuccuaccacaacuccuuccagacccacgagcgccuccacaccggcaagaagcccuacgacugcaaggagugcggcaaguccuucuccucccucggcaaccuccagcgccacauggccguccagcgcggcgacggccccuacaagugcaagcucugcggcaaggccuucuucuggcccucccuccuccacaugcacgagcgcacccacaccggcgagaagcccuacgagugcaagcagugcuccaaggccuucuccuucuacuccuccuaccuccgccacgagcgcacccacaccggcgagaagcccuacgagugcaagcagugcuccaaggccuuccccuucuacuccuccuaccuccgccacgagcgcacccacaccggcgagaagcccuacaagugcaagcagugcuccaaggccuuccccgacuccuccuccugccucauccacgagcgcacccacaccggcgagaagcccuacaccugcaagcagugcggcaaggccuucuccgucuccggcucccuccagcgccacgagaccacccacuccgccgagaagcccuacgccugccagcagugcggcaaggccuuccaccaccucggcuccuuccagcgccacaugauccgccacaccggcaacggcccccacaagugcaagaucugcggcaagggcuucgacugccccuccucccuccagucccacgagcgcacccacaccggcgagaagcccuacgagugcaagcagugcggcaaggcccucucccaccgcuccuccuuccgcucccacaugaucaugcacaccggcgacggcccccacaagugcaaggucugcggcaaggccuucgucuaccccuccgucuuccagcgccacgagcgcacccacaccgccgagaagcccuacaagugcaagcagugcggcaaggccuaccgcaucuccuccucccuccgccgccacgagaccacccacaccggcgagaagcccuacaagugcaagcucggcaaggccuucaucgacuucugcuccuuccagaaccacaagaccacccacaccggcgagaagcccuacgagugcaaggagugcggcaaggccuucucccgcuuccgcuaccucucccgccacaagcgcacccacaccggcgagaagcccuacgagugcaagaccugccgcaaggccuucggccacuacgacaaccucaagguccacgagcgcauccacuccggcgagaagcccuacgagugcaaggagugcggcaaggccuucuccuggcucaccugcuuccuccgccacgagcgcauccacaugcgcgagaaguccuacgagugcccccagugcggcaaggccuucacccacucccgcuuccuccagggccacgagaagacccacaccggcgagaaccccuacgagugcaaggagugcggcaaggccuucgccucccucuccucccuccaccgccacaagaagacccacuggaagaagacccacaccggcgagaaccccuacgagugcaaggagugcggcaaggccuucgccucccucuccucccuccaccgccacaagaagacccacuga

SEQ ID NO: 52115 - RNA, 984 nt, Artificial Sequence
  derived and/or modified sequence opt2 from ZNF444__Homo_sapiens__XP_011525370
auggaggucgccguccccgucaagcaggaggccgagggccucgcccucgacucccccuggcaccgcuuccgccgcuuccaccucggcgacgcccccggcccccgcgaggcccucggccuccuccgcgcccucugccgcgacuggcuccgccccgagguccacaccaaggagcagaugcucgagcuccucguccucgagcaguuccucuccgcccuccccgccgacacccaggccugggucugcucccgccagccccaguccggcgaggaggccgucgcccuccucgaggagcucuggggccccgccgccucccccgacggcuccuccgccacccgcgucccccaggacgucacccagggccccggcgccaccggcggcaaggaggacuccggcaugaucccccucgccggcaccgcccccggcgccgagggccccgcccccggcgacucccaggccguccgccccuacaagcaggagcccuccucccccccccucgcccccggccuccccgccuuccucgccgcccccggcaccaccuccugccccgagugcggcaagaccucccucaagcccgcccaccuccuccgccaccgccagucccacuccggcgagaagccccacgccugccccgagugcggcaaggccuuccgccgcaaggagcaccuccgccgccaccgcgacacccaccccggcucccccggcucccccggccccgcccuccgcccccuccccgcccgcgagaagccccacgccugcugcgagugcggcaagaccuucuacuggcgcgagcaccucguccgccaccgcaagacccacuccggcgcccgccccuucgccugcugggagugcggcaagggcuucggccgccgcgagcacguccuccgccaccagcgcauccacggccgcgccgccgccuccgcccagggcgccgucgcccccggccccgacggcggcggccccuucccccccuggccccucggcuga

SEQ ID NO: 52116 - RNA, 1992 nt, Artificial Sequence
  derived and/or modified sequence opt2 from ZNF44__Homo_sapiens__NP_001157748
auggcccucugcuacggcaccuucuggggcuaccccaagaugcucgaggccgccaaccucauggagggccucgucgacaucggccccugggucacccucccccgcggccagcccgagguccucgaguggggccuccccaaggaccaggacuccgucgccuucgaggacgucgccgucaacuucacccacgaggagugggcccuccucggccccucccagaagaaccucuaccgcgacgucaugcgcgagaccauccgcaaccucaacugcaucggcaugaagugggagaaccagaacaucgacgaccagcaccagaaccuccgccgcaacccccgcugcgacgucgucgagcgcuucggcaaguccaaggacggcucccagugcggcgagacccucucccagauccgcaacuccaucgucaacaagaacacccccgcccgcgucgacgccugcggcuccuccgucaacggcgaggucaucaugggccacuccucccucaacugcuacauccgcgucgacaccggccacaagcaccgcgagugccacgaguacgccgagaaguccuacacccacaagcagugcggcaagggccucuccuaccgccacuccuuccagaccugcgagcgcccccacaccggcaagaagcccuacgacugcaaggagugcggcaagaccuucuccucccccggcaaccuccgccgccacauggucgucaagggcggcgacggccccuacaagugcgagcucugcggcaaggccuucuucuggcccucccuccuccgcaugcacgagcgcacccacaccggcgagaagcccuacgagugcaagcagugcuccaaggccuuccccgucuacuccuccuaccuccgccacgagaagauccacaccggcgagaagcccuacgagugcaagcagugcuccaaggccuuccccgacuacuccuccuaccuccgccacgagcgcacccacaccggcgagaagcccuacaagugcaagcagugcggcaaggccuucuccgucuccggcucccuccgcguccacgagcgcauccacaccggcgagaagcccuacaccugcaagcagugcggcaaggccuucugccaccucggcuccuuccagcgccacaugaucaugcacuccggcgacggcccccacaagugcaagaucugcggcaagggcuucgacuuccccggcuccgcccgcauccacgagggcacccacacccucgagaagcccuacgagugcaagcagugcggcaagcuccucucccaccgcuccuccuuccgccgccacaugauggcccacaccggcgacggcccccacaagugcaccgucugcggcaaggccuucgacucccccuccgucuuccagcgccacgagcgcacccacaccggcgagaagcccuacgagugcaagcagugcggcaaggccuuccgcaccuccuccucccuccgcaagcacgagaccacccacaccggcgagcagcccuacaagugcaagugcggcaaggccuucuccgaccucuucuccuuccagucccacgagaccacccacuccgaggaggagcccuacgagugcaaggagugcggcaaggccuucuccuccuucaaguacuucugccgccacgagcgcacccacuccgaggagaaguccuacgagugccagaucugcggcaaggccuucucccgcuucuccuaccucaagacccacgagcgcacccacaccgccgagaagcccuacgagugcaagcagugccgcaaggccuucuucuggcccuccuuccuccuccgccacgagcgcacccacaccggcgagcgccccuacgagugcaagcacugcggcaaggccuucucccgcuccuccuucugccgcgagcacgagcgcacccacaccggcgagaagcccuacgagugcaaggagugcggcaaggccuucuccucccucuccuccuucaaccgccacaagcgcacccacuggaaggacauccucuga

SEQ ID NO: 52117 - RNA, 3186 nt, Artificial Sequence
  derived and/or modified sequence opt2 from ZNF451__Homo_sapiens__NP_001026794
augggcgaccccggcuccgagaucaucgaguccgucccccccgccggccccgaggccuccgaguccaccaccgacgagaacgaggacgacauccaguucgucuccgagggcccccuccgccccguccucgaguacaucgaccucgucuccuccgacgacgaggagcccuccaccuccuacaccgacgagaacaucaagcgcaaggaccacaucgacuaccagaaggacaaggucgcccucacccucgcccgccucgcccgccacgucgaggucgagaagcagcagaaggaggagaagaaccgcgccuuccgcgagaagaucgacuuccagcacgcccacggccuccaggagcucgaguucauccgcggccacuccgacaccgaggccgcccgccucugcgucgaccaguggcucaagaugcccggccucaagaccggcaccaucaacugcggcaccaaguccuccuuccgccgcggcggccacaccugggucuccggcaagcccauccucugccccaucaugcacugcaacaaggaguucgacaacggccaccuccuccucggccaccucaagcgcuucgaccacucccccugcgaccccaccaucacccuccacggccccuucuucuccuccuucgccugcgucgucugcuacaagaaguucgucacccagcagcaguaccgcgaccaccucuucgacaaggaggccaccgacgacggccacaacaacaaccuccucccccagaucauccagugcuucgccugccccaacugcuuccuccucuucucccgcaaggaggagugcuccaagcacauguccggcaagaaccacuuccaccaguccuucaagcucggcgacaacaagggcaucgcccaccccaucuccuuccccuccuucgccaagaagcuccucaucucccucugcaaggacguccccuuccaggucaagugcgucgccugccacaagacccuccgcucccacauggagcucaccgcccacuuccgcguccacugccgcaacgccggccccgucgccgucgccgagaaguccaucacccaggucgccgagaaguucauccuccgcggcuacugccccgacugcaaccaggucuucgucgacgagaccuccacccagaaccacaagcagaacuccggccacaagguccgcgucaucaacuccgucgaggaguccguccuccucuacugccacuccuccgagggcaacaaggaccccuccuccgaccuccaccuccuccucgaccaguccaaguucuccucccucaagcgcaccauguccaucaaggaguccuccucccucgagugcaucgccauccccaagaagaagaugaaccucaaggacaagucccacgagggcgucgccugcguccagaaggagaaguccgucgucaagaccugguucugcgagugcaaccagcgcuuccccuccgaggacgccgucgagaagcacgucuucuccgccaacaccaugggcuacaagugcgucgucugcggcaaggucugcgacgacuccggcgucauccgccuccacaugucccgcauccacggcggcgcccaccucaacaacuuccucuucuggugccgcaccugcaagaaggagcucacccgcaaggacaccaucauggcccacgucaccgaguuccacaacggccaccgcuacuucuacgagauggacgaggucgagggcgagacccuccccuccuccuccaccacccucgacaaccucaccgccaacaagcccuccuccgccaucaccgucaucgaccacucccccgccaacuccuccccccgcggcaaguggcagugccgcaucugcgaggacauguucgacucccaggaguacgucaagcagcacugcaugucccucgccucccacaaguuccaccgcuacuccugcgcccacugccgcaagcccuuccacaagaucgagacccucuaccgccacugccaggacgagcacgacaacgagaucaagaucaaguacuucugcggccucugcgaccucaucuucaacgucgaggaggccuuccucucccacuacgaggagcaccacuccaucgacuacgucuucgucuccgagaagaccgagaccuccaucaagaccgaggacgacuuccccgucaucgagaccuccaaccagcucaccugcggcugccgcgaguccuacaucugcaaggucaaccgcaaggaggacuacucccgcugccuccagaucaugcucgacaagggcaagcucugguuccgcugcucccucugcuccgccaccgcccagaaccucaccgacaugaacacccacauccaccagguccacaaggagaaguccgacgaggaggagcagcaguacgucaucaagugcggcaccugcaccaaggccuuccacgaccccgaguccgcccagcagcacuuccaccgcaagcacugcuuccuccagaagcccuccgucgcccacuucggcuccgagaaguccaaccucuacaaguucaccgccuccgccucccacaccgagcgcaagcucaagcaggccaucaacuacuccaagucccucgacauggagaagggcgucgagaacgaccucuccuaccagaacaucgaggaggagaucgucgagcuccccgaccucgacuaccuccgcaccaugacccacaucgucuucgucgacuucgacaacugguccaacuucuucggccaccuccccggccaccucaaccagggcaccuucaucuggggcuuccagggcggcaacaccaacuggaagcccccccucaacugcaagaucuacaacuaccucaaccgcaucggcugcuucuuccuccacccccgcugcuccaagcgcaaggacgccgccgacuucgccaucugcaugcacgccggccgccucgacgagcagcuccccaagcagauccccuucaccauccucuccggcgaccagggcuuccucgagcucgagaaccaguucaagaagacccagcgccccgcccacauccucaacccccaccaccucgagggcgacaugaugugcgcccuccucaacuccaucuccgacaccaccaaggagugcgacuccgacgacaacaugggcgccaagaacaccuccaucggcgaggaguucaucuccaccgaggacgucgagcucgaggaggccauccgccgcucccucgaggagauguga

SEQ ID NO: 52118 - RNA, 2049 nt, Artificial Sequence
  derived and/or modified sequence opt2 from ZNF45__Homo_sapiens__NP_003416
augaccaaguccaaggaggccgucaccuucaaggacgucgccgucgucuucuccgaggaggagcuccagcuccucgaccucgcccagcgcaagcucuaccgcgacgucaugcucgagaacuuccgcaacgucgucuccgucggccaccaguccacccccgacggccucccccagcucgagcgcgaggagaagcucuggaugaugaagauggccacccagcgcgacaacuccuccggcgccaagaaccucaaggagauggagacccuccaggaggucggccuccgcuaccucccccacgaggagcucuucugcucccagaucuggcagcagaucacccgcgagcucaucaaguaccaggacuccgucgucaacauccagcgcaccggcugccagcucgagaagcgcgacgaccuccacuacaaggacgagggcuucuccaaccaguccucccaccuccagguccaccgcguccacaccggcgagaagcccuacaagggcgagcacugcgucaaguccuucuccugguccucccaccuccagaucaaccagcgcgcccacgccggcgagaagcccuacaagugcgagaagugcgacaacgccuuccgccgcuucuccucccuccaggcccaccagcgcguccacucccgcgccaaguccuacaccaacgacgccuccuaccgcuccuucucccagcgcucccaccucccccaccaccagcgcguccccaccggcgagaaccccuacaaguacgaggagugcggccgcaacgucggcaaguccucccacugccaggccccccucaucguccacaccggcgagaagcccuacaagugcgaggagugcggcgucggcuucucccagcgcuccuaccuccagguccaccucaagguccacaccggcaagaagcccuacaagugcgaggagugcggcaaguccuucuccuggcgcucccgccuccaggcccacgagcgcauccacaccggcgagaagcccuacaagugcaacgccugcggcaaguccuucuccuacuccucccaccucaacauccacugccgcauccacaccggcgagaagcccuacaagugcgaggagugcggcaagggcuucuccgucggcucccaccuccaggcccaccagaucucccacaccggcgagaagcccuacaagugcgaggagugcggcaagggcuucugccgcgccuccaaccuccucgaccaccagcgcggccacaccggcgagaagcccuaccagugcgacgccugcggcaagggcuucucccgcuccuccgacuucaacauccacuuccgcguccacaccggcgagaagcccuacaagugcgaggagugcggcaagggcuucucccaggccuccaaccuccucgcccaccagcgcggccacaccggcgagaagcccuacaagugcggcaccugcggcaagggcuucucccgcuccuccgaccucaacguccacugccgcauccacaccggcgagaagcccuacaagugcgagcgcugcggcaaggccuucucccaguucuccucccuccagguccaccagcgcguccacaccggcgagaagcccuaccagugcgccgagugcggcaagggcuucuccgucggcucccagcuccaggcccaccagcgcugccacaccggcgagaagcccuaccagugcgaggagugcggcaagggcuucugccgcgccuccaacuuccucgcccaccgcggcguccacaccggcgagaagcccuaccgcugcgacgucugcggcaagcgcuuccgccagcgcuccuaccuccaggcccaccagcgcguccacaccggcgagcgccccuacaagugcgaggagugcggcaaggucuucuccugguccuccuaccuccaggcccaccagcgcguccacaccggcgagaagcccuacaagugcgaggagugcggcaagggcuucuccugguccuccucccucaucauccaccagcgcguccacgccgacgacgagggcgacaaggacuuccccuccuccgaggacucccaccgcaagacccgcuga

SEQ ID NO: 52119 - RNA, 7521 nt, Artificial Sequence
  derived and/or modified sequence opt2 from ZNF462__Homo_sapiens__NP_067047
auggagguccuccagugcgacggcugcgacuuccgcgcccccuccuacgaggaccucaaggcccacauccaggacguccacaccgccuuccuccagcccaccgacgucgccgaggacaacgucaacgagcuccgcugcggcuccgucaacgccuccaaccagaccgaggucgaguucuccuccaucaaggacgaguucgccaucgccgaggaccucuccggccagaacgccaccucccucggcaccggcggcuacuacggccacucccccggcuacuacggccagcacaucgccgccaaccccaagcccaccaacaaguucuuccagugcaaguucugcguccgcuacuuccgcuccaagaaccuccucaucgagcacacccgcaagguccacggcgcccaggccgagggcuccuccuccggcccccccguccccggcucccucaacuacaacaucaugaugcacgagggcuucggcaaggucuucuccugccaguucugcaccuacaaguccccccgccgcgcccgcaucaucaagcaccagaagauguaccacaagaacaaccucaaggagaccaccgcccccccccccgcccccgcccccaugcccgaccccgucgucccccccgucucccuccaggaccccugcaaggagcuccccgccgaggucgucgagcgcuccauccucgaguccauggucaagccccucaccaagucccgcggcaacuucugcugcgaguggugcuccuaccagaccccccgccgcgagcgcuggugcgaccacaugaugaagaagcaccgcuccauggucaagauccucuccucccuccgccagcagcaggagggcaccaaccuccccgacguccccaacaaguccgcccccucccccaccuccaacuccaccuaccucaccaugaacgccgccucccgcgagauccccaacaccaccgucuccaacuuccgcggcuccaugggcaacuccaucaugcgccccaacuccuccgccuccaaguucucccccauguccuacccccagaugaagcccaaguccccccacaacuccggccucgucaaccucaccgagcgcucccgcuacggcaugaccgacaugaccaacuccuccgccgaccucgagaccaacuccaugcucaacgacuccuccuccgacgaggagcucaacgagaucgacuccgagaacggccucuccgccauggaccaccagaccuccggccucuccgccgagcagcucaugggcuccgacggcaacaagcuccucgagaccaagggcauccccuuccgccgcuucaugaaccgcuuccagugccccuucugccccuuccucaccaugcaccgccgcuccaucucccgccacaucgagaacauccaccucuccggcaagaccgccgucuacaagugcgacgagugccccuucaccugcaaguccucccucaagcucggcgcccacaagcagugccacaccggcaccaccuccgacugggacgccgucaacucccaguccgaguccaucuccuccucccucaacgagggcgucgucuccuacgaguccuccuccaucaacggccgcaaguccggcgucaugcucgacccccuccagcagcagcagcccccccagccccccccccccccccccccccccccccccucccagccccagccccuccagcagccccagcccccccagcuccagcccccccaccagguccccccccagccccagacccagcccccccccacccagcagccccagccccccacccaggccgccccccuccaccccuacaagugcaccaugugcaacuacuccaccaccacccucaagggccuccgcguccaccagcagcacaagcacuccuucugcgacaaccuccccaaguucgagggccagcccuccucccucccccucgagaacgagaccgacucccaccccuccuccuccaacaccgucaagaagucccagaccuccauccucggccucuccuccaagaacaacuucgucgccaaggccucccgcaagcucgccaacgacuucccccucgaccucucccccgucaagaagcgcacccgcaucgacgagaucgccuccaaccuccaguccaagaucaaccagaccaagcagcaggaggacgccgucaucaacgucgaggacgacgaggaggaggaggaggacaacgaggucgagaucgaggucgagcucgaccgcgaggaggagcccaccgagcccaucaucgagguccccaccuccuucuccgcccagcagaucuggguccgcgacaccuccgagccccagaaggagcccaacuuccgcaacaucacccacgacuacaacgccaccaacggcgccgagaucgagcucacccucuccgaggacgaggaggacuacuacggcuccuccaccaaccucaaggaccaccaggucuccaacaccgcccuccucaacacccagacccccaucuacggcaccgagcacaacuccgagaacaccgacuucggcgacuccggccgccucuacuacugcaagcacugcgacuucaacaacaaguccgcccgcuccgucuccacccacuaccagcgcaugcaccccuacaucaaguucuccuuccgcuacauccucgaccccaacgaccacuccgccgucuaccgcugccucgagugcuacaucgacuacaccaacuucgaggaccuccagcagcacuacggcgagcaccaccccgaggccaugaacguccucaacuucgaccacuccgaccucaucuaccgcugccgcuucugcuccuacaccucccccaacguccgcucccucaugccccacuaccagcgcaugcaccccaccgucaagaucaacaacgccaugaucuucuccuccuacgucgucgagcagcaggagggccucaacaccgagucccagacccuccgcgagauccucaacuccgcccccaagaacauggccaccuccacccccgucgcccgcggcggcggccuccccgccaccuucaacaagaacacccccaagaccuucacccccgagugcgagaaccagaaggacccccucgucaacaccgucgucgucuacgacugcgacgucugcuccuucgccucccccaacaugcacuccguccucguccacuaccagaagaagcaccccgaggagaaggccuccuacuuccgcauccagaagaccaugcgcauggucuccgucgaccgcggcuccgcccucucccagcucuccuucgaggucggcgcccccaugucccccaagauguccaacaugggcucccccccccccccccagccccccccccccgaccucuccaccgagcucuacuacugcaagcacugcuccuacuccaaccgcuccgucgucggcguccucguccacuaccagaagcgccaccccgagaucaaggucaccgccaaguacauccgccaggccccccccaccgccgccaugaugcgcggcgucgagggcccccagggcuccccccgcccccccgcccccauccagcagcucaaccgcuccuccuccgagcgcgacggcccccccgucgagaacgagauguucuucugccagcacugcgacuacggcaaccgcaccgucaagggcguccucauccacuaccagaagaagcaccgcgacuucaaggccaacgccgacgucauccgccagcacaccgccaccauccgcucccucugcgaccgcaaccagaagaagcccgccuccugcguccucgucucccccuccaaccucgagcgcgacaagaccaagcuccgcgcccucaagugccgccagugcuccuacaccucccccuacuucuacgcccuccgcaagcacaucaagaaggaccaccccgcccucaaggccaccgucaccuccaucaugcgcugggccuuccucgacggccucaucgaggccggcuaccacugcgaguggugcaucuacucccacaccgagcccaacggccuccuccuccacuaccagcgccgccaccccgagcacuacgucgacuacaccuacauggccaccaagcucugggccggccccgaccccuccccccccucccucaccaugcccgccgaggccaagaccuaccgcugccgcgacugcgucuucgaggccgucuccaucugggacaucaccaaccacuaccaggccuuccaccccugggccaugaacggcgacgaguccguccuccucgacaucaucaaggagaaggacgccgucgagaagcccauccucuccuccgaggagcucgccggccccgucaacugcgagaacuccauccccacccccuuccccgagcaggaggccgagugccccgaggacgcccgccucucccccgagaagucccuccagcucgccuccgccaaccccgccaucuccuccacccccuaccagugcaccgucugccaguccgaguacaacaaccuccacggccuccucacccacuacggcaagaagcaccccggcaugaaggucaaggccgccgacuucgcccaggacaucgacaucaaccccggcgccgucuacaagugccgccacugccccuacaucaacacccgcauccacggcguccucacccacuaccagaagcgccaccccuccaucaaggucaccgccgaggacuucguccacgacgucgagcaguccgccgacaucucccagaacgacgucgaggagaccucccgcaucuucaagcagggcuacggcgccuaccgcugcaagcucugccccuacacccacggcacccucgagaagcucaagauccacuacgagaaguaccacaaccagcccgaguucgacgucuucucccaguccccccccaagcuccccgucccccucgagcccgagaugaccaccgaggucucccccucccaggucuccaucaccgaggaggaggucggcgaggagcccgucuccaccucccacuucuccaccucccaccucgucucccacaccgucuuccgcugccagcucugcaaguacuucugcuccacccgcaagggcaucgcccgccacuaccgcaucaagcacaacaacguccgcgcccagcccgagggcaagaacaaccucuucaagugcgcccucugcgccuacaccaaccccauccgcaagggccucgccgcccacuaccagaagcgccacgacaucgacgccuacuacacccacugccucgccgccucccgcaccaucuccgacaagcccaacaaggucaucauccccuccccccccaaggacgacuccccccagcucuccgaggagcuccgccgcgccgucgagaagaagaagugcucccucugcuccuuccaguccuucuccaagaagggcaucgucucccacuacaugaagcgccaccccggcgucuuccccaagaagcagcacgccuccaagcucggcggcuacuucaccgccgucuacgccgacgagcacgagaagcccacccucauggaggaggaggagcgcggcaacuucgagaaggccgaggucgagggcgaggcccaggagaucgaguggcuccccuuccgcugcaucaagugcuucaagcucuccuucuccaccgccgagcuccucugcaugcacuacaccgaccaccacucccgcgaccucaagcgcgacuucaucauccucggcaacggcccccgccuccagaacuccaccuaccagugcaagcacugcgacuccaagcuccaguccaccgccgagcucaccucccaccucaacauccacaacgaggaguuccagaagcgcgccaagcgccaggagcgccgcaagcagcuccucuccaagcagaaguacgccgacggcgccuucgccgacuucaagcaggagcgccccuucggccaccucgaggagguccccaagaucaaggagcgcaaggucgucggcuacaagugcaaguucugcgucgagguccaccccacccuccgcgccaucugcaaccaccuccgcaagcacguccaguacggcaacguccccgccgucuccgccgccgucaagggccuccgcucccacgagcgcucccaccucgcccucgccauguucacccgcgaggacaaguacuccugccaguacugcuccuucgucuccgccuuccgccacaaccucgaccgccacaugcagacccaccacggccaccacaagcccuuccgcugcaagcucugcuccuucaaguccuccuacaacucccgccucaagacccacauccucaaggcccacgccggcgagcacgccuacaagugcuccuggugcuccuucuccaccaugaccaucucccagcucaaggagcacucccucaagguccacggcaaggcccucacccucccccgcccccgcaucgucucccuccucuccucccacucccaccacuccucccagaaggccacccccgccgaggaggucgaggacuccaacgacuccuccuacuccgagccccccgacguccagcagcagcucaaccacuaccaguccgccgcccucgcccgcaacaacucccgcgucucccccgucccccucuccggcgccgccgccggcaccgagcagaagaccgaggccguccuccacugcgaguucugcgaguucuccuccggcuacauccaguccauccgccgccacuaccgcgacaagcacggcggcaagaagcucuucaagugcaaggacugcuccuucuacaccggcuucaaguccgccuucaccaugcacgucgaggccggccacuccgccguccccgaggagggccccaaggaccuccgcugcccccucugccucuaccacaccaaguacaagcgcaacaugaucgaccacaucguccuccaccgcgaggagcgcgucguccccaucgaggucugccgcuccaagcucuccaaguaccuccagggcgucgucuuccgcugcgacaagugcaccuucaccugcuccuccgacgagucccuccagcagcacaucgagaagcacaacgagcucaagcccuacaagugccagcucugcuacuacgagaccaagcacaccgaggagcucgacucccaccuccgcgacgagcacaaggucucccgcaacuucgagcucgucggccgcgucaaccucgaccagcucgagcagaugaaggagaagauggaguccuccuccuccgacgacgaggacaaggaggaggagaugaacuccaaggccgaggaccgcgagcucaugcgcuucuccgaccacggcgccgcccucaacaccgagaagcgcuuccccugcgaguucugcggccgcgccuucucccagggcuccgagugggagcgccacguccuccgccacggcauggcccucaacgacaccaagcaggucucccgcgaggagauccaccccaaggagaucauggagaacuccgucaagaugcccuccaucgaggagaaggaggacgacgaggccaucggcaucgacuucucccucaagaacgagaccgucgccaucugcgucgucaccgccgacaagucccuccucgagaacgccgaggccaagaaggaguga

SEQ ID NO: 52120 - RNA, 11778 nt, Artificial Sequence
  derived and/or modified sequence opt2 from ZNF469__Homo_sapiens__NP_001120936
augcccggcgagcgcccccgcggcgcccccccccccaccaugaccggcgaccuccagccccgccaggucgccuccucccccggccaccccucccagcccccccucgaggacaacacccccgccacccgcaccaccaagggcgcccgcgaggccggcggccaggcccaggccauggagcuccccgaggcccagccccgccaggcccgcgacggcgagcucaagccccccucccuccgcggccaggcccccuccuccacccccggcaagcgcggcuccccccagaccccccccggccgcuccccccuccaggcccccucccgccucgccggccgcgccgagggcucccccccccagcgcuacauccucggcaucgccuccucccgcaccaagcccacccucgacgagacccccgagaacccccagcucgaggccgcccagcuccccgaggucgacaccccccagggccccggcaccggcgccccccuccgccccggccucccccgcaccgaggcccagcccgccgccgaggagcucggcuuccaccgcugcuuccaggagccccccuccuccuucaccuccaccaacuacaccucccccuccgccaccccccgcccccccgcccccggccccccccagucccgcggcaccuccccccuccagcccggcuccuaccccgaguaccaggccuccggcgccgacuccuggccccccgccgccgagaacuccuuccccggcgccaacuucggcgucccccccgccgagcccgagcccauccccaagggcucccgccccggcggcuccccccgcggcgucuccuuccaguuccccuuccccgcccuccacggcgccuccaccaagcccuuccccgccgacgucgccggccacgccuucaccaacggcccccucgucuucgccuuccaccagccccagggcgccuggcccgaggaggccgucggcaccggccccgccuacccccuccccacccagcccgcccccuccccccuccccugcuaccagggccagcccggcggccucaaccgccacuccgaccucuccggcgcccucuccucccccggcgccgcccacuccgccccccgccccuucuccgacucccuccacaagucccucaccaagauccuccccgagcgcccccccuccgcccaggacggccucggcuccacccgcggcccccccuccucccucccccagcgccacuuccccggccaggccuaccgcgccuccggcgucgacaccucccccggcccccccgacaccgagcucgccgcccccggccccccccccgcccgccucccccagcucugggaccccaccgccgcccccuaccccaccccccccggcggcccccucgccgccacccgcuccauguucuucaacggccagcccucccccggccagcgccucugccucccccaguccgccccccuccccuggccccagguccuccccaccgcccgccccuccccccacggcauggagaugcucucccgccuccccuuccccgccggcggccccgaguggcagggcggcucccagggcgcccucggcaccgccggcaagacccccggcccccgcgagaagcuccccgccguccgcuccucccagggcggcucccccgcccucuucaccuacaacggcaugaccgaccccggcgcccagccccucuucuucggcgucgcccagccccaggucuccccccacggcacccccucccucccccccccccgcgucgucggcgccucccccuccgaguccccccuccccucccccgccaccaacaccgccggcuccaccugcuccucccucucccccauguccuccucccccgccaaccccuccuccgaggagucccagcuccccggcccccucggccccuccgccuucuuccacccccccacccacccccaggagaccggcucccccuuccccucccccgagcccccccacucccuccccacccacuaccagcccgagcccgccaaggccuuccccuuccccgccgacggccucggcgccgagggcgccuuccagugccucgaggagacccccuucccccacgagggccccgaggucggccgcggcggccuccagggcuucccccgcgcccccccccccuaccccacccaccacuucucccucuccuccgccucccucgaccagcucgacguccuccucaccugccgccagugcgaccgcaacuacuccucccucgccgccuuccucgcccaccgccaguucugcggccuccuccucgcccgcgccaaggacggccaccagcgcucccccggcccccccggccuccccuccccccccgccgccccccgcguccccgccgacgcccacgccggccuccucucccacgccaagaccuuccuccucgccggcgacgcccaggccgagggcaaggacgacccccuccgcaccggcuuccuccccucccucgccgccacccccuucccccuccccgccuccgaccucgacauggaggacgacgccaagcucgacucccucaucaccgaggcccucaacggcauggaguaccaguccgacaaccccgagaucgacuccuccuucaucgacgucuucgccgacgaggagcccuccggcccccgcggccccuccuccggccacccccucaaguccaaggccggcgucacccccgaguccaaggccccccccccccuccccgccgccacccccgacccccagaccccccgccccggcgaccgcggcugccccgcccgcggccgccccaagacccgcucccucggccucgcccccaccgaggccgacgcccccucccagggccgccagcagcgccgcggcaagcagcucaagcucuuccgcaaggaccucgacuccggcggcgccgccgagggcuccggcuccggcggcggcggccgcgccuccggccuccgcccccgccgcaacgacggccucggcgagcgcccccccccccgcccccgccgcccccgcacccaggcccccggcucccgcgccgaccccgccccccgcgucccccgcgccgccgcccuccccgaggagacccgcuccucccgccgccgccgccuccccccccgcaaggacccccgcaagcgcaaggcccgcggcggcgccuggggcaaggagcucauccucaagaucguccagcagaagaaccgccuccgcgaguacgacuucgccuccgaguccgaggaggacgagcagccccccccccgcggccccggcuuccgcggccgccgcggccgcggcgagaagcgcaaggaggucgagcucacccagggcccccgcgaggacgagccccagaagccccgcaaggccgcccgccaggaggccggcggcgacggcgcccccgccaaccccgaggagcccggcggcucccgccccggccccggccgcuccccccaggcccgcggccccucccgcucccucgagaccggcgccgccgcccgcgagggcggccccaagugcgccgaccgccccuccgucgcccccaaggacccccuccagguccccaccaacaccgagaccuccgaggagacccgccccucccucgacuucccccaggaggccaaggagcccgagaccgccgaggaguccgcccccgacuccaccgaguucaccgaggcccuccgcuccccccccgccgccugcgccggcgagaugggcgccucccccggccuccucauccccgagcagcccccccccucccgccacgacaccggcacccccaagcccuccggcucccucgccaacaccgccccccacggcuccucccccacccccggcgucggcucccuccucggcggccccggcggcacccaggcccccgucucccacaacuccaaggacccccccgcccgccagcccggcgaguuccucgcccccgucgccaaccccuccuccaccgccugccccaagcccuccguccucuccuccaagaucuccuccuucggcugcgaccccgccggcuucaaccgcgacccccucggcguccccgucgccaagaagggcccccagcccuacuccuccccccacuccgagcucuuccucggccccaaggaccucgccggcugcuuccucgaggagcuccaccccaagcccuccgcccgcgacgccccccccgccuccuccuccugccucugccaggacggcgaggacgccggcucccucgagccccagcucccccgcuccccccccggcaccgccgagaccgagcccggccgcgccgccuccccccccacccucgaguccuccucccucuuccccgaccuccccgucgaccgcuucgaccccccccucuacggcucccucuccgccaaccgcgacuccggccuccccuucgccugcgccgaccccccccagaagaccguccccuccgacccccccuaccccuccuuccuccuccucgaggaggucucccccaugcuccccucccacuuccccgaccucuccggcggcaagguccucuccaagaccugcccccccgagcgcaccgucguccccggcgccgcccccucccuccccggcaagggcuccggcugcuccgucgcccucaugucccaccucuccgaggacgagcucgagauccagaagcucgucaccgagcucgagucccagcuccagcgcuccaaggacacccgcggcgccccccgcgagcucgccgaggccgaguccgucggccgcgucgagcucggcaccggcaccgagccccccucccagcgccgcaccugccaggccaccgucccccacgaggacaccuucuccgccgccgaccucacccgcgucggcgaguccaccgcccaccgcgagggcgccgaguccgccgucgccaccgucgaggccguccagggccgccccggcggcaccuggcccugccccgccuccuuccaccccggccacgccgcccuccuccccugcgcccaggaggaccucgucuccggcgcccccuucuccccccgcggcgccaacuuccacuuccagcccguccagaaggccggcgccuccaagaccggccucugccaggccgagggcgacucccgccccccccaggacgucugccuccccgagcccuccaagcagcccggcccccagcucgacgccggcucccucgccaagugcucccccgaccaggagcucuccuuccccaagaacaaggaggccgccuccucccaggaguccgaggacucccuccgccuccuccccugcgagcagcgcggcggcuuccuccccgagcccggcaccgccgaccagccccaccgcggcgcccccgcccccgaggccuucggcucccccgccguccaccucgcccccgaccucgccuuccagggcgacggcgcccccccccucgacgccaccuggcccuucggcgccucccccucccacgccgcccagggccacuccgccggccgcgccggcggccaccuccaccccaccgccggccgccccggcuucgagggcaacgaguucgcccccgccggcgccuccucccucaccgccccccgcggccgcgaggccuggcucguccccguccccucccccgccugcgucuccaacacccaccccucccgccgcucccaggaccccgcccucuccccccccauccgccagcuccagcuccccggccccggcgucgccaaguccaaggacggcauccucggccuccaggagcucacccccgccgcccagucccccccccgcgucaaccccuccggccucgagggcggcaccgucgagggcggcaaggucgccugcggccccgcccagggcucccccggcggcguccaggucaccacccuccccgccgucgccggccaccagcucggccucgaggccgacggccacuggggccuccucggccaggccgagaagacccagggccagggcaccgccaaccagcuccagcccgagaacggcgucucccccggcggcaccgacaaccacgccuccgucaacgccucccccaagaccgcccucaccggccccaccgagggcgccguccuccucgagaagugcaagggcucccgcgccgccaugucccuccaggaggaggccgagcccacccccuccccccccucccccaaccgcgagucccucgcccucgcccucaccgccgcccacucccgcuccggcuccgagggccgcacccccgagcgcgccuccucccccggccucaacaagccccuccucgccaccggcgacucccccgcccccuccgucggcgaccucgccgccugcgcccccucccccaccuccgccgcccacaugcccugcucccucggcccccucccccgcgaggacccccucaccucccccucccgcgcccagggcggccucggcggccagcuccccgccucccccuccugccgcgacccccccggcccccagcagcuccucgccugcucccccgccugggccccccucgaggaggccgacggcguccaggccaccaccgacaccggcgccgaggacucccccgucgccccccccucccucaccaccucccccugcgaccccaaggaggcccucgccggcugccuccuccagggcgagggcuccccccucgaggaccccuccuccuggccccccggcuccgucuccgccgucaccugcacccacuccggcgacacccccaaggacuccacccuccgcauccccgaggacucccgcaaggagaagcucugggagucccccggccgcgccaccucccccccccucgccggcgccgucucccccuccgucgccguccgcgccaccggccucuccuccacccccaccggcgacgaggcccaggccggccgcggccuccccggccccgacccccagucccgcggcgcccccccccacaccaaccccgaccgcaugccccgcggccacuccuccuacucccccuccaacaccgcccgccucggccaccgcgagggccaggccgucaccgccguccccaccgagccccccacccuccagggcgccggccccgacucccccgccugccucgagggcgagaugggcaccuccuccaaggagcccgaggaccccggcacccccgagaccggccgcuccggcgccaccaagaugccccgcgucaccugccccuccaccggccucggccucggccgcaccaccgcccccuccuccaccgccuccgacuuccaguccgacuccccccagucccaccgcaacgccucccaccagaccccccagggcgacccccucggcccccaggaccucaagcagcgcucccgcggcuacaagaagaagcccgccuccaccgagaacggccaguggaagggccaggccccccacggccccgucaccugcgaggucugcgccgccuccuuccgcuccggccccggccucucccgccacaaggcccgcaagcaccgcccccaccccggcgcccccgccgagcccucccccgccgcccuccccgcccagcagccccucgagccccucgcccagaagugccagcccccccgcaagaagucccaccgcgucuccggcaaggagcgccccaaccacucccgcggcgaccccucccacgucacccagcccccccccgcccagggcuccaaggagguccuccgcgcccccggcuccccccacucccagcagcuccacccccccucccccaccgagcacgaggucgacgucaagacccccgccuccaagccccgccccgaccaggcccgcgaggacgagcuccaccccaagcaggccgagaagcgcgagggccgccgcuggcgccgcgagcccaccgucgacucccccucccacuccgagggcaaguccaacaagaagcgcggcaagcuccgcggccgccgccuccgcgaggaguccauccuccccgucuccgccgacgucaucuccgacggccgcggcucccgccccucccccgccauggccuccuacgccgccucccccucccacugccucuccgucgagggcggccccgaggccgacggcgagcagcccccccgccucgccacccucggccccggcgucauggagggcgccgccgagaccgaccaggaggcccucugcgccggcgagaccggcgcccagaagccccccggcgaccgcaugcucugccccggccgcauggacggcgccgcccucggcgagcagcccaccggccagaagggcgccuccgcccgcggcuucuggggcccccgcgagaccaaggcccucggcgucugcaaggaguccggcuccgagcccgccgaggacuccucccgcgcccacucccgcuccgaggagggcgucugggaggagaacacccccccccucggcccccucggcuuccccgagaccuccuccucccccgccgacuccaccaccuccuccugccuccagggccuccccgacaaccccgacacccagggcggcguccagggccccgagggccccacccccgacgccuccggcuccuccgccaaggacccccccucccucuucgacgacgaggucuccuucucccagcucuucccccccggcggccgccucacccgcaagcgcaacccccacgucuacggcaagcgcugcgagaagcccguccucccccuccccacccagcccuccuucgaggagggcggcgaccccacccucggccccgcccgccuccccaccgaccucuccgacuccuccucccucugccucugccacgaggaccccugggaggacgaggaccccgccggccuccccgaguccuuccuccucgacggcuuccucaacucccgcguccccggcaucgaccccugggcccccggccucucccucugggcccucgagcccucccgcgaggccggcgccgagaagcuccccucccacugccccgaggacgaccgccccgaggccauccccgagcuccacaugguccccgccgccuggcgcggccucgagaugcccgcccccgccgacgacuccuccuccucccucggcgacgucucccccgagccccccucccucgagcgcgagcgcugcgacggcggccuccccggcaacacccaccuccucccccuccgcgccaccgacuucgagguccucuccaccaaguucgagaugcaggaccucugcuuccucggccccuucgaggaccccgucggccuccccggccccuccuuccucgacuucgagggcaccgccuccucccagggcccccagucccgccgcaccgaggaggccgccggcgccggccgcgcccagggccgcggccgccccgccaagggccgccgcgccuccuacaagugcaaggucugcuuccagcgcuuccgcucccucggcgagcucgaccuccacaagcucgcccacacccccgcccccccccccaccugcuacaugugcgucgagcgccgcuucggcucccgcgagcuccuccgcggccaccuccaggagcgccacgcccaguccaaggccggccccugggccugcggcaugugccucaaggaggucgccgacgucuggauguacaacgagcaccuccgcgagcacgccguccgcuucgcccgccgcggccaggcccgccgcucccucggcgaccuccccggcggccucgagggcuccuccgccgucgcccaccuccucaacuccaucaccgagcccgcccccaagcaccaccgcggcaagcgcuccgccggcaaggccgccggcucccccggcgaccccuggggccaggagggcgaggccaagaaggacucccccggcgagcgcgccaagccccgcgcccgcuccacccccuccaaccccgacggcgccgccacccccgacuccgccuccgccaccgcccucgccgacgccggcucccccggccccccccgcaccacccccucccccucccccgaccccugggccggcggcgagccccuccuccaggccacccccguccacgaggccugcaaggaccccucccgcgacugccaccacugcggcaagcgcuuccccaagcccuucaagcuccagcgccaccucgccguccacuccccccagcgcgucuaccucugcccccgcugcccccgcgucuaccccgagcacggcgagcuccucgcccaccucggcggcgcccacggccuccucgagcgccccgagcuccagcacaccccccucuacgccugcgagcucugcgccaccgucaugcgcaucaucaagaaguccuucgccugcuccuccugcaacuacaccuucgccaagaaggagcaguucgaccgccacaugaacaagcaccuccgcggcggccgccagcccuucgccuuccgcggcguccgccgccccggcgcccccggccagaaggcccgcgcccucgagggcacccuccccuccaagcgccgccgcgucgccaugcccggcuccgcccccggccccggcgaggaccgcccccccccccgcggcuccucccccauccucuccgagggcucccuccccgcccuccuccaccucugcuccgaggucgcccccuccaccaccaagggcuggcccgagacccucgagcgccccgucgaccccgucacccaccccauccgcggcugcgagcuccccuccaaccaccaggagugccccccccccucccucucccccuuccccgccgcccucgccgacggccgcggcgacugcgcccucgacggcgcccucgagcgccccgagaacgaggccucccccggcucccccggcccccuccuccagcaggcccucccccucggcgccucccucccccgccccggcgcccgcggccaggacgccgagggcaagcgcgccccccucgucuucuccggcaagcgccgcgcccccggcgcccgcggccgcugcgcccccgaccacuuccaggaggaccaccuccuccagaaggagaaggaggucuccuccucccacauggucuccgagggcggcccccgcggcgccuuccacaagggcuccgccaccaagcccgccggcugccaguccuccuccaaggaccgcuccgccgccuccacccccuccaaggcccucaaguuccccguccacccccgcaaggccgucggcucccucgcccccggcgagcucgcccgcggcaccgagaacggcaugaagcccgccacccccaaggccaagcccggccccuccucccagggcuccggcuccccccgccccggcaccaagaccggcggcggcucccagccccagcccgccuccggccagcuccaguccgagaccgccaccacccccgccaagcccuccuuccccucccgcucccccgcccccgagcgccuccccgcccgcgcccaggccaaguccugcaccaagggcccccgcgaggccggcgagcagggcccccacggcucccucggccccaaggagaagggcgaguccuccaccaagcgcaagaagggccagguccccggccccgcccgcuccgaguccgucggcuccuucggccgcgcccccuccgcccccgacaagcccccccgcaccccccgcaagcaggccacccccucccgcguccuccccaccaagcccaagcccaacucccagaacaagccccgccccccccccuccgagcagcgcaaggccgagcccggccacacccagcgcaaggaccgccucggcaaggccuucccccagggccgcccccuccuccgcccccccaagcgcggcaccgccguccacggcgccgagcccgccgagccccacacccaccgcaccgccgaggcccaguccgaccuccucucccagcucuucggccagcgccucaccggcuucaagaucccccucaagaaggacgccuccgaguga

SEQ ID NO: 52121 - RNA, 771 nt, Artificial Sequence
  derived and/or modified sequence opt2 from ZNF483__Homo_sapiens__NP_001007170
augcaggccgucgucccccucaacaagaugaccgccaucucccccgagccccagacccucgccuccaccgagcagaacgaggucccccgcgucgucaccuccggcgagcaggaggccauccuccgcggcaacgccgccgacgccgaguccuuccgccagcgcuuccgcugguucugcuacuccgaggucgccggcccccgcaaggcccucucccagcucugggagcucugcaaccaguggcuccgccccgacauccacaccaaggagcagauccucgagcuccucgucuucgagcaguuccucaccauccuccccggcgagauccgcaucugggucaagucccagcaccccgaguccuccgaggaggucgucacccucaucgaggaccucacccagaugcucgaggagaaggaccccgucucccaggacuccaccgucucccaggaggagaacuccaaggaggacaagauggucaccgucugccccaacaccgaguccugcgaguccaucacccucaaggacgucgccgucaacuucucccgcggcgaguggaagaagcucgagcccuuccagaaggagcucuacaaggagguccuccucgagaaccuccgcaaccucgaguuccucgacuuccccgucuccaagcucgagcucaucucccagcucaagugggucgagcuccccuggcuccucgaggaggucuccaaguccucccgccucgacauccacggcgccgucaagaagaugcagauguucuccgaggccgaguga

SEQ ID NO: 52122 - RNA, 1590 nt, Artificial Sequence
  derived and/or modified sequence opt2 from ZNF490__Homo_sapiens__NP_065765
augcgccgcaacuccucccucuccuuccagauggagcgcccccucgaggagcagguccaguccaagugguccuccucccagggccgcaccggcaccggcggcuccgacguccuccagaugcagaacuccgagcaccacggccaguccaucaagacccagaccgacuccaucucccucgaggacgucgccgucaacuucacccucgaggagugggcccuccucgaccccggccagcgcaacaucuaccgcgacgucaugcgcgccaccuucaagaaccucgccugcaucggcgagaaguggaaggaccaggacaucgaggacgagcacaagaaccagggccgcaaccuccgcucccccauggucgaggcccucugcgagaacaaggaggacugccccugcggcaaguccaccucccagauccccgaccucaacaccaaccucgagacccccaccggccucaagcccugcgacugcuccgucugcggcgaggucuucaugcaccaggucucccucaaccgccacaugcgcucccacaccgagcagaagcccaacgagugccacgaguacggcgagaagccccacaagugcaaggagugcggcaagaccuucacccgcuccuccuccauccgcacccacgagcgcauccacaccggcgagaagcccuacgagugcaaggagugcggcaaggccuucgccuuccucuucuccuuccgcaaccacauccgcauccacaccggcgagacccccuacgagugcaaggagugcggcaaggccuuccgcuaccucaccgcccuccgccgccacgagaagaaccacaccggcgagaagcccuacaagugcaagcagugcggcaaggccuucaucuacuaccagcccuuccucacccacgagcgcacccacaccggcgagaagcccuacgagugcaagcagugcggcaaggccuucuccugccccaccuaccuccgcucccacgagaagacccacaccggcgagaagcccuucgucugccgcgagugcggccgcgccuucuucucccacuccucccuccgcaagcacgucaagacccacaccggcguccagcccuacaccugcaagaagugcggcgaggccuucaaguccuccuccuccugcgagguccacgagcgcacccacuucggcgagaagcccuacgagugcaagcagugcggcaaggccuucaacuccuccuccuaccuccagcuccacgagcgcguccacaccggcgagaagaccuacgagugcaaggagugcggcaaggccuuccucuacuccacccacuuccgcauccacgagcgcacccacacccgcgagaagcccuacgagugcaagcagugcggccgcgucuucaucuacuucucccaccuccgccgccacgagcgcucccacaccggcgucaagcccugcgagugcaagcagugcggcaaggccuucaccugccucaacucccucaagguccacaagcgcauccacaccggcgagcgccccuuccagugccgccagugcggcaaggccuucuccuacuccaagucccuccacguccacgagcgcacccacucccgccagaagcccuga

SEQ ID NO: 52123 - RNA, 1596 nt, Artificial Sequence
  derived and/or modified sequence opt2 from ZNF492__Homo_sapiens__NP_065906
augcucgagaacuaccgcaaccucgucuucgucggcaucgccgccuccaagcccgaccucaucaccugccucgagcagggcaaggagcccuggaacgucaagcgccacgagauggucgccgagccccccgucgucugcuccuacuucgcccgcgaccucuggcccaagcagggcaagaagaacuacuuccagaaggucauccuccgccgcuacaagaagugcggcugcgagaaccuccagcuccgcaaguacugcaaguccauggacgagugcaagguccacaaggagugcuacaacggccucaaccagugccucaccaccacccagaacaagaucuuccagugcgacaaguacgucaaggucuuccacaaguucuccaacuccaaccgccacaccauccgccacaccggcaagaaguccuucaagugcaaggagugcgagaaguccuucugcaugcucucccaccucgcccagcacaagcgcauccacuccggcgagaagcccuacaagugcaaggagugcggcaaggccuacaacgagaccuccaaccucuccacccacaagcgcauccacaccggcaagaagcccuacaagugcgaggagugcggcaaggccuucaaccgccucucccaccucaccacccacaagaucauccacaccggcaagaagcccuacaagugcgaggagugcggcaaggccuucaaccaguccgccaaccucaccacccacaagcgcauccacaccggcgagaagcccuacaagugcgaggagugcggccgcgccuucucccaguccuccacccucaccgcccacaagaucauccacgccggcgagaagcccuacaagugcgaggagugcggcaaggccuucucccaguccuccacccucaccacccacaagaucauccacaccggcgagaaguucuacaagugcgaggagugcggcaaggccuucucccagcucucccaccucaccacccacaagcgcauccacuccggcgagaagcccuacaagugcgaggagugcggcaaggccuucaagcaguccuccacccucaccacccacaagcgcauccacgccggcgagaaguucuacaagugcgaggucugcuccaaggccuucucccgcuucucccaccucaccacccacaagcgcauccacaccggcgagaagcccuacaagugcgaggagugcggcaaggccuucaaccucuccucccagcucaccacccacaagaucauccacaccggcgagaagcccuacaagugcgaggagugcggcaaggccuucaaccaguccuccacccucuccaagcacaaggucauccacaccggcgagaagcccuacaaguacgaggagugcggcaaggccuucaaccaguccucccaccucaccacccacaagaugauccacaccggcgagaagcccuacaagugcgaggagugcggcaaggccuucaacaacuccuccauccucaaccgccacaagaugauccacaccggcgagaagcucuacaagcccgaguccugcaacaacgccugcgacaacaucgccaagaucuccaaguacaagcgcaacugcgccggcgagaaguga

SEQ ID NO: 52124 - RNA, 1764 nt, Artificial Sequence
  derived and/or modified sequence opt2 from ZNF496__Homo_sapiens__NP_116141
augcccaccgcccucugcccccgcguccucgcccccaaggaguccgaggagccccgcaagaugcgcuccccccccggcgagaaccccuccccccagggcgagcuccccucccccgaguccucccgccgccucuuccgccgcuuccgcuaccaggaggccgccggcccccgcgaggcccuccagcgccucugggaccucugcggcggcuggcuccgccccgagcgccacaccaaggagcagauccucgagcuccucguccucgagcaguuccucgccauccucccccgcgagauccaguccuggguccgcgcccaggagcccgaguccggcgagcaggccgucgccgccgucgaggcccucgagcgcgagcccggccgccccuggcaguggcucaagcacugcgaggaccccgucgucaucgacgacggcgacuccccccucgaccaggagcaggagcagcuccccgucgagccccacuccgaccucgccaagaaccaggacgcccagcccaucacccucgcccagugccucggccuccccucccgcccccccucccagcucuccggcgaccccguccuccaggacgccuuccuccuccaggaggagaacguccgcgacacccagcaggucaccacccuccagcucccccccucccgcgucucccccuucaaggacaugauccucugcuucuccgaggaggacuggucccuccucgaccccgcccagaccggcuucuacggcgaguucaucaucggcgaggacuacggcgucuccaugccccccaacgaccucgccgcccagcccgaccucucccagggcgaggagaacgagccccgcguccccgagcuccaggaccuccagggcaaggaggucccccaggucuccuaccucgacucccccucccuccagcccuuccaggucgaggagcgccgcaagcgcgaggagcuccagguccccgaguuccaggccugcccccagaccgucgucccccagaacaccuaccccgccggcggcaacccccgcucccucgagaacucccucgacgaggaggucaccaucgagaucguccucuccuccuccggcgacgaggacucccagcacggccccuacugcaccgaggagcucggcucccccaccgagaagcagcgcucccuccccgccucccaccgcuccuccaccgaggccggcggcgagguccagaccuccaagaaguccuacgucugccccaacugcggcaagaucuuccgcuggcgcgucaacuucauccgccaccuccgcucccgccgcgagcaggagaagccccacgagugcuccgucugcggcgagcucuucuccgacuccgaggaccucgacggccaccucgagucccacgaggcccagaagcccuaccgcugcggcgccugcggcaaguccuuccgccucaacucccaccuccucucccaccgccgcauccaccuccagcccgaccgccuccagcccgucgagaagcgcgagcaggccgccuccgaggacgccgacaagggccccaaggagccccucgagaacggcaaggccaagcucuccuuccagugcugcgagugcggcaaggccuuccagcgccacgaccaccucgcccgccaccgcucccacuuccaccucaaggacaaggcccgccccuuccagugccgcuacugcgucaaguccuucacccagaacuacgaccuccuccgccacgagcgccuccacaugaagcgccgcuccaagcaggcccucaacuccuacuga

SEQ ID NO: 52125 - RNA, 816 nt, Artificial Sequence
  derived and/or modified sequence opt2 from ZNF501__Homo_sapiens__NP_659481
augaacuccucccagaucucccuccgcaugaagcacggccgcgucaacaugcagaagaagcccuccaagugcuccgagugcggcaaguucuucacccagcgcuccucccucacccagcaccagcgcauccaccgcggcgagaagcccuacgucugcuccgagugcggcuccugcuuccgcaagcaguccaaccucacccagcaccuccgcauccacaccggcgagaagcccuacaagugcaacgagugcgagaaggccuuccagaccaaggccauccucguccagcaccuccgcauccacaccggcgagaagcccuacaagugcaacgagugcggcaaggccuucugccagucccccucccucaucaagcaccagcgcauccacaccggcgagaagcccuacaagugcaccgagugcggcaaggccuucucccaguccaucugccucacccgccaccagcgcucccacuccggcgacaagcccuucaagugcaacgagugcggcaaggccuucaaccaguccgccugccucaugcagcaccagcgcauccacuccggcgagaagcccuacaccugcaccgagugcggcaaggccuucacccagaacuccucccucgucgagcacgagcgcacccacaccggcgagaagcucuacaagugcuccgagugcgagaagaccuuccgcaagcaggcccaccucuccgagcacuaccgcauccacaccggcgagaagcccuacgagugcgucggcugcggcaaguccuuccgccacuccuccgcccuccuccgccaccagcgccuccacgccggcgaguga

SEQ ID NO: 52126 - RNA, 2862 nt, Artificial Sequence
  derived and/or modified sequence opt2 from ZNF507__Homo_sapiens__NP_001129628
auggaggaguccuccuccgucgccaugcucguccccgacaucggcgagcaggaggccauccucaccgccgaguccaucaucucccccucccucgagaucgacgagcagcgcaagaccaagcccgacccccucauccacgucauccagaagcucuccaagaucgucgagaacgagaagucccagaagugccuccucaucggcaagaagcgcccccgcuccuccgccgccacccacucccucgagacccaggagcucugcgagauccccgccaaggucauccagucccccgccgccgacacccgccgcgccgagaugucccagaccaacuucacccccgacacccucgcccagaacgagggcaaggccauguccuaccagugcucccucugcaaguuccucuccuccuccuucuccguccucaaggaccacaucaagcagcacggccagcagaacgaggucauccucaugugcuccgagugccacaucaccucccgcucccaggaggagcucgaggcccacgucgucaacgaccacgacaacgacgccaacauccacacccaguccaaggcccagcagugcgucucccccuccuccucccucugccgcaagaccaccgagcgcaacgagaccauccccgacauccccgucuccgucgacaaccuccagacccacaccguccagaccgccuccgucgccgagaugggccgccgcaagugguacgccuacgagcaguacggcauguaccgcugccucuucugcuccuacaccugcggccagcagcgcaugcucaagacccacgccuggaagcacgccggcgaggucgacugcuccuaccccaucuucgagaacgagaacgagccccucggccuccucgacuccuccgccgccgccgcccccggcggcgucgacgccgucgucaucgccaucggcgaguccgagcucuccauccacaacggccccuccguccagguccagaucugcuccuccgagcagcucuccuccuccuccccccucgagcaguccgccgagcgcggcguccaccucucccaguccgucacccucgaccccaacgaggaggagaugcucgaggucaucuccgacgccgaggagaaccucauccccgacucccuccucaccuccgcccagaagaucaucuccuccucccccaacaagaagggccacgucaacgucaucgucgagcgccuccccuccgccgaggagacccucucccagaagcgcuuccucaugaacaccgagauggaggagggcaaggaccucucccucaccgaggcccagaucggccgcgagggcauggacgacgucuaccgcgccgacaagugcaccgucgacaucggcggccucaucaucggcugguccuccuccgagaagaaggacgagcucaugaacaagggccucgccaccgacgagaacgccccccccggccgccgccgcaccaacuccgagucccuccgccuccacucccucgccgccgaggcccucgucaccaugcccauccgcgccgccgagcucacccgcgccaaccucggccacuacggcgacaucaaccuccucgaccccgacaccucccagcgccaggucgacuccacccucgccgccuacuccaagaugauguccccccucaagaacuccuccgacggccucaccucccucaaccaguccaacuccacccucgucgcccuccccgagggccgccaggagcucuccgacggccaggucaagaccggcaucuccaugucccuccucaccgucaucgagaagcuccgcgagcgcaccgaccagaacgccuccgacgacgacauccucaaggagcuccaggacaacgcccagugccagcccaacuccgacaccucccucuccggcaacaacgucgucgaguacauccccaacgccgagcgccccuaccgcugccgccucugccacuacaccuccggcaacaagggcuacaucaagcagcaccuccgcguccaccgccagcgccagcccuaccagugccccaucugcgagcacaucgccgacaacuccaaggaccucgagucccacaugauccaccacugcaagacccgcaucuaccagugcaagcagugcgaggaguccuuccacuacaagucccagcuccgcaaccacgagcgcgagcagcacucccuccccgacacccucuccaucgccaccuccaacgagccccgcaucuccuccgacaccgccgacggcaagugcguccaggagggcaacaaguccuccguccagaagcaguaccgcugcgacgucugcgacuacaccuccaccaccuacgucggcguccgcaaccaccgccgcauccacaacuccgacaagcccuaccgcugcucccucugcggcuacgucugcucccacccccccucccucaagucccacauguggaagcacgccuccgaccagaacuacaacuacgagcaggucaacaaggccaucaacgacgccaucucccaguccggccgcguccucggcaagucccccggcaagacccagcucaaguccuccgaggaguccgccgaccccgucaccggcuccuccgagaacgccgucuccuccuccgagcucaugucccagacccccuccgagguccucggcaccaacgagaacgagaagcucucccccaccuccaacaccuccuacucccucgagaagaucuccucccucgccccccccuccauggaguacugcguccuccucuucugcugcugcaucugcggcuucgaguccaccuccaaggagaaccuccucgaccacaugaaggagcacgagggcgagaucgucaacaucauccucaacaaggaccacaacaccgcccucaacaccaacuga

SEQ ID NO: 52127 - RNA, 2679 nt, Artificial Sequence
  derived and/or modified sequence opt2 from ZNF512B__Homo_sapiens__NP_065764
augaccgaccccuucugcgucggcggccgccgccuccccggcuccuccaaguccggccccggcaaggacggcucccgcaaggagguccgccuccccaugcuccacgacccccccaagaugggcaugcccgucguccgcggcggccagaccguccccggccaggccccccucugcuucgaccccggcucccccgccuccgacaagaccgagggcaagaagaagggccgccccaaggccgagaaccaggcccuccgcgacaucccccucucccucaugaacgacuggaaggacgaguucaaggcccacucccgcgucaagugccccaacuccggcugcuggcucgaguuccccuccaucuacggccucaaguaccacuaccagcgcugccagggcggcgccaucuccgaccgccucgccuuccccugccccuucugcgaggccgccuucaccuccaagacccagcucgagaagcaccgcaucuggaaccacauggaccgcccccuccccgccuccaagcccggccccaucucccgccccgucaccaucucccgccccgucggcgucuccaagcccaucggcgucuccaagcccgucaccaucggcaagcccgucggcgucuccaagcccaucggcaucuccaagcccgucuccgucggccgccccaugcccgucaccaaggccauccccgucacccgccccguccccgucaccaagcccgucaccgucucccgccccaugcccgucaccaaggccaugcccgucaccaagcccaucaccgucaccaaguccguccccgucaccaagcccguccccgucaccaagcccaucaccgucaccaagcucgucaccgucaccaagcccguccccgucaccaagcccgucaccgucucccgccccaucgucgucuccaagcccgucaccgucucccgccccaucgccaucucccgccacaccccccccugcaagaugguccuccucacccgcuccgagaacaaggccccccgcgccaccggccgcaacuccggcaagaagcgcgccgccgacucccucgacaccugccccaucccccccaagcaggcccgccccgagaacggcgaguacggccccuccuccaugggccaguccuccgccuuccagcucuccgccgacaccuccuccggcucccucucccccggcucccgccccuccggcggcauggaggcccucaaggccgccggccccgccuccccccccgaggaggaccccgagcgcaccaagcaccgccgcaagcagaagacccccaagaaguucaccggcgagcagcccuccaucuccggcaccuucggccucaagggccucgucaaggccgaggacaaggcccgcguccaccgcuccaagaagcaggagggccccggccccgaggacgcccgcaagaagguccccgccgcccccaucaccgucuccaaggaggcccccgcccccgucgcccaccccgcccccggcggccccgaggagcaguggcagcgcgccauccacgagcgcggcgaggccgucugccccaccugcaacgucgucacccgcaagacccucgucggccucaagaagcacauggaggucugccagaagcuccaggacgcccucaagugccagcacugccgcaagcaguucaaguccaaggccggccucaacuaccacaccauggccgagcacuccgccaagcccuccgacgccgaggccuccgagggcggcgagcaggaggagcgcgagcgccuccgcaagguccucaagcagaugggccgccuccgcugcccccaggagggcugcggcgccgccuucuccucccucaugggcuaccaguaccaccagcgccgcugcggcaagccccccugcgaggucgacucccccuccuuccccugcacccacugcggcaagaccuaccgcuccaaggccggccacgacuaccacguccgcuccgagcacaccgcccccccccccgaggagcccaccgacaagucccccgaggccgaggacccccucggcgucgagcgcacccccuccggccgcguccgccgcaccuccgcccaggucgccgucuuccaccuccaggagaucgccgaggacgagcucgcccgcgacuggaccaagcgccgcaugaaggacgaccucguccccgagaccgcccgccucaacuacacccgccccggccuccccacccucaacccccagcuccucgaggccuggaagaacgaggucaaggagaagggccacgucaacugccccaacgacugcugcgaggccaucuacuccuccgucuccggccucaaggcccaccucgccuccugcuccaagggcgcccaccucgccggcaaguaccgcugccuccucugccccaaggaguucuccuccgaguccggcgucaaguaccacauccucaagacccacgccgagaacugguuccgcaccuccgccgaccccccccccaagcaccgcucccaggacucccucguccccaagaaggagaagaagaagaaccucgccggcggcaagaagcgcggccgcaagcccaaggagcgcacccccgaggagcccgucgccaagcuccccccccgccgcgacgacuggccccccggcugccgcgacaagggcgcccgcggcuccaccggccgcaaggucggcgucuccaaggcccccgagaaguga

SEQ ID NO: 52128 - RNA, 1617 nt, Artificial Sequence
  derived and/or modified sequence opt2 from ZNF512__Homo_sapiens__NP_001258215
auguccucccgccucggcgccguccccgccaccuccggccccaccaccuucaagcagcagcgcuccacccgcaucgucggcgccaagaaccgcacccagugcuccaucaaggacaacuccuuccaguacaccaucccccacgacgacucccucuccggcuccuccuccgccuccuccugcgagcccgucuccgacuuccccgccuccuuccgcaaguccaccuacuggaugaagaugcgccgcaucaagcccgccgccaccucccacgucgagggcuccggcggcgucuccgccaagggcaagcgcaagccccgccaggaggaggacgaggacuaccgcgaguucccccagaagaagcacaagcucuacggcucccucgaggagcagugguaccucgagaucgucgacaagggcuccgucuccugccccaccugccaggccgucggccgcaagaccaucgagggccucaagaagcacauggagaacugcaagcaggagauguucaccugccaccacugcggcaagcagcuccgcucccucgccggcaugaaguaccacgucauggccaaccacaacucccuccccauccucaaggccggcgacgagaucgacgagcccuccgagcgcgagcgccuccgcaccguccucaagcgccucggcaagcuccgcugcaugcgcgaguccugcuccuccuccuucaccuccaucaugggcuaccucuaccacguccgcaagugcggcaagggcgccgccgagcucgagaagaugacccucaagugccaccacugcggcaagcccuaccgcuccaaggccggccucgccuaccaccuccgcuccgagcacggccccaucuccuucuuccccgaguccggccagcccgagugccucaaggagaugaaccucgaguccaaguccggcggccgcguccagcgccgcuccgccaagaucgccgucuaccaccuccaggagcucgccuccgccgagcucgccaaggaguggcccaagcgcaagguccuccaggaccucguccccgacgaccgcaagcucaaguacacccgccccggccuccccaccuucucccaggagguccuccacaaguggaagaccgacaucaagaaguaccaccgcauccagugccccaaccagggcugcgaggccgucuacuccuccgucuccggccucaaggcccaccucggcuccugcacccucggcaacuucgucgccggcaaguacaagugccuccucugccagaaggaguucgucuccgaguccggcgucaaguaccacaucaacuccguccacgccgaggacugguucgucgucaaccccaccaccaccaaguccuucgagaagcucaugaagaucaagcagcgccagcaggaggaggagaagcgccgccagcagcaccgcucccgccgcucccuccgccgccgccagcagcccggcaucgagcuccccgagaccgagcucucccuccgcgucggcaaggaccagcgccgcaacaacgaggagcucgucgucuccgccuccugcaaggagcccgagcaggagcccguccccgcccaguuccagaaggucaagccccccaagaccaaccacaagcgcggccgcaaguga

SEQ ID NO: 52129 - RNA, 1440 nt, Artificial Sequence
  derived and/or modified sequence opt2 from ZNF513__Homo_sapiens__NP_001188388
augggcuucgagcgcgacuccgagggcgacucccucggcgcccgccccggccuccccuacggccucuccgacgacgaguccggcggcggccgcgcccucuccgccgaguccgaggucgaggagcccgcccgcggccccggcgaggcccgcggcgagcgccccggccccgccugccagcucugcggcggccccaccggcgagggccccugcugcggcgccggcggccccggcggcggcccccuccuccccccccgccuccucuacuccugccgccucugcaccuucgucucccacuacuccucccaccucaagcgccacaugcagacccacuccggcgagaagcccuuccgcugcggccgcugccccuacgccuccgcccagcucgucaaccucacccgccacacccgcacccacaccggcgagaagcccuaccgcugcccccacugccccuucgccugcuccucccucggcaaccuccgccgccaccagcgcacccacgccggcccccccaccccccccugccccaccugcggcuuccgcugcugcaccccccgccccgcccgcccccccucccccaccgagcaggagggcgccgucccccgccgccccgaggacgcccuccuccuccccgaccucucccuccacgucccccccggcggcgccuccuuccuccccgacugcggccagcuccgcggcgagggcgagggccucugcggcaccggcuccgagccccuccccgagcuccucuuccccuggaccugccgcggcugcggccaggagcucgaggagggcgagggcucccgccucggcgccgccaugugcggccgcugcaugcgcggcgaggccggcggcggcgccuccggcggcccccagggccccuccgacaagggcuucgccugcucccucugccccuucgccacccacuaccccaaccaccucgcccgccacaugaagacccacuccggcgagaagcccuuccgcugcgcccgcugccccuacgccuccgcccaccucgacaaccucaagcgccaccagcgcguccacaccggcgagaagcccuacaagugcccccucugccccuacgccugcggcaaccucgccaaccucaagcgccacggccgcauccacuccggcgacaagcccuuccgcugcucccucugcaacuacuccugcaaccaguccaugaaccucaagcgccacaugcuccgccacaccggcgagaagcccuuccgcugcgccaccugcgccuacaccaccggccacugggacaacuacaagcgccaccagaagguccacggccacggcggcgccggcggccccggccucuccgccuccgagggcugggcccccccccacuccccccccuccguccucuccucccgcggcccccccgcccucggcaccgccggcucccgcgccguccacaccgacuccuccuga

SEQ ID NO: 52130 - RNA, 3492 nt, Artificial Sequence
  derived and/or modified sequence opt2 from ZNF516__Homo_sapiens__NP_055458
auggaccgcaaccgcgaggccgagauggagcuccgccgcggccccucccccacccgcgccggccgcggccacgaggucgacggcgacaaggccaccugccacaccugcugcaucugcggcaaguccuuccccuuccaguccucccucucccagcacaugcgcaagcacaccggcgagaagcccuacaagugccccuacugcgaccaccgcgccucccagaagggcaaccucaagauccacauccgcucccaccgcaccggcacccucauccagggccacgagcccgaggccggcgaggccccccucggcgagaugcgcgccuccgagggccucgacgccugcgccucccccaccaaguccgccuccgccugcaaccgccuccucaacggcgccucccaggccgacggcgcccgcguccucaacggcgccucccaggccgacuccggccgcguccuccuccgcuccuccaagaagggcgccgagggcuccgccugcgcccccggcgaggccaaggccgccguccagugcuccuucugcaagucccaguucgagcgcaagaaggaccucgagcuccacguccaccaggcccacaagcccuucaagugccgccucugcuccuacgccacccuccgcgaggagucccuccucucccacaucgagcgcgaccacaucaccgcccagggccccggcuccggcgaggccugcgucgagaacggcaagcccgagcucucccccggcgaguuccccugcgaggucugcggccaggccuucucccagaccugguuccucaaggcccacaugaagaagcaccgcggcuccuucgaccacggcugccacaucugcggccgccgcuucaaggagcccugguuccucaagaaccacaugaaggcccacggccccaagaccggcuccaagaaccgccccaaguccgagcucgaccccaucgccaccaucaacaacgucguccaggaggaggucaucgucgccggccucucccucuacgaggucugcgccaagugcggcaaccucuucaccaaccucgacucccucaacgcccacaacgccauccaccgccgcgucgaggccucccgcacccgcgcccccgccgaggagggcgccgagggccccuccgacaccaagcaguucuuccuccagugccucaaccuccgccccuccgccgccggcgacuccugccccggcacccaggccggccgccgcgucgccgagcucgaccccgucaacuccuaccaggccuggcagcucgccacccgcggcaaggucgccgagcccgccgaguaccucaaguacggcgccugggacgaggcccucgccggcgacgucgccuucgacaaggaccgccgcgaguacguccucgucucccaggagaagcgcaagcgcgagcaggacgcccccgccgcccagggccccccccgcaagcgcgccuccggccccggcgaccccgcccccgccggccaccucgacccccgcuccgccgcccgccccaaccgccgcgccgccgccaccaccggccagggcaaguccuccgagugcuucgagugcggcaagaucuuccgcaccuaccaccagaugguccuccacucccgcguccaccgccgcgcccgccgcgagcgcgacuccgacggcgaccgcgccgcccgcgcccgcugcggcucccucuccgagggcgacuccgccucccagcccuccucccccggcuccgccugcgccgccgccgacucccccggcuccggccucgccgacgaggccgccgaggacuccggcgaggagggcgcccccgagcccgcccccggcggccagccccgccgcugcugcuucuccgaggaggucaccuccaccgagcucuccuccggcgaccagucccacaagaugggcgacaacgccuccgagcgcgacaccggcgaguccaaggccggcaucgccgccuccgucuccauccucgagaacuccucccgcgagaccucccgccgccaggagcagcaccgcuucuccauggaccucaagaugcccgccuuccaccccaagcaggagguccccguccccggcgacggcgucgaguuccccuccuccaccggcgccgagggccagaccggccaccccgccgagaagcucuccgaccuccacaacaaggagcacuccggcggcggcaagcgcgcccucgcccccgaccucaugccccucgaccucuccgcccgcuccacccgcgacgaccccuccaacaaggagaccgccuccucccuccaggccgcccucgucguccaccccugccccuacugcucccacaagaccuacuaccccgagguccucuggaugcacaagcgcaucuggcaccgcgucuccugcaacuccgucgccccccccuggauccagcccaacggcuacaaguccauccgcuccaaccucgucuuccucucccgcuccggccgcaccggccccccccccgcccucggcggcaaggagugccagccccuccuccucgcccgcuucacccgcacccagguccccggcggcaugcccggcuccaaguccggcuccuccccccucggcgucgucaccaaggccgccuccaugcccaagaacaaggagucccacuccggcggccccugcgcccucugggcccccggccccgacggcuaccgccagaccaagcccugccacggccaggagccccacggcgccgccacccagggcccccucgccaagccccgccaggaggccuccuccaagcccguccccgcccccggcggcggcggcuucucccgcuccgccacccccacccccaccgucaucgcccgcgccggcgcccagcccuccgccaacuccaagcccgucgagaaguucggcgucccccccgccggcgccggcuucgcccccaccaacaagcacuccgcccccgacucccucaaggccaaguucuccgcccagccccagggccccccccccgccaagggcgagggcggcgcccccccccuccccccccgcgagccccccuccaaggccgcccaggagcuccgcacccucgccaccugcgccgccggcucccgcggcgacgccgcccuccaggcccagcccggcgucgccggcgccccccccguccuccacuccaucaagcaggagcccgucgccgagggccacgagaagcgccucgacauccucaacaucuucaagaccuacauccccaaggacuucgccacccucuaccagggcuggggcgucuccggccccggccucgagcaccgcggcacccuccgcacccaggcccgccccggcgaguucgucugcaucgagugcggcaaguccuuccaccagcccggccaccuccgcgcccacaugcgcgcccacuccgucgucuucgaguccgacggcccccgcggcuccgagguccacaccaccuccgccgacgcccccaagcagggccgcgaccacuccaacaccggcaccguccagaccgucccccuccgcaagggcaccuga

SEQ ID NO: 52131 - RNA, 1623 nt, Artificial Sequence
  derived and/or modified sequence opt2 from ZNF519__Homo_sapiens__XP_011523906
auggagcuccucaccuuccgcgacgucgccaucgaguucucccccgaggaguggaagugccucgaccccgcccagcagaaccucuaccgcgacgucaugcucgagaacuaccgcaaccucgucucccucgccgucuacuccuacuacaaccagggcauccuccccgagcagggcauccaggacuccuucaagaaggccacccucggccgcuacggcuccugcggccucgagaacaucugccucuggaagaacugggaguccaucggcgagggcgagggccagaaggagugcuacaaccucugcucccaguaccucaccaccucccacaacaagcaccucaccgucaagggcgacaaggaguaccgcaucuuccagaagaagccccaguuccucuccgccgcccccaccgagcccugcauccccaugaacaaguaccagcacaaguuccucaaguccgucuucugcaacaagaaccagaucaacuucaaccacgacuccaacaucuccaagcaccacuccacccacuuccucgagaacuacuacaacugcaacgagugcgagaaggucuucuaccaguccuccaagcucaucuuccccgagaacauccacauccagaagaagcccuacaacuccaacgagugcggcgagaccuccgaccccuucuccaagcucacccagcaccagcgcaucuacaucggcgaguccucccagcgcugcaacaagaagugcaucaucgucuucucccagucccaccucaagggccacaagaucaucaacaccggcgagaaguccgucaaguacaaggagcgcggcaaggccuucacccgcggccuccaccucggccaccagaagauccacaccggcgagaagcccuacaagugcaagaagugcgacaaggccuucaacaaguccucccaccucgcccagcaccagcgcauccacaccggcgagaagcccuucaagugcaaggagugcggcaaggccuucaaccgcggcuccuaccucacccagcaccagcgcauccacaccggcgagcgcgccuucaagugcgaggagugcggcaaggccuucaaccgcggcuccuaccucacccagcaccagcgcauccacaccggcgagaagcccuuccgcugcaaggagugcggcaaggccuucaaccgcuccuccuacgucacccagcaccagcgcaugcacaccggcgagaagcccuucaagugcaaggagugcggcaaggccuucaaccgcgccucccaccucacccagcaccagcgcauccacaccggcgagaagcacuucaagugcaaggagugcggcaaggccuucaaccgcggcucccaccucacccgccaccagcgcauccacaccggcgagaaguccuucaagugcgaggagugcggcaaggccuucaucuggggcucccaccucacccagcaccagcgcguccacaccggcgagaaguucuucaagugcaaggagugcggcaaggccuucacccgcuccucccaccucacccagcaccagcgcauccacaccggcgagaagcccuucaagugcaaggagugcggcaaggccuucaaccgccgcuccacccucacccagcaccagaucauccacacccgcuga

SEQ ID NO: 52132 - RNA, 3936 nt, Artificial Sequence
  derived and/or modified sequence opt2 from ZNF521__Homo_sapiens__NP_056276
augucccgccgcaagcaggccaagccccgcucccucaaggaccccaacugcaagcucgaggacaagaccgaggacggcgaggcccucgacugcaagaagcgccccgaggacggcgaggagcucgaggacgaggccguccacuccugcgacuccugccuccaggucuucgagucccucuccgacaucaccgagcacaagaucaaccagugccagcucaccgacggcgucgacgucgaggacgaccccaccugcuccuggcccgccuccucccccuccuccaaggaccagaccucccccucccacggcgagggcugcgacuucggcgaggaggagggcggccccggccuccccuaccccugccaguucugcgacaaguccuucucccgccucuccuaccucaagcaccacgagcagucccacuccgacaagcuccccuucaagugcaccuacugcucccgccucuucaagcacaagcgcucccgcgaccgccacaucaagcuccacaccggcgacaagaaguaccacugcuccgagugcgacgccgccuucucccgcuccgaccaccucaagauccaccucaagacccacaccuccaacaagcccuacaagugcgccaucugccgccgcggcuuccucuccuccuccucccuccacggccacaugcagguccacgagcgcaacaaggacggcucccaguccggcucccgcauggaggacuggaagaugaaggacacccagaagugcucccagugcgaggagggcuucgacuuccccgaggaccuccagaagcacaucgccgagugccaccccgagugcucccccaacgaggaccgcgccgcccuccagugcgucuacugccacgagcucuucgucgaggagaccucccucaugaaccacauggagcagguccacuccggcgagaagaagaacuccugcuccaucugcuccgaguccuuccacaccgucgaggagcucuacucccacauggacucccaccagcagcccgaguccugcaaccacuccaacucccccucccucgucaccgucggcuacaccuccgucuccuccaccacccccgacuccaaccucuccgucgacuccuccaccauggucgaggccgccccccccauccccaagucccgcggccgcaagcgcgccgcccagcagacccccgacaugaccggccccuccuccaagcaggccaaggucaccuacuccugcaucuacugcaacaagcagcucuucuccucccucgccguccuccagauccaccucaagaccaugcaccucgacaagcccgagcaggcccacaucugccaguacugccucgagguccuccccucccucuacaaccucaacgagcaccucaagcagguccacgaggcccaggaccccggccucaucgucuccgccaugcccgccaucgucuaccagugcaacuucugcuccgaggucgucaacgaccucaacacccuccaggagcacauccgcugcucccacggcuucgccaaccccgccgccaaggacuccaacgccuucuucugcccccacugcuacaugggcuuccucaccgacuccucccucgaggagcacauccgccagguccacugcgaccucuccggcucccgcuucggcucccccguccucggcacccccaaggagcccgucgucgaggucuacuccugcuccuacugcaccaacucccccaucuucaacuccguccucaagcucaacaagcacaucaaggagaaccacaagaacaucccccucgcccucaacuacauccacaacggcaagaagucccgcgcccucuccccccucucccccgucgccaucgagcagaccucccucaagaugaugcaggccgucggcggcgcccccgcccgccccaccggcgaguacaucugcaaccagugcggcgccaaguacaccucccucgacuccuuccagacccaccucaagacccaccucgacaccguccuccccaagcucaccugcccccagugcaacaaggaguuccccaaccaggagucccuccucaagcacgucaccauccacuucaugaucaccuccaccuacuacaucugcgaguccugcgacaagcaguucaccuccgucgacgaccuccagaagcaccuccucgacaugcacaccuucgucuucuuccgcugcacccucugccaggaggucuucgacuccaaggucuccauccagcuccaccucgccgucaagcacuccaacgagaagaaggucuaccgcugcaccuccugcaacugggacuuccgcaacgagaccgaccuccagcuccacgucaagcacaaccaccucgagaaccagggcaagguccacaagugcaucuucugcggcgaguccuucggcaccgaggucgagcuccagugccacaucaccacccacuccaagaaguacaacugcaaguucugcuccaaggccuuccacgccaucauccuccucgagaagcaccuccgcgagaagcacugcgucuucgagaccaagacccccaacugcggcaccaacggcgccuccgagcagguccagaaggaggaggucgagcuccagacccuccucaccaacucccaggagucccacaacucccacgacggcuccgaggaggacgucgacaccuccgagcccauguacggcugcgacaucugcggcgccgccuacaccauggagacccuccuccagaaccaccagcuccgcgaccacaacauccgccccggcgaguccgccaucgucaagaagaaggccgagcucaucaagggcaacuacaagugcaacgucugcucccgcaccuucuucuccgagaacggccuccgcgagcacaugcagacccaccucggccccgucaagcacuacaugugccccaucugcggcgagcgcuuccccucccuccucacccucaccgagcacaaggucacccacuccaagucccucgacaccggcaacugccgcaucugcaagaugccccuccaguccgaggaggaguuccucgagcacugccagaugcaccccgaccuccgcaacucccucaccggcuuccgcugcgucgucugcaugcagaccgucaccuccacccucgagcucaagauccacggcaccuuccacaugcagaagaccggcaacggcuccgccguccagaccaccggccgcggccagcacguccagaagcucuacaagugcgccuccugccucaaggaguuccgcuccaagcaggaccucgucaagcucgacaucaacggccuccccuacggccucugcgccggcugcgucaaccucuccaaguccgccucccccggcaucaacgucccccccggcaccaaccgccccggccucggccagaacgagaaccucuccgccaucgagggcaagggcaaggucggcggccucaagacccgcugcuccuccugcaacgucaaguucgaguccgaguccgagcuccagaaccacauccagaccauccaccgcgagcucguccccgacuccaacuccacccagcucaagaccccccaggucucccccaugccccgcaucucccccucccaguccgacgagaagaagaccuaccagugcaucaagugccagauggucuucuacaacgagugggacauccagguccacgucgccaaccacaugaucgacgagggccucaaccacgagugcaagcucugcucccagaccuucgacucccccgccaagcuccagugccaccucaucgagcacuccuucgagggcaugggcggcaccuucaagugccccgucugcuucaccgucuucguccaggccaacaagcuccagcagcacaucuucuccgcccacggccaggaggacaagaucuacgacugcacccagugcccccagaaguucuucuuccagaccgagcuccagaaccacaccaugacccagcacuccuccuga

SEQ ID NO: 52133 - RNA, 3903 nt, Artificial Sequence
  derived and/or modified sequence opt2 from ZNF536__Homo_sapiens__NP_055532
auggaggaggccucccucugccucggcgucuccuccgccgagcccgaggccgagccccaccucuccggccccguccucaacggccaguacgccaugucccagaagcuccaccagaucaccucccagcucucccacgccuuccccgagcuccacccccgccccaaccccgaggagaagccccccgccucccucgaggagaaggcccacguccccauguccggccagcccaugggcucccagauggcccuccucgccaaccagcucggccgcgaggucgacaccucccucaacggccgcgucgaccuccagcaguuccucaacggccagaaccucggcaucaugucccagauguccgacaucgaggacgacgcccgcaagaaccgcaaguaccccugcccccucugcggcaagcgcuuccgcuucaacuccauccucucccuccacaugcgcacccacaccggcgagaagcccuucaagugccccuacugcgaccaccgcgccgcccagaagggcaaccucaagauccaccuccgcacccacaagcucggcaaccucggcaagggccgcggccgcguccgcgaggagaaccgccuccuccacgagcucgaggagcgcgccauccuccgcgacaagcagcucaagggcucccuccuccagccccgccccgaccucaagccccccccccacgcccagcaggccccccucgccgccugcacccucgcccuccaggccaaccacuccguccccgacgucgcccaccccguccccucccccaagcccgccuccguccaggaggacgccgucgcccccgccgccggcuuccgcugcaccuucugcaagggcaaguucaagaagcgcgaggagcucgaccgccacauccgcauccuccacaagcccuacaagugcacccucugcgacuucgccgccucccaggaggaggagcucaucucccacgucgagaaggcccacaucaccgccgaguccgcccagggccagggccccaacggcggcggcgagcaguccgccaacgaguuccgcugcgaggucugcggccaggucuucucccaggccugguuccucaagggccacaugcgcaagcacaaggacuccuucgagcacugcugccagaucugcggccgccgcuucaaggagcccugguuccucaagaaccacaugaagguccaccucaacaagcucuccgucaagaacaagucccccuccgaccccgagguccccguccccaugggcggcaugucccaggaggcccacgccaaccucuacucccgcuaccucuccugccuccaguccggcuucaugacccccgacaaggccggccucuccgagcccucccagcucuacggcaagggcgagcuccccaugaaggagaaggaggcccucggcaagcuccucucccccaucuccuccauggcccacggcguccccgagggcgacaagcacucccuccucggcugccucaaccucguccccccccucaaguccuccugcaucgagcgccuccaggccgccgccaaggccgccgagauggaccccgucaacuccuaccaggccuggcagcucauggcccgcggcauggccauggagcacggcuuccucuccaaggagcacccccuccagcgcaaccacgaggacacccucgccaacgccggcguccucuucgacaaggagaagcgcgaguacguccucgucggcgccgacggcuccaagcagaagaugcccgccgaccucguccacuccaccaaggucggcucccagcgcgaccuccccuccaagcucgacccccucgaguccucccgcgacuuccucucccacggccucaaccagacccucgaguacaaccuccagggccccggcaacaugaaggagaagcccaccgagugccccgacugcggccgcgucuuccgcaccuaccaccaggucgucguccacucccgcguccacaagcgcgaccgcaagggcgaggaggacggccuccacgucggccucgacgagcgccgcggcuccggcuccgaccaggagucccaguccgucucccgcuccaccacccccggcuccuccaacgucaccgaggaguccggcgucggcggcggccucucccagaccggcuccgcccaggaggacuccccccaccccuccucccccuccuccuccgacaucggcgaggaggccggccgcuccgccggcguccagcagcccgcccuccuccgcgaccgcucccucggcuccgccaugaaggacugccccuacugcggcaagaccuuccgcaccucccaccaccucaagguccaccuccgcauccacaccggcgagaagcccuacaagugcccccacugcgacuacgccggcacccaguccgccucccucaaguaccaccucgagcgccaccaccgcgagcgccagaacggcgccggcccccucuccggccagccccccaaccaggaccacaaggacgagauguccuccaaggccucccucuucauccgccccgacauccuccgcggcgccuucaagggccuccccggcaucgacuuccgcggcggccccgccucccagcaguggaccuccggcguccucuccuccggcgaccacuccggccaggccaccggcauguccuccgagguccccuccgacgcccucaagggcaccgaccuccccuccaaguccacccacuucuccgagaucggccgcgccuaccaguccaucgucuccaacggcgucaacuuccagggcucccuccaggccuucauggacuccuucguccucuccucccucaagaaggagaaggacaugaaggacaaggcccucgccgacccccccuccaugaagguccacggcgucgacggcggcgaggagaagcccuccggcaaguccucccagcgcaaguccgagaagucccaguacgagccccucgaccucuccguccgccccgacgccgccucccuccccggcuccuccgucaccguccaggacuccaucgccuggcacggcugccucuucugcgccuucaccaccuccuccauggagcucauggcccuccaccuccaggccaaccaccucggcaaggccaagcgcaaggacaacaccaucggcgucaccgucaacugcaaggaccaggcccgcgaggccuccaagauggcccuccuccccucccuccaguccaacaaggaccucggccucuccaacaugaucuccucccucgacuccgccuccgagaagauggcccagggccagcucaaggagacccucggcgagcagaaguccggcgccuggaccggccacgucgaccccgccuucugcaacuuccccuccgacuucuacaagcaguucggcgucuaccccggcauggucggcuccggcgccuccuccuccugccccaacaaggagcccgacggcaaggcccacuccgaggaggacguccccauccucauccccgagaccaccuccaagaacaccaccgacgaccucuccgacaucgccuccuccgaggacauggacuccuccaagggcgagaacaacgacgaggaggacgucgagaccgagcccgagaugaugaccaagccccucuccgcccucuccaaggacuccuccuccgacggcggcgacucccuccagcccaccggcaccucccagcccguccagggccucgucuccccccucucccaggcccccgagaagcaguggcacucccagggccuccuccaggcccaggacccccucgccggccuccccaagcccgagcgcggcccccagucccucgacaagcccaugaacaugcucuccguccuccgcgccuacuccuccgacggccucgccgccuucaacggccucgccuccuccaccgccaacuccggcugcaucaagcgccccgaccucugcggcaaguga

SEQ ID NO: 52134 - RNA, 1884 nt, Artificial Sequence
  derived and/or modified sequence opt2 from ZNF555__Homo_sapiens__NP_001166246
auggacuccgucgucuucgaggacgucgccgucgacuucacccucgaggagugggcccuccucgacuccgcccagcgcgaccucuaccgcgacgucaugcucgagaccuuccagaaccucgccuccgucgacgacgagacccaguucaaggccuccggcuccgucucccagcaggacaucuacggcgagaagauccccaaggaguccaagaucgccaccuucacccgcaacgucuccugggccuccguccucggcaagaucugggacucccucuccaucgaggaccagaccaccaaccagggccgcaaccuccgcaaccacggccucgagcgccucugcgaguccaacgaccagugcggcgaggcccucucccagaucccccaccucaaccucuacaagaagaucccccccggcgucaagcaguacgaguacaacaccuacggcaaggucuucaugcaccgccgcaccucccucaagucccccaucaccguccacaccggccacaagcccuaccagugccaggagugcggccaggccuacuccugccgcucccaccuccgcaugcacguccgcacccacaacggcgagcgccccuacgucugcaagcucugcggcaagaccuucccccgcaccuccucccucaaccgccacguccgcauccacaccgccgagaagaccuacgagugcaagcagugcggcaaggccuucaucgacuucuccucccucaccucccaccuccgcucccacaccggcgagaagcccuacaagugcaaggagugcggcaaggccuucuccuacuccuccaccuuccgccgccacaccaucacccacaccggcgagaagcccuacaagugcaaggagugcgccgaggccuucuccuacuccuccaccuuccgccgccacaugaucucccacaccggcgagaagccccacaagugcaaggagugcggcgaggccuucuccuacuccuccgccuuccgccgccacaugaucacccacaccggcgagaagcccuacgagugcaagcagugcggcaagaccuucaucuaccuccaguccuuccgccgccacgagcgcauccacaccggcgagaagcccuacgagugcaagcagugcggcaagaccuucaucuacccccaguccuuccgccgccacgagcgcacccacggcggcgagaagcccuacgagugcaaccagugcggcaaggccuucucccaccccuccuccuuccgcggccacaugcgcguccacaccggcgagaagcccuacgagugcaagcagugcggcaagaccuucaacuggcccaucucccuccgcaagcacaugcgcacccacacccgcgagaagcccuacgagugcaagcagugcggcaaggccuucucccucuccgccugcuuccgcgagcacguccgcaugcaccccgaggacaaguccuacgagugcaagcucugcggcaaggccuucuacugccacaucucccuccagaagcacaugcgccgccacaccgccgagaagcucuacaagugcaagcagugcggcaaggccuucuccuggcccgagcuccuccagcagcacguccgcacccacaccgucgagaagcccuacgagugcaaggagugcggcaaggucuucaaguggcccuccucccuccccauccacaugcgccuccacaccggcgagaagcccuaccagugcaagcacugcggcaaggccuucaacugcuccuccucccuccgccgccacguccgcauccacaccaccgagaagcaguacaagugcaacgucggccacccccccgccaacgaguucaugugcuccgccuccgagaagucccaccaggagcgcgaccucaucaaggucgucaacaugguccucccccucuga

SEQ ID NO: 52135 - RNA, 1809 nt, Artificial Sequence
  derived and/or modified sequence opt2 from ZNF559__Homo_sapiens__NP_001189335
augcgcaucaccgccgccauccucaccgcccgcucccgcuggcgccuccgcaacuccaucuccgccuuccucuucaccgucaccuucgccuggugcccccccggccucuccaaccucaccauccucuccugccccgaccaccucucccaggacgucuucugccuccacgaguccaaguucgaggaggagcgcauggucgccggcuggcucaccaacuacucccaggacuccgucaccuucgaggacgucgccgucgacuucacccaggaggaguggacccuccucgaccagacccagcgcaaccucuaccgcgacgucaugcucgagaacuacaagaaccucgucgccgucgacugggagucccacaucaacaccaagugguccgccccccagcagaacuuccuccagggcaagaccuccuccgucgucgagauggagcgcaaccacuucggcgaggagcucuucgacuucaaccagugcgagaaggcccucuccgagcacuccugccucaagacccaccgccgcaccuacuuccgcaagaagaccugcgagugcaaccagugcgagaaggccuuccgcaagcccuccaucuucacccuccacaagaagaccgacaucggcgaggagcuccccaacugcaaccagugcgagaccgccuucucccagcaccuccaccucgucugcaagaagaccucccagaaccuccaccucgucugcaagaagacccacacccaggagaagcccuacaagugcuccgacugcgagaagggccuccccuccuccucccaccuccgcgagugcguccgcaucuacggcggcgagcgccccuacacccacaaggaguacgucgagaccuucucccacuccaccgcccucuucguccacaugcagacccaggacggcgagaaguucuacgagugcaaggccugcggcaagcccuucaccgaguccuccuaccucacccagcaccuccgcacccacucccgcguccuccccaucgagcacaagaaguucggcaaggccuucgccuucucccccgaccucgccaagcacauccgccuccgcacccgcggcaagcacuacgucugcaacgagugcggcaaggaguucaccugcuucuccaagcucaacauccacauccgcguccacaccggcgagaagcccuacgagugcaacaagugcggcaaggccuucaccgacuccuccggccucaucaagcaccgccgcacccacaccggcgagaagcccuacgagugcaaggagugcggcaaggccuucgccaacuccucccaccucaccguccacaugcgcacccacaccggcgagaagcccuaccagugcaaggagugcggcaaggccuucaucaacuccuccuccuucaagucccacaugcagacccaccccggcgucaagcccuacgacugccagcagugcggcaaggccuucauccgcuccuccuuccucauccgccaccuccgcucccacuccgccgagcgccccuucgagugcgaggagugcggcaaggccuuccgcuacuccucccaccucucccagcacaagcgcauccacaccggcgagcgccccuacaagugccagaagugcggccaggccuucuccaucuccuccggccucaccguccacaugcgcacccacaccggcgagcgccccuucgagugccaggagugcggcaaggccuucacccgcuccaccuaccucauccgccaccuccgcucccacuccgucgagaagcccuacaaggagugcggccagaccuucuccaacuccuccugccucaccgagugcgucuga

SEQ ID NO: 52136 - RNA, 1743 nt, Artificial Sequence
  derived and/or modified sequence opt2 from ZNF568__Homo_sapiens__NP_001191766
augaagcccgcccagcgcaaccucuaccgcgacgucaugcucgagaacuacuccaaccucgucaccgucggcugccaggucaccaagcccgacgucaucuucaagcucgagcaggaggaggagcccugggucauggaggaggagauguucggccgccacugccccgaggucugggaggucgacgagcagaucaagaagcagcaggagacccucguccgcaaggucaccuccaucuccaagaagauccucaucaaggagaaggucaucgagugcaagaaggucgccaagaucuucccccucuccuccgacaucgucaccucccgccaguccuucuacgacugcgacucccucgacaagggccucgagcacaaccucgaccuccuccgcuacgagaagggcugcguccgcgagaagcaguccaacgaguucggcaagcccuucuaccacugcgccuccuacgucgucacccccuucaagugcaaccagugcggccaggacuucucccacaaguucgaccucauccgccacgagcgcauccacgccggcgagaagcccuacgagugcaaggagugcggcaaggccuucucccgcaaggagaaccucaucacccaccagaagauccacaccggcgagaagcccuacaagugcaacgagugcggcaaggccuucauccagauguccaaccucauccgccaccaccgcauccacaccggcgagaagcccuacgccugcaaggacugcuggaaggccuucucccagaaguccaaccucaucgagcacgagcgcauccacaccggcgagaagcccuacgagugcaaggagugcggcaaguccuucucccagaagcagaaccucaucgagcacgagaagauccacaccggcgagaagcccuacgccugcaacgagugcggccgcgccuucucccgcauguccuccgucacccuccacaugcgcucccacaccggcgagaagcccuacaagugcaacaagugcggcaaggccuucucccagugcuccgucuucaucauccacaugcgcucccacaccggcgagaagcccuacgucugcuccgagugcggcaaggccuucucccaguccuccucccucaccguccacaugcgcaaccacaccgccgagaagcccuacgagugcaaggagugcggcaaggccuucucccgcaaggagaaccucaucacccaccagaagauccacaccggcgagaagcccuacgagugcuccgagugcggcaaggccuucauccagauguccaaccucauccgccaccagcgcauccacaccggcgagaagcccuacgccugcaccgucugcggcaaggccuucucccagaaguccaaccucaccgagcacgagaagauccacaccggcgagaagcccuaccacugcaaccagugcggcaaggccuucucccagcgccagaaccuccucgagcacgagaagauccacaccggcgagaagcccuucaagugcaacgagugcggcaaggccuucucccgcaucuccucccucacccuccacguccgcucccacaccggcgagaagcccuacgagugcaacaagugcggcaaggccuucucccagugcucccuccucaucauccacaugcgcucccacaccggcgagaagcccuucgagugcaacgagugcggcaaggccuucucccagcgcgccucccucuccauccacaagcgcggccacaccggcgagcgccaccaggucuacuga

SEQ ID NO: 52137 - RNA, 2061 nt, Artificial Sequence
  derived and/or modified sequence opt2 from ZNF569__Homo_sapiens__NP_689697
augaccgagucccagggcaccgucaccuucaaggacgucgccaucgacuucacccaggaggaguggaagcgccucgaccccgcccagcgcaagcucuaccgcaacgucaugcucgagaacuacaacaaccucaucaccgucggcuaccccuucaccaagcccgacgucaucuucaagcucgagcaggaggaggagcccugggucauggaggaggagguccuccgccgccacuggcagggcgagaucuggggcgucgacgagcaccagaagaaccaggaccgccuccuccgccaggucgaggucaaguuccagaagacccucaccgaggagaagggcaacgagugccagaagaaguucgccaacgucuucccccucaacuccgacuucuuccccucccgccacaaccucuacgaguacgaccucuucggcaagugccucgagcacaacuucgacugccacaacaacgucaagugccucaugcgcaaggagcacugcgaguacaacgagcccgucaaguccuacggcaacuccuccucccacuucgucaucacccccuucaagugcaaccacugcggcaagggcuucaaccagacccucgaccucauccgccaccuccgcauccacaccggcgagaagcccuacgagugcuccaacugccgcaaggccuucucccacaaggagaagcucaucaagcacuacaagauccacucccgcgagcaguccuacaagugcaacgagugcggcaaggccuucaucaagauguccaaccucauccgccaccagcgcauccacaccggcgagaagcccuacgccugcaaggagugcgagaaguccuucucccagaaguccaaccucaucgaccacgagaagauccacaccggcgagaagcccuacgagugcaacgagugcggcaaggccuucucccagaagcagucccucaucgcccaccagaagguccacaccggcgagaagcccuacgccugcaacgagugcggcaaggccuucccccgcaucgccucccucgcccuccacaugcgcucccacaccggcgagaagcccuacaagugcgacaagugcggcaaggccuucucccaguucuccaugcucaucauccacguccgcauccacaccggcgagaagcccuacgagugcaacgagugcggcaaggccuucucccaguccuccgcccucaccguccacaugcgcucccacaccggcgagaagcccuacgagugcaaggagugccgcaaggccuucucccacaagaagaacuucaucacccaccagaagauccacacccgcgagaagcccuacgagugcaacgagugcggcaaggccuucauccagauguccaaccucguccgccaccagcgcauccacaccggcgagaagcccuacaucugcaaggagugcggcaaggccuucucccagaaguccaaccucaucgcccacgagaagauccacuccggcgagaagcccuacgagugcaacgagugcggcaaggccuucucccagaagcagaacuucaucacccaccagaagguccacaccggcgagaagcccuacgacugcaacgagugcggcaaggccuucucccagaucgccucccucacccuccaccuccgcucccacaccggcgagaagcccuacgagugcgacaagugcggcaaggccuucucccagugcucccuccucaaccuccacaugcgcucccacaccggcgagaagcccuacgucugcaacgagugcggcaaggccuucucccagcgcaccucccucaucguccacaugcgcggccacaccggcgagaagcccuacgagugcaacaagugcggcaaggccuucucccaguccuccucccucaccauccacauccgcggccacaccggcgagaagcccuucgacugcuccaagugcggcaaggccuucucccagaucuccucccucacccuccacaugcgcaagcacaccggcgagaagcccuaccacugcaucgagugcggcaaggccuucucccagaagucccaccucguccgccaccagcgcauccacacccacuga

SEQ ID NO: 52138 - RNA, 1281 nt, Artificial Sequence
  derived and/or modified sequence opt2 from ZNF577__Homo_sapiens__NP_001129062
augaagaacgccaccaucgucauguccguccgccgcgagcagggcuccuccuccggcgagggcucccucuccuucgaggacgucgccgucggcuucacccgcgaggaguggcaguuccucgaccagucccagaagguccucuacaaggaggucaugcucgagaacuacaucaaccucgucuccaucggcuaccgcggcaccaagcccgacucccucuucaagcucgagcagggcgagccccccggcaucgccgagggcgccgcccacucccagaucugccccggcggcaagccccacgagugcuccgucugcggccgcgccuucucccgcaaggcccagcucauccagcaccagcgcaccgagcgcggcgagaagccccacggcugcggcgagugcggcaagaccuucaugcgcaagauccagcucaccgagcaccagcgcacccacaccggcgagaagccccacgagugcuccgagugcggcaaggccuucucccgcaagucccagcucaugguccaccagcgcacccacaccggcgagaagcccuaccgcugcuccaagugcggcaaggccuucucccgcaagugccgccucaaccgccaccagcgcucccacaccggcgagaagcucuacggcugcuccgucugcggcaaggccuucucccagaaggccuaccucaccgcccaccagcgccuccacaccggcgacaagcccuacaagugcuccgacugcggccgcaccuucuacuucaaguccgaccucacccgccaccagcgcauccacaccggcgagaagcccuacgagugcuccgagugcgagaaggccuuccgcuccaaguccaagcucauccagcaccagcgcacccacaccggcgagcgccccuacuccugccgcgagugcggcaaggccuucgcccacauguccguccucaucaagcacgagaagacccacauccgcgagaccgccaucaacucccucaccgucgagaagcccuccucccgcucccacaccucccucuacauguccgagcucauccaggagcagaagaccgucaacaccguccccaucgagaugcccuccuccggcacccccccccuccucaacaaguccgagcgccucgucggccgcaacgucgucaucgucgagcagcccuucccccgcaaccaggccuucgucgucaaccaggaguucgagcagcgcaucucccucaccaacgaggucaacgucgcccccuccgucaucaacuacauccucuaccucaccgacaucgucuccgaguga

SEQ ID NO: 52139 - RNA, 519 nt, Artificial Sequence
  derived and/or modified sequence opt2 from ZNF580__Homo_sapiens__NP_057286
augcuccuccuccccccccgccccccccacccccgcuccuccucccccgaggccauggacccccccccccccaaggccccccccuuccccaaggccgagggccccuccuccacccccuccuccgccgccggcccccgccccccccgccucggccgccaccuccucaucgacgccaacggcguccccuacaccuacaccguccagcucgaggaggagccccgcggccccccccagcgcgaggccccccccggcgagcccggcccccgcaagggcuacuccugccccgagugcgcccgcgucuucgccuccccccuccgccuccagucccaccgcgucucccacuccgaccucaagcccuucaccugcggcgccugcggcaaggccuucaagcgcuccucccaccucucccgccaccgcgccacccaccgcgcccgcgccggccccccccacaccugcccccucugcccccgccgcuuccaggacgccgccgagcucgcccagcacguccgccuccacuga

SEQ ID NO: 52140 - RNA, 594 nt, Artificial Sequence
  derived and/or modified sequence opt2 from ZNF581__Homo_sapiens__XP_006723303
augcucguccuccccucccccugcccccagccccucgccuucuccuccgucgagaccauggagggccccccccgccgcaccugccgcucccccgagcccggccccuccuccuccaucggcuccccccaggccuccucccccccccgccccaaccacuaccuccucaucgacacccagggcguccccuacaccguccucgucgacgaggagucccagcgcgagcccggcgccuccggcgcccccggccagaagaagugcuacuccugccccgucugcucccgcgucuucgaguacauguccuaccuccagcgccacuccaucacccacuccgaggucaagcccuucgagugcgacaucugcggcaaggccuucaagcgcgccucccaccucgcccgccaccacuccauccaccucgccggcggcggccgcccccacggcugcccccucugcccccgccgcuuccgcgacgccggcgagcucgcccagcacucccgcguccacuccggcgagcgccccuuccagugcccccacugcccccgccgcuucauggagcagaacacccuccagaagcacacccgcuggaagcaccccuga

SEQ ID NO: 52141 - RNA, 1554 nt, Artificial Sequence
  derived and/or modified sequence opt2 from ZNF582__Homo_sapiens__NP_653291
augucccucggcuccgagcucuuccgcgacgucgccaucgucuucucccaggaggaguggcaguggcucgcccccgcccagcgcgaccucuaccgcgacgucaugcucgagaccuacuccaaccucgucucccucggccucgccgucuccaagcccgacgucaucuccuuccucgagcagggcaaggagcccuggauggucgagcgcgucgucuccggcggccucugccccguccucgagucccgcuacgacaccaaggagcucuuccccaagcagcacgucuacgaggucgaguccccccagugggagaucauggagucccucaccuccuacggccucgagugcuccuccuuccaggacgacugggagugccgcaaccaguucgaccgccagcagggcaaccccgaccgccacuuccaccagaugaucauccgccacgaggagaugcccaccuucgaccagcacgccucccucaccuucuaccagaagauccacacccgcgagaagcccuucggcuacaacaagugccgcaaggacuucuggcagaaggagcuccucaucaaccaccagggcaucuacaccaacgagaagcccuacaagugcaaggagugcggcaaggccuucaaguacggcucccgccucauccagcacgagaacauccacuccggcaagaagcccuacgagugcaaggagugcggcaaggccuucaacuccggcuccaacuucauccagcaccagcgcguccacaccggcgagaagcccuacgagugcaaggacugcgagaaggccuucucccgcuccucccagcucaucgagcaccagcgcacccacaccggcgagaagcccuaccagugcaaggagugcggcaaggccuucaaccgcaucucccaccucaagguccacuaccgcauccacaccggcgagaagcccuacgccugcaaggagugcggcaagaccuucucccaccgcucccagcucauccagcaccagaccguccacaccggccgcaagcucuacgagugcaaggagugcggcaaggccuucaaccagggcuccacccucauccgccaccagcgcauccacaccggcgagaagcccuacgagugcaaggucugcggcaaggccuuccgcgucuccucccagcucaagcagcaccagcgcauccacaccggcgagaagcccuaccagugcaaggucugcggccgcgccuucaagcgcgucucccaccucaccguccacuaccgcauccacaccggcgagaagcccuacgagugcaaggagugcggcaaggccuucucccacugcucccagcucauccaccaccaggucauccacaccgagaagaagcccuacgaguacaaggagugcgagaagacccucucccacgacuccaccaccguccagccccagcgcaugcacaaccgcgagacccacgucaacaucaucaacgucgagaagcccuccaucuccuccuacccccuccucaucauccgcgaguucaugcucgccuccaaccacaugaacggcuccaacggcgaguccccccucgccuga

SEQ ID NO: 52142 - RNA, 1710 nt, Artificial Sequence
  derived and/or modified sequence opt2 from ZNF583__Homo_sapiens__XP_011524819
auguccaaggaccucgucaccuucggcgacgucgccgucaacuucucccaggaggagugggaguggcucaaccccgcccagcgcaaccucuaccgcaaggucaugcucgagaacuaccgcucccucgucucccucggcgucuccgucuccaagcccgacgucaucucccuccucgagcagggcaaggagcccuggauggucaagaaggagggcacccgcggccccugccccgacugggaguacgucuucaagaacuccgaguucuccuccaagcaggagaccuacgaggaguccuccaaggucgucaccgucggcgcccgccaccucuccuacucccucgacuaccccucccuccgcgaggacugccaguccgaggacugguacaagaaccagcucggcucccaggagguccaccucucccagcucaucaucacccacaaggagauccuccccgagguccagaacaaggaguacaacaaguccuggcagaccuuccaccaggacaccaucuucgacauccagcaguccuuccccaccaaggagaaggcccacaagcacgagccccagaagaaguccuaccgcaagaaguccgucgagaugaagcaccgcaaggucuacgucgagaagaagcuccucaagugcaacgacugcgagaaggucuucaaccaguccuccucccucacccuccaccagcgcauccacaccggcgagaagcccuacgccugcgucgagugcggcaagaccuucucccaguccgccaaccucgcccagcacaagcgcauccacaccggcgagaagcccuacgagugcaaggagugccgcaaggccuucucccagaacgcccaccucgcccagcaccagcgcguccacaccggcgagaagcccuaccagugcaaggagugcaagaaggccuucucccagaucgcccaccucacccagcaccagcgcguccacaccggcgagcgccccuucgagugcaucgagugcggcaaggccuucuccaacggcuccuuccucgcccagcaccagcgcauccacaccggcgagaagcccuacgucugcaacgucugcggcaaggccuucucccaccgcggcuaccucaucguccaccagcgcauccacaccggcgagcgccccuacgagugcaaggagugccgcaaggccuucucccaguacgcccaccucgcccagcaccagcgcguccacaccggcgagaagcccuacgagugcaaggucugccgcaaggccuucucccagaucgccuaccucgaccagcaccagcgcguccacaccggcgagaagcccuacgagugcaucgagugcggcaaggccuucuccaacuccuccucccucgcccagcaccagcgcucccacaccggcgagaagcccuacaugugcaaggagugccgcaagaccuucucccagaacgccggccucgcccagcaccagcgcauccacaccggcgagaagcccuacgagugcaacgucugcggcaaggccuucuccuacuccggcucccucacccuccaccagcgcauccacaccggcgagcgccccuacgagugcaaggacugccgcaaguccuuccgccagcgcgcccaccucgcccaccacgagcgcauccacaccauggaguccuuccucacccucuccucccccucccccuccaccuccaaccagcucccccgccccgucggcuucaucuccuga

SEQ ID NO: 52143 - RNA, 2310 nt, Artificial Sequence
  derived and/or modified sequence opt2 from ZNF585B__Homo_sapiens__NP_689492
augcccgccuccuggaccuccccccagaaguccuccgcccucgcccccgaggaccacggcuccuccuacgagggcuccgucuccuuccgcgacgucgccaucgacuucucccgcgaggaguggcgccaccucgaccucucccagcgcaaccucuaccgcgacgucaugcucgagaccuacucccaccuccucuccgucggcuaccagguccccaagcccgaggucgucaugcucgagcagggcaaggagcccugggcccuccagggcgagcgcccccgccacuccugccccggcgagaagcucugggaccacaaccagcaccgcaagaucaucggcuacaagcccgccuccucccaggaccagaagaucuacuccggcgagaaguccuacgagugcgccgaguucggcaaguccuucaccuggaagucccaguucaagguccaccucaagguccccaccggcgagaagcucuacgucugcaucgagugcggccgcgccuucguccagaagcccgaguucaucacccaccagaagacccacaugcgcgagaagcccuacaagugcaacgagugcggcaaguccuucuuccaggucuccucccucuuccgccaccaccgcauccacaccggcgagaagcucuacgagugcuccgagugcggcaagggcuuccccuacaacuccgaccucuccauccacgagaagauccacaccggcgagcgccaccacgagugcaccgacugcggcaaggccuucacccagaaguccacccucaagauccaccagaagauccacaccggcgagcgcuccuacaucugcaucgagugcggccaggccuucauccagaagacccagcucaucgcccaccgccgcauccacuccggcgagaagcccuacgagugcaacaacugcggcaaguccuucaucuccaagucccagcuccagguccaccagcgcguccacacccgcgucaagcccuacaucugcaccgaguacggcaaggucuucuccaacaacuccaaccucaucacccacgagaagauccagucccgcgagaaguccuccaucugcaccgagugcggcaaggccuucaccuaccgcuccgagcucaucauccaccagcgcauccacaccggcgagaagcccuacgagugcuccgacugcggccgcgccuucacccagaaguccgcccucaccguccaccagcgcauccacaccggcgagaaguccuacaucugcaugaagugcggccucgccuucauccgcaaggcccaccucaucacccaccagaucauccacaccggcgagaagcccuacaagugcggccacugcggcaagcucuucaccuccaagucccagcuccacguccacaagcgcauccacaccggcgagaagcccuacgucugcaacaagugcggcaaggccuucaccaaccgcuccaaccucaucacccaccagaagacccacaccggcgagaaguccuacaucugcuccaagugcggcaaggccuucacccagcgcuccgaccucaucacccaccagcgcauccacaccggcgagaagcccuacgagugcaacaccugcggcaaggccuucacccagaaguccaaccucaacauccaccagaagauccacaccggcgagcgccaguacgagugccacgagugcggcaaggccuucaaccagaaguccauccucaucguccaccagaagauccacaccggcgagaagcccuacgucugcaccgagugcggccgcgccuucauccgcaaguccaacuucaucacccaccagcgcauccacaccggcgagaagcccuacgagugcuccgacugcggcaaguccuucaccuccaagucccagcuccucguccaccagcccguccacaccggcgagaagcccuacgucugcgccgagugcggcaaggccuucuccggccgcuccaaccucuccaagcaccagaagacccacaccggcgagaagcccuacaucugcuccgagugcggcaagaccuuccgccagaaguccgagcucaucacccaccaccgcauccacaccggcgagaagcccuacgagugcuccgacugcggcaaguccuucaccaagaagucccagcuccagguccaccagcgcauccacaccggcgagaagcccuacgucugcgccgagugcggcaaggccuucuccaaccgcuccaaccucaacaagcaccagaccacccacaccggcgacaagcccuacaagugcggcaucugcggcaagggcuucguccagaaguccgucuucuccguccaccaguccucccacgccuga

SEQ ID NO: 52144 - RNA, 3804 nt, Artificial Sequence
  derived and/or modified sequence opt2 from ZNF592__Homo_sapiens__NP_055445
augggcgacaugaagacccccgacuucgacgaccuccucgccgccuucgacauccccgaccccaccucccucgacgccaaggaggccauccagacccccuccgaggagaacgaguccccccucaagccccccggcaucugcauggacgaguccgucucccucucccacuccggcuccgcccccgacguccccgccgucuccgucaucgucaagaacaccucccgccaggaguccuucgaggccgagaaggaccacaucacccccucccuccuccacaacggcuuccgcggcuccgaccucccccccgacccccacaacugcggcaaguucgacuccaccuucaugaacggcgacuccgcccgcuccuuccccggcaagcucgagccccccaaguccgagccccuccccaccuucaaccaguucucccccaucuccucccccgagcccgaggaccccaucaaggacaacggcuucggcaucaagcccaagcacuccgacuccuacuucccccccccccucggcugcggcgccgucggcggccccguccucgaggcccucgccaaguuccccguccccgagcuccacauguucgaccacuucugcaagaaggagcccaagcccgagccccucccccucggcucccagcaggagcacgagcaguccggccagaacaccgucgagccccacaaggaccccgacgccacccgcuucuucggcgaggcccucgaguucaacucccaccccuccaacuccaucggcgaguccaagggccucgcccgcgagcucggcaccugcuccuccguccccccccgccagcgccucaagcccgcccacuccaagcucuccuccugcgucgccgcccucgucgcccuccaggccaagcgcgucgccuccgucaccaaggaggaccagcccggccacaccaaggaccucuccggccccaccaaggaguccuccaagggcucccccaagaugcccaagucccccaaguccccccgcuccccccucgaggccacccgcaaguccaucaagcccuccgacuccccccgcuccaucugcuccgacuccuccuccaagggcucccccuccgucgccgccuccuccccccccgccauccccaagguccgcaucaagaccaucaagaccuccuccggcgagaucaagcgcaccgucacccgcauccuccccgaccccgacgaccccuccaagucccccgucggcuccccccucggcuccgccaucgccgaggcccccuccgagaugcccggcgacgagguccccgucgaggagcacuuccccgaggccggcaccaacuccggcuccccccagggcgcccgcaagggcgacgaguccaugaccaaggccuccgacuccuccucccccuccugcuccuccggcccccgcguccccaagggcgccgcccccggcucccagaccggcaagaagcagcaguccaccgcccuccaggccuccacccucgcccccgccaaccuccuccccaaggccguccaccucgccaaccucaaccucgucccccacuccgucgccgccuccgucaccgccaaguccuccguccagcgccgcucccagccccagcucacccagauguccgucccccucguccaccaggucaagaaggccgccccccucaucgucgaggucuucaacaagguccuccacuccuccaaccccgucccccucuacgcccccaaccucuccccccccgccgacucccgcauccacguccccgccuccggcuacugcugccucgagugcggcgacgccuucgcccucgagaagucccucucccagcacuacggccgccgcuccguccacaucgagguccucugcacccucugcuccaagacccuccucuucuucaacaagugcucccuccuccgccacgcccgcgaccacaaguccaagggccucgucaugcagugcucccagcuccucgucaagcccaucuccgccgaccagauguucgucuccgcccccgucaacuccaccgcccccgccgcccccgcccccuccuccucccccaagcacggccucaccuccggcuccgccuccccccccccccccgcccucccccucuaccccgaccccguccgccucauccgcuacuccaucaagugccucgagugccacaagcagaugcgcgacuacaugguccucgccgcccacuuccagcgcaccaccgaggagaccgagggccucaccugccaggucugccagaugcuccuccccaaccagugcuccuucugcgcccaccagcgcauccacgcccacaagucccccuacugcugccccgagugcggcguccucugccgcuccgccuacuuccagacccacgucaaggagaacugccuccacuacgcccgcaaggucggcuaccgcugcauccacugcggcgucguccaccucacccucgcccuccucaagucccacauccaggagcgccacugccaggucuuccacaagugcgccuucugccccauggccuucaagaccgccuccuccaccgccgaccacuccgccacccagcaccccacccagccccaccgccccucccagcucaucuacaagugcuccugcgagauggucuucaacaagaagcgccacauccagcagcacuucuaccagaacgucuccaagacccaggucggcgucuucaagugccccgagugcccccuccucuucguccagaagcccgagcucaugcagcacgucaaguccacccacggcgucccccgcaacgucgacgagcucuccucccuccaguccuccgccgacaccuccuccucccgccccggcucccgcguccccaccgagccccccgccaccuccgucgccgcccgcuccuccucccuccccuccggccgcuggggccgccccgaggcccaccgccgcgucgaggcccgcccccgccuccgcaacaccggcuggaccugccaggagugccaggaguggguccccgaccgcgaguccuacgucucccacaugaagaagucccacggccgcacccucaagcgcuaccccugccgccagugcgagcaguccuuccacacccccaacucccuccgcaagcacauccgcaacaaccacgacaccgucaagaaguucuacaccugcggcuacugcaccgaggacucccccuccuucccccgccccucccuccucgagucccacaucucccucaugcacggcauccgcaaccccgaccucucccagaccuccaaggucaagccccccggcggccacuccccccaggucaaccaccucaagcgccccgucuccggcgucggcgacgcccccggcaccuccaacggcgccaccgucuccuccaccaagcgccacaagucccucuuccagugcgccaagugcuccuucgccaccgacuccggccucgaguuccagucccacaucccccagcaccaggucgacuccuccaccgcccagugccuccucugcggccucugcuacaccuccgccuccucccucucccgccaccucuucaucguccacaagguccgcgaccaggaggaggaggaggaggaggaggccgccgccgccgagauggccgucgaggucgccgagcccgaggagggcuccggcgaggagguccccauggagacccgcgagaacggccucgaggagugcgccggcgagccccucuccgccgaccccgaggcccgccgccuccucggccccgcccccgaggacgacggcggccacaacgaccacucccagccccaggccucccaggaccaggacucccacacccucuccccccaggucuga

SEQ ID NO: 52145 - RNA, 1515 nt, Artificial Sequence
  derived and/or modified sequence opt2 from ZNF596__Homo_sapiens__XP_011533044
augcccucccccgacuccaugaccuucgaggacaucaucgucgacuucacccaggaggagugggcccuccucgacaccucccagcgcaagcucuuccaggacgucaugcucgagaacaucucccaccucgucuccaucggcaagcagcucugcaaguccgucguccucucccagcucgagcaggucgagaagcucuccacccagcgcaucucccuccuccagggccgcgaggucggcaucaagcaccaggagauccccuucauccagcacaucuaccagaagggcaccuccaccaucuccaccaugcgcucccacacccaggaggaccccuuccucugcaacgaccucggcgaggacuucacccagcacaucgcccucacccagaacgucaucaccuacaugcgcaccaagcacuucgucuccaagaaguucggcaagaucuucuccgacuggcucuccuucaaccagcacaaggagauccacaccaagugcaaguccuacggcucccaccucuucgacuacgccuucauccagaacuccgcccuccgcccccacuccgucacccacacccgcgagaucacccucgagugccgcgucugcggcaagaccuucuccaagaacuccaaccuccgccgccacgagaugauccacaccggcgagaagccccacggcugccaccucugcggcaaggccuucacccacugcuccgaccuccgcaagcacgagcgcacccacaccggcgagaagcccuacggcugccaccucugcggcaaggccuucuccaaguccuccaaccuccgccgccacgagaugauccacacccgcgagaaggcccagaucugccaccucugcggcaaggccuucacccacugcuccgaccuccgcaagcacgagcgcacccaccucggcgacaagcccuacggcugccuccucugcggcaaggccuucuccaagugcuccuaccuccgccagcacgagcgcacccacaacggcgagaagcccuacgagugccaccucugcggcaaggccuucucccacugcucccaccuccgccagcacgagcgcucccacaacggcgagaagccccacggcugccaccucugcggcaaggccuucaccgaguccuccguccucaagcgccacgagcgcauccacaccggcgagaagcccuacgagugccacgucugcggcaaggccuucaccgaguccuccgaccuccgccgccacgagcgcacccacaccggcgagaagcccuacgagugccaccucugcggcaaggccuucaaccacuccuccguccuccgccgccacgagcgcacccacaccggcgagaagcccuacgagugcaacaucugcggcaaggccuucaaccgcuccuacaacuuccgccuccaccgccgcguccacaccggcgagaagcccuacgucugcccccucugcggcaaggccuucuccaaguucuucaaccuccgccagcacgagcgcacccacaccaagaaggccaugaacauguga

SEQ ID NO: 52146 - RNA, 2379 nt, Artificial Sequence
  derived and/or modified sequence opt2 from ZNF606__Homo_sapiens__NP_079303
auggccgccaucaaccccugggccuccuggggcgcccucaccgaccaguccuggggcaugaccgccgucgaccccugggccuccugggcccucugcccccaguaccccgccuggcacgucgagggcucccucgaggagggccgccgcgccaccggccuccccgccgcccagguccaggagcccgucaccuucaaggacgucgccgucgacuucacccaggaggaguggggccagcucgaccucguccagcgcacccucuaccgcgacgucaugcucgagaccuacggccaccuccucuccgucggcaaccagaucgccaagcccgaggucaucucccuccucgagcagggcgaggagcccugguccgucgagcaggccugcccccagcgcaccugccccgaguggguccgcaaccucgaguccaaggcccucauccccgcccaguccaucuucgaggaggagcagucccacggcaugaagcucgagcgcuacaucugggacgaccccugguucucccgccucgagguccucggcugcaaggaccagcucgagauguaccacaugaaccaguccaccgccaugcgccagauggucuucaugcagaagcagguccucucccagcgcuccuccgaguucugcggccucggcgccgaguucucccagaaccucaacuucguccccucccagcgcgucucccagaucgagcacuucuacaagcccgacacccacgcccaguccuggcgcugcgacuccgccaucauguacgccgacaaggucaccugcgagaacaacgacuacgacaagaccgucuaccaguccauccagcccaucuaccccgcccgcauccagaccggcgacaaccucuucaagugcaccgacgccgucaaguccuucaaccacaucauccacuucggcgaccacaagggcauccacaccggcgagaagcucuacgaguacaaggagugccaccagaucuucaaccagucccccuccuucaacgagcacccccgccuccacgucggcgagaaccaguacaacuacaaggaguacgagaacaucuucuacuucuccuccuucauggagcaccagaagaucggcaccgucgagaaggccuacaaguacaacgagugggagaaggucuucggcuacgacuccuuccucacccagcacaccuccaccuacaccgccgagaagcccuacgacuacaacgagugcggcaccuccuucaucugguccuccuaccucauccagcacaagaagacccacaccggcgagaagcccuacgagugcgacaagugcggcaaggucuuccgcaaccgcuccgcccucaccaagcacgagcgcacccacaccggcaucaagcccuacgagugcaacaagugcggcaaggccuucuccuggaacucccaccucaucguccacaagcgcauccacaccggcgagaagcccuacgucugcaacgagugcggcaaguccuucaacuggaacucccaccucaucggccaccagcgcacccacaccggcgagaagcccuucgagugcaccgagugcggcaaguccuucuccugguccucccaccucaucgcccacaugcgcaugcacaccggcgagaagcccuucaagugcgacgagugcgagaaggccuuccgcgacuacuccgcccucuccaagcacgagcgcacccacuccggcgccaagcccuacaagugcaccgagugcggcaaguccuucuccugguccucccaccucaucgcccaccagcgcacccacaccggcgagaagcccuacaacugccaggagugcggcaaggccuuccgcgagcgcuccgcccucaccaagcacgagaucauccacuccggcaucaagcccuacgagugcaacaagugcggcaaguccugcucccagauggcccaccucguccgccaccagcgcacccacaccggcgagaagcccuacgagugcaacaagugcggcaaguccuucucccaguccugccaccucgucgcccaccgccgcauccacaccggcgagaagcccuacaagugcaaccagugcgagcgcuccuucaacugcuccucccaccucaucgcccaccgccgcacccacaccggcgagaagcccuaccgcugcaacgagugcggcaaggccuucaacgaguccuccucccucaucguccaccuccgcaaccacaccggcgagaagcccuacaagugcaaccacugcgagaaggccuucugcaagaacuccucccucaucauccaccagcgcaugcacuccggcgagaagcgcuucaucugcuccgagugcggcaaggccuucuccggccacuccgcccuccuccagcaccagcgcaaccacuccgaggagaagcucaacuga

SEQ ID NO: 52147 - RNA, 2088 nt, Artificial Sequence
  derived and/or modified sequence opt2 from ZNF607__Homo_sapiens__NP_001166148
auguccuacggcuccaucaccuucggcgacgucgccaucgacuucucccaccaggagugggaguaccucucccucguccagaagacccucuaccaggaggucaugauggagaacuacgacaaccucgucucccucggccacuccgucuccaagcccgaccucaucacccuccucgagcagggcaaggagcccuggaugaucguccgcgaggagacccgcggcgagugcaccgaccucgacucccgcugcgagaucaucuccgacggcaagaugcagcucuaccgcaagcacuccugcgucacccuccaccagcgcauccacaacggccagaagcccuacgagugcaagcagugccagaaguccuucucccaccucaccgagcucaugguccaccagaccauccacaccuccgaggagcccgaccagugcgagaaguuccgcaaggccuucucccaccucaccgaccuccgcaagcaccagaagaucaacgcccgcgagaagcccuacgagugcgaggagugcggcaaggucuucuccuaccccgccaaccucgcccagcacggcaagguccacgucgagaagcccuacgagugcaaggagugcggcgaggccuuccgcaccucccgccagcucaccguccaccaccgcuuccacuacggcgagaagcccuacgagugcaaggagugcggcaaggccuucuccgucuacggccgccucucccgccaccaguccauccacaccggcgagaagcccuucgagugcaacaagugcggcaaguccuuccgccucaaggccggccucaagguccaccaguccauccacaccggcgagaagccccacgagugcaaggagugcggcaaggccuuccgccaguucucccaccucgucggccacaagcgcauccacaccggcgagaagcccuacgagugcaaggagugcggcaagggcuucaccugccgcuaccagcucaccaugcaccagcgcaucuacuccggcgagaagcacuacgagugcaaggagaacggcgaggccuucuccuccggccaccagcucaccgccccccacaccuucgaguccgucgagaagcccuacaagugcgaggagugcggcaaggccuucuccguccacggccgccucacccgccaccagggcauccacuccggcaagaagcccuacgagugcaacaagugcggcaaguccuuccgccucaacuccucccucaagauccaccagaacauccacaccggcgagaagcccuacaagugcaaggagugcggcaaggccuucucccagcgcgcccaccucgcccaccacaaccgcauccacaccggcuacaagcccuucgagugcaaggagugcggcaaguccuuccgcugcgccuccuaccucgucauccacgagcgcauccacaccggcgagaagcccuacgucugccaggagugcggcaagggcuucuccuacucccacaagcucaccauccaccgccgcguccacaccggcgagaagcccuacgagugcaaggagugcggcaaggccuucuccgucuccggccagcucacccagcaccucuccauccacuccggcaagaagcccuucgagugcaacaagugcggcaaguccuuccgcuucaucuccguccucaaggcccaccagaacauccacuccgccgagaagcccuacgagugcaaggagugcggcaaggccuuccgccacgccaccucccucaucuaccacgaccgcacccacgccggcgagaaguccuacgagugcaaggagugcggcgagaccuucucccacgccucccaccucaucauccacgagcgcauccacaccuccgacaagcccuacgagugcaagcgcugcggcaaggccuuccacugcgccuccuaccucguccgccacgaguccguccacgccgacggcaaccccuacaugugcgaggagugcggcaaggccuucaacuccucccacgagcucuccauccaccaccgcguccacaccggcgagaagcccuucaagugcaacaagugccgccgcuccuuccgccuccgcuccauccucgagguccaccagcgcauccacaucuga

SEQ ID NO: 52148 - RNA, 4539 nt, Artificial Sequence
  derived and/or modified sequence opt2 from ZNF608__Homo_sapiens__NP_065798
auguccgucaacaucuccaccgccggcaagggcgucgaccccaacaccgucgacaccuacgacuccggcgacgacugggagaucggcgucggcaaccucaucaucgaccucgacgccgaccucgagaaggaccgccagaaguucgagaugaacaacuccaccaccaccaccuccuccuccaacuccaaggacugcggcggccccgccuccuccggcgccggcgccaccgccgcccucgccgacggccucaaguucgccuccguccaggccuccgccccccagggcaacucccacaaggagaccuccaaguccaaggucaagcgcuccaagaccuccaaggacgccaacaagucccuccccuccgccgcccucuacggcauccccgagaucuccuccaccggcaagcgccaggagguccagggccgccccggcgaggccaccggcaugaacuccgcccucggccaguccgucuccuccggcggcuccggcaaccccaacuccaacuccaccuccaccuccaccuccgccgccaccgccggcgccggcuccugcggcaaguccaaggaggagaagcccggcaagucccaguccucccgcggcgccaagcgcgacaaggacgccggcaagucccgcaaggacaagcacgaccuccuccagggccaccagaacggcuccggcucccaggcccccuccggcggccaccucuacggcuucggcgccaaguccaacggcggcggcgccucccccuuccacugcggcggcaccggcuccggcuccgucgccgccgccggcgaggucuccaaguccgcccccgacuccggccucaugggcaacuccaugcucgucaagaaggaggaggaggaggaggagucccaccgccgcaucaagaagcucaagaccgagaaggucgacccccucuucaccguccccgccccccccccccccaucuccuccucccucaccccccagauccuccccuccuacuucucccccuccuccuccaacaucgccgcccccgucgagcagcuccucguccgcacccgcuccgucggcgucaacaccugcgaggucggcgucgucaccgagcccgagugccucggccccugcgagcccggcaccuccgucaaccucgagggcaucgucuggcacgagaccgaggagggcguccucgucgucaacgucaccuggcgcaacaagaccuacgucggcacccuccucgacugcaccaagcacgacugggcccccccccgcuucugcgagucccccaccuccgaccucgagaugcgcggcggccgcggccgcggcaagcgcgcccgcuccgccgccgccgcccccggcuccgaggccuccuucaccgagucccgcggccuccagaacaagaaccgcggcggcgccaacggcaagggccgccgcggcucccucaacgccuccggccgccgcaccccccccaacugcgccgccgaggacaucaaggccucccccuccuccaccaacaagcgcaagaacaagccccccauggagcucgaccucaacuccuccuccgaggacaacaagcccggcaagcgcguccgcaccaacucccgcuccacccccaccaccccccagggcaagcccgagaccaccuuccucgaccagggcugcuccucccccguccucaucgacugcccccaccccaacugcaacaagaaguacaagcacaucaacggccuccgcuaccaccaggcccacgcccaccucgaccccgagaacaagcucgaguucgagcccgacuccgaggacaagaucuccgacugcgaggagggccucuccaacgucgcccucgagugcuccgagcccuccaccuccgucuccgccuacgaccagcucaaggcccccgccucccccggcgccggcaacccccccggcacccccaagggcaagcgcgagcucauguccaacggccccggcuccaucaucggcgccaaggccggcaagaacuccggcaagaagaagggccucaacaacgagcucaacaaccuccccgucaucuccaacaugaccgccgcccucgacuccugcuccgccgccgacggcucccucgccgccgagaugcccaagcucgaggccgagggccucaucgacaagaagaaccucggcgacaaggagaagggcaagaaggccaccaacugcaagaccgacaagaaccucuccaagcucaaguccgcccgccccaucgcccccgcccccgcccccacccccccccagcucaucgccauccccaccgccaccuucaccaccaccaccaccggcaccauccccggccuccccucccucaccaccaccgucguccaggccacccccaagucccccccccucaagcccauccagcccaagcccaccaucaugggcgagcccaucaccgucaaccccgcccucgucucccucaaggacaagaagaagaaggagaagcgcaagcucaaggacaaggagggcaaggagaccggcucccccaagauggacgccaagcucggcaagcucgaggacuccaagggcgccuccaaggaccuccccggccacuuccucaaggaccaccucaacaagaacgagggccucgccaacggccucuccgagucccaggagucccgcauggccuccaucaaggccgaggccgacaaggucuacaccuucaccgacaacgcccccucccccuccaucggcuccgccucccgccucgagugcuccacccucgucaacggccaggcccccauggccccccuccacguccucacccagaacggcgccgaguccuccgccgccaagaccuccucccccgccuacuccgacaucuccgacgccgccgacgacggcggcuccgacucccgcuccgagggcaugcgcuccaaggccuccucccccuccgacaucaucuccuccaaggacuccgucgucaagggccacuccuccaccaccgcccaguccucccagcucaaggagucccacucccccuacuaccacuccuacgaccccuacuacucccccuccuacaugcaccccggccaggucggcgcccccgccgccggcaacuccggcuccacccagggcaugaagaucaagaaggaguccgaggaggacgccgagaagaaggacaaggccgagcagcucgacuccaagaaggucgaccacaacuccgccucccuccagccccagcaccaguccgucaucacccagcgccaccccgcccucgcccagucccucuacuacggccaguacgccuacggccucuacauggaccagaagucccucauggccaccucccccgccuaccgccagcaguacgagaaguacuacgaggaccagcgccucgccgagcagaagauggcccagaccggccgcggcgacugcgagcgcaaguccgagcucccccucaaggagcucggcaaggaggagaccaagcagaagaacaugcccuccgccaccaucuccaaggcccccuccacccccgagcccaacaagaaccacuccaagcucggccccuccguccccaacaagaccgaggagaccggcaagucccagcuccucuccaaccaccagcagcagcuccaggccgacuccuucaaggccaagcagauggagaaccaccagcucaucaaggaggccgucgagaugaaguccgucauggacuccaugaagcagaccggcgucgaccccaccucccgcuucaagcaggaccccgacucccgcaccuggcaccacuacgucuaccagcccaaguaccucgaccagcagaaguccgaggagcucgaccgcgagaagaagcucaaggaggacuccccccgcaagacccccaacaaggaguccggcguccccucccuccccgucucccucaccuccaucaaggaggagcccaaggaggccaagcaccccgacucccaguccauggaggaguccaagcucaagaacgacgaccgcaagacccccgucaacuggaaggacucccgcggcacccgcgucgccgucuccucccccaugucccagcaccaguccuacauccaguaccuccacgccuaccccuacccccagauguacgaccccucccaccccgccuaccgcgccgucucccccguccucaugcacuccuaccccggcgccuaccucucccccggcuuccacuaccccgucuacggcaagauguccggccgcgaggagaccgagaaggucaacaccucccccuccgucaacaccaagaccaccaccgaguccaaggcccucgaccuccuccagcagcacgccaaccaguaccgcuccaagucccccgcccccgucgagaaggccaccgccgagcgcgagcgcgaggccgagcgcgagcgcgaccgccacucccccuucggccagcgccaccuccacacccaccaccacacccacgucggcaugggcuacccccucauccccggccaguacgaccccuuccagggccucaccuccgccgcccucgucgccucccagcaggucgccgcccaggccuccgccuccggcauguuccccggccagcgccgcgaguga

SEQ ID NO: 52149 - RNA, 2229 nt, Artificial Sequence
  derived and/or modified sequence opt2 from ZNF615__Homo_sapiens__XP_011525128
augaugcaggcccaggagucccucacccucgaggacgucgccgucgacuucaccugggaggaguggcaguuccucucccccgcccagaaggaccucuaccgcgacgucaugcucgagaacuacuccaaccucgucgccgucggcuaccaggccuccaagcccgacgcccucuccaagcucgagcgcggcgaggagaccugcaccaccgaggacgagaucuacucccgcaucugcuccgacuccggcggcgccuccggcggcgccuacgccgagauccgcaagaucgacgacccccuccagcaccaccuccagaaccaguccauccagaaguccgucaagcagugccacgagcagaacauguucggcaacaucgucaaccagaacaagggccacuuccuccucaagcaggacugcgacaccuucgaccuccacgagaagccccucaaguccaaccucuccuucgagaaccagaagcgcuccuccggccucaagaacuccgccgaguucaaccgcgacggcaagucccucuuccacgccaaccacaagcaguucuacaccgagaugaaguuccccgccaucgccaagcccaucaacaagucccaguucaucaagcagcagcgcacccacaacaucgagaacgcccacgucugcuccgagugcggcaaggccuuccucaagcucucccaguucaucgaccaccagcgcguccacaccggcgagaagccccacgucugcuccaugugcggcaaggccuucucccgcaagucccgccucauggaccaccagcgcacccacaccgagcucaagcacuacgagugcaccgagugcgacaagaccuuccucaagaagucccagcucaacauccaccagaagacccacaugggcggcaagcccuacaccugcucccagugcggcaaggccuucaucaagaagugccgccucaucuaccaccagcgcacccacaccggcgagaagccccacggcugcuccgucugcggcaaggccuucuccaccaaguucucccucaccacccaccagaagacccacaccggcgagaagcccuacaucugcuccgagugcggcaagggcuucaucgagaagcgccgccucaccgcccaccaccgcacccacaccggcgagaagcccuucaucugcaacaagugcggcaagggcuucacccucaagaacucccucaucacccaccagcagacccacaccggcgagaagcucuacaccugcuccgagugcggcaagggcuucuccaugaagcacugccucaugguccaccagcgcacccacaccggcgagaagcccuacaagugcaacgagugcggcaagggcuucgcccucaaguccccccucauccgccaccagcgcacccacaccggcgagaagcccuacgucugcaccgagugccgcaagggcuucaccaugaaguccgaccucaucguccaccagcgcacccacaccgccgagaagcccuacaucugcaacgacugcggcaagggcuucaccgucaagucccgccucaucguccaccagcgcacccacaccggcgagaagcccuacgucugcggcgagugcggcaagggcuuccccgccaagauccgccucaugggccaccagcgcacccacaccggcgagaagcccuacaucugcaacgagugcggcaagggcuucaccgagaagucccaccucaacguccaccgccgcacccacaccggcgagaagcccuacgucugcuccgagugcggcaagggccucaccggcaaguccaugcucaucgcccaccagcgcacccacaccggcgagaagcccuacaucugcaacgagugcggcaagggcuucaccaugaaguccacccucuccauccaccagcagacccacaccggcgagaagcccuacaagugcaacgagugcgacaagaccuuccgcaagaagaccugccucauccagcaccagcgcuuccacaccggcaagaccuccuucgccugcaccgagugcggcaaguucucccuccgcaagaacgaccucaucacccaccagcgcauccacaccggcgagaagcccuacaagugcuccgacugcggcaaggccuucaccaccaaguccggccucaacguccaccagcgcaagcacaccggcgagcgccccuacggcugcuccgacugcggcaaggccuucgcccaccucuccauccucgucaagcaccgccgcauccaccgcuga

SEQ ID NO: 52150 - RNA, 2586 nt, Artificial Sequence
  derived and/or modified sequence opt2 from ZNF618__Homo_sapiens__NP_588615
augaaccagcccggcggcgccgccgccccccaggccgacggcgccuccgccgccggccgcaaguccaccgccucccgcgagcgccucaagcgcucccagaaguccaccaaggucgagggccccgagcccguccccgccgaggccucccucuccgccgagcagggcaccaugaccgaggucaaggucaagaccgagcuccccgacgacuacauccaggaggucaucuggcagggcgaggccaaggaggagaagaaggccgucuccaaggacggcaccuccgacguccccgccgagaucugcgucgucaucggcggcguccgcaaccagcagacccucggcuccuacgagugcggcaucugcggcaagaaguacaaguacuacaacugcuuccagacccacguccgcgcccaccgcgacaccgaggccaccuccggcgagggcgccucccaguccaacaacuuccgcuacaccugcgacaucugcggcaagaaguacaaguacuacuccugcuuccaggagcaccgcgaccuccacgccgucgacgucuucuccgucgagggcgcccccgagaaccgcgccgaccccuucgaccagggcgucgucgccaccgacgaggucaaggaggagccccccgagcccuuccagaagaucggccccaugaacaacaucaccuccgacaucuucaagaagaaggagguccgccagugccagaagcgcgagaccggcaacuacaccugcgaguucugcggcaagcaguacaaguacuacacccccuaccaggagcacgucgcccuccacgcccccaucaaguccgccuucucccgccgcgucgagggcaaggcccagaaccacuucgaggagaccaacuccuccucccagaacuccuccgagcccuacaccugcggcgccugcggcauccaguuccaguucuacaacaaccuccucgagcacaugcagucccacgccgccgacaacgagaacaacaucgccuccaaccagucccgcuccccccccgccgucgucgaggagaaguggaagccccaggcccagcgcaacuccgccaacaacaccaccaccuccggccucacccccaacuccaugauccccgagaaggagcgccagaacaucgccgagcgccuccuccgcgucaugugcgccgaccucggcgcccucuccgucgucuccggcaaggaguuccucaagcucgcccagacccucgucgacuccggcgcccgcuacggcgccuucuccgucaccgagauccucggcaacuucaacacccucgcccucaagcaccucccccgcauguacaaccaggucaaggucaaggucaccugcgcccucggcuccaacgccugccucggcaucggcgucaccugccacucccaguccgucggccccgacuccugcuacauccucaccgccuaccaggccgagggcaaccacaucaaguccuacguccucggcgucaagggcgccgacauccgcgacuccggcgaccucguccaccacuggguccagaacguccucuccgaguucgucauguccgagauccgcaccgucuacgucaccgacugccgcgucuccaccuccgccuucuccaaggccggcaugugccuccgcugcuccgccugcgcccucaacuccgucguccaguccguccucuccaagcgcacccuccaggcccgcuccaugcacgaggucaucgagcuccucaacgucugcgaggaccucgccggcuccaccggccucgccaaggagaccuucggcucccucgaggagaccucccccccccccugcuggaacuccgucaccgacucccuccuccucguccacgagcgcuacgagcagaucugcgaguucuacucccgcgccaagaagaugaaccucauccagucccucaacaagcaccuccucuccaaccucgccgccauccucacccccgucaagcaggccgucaucgagcucuccaacgagucccagcccacccuccagcucguccuccccaccuacguccgccucgagaagcucuucaccgccaaggccaacgacgccggcaccgucuccaagcucugccaccucuuccucgaggcccucaaggagaacuucaagguccaccccgcccacaaggucgccaugauccucgacccccagcagaagcuccgccccgucccccccuaccagcacgaggagaucaucggcaaggucugcgagcucaucaacgaggucaaggaguccugggccgaggaggccgacuucgagcccgccgccaagaagccccgcuccgccgccgucgagaaccccgccgcccaggaggacgaccgccucggcaagaacgaggucuacgacuaccuccaggagccccucuuccaggccacccccgaccucuuccaguacugguccugcgucacccagaagcacaccaagcucgccaagcucgccuucuggcuccucgccguccccgccgucggcgcccgcuccggcugcgucaacaugugcgagcaggcccuccucaucaagcgccgccgccuccucucccccgaggacaugaacaagcucauguuccucaaguccaacaugcucuga

SEQ ID NO: 52151 - RNA, 1386 nt, Artificial Sequence
  derived and/or modified sequence opt2 from ZNF627__Homo_sapiens__NP_660338
auggacuccgucgccuucgaggacgucgccgucaacuucacccucgaggagugggcccuccucgaccccucccagaagaaccucuaccgcgacgucaugcgcgagaccuuccgcaaccucgccuccgucggcaagcagugggaggaccagaacaucgaggaccccuucaagaucccccgccgcaacaucucccacauccccgagcgccucugcgaguccaaggagggcggccagggcgaggagaccuucucccagauccccgacggcauccucaacaagaagacccccggcgucaagcccugcgaguccuccgucugcggcgaggucggcaugggccccuccucccucaaccgccacauccgcgaccacaccggccgcgagcccaacgaguaccaggaguacggcaagaaguccuacacccgcaaccagugcggccgcgcccucuccuaccaccgcuccuuccccguccgcgagcgcacccaccccggcggcaagcccuacgacugcaaggagugcggcgagaccuucaucucccucgucuccauccgccgccacaugcucacccaccgcggcggcguccccuacaagugcaaggucugcggcaaggccuucgacuaccccucccucuuccgcauccacgagcgcucccacaccggcgagaagcccuacgagugcaagcagugcggcaaggccuucuccugcuccuccuacauccgcauccacgagcgcacccacaccggcgacaagcccuacgagugcaagcagugcggcaaggccuucuccugcuccaaguacauccgcauccacgagcgcacccacaccggcgagaagcccuacgagugcaagcagugcggcaaggccuuccgcugcgccuccuccguccgcucccacgagcgcacccacaccggcgagaagcucuucgagugcaaggagugcggcaaggcccucaccugccucgccuccguccgccgccacaugaucaagcacaccggcaacggccccuacaagugcaaggucugcggcaaggccuucgacuuccccuccuccuuccgcauccacgagcgcacccacaccggcgagaagcccuacgacugcaagcagugcggcaaggccuucuccugcuccuccuccuuccgcaagcacgagcgcauccacaccggcgagaagcccuacaagugcaccaagugcggcaaggccuucucccgcuccuccuacuuccgcauccacgagcgcacccacaccggcgagaagcccuacgagugcaagcagugcggcaaggccuucucccgcuccaccuacuuccgcguccacgagaagauccacaccggcgagaagcccuacgagaaccccaaccccaacgccuccgucguccccguccucuccuga

SEQ ID NO: 52152 - RNA, 2610 nt, Artificial Sequence
  derived and/or modified sequence opt2 from ZNF629__Homo_sapiens__NP_001073886
auggagcccgagaccgcccucuggggccccgaccuccagggccccgagcagucccccaacgacgcccaccgcggcgccgaguccgagaacgaggaggaguccccccgccaggaguccuccggcgaggagaucaucaugggcgaccccgcccagucccccgaguccaaggacuccaccgagaugucccucgagcgcuccucccaggaccccuccgucccccagaacccccccaccccccucggccacuccaacccccucgaccaccagaucccccucgacccccccgcccccgaggucguccccacccccuccgacuggaccaaggccugcgaggccuccuggcaguggggcgcccucaccaccuggaacuccccccccgucguccccgccaacgagcccucccuccgcgagcucguccagggccgccccgccggcgccgagaagcccuacaucugcaacgagugcggcaaguccuucucccagugguccaagcuccuccgccaccagcgcauccacaccggcgagcgccccaacaccugcuccgagugcggcaaguccuucacccaguccucccaccucguccagcaccagcgcacccacaccggcgagaagcccuacaagugccccgacugcggcaagugcuucuccugguccuccaaccucguccagcaccagcgcacccacaccggcgagaagcccuacaagugcaccgagugcgagaaggccuucacccaguccaccaaccucaucaagcaccagcgcucccacaccggcgagaagcccuacaagugcggcgagugccgccgcgccuucuaccgcuccuccgaccucauccagcaccaggccacccacaccggcgagaagcccuacaagugccccgagugcggcaagcgcuucggccagaaccacaaccuccucaagcaccagaagauccacgccggcgagaagcccuaccgcugcaccgagugcggcaaguccuucauccaguccuccgagcucacccagcaccagcgcacccacaccggcgagaagcccuacgagugccucgagugcggcaaguccuucggccacuccuccacccucaucaagcaccagcgcacccaccuccgcgaggaccccuucaagugccccgucugcggcaagaccuucacccucuccgccacccuccuccgccaccagcgcacccacaccggcgagcgccccuacaagugccccgagugcggcaaguccuucuccgucuccuccaaccucaucaaccaccagcgcauccaccgcggcgagcgccccuacaucugcgccgacugcggcaaguccuucaucauguccuccacccucauccgccaccagcgcauccacaccggcgagaagcccuacaagugcuccgacugcggcaaguccuucauccgcuccucccaccucauccagcaccgccgcacccacaccggcgagaagcccuacaagugccccgagugcggcaaguccuucucccaguccuccaaccucaucacccacguccgcacccacauggacgagaaccucuucgucugcuccgacugcggcaaggccuuccucgaggcccacgagcucgagcagcaccgcgucauccacgagcgcggcaagacccccgcccgccgcgcccagggcgacucccuccucggccucggcgaccccucccuccucacccccccccccggcgccaagccccacaagugccucgucugcggcaagggcuucaacgacgagggcaucuucaugcagcaccagcgcauccacaucggcgagaaccccuacaagaacgccgacggccucaucgcccacgccgcccccaagcccccccagcuccgcuccccccgccuccccuuccgcggcaacuccuaccccggcgccgccgagggccgcgccgaggcccccggccagccccucaagccccccgagggccaggagggcuucucccagcgccgcggccuccucuccuccaagaccuacaucugcucccacugcggcgaguccuuccucgaccgcuccguccuccuccagcaccagcucacccacggcaacgagaagcccuuccucuuccccgacuaccgcaucggccucggcgagggcgccggccccucccccuuccucuccggcaagcccuucaagugccccgagugcaagcaguccuucggccucuccuccgagcuccuccuccaccagaagguccacgccggcggcaaguccucccagaagucccccgagcucggcaaguccuccuccguccuccucgagcaccuccgcuccccccucggcgcccgccccuaccgcugcuccgacugccgcgccuccuuccucgaccgcgucgcccucacccgccaccaggagacccacacccaggagaagccccccaaccccgaggaccccccccccgaggccgucacccucuccaccgaccaggagggcgagggcgagacccccacccccaccgaguccuccucccacggcgagggccagaaccccaagacccucgucgaggagaagcccuaccucugccccgagugcggcgccggcuucaccgaggucgccgcccuccuccuccaccgcuccugccaccccggcgucucccucuga

SEQ ID NO: 52153 - RNA, 1458 nt, Artificial Sequence
  derived and/or modified sequence opt2 from ZNF639__Homo_sapiens__NP_001290355
augaacgaguaccccaagaagcgcaagcgcaagacccuccaccccucccgcuacuccgacuccuccggcaucucccgcaucgccgacggcuucaacggcaucuucuccgaccacugcuacuccgucugcuccaugcgccagcccgaccucaaguacuucgacaacaaggacgacgacuccgacaccgagaccuccaacgaccuccccaaguucgccgacggcaucaaggcccgcaaccgcaaccagaacuaccucguccccucccccguccuccgcauccucgaccacaccgccuucuccaccgagaaguccgccgacaucgucaucugcgacgaggagugcgacucccccgaguccgucaaccagcagacccaggaggagucccccaucgagguccacaccgccgaggacguccccaucgccgucgagguccacgccaucuccgaggacuacgacaucgagaccgagaacaacuccuccgagucccuccaggaccagaccgacgaggagccccccgccaagcucugcaagauccucgacaagucccaggcccucaacgucaccgcccagcagaaguggccccuccuccgcgccaacuccuccggccucuacaagugcgagcucugcgaguucaacuccaaguacuucuccgaccucaagcagcacaugauccucaagcacaagcgcaccgacuccaacgucugccgcgucugcaaggaguccuucuccaccaacaugcuccucaucgagcacgccaagcuccacgaggaggaccccuacaucugcaaguacugcgacuacaagaccgucaucuucgagaaccucucccagcacaucgccgacacccacuucuccgaccaccucuacuggugcgagcagugcgacguccaguucuccuccuccuccgagcucuaccuccacuuccaggagcacuccugcgacgagcaguaccucugccaguucugcgagcacgagaccaacgaccccgaggaccuccacucccacgucgucaacgagcacgccugcaagcucaucgagcucuccgacaaguacaacaacggcgagcacggccaguacucccuccucuccaagaucaccuucgacaagugcaagaacuucuucgucugccaggucugcggcuuccgcucccgccuccacaccaacgucaaccgccacgucgccaucgagcacaccaagaucuucccccacgucugcgacgacugcggcaagggcuucuccuccaugcucgaguacugcaagcaccucaacucccaccucuccgagggcaucuaccucugccaguacugcgaguacuccaccggccagaucgaggaccucaagauccaccucgacuucaagcacuccgccgaccucccccacaagugcuccgacugccucaugcgcuucggcaacgagcgcgagcucaucucccaccuccccguccacgagaccaccuga

SEQ ID NO: 52154 - RNA, 4107 nt, Artificial Sequence
  derived and/or modified sequence opt2 from ZNF644__Homo_sapiens__XP_011540563
augcgcuccuuccuccagcaggacgucaacaagaccaagucccgccucaacguccucaacggccucgccaacaacauggacgaccucaagaucaacaccgacaucaccggcgccaaggaggagcuccucgacgacaacaacuucaucuccgacaaggaguccggcguccacaagcccaaggacugccagaccuccuuccagaagaacaacacccucacccuccccgaggagcucuccaaggacaaguccgagaacgcccucuccggcggccaguccucccucuucauccacgccggcgcccccaccgucuccuccgagaacuucauccuccccaagggcgccgccgucaacggccccgucucccacuccucccucaccaagaccuccaacaugaacaagggcuccgucucccucaccaccggccagcccgucgaccagcccaccaccgaguccugcuccacccucaaggucgccgccgaccuccagcucuccaccccccagaaggccucccagcaccagguccucuuccuccucuccgacgucgcccacgccaagaaccccacccacuccaacaagaagcuccccaccuccgccuccgucggcugcgacauccagaacuccgucggcuccaacaucaaguccgacggcacccucaucaaccaggucgaggucggcgaggacggcgaggaccuccucgucaaggacgacugcgucaacaccgucaccggcaucuccuccggcaccgacggcuuccgcuccgagaacgacaccaacugggacccccagaaggaguucauccaguuccucaugaccaacgaggagaccgucgacaaggcccccccccacuccaagaucggccucgagaagaagcgcaagcgcaagauggacgucuccaagaucacccgcuacaccgaggacugcuucuccgacuccaacugcguccccaacaaguccaagaugcaggaggucgacuuccucgagcagaacgaggagcuccaggccgucgacucccagaaguacgcccucuccaaggucaagcccgaguccaccgacgaggaccucgaguccgucgacgccuuccagcaccucaucuacaaccccgacaagugcggcgaggaguccucccccguccacaccuccaccuuccucuccaacacccucaagaagaagugcgaggaguccgacuccgagucccccgccaccuucuccaccgaggagcccuccuucuaccccugcaccaagugcaacgucaacuuccgcgagaagaagcaccuccaccgccacaugauguaccaccucgacggcaacucccacuuccgccaccucaacgucccccgccccuacgccugccgcgagugcggccgcaccuuccgcgaccgcaacucccuccucaagcacaugaucauccaccaggagcgccgccagaagcucauggaggagauccgcgagcucaaggagcuccaggacgagggccgcuccgcccgccuccagugcccccagugcgucuucggcaccaacugccccaagaccuucguccagcacgccaagacccacgagaaggacaagcgcuacuacugcugcgaggagugcaacuucauggccgucaccgagaacgagcucgagugccaccgcggcaucgcccacggcgccgucgucaagugccccauggucaccuccgacaucgcccagcgcaagacccagaagaagaccuucaugaaggacuccgucgucggcuccuccaagaaguccgccaccuacaucugcaagaugugccccuucaccaccuccgccaaguccguccucaagaagcacaccgaguaccuccacuccuccuccugcgucgacuccuucggcuccccccucggccucgacaagcgcaagaacgacauccucgaggagcccgucgacuccgacuccaccaagacccucaccaagcagcaguccaccaccuuccccaagaacuccgcccucaagcaggacgucaagcgcaccuucggcuccaccucccaguccuccuccuucuccaagauccacaagcgcccccaccgcauccagaaggcccgcaaguccaucgcccaguccggcgucaacaugugcaaccagaacuccuccccccacaagaacgucaccaucaaguccuccgucgaccagaagcccaaguacuuccaccaggccgccaaggagaaguccaacgccaaggccaacucccacuaccucuaccgccacaaguacgagaacuaccgcaugaucaagaaguccggcgaguccuaccccguccacuucaagaaggaggaggccuccucccucaacucccuccaccucuucuccuccuccuccaacucccacaacaacuucaucuccgacccccacaagcccgacgccaagcgccccgaguccuucaaggaccaccgccgcgucgccgucaagcgcgucaucaaggaguccaagaaggaguccuccgucggcggcgaggaccucgacuccuaccccgacuuccuccacaagaugaccgucgucguccuccagaagcucaacuccgccgagaagaaggacuccuacgagaccgaggacgaguccuccugggacaacgucgagcucggcgacuacaccacccaggccaucgaggacgagaccuacuccgacaucaaccaggagcacgucaaccucuucccccucuucaaguccaaggucgagggccaggagcccggcgagaacgccacccucuccuacgaccagaacgacggcuucuacuucgaguacuacgaggacaccggcuccaacaacuuccuccacgagauccacgacccccagcaccucgagaccgccgacgccucccucuccaagcacuccuccgucuuccacuggaccgaccucucccucgagaagaaguccugccccuacugccccgccaccuucgagaccggcgucggccucuccaaccacguccgcggccaccuccaccgcgccggccucuccuacgaggcccgccacgucgucucccccgagcagaucgccaccuccgacaagaugcagcacuucaagcgcaccggcaccggcacccccgucaagcgcguccgcaaggccaucgagaaguccgagaccaccuccgagcacaccugccagcucugcggcggcugguucgacaccaagaucggccucuccaaccacguccgcggccaccucaagcgccucggcaagaccaagugggacgcccacaagucccccaucugcguccucaacgagaugaugcagaacgaggagaaguacgagaagauccucaaggcccucaacucccgccgcaucaucccccgccccuucgucgcccagaagcucgccuccuccgacgacuucaucucccagaacgucaucccccucgaggccuaccgcaacggccucaagaccgaggcccucuccgucuccgccuccgaggaggagggccucaacuuccucaacgaguacgacgagaccaagcccgagcuccccuccggcaagaagaaccagucccucacccucaucgagcuccucaagaacaagcgcaugggcgaggagcgcaacuccgccaucuccccccagaagauccacaaccagaccgcccgcaagcgcuucguccagaagugcguccucccccucaacgaggacuccccccucauguaccagccccagaagauggaccucaccaugcacuccggcaugcccgucaagcuccgcaccugcguccacugcaacaccaccuucaccuccgccgucucccucuccaaccaccuccgcgccuacgcccgcaagaaguccgccggccuccucaccggcaccgcccucgacugcaagcagaagaagucccgcucccgcuccggcuccaagaagaagaugcucacccucccccacggcgccgacgaggucuacauccuccgcugccgcuucugcggccucgucuuccgcggcccccucuccguccaggaggacuggaucaagcaccuccagcgccacaucgucaacgccaaccucccccgcaccggcgccggcauggucgaggucaccucccuccucaagaagcccgccuccaucaccgagaccuccuucucccuccucauggccgaggccgccuccuga

SEQ ID NO: 52155 - RNA, 1278 nt, Artificial Sequence
  derived and/or modified sequence opt2 from ZNF645__Homo_sapiens__NP_689790
augaacaagaugcccgccggcgagcaggagugcgaguacaacaaggagggcaaguacuacuccaagggcgucaagcucguccgcaagaagaagaagauccccggcuaccgcuggggcgacaucaagaucaacaucaucggcgagaaggacgaccuccccauccacuucugcgacaagugcgaccuccccaucaagaucuacggccgcaucauccccugcaagcacgccuucugcuaccacugcgccaaccucuacgacaaggucggcuacaaggucugcccccgcugccgcuaccccguccuccgcaucgaggcccacaagcgcggcuccgucuucaugugcuccaucguccagcagugcaagcgcaccuaccucucccagaagucccuccaggcccacaucaagcgccgccacaagcgcgcccgcaagcaggucaccuccgccucccucgagaagguccgcccccacaucgcccccccccagaccgagaucuccgacauccccaagcgccuccaggaccgcgaccaccucuccuacaucccccccgagcagcacaccauggucucccuccccuccguccagcacaugcuccaggagcagcacaaccagccccacaaggacauccaggcccccccccccgagcucucccucucccuccccuuccccauccagugggagaccgucuccaucuucacccgcaagcacggcaaccucaccgucgaccacauccagaacaacuccgacuccggcgccaagaagcccaccccccccgacuacuaccccgagugccagucccagcccgccgucuccuccccccaccacaucaucccccagaagcagcacuacgcccccccccccucccccuccucccccgucaaccaccagaugcccuaccccccccaggacgucgucacccccaacuccguccgcucccagguccccgcccucaccaccaccuacgaccccuccuccggcuacaucaucgucaaggucccccccgacaugaacucccccccccuccgcgccccccagucccagaacggcaaccccuccgccuccgaguucgccucccaccacuacaaccucaacauccucccccaguucaccgagaaccaggagacccucuccccccaguucacccagaccgacgccauggaccaccgccgcuggcccgccuggaagcgccucucccccugcccccccacccgcucccccccccccuccacccuccacggccgcucccaccacucccaccagcgccgccaccgccgcuacuga

SEQ ID NO: 52156 - RNA, 5499 nt, Artificial Sequence
  derived and/or modified sequence opt2 from ZNF646__Homo_sapiens__NP_055514
auggaggacaccccccccucccucuccugcuccgacugccagcgccacuuccccucccuccccgagcucucccgccaccgcgagcuccuccaccccucccccaaccaggacuccgaggaggccgacuccaucccccgccccuaccgcugccagcagugcggccgcggcuaccgccaccccggcucccucgucaaccaccgccgcacccacgagaccggccucuuccccugcaccaccugcggcaaggacuucuccaaccccauggcccucaagucccacaugcgcacccacgcccccgagggccgccgccgccaccgccccccccgccccaaggaggccaccccccaccuccagggcgagaccgucuccaccgacuccuggggccagcgccucggcuccuccgagggcugggagaaccagaccaagcacaccgaggagacccccgacugcgaguccguccccgacccccgcgccgccuccggcaccugggaggaccuccccacccgccagcgcgagggccucgccucccaccccggccccgaggacggcgccgacggcuggggccccuccaccaacuccgcccgcgcccccccccuccccauccccgccuccucccuccucuccaaccucgagcaguaccucgccgaguccgucgucaacuucaccggcggccaggagcccacccaguccccccccgccgaggaggagcgccgcuacaagugcucccagugcggcaagaccuacaagcacgccggcucccucaccaaccaccgccagucccacacccucggcaucuaccccugcgccaucugcuucaaggaguucuccaaccucauggcccucaagaaccacucccgccuccacgcccaguaccgccccuaccacugcccccacugcccccgcgucuuccgccucccccgcgagcuccucgagcaccagcagucccacgagggcgagcgccaggagccccgcugggaggagaagggcaugcccaccaccaacggccacaccgacgaguccucccaggaccagcuccccuccgcccagaugcucaacggcuccgccgagcucuccaccuccggcgagcucgaggacuccggccucgaggaguaccgccccuuccgcugcggcgacugcggccgcaccuaccgccacgccggcucccucaucaaccaccgcaagucccaccagaccggcgucuaccccugcucccucugcuccaagcagcucuucaacgccgccgcccucaagaaccacguccgcgcccaccaccgcccccgccagggcgucggcgagaacggccagcccuccgucccccccgccccccuccuccucgccgagaccacccacaaggaggaggaggaccccaccaccacccucgaccaccgccccuacaagugcuccgagugcggccgcgccuaccgccaccgcggcucccucgucaaccaccgccacucccaccgcaccggcgaguaccagugcucccucugcccccgcaaguaccccaaccucauggcccuccgcaaccacguccgcguccacugcaaggccgcccgccgcuccgccgacaucggcgccgagggcgcccccucccaccucaaggucgagcucccccccgaccccgucgaggccgaggccgccccccacaccgaccaggaccacgucugcaagcacgaggaggaggccaccgacaucacccccgccgccgacaagaccgccgcccacaucugcuccaucugcggccuccucuucgaggacgccgagucccucgagcgccacggccucacccacggcgccggcgagaaggagaacucccgcaccgagaccaccaugucccccccccgcgccuucgccugccgcgacugcggcaaguccuaccgccacuccggcucccucaucaaccaccgccagacccaccagaccggcgacuucuccugcggcgccugcgccaagcacuuccacaccauggccgccaugaagaaccaccuccgccgccacucccgccgccgcucccgccgccaccgcaagcgcgccggcggcgccuccggcggccgcgaggccaagcuccucgccgccgaguccuggacccgcgagcucgaggacaacgagggccucgaguccccccaggaccccuccggcgaguccccccacggcgccgagggcaaccucgaguccgacggcgacugccuccaggccgaguccgagggcgacaagugcggccucgagcgcgacgagacccacuuccagggcgacaaggaguccggcggcaccggcgagggccucgagcgcaaggacgccucccuccucgacaaccucgacauccccggcgaggagggcggcggcacccacuucugcgacucccucaccggcgucgacgaggaccagaagcccgccaccggccagcccaacuccuccucccacuccgccaacgccgucaccggcuggcaggccggcgccgcccacaccugcuccgacugcggccacuccuucccccacgccaccggccuccucucccaccgccccugccacccccccggcaucuaccagugcucccucugccccaaggaguucgacucccuccccgcccuccgcucccacuuccagaaccaccgccccggcgaggccaccuccgcccagcccuuccucugcugccucugcggcaugaucuuccccggccgcgccggcuaccgccuccaccgccgccaggcccacuccuccuccggcaugaccgagggcuccgaggaggagggcgaggaggagggcgucgccgaggccgcccccgcccgcucccccccccuccagcucuccgaggccgagcuccucaaccagcuccagcgcgaggucgaggcccucgacuccgccggcuacggccacaucugcggcugcugcggccagaccuacgacgaccucggcucccucgagcgccaccaccagucccaguccuccggcaccaccgccgacaaggcccccuccccccucggcgucgccggcgacgccauggagauggucgucgacuccguccucgaggacaucgucaacuccgucuccggcgagggcggcgacgccaagucccaggagggcgccggcaccccccucggcgacucccucugcauccagggcggcgagucccuccucgaggcccagccccgccccuuccgcugcaaccagugcggcaagaccuaccgccacggcggcucccucgucaaccaccgcaagauccaccagaccggcgacuuccucugccccgucugcucccgcugcuaccccaaccucgccgccuaccgcaaccaccuccgcaaccacccccgcugcaagggcuccgagccccaggucggccccauccccgaggccgccggcuccuccgagcuccaggucggccccauccccgagggcggcuccaacaagccccagcacauggccgaggagggccccggccaggccgaggucgagaagcuccaggaggagcucaaggucgagccccucgaggaggucgcccgcgucaaggaggaggucugggaggagaccaccgucaagggcgaggagaucgagccccgccucgagaccgccgagaagggcugccagaccgaggccuccuccgagcgccccuucuccugcgaggucugcggccgcuccuacaagcacgccggcucccucaucaaccaccgccagucccaccagaccggccacuucggcugccaggccugcuccaagggcuucuccaaccucaugucccucaagaaccaccgccgcauccacgccgacccccgccgcuuccgcugcuccgagugcggcaaggccuuccgccuccgcaagcagcucgccucccaccagcgcguccacauggagcgccgcggcggcggcggcacccgcaaggccacccgcgaggaccgccccuuccgcugcggccagugcggccgcaccuaccgccacgccggcucccuccucaaccaccgccgcucccacgagaccggccaguacuccugccccaccugccccaagaccuacuccaaccgcauggcccucaaggaccaccagcgccuccacuccgagaaccgccgccgccgcgccggccgcucccgccgcaccgccguccgcugcgcccucugcggccgcuccuuccccggccgcggcucccucgagcgccaccuccgcgagcacgaggagaccgagcgcgagcccgccaacggccagggcggccucgacggcaccgccgccuccgaggccaaccucaccggcucccagggccucgagacccagcucggcggcgccgagcccgucccccaccucgaggacggcgucccccgccccggcgagcgcucccagucccccauccgcgccgccuccuccgaggcccccgagccccucuccuggggcgccggcaaggccggcggcuggcccgucggcggcggccucggcaaccacuccggcggcugggucccccaguuccucacccgcuccgaggagcccgaggacuccguccaccgcucccccugccacgccggcgacugccagcucaacggccccacccucucccacauggacuccugggacaaccgcgacaacuccucccagcuccagcccggcucccacuccuccugcucccagugcggcaagaccuacugccaguccggcucccuccucaaccacaacaccaacaagaccgaccgccacuacugccuccucugcuccaaggaguuccucaaccccgucgccaccaagucccacucccacaaccacaucgacgcccagaccuucgccugccccgacugcggcaaggccuucgagucccaccaggagcucgccucccaccuccaggcccacgcccgcggccacucccagguccccgcccagauggaggaggcccgcgaccccaaggccggcaccggcgaggaccaggucguccuccccggccagggcaaggcccaggaggcccccuccgagaccccccgcggccccggcgaguccgucgagcgcgcccgcggcggccaggccgucaccuccauggccgccgaggacaaggagcgccccuuccgcugcacccagugcggccgcuccuaccgccacgccggcucccuccucaaccaccagaaggcccacaccaccggccucuaccccugcucccucugccccaagcuccuccccaaccuccucucccucaagaaccacucccgcacccacaccgaccccaagcgccacugcugcuccaucugcggcaaggccuuccgcaccgccgcccgccucgagggccacggccgcguccacgccccccgcgagggccccuucaccugcccccacugcccccgccacuuccgccgccgcaucuccuucguccagcaccagcagcagcaccaggaggaguggaccgucgccggcuccggcgcccccgucgcccccgucaccggccgcggcgaccucccccucccccccccccccacccccaccaccccccuccucgaccccuccccccaguggcccgccgaccucuccuucucccucuga

SEQ ID NO: 52157 - RNA, 1821 nt, Artificial Sequence
  derived and/or modified sequence opt2 from ZNF652__Homo_sapiens__NP_001138837
augucccacaccgccuccuccugccaggagcucgucgagaacugcgccguccacgucgccggcauggcccaggaggacucccgccgcggccagguccccuccuccuucuaccacggcgccaaccaggagcucgaccucuccaccaaggucuacaagcgcgaguccggcucccccuacuccguccucgucgacaccaagauguccaagccccaccuccacgagaccgaggagcagcccuacuuccgcgagacccgcgccgucuccgacguccacgccgucaaggaggaccgcgagaacuccgacgacaccgaggaggaggaggaggaggucuccuacaagcgcgagcagaucaucgucgaggucaaccucaacaaccagacccucaacgucuccaagggcgagaagggcgucuccucccaguccaaggagacccccguccucaagaccuccuccgaggaggaggaggaggaguccgaggaggaggccaccgacgacuccaacgacuacggcgagaacgagaagcagaagaagaaggagaagaucgucgagaaggucuccgucacccagcgccgcacccgccgcgccgccuccgucgccgccgccaccaccucccccaccccccgcaccacccgcggccgccgcaaguccgucgagccccccaagcgcaagaagcgcgccaccaaggagcccaaggcccccguccagaaggccaagugcgaggagaaggagacccucaccugcgagaagugcccccgcgucuucaacacccgcugguaccucgagaagcacaugaacgucacccaccgccgcaugcagaucugcgacaagugcggcaagaaguucguccucgaguccgagcucucccuccaccagcagaccgacugcgagaagaacauccagugcgucuccugcaacaaguccuucaagaagcucuggucccuccacgagcacaucaagaucguccacggcuacgccgagaagaaguucuccugcgagaucugcgagaagaaguucuacaccauggcccacguccgcaagcacauggucgcccacaccaaggacaugcccuucaccugcgagaccugcggcaaguccuucaagcgcuccaugucccucaagguccacucccuccagcacuccggcgagaagcccuuccgcugcgagaacugcgacgagcgcuuccaguacaaguaccagcuccgcucccacauguccauccacaucggccacaagcaguucaugugccaguggugcggcaaggacuucaacaugaagcaguacuucgacgagcacaugaagacccacaccggcgagaagcccuucaucugcgagaucugcggcaaguccuucaccucccgccccaacaugaagcgccaccgccgcacccacaccggcgagaagcccuaccccugcgacgucugcggccagcgcuuccgcuucuccaacaugcucaaggcccacaaggagaagugcuuccgcgucaccucccccgucaacgucccccccgccguccagaucccccucaccaccucccccgccacccccguccccuccgucgucaacaccgccaccacccccaccccccccaucaacaugaaccccgucuccacccuccccccccgccccaucccccaccccuucucccaccuccacauccacccccacccccaccacccccaccaccuccccaucccccccgucccccaccucccccccccccccgcccucuucaaguccgagccccucaaccaccgcggccaguccgaggacaacuuccuccgccaccucgccgagaagaacuccuccgcccagcaccacuga

SEQ ID NO: 52158 - RNA, 1746 nt, Artificial Sequence
  derived and/or modified sequence opt2 from ZNF654__Homo_sapiens__NP_060763
augcucugcaacaaggaguuccucggcggccacaucguccgccacgcccaggcccaccagaagaagggcuccuucgccugcgucaucugcggccgcaaguuccgcaaccgcggccucaugcagaagcaccucaagaaccacgucaagaagauccagcgccagcagaucgccgccgcccagcaggacgaccaggaggucaccgcccucgaggagaucaacugcuccuccuccuccaucuccuucgagaacggcaacuccgacuccaaggaccucgaggucgagacccucaccgccuccuccgagggcaacaaggaggucauccccgagcacgucgccgaguucaucgagauccccaucuccguccccgaggacgucaucgagaacgucaucgagaacggcucccccaacaacucccucaacaacgucuucaagccccucaccgagugcggcgacgacuacgaggaggaggaggacgaggagggcgacuacgaggaggacgacuacgaccucaaccaggagaccuccgucauccacaagaucaacggcaccgucugccaccccaaggacaucuacgccaccgaccaggagggcaacuucaagugccccgcccucggcugcguccgcaucuucaagcgcaucggcuuccucaacaagcacgccaugaccguccaccccaccgaccucaacguccgccagaccgucaugaagugguccaagggcaagugcaaguucugccagcgccaguucgaggacucccagcacuucaucgaccaccucaaccgccacuccuaccccaacgucuacuucugccuccacuucaacugcaacgaguccuucaagcuccccuuccagcucgcccagcacaccaagucccaccgcaucuuccaggcccagugcuccuuccccgagugccacgagcucuucgaggaccucccccuccucuacgagcacgaggcccagcacuaccucuccaagacccccgaguccuccgcccagcccuccgagaccauccucugggacguccagaccgacuccaaccccaaccaggagaaggacuccuccuccaacgagaagcagaccaucucccuccccgucuccaccuccaagucccgcaaggaguccaccgagcccaagaccugcaucgaguccauggagaagaagaccgacucccucguccagaacggcaacgagcgcuccgacgacaccgucuccaacaucucccucaucgaccagaagaugcccgacaucgagcccaacuccgagaacaacugcuccuccuccgacaucgucaacggccacuccgagaucgagcagaccccccucgucuccuccgaccccgcccucaagaucgacaccaaccgcauccgcaccgagaacggcuccauccuccccuccgucgucccccaggagcacaacacccuccccgucucccaggcccccuccaagcccaaccucaccuccgagcacaccuccuacggccucauccucaccaagcccuacguccgcccccucccccccuccuaccucgacgagcgcuaccucuccaugcccaagcgccgcaaguuccucaccgaccgcgucgacgccugcuccgaccaggacaacgucuacaagaaguccgucaagcgccuccgcugcggcaagugccucaccaccuacugcaacgccgaggcccucgaggcccaccucgcccagaagaagugccagacccucuucggcuucgacuccgacgacgaguccgccuga

SEQ ID NO: 52159 - RNA, 786 nt, Artificial Sequence
  derived and/or modified sequence opt2 from ZNF664__Homo_sapiens__NP_689650
augaucuacaagugccccaugugccgcgaguucuucuccgagcgcgccgaccucuucaugcaccagaagauccacaccgccgagaagccccacaagugcgacaagugcgacaagggcuucuuccacaucuccgagcuccacauccacuggcgcgaccacaccggcgagaaggucuacaagugcgacgacugcggcaaggacuucuccaccaccaccaagcucaaccgccacaagaagauccacaccgucgagaagcccuacaagugcuacgagugcggcaaggccuucaacugguccucccaccuccagauccacaugcgcguccacaccggcgagaagcccuacgucugcuccgagugcggccgcggcuucuccaacuccuccaaccucugcaugcaccagcgcguccacaccggcgagaagcccuucaagugcgaggagugcggcaaggccuuccgccacaccuccucccucugcaugcaccagcgcguccacaccggcgagaagcccuacaagugcuacgagugcggcaaggccuucucccaguccuccucccucugcauccaccagcgcguccacaccggcgagaagcccuaccgcugcugcggcugcggcaaggccuucucccaguccuccucccucugcauccaccagcgcguccacaccggcgagaagcccuucaagugcgacgagugcggcaaggccuucucccaguccaccucccucugcauccaccagcgcguccacaccaaggagcgcaaccaccucaagaucuccgucaucuga

SEQ ID NO: 52160 - RNA, 1833 nt, Artificial Sequence
  derived and/or modified sequence opt2 from ZNF667__Homo_sapiens__NP_071386
augcccuccgcccgcggcaaguccaaguccaaggcccccaucaccuucggcgaccucgccaucuacuucucccaggaggagugggaguggcucucccccauccagaaggaccucuacgaggacgucaugcucgagaacuaccgcaaccucgucucccucggccucuccuuccgccgccccaacgucaucacccuccucgagaagggcaaggcccccuggauggucgagcccguccgccgccgccgcgcccccgacuccggcuccaagugcgagaccaagaagcucccccccaaccagugcaacaaguccggccaguccaucugccagaagcucgucuccgcccagcagaaggcccccacccgcaaguccggcugcaacaagaacuccguccucgucaagcccaagaagggccacuccggcaagaagccccucaagugcaacgacugcggcaagaccuucucccgcuccuucucccucaagcuccaccagaacauccacaccggcgagaagcccuucgagugcuccaacugccgcaaggccuuccgccagaucuccuccauccuccuccaccagcgcauccacuccggcaagaagucccacgagugcaacaagugcggcgaguccuucaaccagcgcaccacccucauccuccacaugcgcauccacgacggcaaggagauccucgacugcggcaaggcccucucccagugccaguccuucaacauccaccagaagauccacgucgucggcaacgucugccagugccgcaagugcggcaaggccuucaaccagauguccucccuccuccuccacaagaagauccacaacggcaagaagacccacaaguacaacaagugcggccgcggcuucaagaagaaguccgucuucgucguccacaagcgcauccacgccggcgagaagauccccgagaacgccaaggcccucucccagucccuccagcagcgcucccaccaccucgagaaccccuucaagugccgcaagugcggcaagcucuucaaccgcaucuccccccucaugcuccaccagcgcauccacaccuccgagaagcccuacaagugcgacaagugcgacaaguucuuccgccgccucuccacccucauccuccaccuccgcauccacaacggcgagaagcucuaccgcugcaacaagugcgagaaggucugcaaccgccacuccucccucauccagcaccagaagguccacaccaagaagaagaagcucuucgagugcaaggagugcggcaagauguucuccggcaccgccaaccucaagauccaccagaacauccacuccgaggagaagcccuucaagugcaacaagugcuccaaggucuucggccgccaguccuuccucaucgagcaccagcgcauccacaccggcgagaagcccuaccagugcgaggagugcggcaaggccuucucccaccgcaucucccucacccgccacaagcgcauccacaccgaggaccgccccuacgagugcgaccagugcggcaaggccuucucccaguccgcccaccucgcccagcacgagcgcauccacaccggcgagaagcccuacaccugcaagaccugcggcaaggccuucucccagcgcaccucccucauccuccacgagcgcucccacaccggcgagaagcccuacgagugcaacgagugcggcaaggccuucuccuccggcuccgaccucauccgccaccagcgcucccacuccuccgagaagcccuacgagugcuccaagugcggcaaggccuacucccgcuccuccucccucauccgccaccagaacacccacuccgaggagaaggccuga

SEQ ID NO: 52161 - RNA, 1860 nt, Artificial Sequence
  derived and/or modified sequence opt2 from ZNF668__Homo_sapiens__NP_078982
auggaggucgaggccgccgaggcccgcucccccgcccccggcuacaagcgcuccggccgccgcuacaagugccucuccugcaccaagaccuuccccaacgccccccgcgccgcccgccacgccgccacccacggccccgccgacugcuccgaggaggucgccgaggucaagcccaagcccgagaccgaggccaaggccgaggaggccuccggcgagaaggucuccggcuccgccgccaagccccgccccuacgccugcccccucugccccaaggccuacaagaccgcccccgagcuccgcucccacggccgcucccacaccggcgagaagcccuuccccugccccgagugcggccgccgcuucaugcagcccgucugccuccgcguccaccucgccucccacgccggcgagcuccccuuccgcugcgcccacugccccaaggccuacggcgcccucuccaagcucaagauccaccagcgcggccacaccggcgagcgccccuacgccugcgccgacugcggcaaguccuucgccgaccccuccgucuuccgcaagcaccgccgcacccacgccggccuccgccccuacuccugcgagcgcugcggcaaggccuacgccgagcucaaggaccuccgcaaccacgagcgcucccacaccggcgagcgccccuuccucugcuccgagugcggcaaguccuucucccgcuccuccucccucaccugccaccagcgcauccacgccgcccagaagcccuaccgcugccccgccugcggcaagggcuucacccagcucuccuccuaccagucccacgagcgcacccacuccggcgagaagcccuuccucugcccccgcugcggccgcauguucuccgaccccuccuccuuccgccgccaccagcgcgcccacgagggcgucaagcccuaccacugcgagaagugcggcaaggacuuccgccagcccgccgaccucgccaugcaccgccgcguccacaccggcgaccgccccuucaagugccuccagugcgacaagaccuucgucgccuccugggaccucaagcgccacgcccucguccacuccggccagcgccccuuccgcugcgaggagugcggccgcgccuucgccgagcgcgccucccucaccaagcacucccgcguccacuccggcgagcgccccuuccacugcaacgccugcggcaaguccuucgucgucuccuccucccuccgcaagcacgagcgcacccaccgcuccuccgaggccgccggcgucccccccgcccaggagcucgucgucggccucgcccuccccgucggcgucgccggcgaguccuccgccgcccccgccgccggcgccggccucggcgacccccccgccggccuccucggccucccccccgaguccggcggcgucauggccacccaguggcaggucgucggcaugaccgucgagcacgucgagugccaggacgccggcguccgcgaggcccccggcccccucgagggcgccggcgaggccggcggcgaggaggccgacgagaagcccccccaguucgucugccgcgagugcaaggagaccuucuccaccaugacccuccuccgccgccacgagcgcucccaccccgagcuccgccccuuccccugcacccagugcggcaaguccuucuccgaccgcgccggccuccgcaagcacucccgcacccacuccuccguccgccccuacaccugcccccacugccccaaggccuuccucuccgccuccgaccuccgcaagcacgagcgcacccaccccguccccaugggcacccccaccccccucgagccccucgucgcccuccucggcaugcccgaggagggccccgccuga

SEQ ID NO: 52162 - RNA, 1728 nt, Artificial Sequence
  derived and/or modified sequence opt2 from ZNF674__Homo_sapiens__NP_001139763
auggccaugucccaggagucccucaccuucaaggacgucuucgucgacuucacccucgaggaguggcagcagcucgacuccgcccagaagaaccucuaccgcgacgucaugcucgagaacuacucccaccucgucuccgucggccaccucgucggcaagcccgacgucaucuuccgccucggccccggcgacgaguccuggauggccgacggcggcacccccguccgcaccugcgccgucugggaggucgacgagcagaucgaccacuacaaggagucccaggacaaguuccucuggcaggccgccuucaucggcaaggagacccucaaggacgaguccggccaggagugcaagaucugccgcaagaucaucuaccucaacaccgacuucgucuccgucaagcagcgccuccccaaguacuacuccugggagcgcugcuccaagcaccaccucaacuuccucggccagaaccgcuccuacguccgcaagaaggacgacggcugcaaggccuacuggaaggucugccuccacuacaaccuccacaaggcccagcccgccgagcgcuucuucgaccccaaccagcgcggcaaggcccuccaccagaagcaggcccuccgcaagucccagcgcucccagaccggcgagaagcucuacaagugcaccgagugcggcaaggucuucauccagaaggccaaccucgucguccaccagcgcacccacaccggcgagaagcccuacgagugcugcgagugcgccaaggccuucucccagaaguccacccucaucgcccaccagcgcacccacaccggcgagaagcccuacgagugcuccgagugcggcaagaccuucauccagaaguccacccucaucaagcaccagcgcacccacaccggcgagaagcccuucgucugcgacaagugccccaaggccuucaaguccuccuaccaccucauccgccacgagaagacccacauccgccaggccuucuacaagggcaucaagugcaccaccuccucccucaucuaccagcgcauccacaccuccgagaagccccagugcuccgagcacggcaaggccuccgacgagaagcccucccccaccaagcacuggcgcacccacaccaaggagaacaucuacgagugcuccaagugcggcaaguccuuccgcggcaagucccaccucuccguccaccagcgcauccacaccggcgagaagcccuacgagugcuccaucugcggcaagaccuucuccggcaagucccaccucuccguccaccaccgcacccacaccggcgagaagcccuacgagugccgccgcugcggcaaggccuucggcgagaaguccacccucaucguccaccagcgcaugcacaccggcgagaagcccuacaagugcaacgagugcggcaaggccuucuccgagaaguccccccucaucaagcaccagcgcauccacaccggcgagcgccccuacgagugcaccgacugcaagaaggccuucucccgcaaguccacccucaucaagcaccagcgcauccacaccggcgagaagcccuacaagugcuccgagugcggcaaggccuucuccgucaaguccacccucaucguccaccaccgcacccacaccggcgagaagcccuacgagugccgcgacugcggcaaggccuucuccggcaaguccacccucaucaagcaccagcgcucccacaccggcgacaagaaccucuga

SEQ ID NO: 52163 - RNA, 1896 nt, Artificial Sequence
  derived and/or modified sequence opt2 from ZNF676__Homo_sapiens__XP_011526034
augugguccguccucugccucucccuccagcccgagggcgcccucaccuuccgcgacgucgccaucgaguucucccucgaggaguggcagugccucgacuccacccagcagaaccucuaccgcaacgucaugcucgagaacuaccgcaaccucgucuuccucggcaucgccgccuucaagcccgaccucaucaucuuccucgagcagggcaaggagcccuggaacaugaagcgccacgagauggucgaggagccccccgucaucugcucccacuucucccaggaguucuggcccgagcagggcaucgaggacuccuuccagaagaugauccuccgccgcuacgacaagugcggccacgagaaccuccaccucaagaucuccugcaccaacgucgacgagugcaacguccacaaggagggcuacaacaagcucaaccagucccucaccaccacccaguccaaggucuuccagugcggcaaguacgccaacgucuuccacaagugcuccaacuccaaccgccacaagauccgccacaccggcgagaagggccucaagugcaaggaguacguccgcuccuucugcaugcucucccaccucucccagcacgagcgcaucuacacccgcgagaacuccuacaagugcgaggagaacggcaaggccuucaacugguccuccacccucaccuacuacaaguccauccacaccggcgagaagcccuacaagugcgaggagugcggcaaggccuucuccaaguucuccauccucaccaagcacaaggucauccacaccggcgagaagcccuacaagugcgaggagugcggcaaggccuucaaccgcuccuccauccucaccaagcacaagaucauccacaccggcgagaagcccuacaagugcgaggagugcggcaagggcuucuccuccgucuccacccucaacacccacaaggccauccacgccgaggagaagcccuacaagugcgaggagugcggcaaggccuccaacuccuccuccaagcucauggagcacaagcgcauccacaccggcgagaagcccuacaagugcgaggagugcggcaaggccuucuccugguccuccucccucaccgagcacaagcgcauccacgccggcgagaagcccuacaagugcgaggagugcggcaaggccuucaaccgcuccuccauccucaccaagcacaagaucauccacaccggcgagaagcccuacaagugcgagggcugcggcaaggccuucuccaaggucuccacccucaacacccacaaggccauccacgccgaggagaagcccuacaagugcgaggagugcggcaaggccuccaacuccuccuccaagcucauggagcacaagcgcauccacaccggcgagaagcccuacaagugcgaggagugcggcaaggccuucuccugguccuccucccucaccgagcacaagcgcauccacgccggcgagaagcccuacaagugcgaggagugcggcaaggccuucaccugguccuccuccuucaccaagcacaagcgcauccacgccgccgagaagcccuacaagugcgaggagugcggcaagggcuucuccaccuucuccauccucaccaagcacaagaucauccacaccggcgagaagcgcuacaagugcgaggagugcggcaaggccuucuccugguccuccauccucaccgagcacaagaucauccacaccggcgagaagcccuacaagugcgaggagugcggcaaggccuucucccgcuccuccucccucacccgccacaagcgcauccacaccggcgagaagcccuacaagugcgaggagugcggcaaggccuucaaguccuccuccaccgucuccuaccacaagaagauccacaccggcgagaaccccuga

SEQ ID NO: 52164 - RNA, 1743 nt, Artificial Sequence
  derived and/or modified sequence opt2 from ZNF678__Homo_sapiens__NP_848644
augcccggccaccccgagucccgcaagacccgccgcauccucaccaugcucccccgccucguccucaacuccuucccccaggucauccuccuccccaacccccccaagguccuccgccuccagggccuccucgccuucuccgacgucgucaucgaguucucccccgaggagugggccugccucgaccccgcccagcgcaaccucuaccgcgacgucauguucgagaacuaccgcaaccucgucucccucgccauccucuccuacuccauccaggaccuccuccccgagcaggacaugaaggaccucugccagaaggucacccucacccgccaccgcuccuggggccucgacaaccuccaccucgucaaggacuggcgcaccgucaacgagggcaagggccagaaggaguacugcaaccgccucacccagugcuccuccaccaaguccaagaucuuccagugcaucgagugcggccgcaacuucuccuggcgcuccauccucaccgagcacaagcgcauccacaccggcgagaagcccuacaagugcgaggagugcggcaaggucuucaaccgcugcuccaaccucaccaagcacaagcgcauccacaccggcgagaagcccuacaagugcgacgagugcggcaaggucuucaacugguggucccagcucaccaaccacaagaagauccacaccggcgagaagcccuacaagugcgacgagugcgacaaggucuucaacugguggucccagcucaccucccacaagaagauccacuccggcgagaagcccuaccccugcgaggagugcggcaaggccuucacccaguucuccaaccucacccagcacaagcgcauccacaccggcgagaagcccuacaagugcaaggagugcugcaaggccuucaacaaguucuccaaccucacccagcacaagcgcauccacaccggcgagaagcccuacaagugcgaggagugcggcaacgucuucaacgagugcucccaccucacccgccaccgccgcauccacaccggcgagaagcccuacaagugcgaggagugcggcaaggccuucacccaguucgccucccucacccgccacaagcgcauccacaccggcgagaagcccuaccagugcgaggagugcggcaagaccuucaaccgcugcucccaccucuccucccacaagcgcauccacaccggcgagaagcccuacaagugcgaggagugcggccgcaccuucacccaguucuccaaccucacccagcacaagcgcauccacaccggcgagaagcccuacaagugcaaggagugcggcaaggccuucaacaaguucuccucccucacccagcaccgccgcauccacaccggcgucaagcccuacaagugcgaggagugcggcaaggucuucaagcagugcucccaccucaccucccacaagcgcauccacaccggcgagaagcccuacaagugcaaggagugcggcaaggccuucuaccaguccuccauccucuccaagcacaagcgcauccacaccgaggagaagcccuacaagugcgaggagugcggcaaggccuucaaccaguucuccucccucacccgccacaagcgcauccacaccggcgagaagcgcuacaagugcaaggagugcggcaagggcuucuaccaguccuccauccacuccaaguacaagcgcaucuacaccggcgaggagcccgacaagugcaagaagugcggcucccucuga

SEQ ID NO: 52165 - RNA, 1623 nt, Artificial Sequence
  derived and/or modified sequence opt2 from ZNF683__Homo_sapiens__XP_011539498
augaucacccgcgucggcugggagguccgcaucgagggcaacggcgacaugaaggaggaguccgccgcccagcucggcugcugccaccgccccauggcccucggcggcaccggcggcucccucucccccucccucgacuuccagcucuuccgcggcgaccaggucuucuccgccugccgcccccuccccgacauggucgacgcccacggccccuccugcgccuccuggcucugcccccucccccucgcccccggccgcuccgcccuccucgccugccuccaggaccucgaccucaaccucugcaccccccagcccgccccccucggcaccgaccuccagggccuccaggaggacgcccucuccaugaagcacgagccccccggccuccaggccuccuccaccgacgacaagaaguucaccgucaaguacccccagaacaaggacaagcucggcaagcagcccgagcgcgccggcgagggcgcccccugccccgccuucuccucccacaacuccuccuccccccccccccuccagaaccgcaagucccccuccccccucgccuucugccccugcccccccgucaacuccaucuccaaggagcuccccuuccuccuccacgccuucuaccccggcuacccccuccuccucccccccccccaccucuucaccuacggcgcccuccccuccgaccagugcccccaccuccucaugcucccccaggaccccuccuaccccaccauggccaugcccucccuccucaugauggucaacgagcucggccaccccuccgcccgcugggagacccuccuccccuaccccggcgccuuccaggccuccggccaggcccuccccucccaggcccgcaaccccggcgccggcgccgcccccaccgacucccccggccucgagcgcggcggcauggccucccccgccaagcgcgucccccucuccucccagaccggcaccgccgcccuccccuacccccucaagaagaagaacggcaagauccucuacgagugcaacaucugcggcaaguccuucggccagcucuccaaccucaagguccaccuccgcguccacuccggcgagcgccccuuccagugcgcccucugccagaaguccuucacccagcucgcccaccuccagaagcaccaccucguccacaccggcgagcgcccccacaagugcuccauccccuggguccccggccgcaaccacuggaaguccuuccaggccuggcgcgagcgcgaggucugccacaagcgcuucuccuccuccuccaaccucaagacccaccuccgccuccacuccggcgcccgccccuuccagugcuccgucugccgcucccgcuucacccagcacauccaccucaagcuccaccaccgccuccacgccccccagcccugcggccucguccacacccagcucccccucgccucccucgccugccucgcccaguggcaccagggcgcccucgaccucauggccgucgccuccgagaagcacaugggcuacgacaucgacgaggucaaggucuccuccaccucccagggcaaggcccgcgccgucucccucuccuccgccggcaccccccucgucaugggccaggaccagaacaacuga

SEQ ID NO: 52166 - RNA, 3714 nt, Artificial Sequence
  derived and/or modified sequence opt2 from ZNF687__Homo_sapiens__NP_001291693
augggcgacaugaagacccccgacuucgacgaccuccucgccgccuucgacauccccgacaucgacgccaacgaggccauccacuccggccccgaggagaacgagggccccggcggccccggcaagcccgagcccggcgucggcuccgaguccgaggacaccgccgccgccuccgccggcgacggccccggcguccccgcccaggccuccgaccacggccuccccccccccgacaucuccgucgucuccgucaucgucaagaacaccgucugccccgagcaguccgaggcccucgccggcggcuccgccggcgacggcgcccaggccgccggcgucaccaaggagggccccgucggcccccaccgcaugcagaacggcuucggcucccccgagcccucccuccccggcaccccccacucccccgccccccccuccggcggcaccuggaaggagaagggcauggagggcaagaccccccucgaccucuucgcccacuucggccccgagcccggcgaccacuccgacccccucccccccuccgcccccucccccacccgcgagggcgcccucacccccccccccuuccccuccuccuucgagcucgcccaggagaacggccccggcaugcagccccccgucuccucccccccccucggcgcccucaagcaggaguccugcuccccccaccacccccagguccucgcccagcagggcuccggcuccucccccaaggccaccgacauccccgccuccgccucccccccccccgucgccggcguccccuucuucaagcagucccccggccaccaguccccccucgccucccccaagguccccgucugccagccccucaaggaggaggacgacgacgagggccccgucgacaaguccucccccggcuccccccagucccccuccuccggcgccgaggccgccgacgaggacuccaacgacucccccgccuccuccuccucccgcccccucaagguccgcaucaagaccaucaagaccuccugcggcaacaucacccgcaccgucacccagguccccuccgaccccgacccccccgccccccucgccgagggcgccuuccucgccgaggccucccuccucaagcucucccccgccacccccaccuccgagggccccaaggucgucuccguccagcucggcgacggcacccgccucaagggcaccguccuccccgucgccaccauccagaacgccuccaccgccaugcucauggccgccuccgucgcccgcaaggccgucguccuccccggcggcaccgccaccucccccaagaugaucgccaagaacguccucggccucgucccccaggcccuccccaaggccgacggccgcgccggccucggcaccggcggccagaaggucaacggcgccuccgucgucaugguccagcccuccaagaccgccaccggccccuccaccggcggcggcaccgucaucucccgcacccaguccucccucgucgaggccuucaacaagauccucaacuccaagaaccuccuccccgccuaccgccccaaccucuccccccccgccgaggccggccucgcccucccccccaccggcuaccgcugccucgagugcggcgacgccuucucccucgagaagucccucgcccgccacuacgaccgccgcuccaugcgcaucgaggucaccugcaaccacugcgcccgccgccucgucuucuucaacaagugcucccuccuccuccacgcccgcgagcacaaggacaagggccucgucaugcagugcucccaccucgucaugcgccccgucgcccucgaccagauggucggccagcccgacaucaccccccuccuccccgucgccgucccccccgucuccggcccccucgcccuccccgcccucggcaagggcgagggcgccaucaccuccuccgccaucaccaccgucgccgccgaggcccccguccucccccucuccaccgagccccccgccgcccccgccaccuccgccuacaccugcuuccgcugccucgagugcaaggagcagugccgcgacaaggccggcauggccgcccacuuccagcagcucggcccccccgcccccggcgccaccuccaacgucugccccaccugccccaugaugcuccccaaccgcugcuccuucuccgcccaccagcgcaugcacaagaaccgccccccccacgucugccccgagugcggcggcaacuuccuccaggccaacuuccagacccaccuccgcgaggccugccuccacgucucccgccgcgucggcuaccgcugccccuccugcuccgucgucuucggcggcgucaacuccaucaagucccacauccagaccucccacugcgaggucuuccacaagugccccaucugccccauggccuucaaguccggccccuccgcccacgcccaccucuacucccagcaccccuccuuccagacccagcaggccaagcucaucuacaagugcgccaugugcgacaccgucuucacccacaagccccuccucuccucccacuucgaccagcaccuccucccccagcgcgucuccgucuucaagugccccuccugcccccuccucuucgcccagaagcgcaccaugcucgagcaccucaagaacacccaccaguccggccgccucgaggagaccgccggcaagggcgccggcggcgcccuccucacccccaagaccgagcccgaggagcucgccgucucccagggcggcgccgcccccgccaccgaggaguccuccuccuccuccgaggaggaggagguccccuccucccccgagcccccccgccccgccaagcgcccccgccgcgagcucggcuccaagggccucaagggcggcggcggcggccccggcggcuggaccugcggccucugccacuccugguuccccgagcgcgacgaguacgucgcccacaugaagaaggagcacggcaaguccgucaagaaguuccccugccgccucugcgagcgcuccuucugcuccgcccccucccuccgccgccacguccgcgucaaccacgagggcaucaagcgcgucuaccccugccgcuacugcaccgagggcaagcgcaccuucuccucccgccucauccucgagaagcacguccagguccgccacggccuccagcucggcgcccagucccccggccgcggcaccacccucgcccgcggcuccuccgcccgcgcccagggccccggccgcaagcgccgccaguccuccgacuccugcuccgaggagcccgacuccaccaccccccccgccaaguccccccgcggcggccccggcuccggcggccacggcccccuccgcuaccgcuccuccuccuccaccgagcagucccucaugaugggccuccgcgucgaggacggcgcccagcagugccucgacugcggccucugcuucgccucccccggcucccucucccgccaccgcuucaucucccacaagaagcgccgcggcgucggcaaggccuccgcccucggccucggcgacggcgaggaggaggccccccccucccgcuccgaccccgacggcggcgacuccccccuccccgccuccggcggcccccucaccugcaaggucugcggcaaguccugcgacuccccccucaaccucaagacccacuuccgcacccacggcauggccuucauccgcgcccgccagggcgccgucggcgacaacuga

SEQ ID NO: 52167 - RNA, 1503 nt, Artificial Sequence
  derived and/or modified sequence opt2 from ZNF689__Homo_sapiens__NP_612456
auggccccccccuccgccccccuccccgcccagggccccggcaaggcccgccccucccgcaagcgcggccgccgcccccgcgcccucaaguucgucgacgucgccgucuacuucucccccgaggaguggggcugccuccgccccgcccagcgcgcccucuaccgcgacgucaugcgcgagaccuacggccaccucggcgcccucggcugcgccggccccaagcccgcccucaucuccuggcucgagcgcaacaccgacgacugggagcccgccgcccucgacccccaggaguacccccgcggccucaccguccagcgcaagucccgcacccgcaagaagaacggcgagaaggaggucuucccccccaaggaggccccccgcaagggcaagcgcggccgccgccccuccaagccccgccucaucccccgccagaccuccggcggccccaucugccccgacugcggcugcaccuuccccgaccaccaggcccucgagucccacaagugcgcccagaaccucaagaagcccuaccccugccccgacugcggccgccgcuucuccuaccccucccuccucgucucccaccgccgcgcccacuccggcgagugccccuacgucugcgaccagugcggcaagcgcuucucccagcgcaagaaccucucccagcaccaggucauccacaccggcgagaagcccuaccacugccccgacugcggccgcugcuuccgccgcucccgcucccucgccaaccaccgcaccacccacaccggcgagaagccccaccagugccccuccugcggccgccgcuucgccuaccccucccuccucgccauccaccagcgcacccacaccggcgagaagcccuacaccugccucgagugcaaccgccgcuuccgccagcgcaccgcccucgucauccaccagcgcauccacaccggcgagaagcccuaccccugccccgacugcgagcgccgcuucuccuccuccucccgccucgucucccaccgccgcguccacuccggcgagcgccccuacgccugcgagcacugcgaggcccgcuucucccagcgcuccacccuccuccagcaccagcuccuccacaccggcgagaagcccuaccccugccccgacugcggccgcgccuuccgccgcuccggcucccucgccauccaccgcuccacccacaccgaggagaagcuccacgccugcgacgacugcggccgccgcuucgccuaccccucccuccucgccucccaccgccgcguccacuccggcgagcgccccuacgccugcgaccucugcuccaagcgcuucgcccaguggucccaccucgcccagcaccagcuccuccacaccggcgagaagcccuuccccugccucgagugcggccgcugcuuccgccagcgcuggucccucgccguccacaagugcucccccaaggcccccaacugcuccccccgcuccgccaucggcggcuccucccagcgcggcaacgcccacuga

SEQ ID NO: 52168 - RNA, 1773 nt, Artificial Sequence
  derived and/or modified sequence opt2 from ZNF703__Homo_sapiens__NP_079345
auguccgacucccccgccggcuccaacccccgcacccccgaguccuccggcuccggcuccggcggcggcggcaagcgccccgccguccccgccgccgucucccuccucccccccgccgacccccuccgccaggccaaccgccuccccauccgcguccucaagaugcucuccgcccacaccggccaccuccuccaccccgaguaccuccagccccucuccuccacccccgucucccccaucgagcucgacgccaagaaguccccccucgcccuccucgcccagaccugcucccagaucggcaagcccgaccccccccccuccuccaagcucaacuccgucgccgccgccgccaacggccucggcgccgagaaggaccccggccgcuccgcccccggcgccgccuccgccgccgccgcccucaagcagcucggcgacucccccgccgaggacaaguccuccuucaagcccuacuccaagggcuccggcggcggcgacucccgcaaggacuccggcuccuccuccgucuccuccaccuccuccuccuccuccuccucccccggcgacaaggccggcuuccgcguccccuccgccgccugcccccccuuccccccccacggcgcccccgucuccgccuccuccuccuccuccucccccggcggcucccgcggcggcuccccccaccacuccgacugcaagaacggcggcggcgucggcggcggcgagcucgacaagaaggaccaggagcccaagcccucccccgagcccgccgccgucucccgcggcggcggcggcgagcccggcgcccacggcggcgccgaguccggcgccuccggccgcaaguccgagccccccuccgcccucgucggcgccggccacgucgcccccgucucccccuacaagcccggccacuccgucuucccccucccccccuccuccaucggcuaccacggcuccaucgucggcgccuacgccggcuaccccucccaguucguccccggccucgaccccuccaaguccggccucgucggcggccagcucuccggcggccucggccucccccccggcaagccccccuccuccuccccccucaccggcgccuccccccccuccuuccuccagggccucugccgcgaccccuacugccucggcggcuaccacggcgccucccaccucggcggcuccuccugcuccaccugcuccgcccacgaccccgccggccccucccucaaggccggcggcuacccccucgucuaccccggccacccccuccagcccgccgcccucuccuccuccgccgcccaggccgcccuccccggccacccccucuacaccuacggcuucaugcuccagaacgagccccucccccacuccugcaacugggucgccgccuccggccccugcgacaagcgcuucgccaccuccgaggagcuccucucccaccuccgcacccacaccgcccuccccggcgccgagaagcuccucgccgccuaccccggcgccuccggccucggcuccgccgccgccgccgccgccgccgccgccuccugccaccuccaccuccccccccccgccgcccccggcucccccggcucccucucccuccgcaacccccacacccucggccucucccgcuaccaccccuacggcaagucccaccucuccaccgccggcggccucgccguccccucccuccccaccgccggccccuacuacucccccuacgcccucuacggccagcgccucgccuccgccuccgcccucggcuaccaguga

SEQ ID NO: 52169 - RNA, 1239 nt, Artificial Sequence
  derived and/or modified sequence opt2 from ZNF704__Homo_sapiens__NP_001028895
augaccuucaccuuccaguccgaggaccucaagcgcgacugcggcaagaagaugucccaccagcacgucuucucccucgccauggaggaggacgucaagaccgccgacaccaagaaggccucccgcauccucgaccacgagaaggagaacacccgcuccaucugccuccucgagcagaagcgcaaggucgucuccuccaacaucgacgucccccccgcccgcaaguccuccgaggagcucgacauggacaaggucaccgccgccaugguccucaccucccucuccaccuccccccucguccgcuccccccccguccgccccaacgagucccucuccggcuccuggaaggagggcggcugcguccccuccuccaccuccuccuccggcuacugguccugguccgcccccuccgaccaguccaaccccuccacccccucccccccccucuccgccgacuccuucaagcccuuccgcucccccgcccagcccgacgacggcaucgacgaggccgaggccuccaaccuccucuucgacgagcccaucccccgcaagcgcaagaacuccaugaaggucauguucaagugccucuggaagaacugcggcaagguccucuccaccgccgccggcauccagaagcacauccgcaccauccaccucggccgcgucggcgacuccgacuacuccgacggcgaggaggacuucuacuacaccgagaucaagcucaacaccgacuccgucgccgacggccucuccucccucgcccccgucucccccucccagucccucgccuccccccccaccuuccccauccccgacuccucccgcaccgagacccccugcgccaagaccgagaccaagcucaugaccccccucucccgcuccgcccccaccacccucuaccucguccacaccgaccacgccuaccaggccaccccccccgucaccauccccggcuccgccaaguucacccccaacggcuccuccuucuccaucuccuggcaguccccccccgucaccuucaccggcauccccgucucccccacccaccaccccgucggcaccggcgagcagcgccagcacgcccacaccguccucuccucccccccccgcggcaccgucucccuccgcaagccccgcggcgagggcaagaagugccgcaaggucuacggcauggagaaccgcgacauguggugcaccgccugccgcuggaagaaggccugccagcgcuuccucgacuga

SEQ ID NO: 52170 - RNA, 231 nt, Artificial Sequence
  derived and/or modified sequence opt2 from ZNF706__Homo_sapiens__NP_001254638
auggcccgcggccagcagaagauccagucccagcagaagaacgccaagaagcaggccggccagaagaagaagcagggccacgaccagaaggccgccgccaaggccgcccucaucuacaccugcaccgucugccgcacccagaugcccgaccccaagaccuucaagcagcacuucgaguccaagcaccccaagaccccccucccccccgagcucgccgacguccaggccuga

SEQ ID NO: 52171 - RNA, 2286 nt, Artificial Sequence
  derived and/or modified sequence opt2 from ZNF711__Homo_sapiens__NP_068838
auggacuccggcggcggcucccucggccuccacacccccgacucccgcauggcccacaccaugaucaugcaggacuucgucgccggcauggccggcaccgcccacaucgacggcgaccacaucgucgucuccguccccgaggccguccucgucuccgacgucgucaccgacgacggcaucacccucgaccacggccucgccgccgaggucguccacggccccgacaucaucaccgagaccgacgucgucaccgagggcgucaucguccccgaggccguccucgaggccgacgucgccaucgaggaggaccucgaggaggacgacggcgaccacauccucaccuccgagcucaucaccgagaccguccgcguccccgagcaggucuucgucgccgaccucgucaccggccccaacggccaccucgagcacgucguccaggacugcgucuccggcgucgacucccccaccauggucuccgaggagguccucgucaccaacuccgacaccgagaccgucauccaggccgccggcggcguccccggcuccaccgucaccaucaagaccgaggacgacgacgacgacgacgucaaguccaccuccgaggacuaccucaugaucucccucgacgacgucggcgagaagcucgagcacaugggcaacaccccccucaagaucggcuccgacggcucccaggaggacgccaaggaggacggcuucggcuccgaggucaucaaggucuacaucuucaaggccgaggccgaggacgacgucgagaucggcggcaccgagaucgucaccgaguccgaguacaccuccggccacuccgucgccggcguccucgaccagucccgcaugcagcgcgagaagauggucuacauggccgucaaggacuccucccaggaggaggacgacauccgcgacgagcgccgcgucucccgccgcuacgaggacugccaggccuccggcaacacccucgacuccgcccucgagucccgcuccuccaccgccgcccaguaccuccagaucugcgacggcaucaacaccaacaagguccucaagcagaaggccaagaagcgccgccgcggcgagacccgccaguggcagaccgccgucaucaucggccccgacggccagccccucaccgucuaccccugccacaucugcaccaagaaguucaagucccgcggcuuccucaagcgccacaugaagaaccaccccgaccaccucaugcgcaagaaguaccagugcaccgacugcgacuucaccaccaacaagaaggucuccuuccacaaccaccucgagucccacaagcucaucaacaaggucgacaagacccacgaguucaccgaguacacccgccgcuaccgcgaggccuccccccucuccuccaacaagcucauccuccgcgacaaggagcccaagaugcacaagugcaaguacugcgacuacgagaccgccgagcagggccuccucaaccgccaccuccucgccguccacuccaagaacuucccccacgucugcgucgagugcggcaagggcuuccgccaccccuccgagcucaagaagcacaugcgcacccacaccggcgagaagcccuaccagugccaguacugcaucuuccgcugcgccgaccaguccaaccucaagacccacaucaaguccaagcacggcaacaaccuccccuacaagugcgagcacugcccccaggccuucggcgacgagcgcgagcuccagcgccaccucgaccucuuccagggccacaagacccaccagugcccccacugcgaccacaaguccaccaacuccuccgaccucaagcgccacaucaucuccguccacaccaaggacuucccccacaagugcgaggucugcgacaagggcuuccaccgccccuccgagcucaagaagcacuccgacauccacaagggccgcaagauccaccagugccgccacugcgacuucaagaccuccgaccccuucauccucuccggccacauccucuccguccacaccaaggaccagccccucaagugcaagcgcugcaagcgcggcuuccgccagcagaacgagcucaagaagcacaugaagacccacaccggccgcaagaucuaccagugcgaguacugcgaguacuccaccaccgacgccuccggcuucaagcgccacgucaucuccauccacaccaaggacuacccccaccgcugcgaguucugcaagaagggcuuccgccgccccuccgagaagaaccagcacaucaugcgccaccacaaggaggcccucauguga

SEQ ID NO: 52172 - RNA, 1488 nt, Artificial Sequence
  derived and/or modified sequence opt2 from ZNF716__Homo_sapiens__NP_001152751
auggccaagcgccccggcccccccggcucccgcgagaugggccuccucaccuuccgcgacaucgccaucgaguucucccucgccgaguggcagugccucgaccacgcccagcagaaccucuaccgcgacgucaugcucgagaacuaccgcaaccucgucucccucggcaucgccgucuccaagcccgaccucaucaccugccucgagcagaacaaggagccccagaacaucaagcgcaacgagauggucgccaagcaccccgucaccugcucccacuucacccaggaccuccaguccgagcagggcaucaaggacucccuccagaaggucauccuccgccgcuacggcaagugcggccaggaggaccuccaggucaagaagugcugcaaguccgucggcgagugcgagguccacaagggcggcuacaacuacgucaaccagugccucuccgccacccagaacaagaccuuccagacccacaagugcgucaaggucuucggcaaguucuccaacuccaaccgccacaagacccgccacaccggcaagaagcacuucaagugcaagaacgacggcaaguccuucugcaugcucucccgccucaaccagcaccagaucauccacacccgcgagaaguccuacaagugcgaggagugcggcaaguccuucaacugcuccuccacccucacccgccacaagcgcauccacaccggcgagaagcccuaccgcugcgaggagugcggcaaggccuucuccugguccgccucccucaccaagcacaagcgcauccacaccggcgagaagcccuacaccugcgaggagcgcggcaaggucuucucccgcuccacccucaccaacuacaagcgcauccacaccggcgagaagcccuacaccugcgaggagugcggcaaggccuucucccgcuccuccacccucaccaaccacaagcgcauccacaccggcgagcgccccuacaagugcgaggagugcggcaaggccuucucccucuccuccacccucaagaagcacaagaucguccacaccggcgagaagcucuacaccugcgaggagugcggcaaggccuucaccuucuccuccacccucaacacccacaagcgcauccacaccggcgagaagcccuacaccugcgaggagugcggcaaggccuucucccuccccuccaccuucaccuaccacaagcgcacccacaccggcgagaagcccuacaagugcgaggagugcggcaaggccuucaacugcuccuccacccucaagaagcacaagaucauccacaccggcgagaagcucuacaagugcaaggagugcggcaaggccuucaccuucuccuccacccucaacacccacaagcgcauccacaccggcgagaagcccuacaagugcgaggagugcgaccagaccuucaaguggcacuccucccucgccaaccacaagaacaugcacaccggcgagaagcccuacaaguacgaguga

SEQ ID NO: 52173 - RNA, 2745 nt, Artificial Sequence
  derived and/or modified sequence opt2 from ZNF717__Homo_sapiens__NP_001277137
auguuccccgucuucuccggcugcuuccaggagcuccaggagaagaacaagucccucgagcucgucuccuucgaggaggucgccguccacuucaccugggaggaguggcaggaccucgacgacgcccagcgcacccucuaccgcgacgucaugcucgagaccuacuccucccucgucucccucggccacuacaucaccaagcccgagaugaucuucaagcucgagcagggcgccgagcccuggaucgucgaggagacccccaaccuccgccucuccgccguccagaucaucgacgaccucaucgagcgcucccacgagucccacgaccgcuucuucuggcagaucgucaucaccaacuccaacaccuccacccaggagcgcgucgagcucggcaagaccuucaaccucaacuccaaccacguccucaaccucaucaucaacaacggcaacuccuccggcaugaagcccggccaguucaacgacugccagaacaugcucuuccccaucaagcccggcgagacccaguccggcgagaagccccacgucugcgacaucacccgccgcucccaccgccaccacgagcaccucacccagcaccacaagauccagacccuccuccagaccuuccagugcaacgagcagggcaagaccuucaacaccgaggccauguucuucauccacaagcgcguccacaucguccagaccuucggcaaguacaacgaguacgagaaggccugcaacaacuccgccgucaucguccaggucaucacccaggucggccagcccaccugcugccgcaaguccgacuucaccaagcaccagcagacccacaccggcgagaagcccuacgagugcgucgagugcgagaagcccuccaucuccaaguccgaccucaugcuccagugcaagaugcccaccgaggagaagcccuacgccugcaacuggugcgagaagcucuucuccuacaaguccucccucaucauccaccagcgcauccacaccggcgagaagcccuacggcugcaacgagugcggcaagaccuuccgccgcaaguccuuccucacccuccacgagcgcacccacaccggcgacaagcccuacaagugcaucgagugcggcaagaccuuccacugcaagucccuccucacccuccaccaccgcacccacuccggcgagaagcccuaccagugcuccgagugcggcaagaccuucucccagaaguccuaccucaccauccaccaccgcacccacaccggcgagaagcccuacgccugcgaccacugcgaggaggccuucucccacaagucccgccucaccguccaccagcgcacccacaccggcgagaagcccuacgagugcaacgagugcggcaagcccuucaucaacaaguccaaccuccgccuccaccagcgcacccacaccggcgagaagcccuacgagugcaacgagugcggcaagaccuuccaccgcaaguccuuccucaccauccaccaguggacccacaccggcgagaagcccuacgagugcaacgagugcggcaagaccuuccgcugcaaguccuuccucaccguccaccagcgcacccacgccggcgagaagcccuacgccugcaacgagugcggcaagaccuacucccacaaguccuaccucaccguccaccaccgcacccacaccggcgagaagcccuacgagugcaacgagugcggcaaguccuuccacugcaaguccuuccucaccauccaccagcgcacccacgccggcaagaagcccuacgagugcaacgagugcgagaagaccuucaucaacaagcucaaccucggcauccacaagcgcacccacaccggcgagcgccccuacgagugcaacgagugcggcaagaccuuccgccagaaguccaaccucuccacccaccagggcacccacaccggcgagaagcccuacgucugcaacgagugcggcaagaccuuccaccgcaaguccuuccucaccauccaccagcgcacccacaccggcaagaaccgcauggacgucaugaacgucgagaagcucuucguccgcaaccacacccuccucuacauccgcgagcucacccccggcaagucccccaugaacgucaugaacgucgagaaccccuucauccgccgccagaucuuccgcuccaucaaggucuucacccgcggccgcaaccccaugaacgucgccaacgucgagaagcccugccagaaguccguccucaccguccaccaccgcacccacaccggcgagaagcccuacgagugcaacgagugcggcaagaccuucugccacaaguccaaccucuccacccaccagggcacccacuccggcgagaagcccuacgagugcgacgagugccgcaagaccuucuacgacaagaccguccucaccauccaccagcgcacccacaccggcgagaagcccuucgagugcaaggagugccgcaagaccuucucccagaaguccaagcucuucguccaccaccgcacccacaccggcgagaagcccuuccgcugcaacgagugccgcaagaccuucucccagaaguccggccucuccauccaccagcgcacccacaccggcgagaagcccuacgagugcaaggagugcggcaagaccuucugccagaagucccaccucucccgccaccagcagacccacaucggcgagaaguccgacgucgccgaggccggcuacgucuucccccagaaccacuccuucuuccccuga

SEQ ID NO: 52174 - RNA, 1938 nt, Artificial Sequence
  derived and/or modified sequence opt2 from ZNF746__Homo_sapiens__NP_001156946
auggccgaggccgucgccgcccccaucucccccuggaccauggccgccaccauccaggccauggagcgcaagaucgagucccaggccgcccgccuccucucccucgagggccgcaccggcauggccgagaagaagcucgccgacugcgagaagaccgccgucgaguucggcaaccagcucgagggcaagugggccguccucggcacccuccuccaggaguacggccuccuccagcgccgccucgagaacgucgagaaccuccuccgcaaccgcaacuucuggauccuccgccucccccccggcuccaagggcgagucccccaaggaguggggcaagcucgaggacuggcagaaggagcucuacaagcacgucaugcgcggcaacuacgagacccucgucucccucgacuacgccaucuccaagcccgagguccucucccagaucgagcagggcaaggagcccugcaacuggcgccgccccggccccaagauccccgacguccccgucgaccccucccccggcuccggcccccccguccccgcccccgaccuccucaugcagaucaagcaggagggcgagcuccagcuccaggagcagcaggcccucggcgucgaggccugggccgccggccagcccgacaucggcgaggagcccuggggccucucccagcucgacuccggcgccggcgacaucuccaccgacgccaccuccggcguccacuccaacuucuccaccaccaucccccccaccuccuggcagaccgaccuccccccccaccaccccuccuccgccugcuccgacggcacccucaagcucaacaccgccgccuccaccgaggccgacgucaagaucgucaucaagaccgagguccaggaggaggaggucgucgccacccccguccaccccaccgaccucgaggcccacggcacccucuucggccccggccaggccacccgcuucuuccccucccccgcccaggagggcgccugggagucccagggcuccuccuuccccucccaggaccccguccucggccuccgcgagcccgcccgccccgagcgcgacaugggcgagcucucccccgccgucgcccaggaggagaccccccccggcgacuggcucuucggcggcguccgcuggggcuggaacuuccgcugcaagccccccgucggccucaacccccgcaccggccccgagggccuccccuacuccucccccgacaacggcgaggccauccucgaccccucccaggccccccgccccuucaacgagcccugcaaguaccccggccgcaccaagggcuucggccacaagcccggccucaagaagcaccccgccgccccccccggcggccgccccuucaccugcgccaccugcggcaaguccuuccagcuccaggucucccucuccgcccaccagcgcuccugcggcgcccccgacggcuccggccccggcaccggcggcggcggcuccggcuccggcggcggcggcggcggcuccggcggcggcuccgcccgcgacggcuccgcccuccgcugcggcgagugcggccgcugcuucacccgccccgcccaccucauccgccaccgcaugcuccacaccggcgagcgccccuuccccugcaccgagugcgagaagcgcuucaccgagcgcuccaagcucaucgaccacuaccgcacccacaccggcguccgccccuucaccugcaccgucugcggcaaguccuucauccgcaaggaccaccuccgcaagcaccagcgcaaccacgccgccggcgccaagacccccgcccgcggccagccccuccccaccccccccgccccccccgaccccuucaagucccccgccuccaagggcccccucgccuccaccgaccucgucaccgacuggaccugcggccucuccguccucggccccaccgacggcggcgacauguga

SEQ ID NO: 52175 - RNA, 1935 nt, Artificial Sequence
  derived and/or modified sequence opt2 from ZNF74__Homo_sapiens__NP_001243453
auggagauccccgcccccgagcccgagaagaccgcccucuccucccaggaccccgcccucucccucaaggagaaccucgaggacaucuccggcuggggccuccccgaggcccgcuccaaggaguccgucuccuucaaggacgucgccgucgacuucacccaggaggaguggggccagcucgacuccccccagcgcgcccucuaccgcgacgucaugcucgagaacuaccagaaccuccucgcccucggccccccccuccacaagcccgacgucaucucccaccucgagcgcggcgaggagcccugguccaugcagcgcgaggucccccgcggccccugccccgagugggagcucaaggccguccccucccagcagcagggcaucugcaaggaggagcccgcccaggagcccaucauggagcgcccccucggcggcgcccaggccuggggccgccaggccggcgcccuccagcgcucccaggccgcccccugggcccccgcccccgccauggucugggacguccccgucgaggaguucccccuccgcugcccccucuucgcccagcagcgcguccccgagggcggcccccuccucgacacccgcaagaacguccaggccaccgagggccgcaccaaggcccccgcccgccucugcgccggcgagaacgccuccacccccuccgagcccgagaaguucccccagguccgccgccagcgcggcgccggcgccggcgagggcgaguucgucugcggcgagugcggcaaggccuuccgccaguccuccucccucacccuccaccgccgcuggcacucccgcgagaaggccuacaagugcgacgagugcggcaaggccuucaccugguccaccaaccuccucgagcaccgccgcauccacaccggcgagaagcccuucuucugcggcgagugcggcaaggccuucuccugccacuccucccucaacguccaccagcgcauccacaccggcgagcgccccuacaagugcuccgccugcgagaaggccuucuccugcuccucccuccucuccaugcaccuccgcguccacaccggcgagaagcccuaccgcugcggcgagugcggcaaggccuucaaccagcgcacccaccucacccgccaccaccgcauccacaccggcgagaagcccuaccagugcggcuccugcggcaaggccuucaccugccacuccucccucaccguccacgagaagauccacuccggcgacaagcccuucaagugcuccgacugcgagaaggccuucaacucccgcucccgccucacccuccaccagcgcacccacaccggcgagaagcccuucaagugcgccgacugcggcaagggcuucuccugccacgccuaccuccucguccaccgccgcauccacuccggcgagaagcccuucaagugcaacgagugcggcaaggccuucuccucccacgccuaccucaucguccaccgccgcauccacaccggcgagaagcccuucgacugcucccagugcuggaaggccuucuccugccacuccucccucaucguccaccagcgcauccacaccggcgagaagcccuacaagugcuccgagugcggccgcgccuucucccagaaccacugccucaucaagcaccagaagauccacuccggcgagaaguccuucaagugcgagaagugcggcgagauguucaacugguccucccaccucaccgagcaccagcgccuccacuccgagggcaagccccucgccauccaguucaacaagcaccuccucuccaccuacuacguccccggcucccuccucggcgccggcgacgccggccuccgcgacgucgaccccaucgacgcccucgacgucgccaagcuccucugcgucguccccccccgcgccggccgcaacuucucccucggcuccaagccccgcaacuga

SEQ ID NO: 52176 - RNA, 2172 nt, Artificial Sequence
  derived and/or modified sequence opt2 from ZNF750__Homo_sapiens__NP_078978
augucccuccucaaggagcgcaagcccaagaagccccacuacaucccccgcccccccggcaagcccuucaaguacaagugcuuccagugccccuucaccugcaacgagaagucccaccucuucaaccacaugaaguacggccucugcaagaacuccaucacccucgucuccgagcaggaccgcguccccaagugccccaaguccaacucccucgaccccaagcagaccaaccagcccgacgccaccgccaagcccgccuccuccaaguccgucgccaacggccucuccgccuucgacuccaagcuccagcacuccuccgcccgcgaggacaucaaggagaaccucgagcuccaggcccgcggcacccaccgcugccucggccagaagcccgcccuccaccgcgccucccccugcaagucccccgcccccgaggccgcccucggcgcccagcccgcccucgagggcgccgcccgccccuccgccuucguccccgucggcgagcaccgccucaagggccccgacaacgccgaggcccccgagacccucgcccuccacaaccccaccgccaaggccgucuccuuccacaccaaguccgccuuccacacccccggcuaccccuggaaggccggcucccccuuccucccccccgaguucccccacaagaucuccuccaccaagggccucggcgccaucucccccuacaugcaccccaccauccccgaguaccccccccacuucuacaccgagcacggccucgccaccaucuacucccccuaccuccucgccggcuccucccccgagugcgacgccccccuccucuccgucuacggcacccaggacccccgccacuuccucccccaccccggccccauccccaagcaccucgcccccucccccgccaccuacgaccacuaccgcuucuuccagcaguaccccuccaaccuccccauccccuacggcuucuaccgccccgaguccgccuucuccuccuacggccuccgccucccccccgucaccggccucacccgcgaccaguccucccaccuccucgaggaggccacccucgucuaccccgccuccucccccucccgccucaaccccuccgaccccaaccgcaagcacgucgaguucgagucccccauccccgaggccaaggacuccuccaaggccggccagcgcgacaccgagggcuccaagauguccccccgcgccggcuccgccgccaccggcucccccggccgccccucccccaccgacuucaugcagaccucccagaccugcgagggccucuacgaccucuccaacaaggccgccuccuccgcccucggccgccucuacccccccgagcagucccucaccgccuuccgccccgucaagaaguccaccgagugccuccccgcccaggccgccgagaccaccgccgagucccccgucucccucaacgucgucaacggcgacccccccgcccccaccggcuccgccucccucgucuccgaggccgcccccuccucccccgacgacuccuccggcaugggcccccucaaccucuccaagaaguccgagaucaaccucgccgccacccacgagcccaccuaccagggcuccccccaggccgagaccgccuccuucuccgagcuccaggaccucccccucaaccucuccgucaaggaccccugcaacacccaggccccccgccccgccuuccccggccgcccccgcgccgccgagcccgccgccgccgucccccagaagaccggcaccgagggcuccgaggacggccccucccaccccgagaccaagcccggcucccucgacggcgacggcgccccccccaccggccccggcgaggaggcccccgacgccugcgccgucgacuccuccgaggagcagaagcagaccgccgccgucgcccucugccagcucgccgccuacuccccccgcaacauccgcgucggcgacggcgacgccgccgcccccgagcccgccugccgccaggacacccccacccucuccuccauggagucccaggaggcccagugcgaccuccgccccaagggccagaagcgcaccucccuccgcgacgccggcaagucccagcagggcgccaagaaggccaagcuccaggacaccgcccgcgucuucacccuccgccgccgcgcccgcgucuccuga

SEQ ID NO: 52177 - RNA, 1194 nt, Artificial Sequence
  derived and/or modified sequence opt2 from ZNF763__Homo_sapiens__NP_001012771
augauguuccaggaccccgucgccugcgaggacgucgccgucaacuucacccaggaggagugggcccuccucgacaucucccagcgcaagcucuaccgcgaggucaugcucgagaccuuccgcaaccucaccuccaucggcaagaaguggaaggaccagaacaucgaguacgaguaccagaacccccgccgcaacuuccgcucccucaucgagggcaacgucaacgagaucaaggaggacucccacugcggcgagaccuucacccagguccccgacgaccgccucaacuuccaggagaagaaggccucccccgaggccaaguccugcgacaacuucgucugcggcgaggucggcaucggcaacuccuccuucaacaugaacauccgcggcgacaucggccacaaggccuacgaguaccaggacuacgcccccaagcccuacaagugccagcagcccaagaaggccuuccgcuaccaccccuccuuccgcacccaggagcgcaaccacaccggcgagaagcccuacgccugcaaggagugcggcaagaccuucaucucccacuccggcauccgccgccgcauggucaugcacuccggcgacggccccuacaagugcaaguucugcggcaaggccguccacugccuccgccucuaccucauccacgagcgcacccacaccggcgagaagcccuacgagugcaagcagugcgucaaguccuucuccuacuccgccacccaccgcauccacgagcgcacccacaccggcgagaagcccuacgagugccagcagugcggcaaggccuuccacuccuccuccuccuuccaggcccacaagcgcacccacaccggcggcaagcccuacgagugcaagcagugcggcaaguccuucuccuggugccacuccuuccagauccacgagcgcacccacaccggcgagaagcccugcgagugcuccaagugcaacaaggccuuccgcuccuaccgcuccuaccuccgccacaagcgcucccacaccggcgagaagcccuaccagugcaaggagugccgcaaggccuucaccuaccccuccucccuccgccgccacgagcgcacccacuccgccaagaagcccuacgagugcaagcagugcggcaaggcccucuccuacaaguucuccaacacccccaagaacgcccucuggcgcaagacccucuga

SEQ ID NO: 52178 - RNA, 1224 nt, Artificial Sequence
  derived and/or modified sequence opt2 from ZNF764__Homo_sapiens__NP_001166150
auggcccccccccucgccccccuccccccccgcgaccccaacggcgccggccccgaguggcgcgagcccggcgccgucuccuucgccgacgucgccgucuacuucugccgcgaggaguggggcugccuccgccccgcccagcgcgcccucuaccgcgacgucaugcgcgagaccuacggccaccucuccgcccucggcaucggcggcaacaagcccgcccucaucuccugggucgaggaggaggccgagcucuggggccccgccgcccaggaccccgaggucgccaagugccagacccagaccgaccccgacucccgcaacaagaagaaggagcgccagcgcgagggcaccggcgcccucgagaagcccgaccccgucgccgccggcucccccggccucaaguccccccaggcccccuccgccggcccccccuacggcugggagcagcucuccaaggccccccaccgcggccgccccucccucugcgcccacccccccgucccccgcgccgaccagcgccacggcugcuacgucugcggcaaguccuucgccuggcgcuccacccucgucgagcacgucuacucccacaccggcgagaagcccuuccacugcaccgacugcggcaagggcuucggccacgccuccucccucuccaagcaccgcgccauccaccgcggcgagcgcccccaccgcugccucgagugcggccgcgccuucacccagcgcuccgcccucaccucccaccuccgcguccacaccggcgagaagcccuacggcugcgccgacugcggccgccgcuucucccaguccuccgcccucuaccagcaccgccgcguccacuccggcgagacccccuuccccugccccgacugcggccgcgccuucgccuaccccuccgaccuccgccgccacguccgcacccacaccggcgagaagcccuaccccugccccgacugcggccgcugcuuccgccaguccuccgagauggccgcccaccgccgcacccacuccggcgagaagcccuaccccugcccccagugcggccgccgcuucggccagaaguccgccgucgccaagcaccaguggguccaccgccccggcgccggcggccaccgcggccgcgucgccggccgccucuccgucacccucacccccggccacggcgaccucgacccccccgucggcuuccagcucuaccccgagaucuuccaggagugcggcuga

SEQ ID NO: 52179 - RNA, 1572 nt, Artificial Sequence
  derived and/or modified sequence opt2 from ZNF765__Homo_sapiens__XP_006723529
auggcccucccccagggccuccucaccuuccgcgacgucgccaucgaguucucccaggaggaguggaagugccucgaccccgcccagcgcacccucuaccgcgacgucaugcucgagaacuaccgcaaccucgucucccucgacaucuccuccaagugcaugaugaaggaguucuccuccaccgcccagggcaaccgcgaggucuuccacgccggcaccucccagcgccacgagucccaccacaacggcgacuucugcuuccaggacaucgacaaggacauccacgacaucgaguuccaguggcaggaggacgagcgcaacggccacgaggcccucaugaccaagaucaagaagcucaccggcuccaccgagcgcuacgaccagaacuacgccggcaacaagcccgucaaguaccagcucggcuucuccuuccacucccaccuccccgagcuccacaucuuccacaccgaggagaagaucgacaaccaggucgucaaguccauccacgacgccucccucgucuccaccgcccagcgcaucuccugccgccccgagacccacaucuccaacgacuacggcaacaacuuccucaacuccucccucuucacccagaagcaggagguccacaugcgcgagaaguccuuccagugcaacgacuccggcaaggccuacaacugcuccucccuccuccgcaagcaccagcucauccaccucggcgagaagcaguacaagugcgacaucugcggcaaggucuucaacuccaagcgcuacgucgcccgccaccgccgcugccacaccggcgagaagcccuacaagugcaacgagugcggcaagaccuucucccagaccuacuaccucaccugccaccgccgccuccacaccggcgagaagcccuacaagugcgaggagugcgacaaggccuuccacuucaaguccaagcuccagauccaccgccgcauccacaccggcgagaagcccuacaagugcaacgagugcggcaagaccuucucccagaaguccuaccucaccugccaccgccgccuccacaccggcgagaagcccuacaagugcaacgagugcggcaagaccuucucccgcaagucccacuucaccugccaccaccgcguccacaccggcgagaagcccuacaagugcaacgagugcuccaagaccuucucccacaaguccucccucaccuaccaccgccgccuccacaccgaggagaagcccuacaagugcaacgagugcggcaagaccuucaaccagcagcucacccucaacaucugccgccuccacuccggcgagaagcccuacaagugcgaggagugcgacaaggccuacuccuucaaguccaaccucgagauccaccagaagauccacaccgaggagaaccccuacaagugcaacgagugcggcaagaccuucucccgcaccuccucccucaccuaccaccaccgccuccacaccggccagaagcccuacaagugcgaggacugcgacgaggccuucuccuucaaguccaaccucgagcgccaccgccgcaucuacaccggcgagaagcuccacgucuga

SEQ ID NO: 52180 - RNA, 1548 nt, Artificial Sequence
  derived and/or modified sequence opt2 from ZNF76__Homo_sapiens__NP_001278961
auggagucccucggccuccacaccgucacccucuccgacggcaccaccgccuacguccagcaggccgucaagggcgagaagcuccucgagggccaggucauccagcucgaggacggcaccaccgccuacauccaccaggucaccguccagaaggaggcccucuccuucgaggacggccagcccguccagcucgaggacggcuccauggccuacauccaccgcaccccccgcgagggcuacgaccccuccacccucgaggccguccagcucgaggacggcuccaccgccuacauccaccaccccgucgccguccccuccgaguccaccauccucgccguccagaccgaggucggccucgaggaccucgccgccgaggacgacgagggcuucuccgccgacgccgucgucgcccucgagcaguacgccuccaagguccuccacgacucccagaucccccgcaacggcaagggccagcaggucggcgaccgcgccuuccgcugcggcuacaagggcugcggccgccucuacaccaccgcccaccaccucaagguccacgagcgcgcccacaccggcgaccgccccuaccgcugcgacuuccccuccugcggcaaggccuucgccaccggcuacggccucaagucccacguccgcacccacaccggcgagaagcccuacaagugccccgaggagcucugcuccaaggccuucaagaccuccggcgaccuccagaagcacguccgcacccacaccggcgagcgccccuuccagugccccuucgagggcugcggccgcuccuucaccaccuccaacauccgcaagguccacguccgcacccacaccggcgagcgccccuacaccugccccgagccccacugcggccgcggcuucaccuccgccaccaacuacaagaaccacguccgcauccacaccggcgagaagcccuacgucugcaccguccccggcugcggcaagcgcuucaccgaguacuccucccucuacaagcaccacgucguccacacccacugcaagcccuacaccugcuccaccugcggcaagaccuaccgccagaccuccacccucgccaugcacaagcgcuccgcccacggcgagcucgaggccaccgaggaguccgagcaggcccucuacgagcagcagcagcucgaggccgccuccgccgccgaggagucccccccccccaagcgcccccgcaucgccuaccucuccgaggucaaggaggagcgcgacgacauccccgcccaggucgccauggucaccgaggaggacggcgccccccaggucgcccucaucacccaggacggcgcccagcaggucaccaucaucaccuccggcgccgucgucgccgaggacuccuccgucgccucccuccgccaccagcaggucgcccuccucgccaccgccaacggcacccacaucgccguccagcucgaggagcagcagacccucgaggaggccaucaacgucgccaccgccgccaugcagcagggcgccgucacccucgagaccaccgucuccgaguccggcugcuga

SEQ ID NO: 52181 - RNA, 1452 nt, Artificial Sequence
  derived and/or modified sequence opt2 from ZNF774__Homo_sapiens__NP_001004309
auguggcucggcaccuccggcaaguccggccuccccggccacugccucgagaacccccuccaggagugccaccccgcccagcucgaggagugggcccucaagggcaucucccgccccuccgucaucucccagcccgagcagaaggaggagcccuggguccucccccuccagaacuucgaggcccgcaagaucccccgcgagucccacaccgacugcgagcaccaggucgccaagcucaaccaggacaacuccgagaccgccgagcagugcggcaccuccuccgagcgcaccaacaaggaccucucccacacccucuccuggggcggcaacugggagcagggccucgagcucgagggccagcacggcacccuccccggcgagggccagcucgaguccuucucccaggagcgcgaccucaacaagcuccucgacggcuacgucggcgagaagcccaugugcgccgagugcggcaaguccuucaaccaguccuccuaccucauccgccaccuccgcacccacaccggcgagcgccccuacaccugcaucgagugcggcaagggcuucaagcaguccuccgaccucgucacccaccgccgcacccacaccggcgagaagcccuaccagugcaagggcugcgagaagaaguucuccgacuccuccacccucaucaagcaccagcgcacccacaccggcgagcgccccuacgagugccccgagugcggcaagaccuucggccgcaagccccaccucaucaugcaccagcgcacccacaccggcgagaagcccuacgccugccucgagugccacaaguccuucucccgcuccuccaacuucaucacccaccagcgcacccacaccggcgucaagcccuaccgcugcaacgacugcggcgaguccuucucccaguccuccgaccucaucaagcaccagcgcacccacaccggcgagcgccccuucaagugccccgagugcggcaagggcuuccgcgacuccucccacuucgucgcccacauguccacccacuccggcgagcgccccuucuccugccccgacugccacaaguccuucucccaguccucccaccucgucacccaccagcgcacccacaccggcgagcgccccuucaagugcgagaacugcggcaagggcuucgccgacuccuccgcccucaucaagcaccagcgcauccacaccggcgagcgccccuacaagugcggcgagugcggcaaguccuucaaccaguccucccacuucaucacccaccagcgcauccaccucggcgaccgccccuaccgcugccccgagugcggcaagaccuucaaccagcgcucccacuuccucacccaccagcgcacccacaccggcgagaagcccuuccacugcuccaagugcaacaaguccuuccgccagaaggcccaccuccucugccaccagaacacccaccucaucuga

SEQ ID NO: 52182 - RNA, 1557 nt, Artificial Sequence
  derived and/or modified sequence opt2 from ZNF776__Homo_sapiens__NP_775903
auggccgccgccgcccuccgcccccccgcccagggcaccgucaccuucgaggacgucgccgucaacuucucccaggaggaguggucccuccucuccgaggcccagcgcugccucuaccacgacgucaugcucgagaaccucacccucaucuccucccucggcugcugguacggcgccaaggacgagacccccuccaagcagacccucuccauccagcaggaguccccccuccgcacccacuggaccggcgucugcaccaagaagguccaccucuggggcaugugcggcccccuccucggcgacauccuccaccagggcacccagcacaaccagaagcucaacggcuucggcgccuacgagaagaagcucgacgacgacgccaaccaccaccaggaccagaagcagcacaucggcgagaaguccuaccgcuccaacgccaagggcaccuccuucgucaagaacugcaaguuccacaugucccacgagcccuucaucuuccacgaggucggcaaggacuuccucuccucccuccgccuccuccagcaggaggacauccacaccuccggcaaguccaacuucgagaccaagcacggcaucccccuccagggcggcaagacccacuacaucugcggcgaguccaccauccccuucuccaacaagcacucccucguccuccaccagcgccuccucccccgcgagggccccuacgucugcuccgacuccggcaaguucaccuccaaguccaacuccuucaacaaccaccagggcguccgcaccggcaagcgccccuaccagugcggccagugcgacgaguccuucugguacaaggcccaccucaccgagcaccagcgcguccacaccggcgagcgccccuacgagugcggcgagugcgacaaguccuucucccacaagcacucccucgucgaccaccagcgcguccacaccggcgagcgccccuacgagugcgacgagugcggcaaguccuucucccacaagcgcucccucguccaccaccagcgcguccacaccggcgagcgccccuaccagugcggcgagugcggcaaguccuucaaccacaagugcaaccucauccagcaccagcgcguccacaccggcgagcgccccuucgagugcaccgccugcggcaagcucuuccgcuccaacucccaccucaaggagcaccagcgcguccacaccggcgagcgccccuacgagugcaaggagugccgcaaguccuuccgcuacaagucccaccucaccgagcaccagcgcguccacaccggcgagcgccccuacgagugccgcgagugcggcaagugcuuccaccagaagggcucccucauccagcaccagcagauccacuccggcgagcgcccccacgagugcggcgagugcggcaagugcuuccaccagaagggcucccucauccgccaccagcagauccacuccggcgagcgcccccacgagugcggcgagugcggcaagugcuuccgccagaagggcaaccucaucaagcaccagcgcguccacaccggcgagcgccaccacgagugcuga

SEQ ID NO: 52183 - RNA, 2274 nt, Artificial Sequence
  derived and/or modified sequence opt2 from ZNF778__Homo_sapiens__NP_001188336
auggccgcccccgaccucgcccacggcggccacgucucccgcgacuccgucugccuccacgaggagcagacccaggccgccggcauggucgccggcuggcucaucaacugcuaccaggacgccgucaccuucgacgacgucgccgucgacuucacccaggaggaguggacccuccucgaccccucccagcgcgaccucuaccgcgacgucaugcucgagaacuacgagaaccucgccuccgucggccaccaccucuuccagcccuccgucaucuacuggcucgagcaggaggaggagcuccgcgccggccgccgcgccguccuccaggaguggcgccucaagaccaagggccccgcccuccgccaggaccgcuccugguuccgcgccuccaacgagacccagaccgcccgcucccacaacggcggccagcucugcgaccgcacccagugcggcgaggccuucuccgagcacuccggccucuccacccacguccgcacccagaacaccggcgacuccugcgucuccaaccacuacgagcgcgacuucuucauccccugccagaagacccucuucaagaucggcgagcaguucuccguccucggccagugcggcaaggccuucuccuccacccccaacgucgucucccagcaggccugcacccgcgaccgcucccucgacuacuccuccugcggcgaggucuuccucaaccaguccuaccuccaggcccgcgccggcucccacaacggcgaggagaccuggaaguggaagcccugcggcaaggcccucacccacuccaugggcugcgccacccccgucgagaugcacgccguccgcaacccccacgucugccgcgagugcggcaaggccuuccgcuacaccgccuaccucaccggccgcguccagguccaccccggcgagaagcccugcgagcucgaggagugcggcaaggccucccccgucuccuccucccucacccagcacguccgcauccacgccgccgagaagcccugcgagugcaaggagugcggcaaggccuucaccggccucuccggccucuccaagcacguccagaccgaccccggccagaagcccuacgagugcaaggacugcggcaaggccugcggcggcuucuaccuccucaacgagcacggcaagacccacacccgcgagaagcccuucgccugcgucgucugcggcaaguacuuccgcaacuccuccugccucaacaaccacguccgcauccacaccggcaucaagcccuacaccugcuccuacugcggcaaggccuucaccguccgcugcggccucacccgccacguccgcacccacaccggcgagaagcccuacaccugcaaggacugcggcaaggccuucugcaccuccuccggccucaccgagcacguccgcacccacaccggcgagaagcccuacgagugcaaggacugcggcaaguccuucaccgucuccuccucccucaccgagcacgcccgcauccacaccggcgagaagcccuacgagugcaagcagugcggcaaggccuucaccggccgcuccggccucaccaagcacaugcgcacccacaccggcgagaagcccuacgagugcaaggacugcggcaaggccuacaaccgcgucuaccuccucaacgagcacgucaagacccacaccgaggagaagcccuucaucugcaccgucugccgcaaguccuuccgcaacuccuccugccucaacaagcacauccagauccacaccggcaucaagcccuacgagugcaaggacugcggcaagaccuucaccgucuccuccucccucaccgagcacauccgcacccacaccggcgagaagcccuacgagugcaaggucugcggcaaggccuucaccaccuccucccaccucaucguccacauccgcacccacaccggcgagaagcccuacaucugcaaggagugcggcaaggccuucgccuccuccucccaccucaucgagcaccgccgcacccacaccggcgagaagcccuacaucugcaacgagugcggcaaggccuuccgcgccuccucccaccuccacaagcacggccgcauccacaccggccagaagcccuacaagugcaaggagugcggcaaggccuacaaccgcuucuaccuccucaaggagcaccucaagaccuacaccgaggagcaggucuucgucugcaaggacugcggcaaguccuucaagaacuccuccugccucaaccaccacacccagauccacaccgacgagaagcccuucuga

SEQ ID NO: 52184 - RNA, 972 nt, Artificial Sequence
  derived and/or modified sequence opt2 from ZNF784__Homo_sapiens__NP_976308
auggccgccgcccgccccgaggcccagucccgcuccucccccacccccgagucccgcucccaggagccccucgaccucguccucguccccgacgacugccgccccggcaccccccccuccgaccucaucgagauccaggucgucaaggucaccgacaccacccucguccccgagccccccgagcccggcuccuuccacugcgcccucugccccgccgccuuccgccucgucuccgagcuccucuuccacgagcacggccaccucgccggcgccgagggcggcggccagggcggcgaccccucccgcugccacgucugcggccacuccugccccggccccgccucccuccgcgcccacuacucccuccacaccggcgagcgccccuaccgcugcgcccucugcccccgcgccuucaaggcccucgccccccuccuccgccaccagcaccgccacggcgucgagcccggcaccucccgccgcccccccgacaccgccgccgucgccgagcagcgccccggcgucgcccccgagcgcgccgaggucgucauggccgccgccgccgccggcgccgccgucggcaagcccuucgccugccgcuucugcgccaagcccuuccgccgcuccuccgacaugcgcgaccacgagcgcguccacaccggcgagcgccccuaccacugcggcaucugcggcaagggcuucacccaguccuccguccucuccggccacgcccgcauccacaccggcgagcgccccuuccgcugcacccucugcgaccgcaccuucaacaacuccuccaacuuccgcaagcaccagcgcacccacuuccacggccccggccccggccucggcgacuccggcggccagcucggcuccuccgccgccgagggcuccggcuccggcugcggcgucggcgaccccgccgaggagggccgcggcgagaccgccaaggucaaggucgaggccgaccaguga

SEQ ID NO: 52185 - RNA, 1425 nt, Artificial Sequence
  derived and/or modified sequence opt2 from ZNF79__Homo_sapiens__NP_001273625
auggccgccggccuccucaccgccggcccccgcggcuccaccuucuucuccuccgucaccgucgccuucgcccaggagcgcuggcgcugccucgucuccaccccccgcgaccgcuucaaggagggcauccccggcaagucccgcucccucguccuccucggccuccccgucucccagcccggcaugaacucccagcucgagcagcgcgagggcgccuggaugcucgagggcgaggaccuccgcucccccucccccggcuggaagaucaucuccggcuccccccccgagcaggcccucuccgaggccuccuuccaggaccccugcgucgagaugccccccggcgacuccgaccacggcaccuccgaccucgagaaguccuucaaccuccgccccguccucuccccccagcagcgcguccccgucgaggcccgcccccgcaagugcgagacccacaccgaguccuucaagaacuccgagauccucaagccccaccgcgccaagcccuacgccugcaacgagugcggcaaggccuucuccuacugcuccucccucucccagcaccagaagucccacaccggcgagaagcccuacgagugcuccgagugcggcaaggccuucucccaguccuccucccucauccagcaccagcgcauccacaccggcgagaagcccuacaagugcuccgagugcggccgcgccuucucccagaacgccaaccucaccaagcaccagcgcacccacaccggcgagaagcccuaccgcugcuccgagugcgagaaggccuucuccgacugcuccgcccucguccagcaccagcgcauccacaccggcgagaagcccuacgagugcuccgacugcggcaaggccuuccgccacuccgccaaccucaccaaccaccagcgcacccacaccggcgagaagcccuacaagugcuccgagugcggcaaggccuucuccuacugcgccgccuucauccagcaccagcgcauccacaccggcgagaagcccuaccgcugcgccgccugcggcaaggccuucucccaguccgccaaccucaccaaccaccagcgcacccacaccggcgagaagcccuacaagugcuccgagugcggcaaggccuucucccaguccaccaaccucaucauccaccagaagacccacaccggcgagaagcccuacaagugcaacgagugcggcaaguucuucuccgaguccuccgcccucauccgccaccacaucauccacaccggcgagaagcccuacgagugcaacgagugcggcaaggccuucaaccaguccuccucccucucccagcaccagcgcauccacaccggcgucaagcccuacgagugcuccgagugcggcaaggccuuccgcugcuccuccgccuucguccgccaccagcgccuccacgccggcgaguga

SEQ ID NO: 52186 - RNA, 447 nt, Artificial Sequence
  derived and/or modified sequence opt2 from ZNF7__Homo_sapiens__NP_001269725
auggaggucgucaccuucggcgacgucgccguccacuucucccgcgaggaguggcagugccucgaccccggccagcgcgcccucuaccgcgaggucaugcucgagaaccacuccuccgucgccggccucgccggcuuccucgucuucaagcccgagcucaucucccgccucgagcagggcgaggagcccuggguccucgaccuccagggcgccgagggcaccgaggccccccgcaccuccaagaccggcuuccucggccgccccaccaugggccaggagccccgccacccccacgccccccccgccacccccguccccggccuccccaagcacugcucccagcgccucacccuccccccccccggccucuccuccuccccccucggccacuuccucguccacgaccaggaccgccgccgcggcaccuccgccaucuggauggucuga

SEQ ID NO: 52187 - RNA, 1995 nt, Artificial Sequence
  derived and/or modified sequence opt2 from ZNF800__Homo_sapiens__XP_005250238
augccccuccgcgacaaguacugccagaccgaccaccaccaccacggcugcugcgagcccgucuacauccucgagcccggcgaccccccccuccuccagcagccccuccagaccuccaaguccggcauccagcagaucaucgagugcuuccgcuccggcaccaagcagcucaagcacauccuccucaaggacgucgacaccaucuucgagugcaagcucugccgcucccucuuccgcggccuccccaaccucaucacccacaagaaguucuacugcccccccucccuccagauggacgacaaccuccccgacgucaacgacaagcagucccaggccaucaacgaccuccucgaggccaucuaccccuccgucgacaagcgcgaguacaucaucaagcucgagcccaucgagaccaaccagaacgccgucuuccaguacaucucccgcaccgacaaccccaucgaggucaccgaguccuccuccacccccgagcagaccgagguccagauccaggagaccuccaccgagcaguccaagaccguccccgucaccgacaccgaggucgagaccgucgagcccccccccgucgagaucgucaccgacgaggucgcccccaccuccgacgagcagccccaggagucccaggccgaccucgagaccuccgacaacuccgacuucggccaccagcucaucugcugccucugccgcaaggaguucaacucccgccgcggcguccgccgccacauccgcaagguccacaagaagaagauggaggagcucaagaaguacaucgagacccgcaagaaccccaaccaguccuccaagggccgcuccaagaacguccucgucccccucucccgcuccugccccgucugcugcaaguccuucgccaccaaggccaacguccgccgccacuucgacgagguccaccgcggccuccgccgcgacuccaucacccccgacaucgccaccaagcccggccagccccucuuccucgacuccaucucccccaagaaguccuucaagacccgcaagcagaaguccuccuccaaggccgaguacaaccucaccgccugcaagugccuccucugcaagcgcaaguacuccucccagaucaugcucaagcgccacaugcagaucguccacaagaucacccucuccggcaccaacuccaagcgcgagaagggccccaacaacaccgccaacuccuccgagaucaaggucaaggucgagcccgccgacuccgucgaguccuccccccccuccaucacccacuccccccagaacgagcucaagggcaccaaccacuccaacgagaagaagaacacccccgccgcccagaagaacaaggucaagcaggacuccgagucccccaaguccaccucccccuccgccgccggcggccagcagaagacccgcaagcccaagcucuccgccggcuucgacuucaagcagcucuacugcaagcucugcaagcgccaguucaccuccaagcagaaccucaccaagcacaucgagcuccacaccgacggcaacaacaucuacgucaaguucuacaagugcccccucugcaccuacgagacccgccgcaagcgcgacgucauccgccacaucaccgucguccacaagaaguccucccgcuaccucggcaagaucaccgccucccucgagauccgcgccaucaagaagcccaucgacuucguccucaacaaggucgccaagcgcggccccucccgcgacgaggccaagcacuccgacuccaagcacgacggcaccuccaacucccccuccaagaaguacgaggucgccgacgucggcaucgaggucaaggucaccaagaacuucucccuccaccgcugcaacaagugcggcaaggccuucgccaagaagaccuaccucgagcaccacaagaagacccacaaggccaacgccuccaacucccccgagggcaacaagaccaagggccgcuccacccgcuccaaggcccucgucuga

SEQ ID NO: 52188 - RNA, 3630 nt, Artificial Sequence
  derived and/or modified sequence opt2 from ZNF804A__Homo_sapiens__NP_919226
auggagugcuacuacaucgucaucuccuccacccaccucuccaacggccacuuccgcaacaucaagggcgucuuccgcggcccccucuccaagaacggcaacaagacccucgacuacgccgagaaggagaacaccaucgccaaggcccucgaggaccucaaggccaacuucuacugcgagcucugcgacaagcaguacuacaagcaccaggaguucgacaaccacaucaacuccuacgaccacgcccacaagcagcgccucaaggagcucaagcagcgcgaguucgcccgcaacgucgccuccaagucccgcaaggacgagcgcaagcaggagaaggcccuccagcgccuccacaagcucgccgagcuccgcaaggagaccgucugcgcccccggcuccggccccauguucaaguccaccaccgucaccguccgcgagaacugcaacgagaucucccagcgcgucgucgucgacuccgucaacaaccagcaggacuucaaguacacccucauccacuccgaggagaacaccaaggacgccaccaccgucgccgaggaccccgaguccgccaacaacuacaccgccaagaacaaccaggucggcgaccaggcccagggcauccaccgccacaagaucggcuucuccuucgccuuccccaagaaggccuccgucaagcucgaguccuccgccgccgccuucuccgaguacuccgacgacgccuccgucggcaagggcuucucccgcaagucccgcuucguccccuccgccugccaccuccagcaguccucccccaccgacguccuccucuccuccgaggagaagaccaacuccuuccacccccccgaggccaugugccgcgacaaggagaccguccagacccaggagaucaaggaggucuccuccgagaaggacgcccuccuccuccccuccuucugcaaguuccagcuccagcucuccuccgacgccgacaacugccagaacuccgucccccucgccgaccagaucccccucgaguccgucgucaucaacgaggacauccccgucuccggcaacuccuucgagcuccucggcaacaaguccaccguccucgacauguccaacgacugcaucuccguccaggccaccaccgaggagaacgucaagcacaacgaggccuccaccaccgaggucgagaacaagaacggccccgagacccucgcccccuccaacaccgaggaggucaacaucaccauccacaagaagaccaacuucugcaagcgccagugcgagcccuucguccccguccucaacaagcaccgcuccaccguccuccaguggcccuccgagaugcucgucuacaccaccaccaagcccuccaucuccuacuccugcaacccccucugcuucgacuucaaguccaccaaggucaacaacaaccucgacaagaacaagcccgaccucaaggaccucugcucccagcagaagcaggaggacaucugcaugggcccccucuccgacuacaaggacgucuccaccgagggccucaccgacuacgagaucggcuccuccaagaacaagugcucccaggucaccccccuccucgccgacgacauccucuccuccuccugcgacuccggcaagaacgagaacaccggccagcgcuacaagaacaucuccugcaagauccgcgagaccgagaaguacaacuucaccaagucccagaucaagcaggacacccucgacgagaaguacaacaagauccgccucaaggagacccacgaguacugguuccacaagucccgccgcaagaagaagcgcaagaagcucugccagcaccaccacauggagaagaccaaggaguccgagacccgcugcaagauggaggccgagaacuccuacaccgagaacgccggcaaguaccuccucgagcccaucuccgagaagcaguaccucgccgccgagcagcuccucgacucccaccagcuccucgacaagcgccccaaguccgaguccaucucccucuccgacaacgaggagaugugcaagaccuggaacaccgaguacaacaccuacgacaccaucuccuccaagaaccacugcaagaagaacaccauccuccucaacggccaguccaacgccaccaugauccacuccggcaagcacaaccucaccuacucccgcaccuacugcugcuggaagaccaagauguccuccugcucccaggaccaccgcucccucguccuccagaacgacaugaagcacaugucccagaaccaggccgucaagcgcggcuacaacuccgucaugaacgaguccgagcgcuucuaccgcaagcgccgccagcacucccacuccuacuccuccgacgagucccucaaccgccagaaccaccuccccgaggaguuccuccgcccccccuccaccuccgucgcccccugcaagcccaagaagaagcgccgccgcaagcgcggccgcuuccaccccggcuucgagacccucgagcucaaggagaacaccgacuaccccgucaaggacaacuccucccucaacccccucgaccgccucaucuccgaggacaagaaggagaagaugaagccccaggaggucgccaagaucgagcgcaacuccgagcagaccaaccagcuccgcaacaagcucuccuuccaccccaacaaccuccuccccuccgagaccaacggcgagaccgagcaccucgagauggagaccaccuccggcgagcucuccgacgucuccaacgaccccaccaccuccgucugcgucgccuccgcccccaccaaggaggccaucgacaacacccuccucgagcacaaggagcgcuccgagaacaucaaccucaacgagaagcagauccccuuccagguccccaacaucgagcgcaacuuccgccagucccagcccaaguccuaccucugccacuacgagcucgccgaggcccucccccagggcaagaugaacgagacccccaccgaguggcuccgcuacaacuccggcauccucaacacccagcccccccuccccuucaaggaggcccacgucuccggccacaccuucgucaccgccgagcagauccucgccccccucgcccuccccgagcaggcccuccucaucccccucgagaaccacgacaaguucaagaacguccccugcgaggucuaccagcacauccuccagcccaacaugcucgccaacaaggucaaguucaccuucccccccgccgcccuccccccccccuccaccccccuccagccccucccccuccagcagucccucugcuccaccuccgucaccaccauccaccacaccguccuccagcagcacgccgccgccgccgccgccgccgccgccgccgccgccgccggcaccuucaagguccuccagccccaccagcaguuccucucccagauccccgcccucacccgcaccucccucccccagcucuccgucggccccgucggcccccgccucugccccggcaaccagcccaccuucgucgcccccccccagaugcccaucauccccgccuccguccuccaccccucccaccucgccuuccccucccucccccacgcccucuuccccucccuccucuccccccaccccaccgucaucccccuccagccccucuucuga

SEQ ID NO: 52189 - RNA, 4050 nt, Artificial Sequence
  derived and/or modified sequence opt2 from ZNF804B__Homo_sapiens__NP_857597
auggccugcuaccucgucaucuccucccgccaccucuccaacggccacuaccgcggcaucaagggcgucuuccgcggcccccucugcaagaacggcucccccucccccgacuucgccgagaagaaguccaccgccaaggcccucgaggacgucaaggccaacuucuacugcgagcucugcgacaagcaguaccacaagcaccaggaguucgacaaccacaucaacuccuacgaccacgcccacaagcagcgccucaaggagcucaagcagcgcgaguucgcccgcaacgucgccuccaaguccuggaaggacgagaagaagcaggagaaggcccucaagcgccuccaccagcucgccgagcuccgccagcaguccgagugcgucuccggcaacggccccgccuacaaggccccccgcgucgccaucgagaagcagcuccagcagggcaucuuccccaucaagaacggccgcaaggucuccugcaugaaguccgcccuccuccucaagggcaagaaccucccccgcaucaucuccgacaagcagcgcuccaccaugcccaaccgccaccagcuccaguccgaccgccgcugccucuucggcaaccagguccuccagaccuccuccgaccucuccaacgccaaccaccgcaccggcgucuccuucaccuucuccaagaagguccaccucaagcucgaguccuccgccuccgucuucuccgagaacaccgaggagacccacgacugcaacaagucccccaucuacaagaccaagcagaccgccgacaagugcaagugcugccgcuucgccaacaaggacacccaccucaccaaggagaaggaggucaacaucucccccucccaccucgaguccguccuccacaacaccaucuccaucaacuccaagauccuccaggacaagcacgacuccaucgacgagacccucgaggacuccaucggcauccacgccuccuucuccaaguccaacauccaccucuccgacgucgacuucacccccaccucccgcgagaaggagacccgcaacacccucaagaacacccucgagaacugcgucaaccaccccugccaggccaacgccuccuucuccccccccaacaucuacaaccacuccgacgcccgcaucuccgagugccucgacgaguucuccucccucgagcccuccgagcagaaguccaccguccaccucaaccccaacucccgcaucgagaaccgcgagaagucccucgacaagaccgagcgcgucuccaagaacguccagcgccucgucaaggaggccugcacccacaacgucgccuccaagccccuccccuuccuccacguccaguccaaggacggccacaccacccuccaguggcccaccgagcuccuccucuucaccaagaccgagcccugcaucuccuacggcugcaacccccucuacuucgacuucaagcucucccgcaacaccaaggaggaccacaaccucgaggaccucaagaccgagcucggcaagaagccccucgagcucaagaccaagcgcgagucccaggucuccggccucaccgaggaccagcagaagcucauccaggaggacuaccaguaccccaagcccaagaccaugaucgccaaccccgacugggagaaguuccagcgcaaguacaaccucgacuacuccgacuccgagcccaacaaguccgaguacaccuucuccgccaacgaccucgagaugaagaaccccaaggucccccucuaccucaacaccucccucaaggacugcgccggcaagaacaacuccuccgagaacaagcucaaggaggccucccgcgcccacuggcagggcugccgcaaggccguccucaacgacaucgacgaggaccucuccuuccccuccuacaucucccgcuucaagaagcacaagcucauccccugcuccccccaccucgaguucgaggacgagcgccaguucaacugcaaguccucccccugcaccgucggcggccacuccgaccacggcaaggacuucuccgucauccucaaguccaaccacaucuccaugaccuccaaggucuccggcugcggcaaccagcgcuacaagcgcuacuccccccaguccugccucucccgcuacuccuccucccucgacaccucccccuccuccauguccucccuccgcuccaccugcuccucccaccgcuucaacggcaacucccgcggcaaccuccucugcuuccacaagcgcgagcaccacuccgucgagcgccacaagcgcaagugccucaagcacaacugcuucuaccucuccgacgacaucaccaaguccucccagaugcaguccgagccccagaaggagcgcaacugcaagcucugggaguccuucaagaacgagaaguacuccaagcgccgcuacugccacugccgcgagcgccagaagcucggcaagaaccagcagcaguucuccggccucaaguccacccgcaucaucuacugcgacuccaacucccagaucuccugcaccggcuccuccaagaagccccccaacugccagggcacccagcacgaccgccucgacuccuacuccaucgagaagauguacuaccucaacaaguccaagcgcaaccaggagucccucggcuccccccacaucugcgaccucggcaagguccgccccaugaagugcaacuccggcaacaucuccugccuccucaagaacugcuccuccggccccuccgagaccaccgaguccaacaccgccgagggcgagcgcaccccccucaccgccaagauccuccucgagcgcguccaggccaagaagugccaggagcaguccuccaacgucgagaucuccuccaacuccugcaaguccgagcucgaggcccccucccagguccccugcaccauccagcucgcccccuccggcugcaaccgccaggcccucccccucuccgagaagauccaguacgccuccgagucccgcaacgaccaggacuccgccaucccccgcaccaccgagaaggacaaguccaaguccucccacaccaacaacuucaccauccucgccgacaccgacugcgacaaccaccucuccaagggcaucauccaccucgucaccgagucccagucccucaacaucaagcgcgacgccaccaccaaggagcaguccaagccccucaucuccgagauccagcccuucauccaguccugcgaccccguccccaacgaguuccccggcgccuuccccuccaacaaguacaccggcgucaccgacuccaccgagacccaggaggaccagaucaaccucgaccuccaggacgucuccaugcacaucaaccacgucgagggcaacaucaacuccuacuacgaccgcaccaugcagaagcccgacaaggucgaggacggccucgagaugugccacaaguccaucucccccccccucauccagcagcccaucaccuucucccccgacgagaucgacaaguacaagauccuccagcuccaggcccagcagcacaugcagaagcagcuccucuccaagcaccuccgcguccuccccgccgccggccccaccgccuucucccccgccuccaccguccagaccguccccguccaccagcacaccuccaucaccaccauccaccacaccuuccuccagcacuucgccgucuccgccucccucuccucccacuccucccaccuccccaucgcccaccuccacccccucucccaggcccacuucucccccaucuccuucuccacccucacccccaccaucauccccgcccaccccaccuuccucgccggccacccccuccaccucgucgccgccacccccuuccaccccucccacaucacccuccagccccucccccccaccgccuucauccccacccucuucggcccccaccucaaccccgccaccaccuccaucauccaccucaacccccucauccagcccgucuuccagggccaggacuucugccaccacuccugcuccucccagaugcagcagcucaacgaggucaaggaggcccucaacgucuccacccaccucaacuga

SEQ ID NO: 52190 - RNA, 822 nt, Artificial Sequence
  derived and/or modified sequence opt2 from ZNF80__Homo_sapiens__NP_009067
augucccccaagcgcgacggccucggcaccggcgacggccuccacucccagguccuccaggagcaggucuccaccggcgacaaccuccacgagugcgacucccagggccccuccaaggacacccucguccgcgagggcaagaccuacaagugcaaggagugcggcuccgucuucaacaagaacucccuccucguccgccaccagcagauccacaccggcgucaagcccuacgagugccaggagugcggcaaggccuuccccgagaaggucgacuucguccgccccaugcgcauccacaccggcgagaagcccugcaagugcgucgagugcggcaaggucuucaaccgccgcucccaccuccucugcuaccgccagauccacaccggcgagaagcccuacgagugcuccgagugcggcaagaccuucuccuaccacuccgucuucauccagcaccgcgucacccacaccggcgagaagcucuucggcugcaaggagugcggcaagaccuucuacuacaacuccucccucacccgccacaugaagauccacaccggcgagaagcccugcaagugcuccgagugcggcaagaccuucaccuaccgcuccgucuucuuccgccacuccaugacccacaccgccggcaagcccuacgagugcaaggagugcggcaagggcuucuacuacuccuacucccucacccgccacacccgcucccacaccggcgagaagcccuacgagugccucgagcaccgcaaggacuucggcuaccacuccgccuucgcccagcaguccaagauccacuccggcggcaagaaccucuga

SEQ ID NO: 52191 - RNA, 1185 nt, Artificial Sequence
  derived and/or modified sequence opt2 from ZNF812__Homo_sapiens__XP_011526544
augccccuccagcgcugcgacgucggcgagcucugcgagcccggccucugcggccgccaggaggccaccgucgacggcaacuccgagaacugcggcgaggucuucuccgagugguucugccucaagacccacaugcgcgcccagaacggcggcaacaucuucgagggcaacugcuacggcaaggacauccucuccguccacaaggaggccuccaucggccaggagcucuccaaguucaaccccugcggcaaggucuucacccucacccccgaccucgccgcccaccucggcauccucaacgcccgccagcccuacaagugcaaggagugccgcaagggcuucaaguacuucgccucccucgacaaccacaugggcauccacaucggcgagaaguucugcgaguuccaggagugccgccgcgccaucacccacuccucccaccucaagcagugcgucaccguccacaccggcaagaaguccaagaagaccaagaagcacggcaaguccuucaccaacuucucccagcucuccgcccacgucaagauccacaagggcgagaaguccuucgagugcaaggagugcggccgcuccuuccgcaacuccuccuccuucaacguccacauccagauccacaccggcaucaagccccacaaguacaccgagugcggcaaggccuucacccgcuccacccaccucacccagcacguccgcacccacaccggcaucaagcccuacgagugcaaggagugcggccaggccuucacccaguacaccggccucgccauccacauccgcaaccacaccggcgagaagcacuaccagugcaaggagugcggcaaggccuucaacggcuccuccacccucacccagcacaagaucauccacaccggcgagaagcccuacggcugcgucgagugcggcaagaccuucaucaccuccuccuaccgcuccaagcaccucaagacccaccacgaggagcgccccuucgucugcaagaucugcggcaaggccuuccucuacuccuccccccucaacguccaccuccagacccacacccgcgagaaggcccucaucugcaaggagugcggcaaggccuucgccgucuccucccaccucucccgccacgagcgcauccacaccggcgaggagcccuacgaguacaagggcaugaacgucaccaucuga

SEQ ID NO: 52192 - RNA, 1854 nt, Artificial Sequence
  derived and/or modified sequence opt2 from ZNF813__Homo_sapiens__NP_001004301
auggcccucccccagggccuccucaccuuccgcgacgucgccaucgaguucucccaggaggaguggaagugccucgaccccgcccagcgcacccucuaccgcgacgucaugcucgagaacuaccgcaaccucgucucccucgacaucuccuccaagugcaugaugaaggaguucuccuccaccgcccagggcaaccgcgaggucauccacaccggcacccuccagcgccacgagucccaccacaccggcgacuuccgcuuccaggagaucgacaaggacauccacaaccucgaguuccaguggcaggaggacgagcgcaacucccacgaggcccccaugaccgagaucaagaagcucaccggcuccgccgaccgcuacgaccagcgccacgccggcaacaagcccaucaaggaccagcucggcuccuccuuccacucccaccuccccgagcuccacauguuccagacccagggcaagaucggcaaccaggucgagaaguccaucaacgacgccuccuccaucuccaccucccagcgcaucuccugccgccccaagacccacaucuccaacaacuacggcaacaacuuccgcaacuccucccuccucacccagaagcaggagguccacaugcgcgagaaguccuuccagugcaacgaguccggcaaggccuucaacuacuccucccuccuccgcaagcaccagaucauccaccucggcgagaagcaguacaagugcgacgucugcggcaaggucuucaaccgcaagcgcaaccucgucugccaccgccgcugccacaccggcgagaagcccuaccgcugcaacgagugcggcaagaccuucucccagaccuacucccucaccugccaccgccgccuccacaccggcgagaagcccuacaagugcgaggagugcgacaaggccuucuccuucaaguccaaccucaagcgccaccgccgcauccacgccggcgagaagcccuacaagugcaacgagugcggcaagaccuucucccagaccuccucccucaccugccaccgccgccuccacaccggcgagaagcccuucaagugcaacgagugcggcaagaccuucucccgcaaguccucccucaccugccaccaccgccuccacaccggcgagaagcccuacaagugcaacgagugcggcaagaccuucucccaggagcucacccucaagugccaccgccgccuccacaccggcgagaagcccuacaagugcaacgagugcggcaaggucuucaacaagaaggccaaccucgcccgccaccaccgccuccacuccggcgagaagcccuacaagugcaccgagugcgucaagaccuucucccgcaacuccgcccucgucauccacaaggccauccacaucggcgagaagcgcuacaagugcaacgagugcggcaagaccuucucccgcaucuccgcccucgucauccacaccgccauccacaccggcgagaagcccuacaagugcaacgagugcggcaagggcuucaaccgcaagacccaccucgccugccaccaccgccuccacaccggcgagaagcccuacaagugcaacgagugcggcaaggucuucaaccgcaagacccaccucgcccaccaccaccgccuccacaccggcgacaagcccuacaagugcaacgagugcggcaaggucuucaaccagaaggcccaccucgcccgccaccaccgccuccacaccggcgagaagcccuacaagugcaacgagugcggcaaggucuucaaccagaaggccaaccucgcccgccaccaccgccuccacaccggcgagaagcccuacaaguucaacgagugcggcaaggccuucaacuga

SEQ ID NO: 52193 - RNA, 1956 nt, Artificial Sequence
  derived and/or modified sequence opt2 from ZNF816__Homo_sapiens__NP_001189386
augcuccgcgaggaggccaccaagaaguccaaggagaaggagcccggcauggcccucccccagggccgccucaccuuccgcgacgucgccaucgaguucucccucgaggaguggaagugccucaaccccgcccagcgcgcccucuaccgcgccgucaugcucgagaacuaccgcaaccucgaguucgucgacuccucccucaaguccaugauggaguucuccuccacccgccacuccaucaccggcgaggucauccacaccggcacccuccagcgccacaagucccaccacaucggcgacuucugcuuccccgagaugaagaaggacauccaccacuucgaguuccaguggcaggaggucgagcgcaacggccacgaggcccccaugaccaagaucaagaagcucaccggcuccaccgaccgcuccgaccaccgccacgccggcaacaagcccaucaaggaccagcucggccucuccuuccacucccaccuccccgagcuccacauguuccagaccaagggcaagaucuccaaccagcucgacaaguccaucggcgccuccuccgccuccgagucccagcgcaucuccugccgccucaagacccacaucuccaacaaguacggcaagaacuuccuccacuccuccuucacccagauccaggagaucugcaugcgcgagaagcccugccaguccaacgagugcggcaaggccuucaacuacuccucccuccuccgccgccaccacaucacccacucccgcgagcgcgaguacaagugcgacgucugcggcaagaucuucaaccagaagcaguacaucgucuaccaccaccgcugccacaccggcgagaagaccuacaagugcaacgagugcggcaagaccuucacccagauguccucccucgucugccaccgccgccuccacaccggcgagaagcccuacaagugcaacgagugcggcaagaccuucuccgagaaguccucccuccgcugccaccgccgccuccacaccggcgagaagcccuacaagugcaacgagugcggcaagaccuucggccgcaacuccgcccucgucauccacaaggccauccacaccggcgagaagcccuacaagugcaacgagugcggcaagaccuucucccagaaguccucccuccagugccaccacauccuccacaccggcgagaagcccuacaagugcgaggagugcgacaacgucuacauccgccgcucccaccucgagcgccaccgcaagauccacaccggcgagggcuccuacaagugcaaggucugcgacaaggucuuccgcuccgacuccuaccucgccgagcaccagcgcguccacaccggcgagaagcccuacaagugcaacaagugcggccgcuccuucucccgcaaguccucccuccaguaccaccacacccuccacaccggcgagaagcccuacaccugcaacgagugcggcaaggucuucucccgccgcgagaaccucgcccgccaccaccgccuccacgccggcgagaagcccuacaagugcgaggagugcgacaaggucuucucccgccgcucccaccucgagcgccaccgccgcauccacaccggcgagaagcccuacaagugcaaggucugcgacaaggccuuccgcuccgacuccugccucgccaaccacacccgcguccacaccggcgagaagcccuacaagugcaacaagugcgccaaggucuucaaccagaagggcauccucgcccagcaccagcgcguccacaccggcgagaagcccuacaagugcaacgagugcggcaaggucuucaaccagaaggccucccucgccaagcaccagcgcguccacaccgccgagaagcccuacaagugcaacgagugcggcaaggccuucaccggccaguccacccucauccaccaccaggccauccacggcugccgcgagacccuccagauguga

SEQ ID NO: 52194 - RNA, 1986 nt, Artificial Sequence
  derived and/or modified sequence opt2 from ZNF81__Homo_sapiens__XP_011542204
augcccgccaacgaggacgccccccagcccggcgagcacggcuccgccugcgaggucuccgucuccuucgaggacgucaccgucgacuucucccgcgaggaguggcagcagcucgacuccacccagcgccgccucuaccaggacgucaugcucgagaacuacucccaccuccucuccgucggcuucgagguccccaagcccgaggucaucuucaagcucgagcagggcgagggccccuggacccucgagggcgaggccccccaccaguccugcuccgacggcaaguucggcaucaagcccucccagcgccgcaucuccggcaaguccaccuuccacuccgagauggagggcgaggacacccgcgacgacucccucuacuccauccucgaggagcucuggcaggacgccgagcagaucaagcgcugccaggagaagcacaacaagcuccucucccgcaccaccuuccucaacaagaagauccucaacaccgagugggacuacgaguacaaggacuucggcaaguucguccaccccucccccaaccucauccucucccagaagcgcccccacaagcgcgacuccuucggcaaguccuucaagcacaaccucgaccuccacauccacaacaaguccaacgccgccaagaaccucgacaagaccaucggccacggccaggucuucacccagaacuccuccuacucccaccacgagaacacccacaccggcgucaaguucugcgagcgcaaccagugcggcaagguccucucccucaagcacucccucucccagaacgucaaguuccccaucggcgagaaggccaacaccugcaccgaguucggcaagaucuucacccagcgcucccacuucuucgccccccagaagauccacaccgucgagaagccccacgagcucuccaagugcgucaacgucuucacccagaagccccuccucuccaucuaccuccgcguccaccgcgacgagaagcucuacaucugcaccaagugcggcaaggccuucauccagaacuccgagcucaucaugcacgagaagacccacacccgcgagaagcccuacaagugcaacgagugcggcaaguccuucuuccaggucuccucccuccuccgccaccagaccacccacaccggcgagaagcucuucgagugcuccgagugcggcaagggcuucucccucaacuccgcccucaacauccaccagaagauccacaccggcgagcgccaccacaagugcuccgagugcggcaaggccuucacccagaaguccacccuccgcaugcaccagcgcauccacaccggcgagcgcuccuacaucugcacccagugcggccaggccuucauccagaaggcccaccucaucgcccaccagcgcauccacaccggcgagaagcccuacgagugcuccgacugcggcaaguccuuccccuccaagucccagcuccagaugcacaagcgcauccacaccggcgagaagcccuacaucugcaccgagugcggcaaggccuucaccaaccgcuccaaccucaacacccaccagaagucccacaccggcgagaaguccuacaucugcgccgagugcggcaaggccuucaccgaccgcuccaacuucaacaagcaccagaccauccacaccggcgagaagcccuacgucugcgccgacugcggccgcgccuucauccagaaguccgagcucaucacccaccagcgcauccacaccaccgagaagcccuacaagugccccgacugcgagaaguccuucuccaagaagccccaccucaagguccaccagcgcauccacaccggcgagaagcccuacaucugcgccgagugcggcaaggccuucaccgaccgcuccaacuucaacaagcaccagaccauccacaccggcgacaagcccuacaagugcuccgacugcggcaagggcuucacccagaaguccguccucuccaugcaccgcaacauccacaccuga

SEQ ID NO: 52195 - RNA, 1833 nt, Artificial Sequence
  derived and/or modified sequence opt2 from ZNF823__Homo_sapiens__NP_001073962
auggacuccgucgccuucgaggacgucgccgucaacuucacccaggaggagugggcccuccucggccccucccagaagucccucuaccgcaacgucaugcaggagaccauccgcaaccucgacugcaucgagaugaagugggaggaccagaacaucggcgaccagugccagaacgccaagcgcaaccuccgcucccacaccugcgagaucaaggacgacucccagugcggcgagaccuucggccagauccccgacuccaucgucaacaagaacaccccccgcgucaaccccugcgacuccggcgagugcggcgaggucguccucggccacuccucccucaacugcaacauccgcgucgacaccggccacaaguccugcgagcaccaggaguacggcgagaagcccuacacccacaagcagcgcggcaaggccaucucccaccagcacuccuuccagacccacgagcgcccccccaccggcaagaagcccuucgacugcaaggagugcgccaagaccuucuccucccucggcaaccuccgccgccacauggccgcccaccacggcgacggccccuacaagugcaagcucugcggcaaggccuucgucuggcccucccucuuccaccuccacgagcgcacccacaccggcgagaagcccuacgagugcaagcagugcuccaaggccuuccccuucuacuccuccuaccuccgccacgagcgcauccacaccggcgagaaggccuacgagugcaagcagugcuccaaggccuuccccgacuacuccaccuaccuccgccacgagcgcacccacaccggcgagaagcccuacaagugcacccagugcggcaaggccuucuccugcuacuacuacacccgccuccacgagcgcacccacaccggcgagcagcccuacgccugcaagcagugcggcaagaccuucuaccaccacaccuccuuccgccgccacaugauccgccacaccggcgacggcccccacaagugcaagaucugcggcaagggcuucgacugccccuccuccguccgcaaccacgagaccacccacaccggcgagaagcccuacgagugcaagcagugcggcaagguccucucccacuccuccuccuuccgcucccacaugaucacccacaccggcgacggcccccagaagugcaagaucugcggcaaggccuucggcugccccucccucuuccagcgccacgagcgcacccacaccggcgagaagcccuaccagugcaagcagugcggcaaggccuucucccucgccggcucccuccgccgccacgaggccacccacaccggcgucaagcccuacaagugccagugcggcaaggccuucuccgaccucuccuccuuccagaaccacgagaccacccacaccggcgagaagcccuacgagugcaaggagugcggcaaggccuucuccugcuucaaguaccucucccagcacaagcgcacccacaccgucgagaagcccuacgagugcaagaccugccgcaaggccuucucccacuucuccaaccucaagguccacgagcgcauccacuccggcgagaagcccuacgagugcaaggagugcggcaaggccuucuccuggcucaccugccuccuccgccacgagcgcauccacaccggcgagaagcccuacgagugccuccagugcggcaaggccuucacccgcucccgcuuccuccgcggccacgagaagacccacaccggcgagaagcucuacgagugcaaggagugcggcaaggcccucuccucccuccgcucccuccaccgccacaagcgcacccacuggaaggacacccucuga

SEQ ID NO: 52196 - RNA, 3234 nt, Artificial Sequence
  derived and/or modified sequence opt2 from ZNF827__Homo_sapiens__NP_849157
augccccgccgcaagcaggagcagcccaagcgccuccccucccacgucucccgccaggaggaggccgagggcgagcucuccgagggcgagcacugguacggcaacuccuccgagacccccuccgaggccuccuacggcgagguccaggagaacuacaagcucucccucgaggaccgcauccaggagcaguccaccucccccgacaccucccucggcuccaccacccccuccucccacacccucgagcucgucgcccucgacuccgagguccuccgcgacucccuccagugccaggaccaccucucccccggcgucuccucccucugcgacgacgaccccggcuccaacaagccccucuccuccaaccuccgccgccuccucgaggccggcucccucaagcucgacgccgccgccaccgccaacggccgcgucgagucccccgucaacgucggcuccaaccucuccuucuccccccccucccaccacgcccagcagcucuccguccucgcccgcaagcucgccgagaagcaggagcagaacgaccaguacacccccuccaaccgcuucaucuggaaccagggcaaguggcuccccaacuccaccaccaccugcucccucucccccgacuccgccauccucaagcucaaggccgccgccaacgccguccuccaggacaagucccucacccgcaccgaggagaccaugcgcuucgaguccuucuccucccccuucuccucccaguccgccuccuccacccucgccgcccucuccaagaaggucuccgagcgcucccucacccccggccaggagcaccccccccccgccuccuccuuccucucccucgccuccaugaccuccuccgccgcccuccucaaggaggucgccgcccgcgccgccggcucccuccucgccgagaaguccucccuccuccccgaggacccccucccccccccccccuccgagaagaagcccgagaaggucaccccccccccccccccccccccccccccccccccccccccccccccccagucccucgagcuccuccuccuccccguccccaagggccgcgucuccaagcccuccaacuccgccuccgaggaggaguccggcaagcccuuccagugccccaucugcggccucgucaucaagcgcaaguccuacuggaagcgccacauggucauccacaccggccucaagucccaccagugcccccucugccccuuccgcugcgcccgcaaggacaaccucaagucccacaugaagguccaccagcaccaggaccgcggcgagaccuuccagugccagcucugccccuucaccuccucccgccacuucucccucaagcuccacaugcgcugccaccagcacuuccuccgcaccgaggccaaggucaaggaggagauccccgaccccgacgucaagggcuccccccaccucuccgacuccgccugccucggccagcagcgcgagggcggcggcaccgagcucgucggcaccaugaugaccuccaacacccccgagcgcaccucccagggcggcgccggcgucuccccccuccucgucaaggaggagcccaaggaggacaacggccuccccaccuccuucacccucaacgccgccgaccgccccgccaaccacaccaagcucaaggaccccuccgaguacgucgccaacuccgccuccgcccucuucucccaggacaucuccgucaagauggccuccgacuuccucaugaagcucuccgccgccaaccagaaggagcccaugaaccucaacuucaaggucaaggaggagcccaaggagggcgagucccucuccaccacccucccccgcuccuccuacgucuucucccccgaguccgaggucuccgcccccggcgucuccgaggacgcccucaagccccaggagggcaagggcuccguccuccgccgcgacgucuccgucaaggccgccuccgagcuccucaugaagcucuccgccgaguccuacaaggagacccagauggucaagaucaaggaggagcccauggaggucgacauccaggacucccacgucuccaucucccccucccgcaacgucggcuacuccacccucaucggccgcgagaagaccgagccccuccagaagaugcccgagggccgcgucccccccgagcgcaaccucuucucccaggacaucuccgucaagauggccuccgagcuccucuuccagcucuccgagaaggucuccaaggagcacaaccacaccaaggagaacaccauccgcaccaccaccucccccuucuucuccgaggacaccuuccgccagucccccuucaccuccaacuccaaggagcuccuccccuccgacuccguccuccacggccgcaucuccgcccccgagaccgagaagaucguccucgaggccggcaacggccuccccuccuggaaguucaacgaccagcucuuccccugcgacgucugcggcaaggucuucggccgccagcagacccucucccgccaccucucccuccacaccgaggagcgcaaguacaagugccaccucugccccuacgccgccaagugccgcgccaaccucaaccagcaccucaccguccacuccgucaagcucgucuccaccgacaccgaggacaucgucuccgccgucaccuccgagggcuccgacggcaagaagcaccccuacuacuacuccugccacgucugcggcuucgagaccgagcucaacguccaguucgucucccacaugucccuccacgucgacaaggagcaguggauguucuccaucugcugcaccgccugcgacuucgucaccauggaggaggccgagaucaagacccacaucggcaccaagcacaccggcgaggaccgcaagacccccuccgaguccaacucccccuccuccuccucccucuccgcccucuccgacuccgccaacuccaaggacgacuccgacggcucccagaagaacaagggcggcaacaaccuccucgucaucuccgucaugcccggcucccagcccucccucaacuccgaggagaagcccgagaagggcuucgagugcgucuucugcaacuucgucugcaagaccaagaacauguucgagcgccaccuccagauccaccucaucacccgcauguucgagugcgacgucugccacaaguucaugaagacccccgagcagcuccucgagcacaagaagugccacaccguccccaccggcggccucaaguga

SEQ ID NO: 52197 - RNA, 1542 nt, Artificial Sequence
  derived and/or modified sequence opt2 from ZNF829__Homo_sapiens__NP_001165450
augaccggcaagggccucggcgaggacaccgaggaccgcuggggcgccggcgcccucggccccugcggccgcuccggccucaagggcggcggcugcgucugggaggccgaggccggcggcucccgcggccaggagaucgagaccauccucgccaacauggagaccucccuccgcuccggccagauccccacccucgacuccuccgagcacaaccucucccccgagccccucgagcucgaccgcaugccccacuccccccucaucuccaucccccacgucuggugccaccccgaggaggaggagcgcaugcacgacgagcuccuccaggccgucuccaagggccccgucauguuccgcgacgucuccaucgacuucucccaggaggagugggagugccucgacgccgaccagaugaaccucuacaaggaggucaugcucgagaacuucuccaaccucgucuccgucggccucuccaacuccaagcccgccgucaucucccuccucgagcagggcaaggagcccuggauggucgaccgcgagcucacccgcggccucugcuccgaccucgaguccaugugcgagaccaagauccucucccucaagaagcgccacuucucccaggucaucaucacccgcgaggacauguccaccuucauccagcccaccuuccucauccccccccagaagaccauguccgaggagaagcccugggagugcaagaucugcggcaagaccuucaaccagaacucccaguucauccagcaccagcgcauccacuucggcgagaagcacuacgaguccaaggaguacggcaaguccuucucccgcggcucccucgucacccgccaccagcgcauccacaccggcaagaagcccuacgagugcaaggagugcggcaaggccuucuccugcuccuccuacuucucccagcaccagcgcauccacaccggcgagaagcccuacgagugcaaggagugcggcaaggccuucaaguacugcuccaaccucaacgaccaccagcgcauccacaccggcgagaagcccuacgagugcaaggucugcggcaaggccuucaccaaguccucccagcucuuccuccaccuccgcauccacaccggcgagaagcccuacgagugcaaggagugcggcaaggccuucacccagcacucccgccucauccagcaccagcgcaugcacaccggcgagaagcccuacgagugcaagcagugcggcaaggccuucaacuccgccuccacccucaccaaccaccaccgcauccacgccggcgagaagcucuacgagugcgaggagugccgcaaggccuucauccaguccuccgagcucauccagcaccagcgcauccacaccgacgagaagcccuacgagugcaacgagugcggcaaggccuucaacaagggcuccaaccucacccgccaccagcgcauccacaccggcgagaagcccuacgacugcaaggagugcggcaaggccuucggcucccgcuccgaccucauccgccacgagggcauccacaccggcuga

SEQ ID NO: 52198 - RNA, 5034 nt, Artificial Sequence
  derived and/or modified sequence opt2 from ZNF831__Homo_sapiens__NP_848552
auggagguccccgagcccaccugccccgccccccccgcccgcgaccagcccgcccccacccccggcccccccggcgcccccggcggccaggccuccccccaccucacccucggccccguccuccucccccccgagcagggccucgccccccccaccgucuuccucaaggcccuccccaucccccucuaccacaccgucccccccggcggccuccagccccgcgccccccucgucaccggcucccucgacggcggcaacguccccuucauccucucccccguccuccagcccgagggccccggccccacccaggucggcaagcccgccgcccccacccucaccgucaacaucgucggcacccuccccguccucucccccggccucggccccacccucggcucccccggcaagguccgcaacgccggcaaguaccucugcccccacugcggccgcgacugccucaagcccuccguccucgagaagcacauccgcucccacaccggcgagcgccccuuccccugcgccaccugcggcaucgccuucaagacccaguccaaccucuacaagcaccgccgcacccagacccaccucaacaacucccgccucuccuccgaguccgagggcgccggcggcggccuccucgaggagggcgacaaggccggcgagcccccccgccccgagggccgcggcgagucccgcugccagggcaugcacgagggcgccuccgagcgcccccucucccccggcgcccacgucccccuccucgccaagaaccucgacguccgcaccgaggccgcccccugccccggcuccgccuucgccgaccgcgaggcccccugggacuccgcccccauggccucccccggccuccccgccgccuccacccagcccuggcgcaagcuccccgagcagaagucccccaccgccggcaagcccugcgcccuccagcgccagcaggccaccgccgccgagaagcccugggacgccaaggcccccgagggccgccuccgcaagugcgaguccaccgacuccggcuaccucucccgcuccgacuccgccgagcagccccacgcccccugcuccccccuccacucccucuccgagcacuccgccgaguccgagggcgagggcggccccggccccggccccggcgucgccggcgccgagcccggcgcccgcgaggccggccucgagcucgagaagaagcgccucgaggagcgcaucgcccagcucaucucccacaaccaggccgucgucgacgacgcccagcucgacaacguccgcccccgcaagaccggccucuccaagcagggcuccaucgaccuccccacccccuacaccuacaaggacuccuuccacuucgacauccgcgcccucgagcccggccgccgccgcgcccccggccccguccgcuccaccuggaccccccccgacaagucccgcccccucuucuuccacuccguccccacccagcucuccaccaccgucgagugcguccccgucacccgcuccaacucccuccccuucgucgagggcucccgcaccuggcucgagccccgcgagccccgcgaccccuggucccgcacccagaagccccucuccccccgccccggccccgcccgccucggcugccgcuccggccucuccuccaccgacguccccuccggccacccccgcgcccucguccgccaggccgccgucgaggaccuccccggcacccccaucggcgacgcccucguccccgccgaggacaccgacgccaagcgcaccgccgcccgcgaggccauggccggcaagggccgcgccggcggccgcaagugcggccagcgccgccucaagauguucucccaggagaaguggcaggucuacggcgacgagaccuucaagcgcaucuaccagaagaugaaggccuccccccacggcggcaagaaggcccgcgaggucggcaugggcuccggcgccgagcucggcuucccccuccagaaggaggccgccggcuccuccggcaccguccccacccaggaccgccgcacccccguccacgaggacaucuccgccggcgccacccccgagcccuggggcaacccccccgcccucgaggccucccucgucaccgagcccaccaagcacggcgagaccgucgcccgccgcggcgacuccgaccgcccccgcgucgaggaggccgucuccucccccgcccucggcggccgcgacucccccugcuccggcucccgcuccccccucgucucccccaacggccgccucgagcucggcuggcagaugccccccgcccccggcccccucaagggcggcgacgucgaggccccccgccccgucuggcccgaccccaagcucgagggcggcgcccgcggcgucggcgacguccaggagaccugccucugggcccagaccguccuccgcuggcccucccgcggcuccggcgaggacaagcuccccuccgagcgcaagaagcucaaggucgaggaccuccacuccuggaagcagcccgagcccgucuccgccgagacccccggcggccccacccagcccgccucccucuccucccagaagcaggacgccgaccccggcgagguccccggcggcuccaaggaguccgcccgccaggucggcgagccccucgaguccuccggcgccucccucgccgccgccuccgucgcccucaagcgcgucggcccccgcgacaaggccaccccccuccaccccgccgcccccgcccccgccgagcaccccucccucgccacccccccccaggccccccgcguccucuccgcccucgccgacaacgccuucucccccaaguaccuccuccgccucccccaggccgagaccccccucccccuccccauccccuggggcccccgccacucccaggacucccucugcuccuccggcuggcccgaggagcgcgccuccuucgucggcuccggccucggcaccccccucucccccucccccgccuccggccccucccccggcgaggccgacuccauccucgaggaccccuccugcucccgcccccaggacggccgcaagggcgcccagcucggcggcgacaagggcgaccgcauggccaccucccgccccgccgcccgcgagcuccccaucuccgcccccggcgccccccgcgaggccaccuccuccccccccacccccaccugcgaggcccaccucguccaggacauggagggcgacucccaccgcauccaccgccucugcaugggcuccacccucgcccgcgcccgccucuccggcgacguccucaaccccuggguccccaacugggagcucggcgagccccccggcaacgcccccgaggaccccuccuccggcccccucgucggccccgaccccugcuccccccuccagcccggcuccuuccucaccgcccucacccgcccccagggcgucccccccggcuggcccgagcucgcccucuccucccacuccggcaccucccgcucccacuccacccgcuccccccacuccacccagaaccccuuccccucccucaaggccgagccccgccucaccuggugcugccucucccgcuccgucccccuccccgccgagcagaaggccaaggccgccuccgucuaccucgccguccacuuccccggcuccucccuccgcgacgagggccccaacggcccccccggcuccaacggcggcuggaccuggaccucccccggcgagggcggccccgcccagauguccaaguucuccuaccccaccguccccggcgucaugccccagcaccaggucuccgagcccgaguggaagaagggccuccccuggcgcgccaagaugucccgcggcaacuccaagcagcgcaagcucaagaucaaccccaagcgcuacaagggcaacuuccuccaguccugcguccagcuccgcgccucccgccuccgcacccccaccuggguccgccgccgcucccgccacccccccgcccucgagggccucaagcccugccgcacccccggccagaccuccuccgagaucgccggccucaaccuccaggaggagcccuccugcgccaccuccgaguccccccccugcugcggcaaggaggagaagaaggagggcgacugccgccagacccucggcacccucucccucggcaccuccucccgcaucguccgcgagauggacaagcgcaccgucaaggacaucucccccuccgccggcgagcacggcgacugcaccacccacuccaccgccgccaccuccggccucucccuccaguccgacaccugccucgccgucgucaacgacgucccccucccccccggcaagggccucgaccucggccuccucgagacccagcuccucgccucccaggacuccgucuccaccgaccccaagcccuacaucuucuccgacgcccagcgccccuccuccuucggcuccaagggcaccuucccccaccacgacaucgccaccuccgucgccgccgucugcaucucccuccccguccgcaccgaccacaucgcccaggagauccacuccgccgagucccgcgaccacucccagaccgccggccgcacccucaccuccuccucccccgacuccaaggucaccgaggagggccgcgcccagacccuccuccccggccgccccuccuccggccagcgcaucuccgacuccgucccccucgaguccaccgagaagacccaccucgagauccccgccuccggccccuccuccgccuccucccaccacaaggagggccgccacaagaccuucuuccccucccgcggccaguacggcugcggcgagaugaccguccccugccccucccucggcuccgacggccgcaagcgccaggucuccggccucaucacccgcaaggacuccgucguccccuccaagcccgagcagcccaucgagauccccgaggcccccuccaagucccucaagaagcgcucccucgagggcaugcgcaagcagacccgcgucgaguucuccgacaccuccuccgacgacgaggaccgccucgucaucgagaucuga

SEQ ID NO: 52199 - RNA, 3480 nt, Artificial Sequence
  derived and/or modified sequence opt2 from ZNF91__Homo_sapiens__NP_001287880
augcccggcacccccggcucccucgagaugggccuccucaccuuccgcgacgucgccaucgaguucucccccgaggaguggcagugccucgacaccgcccagcagaaccucuaccgcaacgucaugcucgagaacuaccgcaaccucgccuuccucggcaucugcccccacuucccccaggacuucuggcccgagcaguccauggaggacuccuuccagaagguccuccuccgcaaguacgagaagugcggccacgagaaccuccagcuccgcaagggcugcaaguccgucgacgagugcaagguccacaaggagggcuacaacaagcucaaccagugccucaccaccgcccaguccaaggucuuccagugcggcaaguaccucaaggucuucuacaaguuccucaacuccaaccgccacaccauccgccacaccggcaagaagugcuucaagugcaagaagugcgucaaguccuucugcauccgccuccacaagacccagcacaagugcgucuacaucaccgagaaguccugcaagugcaaggagugcgagaagaccuuccacugguccuccacccucaccaaccacaaggagauccacaccgaggacaagcccuacaagugcgaggagugcggcaaggccuucaagcagcucuccacccucaccacccacaagaucaucugcgccaaggagaagaucuacaagugcgaggagugcggcaaggccuuccucugguccuccacccucacccgccacaagcgcauccacaccggcgagaagcccuacaagugcgaggagugcggcaaggccuucucccacuccuccacccucgccaagcacaagcgcauccacaccggcgagaagcccuacaagugcgaggagugcggcaaggccuucucccgcuccuccacccucgccaagcacaagcgcauccacaccggcgagaagcccuacaagugcaaggagugcggcaaggccuucuccaacuccuccacccucgccaaccacaagaucacccacaccgaggagaagcccuacaagugcaaggagugcgacaaggccuucaagcgccucuccacccucaccaagcacaagaucauccacgccggcgagaagcucuacaagugcgaggagugcggcaaggccuucaaccgcuccuccaaccucaccauccacaaguucauccacaccggcgagaagcccuacaagugcgaggagugcggcaaggccuucaacugguccuccucccucaccaagcacaagcgcuuccacacccgcgagaagcccuucaagugcaaggagugcggcaaggccuucaucugguccuccacccucacccgccacaagcgcauccacaccggcgagaagcccuacaagugcgaggagugcggcaaggccuuccgccaguccuccacccucaccaagcacaagaucauccacaccggcgagaagcccuacaaguucgaggagugcggcaaggccuuccgccagucccucacccucaacaagcacaagaucauccacucccgcgagaagcccuacaagugcaaggagugcggcaaggccuucaagcaguucuccacccucaccacccacaagaucauccacgccggcaagaagcucuacaagugcgaggagugcggcaaggccuucaaccacuccuccucccucuccacccacaagaucauccacaccggcgagaaguccuacaagugcgaggagugcggcaaggccuuccucugguccuccacccuccgccgccacaagcgcauccacaccggcgagaagcccuacaagugcgaggagugcggcaaggccuucucccacuccuccgcccucgccaagcacaagcgcauccacaccggcgagaagcccuacaagugcaaggagugcggcaaggccuucuccaacuccuccacccucgccaaccacaagaucacccacaccgaggagaagcccuacaagugcaaggagugcgacaagaccuucaagcgccucuccacccucaccaagcacaagaucauccacgccggcgagaagcucuacaagugcgaggagugcggcaaggccuucaaccgcuccuccaaccucaccauccacaaguucauccacaccggcgagaagcccuacaagugcgaggagugcggcaaggccuucaacugguccuccucccucaccaagcacaagcgcauccacacccgcgagaagcccuucaagugcaaggagugcggcaaggccuucaucugguccuccacccucacccgccacaagcgcauccacaccggcgagaagcccuacaagugcgaggagugcggcaaggccuucucccgcuccuccacccucaccaagcacaagaccauccacaccggcgagaagcccuacaagugcaaggagugcggcaaggccuucaagcacuccuccgcccucgccaagcacaagaucauccacgccggcgagaagcucuacaagugcgaggagugcggcaaggccuucaaccaguccuccaaccucaccacccacaagaucauccacaccaaggagaagcccuccaaguccgaggagugcgacaaggccuucaucugguccuccacccucaccgagcacaagcgcauccacacccgcgagaagaccuacaagugcgaggagugcggcaaggccuucucccagcccucccaccucaccacccacaagcgcaugcacaccggcgagaagcccuacaagugcgaggagugcggcaaggccuucucccaguccuccacccucaccacccacaagaucauccacaccggcgagaagcccuacaagugcgaggagugcggcaaggccuuccgcaaguccuccacccucaccgagcacaagaucauccacaccggcgagaagcccuacaagugcgaggagugcggcaaggccuucucccaguccuccacccucacccgccacacccgcaugcacaccggcgagaagcccuacaagugcgaggagugcggcaaggccuucaaccgcuccuccaagcucaccacccacaagaucauccacaccggcgagaagcccuacaagugcgaggagugcggcaaggccuucaucuccuccuccacccucaacggccacaagcgcauccacacccgcgagaagcccuacaagugcgaggagugcggcaaggccuucucccaguccuccacccucacccgccacaagcgccuccacaccggcgagaagcccuacaagugcggcgagugcggcaaggccuucaaggaguccuccgcccucaccaagcacaagaucauccacaccggcgagaagcccuacaagugcgagaagugcggcaaggccuucaaccaguccuccauccucaccaaccacaagaagauccacaccaucacccccgucaucccccuccucugggaggccgaggccggcggcucccgcggccaggagauggagaccauccucgccaacaccgucaagccccuccucuacuga

SEQ ID NO: 52200 - RNA, 1665 nt, Artificial Sequence
  derived and/or modified sequence opt2 from ZNF92__Homo_sapiens__NP_001274461
augggcccccucaccuuccgcgacgucaagaucgaguucucccucgaggaguggcagugccucgacaccgcccagcgcaaccucuaccgcgacgucaugcucgagaacuaccgcaaccucgucuuccucgucaugugcucccacuucgcccaggacgucuggcccgagcacuccaucaaggacuccuuccagaaggucauccuccgcaccuacggcaaguacggccacgagaaccuccagcuccgcaaggaccacaaguccgucgacgccugcaaggucuacaagggcggcuacaacggccucaaccagugccucaccaccaccgacuccaagaucuuccagugcgacaaguacgucaaggucuuccacaaguuccccaacgucaaccgcaacaagauccgccacaccggcaagaagcccuucaagugcaagaaccgcggcaaguccuucugcaugcucucccagcucacccagcacaagaagauccacacccgcgaguacuccuacaagugcgaggagugcggcaaggccuucaacugguccuccacccucaccaagcacaagaucauccacaccggcgagaagcccuacaagugcgaggagugcggcaaggccuucaaccgcuccuccaaccucaccaagcacaagaucauccacaccggcgagaagcccuacaagugcgaggagugcggcaaggccuucaaccgcuccuccacccucaccaagcacaagcgcauccacaccgaggagaagcccuacaagugcgaggagugcggcaaggccuucaaccaguucuccauccucaacaagcacaagcgcauccacauggaggacaagcccuacaagugcgaggagugcggcaaggccuuccgcgucuucuccauccucaagaagcacaagaucauccacaccggcgagaagcccuacaagugcgaggagugcggcaaggccuucaaccaguucuccaaccucaccaagcacaagaucauccacaccggcgagaagcccuacaagugcgacgagugcggcaaggccuucaaccaguccuccacccucaccaagcacaagcgcauccacaccggcgagaagcccuacaagugcgaggagugcggcaaggccuucaagcaguccuccacccucaccgagcacaagaucauccacaccggcgagaagcccuacaagugcgagaagugcggcaaggccuucuccugguccuccgccuucaccaagcacaagcgcaaccacauggaggacaagcccuacaagugcgaggagugcggcaaggccuucuccgucuucuccacccucaccaagcacaagaucauccacacccgcgagaagcccuacaagugcgaggagugcggcaaggccuucaaccaguccuccaucuucaccaagcacaagaucauccacaccgagggcaaguccuacaagugcgagaagugcggcaacgccuucaaccaguccuccaaccucaccgcccgcaagaucaucuacaccggcgagaagcccuacaaguacgaggagugcgacaaggccuucaacaaguucuccacccucaucacccaccagaucaucuacaccggcgagaagcccugcaagcacgagugcggccgcgccuucaacaaguccuccaacuacaccaaggagaagcuccagaccuga

SEQ ID NO: 52201 - RNA, 1863 nt, Artificial Sequence
  derived and/or modified sequence opt2 from ZNF93__Homo_sapiens__NP_112495
augggcccccuccaguuccgcgacgucgccaucgaguucucccucgaggaguggcacugccucgacaccgcccagcgcaaccucuaccgcaacgucaugcucgagaacuacuccaaccucgucuuccucggcaucgucgucuccaagcccgaccucaucgcccaccucgagcagggcaagaagccccucaccaugaagcgccacgagauggucgccaaccccuccgucaucugcucccacuucgcccaggaccucuggcccgagcagaacaucaaggacuccuuccagaaggucauccuccgccgcuacgagaagcgcggccacggcaaccuccagcucaucaagcgcugcgaguccgucgacgagugcaagguccacaccggcggcuacaacggccucaaccagugcuccaccaccacccaguccaaggucuuccagugcgacaaguacggcaaggucuuccacaaguucuccaacuccaaccgccacaacauccgccacaccgagaagaagcccuucaagugcaucgagugcggcaaggccuucaaccaguucuccacccucaucacccacaagaagauccacaccggcgagaagcccuacaucugcgaggagugcggcaaggccuucaaguacuccuccgcccucaacacccacaagcgcauccacaccggcgagaagcccuacaagugcgacaagugcgacaaggccuucaucgccuccuccacccucuccaagcacgagaucauccacaccggcaagaagcccuacaagugcgaggagugcggcaaggccuucaaccaguccuccacccucaccaagcacaagaagauccacaccggcgagaagcccuacaagugcgaggagugcggcaaggccuucaaccaguccuccacccucaccaagcacaagaagauccacaccggcgagaagcccuacgucugcgaggagugcggcaaggccuucaaguacucccgcauccucaccacccacaagcgcauccacaccggcgagaagcccuacaagugcaacaagugcggcaaggccuucaucgccuccuccacccucucccgccacgaguucauccacaugggcaagaagcacuacaagugcgaggagugcggcaaggccuucaucugguccuccguccucacccgccacaagcgcguccacaccggcgagaagcccuacaagugcgaggagugcggcaaggccuucaaguacuccuccacccucuccucccacaagcgcucccacaccggcgagaagcccuacaagugcgaggagugcggcaaggccuucgucgccuccuccacccucuccaagcacgagaucauccacaccggcaagaagcccuacaagugcgaggagugcggcaaggccuucaaccaguccuccucccucaccaagcacaagaagauccacaccggcgagaagcccuacaagugcgaggagugcggcaaggccuucaaccaguccuccucccucaccaagcacaagaagauccacaccggcgagaagcccuacaagugcgaggagugcggcaaggccuucaaccaguccuccacccucaucaagcacaagaagauccacacccgcgagaagcccuacaagugcgaggagugcggcaaggccuuccaccucuccacccaccucaccacccacaagauccuccacaccggcgagaagcccuaccgcugccgcgagugcggcaaggccuucaaccacuccgccacccucuccucccacaagaagauccacuccggcgagaagcccuacgagugcgacaagugcggcaaggccuucaucucccccuccucccucucccgccacgagaucauccacaccggcgagaagcccuga

SEQ ID NO: 52202 - RNA, 1719 nt, Artificial Sequence
  derived and/or modified sequence opt2 from ZNF98__Homo_sapiens__NP_001092096
augcccggcccccucggcucccucgagaugggcguccucaccuuccgcgacgucgcccucgaguucucccucgaggaguggcagugccucgacaccgcccagcagaaccucuaccgcaacgucaugcucgagaacuaccgcaaccucgucuucgucggcaucgccgccuccaagcccgaccucaucaccugccucgagcagggcaaggagcccuggaacgucaagcgccacgagauggucaccgagccccccgucgucuacuccuacuucgcccaggaccucuggcccaagcagggcaagaagaacuacuuccagaaggucauccuccgcaccuacaagaagugcggccgcgagaaccuccagcuccgcaaguacugcaaguccauggacgagugcaagguccacaaggagugcuacaacggccucaaccagugccucaccaccacccagaacaagaucuuccaguacgacaaguacgucaaggucuuccacaaguucuccaacuccaaccgccacaagaucggccacaccggcaagaaguccuucaagugcaaggagugcgagaaguccuucugcaugcucucccaccucgcccagcacaagcgcauccacuccggcgagaagcccuacaagugcaaggagugcggcaaggccuacaacgaggccuccaaccucuccacccacaagcgcauccacaccggcaagaagcccuacaagugcgaggagugcggcaaggccuucaaccgccucucccaccucaccacccacaagaucauccacaccggcaagaagcccuacaagugcgaggagugcggcaaggccuucaaccaguccgccaaccucaccacccacaagcgcauccacaccggcgagaagcccuacaagugcgaggagugcggccgcgccuucucccaguccuccacccucaccgcccacaagaucauccacgccggcgagaagcccuacaagugcgaggagugcggcaaggccuucucccaguccuccacccucaccacccacaagaucauccacaccggcgagaaguucuacaagugcgaggagugcggcaaggccuucucccgccucucccaccucaccacccacaagcgcauccacuccggcgagaagcccuacaagugcgaggagugcggcaaggccuucaagcaguccuccacccucaccacccacaagcgcauccacgccggcgagaaguucuacaagugcgaggucugcuccaaggccuucucccgcuucucccaccucaccacccacaagcgcauccacaccggcgagaagcccuacaagugcgaggagugcggcaaggccuucaaccucuccucccagcucaccacccacaagaucauccacaccggcgagaagcccuacaagugcgaggagugcggcaaggccuucaaccaguccuccacccucuccaagcacaaggucauccacaccggcgagaagcccuacaagugcgaggagugcggcaaggccuucaaccaguccucccaccucaccacccacaagaugauccacaccggcgagaagcccuacaagugcgaggagugcggcaaggccuucaacaacuccuccauccucaaccgccacaagaugauccacaccggcgagaagcucuacaagcccgaguccugcaacaacgccugcgacaacaucgccaagaucuccaaguacaagcgcaacugcgccggcgagaaguga

SEQ ID NO: 52203 - RNA, 5757 nt, Artificial Sequence
  derived and/or modified sequence opt2 from ZNFX1__Homo_sapiens__NP_066363
auggaggagcgccgcccccaccucgacgcccgcccccgcaacucccacaccaaccaccgcggccccgucgacggcgagcuccccccccgcgcccgcaaccaggccaacaacccccccgccaacgcccuccgcggcggcgccucccaccccggccgccacccccgcgccaacaaccaccccgccgccuacuggcagcgcgaggagcgcuuccgcgccaugggccgcaacccccaccagggccgccgcaaccaggagggccacgccuccgacgaggcccgcgaccagcgccacgaccaggagaacgacacccgcuggcgcaacggcaaccaggacugccgcaaccgccgcccccccugguccaacgacaacuuccagcaguggcgcaccccccaccagaagcccaccgagcagccccagcaggccaagaagcucggcuacaaguuccucgagucccuccuccagaaggaccccuccgaggucgucaucacccucgccaccucccucggccucaaggagcuccucucccacuccuccaugaaguccaacuuccucgagcucaucugccagguccuccgcaaggccugcuccuccaagauggaccgccaguccguccuccacguccucggcauccucaagaacuccaaguuccucaaggucugccuccccgccuacgucgucggcaugaucaccgagcccauccccgacauccgcaaccaguaccccgagcacaucuccaacaucaucucccuccuccaggaccucgucuccgucuuccccgccuccuccguccaggagaccuccaugcucgucucccuccuccccaccucccucaacgcccuccgcgccuccggcgucgacaucgaggaggagaccgagaagaaccucgagaagguccagaccaucaucgagcaccuccaggagaagcgccgcgagggcacccuccgcgucgacaccuacacccucguccagcccgaggccgaggaccacgucgaguccuaccgcaccaugcccaucuaccccaccuacaacgagguccaccucgacgagcgccccuuccuccgccccaacaucaucuccggcaaguacgacuccaccgccaucuaccucgacacccacuuccgccuccuccgcgaggacuucguccgcccccuccgcgagggcauccucgagcuccuccaguccuucgaggaccagggccuccgcaagcgcaaguucgacgacauccgcaucuacuucgacacccgcaucaucacccccaugugcuccuccuccggcaucgucuacaagguccaguucgacaccaagccccucaaguucguccgcuggcagaacuccaagcgccuccucuacggcucccucgucugcauguccaaggacaacuucgagaccuuccucuucgccaccgucuccaaccgcgagcaggaggaccucugccgcggcaucguccagcucugcuucaacgagcagucccagcagcuccucgccgagguccagcccuccgacuccuuccucauggucgagaccaccgccuacuucgaggccuaccgccacguccucgagggccuccaggagguccaggaggaggacguccccuuccagcgcaacaucgucgagugcaacucccacgucaaggagccccgcuaccuccucaugggcggccgcuacgacuucaccccccucaucgagaaccccuccgccaccggcgaguuccuccgcaacgucgagggccuccgccacccccgcaucaacguccucgaccccggccaguggcccuccaaggaggcccucaagcucgacgacucccagauggaggcccuccaguucgcccucacccgcgagcucgccaucauccagggcccccccggcaccggcaagaccuacgucggccucaagaucguccaggcccuccucaccaacgaguccgucuggcagaucucccuccagaaguuccccauccucgucgucugcuacaccaaccacgcccucgaccaguuccucgagggcaucuacaacugccagaagaccuccaucguccgcgucggcggccgcuccaacuccgagauccucaagcaguucacccuccgcgagcuccgcaacaagcgcgaguuccgccgcaaccuccccaugcaccuccgccgcgccuacauguccaucaugacccagaugaaggaguccgagcaggagcuccacgagggcgccaagacccucgagugcaccaugcgcggcguccuccgcgagcaguaccuccagaaguacaucuccccccagcacugggagucccucaugaacggccccguccaggacuccgaguggaucugcuuccagcacuggaagcacuccaugaugcucgaguggcucggccucggcgucggcuccuucacccaguccgucucccccgccggccccgagaacaccgcccaggccgagggcgacgaggaggaggagggcgaggaggaguccucccucaucgagaucgccgaggaggccgaccucauccaggccgaccgcgucaucgaggaggaggaggucguccgcccccagcgccgcaagaaggaggaguccggcgccgaccaggagcucgccaagaugcuccucgccaugcgccucgaccacugcggcaccggcaccgccgccggccaggagcaggccaccggcgaguggcagacccagcgcaaccagaagaagaagaugaagaagcgcgucaaggacgagcuccgcaagcucaacaccaugaccgccgccgaggccaacgagaucgaggacgucuggcagcucgaccucuccucccgcuggcagcucuaccgccucuggcuccagcucuaccaggccgacacccgccgcaagauccucuccuacgagcgccaguaccgcaccuccgccgagcgcauggccgagcuccgccuccaggaggaccuccacauccucaaggacgcccaggucgucggcaugaccaccaccggcgccgccaaguaccgccagauccuccagaaggucgagccccgcaucgucaucgucgaggaggccgccgagguccucgaggcccacaccaucgccacccucuccaaggccugccagcaccucauccucaucggcgaccaccagcagcuccgccccuccgccaacgucuacgaccucgccaagaacuucaaccucgaggucucccucuucgagcgccucgucaaggucaacauccccuucguccgccucaacuaccagcaccgcaugugccccgagaucgcccgccuccucaccccccacaucuaccaggaccucgagaaccaccccuccguccucaaguacgagaagaucaagggcgucuccuccaaccucuucuucgucgagcacaacuuccccgagcaggagauccaggagggcaagucccaccagaaccagcacgaggcccacuucgucgucgagcucugcaaguacuuccucugccaggaguaccuccccucccagaucaccauccucaccaccuacaccggccagcucuucugccuccgcaagcucaugcccgccaagaccuucgccggcguccgcguccacgucgucgacaaguaccagggcgaggagaacgacaucauccuccucucccucguccgcuccaaccaggagggcaaggucggcuuccuccagaucuccaaccgcaucugcgucgcccucucccgcgccaagaagggcauguacugcaucggcaacaugcagaugcucgccaaggucccccucugguccaagaucauccacacccuccgcgagaacaaccagaucggccccaugcuccgccucugcugccagaaccaccccgagacccacacccucgucuccaaggccuccgacuuccagaagguccccgagggcggcugcucccuccccugcgaguuccgccucggcugcggccacgucugcacccgcgccugccaccccuacgacuccucccacaaggaguuccagugcaugaagcccugccagaaggucaucugccaggagggccaccgcugcccccucgucugcuuccaggagugccagcccugccaggucaagguccccaagaccaucccccgcugcggccacgagcagaugguccccugcuccguccccgaguccgacuucugcugccaggagcccugcuccaagucccuccgcugcggccaccgcugcucccaccccugcggcgaggacugcguccagcucugcuccgagauggucaccaucaagcucaagugcggccacucccagcccgucaagugcggccacgucgagggccuccucuacggcggccuccucgucaagugcaccaccaagugcggcaccauccucgacugcggccaccccugccccggcuccugccacuccugcuucgagggccgcuuccacgagcgcugccagcagcccugcaagcgccuccucaucugcucccacaagugccaggagcccugcaucggcgagugcccccccugccagcgcaccugccagaaccgcugcguccacucccagugcaagaagaagugcggcgagcucugcucccccugcgucgagcccugcgucuggcgcugccagcacuaccagugcaccaagcucugcuccgagcccugcaaccgcccccccugcuacguccccugcaccaagcuccucgucugcggccaccccugcaucggccucugcggcgagcccugccccaagaagugccgcaucugccacauggacgaggucacccagaucuucuucggcuucgaggacgagcccgacgcccgcuucguccagcucgaggacugcucccacaucuucgagguccaggcccucgaccgcuacaugaacgagcagaaggacgacgaggucgccauccgccucaaggucugccccaucugccagguccccauccgcaagaaccuccgcuacggcaccuccaucaagcagcgccucgaggagaucgagaucaucaaggagaagauccagggcuccgccggcgagaucgccaccucccaggagcgccucaaggcccuccucgagcgcaagucccuccuccaccagcuccuccccgaggacuuccucaugcucaaggagaagcucgcccagaagaaccucuccgucaaggaccucggccucgucgagaacuacaucuccuucuacgaccaccucgccucccucugggacucccucaagaagaugcacguccucgaggagaagcgcguccgcacccgccucgagcagguccacgaguggcucgccaagaagcgccucuccuucaccucccaggagcucuccgaccuccgcuccgagauccagcgccucaccuaccucgucaaccuccucacccgcuacaagaucgccgagaagaaggucaaggacuccaucgccgucgaggucuacuccguccagaacauccucgagaagaccugcaaguucacccaggaggacgagcagcucguccaggagaagauggaggcccucaaggccacccuccccugcuccggccucggcaucuccgaggaggagcgcguccagaucgucuccgccaucggcuacccccgcggccacugguucaagugccgcaacggccacaucuacgucaucggcgacugcggcggcgccauggagcgcggcaccugccccgacugcaaggaggucaucggcggcaccaaccacacccucgagcgcuccaaccagcucgccuccgagauggacggcgcccagcacgccgccugguccgacaccgccaacaaccucaugaacuucgaggagauccagggcaugauguga

SEQ ID NO: 52204 - RNA, 1212 nt, Artificial Sequence
  derived and/or modified sequence opt2 from ZNHIT2__Homo_sapiens__NP_055020
auggagcccgccggccccugcggcuucugccccgccggcgagguccagcccgcccgcuacaccugcccccgcugcaacgcccccuacugcucccuccgcugcuaccgcacccacggcaccugcgccgagaacuucuaccgcgaccagguccucggcgagcuccgcggcugcuccgccccccccucccgccucgccuccgcccuccgccgccuccgccagcagcgcgagaccgaggacgagcccggcgaggccggccucuccuccggccccgcccccggcggccucuccggccucugggagcgccucgcccccggcgagaaggccgccuucgagcgccuccucucccgcggcgaggccggccgccuccucccccccuggcgccccuggugguggaaccgcggcgccggcccccagcuccucgaggagcucgacaacgcccccggcuccgacgccgccgagcucgagcucgcccccgcccgcaccccccccgacuccgucaaggacgccuccgccgccgagcccgccgccgccgagcgcguccucggcgacguccccggcgccugcacccccgucguccccacccgcauccccgccaucgucucccucucccgcggccccgucuccccccucguccgcuuccagcuccccaacguccucuucgccuacgcccacacccucgcccucuaccacggcggcgacgacgcccuccucuccgacuucugcgccacccuccucggcgucuccggcgcccucggcgcccagcaggucuucgccuccgccgaggaggcccuccaggccgccgcccacguccucgaggccggcgagcacccccccggcccccucggcacccgcggcgccaugcacgaggucgcccgcauccuccucggcgagggccccaccaaccagaagggcuacacccucgccgcccucggcgaccucgcccagacccucggccgcgcccgcaagcaggccgucgcccgcgaggagcgcgaccaccucuaccgcgcccgcaagaagugccaguuccuccucgccuggaccaacgagaacgaggccgcccucaccccccucgcccucgacugcgcccgcgcccaccaggcccacgccgucgucgccgaggaggucgccgcccucaccggcgagcucgagcgccucuggggcggccccgucccccccgccccccgcacccucaucgaggagcuccccuccuga

SEQ ID NO: 52205 - RNA, 468 nt, Artificial Sequence
  derived and/or modified sequence opt2 from ZNHIT3__Homo_sapiens__NP_004764
auggccucccucaagugcuccaccgucgucugcgucaucugccucgagaagcccaaguaccgcugccccgccugccgcguccccuacugcuccgucgucugcuuccgcaagcacaaggagcagugcaaccccgagacccgccccgucgagaagaagauccgcuccgcccuccccaccaagaccgucaagcccgucgagaacaaggacgacgacgacuccaucgccgacuuccucaacuccgacgaggaggaggaccgcgucucccuccagaaccucaagaaccucggcgaguccgccacccuccgcucccuccuccucaacccccaccuccgccagcucauggucaaccucgaccagggcgaggacaaggccaagcucaugcgcgccuacaugcaggagccccucuucgucgaguucgccgacugcugccucggcaucgucgagcccucccagaacgaggaguccuga

SEQ ID NO: 52206 - RNA, 381 nt, Artificial Sequence
  derived and/or modified sequence opt2 from ZNRD1__Homo_sapiens__NP_001265715
auguccgucauggaccucgccaacaccugcuccuccuuccaguccgaccucgacuucugcuccgacugcggcuccguccucccccuccccggcgcccaggacaccgucaccugcauccgcugcggcuucaacaucaacguccgcgacuucgagggcaaggucgucaagaccuccgucgucuuccaccagcucggcaccgccaugcccauguccgucgaggagggccccgagugccagggccccgucgucgaccgccgcugcccccgcugcggccacgagggcauggccuaccacacccgccagaugcgcuccgccgacgagggccagaccgucuucuacaccugcaccaacugcaaguuccaggagaaggaggacuccuga

SEQ ID NO: 52207 - RNA, 2811 nt, Artificial Sequence
  derived and/or modified sequence opt2 from ZNRF3__Homo_sapiens__NP_001193927
augcgcccccgcuccggcggccgccccggcgccaccggccgccgccgccgccgccuccgccgccgcccccgcggccuccgcugcucccgccucccccccccccccccccucccccuccuccucggccuccuccucgccgccgccggccccggcgccgcccgcgccaaggagaccgccuucgucgaggucguccucuucgaguccucccccuccggcgacuacaccaccuacaccaccggccucaccggccgcuucucccgcgccggcgccacccucuccgccgagggcgagaucguccagaugcacccccucggccucugcaacaacaacgacgaggaggaccucuacgaguacggcugggucggcgucgucaagcucgagcagcccgagcucgaccccaagcccugccucaccguccucggcaaggccaagcgcgccguccagcgcggcgccaccgccgucaucuucgacgucuccgagaaccccgaggccaucgaccagcucaaccagggcuccgaggacccccucaagcgccccgucgucuacgucaagggcgccgacgccaucaagcucaugaacaucgucaacaagcagaaggucgcccgcgcccgcauccagcaccgccccccccgccagcccaccgaguacuucgacaugggcaucuuccucgccuucuucgucgucgucucccucgucugccucauccuccucgucaagaucaagcucaagcagcgccgcucccagaacuccaugaaccgccucgccguccaggcccucgagaagauggagacccgcaaguucaacuccaaguccaagggccgccgcgagggcuccugcggcgcccucgacacccucuccuccuccuccaccuccgacugcgccaucugccucgagaaguacaucgacggcgaggagcuccgcgucauccccugcacccaccgcuuccaccgcaagugcgucgaccccuggcuccuccagcaccacaccugcccccacugccgccacaacaucaucgagcagaagggcaaccccuccgccgucugcgucgagaccuccaaccucucccgcggccgccagcagcgcgucacccuccccguccacuaccccggccgcguccaccgcaccaacgccauccccgccuaccccacccgcaccuccauggacucccacggcaaccccgucacccuccucaccauggaccgccacggcgagcagucccucuacuccccccagacccccgccuacauccgcuccuaccccccccuccaccucgaccacucccucgccgcccaccgcugcggccucgagcaccgcgccuacucccccgcccaccccuuccgccgccccaagcucuccggccgcuccuucuccaaggccgccugcuucucccaguacgagaccauguaccagcacuacuacuuccagggccucuccuaccccgagcaggagggccaguccccccccucccucgccccccgcggccccgcccgcgccuucccccccuccggcuccggcucccuccucuuccccaccgucguccacgucgccccccccucccaccucgaguccggcuccaccuccuccuucuccugcuaccacggccaccgcuccgucugcuccggcuaccucgccgacugccccggcuccgacuccuccuccuccuccuccuccggccagugccacugcuccuccuccgacuccgucgucgacugcaccgaggucuccaaccagggcgucuacggcuccugcuccaccuuccgcuccucccucuccuccgacuacgaccccuucaucuaccgcucccgcucccccugccgcgccuccgaggccggcggcuccggcuccuccggccgcggccccgcccucugcuucgagggcucccccccccccgaggagcuccccgccguccacucccacggcgccggccgcggcgagcccuggcccggccccgccucccccuccggcgaccaggucuccaccugcucccucgagaugaacuacuccuccaacuccucccucgagcaccgcggccccaacuccuccaccuccgaggucggccucgaggccucccccggcgccgcccccgaccuccgccgcaccuggaagggcggccacgagcuccccuccugcgccugcugcugcgagccccagcccucccccgccggccccuccgccggcgccgccggcuccuccacccucuuccucggcccccaccucuacgagggcuccggccccgccggcggcgagccccaguccggcuccucccagggccucuacggccuccaccccgaccaccucccccgcaccgacggcgucaaguacgagggccuccccugcugcuucuacgaggagaagcaggucgcccgcggcggcggcggcggcuccggcugcuacaccgaggacuacuccgucuccguccaguacacccucaccgaggagcccccccccggcugcuaccccggcgcccgcgaccucucccagcgcauccccaucauccccgaggacgucgacugcgaccucggccuccccuccgacugccagggcacccacucccucggcuccuggggcggcacccgcggccccgacaccccccgcccccaccgcggccucggcgccacccgcgaggaggagcgcgcccucugcugccaggcccgcgcccuccuccgccccggcugcccccccgaggaggccggcgccguccgcgccaacuuccccuccgcccuccaggacacccaggaguccuccaccaccgccaccgaggccgccggcccccgcucccacuccgccgacuccuccucccccggcgccuga

SEQ ID NO: 52208 - RNA, 1917 nt, Artificial Sequence
  derived and/or modified sequence opt2 from ZP1__Homo_sapiens__NP_997224
auggccggcggcuccgccaccaccuggggcuaccccgucgcccuccuccuccucgucgccacccucggccucggccgcuggcuccagcccgaccccggccuccccggccuccgccacuccuacgacugcggcaucaagggcaugcagcuccucgucuucccccgccccggccagacccuccgcuucaaggucgucgacgaguucggcaaccgcuucgacgucaacaacugcuccaucugcuaccacugggucaccucccgcccccaggagcccgccgucuucuccgccgacuaccgcggcugccacguccucgagaaggacggccgcuuccaccuccgcgucuucauggaggccguccuccccaacggccgcgucgacgucgcccaggacgccacccucaucugccccaagcccgaccccucccgcacccucgacucccagcucgccccccccgccauguucuccgucuccaccccccagacccucuccuuccuccccaccuccggccacaccucccagggcuccggccacgccuuccccuccccccucgaccccggccacuccuccguccaccccacccccgcccuccccucccccggccccggccccacccucgccacccucgcccagccccacuggggcacccucgagcacugggacgucaacaagcgcgacuacaucggcacccaccucucccaggagcagugccaggucgccuccggccaccuccccugcaucguccgccgcaccuccaaggaggccugccagcaggccggcugcugcuacgacaacacccgcgagguccccugcuacuacggcaacaccgccaccguccagugcuuccgcgacggcuacuucguccucgucgucucccaggagauggcccucacccaccgcaucacccucgccaacauccaccucgccuacgcccccaccuccugcucccccacccagcacaccgaggccuucgucgucuucuacuucccccucacccacugcggcaccaccaugcaggucgccggcgaccagcucaucuacgagaacuggcucgucuccggcauccacauccagaagggcccccagggcuccaucacccgcgacuccaccuuccagcuccacguccgcugcgucuucaacgccuccgacuuccuccccauccaggccuccaucuuccccccccccucccccgcccccaugacccagcccggcccccuccgccucgagcuccgcaucgccaaggacgagaccuucuccuccuacuacggcgaggacgacuaccccaucguccgccuccuccgcgagcccguccacgucgagguccgccuccuccagcgcaccgaccccaaccucguccuccuccuccaccagugcuggggcgcccccuccgccaaccccuuccagcagccccaguggcccauccucuccgacggcugccccuucaagggcgacuccuaccgcacccagauggucgcccucgacggcgccacccccuuccagucccacuaccagcgcuucaccgucgccaccuucgcccuccucgacuccggcucccagcgcgcccuccgcggccucgucuaccucuucugcuccaccuccgccugccacaccuccggccucgagaccugcuccaccgccugcuccaccggcaccacccgccagcgccgcuccuccggccaccgcaacgacaccgcccgcccccaggacaucgucuccucccccggccccgucggcuucgaggacuccuacggccaggagcccacccucggccccaccgacuccaacggcaacuccucccuccgcccccuccucugggccguccuccuccuccccgccgucgcccucguccucggcuucggcgucuucgucggccucucccagaccugggcccagaagcucugggaguccaaccgccaguga

SEQ ID NO: 52209 - RNA, 1623 nt, Artificial Sequence
  derived and/or modified sequence opt2 from ZP4__Homo_sapiens__NP_067009
auguggcuccuccgcugcguccuccucugcgucucccucucccucgccgucuccggccagcacaagcccgaggcccccgacuacuccuccguccuccacugcggccccugguccuuccaguucgccgucaaccucaaccaggaggccaccuccccccccguccucaucgccugggacaaccagggccuccuccacgagcuccagaacgacuccgacugcggcaccuggauccgcaagggccccggcuccuccgucguccucgaggccaccuacuccuccugcuacgucaccgagugggacucccacuacaucaugcccgucggcgucgagggcgccggcgccgccgagcacaaggucgucaccgagcgcaagcuccucaagugccccauggaccuccucgcccgcgacgcccccgacaccgacuggugcgacuccauccccgcccgcgaccgccuccccugcgcccccucccccaucucccgcggcgacugcgagggccucggcugcugcuacuccuccgaggaggucaacuccugcuacuacggcaacaccgucacccuccacugcacccgcgagggccacuucuccaucgccgucucccgcaacgucaccucccccccccuccuccucgacuccguccgccucgcccuccgcaacgacuccgccugcaaccccgucauggccacccaggccuucguccucuuccaguuccccuucaccuccugcggcaccacccgccagaucaccggcgaccgcgccgucuacgagaacgagcucgucgccacccgcgacgucaagaacggcucccgcggcuccgucacccgcgacuccaucuuccgccuccacgucuccugcuccuacuccgucuccuccaacucccuccccaucaacguccaggucuucacccuccccccccccuuccccgagacccagcccggcccccucacccucgagcuccagaucgccaaggacaagaacuacggcuccuacuacggcgucggcgacuaccccgucgucaagcuccuccgcgaccccaucuacgucgaggucuccauccuccaccgcaccgaccccuaccucggccuccuccuccagcagugcugggccacccccuccaccgacccccucucccagccccaguggcccauccucgucaagggcugccccuacaucggcgacaacuaccagacccagcucauccccguccagaaggcccucgaccuccccuuccccucccaccaccagcgcuucuccaucuucaccuucuccuucgucaaccccaccgucgagaagcaggcccuccgcggccccguccaccuccacugcuccgucuccgucugccagcccgccgagacccccuccugcgucgucaccugccccgaccucucccgccgccgcaacuucgacaacuccucccagaacaccaccgccuccgucuccuccaagggccccaugauccuccuccaggccaccaaggacccccccgagaagcuccgcguccccgucgacuccaagguccucugggucgccggccucuccggcacccucauccucggcgcccuccucgucuccuaccucgccgucaagaagcagaaguccugccccgaccagaugugccaguga

SEQ ID NO: 52210 - RNA, 951 nt, Artificial Sequence
  derived and/or modified sequence opt2 from ZPBP2__Homo_sapiens__NP_942141
augaugcgcaccugcguccuccucuccgccguccucuggugccucaccggcgacaagaucuacgucgagcuccaccagaacucccccguccucaucugcauggacuucaagcucuccaagaaggagaucgucgaccccaccuaccucuggaucggccccaacgagaagacccucaccggcaacaaccgcaucaacaucaccgagaccggccagcucauggucaaggacuuccucgagccccucuccggccucuacaccugcacccucuccuacaagaccgucaaggccgagacccaggaggagaagaccgucaagaagcgcuacgacuucauggucuucgccuaccgcgagcccgacuacuccuaccagauggccguccgcuucaccacccgcuccugcaucggccgcuacaacgacgucuucuuccgcguccucaagaagauccucgacucccucaucuccgaccucuccugccacgucaucgagcccuccuacaagugccacuccgucgagauccccgagcacggccucauccacgagcucuucaucgccuuccaggucaaccccuucgcccccggcuggaagggcgccugcaacggcuccgucgacugcgaggacaccaccaaccacaacauccuccaggcccgcgaccgcaucgaggacuucuuccgcucccaggccuacaucuucuaccacaacuucaacaagacccuccccgccaugcacuucgucgaccacucccuccaggucguccgccucgacuccugccgccccggcuucggcaagaacgagcgccuccacuccaacugcgccuccugcugcgucgucugcucccccgccaccuucucccccgacgucaacgucaccugccagaccugcgucuccguccucaccuacggcgccaaguccugcccccagaccuccaacaagaaccagcaguacgaggacuga

SEQ ID NO: 52211 - RNA, 1296 nt, Artificial Sequence
  derived and/or modified sequence opt2 from ZPLD1__Homo_sapiens__NP_778226
augaugcuccgcuucuccaugugccgcggcaacgacgagggcuucgccauggagcagaucuggcuccuccuccuccucaccauccgcguccuccccggcuccgcccaguucaacggcuacaacugcgacgccaaccuccacucccgcuuccccgccgagcgcgacaucuccgucuacugcggcguccaggccaucaccaugaagaucaacuucugcaccguccucuucuccggcuacuccgagaccgaccucgcccucaacggccgccacggcgacucccacugccgcggcuucaucaacaacaacaccuuccccgccgucgucaucuucaucaucaaccucuccacccucgagggcugcggcaacaaccucgucgucuccaccauccccggcgucuccgccuacggcaacgccaccuccguccaggucggcaacaucuccggcuacaucgacacccccgacccccccaccaucaucuccuaccuccccggccuccucuacaaguucuccugcuccuacccccucgaguaccucgucaacaacacccagcucgccuccuccuccgccgccaucuccguccgcgagaacaacggcaccuucgucuccacccucaaccuccuccucuacaacgacuccaccuacaaccagcagcucaucauccccuccaucggccucccccucaagaccaaggucuucgccgccguccaggccaccaaccucgacggccgcuggaacguccucauggacuacugcuacaccacccccuccggcaaccccaacgacgacauccgcuacgaccucuuccucuccugcgacaaggacccccagaccaccgucaucgagaacggccgcucccagcgcggccgcuucuccuucgaggucuuccgcuucgucaagcacaagaaccagaagauguccaccgucuuccuccacugcgucaccaagcucugccgcgccgacgacugccccuuccucaugcccaucugcucccaccgcgagcgccgcgacgccggccgccgcaccaccugguccccccaguccuccuccggcuccgccguccucuccgccggccccaucaucacccgcuccgacgagacccccaccaacaacucccagcucggcucccccuccaugccccccuuccagcucaacgccaucaccuccgcccucaucuccggcauggucauccucggcgucaccuccuucucccuccuccucugcucccucgcccuccuccaccgcaagggccccaccucccucguccucaacggcauccgcaaccccgucuucgacuga

SEQ ID NO: 52212 - RNA, 1380 nt, Artificial Sequence
  derived and/or modified sequence opt2 from ZPR1__Homo_sapiens__NP_003895
auggccgccuccggcgccgucgagcccggcccccccggcgccgccgucgcccccucccccgcccccgcccccccccccgcccccgaccaccucuuccgccccaucuccgccgaggacgaggagcagcagcccaccgagaucgagucccucugcaugaacugcuacugcaacggcaugacccgccuccuccucaccaagauccccuucuuccgcgagaucaucgucuccuccuucuccugcgagcacugcggcuggaacaacaccgagauccaguccgccggccgcauccaggaccagggcguccgcuacacccucuccguccgcgcccucgaggacaugaaccgcgaggucgucaagaccgacuccgccgccacccgcauccccgagcucgacuucgagauccccgccuucucccagaagggcgcccucaccaccgucgagggccucaucacccgcgccaucuccggccucgagcaggaccagcccgcccgccgcgccaacaaggacgccaccgccgagcgcaucgacgaguucaucgucaagcucaaggagcucaagcaggucgccucccccuucacccucaucaucgacgaccccuccggcaacuccuucgucgagaacccccacgccccccagaaggacgacgcccucgucaucacccacuacaaccgcacccgccagcaggaggagaugcucggccuccaggaggaggcccccgccgagaagcccgaggaggaggaccuccgcaacgagguccuccaguucuccaccaacugccccgagugcaacgcccccgcccagaccaacaugaagcucguccagaucccccacuucaaggaggucaucaucauggccaccaacugcgagaacugcggccaccgcaccaacgaggucaaguccggcggcgccgucgagccccucggcacccgcaucacccuccacaucaccgacgccuccgacaugacccgcgaccuccucaaguccgagaccugcuccgucgagauccccgagcucgaguucgagcucggcauggccguccucggcggcaaguucaccacccucgagggccuccucaaggacauccgcgagcucgucaccaagaaccccuucacccucggcgacuccuccaaccccggccagaccgagcgccuccaggaguucucccagaagauggaccagaucaucgagggcaacaugaaggcccacuucaucauggacgaccccgccggcaacuccuaccuccagaacgucuacgcccccgaggacgaccccgagaugaaggucgagcgcuacaagcgcaccuucgaccagaacgaggagcucggccucaacgacaugaagaccgagggcuacgaggccggccucgccccccagcgcuga

SEQ ID NO: 52213 - RNA, 3234 nt, Artificial Sequence
  derived and/or modified sequence opt2 from ZRANB3__Homo_sapiens__NP_001273497
augccccgcguccacaacaucaagaagucccucaccccccacaucuccugcgucaccaacgaguccgacaaccuccucgacuuccuccccgaccgccuccgcgccaagcuccuccccuuccagaaggacggcaucaucuucgcccucaagcgcaacggccgcugcauggucgccgacgagaugggccucggcaagaccauccaggccaucggcaucaccuacuucuacaaggaggaguggccccuccucaucgucguccccuccucccuccgcuaccccuggaccgaggagaucgagaaguggauccccgagcucucccccgaggagaucaacgucauccagaacaagaccgacguccgccgcauguccaccuccaaggucaccguccucggcuacggccuccucaccgccgacgccaagacccucaucgacgcccucaacaaccagaacuucaaggucgucaucgucgacgagucccacuacaugaagucccgcaacgccacccgcucccgcauccuccuccccaucguccagaaggcccgccgcgccauccuccucaccggcacccccgcccucggccgccccgaggagcucuucaugcagaucgaggcccucuucccccagaaguucggccgcuggaccgacuacgccaagcgcuacugcaacgcccacauccgcuacuucggcaagcgcccccagugggacugccgcggcgccuccaaccucaacgagcuccaccagcuccucuccgacaucaugauccgccgccucaagaccgagguccucacccagcucccccccaagguccgccagcgcauccccuucgaccuccccuccgccgccgccaaggagcucaacaccuccuucgaggagugggagaagaucaugcgcacccccaacuccggcgccauggagaccgucaugggccucaucacccgcauguucaagcagaccgccaucgccaaggccggcgccgucaaggacuacaucaagaugaugcuccagaacgacucccucaaguuccucgucuucgcccaccaccucuccaugcuccaggccugcaccgaggccgucaucgagaacaagacccgcuacauccgcaucgacggcuccgucuccuccuccgagcgcauccaccucgucaaccaguuccagaaggaccccgacacccgcgucgccauccucuccauccaggccgccggccagggccucaccuucaccgccgccucccacgucgucuucgccgagcucuacugggaccccggccacaucaagcaggccgaggaccgcgcccaccgcaucggccagugcuccuccgucaacauccacuaccucaucgccaacggcacccucgacacccucauguggggcaugcucaaccgcaaggcccaggucaccggcuccacccucaacggccgcaaggagaagauccaggccgaggagggcgacaaggagaagugggacuuccuccaguucgccgaggccuggacccccaacgacuccuccgaggagcuccgcaaggaggcccucuucacccacuucgagaaggagaagcagcacgacauccgcuccuucuucgucccccagcccaagaagcgccagcucaugaccuccugcgacgaguccaagcgcuuccgcgaggagaacaccgucgucuccuccgaccccaccaagaccgccgcccgcgacaucaucgacuacgaguccgacgucgagcccgagaccaagcgccucaagcucgccgccuccgaggaccacugcucccccuccgaggagacccccucccaguccaagcagauccgcaccccccucgucgaguccguccaggaggccaaggcccagcucaccacccccgccuuccccgucgagggcuggcagugcucccucugcaccuacaucaacaacuccgagcuccccuacugcgagaugugcgagaccccccagggcuccgccgucaugcagaucgacucccucaaccacauccaggacaagaacgagaaggacgacucccagaaggacaccuccaagaagguccagaccaucuccgacugcgagaagcaggcccucgcccaguccgagcccggccagcucgccgacuccaaggaggagacccccaagaucgagaaggaggacggccucaccucccagcccgagcaguggaaguccuccgacacccuccccgucuacgacacccucauguucugcgccucccgcaacaccgaccgcauccacaucuacaccaaggacggcaagcagauguccugcaacuucaucccccucgacaucaagcucgaccucugggaggaccuccccgccuccuuccagcucaagcaguaccgcucccucauccuccgcuucguccgcgagugguccucccucaccgccaugaagcagcgcaucauccgcaaguccggccagcucuucugcucccccauccucgcccucgaggagaucaccaagcagcagaccaagcagaacugcaccaagcgcuacaucaccaaggaggacgucgccgucgccuccauggacaaggucaagaacgucggcggccacguccgccucaucaccaaggagucccgcccccgcgaccccuucaccaagaagcuccucgaggacggcgccugcguccccuuccucaaccccuacaccguccaggccgaccucaccgucaagcccuccaccuccaagggcuaccuccaggccgucgacaacgagggcaacccccucugccuccgcugccagcagcccaccugccagaccaagcaggccugcaaggccaacuccugggacucccgcuucugcucccucaagugccaggaggaguucuggauccgcuccaacaacuccuaccuccgcgccaaggucuucgagaccgagcacggcgucugccagcucugcaacgucaacgcccaggagcucuuccuccgccuccgcgacgcccccaagucccagcgcaagaaccuccucuacgccaccuggaccuccaagcucccccucgagcagcucaacgagaugauccgcaaccccggcgagggccacuucuggcaggucgaccacaucaagcccgucuacggcggcggcggccagugcucccucgacaaccuccagacccucugcaccgucugccacaaggagcgcaccgcccgccaggccaaggagcgcucccagguccgccgccagucccucgccuccaagcacggcuccgacaucacccgcuuccucgucaagaaguga

SEQ ID NO: 52214 - RNA, 1449 nt, Artificial Sequence
  derived and/or modified sequence opt2 from ZRSR2__Homo_sapiens__NP_005080
auggccgcccccgagaagaugaccuuccccgagaagcccucccacaagaaguaccgcgccgcccucaagaaggagaagcgcaagaagcgccgccaggagcucgcccgccuccgcgacuccggccucucccagaaggaggaggaggaggacaccuucaucgaggagcagcagcucgaggaggagaagcuccucgagcgcgagcgccagcgccuccacgaggaguggcuccuccgcgagcagaaggcccaggaggaguuccgcaucaagaaggagaaggaggaggccgccaagaagcgccaggaggagcaggagcgcaagcucaaggagcagugggaggagcagcagcgcaaggagcgcgaggaggaggagcagaagcgccaggagaagaaggagaaggaggaggcccuccagaagaugcucgaccaggccgagaacgagcucgagaacggcaccaccuggcagaaccccgagccccccgucgacuuccgcgucauggagaaggaccgcgccaacugccccuucuacuccaagaccggcgccugccgcuucggcgaccgcugcucccgcaagcacaacuuccccaccuccucccccacccuccucaucaaguccauguucaccaccuucggcauggagcagugccgccgcgacgacuacgaccccgacgccucccucgaguacuccgaggaggagaccuaccagcaguuccucgacuucuacgaggacguccuccccgaguucaagaacgucggcaaggucauccaguucaaggucuccugcaaccucgagccccaccuccgcggcaacgucuacguccaguaccaguccgaggaggagugccaggccgcccucucccucuucaacggccgcugguacgccggccgccagcuccagugcgaguucugccccgucacccgcuggaagauggccaucugcggccucuucgagauccagcagugcccccgcggcaagcacugcaacuuccuccacgucuuccgcaaccccaacaacgaguucugggaggccaaccgcgacaucuaccucucccccgaccgcaccggcuccuccuucggcaagaacuccgagcgccgcgagcgcaugggccaccacgacgacuacuacucccgccuccgcggccgccgcaaccccucccccgaccacuccuacaagcgcaacggcgaguccgagcgcaaguccucccgccaccgcggcaagaagucccacaagcgcaccuccaagucccgcgagcgccacaacucccgcucccgcggccgcaaccgcgaccgcucccgcgaccgcucccgcggccgcggcucccgcucccgcucccgcucccgcucccgccgcucccgccgcucccgcucccaguccuccucccgcucccgcucccgcggccgccgccgcuccggcaaccgcgaccgcaccguccagucccccaaguccaaguga

SEQ ID NO: 52215 - RNA, 1701 nt, Artificial Sequence
  derived and/or modified sequence opt2 from ZSCAN18__Homo_sapiens__NP_001139014
augcgccgcgucggcggccgcgccgacgaggacgccaccgccgccggcucccucuggguccucgccccccccgagcccaccggccaccucgucauccccggcaccuccccccucgagccccccugccccuggcucgacucccacaucuuccagugccgcuucggcaagaugcucccccucgagaaggccuucgccuccccccgcuccucccccgccccccccgaccuccccacccccggcuccgccgccggcguccagcaggaggagcccgagaccauccccgagcgcacccccgccgaccucgaguucucccgccuccgcuuccgcgaguucgucuaccaggaggccgccggcccccaccagacccucgcccgccuccacgagcucugccgccaguggcucaugcccgaggcccgcuccaaggagcagaugcucgagcuccucguccucgagcaguuccucggcauccuccccgacaagguccgccccugggucgucgcccaguaccccgaguccugcaagaaggccgccucccucgucgagggccucgccgacguccucgaggagcccggcaugcuccucggcucccccgccggcuccuccuccauccucuccgacggcgucuacgagcgccacauggacccccuccuccuccccggcgagcucgccucccccucccaggcccucggcgccggcgagauccccgcccccuccgagacccccuggcucucccccgacccccucuuccucgagcagcgccgcguccgcgaggccaagaccgaggaggacggccccgccaacaccgagcagaagcucaaguccuuccccgaggacccccagcaccucggcgaguggggccaccucgaccccgccgaggagaaccucaaguccuaccgcaagcuccuccucuggggcuaccagcucucccagcccgacgccgccucccgccucgacaccgaggagcuccgccucgucgagcgcgacccccagggcuccucccuccccgagggcggccgccgccaggaguccgccggcugcgccugcgaggaggccgcccccgccggcguccuccccgagcuccccaccgaggccccccccggcgacgcccucgccgacccccccuccggcaccaccgaggaggaggaggagcagcccggcaaggcccccgacccccaggacccccaggacgccgaguccgacuccgccaccggcucccagcgccaguccgucauccagcagcccgcccccgaccgcggcaccgccaagcucggcaccaagcgcccccaccccgaggacggcgacggccagucccucgagggcgucuccuccuccggcgacuccgccggccucgaggccggccagggccccggcgccgacgagcccggccucucccgcggcaagcccuacgccugcggcgagugcggcgaggccuucgccuggcucucccaccucauggagcaccacuccucccacggcggccgcaagcgcuacgccugccagggcugcuggaagaccuuccacuucucccucgcccucgccgagcaccagaagacccacgagaaggagaaguccuacgcccucggcggcgcccgcggcccccagcccuccacccgcgaggcccaggccggcgcccgcgccggcggcccccccgaguccgucgagggcgaggccccccccgccccccccgaggcccagcgcuga

SEQ ID NO: 52216 - RNA, 1476 nt, Artificial Sequence
  derived and/or modified sequence opt2 from ZSCAN22__Homo_sapiens__NP_862829
auggccauccccaagcacucccucucccccguccccugggaggaggacuccuuccuccaggucaaggucgaggaggaggaggaggccucccucucccagggcggcgaguccucccacgaccacaucgcccacuccgaggccgcccgccuccgcuuccgccacuuccgcuacgaggaggccuccggcccccacgaggcccucgcccaccuccgcgcccucugcugccaguggcuccagcccgaggcccacuccaaggagcagauccucgagcuccucguccucgagcaguuccucggcgcccucccccccgagauccaggccugggucggcgcccagucccccaaguccggcgaggaggccgccguccucgucgaggaccucacccagguccucgacaagcgcggcugggaccccggcgccgagcccaccgaggccuccugcaagcaguccgaccucggcgaguccgagcccuccaacgucaccgagacccucaugggcggcgucucccucggccccgccuucgucaaggccugcgagcccgagggcuccuccgagcgcuccggccucuccggcgagaucuggaccaaguccgucacccagcagauccacuucaagaagaccuccggccccuacaaggacguccccaccgaccagcgcggccgcgaguccggcgccucccgcaacuccuccuccgccuggcccaaccucaccucccaggagaagccccccuccgaggacaaguucgaccucgucgacgccuacggcaccgagccccccuacaccuacuccggcaagcgcuccuccaagugccgcgagugccgcaagauguuccaguccgccuccgcccucgaggcccaccagaagacccacucccgcaagacccccuacgccugcuccgagugcggcaaggccuucucccgcuccacccaccucgcccagcaccaggucguccacaccggcgccaagccccacgagugcaaggagugcggcaaggccuucucccgcgucacccaccucacccagcaccagcgcauccacaccggcgagaagcccuacaagugcggcgagugcggcaagaccuucucccgcuccacccaccucacccagcaccagcgcguccacaccggcgagcgccccuacgagugcgacgccugcggcaaggccuucucccaguccacccaccucacccagcaccagcgcauccacaccggcgagaagcccuacaagugcgacgccugcggccgcgccuucuccgacugcuccgcccucauccgccaccuccgcauccacuccggcgagaagcccuaccagugcaaggucugccccaaggccuucgcccaguccuccucccucaucgagcaccagcgcauccacaccggcgagaagcccuacaagugcuccgacugcggcaaggccuucucccgcuccuccgcccucaugguccaccuccgcauccacaucaccguccuccaguga

SEQ ID NO: 52217 - RNA, 1437 nt, Artificial Sequence
  derived and/or modified sequence opt2 from ZSCAN26__Homo_sapiens__NP_001104509
auggccaccgcccucgucuccgcccacucccucgccccccucaaccucaagaaggagggccuccgcgucguccgcgaggaccacuacuccaccugggagcagggcuucaagcuccagggcaacuccaagggccucggccaggagccccucugcaagcaguuccgccagcuccgcuacgaggagaccaccggcccccgcgaggcccucucccgccuccgcgagcucugccagcaguggcuccagcccgagacccacaccaaggagcagauccucgagcuccucguccucgagcaguuccucaucauccuccccaaggagcuccaggcccgcguccaggagcaccaccccgagucccgcgaggacgucgucgucguccucgaggaccuccagcucgaccucggcgagaccggccagcaggaccccgaccagcccaagaagcagaagauccucgucgaggagauggccccccucaagggcguccaggagcagcagguccgccacgagugcgaggucaccaagcccgagaaggagaagggcgaggagacccgcaucgagaacggcaagcucaucgucgucaccgacuccugcggccgcgucgaguccuccggcaagaucuccgagcccauggaggcccacaacgagggcuccaaccucgagcgccaccaggccaagcccaaggagaagaucgaguacaagugcuccgagcgcgagcagcgcuucauccagcaccucgaccucaucgagcacgccuccacccacaccggcaagaagcucugcgaguccgacgucugccaguccuccucccucaccggccacaagaagguccucucccgcgagaagggccaccagugccacgagugcggcaaggccuuccagcgcuccucccaccucguccgccaccagaagauccaccucggcgagaagcccuaccagugcaacgagugcggcaaggucuucucccagaacgccggccuccucgagcaccuccgcauccacaccggcgagaagcccuaccucugcauccacugcggcaagaacuuccgccgcuccucccaccucaaccgccaccagcgcauccacucccaggaggagcccugcgagugcaaggagugcggcaagaccuucucccaggcccuccuccucacccaccaccagcgcauccacucccacuccaagucccaccagugcaacgagugcggcaaggccuucucccucaccuccgaccucauccgccaccaccgcauccacaccggcgagaagcccuucaagugcaacaucugccagaaggccuuccgccucaacucccaccucgcccagcacguccgcauccacaacgaggagaagcccuaccagugcuccgagugcggcgaggccuuccgccagcgcuccggccucuuccagcaccagcgcuaccaccacaaggacaagcucgccuga

SEQ ID NO: 52218 - RNA, 744 nt, Artificial Sequence
  derived and/or modified sequence opt2 from ZSCAN31__Homo_sapiens__NP_001230173
auggucacccagcuccgcuacgaguccuucugccuccaccaguuccaggagcaggacggcgaguccauccccgagaaccaggagcucgccuccaagcaggagauccucaaggagauggagcaccucggcgacuccaagcuccagcgcgacgucucccucgacuccaaguaccgcgagaccugcaagcgcgacuccaaggccgagaagcagcaggcccacuccaccggcgagcgccgccaccgcugcaacgagugcggcaaguccuucaccaaguccuccguccucaucgagcaccagcgcauccacaccggcgagaagcccuacgagugcgaggagugcggcaaggccuucucccgccgcuccucccucaacgagcaccgccgcucccacaccggcgagaagcccuaccagugcaaggagugcggcaaggccuucuccgccuccaacggccucacccgccaccgccgcauccacaccggcgagaagcccuacgagugcaaggucugcggcaaggccuuccuccucuccuccugccucguccagcaccagcgcauccacaccggcgagaagcgcuaccagugccgcgagugcggcaaggccuucauccagaacgccggccucuuccagcaccuccgcguccacaccggcgagaagcccuaccagugcucccagugcuccaagcucuucuccaagcgcacccuccucaagaagcaccagaagauccacaccggcgagcgccccuga

SEQ ID NO: 52219 - RNA, 1227 nt, Artificial Sequence
  derived and/or modified sequence opt2 from ZSCAN32__Homo_sapiens__NP_001271458
auggccgagggccucugggagcagggcuuccuccgcacccccgagcagugccgcaccaaguucaagucccuccagcucuccuaccgcaagguccgccgcggccgcguccccgagcccugcaucuucuacgaggagaugaacgcccucuccggcuccugggccuccgccccccccauggccuccgacgccguccccggccaggagggcuccgacaucgaggccggcgagcucaaccaccagaacggcgagcccaccgaggucgaggacggcaccgucgacggcgccgaccgcgacgagaaggacuuccgcaaccccggccaggagguccgcaagcucgaccuccccguccucuuccccaaccgccucggcuucgaguucaagaacgagaucaagaaggagaaccucaagugggacgacuccgaggaggucgagaucaacaaggcccuccagcgcaagucccgcggcgucuacuggcacuccgagcuccagaagggccucgaguccgagcccaccucccgccgccagugccgcaacucccccggcgaguccgaggagaagacccccucccaggagaagaugucccaccaguccuucugcgcccgcgacaaggccugcacccacauccucugcggcaagaacugcucccaguccguccacuccccccacaagcccgcccucaagcucgagaaggucucccagugccccgagugcggcaagaccuucucccgcuccuccuaccucguccgccaccagcgcauccacaccggcgagaagccccacaagugcuccgagugcggcaagggcuucuccgagcgcuccaaccucaccgcccaccuccgcacccacaccggcgagcgccccuaccagugcggccagugcggcaaguccuucaaccaguccuccucccucaucguccaccagcgcacccacaccggcgagaagcccuaccagugcaucgucugcggcaagcgcuucaacaacuccucccaguucuccgcccaccgccgcauccacaccggcgagucccccuacaagugcgccgucugcggcaagaucuucaacaacuccucccacuucuccgcccaccgcaagacccacaccggcgagaagcccuaccgcugcucccacugcgagcgcggcuucaccaagaacuccgcccucacccgccaccagaccguccacaugaaggccguccucuccucccaggagggccgcgacgcccucuga

SEQ ID NO: 52220 - RNA, 1338 nt, Artificial Sequence
  derived and/or modified sequence opt2 from ZSCAN9__Homo_sapiens__NP_001186408
augaacaccaacuccaaggagguccucucccucggcguccagguccccgaggccugggaggagcuccucaccaugaaggucgaggccaagucccaccuccaguggcaggagucccgccucaagcgcuccaacccccucgcccgcgagaucuuccgccgccacuuccgccagcucugcuaccaggagacccccggcccccgcgaggcccucacccgccuccaggagcucugcuaccaguggcuccgcccccacgucuccaccaaggagcagauccucgaccuccucguccucgagcaguuccucuccauccuccccaaggagcuccagggcuggguccgcgagcacugccccgaguccggcgaggaggccgucauccuccucgaggaccucgagcgcgagcucgacgagccccagcacgagauggucgcccaccgccaccgccaggagguccucugcaaggagauggucccccucgccgagcagaccccccucacccuccagucccagcccaaggagccccagcucaccugcgacuccgcccagaagugccacuccaucggcgagaccgaccucauccgcucccuccgccgccgcgccguccucaucccccucggcgcccaccucuucuccaccgacaccuuccucuucuccaagcccgucgucaucccccagcucaagggcggcggcgagaccuggcccaacaaccgcggcguccuccgcgacgaggucaccaagaccgaggaccgcgagcucguccuccgcaaggacugccccaagaucgucgagccccacggcaagauguucaacgagcagaccugggaggucucccagcaggaccccucccacggcgaggucggcgagcacaaggaccgcaucgagcgccaguggggcaaccuccucggcgagggccagcacaagugcgacgagugcggcaaguccuucacccaguccuccggccucauccgccaccagcgcauccacaccggcgagcgccccuacgagugcaacgagugcggcaaggccuucucccgcuccuccggccucuucaaccaccgcggcauccacaacauccagaagcgcuaccacugcaaggagugcggcaaggucuucucccaguccgccggccucauccagcaccagcgcauccacaagggcgagaagcccuaccagugcucccagugcuccaaguccuacucccgccgcuccuuccucaucgagcaccagcgcucccacaccggcgagcgcccccaccagugcaucgagugcggcaaguccuucaaccgccacugcaaccucauccgccaccagaagauccacaccgucgccgagcucgucuga

SEQ ID NO: 52221 - RNA, 1902 nt, Artificial Sequence
  derived and/or modified sequence opt2 from ZSWIM2__Homo_sapiens__NP_872327
augcuccgccgcggcuacaaggccuccgagcgccgccgccaccucuccgagcgccucuccuggcaccaggaccaggcccucuccuccuccaucuaccuccuccgcgagaugggccccaccggcuuccuccuccgcgaggaggagcccgaguacauggacuuccgcgucuuccucggcaacccccacgucugcaacugcuccaccuuccccaagggcggcgagcucugcaagcacaucugcuggguccuccucaagaaguucaagcucccccgcaaccacgaguccgcccuccagcucggccucggcgagcgcgagaucuccgaccuccuccgcggcauccaccgcguccagaccccccagcccggcaccaacgacgagaacgagcacgucgaggaggacggcuacaucaagcagaaggagaucgacuccgaggacaucugcuccaucugccaggagcuccuccucgagaagaagcuccccgucaccuucugccgcuucggcugcggcaacuccauccacaucaagugcaugaagauccucgccaacuaccaguccaccuccaacaccuccaugcucaagugcccccucugccgcaaggaguucgccccccucaagcucauccucgaggaguucaagaacuccuccaagcucgucgccgccgccgagaaggagcgccucgacaagcaccucggcauccccugcaacaacugcaagcaguuccccaucgagggcaagugcuacaagugcaccgagugcaucgaguaccaccucugccaggagugcuucgacuccugcugccaccucucccacaccuucaccuuccgcgagaagcgcaaccagaaguggcgcucccucgagaagcgcgccgacgaggucgucaaguacaucgacaccaagaacgagaucgaggagaagaugucccacuuccaggagaagcagggccaggucuacacccccaagcacaucguccgcucccucccccuccagcucaucaccaagaacuccaagcuccucgcccccggcuaccagugccuccucugccucaaggccuuccaccucggccagcacacccgccuccuccccugcacccacaaguuccaccgcaagugcaucgacaacuggcucuuccacaagugcaacuccugccccaucgacggccaggucaucuacaacccccucaccuggaagaacuccgccgucaacggccaggcccaccaguccgucuccaaccgcgacaucauccaccucuccaagcagaaggagcccgaccucuucauccccggcaccggccucguccucaagcagaaccgccucggcauccuccccuccaucccccagugcaacuucgacgagcucaacaccccccagucccccaaggacgccuacgagaacaccaccaucgacaaccucugcuccaucaagcucgacaacuccaacuccaagaagcucaccuacgacuacaagaucucccagcacuucccccgcuaccuccaggaccuccccaccgucuccuucggcaagauccccucccagacccuccucccccccaucguccacaagaacaucgucugccccaccgccauggagucccccugcaucuccggcaaguuccacaccucccucucccgcaugaccaagggcugcaagugcaacaaccacaaccucaagaagacccccgccaccaagauccgcgaggacaacaagcgcuccacccuccuccccgaggacuucaaccucaucgucaacugguccaccgccaagcucucccucuccaagcgcuacuccaacugcaugggcgagaucacccgcaagugcucccaccucucccgccagcccgucucccacuccgucaacaccaaguccaccgagcucucccucaucaucgagggcguccagcucuga

SEQ ID NO: 52222 - RNA, 3648 nt, Artificial Sequence
  derived and/or modified sequence opt2 from ZSWIM6__Homo_sapiens__NP_065979
auggccgagcgcggccagcagcccccccccgccaagcgccucugcugccgccccggcggcggcggcggcggcggcggcuccuccggcggcggcggcggcgccggcggcggcuacuccuccgccugccgccccggcccccgcgccggcggcgccgccgccgccgccgccugcggcggcggcgccgcccucggccuccucccccccggcaagacccagucccccgagucccuccucgacaucgccgcccgccgcgucgccgagaaguggcccuuccagcgcgucgaggagcgcuucgagcgcauccccgagcccguccagcgccgcaucgucuacugguccuucccccgcuccgagcgcgagaucugcauguacuccuccuucaacaccggcggcggcgccgccggcggccccggcgacgacuccggcggcggcggcggcgccggcggcggcggcggcggcggcuccuccuccucccccgccgccaccuccgccgccgccaccuccgccgccgccgccgccgccgccgccgccgccgccgccgccgccgccgccggcgccggcgcccccuccgucggcgccgccggcgccgccgacggcggcgacgagacccgccuccccuuccgccgcggcaucgcccuccucgaguccggcugcgucgacaacguccuccaggucggcuuccaccucuccggcaccgucaccgagcccgccauccaguccgagcccgagaccgucugcaacgucgccaucuccuucgaccgcugcaagaucaccuccgucaccugcuccugcggcaacaaggacaucuucuacugcgcccacgucgucgcccucucccucuaccgcauccgcaagcccgaccaggucaagcuccaccuccccaucuccgagacccucuuccagaugaaccgcgaccagcuccagaaguucguccaguaccucaucaccguccaccacaccgagguccuccccaccgcccagaagcucgccgacgagauccucucccagaacuccgagaucaaccagguccacggcgcccccgaccccaccgccggcgccuccaucgacgacgagaacugcuggcaccucgacgaggagcagguccaggagcaggucaagcucuuccucucccagggcggcuaccacggcuccggcaagcagcucaaccuccucuucgccaagguccgcgagaugcucaagaugcgcgacuccaacggcgcccgcaugcucacccucaucaccgagcaguucauggccgacccccgccucucccucuggcgccagcagggcaccgccaugaccgacaaguaccgccagcucugggacgagcucggcgcccucuggaugugcaucguccucaacccccacugcaagcucgagcagaaggccuccuggcucaagcagcucaagaaguggaacuccgucgacgucugccccugggaggacggcaaccacggcuccgagcuccccaaccucaccaacgcccucccccagggcgccaacgccaaccaggacuccuccaaccgcccccaccgcaccgucuucacccgcgccaucgaggccugcgaccuccacuggcaggacucccaccuccagcacaucaucuccuccgaccucuacaccaacuacugcuaccacgacgacaccgagaacucccucuucgacucccgcggcuggccccucuggcacgagcacguccccaccgccugcgcccgcgucgacgcccuccgcucccacggcuacccccgcgaggcccuccgccucgccaucgccaucgucaacacccuccgccgccagcagcagaagcagcucgagauguuccgcacccagaagaaggagcucccccacaagaacaucaccuccaucaccaaccucgagggcugggucggccacccccucgaccccgucggcacccucuucuccucccucauggaggccugccgcaucgacgacgagaaccucuccggcuucuccgacuucaccgagaacaugggccagugcaagucccucgaguaccagcaccuccccgcccacaaguuccucgaggagggcgaguccuaccucacccucgccgucgaggucgcccucaucggccucggccagcagcgcaucaugcccgacggccucuacacccaggagaaggucugccgcaacgaggagcagcucaucuccaagcuccaggagaucgagcucgacgacacccucgucaagaucuuccgcaagcaggccgucuuccuccucgaggccggccccuacuccggccucggcgagaucauccaccgcgaguccguccccaugcacaccuucgccaaguaccucuucaccucccuccucccccacgacgccgagcucgccuacaagaucgcccuccgcgccaugcgccuccucguccucgaguccaccgcccccuccggcgaccucacccgcccccaccacaucgccuccgucguccccaaccgcuacccccgcugguucacccucucccacaucgagucccagcagugcgagcucgccuccaccaugcucaccgccgccaagggcgacguccgccgccucgagaccguccucgaguccauccagaagaacauccacuccuccucccacaucuucaagcucgcccaggacgccuucaagaucgccacccucauggacucccuccccgacaucacccuccucaaggucucccucgagcucggccuccaggucaugcgcaugacccucuccacccucaacuggcgccgccgcgagaugguccgcuggcucgucaccugcgccaccgaggucggcgucuacgcccucgacuccaucaugcagaccugguucacccucuucacccccaccgaggccaccuccaucgucgccaccaccgucauguccaacuccaccaucguccgccuccaccucgacugccaccagcaggagaagcucgccuccuccgcccgcacccucgcccuccagugcgccaugaaggacccccagaacugcgcccucuccgcccucacccucugcgagaaggaccacaucgccuucgagaccgccuaccagaucguccucgacgccgccaccaccggcauguccuacacccagcucuucaccaucgcccgcuacauggagcaccgcggcuaccccaugcgcgccuacaagcucgccacccucgccaugacccaccucaaccucuccuacaaccaggacacccaccccgccaucaacgacguccucugggccugcgcccucucccacucccucggcaagaacgagcucgccgccaucaucccccucgucgucaaguccgucaagugcgccaccguccucuccgacauccuccgccgcugcacccucaccacccccggcauggucggccuccacggccgccgcaacuccggcaagcucaugucccucgacaaggccccccuccgccagcuccucgacgccaccaucggcgccuacaucaacaccacccacucccgccucacccacaucuccccccgccacuacuccgaguucaucgaguuccucuccaaggcccgcgagaccuuccucauggcccacgacggccacauccaguucacccaguucaucgacaaccucaagcagaucuacaagggcaagaagaagcucaugaugcucguccgcgagcgcuucggcuga

SEQ ID NO: 52223 - RNA, 2340 nt, Artificial Sequence
  derived and/or modified sequence opt2 from ZW10__Homo_sapiens__NP_004715
auggccuccuucgucaccgagguccucgcccacuccggccgccucgagaaggaggaccucggcacccgcaucucccgccucacccgccgcgucgaggagaucaagggcgaggucugcaacaugaucuccaagaaguacuccgaguuccuccccuccaugcaguccgcccagggccucaucacccaggucgacaagcucuccgaggacaucgaccuccucaagucccgcaucgaguccgagguccgccgcgaccuccacgucuccaccggcgaguucaccgaccucaagcagcagcucgagcgcgacuccgucguccucucccuccucaagcagcuccaggaguucuccaccgccaucgaggaguacaacugcgcccucaccgagaagaaguacgucaccggcgcccagcgccucgaggaggcccagaagugccucaagcuccucaagucccgcaagugcuucgaccucaagauccucaagucccucuccauggagcucaccauccagaagcagaacauccucuaccaccucggcgaggaguggcagaagcucaucgucuggaaguucccccccuccaaggacaccuccucccucgaguccuaccuccagaccgagcuccaccucuacaccgagcagucccacaaggaggagaagacccccaugccccccaucuccuccguccuccucgccuucuccguccucggcgagcuccacuccaagcucaaguccuucggccagaugcuccucaaguacauccuccgcccccucgccuccugccccucccuccacgccgucaucgagucccagcccaacaucgucaucauccgcuucgaguccaucaugaccaaccucgaguaccccucccccuccgaggucuucaccaagauccgccucguccucgagguccuccagaagcagcuccucgaccucccccucgacaccgaccucgagaacgagaagaccuccaccgucccccucgccgagaugcucggcgacaugaucugggaggaccucuccgagugccucaucaagaacugccucgucuacuccauccccaccaacuccuccaagcuccagcaguacgaggagaucauccaguccaccgaggaguucgagaacgcccucaaggagaugcgcuuccucaagggcgacaccaccgaccuccucaaguacgcccgcaacaucaacucccacuucgccaacaagaagugccaggacgucaucgucgccgcccgcaaccucaugaccuccgagauccacaacaccgucaagaucauccccgacuccaagaucaacguccccgagcuccccacccccgacgaggacaacaagcucgagguccagaaggucuccaacacccaguaccacgaggucaugaaccucgagcccgagaacacccucgaccagcacuccuucucccuccccaccugccgcaucuccgaguccgucaagaagcucauggagcucgccuaccagacccuccucgaggccaccaccuccuccgaccagugcgccguccagcucuucuacuccguccgcaacaucuuccaccucuuccacgacgucguccccaccuaccacaaggagaaccuccagaagcucccccagcucgccgccauccaccacaacaacugcauguacaucgcccaccaccuccucacccucggccaccaguuccgccuccgccucgcccccauccucugcgacggcaccgccaccuucgucgaccucguccccggcuuccgccgccucggcaccgagugcuuccucgcccagaugcgcgcccagaagggcgagcuccucgagcgccucuccuccgcccgcaacuucuccaacauggacgacgaggagaacuacuccgccgccuccaaggccguccgccagguccuccaccagcucaagcgccucggcaucgucuggcaggacguccuccccgucaacaucuacugcaaggccaugggcacccuccucaacaccgccaucuccgaggucaucggcaagaucaccgcccucgaggacaucuccaccgaggacggcgaccgccucuacucccucugcaagaccgucauggacgagggcccccaggucuucgccccccucuccgaggaguccaagaacaagaaguaccaggaggagguccccgucuacguccccaaguggaugcccuucaaggagcucaugaugaugcuccaggccucccuccaggagaucggcgaccgcugggccgacggcaagggcccccucgccgccgccuucuccuccuccgaggucaaggcccucauccgcgcccucuuccagaacaccgagcgccgcgccgccgcccucgccaagaucaaguga

SEQ ID NO: 52224 - RNA, 1434 nt, Artificial Sequence
  derived and/or modified sequence opt2 from ZWILCH__Homo_sapiens__NP_001274752
auggcccacaaccccaacaugacccaccucaagaucaaccuccccgucaccgcccuccccccccucuggguccgcugcgacuccuccgaccccgagggcaccugcuggcucggcgccgagcucaucaccaccaacaacuccaucaccggcaucguccucuacgucgucuccugcaaggccgacaagaacuacuccgucaaccucgagaaccucaagaaccuccacaagaagcgccaccaccucuccaccgucaccuccaagggcuucgcccaguacgagcucuucaaguccuccgcccucgacgacaccaucaccgccucccagaccgccaucgcccucgacaucuccuggucccccgucgacgagauccuccagauccccccccucuccuccaccgccacccucaacaucaaggucgaguccggcgagccccgcggcccccucaaccaccucuaccgcgagcucaaguuccuccucguccucgccgacggccuccgcaccggcgucaccgaguggcucgagccccucgaggccaaguccgccgucgagcucguccaggaguuccucaacgaccucaacaagcucgacggcuucggcgacuccaccaagaaggacaccgaggucgagacccucaagcacgacaccgccgccgucgaccgcuccgucaagcgccucuucaagguccgcuccgaccucgacuucgccgagcagcucuggugcaagauguccuccuccgucaucuccuaccaggaccucgucaagugcuucacccucaucauccagucccuccagcgcggcgacauccagcccuggcuccacuccggcuccaacucccuccucuccaagcucauccaccaguccuaccacggcaccauggacaccgucucccucuccggcaccauccccguccagaugcuccucgagaucggccucgacaagcucaagaaggacuacaucuccuucuucaucggccaggagcucgccucccucaaccaccucgaguacuucaucgcccccuccgucgacauccaggagcaggucuaccgcguccagaagcuccaccacauccucgagauccucgucuccugcaugcccuucaucaagucccagcacgagcuccucuucucccucacccagaucugcaucaaguacuacaagcagaacccccucgacgagcagcacaucuuccagcuccccguccgccccaccgccgucaagaaccucuaccaguccgagaagccccagaaguggcgcgucgagaucuacuccggccagaagaagaucaagaccgucuggcagcucuccgacuccucccccaucgaccaccucaacuuccacaagcccgacuucuccgagcucacccucaacggcucccucgaggagcgcaucuucuucaccaacauggucaccugcucccagguccacuucaaguga

SEQ ID NO: 52225 - RNA, 693 nt, Artificial Sequence
  derived and/or modified sequence opt2 from ZWINT__Homo_sapiens__NP_001005413
auggaggccgccgagaccgaggccgaggccgccgcccucgagguccucgccgaggucgccggcauccucgagcccgucggccuccaggaggaggccgagcuccccgccaagauccucgucgaguucgucgucgacucccagaagaaggacaagcuccucugcucccagcuccaggucgccgacuuccuccagaacauccucgcccaggaggacaccgccaagggccucgacccccucgccuccgaggacaccucccgccagaaggccaucgccgccaaggagcaguggaaggagcucaaggccaccuaccgcgagcacgucgaggccaucaagaucggccucaccaaggcccucacccagauggaggaggcccagcgcaagcgcacccagcuccgcgaggccuucgagcagcuccaggccaagaagcagauggccauggagaagcgccgcgccguccagaaccaguggcagcuccagcaggagaagcaccuccagcaccucgccgaggucuccgccgagggcaagcuccucuuccccgaggccgaggccgaggccgagaaccuccccgacgacaagccccagcagcccacccgcccccaggagcaguccaccggcgacaccaugggccgcgaccccggcgucuccuucaaggccgucggccuccagcccgccggcgacgucaaccuccccuga

SEQ ID NO: 52226 - RNA, 1719 nt, Artificial Sequence
  derived and/or modified sequence opt2 from ZYX__Homo_sapiens__NP_001010972
auggccgccccccgccccucccccgccaucuccgucuccgucuccgcccccgccuucuacgccccccagaagaaguucggccccgucgucgcccccaagcccaaggucaaccccuuccgccccggcgacuccgagcccccccccgcccccggcgcccagcgcgcccagaugggccgcgucggcgagauccccccccccccccccgaggacuucccccuccccccccccccccucgccggcgacggcgacgacgccgagggcgcccucggcggcgccuucccccccccccccccccccaucgaggaguccuucccccccgccccccucgaggaggagaucuuccccucccccccccccccccccgaggaggagggcggccccgaggcccccauccccccccccccccagccccgcgagaaggucuccuccaucgaccucgagaucgacucccucuccucccuccucgacgacaugaccaagaacgaccccuucaaggcccgcgucuccuccggcuacguccccccccccgucgccacccccuucuccuccaaguccuccaccaagcccgccgccggcggcaccgccccccucccccccuggaagucccccuccuccucccagccccucccccagguccccgcccccgcccagucccagacccaguuccacguccagccccagccccagcccaagccccagguccagcuccacguccagucccagacccagcccgucucccucgccaacacccagccccgcggcccccccgccuccucccccgcccccgcccccaaguucucccccgucacccccaaguucacccccgucgccuccaaguucucccccggcgcccccggcggcuccggcucccagcccaaccagaagcucggccaccccgaggcccucuccgccggcaccggcuccccccagccccccuccuucaccuacgcccagcagcgcgagaagccccgcguccaggagaagcagcaccccguccccccccccgcccagaaccagaaccagguccgcucccccggcgcccccggcccccucacccucaaggaggucgaggagcucgagcagcucacccagcagcucaugcaggacauggagcacccccagcgccagaacgucgccgucaacgagcucugcggccgcugccaccagccccucgcccgcgcccagcccgccguccgcgcccucggccagcucuuccacaucgccugcuucaccugccaccagugcgcccagcagcuccagggccagcaguucuacucccucgagggcgcccccuacugcgagggcugcuacaccgacacccucgagaagugcaacaccugcggcgagcccaucaccgaccgcaugcuccgcgccaccggcaaggccuaccacccccacugcuucaccugcgucgucugcgcccgcccccucgagggcaccuccuucaucgucgaccaggccaaccgcccccacugcguccccgacuaccacaagcaguacgccccccgcugcuccgucugcuccgagcccaucaugcccgagcccggccgcgacgagaccguccgcgucgucgcccucgacaagaacuuccacaugaagugcuacaagugcgaggacugcggcaagccccucuccaucgaggccgacgacaacggcugcuucccccucgacggccacguccucugccgcaagugccacaccgcccgcgcccagaccuga

SEQ ID NO: 52227 - RNA, 8886 nt, Artificial Sequence
  derived and/or modified sequence opt2 from ZZEF1__Homo_sapiens__NP_055928
augggcaacgcccccucccacuccuccgaggacgaggccgccgccgccggcggcgagggcuggggcccccaccaggacugggccgccgucuccggcaccacccccggccccggcgucgccgcccccgcccucccccccgccgccgcccuccucgagcccgcccgccuccgcgaggccgccgccgcccuccuccccaccccccccugcgagucccucgucucccgccaccgcggcgcccucuuccgcuggcucgaggagcgccucggccgcggcgaggaguccgucacccucgagcaguuccgcgagcuccucgaggcccgcggcgccggcugcuccuccgagcaguucgaggaggccuucgcccaguucgacgccgagggcgacggcaccgucgacgccgagaacaugcucgaggcccucaagaacuccuccggcgccaaccuccagggcgagcucucccacaucauccgccagcuccaggccugcucccucguccccggcuucaccgacaucuucuccgaguccaaggagggccucgacauccacuccuccaugauccuccgcuuccuccaccgcaaccgccucuccuccgccgucaugcccuaccccaugcucgagcacugcaacaacaugugcaccaugcgcuccuccguccucaaggagucccucgaccagcucguccagaaggagaaggagucccccggcgaccucacccgcucccccgagauggacaagcucaaguccgucgccaagugcuacgccuacaucgagaccuccuccaacuccgccgacaucgacaagaugaccaacggcgagaccuccuccuacuggcaguccgacggcuccgccugcucccacuggauccgccucaagaugaagcccgacgucguccuccgccaccucuccaucgccgucgccgccaccgaccaguccuacaugccccagcaggucaccgucgccgucggccgcaacgccuccgaccuccaggagguccgcgacguccacauccccuccaacgucaccggcuacgucacccuccucgagaacgccaacgucucccagcucuacguccagaucaacaucaagcgcugccucuccgacggcugcgacacccgcauccacggccuccgcgccgucggcuuccagcgcgucaagaaguccggcgucuccgucuccgacgccuccgccaucugguacuggucccuccucaccucccucgucaccgccuccauggagaccaaccccgccuucguccagaccguccuccacaacacccagaaggcccuccgccacaugcccccccucucccucucccccggcuccaccgacuucuccaccuuccucucccccaacguccucgaggaggucgacuccuuccucauccgcaucaccuccugcugcuccacccccgaggucgagcucacccuccucgccuucgcccucgcccgcggcuccgucgccaaggucauguccucccucugcaccaucaccgaccaccucgacacccaguacgacgccuccucccucauccucuccauggccuccguccgccagaaccuccuccucaaguacggcaagccccuccagcucacccuccaggccugcgacgucaagggcaaggaggacaaguccggccccgagaaccuccucgucgagcccuggacccgcgacggcuuccucaccgagaccggcaagacccgcgccuccaccaucuucuccaccggcaccgaguccgccuuccaggucacccagauccgcaucaugguccgccgcggcggcaucggcgcccagugcggccucgucuucgccuacaacuccuccuccgacaaguucugcgccgaggagcacuucaagcgcuucgagaaguacgacaaguggaagcuccaggagcuccgccaguucgucaagucccgcaucggcugcuccuccgacgaccucggcgaggacgaccccaucggcugguucgagcucgaggaggagugggacgaggccgacgucaagcuccagcagugccgcgucgccaaguaccucauggucaaguuccucugcacccgccaggaguccgccgagcgccucggcguccagggccucaccaucuccggcuaccuccgccccgcccgcgccgaggccgagcaguccgucaccugcgcccacugccgcaaggacaccgaggaguccgucugcggcgccacccuccuccuccgcacccuccaguucauccagcagcucgcccacgaccucguccagcagaaggaguccggccucaaguacaaguccuuccucgacuucgccggccucgaccuccagaucuucuggaacuucuacuccaagcucaagcagaacccccgcgaggagugcgucuccgcccagacccuccuccuccagcuccuccaguccugcuucuccguccuccagggcgacguccucgccgccuccgaggaggagaaggcccccauccagucccccaagggcgucgaggccgccaaggagcucuacacccaccucugcgacgucgucgacaaggucgacggcgacuccguccccauggagauccucaagcaggagguccgcaacacccuccucaacggcgccgccaucuucuuccccaaccgccagacccgccgcaaccaccucuucaccaugaugaacgucaccgagcaggagcacaagcagucccuccagcucaccuuccgcucccucugcaccuacuucuccgacaaggaccccggcggccuccuccuccuccccgagaagaacgaccucgccaagaugaacaucuccgagguccucgccgucauggacacccucgucuccgucgccgcccgcgagugcgagcuccucaugcucuccggcgcccccggcgaggucggcuccguccucuucucccucuucugguccguccagggcucccuccucuccuggugcuaccuccagcucaaguccaccgacuccggcgccaaggaccucgccgucgaccucaucgagaaguacgucggccaguuccucgccuccaugcgcgccauccucgagucccucuucucccaguacuccggcaagaccaucgucgagcgccucugcaacuccgucuucuccauggccgcccgccagcucgucaucuuccuccucgacuucugcacccucgacaucccccacugcguccuccuccgcgaguucuccguccucaccgagcuccucaagaagcucugcuccggccccgagggcggccuccgcaagcucgacgucgagaccuggcagcaggagcagcccgucguccuccacaccuggaccaaggaguccgcccacaacuacgagaacaacugccacgaggucuccgucuucgucucccccggcgccaccuacuucgaggucgaguucgacgaccgcugcgagaccgagaagcgcuacgacuaccucgaguucaccgacgcccgcggccgcaagacccgcuacgacaccaaggucggcaccgacaaguggcccaagaaggucaccuucaaggccggcccccgccuccaguuccucuuccacuccgacuccucccacaacgaguggggcuacaaguucaccgucaccgccugcggccuccccgacgucgccgucuccuggggccucgaccuccagcuccucgucucccgccucaugggccgccucgccucccagugcauggcccucaaguccguccgccagcucggcuccaacauggucgucccccaggccaagauggcccucguccucuccuccccccucuggaagcccgucuuccgccaccaggucugccccgagcucgagcucgaggccuccuggcccacccacccccaccgcaacuccaaggaggucaagaacauccccgacgaccccugccgccacuuccuccucgacuucgcccaguccgagcccgcccagaacuucugcggccccuacuccgagcucuucaagggcuucauccaggccugccgcaagcaggcccccaagaccgacaucgucgccggcuccaccaucgaccaggccgucaacgccaccuucgccgcccucgucuaccgcacccccgaccucuacgagaagcuccagaaguacgucaacuccggcggcaagaucgcccucuccgaggaguucgcccaggucuacucccucgccgacggcauccgcaucuggaugcucgagaugaagcagaagucccucaugucccucggcaacgaggccgaggagaagcacuccuccgaggccaccgaggucaaccccgagucccucgccaaggagugcaucgagaagucccuccuccuccucaaguuccuccccaccggcaucuccuccaaggaguccugcgagaagcucgagaccgccgacgagaccucccaccuccagccccucaacaagcgccagcgcaccuccuccgucgucgaggagcacuuccaggccuccgucucccccaccgaggccgccccccccgccaccggcgaccagucccccggccucggcacccagcccaagcuccccuccuccuccggccuccccgccgccgacgucucccccgccaccgccgaggagccccucucccccuccacccccacccgccgcccccccuucacccgcggccgccuccgccuccucuccuuccgcuccauggaggaggcccgccucguccccaccgucaaggagaaguaccccguccucaaggacgucauggacuucaucaaggaccagucccucucccaccgcuccgucgucaagguccucucccuccgcaaggcccaggcccaguccauccucgagguccucaagaucacccagcacugcgccgagucccucggccagccccacugcuuccacccccccuucauccucuuccuccucgagcuccucaccugccagaaggacuucaccaacuacuucggccaccucgagggcugcggcgccgaccuccacaaggagauccgcgacaccuacuaccagcucguccucuuccucgucaaggccgucaagggcuucuccucccucaacgaccgcucccuccuccccgcccucuccugcguccagaccgcccuccuccaccuccucgacaugggcugggagcccaacgaccucgccuucuucgucgacauccagcuccccgaccuccucaugaagaugucccaggagaacaucuccguccacgacuccgucaucucccagugguccgaggaggacgagcucgccgacgccaagcagaacuccgaguggauggacgagugccaggacggcauguucgaggccugguacgagaagaucgcccaggaggaccccgagaagcagcgcaagaugcacauguucaucgcccgcuacugcgaccuccucaacgucgacaucuccugcgacggcugcgacgagaucgcccccuggcaccgcuaccgcugccuccagugcuccgacauggaccucugcaagaccugcuuccucggcggcgucaagcccgagggccacggcgacgaccacgagauggucaacauggaguucaccugcgaccacugccagggccucaucaucggccgccgcaugaacugcaacgucugcgacgacuucgaccucugcuacggcugcuacgccgccaagaaguacuccuacggccaccuccccacccacuccaucaccgcccaccccauggucaccauccgcaucuccgaccgccagcgccucauccagcccuacauccacaacuacuccuggcuccucuucgccgcccucgcccucuacuccgcccaccucgccuccgccgaggacgucgacggcgagaagcucgacccccagacccgcuccuccgccaccacccuccgcucccagugcaugcagcucgucggcgacugccucaugaaggcccaccagggcaagggccucaaggcccucgcccuccucggcguccuccccgacggcgacuccucccucgaggaccaggcccuccccgucaccguccccaccggcgccuccgaggagcagcucgagaagaaggccguccagggcgccgagcucuccgaggccggcaacggcaagcgcgccguccacgaggagauccgccccgucgacuucaagcagcgcaacaaggccgacaagggcgucucccucuccaaggaccccuccugccagacccagaucuccgacucccccgccgacgccuccccccccaccggccuccccgacgccgaggacuccgaggucuccucccagaagcccaucgaggagaaggccgucacccccucccccgagcaggucuucgccgagugcucccagaagcgcauccucggccuccucgccgccaugcuccccccccucaaguccggccccaccgucccccucaucgaccucgagcacguccucccccucauguuccaggucgucaucuccaacgccggccaccucaacgagaccuaccaccucacccucggccuccucggccagcucaucauccgccuccuccccgccgaggucgacgccgccgucaucaagguccucuccgccaagcacaaccucuucgccgccggcgacuccuccaucguccccgacggcuggaagaccacccaccuccucuucucccucggcgccgucugccucgacucccgcgucggccucgacugggccugcuccauggccgagauccuccgcucccucaacuccgccccccucuggcgcgacgucaucgccaccuucaccgaccacugcaucaagcagcuccccuuccagcucaagcacaccaacaucuucacccuccucguccucgucggcuucccccagguccucugcgucggcacccgcugcgucuacauggacaacgccaacgagccccacaacgucaucauccucaagcacuucaccgagaagaaccgcgccgucaucgucgacgucaagacccgcaagcgcaagaccgucaaggacuaccagcucguccagaagggcggcggccaggagugcggcgacucccgcgcccagcucucccaguacucccagcacuucgccuucaucgccucccaccuccuccaguccuccauggacucccacugccccgaggccgucgaggccaccuggguccucucccucgcccucaagggccucuacaagacccucaaggcccacggcuucgaggagauccgcgccaccuuccuccagaccgaccuccucaagcuccucgucaagaagugcuccaagggcaccggcuucuccaagaccuggcuccuccgcgaccucgagauccucuccaucaugcucuacuccuccaagaaggagaucaacgcccucgccgagcacggcgaccucgagcucgacgagcgcggcgaccgcgaggaggaggucgagcgccccgucuccucccccggcgaccccgagcagaagaagcucgacccccucgagggccucgacgagcccacccgcaucugcuuccucauggcccacgacgcccucaacgccccccuccacauccuccgcgccaucuacgagcuccagaugaagaagaccgacuacuucuuccucgagguccagaagcgcuucgacggcgacgagcucaccaccgacgagcgcauccgcucccucgcccagcgcuggcagcccuccaagucccuccgccucgaggagcaguccgccaaggccgucgacaccgacaugaucauccuccccugccucucccgccccgcccgcugcgaccaggccaccgccgaguccaaccccgucacccagaagcucaucuccuccaccgaguccgagcuccagcaguccuacgccaagcagcgccgcuccaaguccgccgcccuccuccacaaggagcucaacugcaaguccaagcgcgccguccgcgacuaccucuuccgcgucaacgaggccaccgccguccucuacgcccgccacguccucgccucccuccucgccgaguggcccucccacguccccgucuccgaggacauccucgagcucuccggccccgcccacaugaccuacauccucgacauguucaugcagcucgaggagaagcacgagugggagaagauccuccagaagguccuccagggcugccgcgaggacaugcucggcaccauggcccucgccgccugccaguucauggaggagcccggcauggagguccagguccgcgaguccaagcaccccuacaacaacaacaccaacuucgaggacaagguccacauccccggcgccaucuaccucuccaucaaguucgacucccagugcaacaccgaggagggcugcgacgagcucgccauguccuccuccuccgacuuccagcaggaccgccacuccuucuccggcucccagcagaaguggaaggacuucgagcuccccggcgacacccucuacuaccgcuucaccuccgacauguccaacaccgaguggggcuaccgcuucaccgucaccgccggccaccucggccgcuuccagaccggcuucgagauccucaagcagaugcucuccgaggagcgcgucgucccccaccucccccucgccaagaucugggaguggcucgucggcgucgccugccgccagaccggccaccagcgccucaaggccauccaccuccuccuccgcaucguccgcugcugcggccacuccgaccucugcgaccucgcccuccucaagccccucuggcagcucuucacccacauggaguacggccucuucgaggacgucacccagcccggcauccuccucccccuccaccgcgcccucaccgagcucuucuucgucaccgagaaccgcgcccaggagcucggcguccuccaggacuaccuccucgcccucaccaccgacgaccaccuccuccgcugcgccgcccaggcccuccagaacaucgccgccaucucccucgccaucaacuaccccaacaaggccacccgccucuggaacgucgagugcuga

SEQ ID NO: 52228 - RNA, 1515 nt, Artificial Sequence
  derived and/or modified sequence opt2 from ZZZ3__Homo_sapiens__XP_011539507
auggccgccucccgcuccacccgcgucacccgcuccaccgucggccucaacggccucgacgaguccuucugcggccgcacccuccgcaaccgcuccaucgcccaccccgaggagaucuccuccaacucccagguccgcucccgcucccccaagaagcgccccgagcccguccccauccagaagggcaacaacaacggccgcaccaccgaccucaagcagcaguccacccgcgaguccugggucuccccccgcaagcgcggccucuccuccuccgagaaggacaacaucgagcgccaggccaucgagaacugcgagcgccgccagaccgagcccgucucccccguccucaagcgcaucaagcgcugccuccgcuccgaggcccccaacuccuccgaggaggacucccccaucaaguccgacaaggaguccgucgagcagcgcuccaccgucgucgacaacgacgccgacuuccagggcaccaagcgcgccugccgcugccucauccucgacgacugcgagaagcgcgagaucaagaaggucaacgucuccgaggagggcccccucaacuccgccgucgucgaggagaucaccggcuaccucgccgucaacggcgucgacgacuccgacuccgccgucaucaacugcgacgacugccagcccgacggcaacaccaagcagaacuccaucggcuccuacguccuccaggagaaguccgucgccgagaacggcgacaccgacacccagaccuccauguuccucgacucccgcaaggaggacuccuacaucgaccacaagguccccugcaccgacucccagguccaggucaagcucgaggaccacaagaucgucaccgccugccuccccgucgagcacgucaaccagcucaccaccgagcccgccaccggccccuucuccgagacccaguccucccuccgcgacuccgaggaggaggucgacgucgucggcgacuccuccgccuccaaggagcagugcaaggagaacaccaacaacgagcucgacaccucccucgaguccaugcccgccuccggcgagcccgagcccucccccguccucgacugcgucuccgcccagaugaugucccucuccgagccccaggagcaccgcuacacccuccgcaccuccccccgccgcgccgcccccacccgcggcucccccaccaagaacuccucccccuaccgcgagaacggccaguucgaggagaacaaccucucccccaacgagaccaacgccaccgucuccgacaacgucucccagucccccaccaaccccggcgagaucucccagaacgagaagggcaucugcugcgacucccagaacaacggcuccgagggcgucuccaagccccccuccgaggcccgccucaacaucggccaccuccccuccgccaaggaguccgccucccagcacaucaccgaggaggaggacgacgaccccgacgucuacuacuucgaguccgaccacgucgcccucaagcacaacaaggaguacgucuga

SEQ ID NO: 52229 - RNA, 1245 nt, Artificial Sequence
  derived and/or modified sequence opt3 from 37135__Homo_sapiens__NP_443070
augagccaccaugacgauggcgccaccguggggcugggaauccagaugugcgaggguuggagagucgaagcugcacucuccuuccuuccccaccaaaggaaguggggcgagacagccggggcgguuauggcuggaggcgugauggacaaagaauacguagguuuugccgcacugccuaaccaguugcaucggaagucugugaaaaagggguucgauuuuacuuuaauggucgccggagagucaggccugggcaaaaguacgcuaauuaauagccucuuccugaccaaccuuuaugaagaccgccaggugccagaggcuuccgcacgacugacacagacuuuggccauagagcguagagggguugaaaucgaggaaggaggugugaaggucaagcucacccugguggauacaccgggcuuuggggacucuguagauuguucggacugcuggcugcccguugugaaauucauugaggagcaauuugaacaguaccucagggaugagucaggauuaaaucggaagaacauccaggacagccgcguccacuguugccuguauuucauuaguccuuuuggcagaggucuuaggccauuggauguggcuuuccugcgggccgugcaugaaaaagucaauaucauacccguuaucgggaaggcggacgcacuaaugccucaggagacccaagcccucaaacagaagauucgcgaucagcugaaggaagaggagauccacauuuaccaguuuccagaaugugacuccgacgaggaugaagacuucaaacgacaagaugcugagaugaaggaaucuauccccuuugccgugguaggaagcugcgagguggucagagacggcggcaacaggccugugcgggggcgucgcuauuccuggggaacuguugagguggaaaauccacaccauugugauuuccuuaaccugagaaggauguugguccagacacaccuccaggaccugaaagaggugacccaugauuuacuguacgaagguuaucgggcacgaugccuccaaucacuugcucgcccgggcgccagagacagggcgagucggagcaagcugucucgccaguccgccacggagauacccuugccuaugcuaccacuggcagauacugaaaaacucauuagagagaaggacgaggaacugaggcguaugcaggagaugcuugagaaaaugcaggcucaaaugcagcagucacaggcccaaggggaacagagcgaugcucuguga

SEQ ID NO: 52230 - RNA, 1086 nt, Artificial Sequence
  derived and/or modified sequence opt3 from 37500__Homo_sapiens__NP_001008492
augagcaagcagcaacccacccaguucaucaacccugagacaccaggcuacgugggguuugccaaucugccgaaccagguccacagaaaauccguuaagaaaggauucgaauuuacucucauggugguaggugagucuggccuugggaagucaacgcugauuaauaguuuguucuuaaccgaccuguaucccgaaagggugauaccuggagcugcagagaaaaucgaacggacaguccagauugaggccagcacuguggagaucgaggaacgcggcguuaagcuacgacucaccguggucgauacaccagguuacggggacgcgauuaacugccgugauuguuuuaagaccaucauauccuauaucgacgaacaauucgagagauaccugcaugaugagucuggacuuaauaggcggcacauuaucgacaaccgcgugcauugcuguuuuuauuucauuucgcccuuuggccacggccugaaaccuuuggauguagcuuucaugaaggccauccauaauaaaguuaacauagugccagucauugcaaaggccgacacucucacacugaaagaaagagagaggcugaagaagcggauccucgaugaaauugaggaacacaauaucaaaaucuaccacuuacccgacgcugagucagaugaggacgaagauuuuaaggagcagacccgccugcuuaaagcaagcauuccuuucaguguggugggguccaaccaguugauagaagccaaggguaaaaagguccgaggaagacuguauccauggggcguuguggagguagaaaauccggagcauaacgacuuucuaaaacucaggacgaugcugaucacucacaugcaggaccuucaagaggugacccaggaucugcauuacgaaaauuuccggucugagcguuugaagcgcgggggaagaaaggucgaaaacgaggacaugaauaaagaucagauucuccuggaaaaggaggcugaguuaaggcggaugcaggaaaugaucgcccgaaugcaagcgcagaugcagaugcaaaugcagggcggugacggggauggaggcgcacugggccaccacguguga

SEQ ID NO: 52231 - RNA, 1053 nt, Artificial Sequence
  derived and/or modified sequence opt3 from 37865__Homo_sapiens__NP_061979
augagcaagggccugcccgagaccagaacagacgccgcuauguccgaacucgugccugagccaaggccgaaacccgcagucccuaugaagccaaugucuaucaacucaaaucuucugggguacauuggaauagauacuaucauugaacagaugcggaaaaagacgaugaaaaccgguuucgacuuuaacaucaugguugugggccaaaguggguugggaaagagcacauuaguaaauacucuguucaagucccaggugucucgcaaagccucgucauggaaccgagaggaaaagauucccaaaaccgucgagaucaaggcgauaggccacgugaucgaggaaggugggguuaaaaugaagcuaacagugauugauaccccuggauuuggcgaccagaucaauaacgagaauugcugggaaccaauugagaaguauaucaacgagcaguacgaaaaauuccucaaggaggaagucaauauagcucguaaaaagaggauucccgauacuagagugcauuguugccuguauuuuaucagcccuacaggccacagucuucggccacuggacuuggaguucaugaaacaucucuccaagguaguuaacauuaucccggugaucgccaaagcagauaccaugacgcuggaagagaagucugaguuuaagcaacgcgucagaaaagaacuggaggugaaugggauugaguucuacccccagaaggaauuugacgaagaucucgaggacaaaacugagaacgauaagauaaggcaggaaagcaugccuuucgccguggucggauccgacaaagaguaucagguuaaugguaagcggguguuaggccgcaagaccccaugggggaucauugaaguagagaaccugaaucacugugaauuugcucuuuugcgagauuucgugaucagaacacaucugcaagaccuaaaagaggucacucacaacauacacuacgagaccuauagggcaaagcggcucaacgacaauggaggccugcccccugugucaguugauacagaagagagucaugacagcaacccauga

SEQ ID NO: 52232 - RNA, 1413 nt, Artificial Sequence
  derived and/or modified sequence opt3 from 38231__Homo_sapiens__NP_001185642
augcccggcuucuacagcgugaugaccgacgaggaaaucaagagauuucuggaggauacaacugacgauggggaacucuccaaauucgucaaggacuuuucuggaaacgccucaugccacccuccagaggcuaaaacgugggcaaguaggccgcagguucccgaaccucggccacaagcccccgaucuuuaugacgaugaccuggaguuccgcccuccaagccgaccccaguccucugauaaucagcaguacuuuugugcgccugcuccauugucgccgucagcccgucccagaagcccuugggguaaguuagacccauaugauaguuccgaggacgauaaagaauacgugggcuucgcaacccugcccaaccaaguacauaggaagucugugaagaaaggguuugacuucacacuaauggucgccggagagagcggccucgguaaguccacucugguuaauucacuuuuucugaccgacuuguaucgggaucgcaaacuccugggggcugaagagagaauuaugcagacaguggagauaaccaagcacgcaguggacaucgaagagaaaggagucaggcugcggcucacuauuguggauacaccuggcuucggcgacgccguaaacaauaccgaaugcuggaagccaguugcugaguacaucgaucagcaguuugaacaauauuuccgcgacgagaguggguuaaaccgaaagaauauucaggauaacagagugcauuguugccuguacuuuaucagccccuucggacacggucuuaggccguuggacgucgaguucaugaaagcccugcaucagcgggugaauauagugccuauccuagcgaaggcagauacgcucacucccccagaagucgaccacaaaaagcguaaaauucgcgaggaaaucgagcacuuuggcauuaagaucuaccaguucccugauugugacucugacgaagaugaggacuuuaaacugcaagaucaggcccuuaaggaguccauacccuucgcuguuauugggucaaacaccgugguagaagccagaggaaggcgggugcgaggccgccuguauccaugggguaucgucgagguggaaaaucccgggcauugcgacuuuguuaaguugagaacaaugcucgugaggacucacaugcaggaucugaaagacgucacccgggagacacauuacgaaaacuaucgcgcacaauguauucagagcaugaccagauuagugguaaaggagaggaaucguaacaaacugacgcgggagaguggaacugauuucccuaucccagcuguuccgcccggcacagacccugaaaccgagaagcucauccgagaaaaagaugaggagcuuagaaggaugcaggaaaugcugcacaagauucagaagcaaaugaaagagaauuacuga

SEQ ID NO: 52233 - RNA, 1041 nt, Artificial Sequence
  derived and/or modified sequence opt3 from 38596__Homo_sapiens__NP_001009939
auggacagccuggccgcuccccaggauagacucguggagcaacuucuguccccuaggacccaggcacagcggcgcuugaaggacaucgauaaacaguacgucggcuucgccacauuaccaaaccaaguucaccgaaagucugugaaaaagggguuugacuucacucugaugguagcgggagaaucaggucuaggcaaaaguacgcucgugcauagccuguuucuuaccgaucuguauaaggaccguaaguugcucuccgcugaggaaagaauuucucagacagucgagauacugaaacacacuguggauaucgaagagaaggggguuaaacugaagcucaccauuguggacacaccgggauucggcgaugccgucaauaacaccgagugcuggaaacccaucacugacuacguggaucagcaguuugaacaauauuucagggacgagucggguuuaaaucggaagaacauucaggauaaucgcguacauuguugccuguacuuuaucucaccuuucgggcacggacuuagaccaguugacgugggcuuuaugaaggcauugcaugaaaaagucaacauagugccccugaucgccaaggcugacugucuagugccuagcgagauuaggaaacucaaggagcggauccgcgaagagauugauaaauucggcauccacgucuaucaguuuccagaaugcgacagugaugaggacgaagauuucaagcagcaagaccgagagcugaaagaguccgcacccuuugccguuauagggucuaauacagugguagaagcuaagggacagagagugaggggucggcuuuacccuuggggcauugucgagggggcccugcguuugcgcgaagcggcacagcacgcccauccacacgcuuaugccagaccgcaaggaagggaugugcggcgagcacuccgcgagcugcccagagcuuuacauccugccgacgaucagcagaccgacccaggccagccccacggugaaccucacccagaucccgcggccgcacauccggggaggcgggacuga

SEQ ID NO: 52234 - RNA, 1305 nt, Artificial Sequence
  derived and/or modified sequence opt3 from 38961__Homo_sapiens__NP_055944
auggcggcuaccgacaucgcaagacaggugggcgaggggugcaggacagucccccuggccggacacguugguuucgauagccucccugaccaacuugugaacaaguccguaucucagggcuuuuguuucaauauucugugcgugggggaaacuggauugggcaaaucaacguuaauggauacccuguuuaacacaaaguucgagggugaaccagcgacucauacccagccggggguccagcuacaaaguaauacauacgaccuccaggagagcaacgugcggcugaaacuuaccauaguuuccacugugggauuuggcgaucagaucaauaaggaagacucuuauaaacccauugucgaguucaucgaugcucaguuugaggccuaccugcaagaagaguugaagauucgccgagugcuccacacauaucaugacucgcguauccacguaugucuguacuucauagcaccuaccggccauucacucaagagccuggauuuaguuacgaugaaaaagcuggacaguaaagugaacaucauuccaaucauugccaaggcugaugcaaucuccaaaucugaacuuacuaaguuuaagauaaaaauuaccagcgaguuggucuccaauggggugcagaucuaucaguuccccacagacgaugagucaguggccgaaauuaacggaacuaugaaugcucaucugccuuuugccgucaucgguaguaccgaggaacuaaagaucggcaacaaaaugaugagagcgaggcaguacccaugggggacaguucaaguggagaaugaagcacacugcgacuucguaaagcuccgggagaugcugauucgcgugaacauggaggaccuuagagaacagacccacacgaggcacuaugagcuguaccggcgcuguaaauuggaagagaugggauuuaaggauacugaccccgauagcaaaccuuucucucuccaggaaacauacgaggccaagcgaaaugaguuccugggcgaauuacaaaagaaagaggaagagaugagacagauguuuguccagagggugaaggaaaaagaggcugagcugaaggaagccgagaaagaacuccaugagaaguucgaccggcuuaagaaacugcaccaggaugagaagaaaaaguuggaagacaaaaagaagucccuagaugacgagguuaacgcauuuaaacaacguaagaccgcugccgaacugcuccagucacaggguagccaggccgggggaagucaaacucugaaacgcgauaaggagaaaaagaauaacccauggcuuugcacagaauga

SEQ ID NO: 52235 - RNA, 1311 nt, Artificial Sequence
  derived and/or modified sequence opt3 from 39326__Homo_sapiens__NP_001011553
augagcguguccgccagaucugcugcagccgaggaaaggucagucaacaguagcaccauggcgcagcaaaagaaucuggagggcuacguuggguucgcuaaccuccccaaucagguguaucggaaauccguaaagcgcggauuugaguucacacuuaugguggucggugagucuggccuggggaaaucgacuuugaucaacucauuauuucugacggaccuauacagcccugaauauccaggaccgagucaccgaauuaagaaaaccgugcagguugagcaguccaaggugcucauaaaggagggcgguguccaacugcuucugacaaucguggauacucccggguucggagacgccguagauaauucuaacugcuggcagccuguuauugacuacaucgauagcaaauuugaagacuauuugaaugcagagucccgugugaacagaaggcagaugccagauaaucggguccaguguugccucuacuucauugcccccucaggccauggccugaagccucuggacaucgaauuuaugaaacgccuccacgagaaggugaacauaaucccauuaauugcuaaagcagauacccugacacccgaggaaugucaacaguucaagaagcagaucaugaaagagauucaggaacauaagaucaaaauauaugaguuuccugaaaccgacgaugaggaggaaaauaaacuugugaagaagauuaaagacagauugccacuggccgucguugggaguaacacuaucauugaggugaauggaaagaggguacggggucgccaauacccguggggcguggcugaagucgagaacggggaacacugcgauuucacaauccuacgaaauaugcucaucagaacccauaugcaggaccugaaggacgugacgaacaacguucacuacgagaauuauaggagccggaaacuugccgcggugacuuacaacggagucgauaauaacaagaauaaaggccagcugaccaagucucccuuggcacaaauggaggaagaacgucgcgaacacguggccaaaaugaagaagauggagauggaaauggagcagguauuugagaugaaaguuaaggaaaaagugcagaagcucaaagacuccgaggcugaacugcagagaaggcaugagcaaaugaagaagaacuuagaggcccagcacaaagaacuggaggaaaagcggcgacaguucgaggaugaaaaagcaaauugggaggcucagcaacgcauucucgagcagcagaacucaagcagaacacuugaaaagaauaaaaagaaggguaaaauauuuuga

SEQ ID NO: 52236 - RNA, 1761 nt, Artificial Sequence
  derived and/or modified sequence opt3 from 40057__Homo_sapiens__NP_001106963
augaagaaaagcuacuccggcgggaccagaacaucuucaggaaggcugcggcgccucggugacaguagcggccccgcccuuaagcgauccuucgagguggaagaggucgaaacuccuaacucuacgccaccgcguagaguucagacaccccuguugagggcuaccguggcaucgucaacucaaaaauuucaggauuuagggguaaagaauagcgagccuagugcccggcacguggacucccugucucagcgcagcccaaaagcgucccuaagaagggucgaacucucaggacccaaggcugccgagccugugagucggcgcaccgagcugagcaucgauauuucuuccaagcagguugaaaacgcaggcgccauagguccaucacgauucgggcuuaaaagagcugaggugcugggacauaagacacccgaaccugcaccaaggcggaccgagaucacuauugucaaaccgcaagagagcgcccaccgucgcauggaacccccugcuaguaaggugccagagguacccacagccccugcgaccgacgcagccccaaaaagaguugaaauccagaugcccaagccggcugaggccccuacggcacccucuccagcucagacuuuggaaaauuccgagccugcccccgugagccagcuccaaucgaggcuggagccaaagccccagccuccagucgcggaagccaccccgcggucucaggaggcaacagaagcugcccccuccugcgugggcgauauggcugacacuccucgagaugccggccugaaacaggcaccagccucacgcaacgagaaggcucccguggacuuuggguaugucggaauugauaguauccucgaacaaaugagaaggaaagcgaugaagcaggguuucgaguuuaauauaaugguugugggccagagcggguuaggaaaauccacccugaucaacacacuuuucaagucuaaaauuagccggaagucaguacaaccuaccagugaggaacgcaucccaaagacgauugagaucaaauccauaacucaugacauugaagagaagggcgugagaaugaaauugacagucaucgauacccccgguuuuggggaccacauuaauaacgaaaauuguuggcagccgaucaugaaguucaucaacgaucaguacgagaaauaucugcaggaggaagugaauauuaacaggaagaagcguauaccugacacucggguucauugcugucuauacuuuaucccagcaacaggacacagccuccgaccccuggacauugaguucaugaaaagacuuucuaagguggucaauaucgugccuguaauagccaaagcugauacccugacguuggaagagaggguucacuuuaagcaacgcauuaccgccgaccuccugucaaacggcaucgauguguauccccagaaagaguucgacgaagauagugaggaccgguuagucaaugaaaaguuuagagagaugaucccauucgcaguggucggcagcgaucaugaauaccaggugaacgggaagaggauucugggacgcaaaacaaagugggguacuaucgagguugagaacaccacacacugcgaauuugccuaucuccgagaccuucugauucggacucauaugcagaauauaaaagauaucaccuccucuauucacuucgaggcuuaccgugugaagagauugaacgaaggcucgagcgccauggcaaaugggauggaggaaaaagagccugaggcgcccgaaauguga

SEQ ID NO: 52237 - RNA, 1365 nt, Artificial Sequence
  derived and/or modified sequence opt3 from 40422__Homo_sapiens__NP_653311
auggccagcuccgagguggcuagacaccuccuguuccagucucauauggcaaccaagacaacuugcaugucaagucaaggcagcgacgaugaacagaucaagagggagaacauucggucccuuacgaugucugggcacgucggauuugaaucgcugcccgaccaguugguuaaucgcucaauacagcaagguuucuguuuuaacaucuuaugcgugggcgagaccgggauuggaaagagcacacugaucgauacucuauucaauaccaacuuugaagacuacgagaguucccauuucuguccuaauguaaaacucaaggcccagacauaugagcugcaggaaucuaacgugcagcuuaaacugaccauugucaauacugugggcuuuggugaucaaaucaacaaggaggaaagcuaccagccaauaguugacuauaucgaugcgcaguucgaggcuuacuugcaggaggaacucaagauuaaacgaucccuguuuacauaucacgacucacguauccaugugugccuguacuucauuaguccgaccgggcacagccucaagacguuagaucugcuuacuaugaaaaauuuggacucuaaggucaacaucauacccgugauugccaaagcagauaccguauccaagacagagcugcaaaaguuuaaaaucaagcuaaugucagaacucguuagcaauggagugcagauuuaucaguucccuacugacgaugacaccaucgccaaagucaacgcugcaaugaauggccaacugccauuugccguggugggcaguauggacgaggucaagguugggaacaaaauggugaaggcuagacaguaccccuggggaguagugcaggucgaaaaugagaaccacugugauuucgugaaacuuagggagaugcugaucugcacaaacauggaagacuugcgggagcagacccauacgcgccacuacgaacucuauagaagguguaagcuggaggaaauggguuucacugauguuggcccugagaauaagccagugucuguccaagagacauacgaagccaaacggcaugaguuucacggggaacgccagcgaaaggaggaagagaugaaacagauguucgugcagagaguaaaggagaaagaagcgauuuuaaaggaggcagaaagggagcugcaagccaaguuugagcaccucaaacggcuucaucaggaggaacguaugaagcuggaagagaaacgcagauugcuagaagaggagauaaucgcuuucuccaagaaaaaggccaccagcgaaauuuuucacucgcagucuuuccuggcaacuggauccaaccucaggaaggacaaagaucggaaaaauucaaacuuucuguga

SEQ ID NO: 52238 - RNA, 1290 nt, Artificial Sequence
  derived and/or modified sequence opt3 from 40787__Homo_sapiens__NP_060713
auggccguggcugucggcagacccagcaacgaggaacugaggaaucucucccuuucugggcacguuggauucgacucacugccugaucaguuggugaacaagaguaccagccaagguuuuugcuucaauaucuuauguguaggcgagacagggauuggaaaauccacucugauggacacgcuauuuaacaccaaguucgaaucugauccagcaacacauaaugagccgggcgugcggcucaaagcccgcucguacgaacugcaggagucaaacguccgacuuaagcugacuauaguggacaccguugguuuuggggaucagaucaauaaagacgauagcuauaagcccauuguggaguacaucgacgcgcaguucgaggcuuauuugcaagaagaacucaagauuaaacguagucuguuuaacuaccacgauacaagaauccaugccugccuguauuucauagcaccuaccggacacucccucaagucuuuagaccuggucacuaugaaaaaguuggauagcaaagugaauaucauuccaaucauugccaaggcugacacaaucgcaaagaacgagcuucauaaauuuaaguccaaaauaaugucagagcugguaaguaauggcguucagauuuaccaguuccccaccgaugaagagacgguggccgaaaucaacgcuacuaugagcguccaccuaccuuuugccguggugggcucuaccgaggaagucaagauugggaauaaaauggcgaaggcaaggcaguauccauggggaguugugcaaguagagaacgagaaucacugugacuucgugaaacuccgggaaaugcugauccgcgucaacauggaggaccuuagagaacagacacauacuaggcacuacgagcuguaccggcgcugcaaguuggaagagauggguuuuaaggauaccgaccccgauuccaaaccuuucucacuccaggagacauaugaagccaagcgaaacgaguuccugggcgaauuacagaaaaaggaggaagagaugagacaaauguuugugaugaggguuaaagagaaggaagcugagcugaaggaagccgagaaagagcuccaugaaaaguucgaccuucugaaacggacccaccaggaggaaaagaaaaagguggaggauaagaaaaaggaauuggaggaggaagucaauaacuuucagaaaaagaaagcagcugcccaacuacugcagagccaggcgcagcaaaguggggcccagcagacgaagaaggacaaagauaagaaaaaugcaucuuucacuuga

SEQ ID NO: 52239 - RNA, 939 nt, Artificial Sequence
  derived and/or modified sequence opt3 from 41153__Homo_sapiens__NP_001147930
auggacccccugagaaggagcccuuccccaugccucucuucacagccgaguagccccuccaccccuccaugugagaugcuuggccccguggggaucgaagccguccuggaucaauugaagauuaaagcuaugaagaugggauucgaguuuaacauaaugguugugggucagucuggcuuagggaaaucgacaaugguaaauacucuguucaagucaaaaguguggaaaagcaacccuccaggacuaggcguccccacgccucagacccuccagcugcacagucuuacacaugugaucgaagagaaggguguuaagcugaaguugacugugaccgacacaccaggguuuggagaucaaauuaauaacgacaauugccuccggccgcuggauaucgaguuccugcagcgccucugucgaaccgucaacgugguacccguuauugcacgugccgacuccuuaacuauggaagagagagaagcguuuaggcggcgcauccagcagaaucugagaacacacugcauagauguguacccucaaauguguuucgacgaggauaucaacgacaaaauucuuaauucuaaguugagggaucggaucccauuugcugucgugggcgccgaccaggaacaucuggugaacggccgcugcguccuagggcgaaaaaccaaguggggaauuaucgagguugagaauauggcacacugugaguucccccuccugagagaucuucugauaaggagccauuugcaggaccucaaggacauuacgcacaacauccacuaugaaaauuaccgggugauucgucugaacgaaucccauuuacugccucgcgguccaggcuggguaaaucucgcccccgcuucaccggggcagcuuacuaccccuagaacauuuaaagugugcaggggagcacacgaugacagugaugacgaguucuga

SEQ ID NO: 52240 - RNA, 1299 nt, Artificial Sequence
  derived and/or modified sequence opt3 from 41883__Homo_sapiens__NP_997249
auggccgagagaaccauggcuaugcccacacagaucccugcagacggcgauacucaaaaggaaaacaauauuaggugccugacgaccauagggcacuucggauuugagugucucccaaaccagcuugugagccgguccauccgccaggguuucacauuuaauauucugugcgucggcgaaacugggaucggaaaaucuaccuugauugacacauuauucaacaccaaucugaaggauaacaaaucaagucauuuuuacagcaauguuggccuacagauccaaacuuaugagcuccaggaauccaacgugcagcugaaacuuacaguaguggagaccgucgguuacggggaccagauagauaaggaggccucuuaucaaccgaucguggacuacauugaugcgcaguucgaggcuuaucugcaggaagaauugaagaucaagcgaucgcucuuugaguaccacgacucacguguucaugugugucuguauuucauuagccccacgggacacagucugaaaucccucgauuuacugacuaugaagaaucuugacucuaaagucaacaucauaccuuugauugccaaggcagauaccaucagcaaaaaugaccugcagacauuuaagaacaagauuauguccgagcuaaucucaaauggcauccaaauuuaccagcucccaacugaugaagagaccgccgcucaggcaaacaguagcgugucuggccugcuucccuucgccguaguuggguccacagacgaagugaaagucggaaagagaauggugaggggucggcauuacccuuggggcgugcugcaagucgagaaugaaaaccacugcgacuuuguuaaauugcgcgauaugcuccuguguaccaacauggagaauuuaaaggagaaaacgcacacucagcauuaugaaugcuacagauaucagaagcugcagaaaaugggguucacagacgugggaccaaacaaucaacccguaucauuucaggagauauucgaagcuaagaggcaggaguucuacgaucagugucaacgggaagaggaggaacucaagcagcgcuuuaugcagcgagugaaagagaaggaagccaccuucaaagaggcggaaaaggagcuucaggacaaauuugagcaccugaagaugauccaacaggaagagauuagaaaguuggaagaggagaaaaagcagcuagaaggcgagaucauagauuucuauaaaaugaaggcagccagcgaagcucugcagacucaacucaguacagacaccaaaaaggauaagcauaggaaaaaguga

SEQ ID NO: 52241 - RNA, 1488 nt, Artificial Sequence
  derived and/or modified sequence opt3 from A1BG__Homo_sapiens__NP_570602
augagcaugcugguggucuuccuccuucuguggggcguuaccugggggcccgugacagaggccgcuaucuuuuacgaaacucagccuuccuugugggcagagucugaaucauuacugaagccacuagccaacguaacgcugaccugccaagcgcaccucgagacaccggacuuccagcuuuuuaaaaauggaguggcucaggaacccguccaucuggauaguccugccauuaagcaccaguucuugcucacuggugacacccaaggcagauauaggugucggagcgggcuguccacaggauggacccagcugucuaaacucuuagagcugacuggcccaaagucgcuucccgcaccuugguugucaauggccccagugagcuggauaacacccggucugaaaaccacggcuguuugccgcggggugcuacgaggagucacuuuucuccugcguagagagggcgaucaugaauuucuugaggugccugaagcacaggaggacguagaggccaccuuuccaguucaccagccgggcaacuacaguuguuccuauaggacagauggggaaggagcucugucugagcccagcgccacugugaccaucgaagaguuggcggcaccuccacccccuguccucaugcaucacggugaauccucacaagugcugcacccaggcaauaaggugacauuaaccugcgucgcuccccugagugggguugacuuccagcuccggcgcggagagaaggagcuucuggugccgagaagcucuacguccccugauaggauuuucuuccauuugaacgccguagcccuaggcgacggugggcacuacacuugucgguaucgccugcaugauaaucagaacggauggucaggcgacagcgcacccguggaacucauccugagugaugagacacuuccagcuccugaauuuucucccgagccagaauccggccgagcccugagauugaggugccucgcgccccuggagggggcccgguucgcauuaguccgugaggaccgcggagguagaagggugcaccgguuucagagcccugcuggcaccgaagcccuguucgagcuacacaauauuucgguugcugauucugccaacuacuccuguguguaugucgaccucaaaccaccguucgggggaucagcacccagugaacgacuggagcuucauguggacggcccuccaccccgcccucaauugagagccacuuggagcggugcuguacuggcggggagggaugcaguucuccggugcgaaggcccaauccccgacgugacauuugagcugcuucgcgagggagaaaccaaggccgucaaaacggugagaaccccgggcgcugccgcaaaucuggaguugauauucgucgggccucagcacgccggaaacuacaggugucguuaccgguccugggugccacauacauuugaaucugagcucagcgaucccguugagcuguuaguggcugaaucauga

SEQ ID NO: 52242 - RNA, 1761 nt, Artificial Sequence
  derived and/or modified sequence opt3 from A1CF__Homo_sapiens__NP_001185747
auggagagcaaccacaaguccggcgacgggcugucuggaacccagaaagaagccgcucucagagcacuugugcaaaggacagguuacucacugguccaggagaauggccagcggaaguaugggggacccccuccaggcugggaugccgcgccgcccgaacgcgguugcgagaucuucauugggaaauugccucgagacuuauuugaagaugagcugauaccacuaugugagaagaucggaaaaauuuacgaaaugcguaugaugauggacuucaacggcaauaacagaggcuaugcuuuuguuacuuucaguaauaagguggaggccaagaacgcaaucaaacagcucaauaacuacgaaauuaggaaugggcggcugcuuggaguaugcgccagcguggauaacugucgccuguuugucgguggcauccccaagacgaaaaagagagaggagauauuguccgaaaugaaaaaggugaccgaggggguuguggacgucaucguguauccuucugcugcagauaagacaaagaauaggggauucgccuuuguagaauacgagucgcaucgggcugccgcgauggcacgccgaaagcuccugccaggcaggauucaacuguggggucacgggaucgccguugacugggcugaacccgagguggaggucgaugaagacacuaugucaagcgugaaaauucucuaugugagaaacuuaaugcugaguaccuccgaggaaaugaucgagaaggaguucaauaacauaaaaccuggagccgucgaacggguuaagaaaauucgugauuacgcauuugugcauuucucuaaucgcgaggacgcuguagaagccaugaaggcgcuuaacggcaagguguuggauggcagcccaaucgaggucacacuggccaaaccgguggacaaggacuccuacguuagauauaccagggggacuggaggucggggcacaaugcuacagggggaauacaccuauucacucggacagguguacgaucccacgacuaccuaucugggcgcaccugucuuuuacgcuccacagacauaugccgcuauucccagucuucacuucccugccacuaaaggucaucugagcaaccgagcaaucauccgcgccccaucugugagaggggcugcgggcguaaggggauugggcgggcggggauaccucgcauacaccggucugggccgcggguaucaaguuaagggagacaaaagagaggauaaguuauacgacauucugcccggcauggaacucacaccgaugaauccugugacccuuaagccccaggguauaaaacuggccccacagaucuuggaggagauuugccagaagaacaauugggggcaaccugucuaucagcuacacuccgcuaucggccaggaucaaaggcagcuguuucucuacaaaauaacgauucccgcccuggcaucacagaacccagccauccaccccuucacuccuccaaaacuuagcgcuuucguggacgaagccaaaacauaugcagcggaguacacccugcagacuuugggaaucccgacagauggcggggacggaaccauggcuacggccgcagccgcugccaccgcauuucccgguuaugcugucccuaaugccacagcgccagugagugccgcucaacucaagcaggcaguuacucugggccaggauuuagccgcuuacaccacauacgaaguguaucccacuuucgccguaaccgcacguggggacggauacggcacauuuuga

SEQ ID NO: 52243 - RNA, 4425 nt, Artificial Sequence
  derived and/or modified sequence opt3 from A2M__Homo_sapiens__NP_000005
augggcaagaacaaacugcuccaccccagccuugugcuguuguuacugguccuacucccuaccgacgccuccguuucugggaagccacaguacauggugcugguaccgucacuucugcauacagagacuacggaaaaaggaugcguguugcucaguuaucugaaugagaccgucacagugagcgcuucccuggaaucuguuagagguaacaggagucucuucacugauuuagaggcagaaaaugacgugcugcacugugucgccuuugcggugcccaagucaagcaguaacgaggagguaauguuccuuaccguucaagugaaaggcccuacacaggaauuuaagaagcggaccacugucauggugaaaaaugaggauuccuugguguucguccagacagacaagucuaucuacaaaccagggcagaccguuaaguuucgcgugguaagcauggaugaaaacuuccauccccugaaugagcuaauuccucucguguauauacaagacccaaaaggaaaccgaaucgcucaguggcaguccuuucagcuggagggcggucuuaagcaauucucauuuccccugaguagcgaaccuuuccaggggucuuacaaggucgugguucagaaaaaguccggaggccguacggagcacccauuuacuguggaagaguucgucuugccgaaauuugaagugcagguaaccguucccaagauuaucacaauucucgaggaggaaaugaaugugucagucugcggccuguauacuuacgggaaaccugugccaggacaugucaccgugagcaucuguagaaaguauagugaugccucugacugccacggugaggauucccaagcauucugugaaaaauucagcggccaguuaaacucgcacgggugcuuuuaccagcaaguuaagacaaagguguuccagcugaaaaggaaggaguacgaaaugaaacuccauaccgaggcccagauacaggaggaaggaacgguagucgagcuuacuggccggcaaucuuccgaaaucacacgcaccauuacuaagcugucauuugugaaaguugacagucacuucagacaggguauccccuuuuucggacaggugagguuggucgaugggaagggcgugccuauuccaaauaagguaaucuuuauacggggcaacgaggcuaauuauuacagcaacgcaacaaccgacgaacaugggcuagugcaguucuccauuaauacgaccaacguuaugggaacaucucugacuguccgcgugaacuauaaagaucgaagccccuguuacgguuaucaaugggugucagaggagcacgaagaggcccaccauaccgcuuaccucgucuuuaguccguccaagagcuucguucaccuggaaccuaugucucaugagcuucccugcggccacacacagacugugcaggcccauuauauccugaaugggggaaccuugcucggccugaaaaaguuaucauuuuacuaccugauuauggcgaaaggugggaucgugagaacaggcacccacggacuacucguaaagcaggaggacaugaagggccacuucaguaucagcauuccagucaaauccgacauagcaccuguggccaggcugcuuaucuaugcuguuuugcccacuggggaugugauuggagacucugccaaguacgaugucgaaaacugucuggcaaauaaaguggaccucucguuuagcccaucccaaucacugcccgcuagucaugcccaccuucggguuacggcggccccucagucugugugcgcacugcgugcuguagaucagagcgucuugcucaugaagccagacgccgagcuguccgcuucaagcguguauaacuuacugccggaaaaagaucuaacagguuuccccggcccucucaaugaccaggaugacgaggauuguaucaaccgccauaauguguacauaaacgggauuaccuauacuccagucucuuccaccaaugaaaaggacauguacaguuuccuggaggacaugggacuuaaggccuuuacaaacagcaaaaucagaaagcccaaaaugugcccucaauugcagcaguaugagaugcacggcccagaaggucugaggguuggguucuacgagucugaugugaugggccggggacacgcacgacucguacauguggaggaaccccacaccgaaacuguccgcaaguacuuuccggagacauggaucugggaccuggugguugucaauuccgccggcguggcugagguggggguuacggugccugauaccauuacugaauggaaagcgggagcauucugcuuaucagaggacgccggucugggcaucaguagcacagcuucgcuuagagccuuucaaccauucuuugucgaauugaccaugcccuauuccguaauuaggggagaggcauucacacucaaggccacugugcugaacuaccuaccuaaauguauacggguuucugugcagcuggaagcuagccccgccuuucucgcagucccaguggagaaggagcaggcgccucauugcaucugugcuaaugggcgccagaccguaucaugggccgugacgcccaagagucugggcaacgucaauuucaccguuuccgcagaagcccuugagucucaagaauugugcgguacagaggugccaagcgugccggagcacgggagaaaagauacugucauuaagccucuguuaguggaacccgagggccucgaaaaagagaccacauuuaacucccugcuuuguccaucaggaggcgaaguuagcgaggagcugaguuugaagcugcccccuaacguaguggaagagucugcuagggccuccgucagcgugcucggggacauccuaggaucggcaaugcagaauacucagaaccugcuccagaugccauauggcugcggugaacaaaauaugguucuguucgcucccaacaucuacgugcuugauuauuugaaugagacccagcagcugacgccugaaauuaaaucaaaggccauaggguacuuaaacacaggauaucagcgucaacucaauuacaagcauuacgacggcucuuauaguaccuuuggugagcgguacggccgaaaccaggggaauacuuggcugacagcguucguccuuaaaaccuucgcccaggcuagagcauauaucuuuauugaugaggcccacaucacucaagcucugauuuggcuaucccagaggcagaaggacaacggauguuuccgcagcucuggcagccuccugaauaacgccaucaaagggggaguggaagaugagguaaccuuguccgcauacauaacaaucgcgcuguuagaaauuccgcucacggucacccacccagugguucggaaugcccuguuuugccuugagucagcuuggaagacugcccaggaaggcgaccaugguagucacguguauacaaaagcacuguuggcuuacgccuucgcacucgccgggaaccaagauaagagaaaggagguccugaaaagccuaaaugaggaagcugugaagaaagacaacucuguucauugggagaggccccagaagccuaaagcgccagugggacacuuuuaugaaccccaggccccuuccgcagaggucgagaugaccucauacgugcugcuugcuuaccucacagcccagccggcccccacuucggaagaccugaccagcgcuacgaacaucguaaaguggauuacaaagcaacagaaugcacagggcgguuucuccucuacccaggauacugugguugccuugcaugcgcugucgaaauauggcgcugccaccuuuacacgcacugggaaggcagcccaagucaccauccagagcucaggaacauucuccaguaaauuucagguggacaacaauaaccgauuacuccugcagcaagugucucuuccagagcugccuggcgaauacagcaugaaggucacgggggagggauguguauauuugcagaccucccucaaauacaauauacugcccgaaaaggaggaguucccauuugcucuaggcgugcagacucugccucaaacaugcgaugaacccaaagcacacaccucauuccagauuucucuuagcguuaguuauacugguucccggagcgccucuaacauggcgaucguggacgucaagauggugucaggguucauuccacucaagccgacaguuaaaaugcuggagcguuccaaucacgugaguagaaccgaagucagcucgaaccauguguugaucuacuuagauaagguaucuaaucagacgcugucccucuuuuucacugugcugcaggacguuccugucagggaucuuaaacccgcuauagugaagguguaugacuacuacgagaccgaugaauuugccaucgcagaguauaacgccccauguagcaaagaccugggaaaugcuuga

SEQ ID NO: 52244 - RNA, 4365 nt, Artificial Sequence
  derived and/or modified sequence opt3 from A2ML1__Homo_sapiens__NP_653271
augugggcccagcugcuccuuggcaugcuggcuuugagccccgcaaucgccgaggaauuaccuaacuaccuggugacccuaccagcgagacucaauuucccguccguccaaaagguuugccuggaccuuucucccggguauucagaugugaaauuuacaguaacucuggagacgaaggacaaaacccagaaguugcucgaauacaguggacugaaaaagaggcaucugcacuguauuagcuuccucgugccuccacccgcugguggcacagaggaagucgccacuauacggguguccgggguuggaaacaauaucucuuuugaggagaagaaaaagguguuaauucagcgccagggcaacgguaccuucguccaaacagauaaaccucuguauaccccagggcaacagguguacuuucgaaucguaacuauggacucgaauuucguucccgugaacgauaaguauucaauggucgaacuucaggacccuaauagcaaccguauugcacagugguuggagguggugccagaacagggaaucgucgaucugaguuuucagcuagccccggaggcuaugcucggcacauacaccguugcaguggccgagggcaaaacguucgggacuuuuuccguagaagaguaugugcugcccaaguucaaggucgaagugguugagccuaaagaacuuucuaccgugcaggagagcuuucuggucaagauaugcuguagauacacauacggaaaaccaauguugggugcugugcaaguauccguuugccagaaggccaauacuuauugguacagggagguggaacgggagcagcuccccgacaaaugucgcaaccugucaggccaaaccgauaagacagggugcuucagugcgccugucgacauggcaaccuuugauuuaaucggauaugccuacagccaccagauuaauaucguggcuacggucguggaagagggcacugguguugaagccaacgcaacacagaauauuuauaucucuccacagaugggguccaugaccuucgaggacacuucaaacuucuaccaucccaauuuuccguucagcggaaaaauaagagugaggggccacgaugacaguuuucugaagaaccaucucguauuccuugucauuuauggcacaaacgggaccuuuaaucaaacgcuggugaccgacaacaauggauuggcuccuuucacacuagagacuucugguuggaacggcaccgauguuucccuggaagggaaguuucagauggaggaccucguguacaaucccgaacaggucccacgguacuaucagaacgccuaccugcaccuucgcccuuucuauagcacaacucgaucguuucugggaauccacagauugaauggcccccucaaauguggucaaccacaggaggugcugguagauuacuauauugaccccgcggaugccucuccugaccaggaaaucuccuucucauacuauuuaaucgggaagggcagucuggugauggagggacagaaacaucuaaacagcaagaaaaagggccucaaggcauccuuuucucugagccuuaccuucacaucaagguuggcuccagauccgagucugguuauuuacgccauauuucccuccgggggagucguggcugacaaaauccaauucagcguggagaugugcuucgauaaucaggucucucucgguuuuucaccuagucagcagcugccaggcgccgaaguugagcuucaacugcaggcagcccccgggagcuugugugcucuccgggcgguggacgaauccgugcuguuacugcguccugaucgcgagcuaucuaacagaucgguauacggaauguucccauuuugguauggccacuaccccuaucaggucgcagaguacgaccaaugcccggugagcgguccuugggacuucccacagccccucauugauccuaugccccaggggcauuccucacagaggaguaucauauggcggccaucuuuuagcgaaggcaccgaccuguucuccuuuuuccgagauguuggacuuaagauuuugucaaaugccaaaaucaagaaaccuguggacuguagccaccgcucucccgaguauuccacugcuaugggcgccgggggaggucacccagaagcauuugagaguagcacgccgcugcaucaagccgaagauucucaggucagacaguacuucccugagacauggcucugggaccuguuucccaucggcaacuccgggaaggaggcugugcacguuaccgugccagaugccauuacugaauggaaggcaaugucauucugcaccagucagagcaggggauuuggcuuaucgcccacaguaggucugaccgcguucaaaccuuucuuugucgaccuuacuuugccauauuccguggugcgcggggagucuuuccggcucacagcuacgaucuuuaauuaccugaaggauugcauuagaguccaaaccgaccuagccaaaagccaugaauaccagcuggagucaugggcagauagucagacuuccucuugucucugcgccgacgaagcuaagacacaccauuggaacauaaccgccguuaaacugggccacaucaauuucacaauuagcacuaagauccuugauuccaacgagcccuguggaggccagaagggguuugugccucaaaaaggaaggucagacaccuugaucaagccgguacuggugaaaccagagggcgucuuaguggaaaagacgcacagcagucuccugugccccaaagguaagguugcaucugaguccgugagccuugaacugccugucgacauugugccagauucgaccaaggcuuauguuacaguguugggggacauaaugggaacugcccuccagaaccuggauggccuaguccagaugcccucagguuguggcgagcaaaauaugguacuguucgcgccuaucauuuacgugcuccaguaucuggaaaaagccgggcuuuugaccgaggagauccguucucgggcuguuggauuucuggaaauuggcuaccagaaggaguuaauguauaaacauaguaacggguccuacagcgcauucggagaacgagacggcaaugguaacacauggcucacugccuuugugaccaagugcuucgggcaggcucaaaaauuuaucuucauagauccgaagaauauccaggacgcccugaaauggauggcaggaaaccagcuucccucuggcuguuaugcgaaugucgguaaccugcuacacacggccaugaagggcgggguggaugacgagguaagccucacagcuuacgugaccgccgcacuguuggagaugggaaaggaugucgacgauccaaugguuucccagggccugagaugccucaaaaauucagcuacaaguacuaccaaccucuacacucaagcccugcuugcauauauuuucagccuggccggggaaauggacaucaggaauauuuugcucaagcagcuggaucagcaggcuaucauaucuggagaguccauuuacuggucacaaaaaccuacccccaguagcaacgcguccccauggucugaaccugccgcaguggacguggagcuaacagcuuaugcccugcuugcccagcucacgaagcccucgcugacccagaaagaaaucgcuaaggcaacuagcauugucgccugguuggcgaagcagcgcaaugcuuacggcgguuuuucauccacacaagacaccgugguugcccugcaggcauuagccaaauaugcuacaacugcauacaugccaagugaggagaucaaccucguagugaagucuaccgaaaauuuccagcggacguuuaacauacaaagcgucaacagacugguguuccagcaggauacacuuccgaauguuccugggauguauacccuggaggccuccggacagggcuguguguacguccaaacuguguugagguacaacaucuuacccccaaccaauaugaaaacauuuucacugucuguagaaauugguaaggcgcgcugcgagcagcccacuagcccucgaagucuaacccugacaauccauacguccuaugucggcagccggucuucauccaacauggcuauuguggaaguuaaaaugcuuaguggguucagcccaauggagggaaccaaucagcuccuguugcagcaacccuuagugaagaaggucgaguuuggcacugacacacugaacaucuaccucgaugaacugauuaaaaauacccagacuuauacauucaccauaucgcagucugugcuuguuacgaaccugaagccugccacuaucaaaguguacgacuauuacuugccggaugagcaggcaaccauccaauauuccgacccaugugaauga

SEQ ID NO: 52245 - RNA, 1023 nt, Artificial Sequence
  derived and/or modified sequence opt3 from A4GNT__Homo_sapiens__NP_057245
augagaaaggagcugcagcucagccuuuccgugacccuguuguuagucugcggcuuccuguaccaauuuacacuaaaaucuucaugucucuucugccugcccaguuuuaagagccaccaggggcuugaagcccuguugucccauaggcggggaaucguuuuccucgagacuucugaacgcauggagccuccacaccuggugucguguucaguagaaagcgcugcaaaaauuuauccggaguggcccguggucuuuuucaugaagggucugacggacaguaccccuaugccauccaacucuacauaccccgccuuuagcuuccucuccgcgauagauaauguguuuuuauucccucuggacaugaaacgacuuuuggaggauacuccacuguuuucaugguauaaccagaucaaugcuagugccgaacguaacuggcuacauauuagcucugacgcauccagacucgccaucauuuggaaguacggcgggaucuauauggauaccgacguuauaucaaucaggcccauuccugaggaaaauuuccuggcugcacaggccagccgguacaguucuaacggaaucuuuggcuuccuuccacaccauccguuccugugggagugcauggagaauuuuguggaacacuauaacuccgcuauuugggguaaucaagggcccgaguugaugacacgcaugcucagagucugguguaagcuggaagauuuccaggaggugagcgacuuaaggugccugaacaucucguuucuccacccucagcgguucuacccaauaucuuaccgcgaauggcgaagauauuacgagguaugggauaccgagcccuccuuuaauguuucauaugcccuucaucuguggaaccacaugaaucaggaaggaagggcggugauucggggcaguaacacuuuggucgagaaucuauaccguaaacauuguccucgcacauauagagaccugaucaagggcccagaagggagcgugaccggagagcucggucccggcaacaaauga

SEQ ID NO: 52246 - RNA, 1542 nt, Artificial Sequence
  derived and/or modified sequence opt3 from AAAS__Homo_sapiens__NP_001166937
augugcagccugggccucuuucccccuccaccgcccagaggacaggugacccuuuacgagcacaacaaugaacuggucacaggguccucuuaugagucaccuccacccgacuucaggggucaauggaucaacuugccuguuuuacagcugacuaaggauccacuaaaaacgcccggccggcucgaccaugggacccgcacagccuucauucaccaucgagaacagguguggaagcguuguauaaauaucuggagagauguaggacuguuuggcgugcuuaacgagauugcuaauagugaagaggaggucuucgaaugggugaaaacugcaagcgguugggcccuggcguuguguaggugggcuuccucucuccacgggucgcuguuuccucaucugucacuccggagcgaggacuuaaucgccgaguucgcacagguuaccaacugcacaauugugccaagucugaagcaccgccuucaaagaaaugucgccuccuuggcuuggaaaccgcugucugcaagcgugcuagccguagcuugccaguccuguauccucauauggacccuggaucccacuucacuuaguacaaggccuagcucuggaugcgcccagguucugucccacccaggccauacccccgugacgucauuggcgugggcaccuagcggcgggcggcuccugagugccucuccagucgacgcugccauccgcgugugggauguguccacugaaaccuguguccccuuaccgugguuucgaggagguggcguuacaaaccugcucuggagcccugacgggucgaagauucuugcaacuacccccucugcuguguucagaguaugggaggcccagauguggacaugcgaaagguggccaacccuguccggacggugucaaacgggcugcuggucaccugaugguagucguuugcuauuuacugugcugggggagccccucaucuacagccuguccuucccagaacgcuguggagagggcaagggcugcgucgggggagcgaaaucugccacaauuguggcagaccuuagcgaaaccacuauccagacacccgauggugaggagagacugggcggggaagcucacucaaugguuugggacccuaguggagagagguuggccgugcucaugaagggcaaaccacggguccaggaugguaagccggugauacuguuauuucgaacccgcaauucccccguauucgaacugcuaccuugcgggauuauccagggcgagccaggagcucaaccccagcucauuacguuucauccuagcuucaacaaaggcgcccugcuuucuguuggguggucaaccggaagaaucgcacacaucccauuguauuucgugaaugcccaguuucccagguucaguccgguccugggucgggcucaagaaccuccagcgggcgggggaggcagcauucacgaccucccccuguuuacagagacuuccccuaccucugcacccugggacccacuuccuggucccccaccggugcugccucauucgccccacagccauuuguga

SEQ ID NO: 52247 - RNA, 2019 nt, Artificial Sequence
  derived and/or modified sequence opt3 from AACS__Homo_sapiens__NP_076417
augagcaaggaggaaagacccggcagggaggaaauccuggagugccaggugaugugggaaccugacuccaaaaagaacacccaaauggaucgguuccgcgccgcugucggggcagccuguggacucgcgcuugagucuuacgacgaucuguaucacuggucaguugagaguuacagcgacuuuugggcugaguucuggaaauuuuccgguauuguguucucucgaguauaugaugaaguggucgacacaucgaagggcauagccgaugugccagaaugguuuaaagggucacguuugaauuacgcagagaacuuacugagacauaaggagaaugacaggguugcccuauauaucgcucgggaaggaaaggaggaaauugugaaagucacuuucgaggaacuccgccaggagguggcacuguuugccgcugccaugagaaagaugggcguuaaaaagggugauaggguagugggguaccuuccgaacagcgagcacgcggucgaagcaaugcuggccgcugccaguaucggagcaauuugguccucuacgagccccgacuucggcgugaauggcguguuggaucgguuuucccagauccagccuaaacucauauucucagucgaggcuguuguguauaacgggaaggaacauaaucacauggagaagcugcaacagguagugaaaggacugccagaccucaagaaagucgugguuauccccuacgugaguagccgcgaaaacauugauuuaucuaagaucccuaauuccgucuuucuggacgacuuccuugccaccgguacaucagagcaggcgccacaguuggaguuugaacaacugcccuucagccauccucuauucauuauguuuaguucuggcacuaccggggccccaaaaugcauggugcacuccgcaggaggcacacucauccagcaccugaaggagcaucuucugcacgguaacaugaccagcucggauauauugcucuguuacacuacaguaggguggaugauguggaauuggaugguuucucuguuagcuaccggagccgcuauggugcuguaugacggcuccccgcucguccccacgccuaacgugcuuugggaucuggucgaccgaauuggcaucacuguguugguuaccggggccaaauggcuaucagugcuggaagagaaggcaaugaagccaguagaaacacauagucuccagaugcugcacacuauucuuagcaccggaucccccuugaaagcccagucuuacgaguaugucuacagaugcaucaagagcucaaucuugcucgguaguauuuccggcgggacagauauaaucagcuguuucaugggacacaauuuuucucugccuguguauaaaggcgagauucaagcuaggaacuuagguauggcgguugaagcauggaaugaggaagggaaggccguguggggcgagucaggagagcuggucugcaccaaaccaauccccugucagccgacgcauuucuggaacgacgaaaacggcaauaaguaccggaaggcuuauuuuaguaaauucccugggauaugggcccacggagauuacugccguauuaaccccaagacugguggcaucgugaugcuagggcgcagcgacggaacacucaauccaaacggcguaagauuugguuccucugagaucuacaauauuguggaaucguucgaggaaguugaggauagccugugugucccucaguauaacaaauacagggaggaacgggugauccuuuuucugaagauggcauccgggcaugccuuccaacccgaccuggugaaacgcauucgagaugcuauaagaaugggccucucagccaggcacgucccaagucugauccuugagaccaagggcauucccuauacucugaauggaaagaaaguugaaguggcagugaagcagaucaucgcggggaaagcuguagagcagggaggugccuuuucuaacccugaaacauuggaccucuaccgggacauuccagagcugcagggcuucuga

SEQ ID NO: 52248 - RNA, 1200 nt, Artificial Sequence
  derived and/or modified sequence opt3 from AADAC__Homo_sapiens__NP_001077
augggcagaaagagccuguaccuccuuaucguggggauucugauagccuauuacaucuauacccccuugccugacaacgucgaggaaccauggaggaugauguggauuaaugcucacuuaaaaacaauccagaaccuggcaacuuucguugagcuacucggacugcaucacuuuauggauuccuucaaggugguagguucuuuugacgaagugccgcccacgucagaugagaaugucaccgugacagaaacuaaauucaacaauauucuuguucggguguacgucccuaagcgcaaaagugaggcccugcgacguggcuuguuuuauauccaugggggaggcuggugcguggguagcgcggcucucuccggguacgaccugcugucuagauggaccgccgauaggcucgacgcaguaguugugucgacaaacuaucgguuagccccaaaguaccacuuccccauacaauuugaggaugucuacaaugcucugcgcugguuccuuagaaagaaaguguuggcaaaguauggagugaacccugaaaggaucggcauuucaggcgacagcgccgggggaaaucuggcugccgcggucacccagcagcuacucgaugacccagauguuaaaaucaagcugaaaauucagagucuuaucuaccccgcacugcaaccuuuggacguggaucucccauccuaucaggagaacucuaauuuucuguucuuaagcaagucccugaugguacgguuuuggucagaauacuucacuacagaccgcagucucgagaaggccaugcuuagccgacagcaugugccggucgagucuucccaccuguuuaaauucgugaacuggagcucauugcuacccgaaagauucauaaagggucacguuuauaauaacccuaauuacggcaguucugagcuggcuaaaaaguauccaggguuucucgacgugagggccgcaccccugcuugcugaugacaacaaacugcggggauugccucucaccuacgucauuacgugucaguacgaucuguuacgugacgauggccugauguaugugacucgccuaagaaacaccgguguacaaguuacacauaaucacguggaagacggguuccauggagccuuuuccuuccucggccugaagaucagccacaggcuuauuaaccaguacaucgagugguugaaagaaaaucuguga

SEQ ID NO: 52249 - RNA, 948 nt, Artificial Sequence
  derived and/or modified sequence opt3 from AAGAB__Homo_sapiens__NP_078942
auggccgcuggcgugcccugcgcacuggucaccagcuguuccucuguuuucucaggggaccagcucgugcaacacauccuuggaacagaggaucugauuguagaagugacgaguaacgacgccgucagauuuuacccuuggacuauagauaauaaguauuacagcgcggacaucaacuugugcgugguuccaaauaaauucuuagugaccgcugagauugccgaauccguccaggcauuugugguauauuucgauucuacacagaagucgggucuggacucaguuagcaguuggcuaccgcucgccaaggcuuggcugcccgaggugaugauccuugucugugauaggguguccgaagacggcauuaaccggcagaaagcacaagaguggugcaucaaacauggguuugagcugguggaauugucuccugaggaacucccagaggaggaugacgauuuccccgaaagcacuggagucaagcgcauaguucaggcccugaaugcuaacgugugguccaauguagugaugaagaacgaccgaaaucagggcuuuucacugcucaacaguuuaaccgguacaaaucacagcaucgggucugccgauccuugucauccagagcagccccaucugccugcggcagacuccaccgaaucacuuagcgaccaccguggaggcgccaguaacacuacagaugcucaagucgacucuauuguggauccaauguuggaccuggauauccaggagcuagccucccucaccacgggcgggggagacguugaaaauuucgagagacuguuuagcaaacuuaaggagaugaaagauaaggcagcuacucugccgcacgaacagaggaaagugcacgccgagaaggucgcgaaggccuucuggauggcaauugguggcgaccgggaugaaaucgagggguugucgucugacgaggaacauuga

SEQ ID NO: 52250 - RNA, 2886 nt, Artificial Sequence
  derived and/or modified sequence opt3 from AAK1__Homo_sapiens__NP_055726
augaagaaauucuuugacagcagaagggagcagggcggguccggacuggguucuggcucaagugggggaggcgguagcaccuccgggcucggaucuggcuacaucggccggguguucgggauuggacgccaacaggucacaguugaugaagugcuugccgaggguggcuuugcuauaguauuccuggugcgaacuucgaacgggaugaagugcgcauugaaacguauguuugucaauaacgaacacgacuuacagguguguaagagagagauccagauuaugagggaucugucaggacauaaaaauaucguuggcuauauugacagcaguaucaacaauguguccucuggugaugucugggaagugcuaauacucauggacuucugcagagggggacaaguaguuaaccugaugaaucagcgccuucagacgggcuuuaccgagaacgaggugcugcagaucuucugugauacaugcgaagccgucgcgagauugcaccaauguaagacucccauuauccauagggaccucaagguggagaauauucugcugcacgaucggggccauuacgugcucugcgacuuugggagcgcuaccaacaaauuccagaauccucagacagaaggagucaacgccguugaggaugagaucaagaaauauaccacuuuauccuaccgcgcaccagaaauggugaaucuguauucagguaagauaauuacaaccaaagccgacaucugggcucuuggcuguuugcuguacaagcuaugcuauuuuacgcucccguucggggagagucagguagcaauuugugauggaaacuuuacuauccccgacaauagccgauacucucaagacaugcacugccugaucagauacaugcuugaaccugauccagacaagaggcccgauauuuaucagguguccuacuucucauucaaacuguugaagaaagaguguccuauaccaaacguccagaacagccccaucccugccaagcucccagaaccggugaaagcuagugaggccgcggcaaagaaaacccaacccaaggcccggcugacagacccuauuccaacuaccgagacaucuaucgcuccccgucagcgcccuaaggccggccagacccagccaaaucccgguauauuaccgauucaaccugcacugacgcccagaaaaagggcuacuguucagccaccuccccaggccgcgggguccagcaaccagccaggccuccuugccucggugccccaaccuaagccacaggcaccgcccucucagccucugccacagacacaagcuaaacagccccaggccccuccaacaccccagcaaacuccguccacacaggcucagggauugccugcccaagcacaggccaccccacagcaccagcaacagcuauuucugaagcagcagcaacagcagcagcaacccccucccgcucagcagcaaccagcgggcacguucuaucagcagcagcaagcacagacccagcaguuucaagccguccauccugcuacacagcagcccgccaucgcacaguucccagugguaucacaagggggaagucagcagcagcucaugcaaaauuuuuaccagcagcaacagcagcagcaacagcagcagcaacagcagcagcuggccacugcccuucaccaacagcagcugaugacccaacaggccgcauugcagcagaaaccgacaauggcggcuggucaacagccucagccccagccagccgcagcuccccaaccugcuccagcccaggaacccgcaauccaggcuccuguucggcagcaaccgaaggugcagacuaccccacccccugccguccagggccagaagguggggagccucacaccacccuccucuccuaaaacccaacgagcgggacaucgccggauucugagcgaugucacucacucagccguguucggcguuccggcuaguaaguccacgcaguuacugcaggcagccgcugccgaggcaagccuaaacaaaucuaagucagcgacaaccacucccagugguagcccaaggaccucccaacagaauguguauaacccuucugaagggucgacauggaaucccuuugacgaugacaacuucagcaaacucaccgccgaggaacugcuuaauaaggauuuugcuaaguugggcgagggaaaacacccagagaagcugggcggguccgccgaaucacucaucccuggauuccagaguacucagggugacgcauuugcuacaacgucuuucagcgccggcaccgcagagaaacggaaagggggacaaacuguagauuccggccugccccuucugucagucagcgacccauuuauuccgcuccaggugccugacgcccccgaaaaguugauagagggucugaagucuccagauacauccuuacugcuacccgaccuccugccuaugaccgauccauucgggaguacaagcgacgcuguuaucgaaaaggcggauguggccgucgagucucuuauucccggcuuggagccuccggugccacagcgccugcccucccagacugaaucaguaaccaguaacagaacggacagccucaccggagaggauucgcuguuagacugcucccugcuuucuaauccuacaacugauuugcucgaagaguucgcacccaccgcuaucagcgccccagugcauaaagccgcugaggacucaaaccugaucaguggcuuugauguuccugaaggguccgacaaggucgcagaggaugaguucgaccccauuccagugcuaauaaccaaaaauccucaaggaggccacucuaggaacagcuccgguucaagcgaaaguucucugccgaaucucgcccguucccugcuuuugguggaccagcugaucgauuuauga

SEQ ID NO: 52251 - RNA, 759 nt, Artificial Sequence
  derived and/or modified sequence opt3 from AANAT__Homo_sapiens__NP_001160051
auggagccccagagcaugaagggccagaaaagaccuuucgggggaccauggaggcugaaggugcucgguggcccgcccuggcuucggcgcacccugccuaaauuggggcgaccaaaggaagcccccgucgcucguauguccacacaaucuacucacccuuuaaaaccagaggcacccagacugccuccaggaaucccggaaucacccaguugccagaggcggcauacgcuaccugccagcgaguuucgcugucucaccccagaagacgcgguuuccgcuuucgagauugagagagaagccuuuauaucugugcugggcguaugcccccuuuaccuggaugagaucaggcacuucuugacacucuguccugaacugucgcuggguugguuugaggaggggugccucguggcauucauuaucggaucauuaugggacaaggaacggcugaugcaggagagccuuacuuugcaucgcaguggcggccacauugcccaucugcacguccuagcugugcaccgagcauuuagacaacaggggaggggaccaauccuccuguggcgguaucuucaucaccuggguucccagcccgccguucgucgcgcugccuugaugugugaagaugcgcucgugccguucuacgagagauuuucuuuccaugcagucggcccuugcgccauaaccguggggagccugacauuuauggaauuacacuguucccugaggggacaccccuuccuccggcgaaacucaggcugcuga

SEQ ID NO: 52252 - RNA, 468 nt, Artificial Sequence
  derived and/or modified sequence opt3 from AARD__Homo_sapiens__NP_001020528
augggccccggggacuucagaaggugccgggagcgcaucagccagggacugcaaggucucccuggccgagccgaacuuugguuuccaccgcgucccgcuugugauuucuuuggggacggaagauccaccgauauucaggaggaagcacuggccgcgucuccuuuguuagaggaccugaggcggcgccuaacaagagcuuuccagugggccgugcagagggcaauaucacggcgcguccaagaagccgcugcagccgcugccgcgcgagaggagcagaguuggacuggcguugaagcaacgcucgccagacugagggcugagcuuguggaaaugcacuuucagaaccaucagcuggcccggaccuugcucgaucugaauaugaagguacaacagcugaaaaaggaguacgagcucgaaaucacaagcgacucccagucuccaaaagaugacgcagcuaaccccgaguga

SEQ ID NO: 52253 - RNA, 2958 nt, Artificial Sequence
  derived and/or modified sequence opt3 from AARS2__Homo_sapiens__NP_065796
auggccgcuagcguggcagccgcggcuagaaggcugcggcgcgccauccgacguucccccgcauggagaggccucucucacaggccucuuucaagugagccaccggccgcuaaggcaagcgccguccgggcugccuuccugaacuuuuuccgcgacagacaugggcacagguugguucccuccgcgucugugcggccucgcggagauccaucguuacuguuuguaaaugcagguaugaaccaguucaaacccauuuuucuaggcaccguggacccucgaucagaaauggccggguucagaagggucgcuaauagccaaaagugcgugcgggccggaggccaucacaacgaucucgaggacguuggucgugaucugagucaucacacauuuuucgaaaugcuugggaauugggcauuuggaggcgaguacuucaaagaagaggcuuguaacauggccugggagcuguugacucagguguauggcauaccagaagagaggcucuggaucuccuacuuugacggggaucccaaggcgggacuggacccugaucuggaaacgagagacauuuggcucucuuuaggugucccagccagcagggugcuguccuucggcccgcaggagaauuuuugggagaugggggauaccggacccugcggcccuuguacagaaauccacuaugaccuugcuggugggguaggagcaccacaguugguugagcuguggaaccuaguguucaugcaacauaaucgggaagccgauggcucacuccagccccugccucagcgacacgucgacacuggcauggggcuugagcgccugguggcuguguugcagggaaaacauaguaccuacgacacagaucucuucagcccacuguuaaacgccauucaacaggguugcagagcacccccguaucugggcagggucgggguugccgacgaaggacggaccgauacugcuuaccgcgugguagcggaccacaucagaacacucucuguguguauauccgauggcgucuuuccugguaugucagggcccccacuugugcugaggcguaucuugcggcgagcaguuagauucagcauggagauucuaaaggccccucccggcuuucugggaagucucgugccagucgugguagagacccugggcgacgcuuaucccgaacuucagcgcaauucugcccagaucgcaaaccugguuuccgaggaugaagccgcuuucuuggccagccucgagcgcgggcggagaauuaucgacaggacgcugcgcacuuuaggaccuucggauauguuuccagcagaaguggcguggucucugucccuaugcggugaccucggccugccgcuugauauggucgaguugaugcuggaggaaaagggggugcaacucgacucagcuggacuggagcgacuugcccaggaagaggcacagcaccgggcccgucaagcugaacccguccagaaacagggccugugguuggacgugcaugcccucggugagcugcagagacaagggguuccuccaaccgaugacagucccaaguacaauuacagcuuaaggccuuccggcucuuaugaguucggaacaugugaagcacaggugcugcagcuauacacugaggauggcaccgcuguagccagcgucgggaaaggacagcgcugcggucuccugcuugaccggacaaacuuuuaugcggaacaaggcgggcaggccucagauagaggauacuuggugagggcuggccaggaggacguucuguucccaguggcacgagcccaggucugugguggguuuauacuccacgaggcuguggcccccgaaugccugcgcuuaggcgaucaaguacagcugcauguggacgaggcauggcggcuuggauguauggcgaagcacaccgccacgcauuugcucaauugggcucugagacagacucuaggcccggggacagaacagcaaggaagucaccugaacccugagcagcucaggcuggauguuaccacucagacaccacuuacccccgaacaauugcgugccgucgagaacacggugcaggaggcagugggccaggacgaagcugucuauauggaggaaguuccucuggccuuaaccgcacaggugcccggucuccgcucccuggaugagguguacccagacccuguacgggucgugagcguuggggugcccgucgcccacgcucuugauccagcgucucaagccgcacugcagacaucaguggaauugugcugcggaacucaucuccugagaaccggcgcuguuggugaccuagugauuaucggcgacaggcagcugaguaaagggacaacucgacuccuggccguaaccggagagcaggcccaacaggcucgggagcuuggccagagcuuggcacaggaagucaaggccgcgacagagcgccuguccuuagggucuagagauguggcugaagcccucaggcugucgaaggacauuggacggcuuaucgaggcaguggaaaccgccgucaugccgcaauggcagcgaagagagcugcuagcuacuguuaaaaugcuccagcgcagggcaaauacggccauccguaagcugcaaaugggccaggcggcuaaaaagacacaggaguugcuggaacggcacagcaaagguccuuuaauuguggauaccguauccgccgagucacucagugugcuggucaaggugguuagacagcuuugugaacaagcacccucuacuagcgugcuguugcucuccccacagcccauggggaaaguccugugcgccugucagguggcucagggagccaugccuaccuucacagcagaggcuugggcccuagcgguuugcucacauaugggcgguaaggccuggggcagcaggguggucgcacaagggaccggaucuacuacagaccuggaggcugcccuuuccauagcucagacguaugcacucagucagcuguga

SEQ ID NO: 52254 - RNA, 2907 nt, Artificial Sequence
  derived and/or modified sequence opt3 from AARS__Homo_sapiens__NP_001596
auggacagcacccugacagccuccgagaucagacagagguucauugauuucuucaagcggaacgaacacacuuacgugcauucuucagcuacgauaccccucgacgauccuacccuucuguuugcaaaugccggcaugaaccaauucaaaccaaucuuuuugaauacaauugacccgagucaccccauggcgaaguuaagccgcgcugccaacacucagaaaugcauccgagcagggggaaagcauaaugaucuggacgaugucgguaaagacguuuaucaccauaccuucuuugagaugcuaggcuccuggucuuucggggauuacuuuaaggaacucgccuguaagauggcucuggagcuucugacacaggaauuugggauuccuaucgagcguuuguaugugaccuacuuuggcggugacgaggcagccgggcucgaagcugaucuggagugcaaacagauauggcaaaaccugggacucgacgauacuaagaucuuaccaggcaauaugaaagacaacuucugggaaaugggcgacacagggcccuguggaccuugcucggagauucacuaugauagaaucgguggcagggacgccgcgcaccugguaaaucaggaugacccaaacgugcuugagauuuggaauuuggucuuuauccaguacaaccgggaagcagaugggauacugaagccccuaccuaaaaagucaauugacaccggaaugggccucgagcgccuggugagcguucuucagaauaagaugaguaacuaugauacggaccuguucgugccauacuucgaagccauccaaaaagguacuggggcuagaccguacaccggaaaggucggcgccgaggaugcagacggcauugauauggcuuauaggguguuggccgaccaugcgcggacaaucacuguagcccucgcagacgggggacgccccgauaauaccggucgaggcuacguucugagaaggaucuuacggcgugcugugcgcuaugcccacgaaaaacugaacgcuuccagaggguuuuucgccacacucgucgacguggugguccagucucuuggagaugcauuuccugagcugaagaaagacccagauaugguuaaggacauuauaaacgaggaagaggugcaguucuugaaaacccuaagcaggggccggcgaauccuggaucgcaagauucagucccucggugacucaaagacgauccccggggauacugccuggcugcuuuacgacacauauggcuuuccuguagaucugaccggauugauagcugaagagaaaggccucguggucgacauggauggguucgaagaggagagaaagcuggcgcaauuaaaaagucagggaaagggugcaggcggggaagaccugauuaugcuagacaucuacgccaucgaggaacucagggcucggggacuggaggugacugaugacagcccaaaauauaauuaccaucuugauucuuccggcucauacguuuuugaaaacacaguggccaccgucauggcauugcgcagagagaagauguucguggaggaaguaagcacgggucaggagugugggguugugcuggacaagaccugcuuuuaugccgaacaaggcggacagauuuacgaugagggcuaucucgucaaaguggacgauaguucugaggacaagacagaguucacugucaaaaaugcucaggugaggggaggauacguucugcacaucgguaccauuuauggcgaucuuaaggugggggaccagguauggcuguuuauagaugaaccccgucggcgaccgaucauguccaaccacacagccacucauauuuugaauuucgcacucagaagcguccugggagaagcggaccaaaaaggcucguuaguggcuccugauaggcugcgcuuugacuucaccgccaagggugcaaugucuacacagcagaucaagaaagccgaggaaaucgcuaacgagaugauugaggccgcaaaggcuguuuacacccaggacuguccccuagccgcggccaaagcuauacaagggcuccgggcaguguucgaugaaacuuauccagacccugucagagugguauccaucggcgugcccguuucagagcugcuugaugacccaaguggacccgccggcagcuugacguccgucgaauuuugcgggggaacacaccugaggaacucuagccaugcuggcgccuucgugauugugaccgaggaagcaaucgcgaaggguauucgccgaaucgucgccguuacuggggcugaggcccagaaagcacuccggaaggcugagucacugaagaaauguuuaagugugauggaagccaaggugaaagcacagaccgccccuaauaaggauguacagcgugagauagcugaccugggagaagcgcuugccacagcagucaucccacaauggcagaaagaugaguugagagaaacccucaagucccugaaaaaggugauggacgaucuagacagggcuagcaaggccgauguucagaaacgcgugcuggagaagacuaaacaguuuauugacucuaauccgaaccaaccccucgucauccuggagauggaaucaggcgccagugcuaaggcacuuaaugaggccuugaaacuguucaagaugcacagcccucagacauccgcgauguuauuuacgguggacaacgaagcugguaagauuaccugccucugucagguuccacaaaaugccgcaaaccggggccugaaagccucugagugggugcagcagguaucggggcuuauggauggaaagggcgggggaaaagacgucagcgcucaggcaacuggcaagaauguggguugccugcaagaggccuugcagcucgcgacauccuucgcucagcugagacuaggggaugugaaaaacuga

SEQ ID NO: 52255 - RNA, 2997 nt, Artificial Sequence
  derived and/or modified sequence opt3 from AASDH__Homo_sapiens__NP_001273597
augaagaaaugcaaccugaaguacauccucguggagaaaaagcagauuaauaaauucaagagcuuucacgaaacccuucugaacuaugacacauucacugucgagcauaaugauuugguuuuauuuagacugcacuggaagaacacggaagugaaucuaaugcucaacgacggcaaagagaaguacgaaaaagagaagauaaaauccaucucuucagagcauguaaaugaagagaaggccgaggaacacauggaucugaggcuuaagcauugucuggcuuauguguugcacaccagugggacaacugguauucccaaaaucguccgggugccucacaagugcauuguuccaaacauccaacauuuccgcgugcucuuugacauaacccaggaggauguccuguuccuggcaagcccgcucacauuugaccccuccgugguagaaaucuucuuagcccugucuucgggagcgucacuuuugauuguuccuaccagcgugaaacugcuaccaaguaagcucgcuuccguccuguuuucucaccaucgagugacugugcuucaggccacacccacccuguugcguagauucggcagccagcucaucaaauccacgguccugucagcaacuaccaguuuaaggguucuggcccucgggggagaggcuuuuccuagccuuacagugcugcggucuuggcgcggcgaagguaauaagacucaaauuuucaacguauacgggaucaccgagguguccucaugggcaacaauauauaggauuccagagaaaaccuugaauagcacgcuaaagugugaacugcccguccagcucggauuuccucugcuuggcacugugguugaggugagagauacaaacggcuucaccauccaggaagggaguggacaggucuuccuggguggccggaaucgcgugugcuuuuuggacgaugagguaacuguuccacucgggacaaugcgagccaccggagacuucgugacggucaaggauggcgaaaucuuuuuccuggguagaaaagacucucaaauuaagaggcacgggaaacgguuaaacaucgagcuggugcagcaggucgcugaggaacuacagcaaguggaguccugugccguuaccugguacaaucaggaaaagcucauucuguuuauggugagcaaagaugcgucgguaaaggaguauauauucaaggaacuucagaaauacuugccgucucacgcaguccccgacgagcuggugcucaucgacucccugccuuuuacaucacauggaaagauugauguuagugaacuuaacaaaaucuaccugaacuauauaaaucucaagagcgagaacaaauuguccggcaaggaggaccugugggaaaaguuacaauaccuguggaaaucuacucuaaaucucccagaggaucugcuucgugugcccgacgagagcuuguuccugaacucaggcggggauagucucaaguccauucgccuguuaagcgaaaucgagaaacuggucggaaccucugugccuggucuuuuggaaaucauucucucaaguagcauccuggagauuuauaaucacauacuacagacaguagugccagacgaagauguuacuuuuagaaaguccugcgccaccaaaaggaagcugucugacaucaaccaggaggaggcuucgggcacaagccuccaucagaaggccauuaugaccuucacuugucacaaugaaaucaacgcauuugucgugcugucccgggggucacaaauccuuaguuugaacucuacgcgauuccugacaaaauuaggacauugcagcuccgcuugucccucagauagcgugucucagaccaauauucagaaucucaagggccugaacuccccgguccuuauagguaaaaguaaggacccuagcugcguugccaaagugucugaggaagggaagcccgcgaucggcacucagaaaauggagcugcacgugcgcuggagauccgauaccggaaaguguguagacgccucaccauuggucgugauuccuacauuugacaagaguagcaccacuguuuacaucggcucgcacucccauaggaugaaagcaguggauuucuauucugggaaggucaaaugggaacaaauucucggagaccggaucgagagcucagcuugcgugaguaagugcgguaauuucauaguugugggcuguuacaacgggcugguauauguccuaaaauccaauucuggagaaaaguacuggauguuuacaacggaggaugccgucaagagcuccgcuaccauggaccccacuacaggccugaucuacauugguucacacgaucagcaugccuaugcacucgacaucuaccgcaaaaagugcguguggaaaagcaagugugggggcaccguguucaguucuccaugccugaaccuuauuccccaccacuuguauuuugccacacugggaggcuuacuccuggcuguuaacccugcgacugggaaugugaucuggaaacauuccuguggaaagccacuuuucagcucgccgcagugcuguucacaguacauaugcauugguuguguagauggcaaccugcuaugcuuuacccacuucggggagcaaguguggcaguuuucuacgaguggacccaucuucuccagcccuuguaccucuccaagcgaacagaagaucuuuuucggcucccaugacugcuuuauuuauugcuguaauaugaaaggucaccuccaguggaaguucgagacaacuucaagagucuacgcaacccccuuugccuuccauaacuauaaugggaguaacgaaaugcuguuggcugccgcaagcacagauggcaaaguguggauacuggagucucaauccggacaguuacagucaguuuacgaacucccuggcgagguguucaguagcccagucgugcuggaguccaugcuuaucauugggugcagggacaauuacguuuauugucuggauuugcucggaggcaaccaaaaguga

SEQ ID NO: 52256 - RNA, 930 nt, Artificial Sequence
  derived and/or modified sequence opt3 from AASDHPPT__Homo_sapiens__NP_056238
augguguuccccgccaagagauuuugccuggucccuagcauggagggcguuaggugggcuuucuccugugggaccuggcucccaucucgggcagaauggcuucuggccgugcgcucaauccagccggaggaaaaagagcgaauuggacaauuuguauucgcgcgugacgcuaaggccgcaauggccgguagauugaugauaaggaaauuaguggcugaaaagcugaacauccccuggaaucacauucggcuacagcgcacagcaaaaggcaagccuguccucgccaaggauaguagcaacccauaccccaauuuuaacuucaauaucucccaucagggggacuaugcugugcuggccgcggagccugagcuucagguuggaauugauaucaugaaaacuucuuuuccaggcagagguucgauacccgaguucuuucacaucaugaagaggaaauucacgaacaaggaaugggaaaccauucggucauuuaaagacgaguggacacaacuggauauguucuaccgcaauugggcauugaaggagagcuuuaucaaggccauuggggugggacucggcuucgaacugcagcgacuggaguucgaccucaguccuuuaaaccuggauaucggccaggucuauaaagaaacuagauuguuucuugacggggaggaagagaaggagugggcuuucgaagaguccaaaauagaugaacaucacuuuguggccguagcacugaggaagccagacggaucucggcaucaggauguuccgagccaagacgauuccaaacccacccagcgucaguucacaauucuaaauuuuaacgaccucaugucaagugcugugccuaugaccccagaggaccccagcuucugggauugcuuuuguuucacugaagagaucccuauucgcaaugguacaaagucuuga

SEQ ID NO: 52257 - RNA, 2781 nt, Artificial Sequence
  derived and/or modified sequence opt3 from AASS__Homo_sapiens__NP_005754
augcuccaggugcacagaaccggccuggggaggcuuggagucagccuguccaaggguuugcaucacaaagccguuuuagcugugcggcgcgaggacguaaacgcaugggaacgacgugcgccccuggccccuaagcauaucaaaggcauuacaaaucuaggguacaaggugcucauacaaccaucuaacagaagggcuauccacgauaaagacuaugucaaggccggaggcauucugcaggaggauaucucagaagcaugccuuauucugggugugaagcggccgcccgaggaaaaauugaugagucgcaagacuuacgccuucuuuagccauacgaucaaagcucaggaggcaaauauggggcuccuggacgagauacugaagcaggaaaucagacucauugauuaugagaaaaugguugaccacaggggagugcgggucguggccuucggccaaugggcuggcguagccgggaugaucaacauuuuacacggaaugggucugcgccuuuuggcgcugggccaucacaccccuuuuaugcauaucgggauggcacacaauuaccgaaacuccucucaggccguucaggcugugagagaugccggauaugaaauaucgcuaggccucaugccaaagucaauugguccccugacauucgucuuuacugggaccggaaaugugagcaagggcgcacaggcuaucuucaacgagcuuccuugugaguacguggaaccacacgagcugaaagaagucagucaaacaggcgacuugaggaagguuuaugggaccgugcucucccggcaucaccaucugguacguaaaacugaugccguguacgaccccgcggaguacgauaagcacccugaacgcuauauuucuagauuuaauacagacaucgccccauacaccacgugcuuaaucaacggaauuuauugggagcagaauacuccgaggcugcucacccggcaggaugcacagagccuucuggcucccgguaaauucuccccugccggcgucgagggguguccagcuuugccccauaagcuaguggccauaugcgacaucucagcagacacaggaggcaguauugaauuuaugacugaguguaccacaaucgaacacccuuucugcauguacgaugccgaccaacacauaauucaugauagcguugaggguucugggauccugauguguuccaucgacaaccucccagcucagcugcccauugaagcgaccgagugcuuuggcgauaugcuuuauccguacguggaggaaaugauccugucagacgcaacgcagccuuuggagagccaaaauuucagucccgucgugcgagaugccguaauuacuucuaacggaacacucccagacaaauauaaguacauacagacccugcgcgaauccagagagagggcucagagcuuaucgaugggcacucggcgcaagguucuggugcuagggucuggauacaucuccgaaccuguccucgaguaucugucaagagaugguaauauugagaucacagugggcagugacaugaaaaaccagaucgaacaacuugggaagaaauacaacauuaaucccgucagcauggauauauguaagcaggaggaaaaauugggauuucugguggccaagcaggaccucguuaucucccugcuuccauaugugcugcaccccuugguagcaaaggccugcauuaccaacaaagucaauauggugacggcuucuuacaucaccccugcccucaaggagcuggagaaaagcguugaagacgcaggcauuacaaucauaggugaguuagggcuggauccaggccuagaccauaugcucgcgauggaaacuaucgauaaggcuaaagaggugggagccaccauugaaucauauaucaguuacuguggcgggcugccggcacccgagcacuccaacaauccucuuagguauaaguucagcuggucuccagucggaguguugaugaacguaaugcagucagccacauaccugcucgacgguaaggugguuaaugucgcuggcgggauuaguuuccuggaugccgugacuagcauggacuuuuuccccggauuaaaccuggagggcuacccuaaucgugauuccaccaaauaugcagaaaucuacgguauaucuucggcucacacacuuuugcgggggacccuccgauauaagggcuacaugaaagcccugaacggauuugugaagcuaggccugauuaauagagaggcgcucccagccuucaggcccgaagcuaacccgcugacuuggaaacaacuuuugugcgaccuggucgggaucagcccuuccucagagcaugauguuuuaaaggaagcagugcucaagaaacugggaggcgacaauacgcagcuugaggccgcugaguggcuggguuugcucggggaugaacaggugccacaggccgagaguauucuggacgcacuaucuaagcaccugguaaugaaacucagcuauggacccgaagagaaggauaugaucgucaugcgcgacuccuuuggcauacggcauccuucaggucaccuggaacauaaaacaaucgaccuuguggcguacggcgauauuaacggguucagcgccauggcuaagaccguuggauugcccacugccauggcagcuaaaaugcuguuagacggcgagaucggggccaagggacucaugggcccauuuucuaaggagauuuaugguccuauccuggaaagaauaaaagcagaggggauuaucuacaccacacaauccaccaucaagcccuga

SEQ ID NO: 52258 - RNA, 1683 nt, Artificial Sequence
  derived and/or modified sequence opt3 from AATF__Homo_sapiens__NP_036270
auggccggcccccagccucuggcucuccaacuugagcagcuguugaacccaagaccgagcgaagcagaccccgaggccgauccugaagaggcgaccgcugccagggugaucgaccgguucgaugaaggggaggacggagagggugauuucuuagucguuggcuccauucgcaagcuggcaucugccucacuacucgacacagauaaacgauacugcgggaagacuacgagucguaaagcauggaaugaagaccacugggagcagacccugccaggaagcuccgaugaagagauaucugacgaggaaggcucgggugaugaggacucagaagggcuuggacuggaggaauaugaugaggacgacuugggcgcugccgaggaacaggaguguggcgaucacagagaaagcaagaaaaguaggucccacucugcuaagacacccggguucagcgugcaauccaucucagacuuugagaaguucacuaaaggaauggaugaccucgguaguagcgaagaggaggaagaugaggaaucuggcauggaggaaggggacgaugccgaggacucccagggagagucagaagaggaucgggcgggcgaccgcaacagcgaagaugacgguguagugaugaccuuuaguucugucaagguguccgaggagguugaaaaagggagagcagugaagaaucagauugcccugugggaccagcugcucgagggaaggaucaaauuacaaaaggcucugcuuacaaccaaccaguugccucagccagaugucuucccccuguuuaaggacaaaggcggcccugaauuuagcucggcccuaaagaacucucauaaagcacucaaggcucugcuucggucccuggugggguugcaggaggaacuccuguuucaauacccagauacucgcuauuuaguagacggaacaaaaccgaaugccgguucagaggagauuaguagcgaagaugacgagcugguugaagagaagaaacagcagcgaagaagggugcccgcgaagcggaagcucgaaauggaggauuacccuuccuucauggccaaacguuuugcagacuucaccgucuaucgcaauagaacgcuucaaaaguggcacgauaaaacuaagcuggcuucuggcaaauuggggaagggauuuggcgccuucgagaggagcauccuaacccagauagaccauauccugauggauaaggaacggcuccugcgacgcacacagacuaaaagaucaguguacagggugcuugguaagccagagcccgcugcccagccugucccagaaagucugcccggggagccggaaauuuugccucaagcacccgccaacgcucaccucaaagaccuggaugaggagaucuucgacgacgaugacuuuuaucaccaguuacugcgggaacuaauugagcgcaagaccuccagccucgauccaaaugaccagguugcgaugggcagacaguggcuggcaauccaaaaacuuaggucuaagauacauaagaaaguggaucguaaggccucaaaaggacggaaguugcgauuccacguacugaguaaacuccugagcuuuauggcuccuauugaccauacaaccaugaacgaugacgccagaacggaacuuuacaggucccuguucggccaguugcaucccccagaugaggggcacggagacuga

SEQ ID NO: 52259 - RNA, 4125 nt, Artificial Sequence
  derived and/or modified sequence opt3 from AATK__Homo_sapiens__NP_001073864
augagcuccucuuucuuuaaccccucauucgccuuuaguagccacuucgacccugauggcgcuccacuguccgaacucucuuggccgucgucacuugcaguggucgccguuagcuuuagugggcuguucgcggugaucguauugauguuagcuugccuguguugcaagaaaggagguauuggcuuuaaggaguucgagaaugccgaaggggacgaguacgcagccgaucuagcucagggaucccccgcaaccgccgcucaaaacggcccugacguguauguccucccacugacagaagugucucuucccauggccaaacagccugguagaagcguucagcuguugaaguccacugauguggggaggcauucacuccuguaccugaaagagauaggacggggcugguuuggcaaggucuuccucggggaggugaauaguggaaucagcucugcgcagguaguugugaaggaauuacaagcauccgccucaguccaggagcagaugcaguuucuggaagaggugcaaccauaucgcgcucuuaaacacagcaacuugcugcagugucuagcccagugcgcagaggugacgcccuaccuccuggucauggaguucuguccucuuggugaccugaagggcuauuugcgaaguugccguguugcugaaucuauggccccagauccgagaacccuccagaggauggcgugugaaguggccugcgggguacugcauuuacaccggaauaacuuugugcauuccgaccuggcacuccgcaauugucuucugacagcugauuugacugucaaaauuggagacuacggccuagcccacugcaaguauagagaggauuacuucgugaccgcugaccaacuguggguuccccucagguggaucgccccugaacugguggaugagguccacagcaaccuucuggugguagaccagacaaaaucggguaauguuuggucuuugggggugaccauuugggaacucuucgaacugggaacucagccauacccccaacauuccgaccagcaggucuuagcauauacagugcgggagcagcaacugaagcuaccuaagccacagcuccagcugacccuuucagaucgcugguacgaagucaugcaguuuuguugguugcaacccgagcagcgaccgacggccgaagaggugcaucugcuccugaguuaucuuugcgcuaaaggcgcgacugaggcagaagaggaguucgaaagaagguggcggagccugcguccuggcgggggagguguuggccccgggccaggagccgcuggcccuauguuggguggggugguagaacucgccgcagccuccucuuuuccccuguuagagcaguucgcuggcgacggauuucacgccgauggcgacgauguccugaccgugacagagacuagccgcgggcuaaacuucgaauacaagugggaggcaggaagaggugcggaggcuuuuccagccacccucucacccggcaggacagcacggcugcaggaacuuugcgccccugacggggcuccaccgggaguugugcccgucuugagugcccacuccccuagccugggcucugaguauuucauccgacucgaagaggcagcuccagccgcgggucacgaucccgacugugccgggugcgcuccuucaccacccgcaaccgccgaucaagacgaugacagugacggcagcacggcugccucccuggcaauggaaccguuacugggacauggcccuccaguggauguacccugggggcgcggagaccacuacccuagaaggucucuugcgcgggaucccuuguguccaucgcgcagcccuucccccucagccgguccacucagucuggcugagggcggggccgaagacgcagauuggggaguggcugccuuuugcccggcauucuuugaggacccucuaggcacuucuccccuggguagcuccggggccccaccccucccucugacaggcgaggaugaacuugaggaaguuggagcuagaagggcggcccagcguggccauuggcggucaaaugucagcgcaaacaauaacucugggucccgauguccagagaguugggaccccgugagcgcuggaggccacgccgaagguugcccuucuccgaaacagaccccaagagccucccccgagccuggguauccaggagagcccuugcugggcuuacaggcugcaucagcccaagaaccugguuguugcccgggccucccccaucuguguagugcgcaggggcuugcuccagccccuugccuggugacucccagcuggacagagaccgcaucguccggaggcgaucacccacaggccgaaccuaaguuggcuacggaggcagaagggaccacaggacccaggcucccacugccgucugucccuagccccucacaagagggcgccccacuacccagugaggaagcguccgcuccugacgccccagaugcacugcccgacucuccuacuccggccaccgguggggagguuagcgcuauaaaacucgccuccgcacugaauggaucaagcaguucuccagaaguggaggcucccuccagcgaggaugaagacacagccgaggcgacuucgggcaucuucaccgacacaucaucugauggucuucaggcccgccggccugacgugguacccgcauuuagaaguuugcagaagcaggucggcaccccagauucccuggacagcuuagauauuccuucuagcgcuuccgacgggggauacgaaguguucucacccagugccacuggcccaagcgggggacaaccuagggcucucgauucuggcuacgacacggagaacuaugaauccccggaguucguucugaaagaggcacaggaagguugugagccccaggccuuugccgaacuugcuucagagggggaaggaccaggcccugagacacgccugaguaccagccuauccggucucaacgagaagaaucccuaccgagauucugcguauuucucggaccuggaagcagaggccgaagcuacuagcggcccagagaagaaaugcgggggagaucgggccccuggccccgaauuggggcugccgucaaccggacagccauccgagcaagugugcuuacguccuggcgucaguggugaggcacaggggucuggacccggcgaagugcucccaccccugcuucagcuggagggcagcuccccugaaccgucaacaugucccucuggguugguuccagagccucccgagccucagggaccagccaaggugagacccgguccuagcccaaguugcucccaauuuuuccuccugacccccguaccgcuaaggagcgaaggcaacucuucagaguuucaggggccuccaggacugcuuuccggccccgcuccucagaaacgcaugggugggccaggaacuccccgggcgccgcucagacuggccuugccuggccugcccgcagcuuuagaaggcaggccagaggaagaggaggaagacagugaggauagcgacgaaucggacgaggaacuccgauguuacucuguccaagagccuuccgaggauagcgaagaggaagcccccgcagugccaguggucguugccgagucacagagugcucgcaaucugcggucucuucugaagaugcccuccuugcucagcgaaacauucugcgaggaccuggagaggaaaaagaaggccgugucauuuuucgaugacguaacgguguaucuauuugaucaggaaaguccuaccagagagcugggggaaccauucccgggagcgaaagagagcccucccacuuuucuucgugguuccccaggcucucccagcgcaccuaaccgcccacagcaagccgacgggucccccaauggaucaacagcugaggaaggcgguggguucgccugggaugacgauuuuccucucaugaccgcuaaggcagccuucgcuauggcccuggacccggcagcgccagcccccgcugccccuacacccacuccagcaccuuucucucgguuuaccgucagucccgcuccaacgucgagauucagcaucacccacguguccgauucugacgccgagucaaaaaggggaccggaagcaggcgccggcggggagagcaaggaggcuuga

SEQ ID NO: 52260 - RNA, 1503 nt, Artificial Sequence
  derived and/or modified sequence opt3 from ABAT__Homo_sapiens__XP_011520703
auggccagcaugcugcucgcucagagacuugcaugcuccuuccaacacucuuacaggcuguuggugcccggcucacggcauaucagucaggccgcggcuaaggucgacguugaguuugauuaugacgggccuuuaaugaaaaccgaagugccaggaccgcgcagccaggagcugaugaagcagcuaaacauuauacaaaaugccgaagcaguacacuucuuuuguaacuacgaggaaucccgagguaauuaucucguggaugucgacggcaaccguaugcuggaucuuuacucucagaucucgucagugcccauuggguauagccauccugcccuguugaaacucauccagcagccacaaaaugcuaguauguucguuaacagacccgcacugggcauucugccuccagagaauuuuguggagaagcucaggcaguccuuacugucugucgcccccaaaggaaugagccagcuuaucacaauggcuugcgguuccuguucaaacgaaaaugccuugaagacuauauucaugugguaccggaguaaggagcgcgggcagagaggauuuagccaagaggaacuggagacgugcaugaucaaccaggcgccuggcuguccagacuauucuauucuauccuucaugggcgcauuucacgggaggaccaugggaugccucgccacaacucauucaaaagcuauccacaagauugauaucccgagcuucgacuggcccauagccccuuuuccacggcugaaauacccccuugaagaguucgugaaggaaaaucagcaagaggaagcacgcugucuggaggagguagaagauuugauuguuaaauaccgaaagaagaaaaagaccguggcugguaucauugucgagccuauccagagugaaggcggggacaaccacgccucugaugacuuuuucagaaaacucagggauaucgcgcggaagcauggaugcgccuuccugguggacgaggugcagacaggcgguggguguaccggaaaauuuugggcacacgaacauuggggcuuagacgauccagcugacgucaugacuuucuccaagaaaaugaugacaggcggguuuuuccacaaggaggaguuucgucccaaugccccguaucgcauuuucaacaccuggcugggagauccuagcaagaaucuccuucuggcugaaguuauaaacaucauuaaaagagaggacuugcuaaacaaugccgcacacgccgguaaggcucugcucacgggccugcuugaucugcaggcgagguacccccaauuuaucucgcgggugcgagggcgcggaacuuucugcucuuuugacaccccagaugacuccauaagaaacaaauugauucucaucgcaaggaauaagggcguagugcuggguggguguggcgauaaaucaauccgguuccgcccuacauuagucuuuagagaccaucacgcccaucuguuccuaaacauuuuuagugauauccucgcugacuucaaguga

SEQ ID NO: 52261 - RNA, 6834 nt, Artificial Sequence
  derived and/or modified sequence opt3 from ABCA12__Homo_sapiens__NP_056472
auguucaccuacaucaagauuauaacaagcggcgacuccgauaacaucacucacguguggaaugaggacgaugggcagacgcugucucccucaagucucgccgcucaacuucugauuuuggaaaacuuugaggacgcauuacugaauaucagcgccaacuccccuuauauuccauaccuagcgugcgucagaaauguuaccgauucucucgcuaggggaucgccggaaaaccugcggcuucugcagucaacaauccgcuucaaaaagagcuuuuugcgaaaugguaguuaugaggacuacuuccccccugugccagaaguacucaaauccaagcugucucagcugcguaaccucacugaguuacugugugagagcgaaaccuuuucccuuauagagaaaucaugccaguugagugauaugagcuucggcucucugugugaagaguccgaguuugaccuacaacuccuggaagccgcagagcuugggacagaaaucgccgcuucacuguuguaucaugauaaugugauuagcaagaaggucagagaccuccugaccggagaucccaguaaaaucaacuuaaauauggaccaguuccuggagcaggcacuccagaugaacuaccuugaaaauauuacucaacugaucccuauaauugaggccauguugcacgugaacaauucugcugaugccuccgagaagccaggccagcuacuggaaauguuuaaaaacguugaggaacucaaggaggaccugaggcggacaaccgguaugagcaaccgcacgaucgacaaacuucuggcgauucccaucccugauaauagagcagaaaucauuucgcagguguucugguugcauucuugcgacacuaacauaaccacaccaaagcucgaggaugccaugaaggaguuuuguaaucuguccuuaucagaaaggagucggcagagcuaucugaucgggcuaacucuccugcacuaccuuaacauuuacaauuucaccuauaaagucuuuuucccgcgcaaggaccaaaaacccguggagaagaugauggaauuguucauccgacugaaagagauacucaaccagauggcuuccggaacacauccucugcuugauaagaugagaucucugaaacagaugcacuugccaaggagcguaccccucacccaagccauguaccggucaaaucguaugaacacgccucagggcaguuuuuccacuauuagccaggcacugugcucucagggcaucacaaccgaauauuuaacugcuaugcugccaucaagucaacgccccaaggggaaucacacaaaggacuuccuaaccuacaaacucacgaaggagcagaucgccagcaaauauggaauuccgaucaacuccaccccuuuuuguuucucucuguacaaggauauuauaaauaugcccgcggguccaguuaucugggccuuucuuaaaccuauguugcugggcagaauucucuaugcacccuacaacccagugacaaaggcuaucauggagaagucgaaugucacucugaggcaguuagccgaacugcgggagaaaagccaggaauggauggacaaguccccccuuuucaugaacucauuucauuugcucaaucaagcuaucccuaugcugcagaacacccuacgaaacccauucgugcagguguuugucaaauucaguguugggcuggaugccguggagcuccugaagcagauugacgagcuugauauauugcgccugaaauuagaaaauaacaucgacauuaucgaccaacucaauacacugucuagccuuacuguaaacauuuccucaugcgugcuguacgauagaauccaggcagccaagaccauagacgagauggaaagggaggcuaagcgguuguauaaaagcaaugaacucuuuggaucugucaucuucaagcugccguccaaccgcaguuggcacagaggcuacgauagcgguaauguguuucuacccccuguuauuaaauauacaaucaggaugucucugaagaccgcgcagacuacgcguucccuccggacaaaaauuugggcaccagggccccauaacucaccuagucacaaucagaucuacggacgagccuucauauaucugcaagacagcauugagagagcuaucauugagcuucagaccggcaggaacucgcaggaaaucgccgugcaaguccaggcaauaccauaccccuguuucaugaaggauaauuuuuugacuuccgugucuuauagccugccgaucguauuaaugguugccuggguggucuucauugcugccuuugugaagaaacucgucuacgagaaggaccugcgccuucacgaauacaugaaaaugaugggcgugaacucaugcagucauuucuuugcauggcugaucgaguccguuggguuccuacucgugaccauuguaauccugauaauuaucuugaaguuuggaaauauccugccuaaaacaaacgguuucauuuuauuucucuauuucucugauuacagcuuuuccgucaucgcgaugucauaucugauuagcguguucuuuaauaacaccaacauagcugcccuuaucggcagucugauuuacaucauugcauucuucccauuuaucguuuuggugacugucgaaaaugagcucucuuaugugcugaagguauucaugucccuacugagccccacagccuuuucguacgcuucacaguauauagcccgguacgaggaacaggggaucggacuucaaugggagaacauguacacgucuccugugcaggacgauaccacuaguuucggcuggcucuguugccugauuuuggcagacuccuuuaucuauuuccugauugcuugguacguuagaaaugucuuucccgguacauaugggauggccgcgccaugguacuucccuaucuuacccagcuauuggaaagaaagguuuggcugcgccgaggugaagccagaaaagucuaacggacucauguucaccaauauaaugaugcagaacacaaauccgagcgcuuccccugaguacauguuuucaaguaacauugagcccgaaccaaaagaucugacugugggcgucgcacuucacgggguuaccaagaucuauggaagcaaaguggccguggacaaucugaacuugaauuucuacgagggucauaucacgucucuccugggccccaacggggcuggaaagaccacaacuauuuccaugcuaaccggccuguucggugccucagcagggacaauauuuguauacggcaaagauaucaagacugaccuucacaccguccgcaagaauaugggaguguguaugcagcaugacguucucuucaguuaucugacgacaaaagaacacuuguuacuguacggcagcauuaaggugccucacuggaccaaaaagcaacuccaugaggaggucaaacgaacucugaaggauacagggcuuuauucccaccggcauaagcgugugggaacccugucugguggcaugaaaagaaaguugucgaucagcauugcgcuaaucgggggaucaaggguugugauacuggacgaaccauccacuggcguagaucccugcagucgccggucuaucugggacgucauuagcaaaaacaagaccgccagaacaaucauucucuccacgcaccaccuggaugaggcugaagugcuuucagacaggaucgccuuuuuagagcagggugggcugcgauguugcggcucuccuuucuaccucaaagaagcauuuggagauggcuaucauuugacccugacuaagaagaaaagcccgaaucucaacgcuaacgccgugugugacacaauggcagucaccgccaugauacagagucaccugccagaggcuuaccuuaaggaggauauugggggagaacugguuuauguguugcccccuuucuccacaaaaguaagcggcgcguaccuaucucugcuccgcgccuuagacaaugguaugggggaucugaacaucggaugcuacggcaucucagacacuaccguggaggaagucuuucuuaaucugacgaaggagucccagaaaaacagugcaaugagccucgaacauuugacacaaaagaaaauugguaauucgaacgcuaauggcaucucuaccccagaugaccuguccgugagcucaaguaacuucacugaccgggaugacaagauacucaccagaggggagaggcuggauggauuuggccuucuacugaagaaaauuauggccaucuugauuaagcguuuccaccauacacgccggaauuggaaaggguuaaucgcccagguuauacugcccauuguguuugucacuaccgcuaugggacucggcacacugagaaacucuuccaauagcuauccugagauccagaucucaccgagucuuuacgguacgagcgaacaaaccgcauucuaugccaacuaccaccccuccacugaggcgcuggugucugcuaugugggacuuuccagggauugauaauaugugucucaacacaagcgacuugcagugccugaauaaggauucccuagaaaaauggaacaccucaggagagccuaucacuaauuucggcguuuguucuugcagugaaaacgugcaggagugucccaaguucaacuauucgccaccucacaggcgaacauacagcucccaggucauuuauaaucugaccggucaacggguagagaacuaccucauaucuacggccaaugaauuugugcagaagcgcuacggcggguggucauucggacuuccccugacuaaagacuuaagauuugauaucaccggcguuccagcaaacaggacauuggccaaggugugguaugacccggagggguaccauagccugccugcuuaucucaauucccugaacaauuuccuucugcgggucaacaugaguaaauacgaugcagcccgacacggaauuaucauguauucucaucccuacccaggcgugcaggaccaggaacaagcgaccaucagcucacucauugacauauugguagcucuguccaucuuaauggguuauagugugacuacagccagcuuugucaccuacguugugagagagcaccagacaaaggcaaaacagcuacagcauauuucugggaucggagugacuugcuacugggucaccaauuucauuuaugauaugguguuuuaccugguucccguagccuucuccaucggcauaaucgcuauuuuuaagcucccugccuucuauucagagaacaaucuuggugcagugagccuguugcugcuccuguuuggcuacgcuacguucucguggauguaucuucucgccgggcuguuucacgaaacaggaauggcguucaucaccuacgucugcgugaacuuguucuuuggcauuaauucuaucguuagucuguccguggucuauuucuuaagcaaggagaaaccaaacgaccccacucuagaacugauaucagagacccucaagcgcauuuuucuuaucuucccucaauuuuguuucggguacggacugauugaauugucccagcagcagucugugcuggauuuucucaaagccuacggcguagaguauccgaaugagacauucgaaaugaacaagcugggugcaauguuugucgcucuugugagccaagggacuauguucuuuaguuuaaggcugcucaucaacgaguccuugauaaaaaagcugcgucuauucuuucggaaguucaauagcucucacguuagagaaaccaucgacgaggaugaagacgugagggccgagcgccugcgagucgagucaggagcugcagaauucgaucucgugcagcuuuacugccugacgaaaacauaucaguugauucauaagaaaaucauugccguuaacaauaucaguauaggcauuccagccggcgaguguuuugggcugcucggagugaacggugcuggcaagaccacuaucuucaaaaugcugacaggggacaucauucccuccagcggaaauaucuuaauaagaaacaagaccggcucucuuggucacgucgauucgcauucaagccuggugggguacugcccucaagaagacgcgcucgaugaccuaguaacuguggaggaacaccuguauuuuuacgcacggguucacggaauucccgagaaggauaucaaagagacaguccauaaguugcugaggcgccuccaccuuaugccauucaaagaccgugccaccuccauguguaguuauggcacgaagagaaaacugucuacugcuuuggcccugauuggcaagccuagcauccucuuacuggacgaacccuccucagggauggauccaaaaaguaagcggcaucuuuggaagauaaucucugaggaagugcagaauaaaugcagcgugauucugaccucccacucaauggaggagugugaagcacuaugcacaaggcucgccaucauggucaacggaaaguuucaguguauugguagccugcagcauaucaaaucucgcuucggccgaggguuuaccguaaaggugcacuugaaaaauaacaagguuacaauggagacucugaccaaguucaugcaacuccacuuuccuaaaacguaccuuaaggaccagcaucuguccauguuagaauaccacgugccggucacagcuggaggcguggcgaauauuuucgaucuguuggagacuaacaaaaccgcccucaauaucacaaacuuucugguuagucagaccacucuagaagagguguucauaaauuuugcaaaggaccagaaaagcuaugagaccgcugauacaucgucccaagguucuacgauuucagucgacagccaggaugaccagauggaaaguuga

SEQ ID NO: 52262 - RNA, 15177 nt, Artificial Sequence
  derived and/or modified sequence opt3 from ABCA13__Homo_sapiens__NP_689914
augggccacgcagggugccaguucaaggcucugcucuggaaaaauuggcuuuguagacugaggaauccaguguuguuuuuagcagaguucuuuuggccuugcauccuguucgucauucuaaccguucuccgguuucaagaaccaccgcgcuaccgagauauauguuaucugcagccccgugaucuuccuagcugcggagugaucccauucguacagucccuguuguguaacacagguucuagaugcaggaauuuuucauacgaaggcagcauggaacaucacuuccggcucagccgcuuucagacugccgcggaccccaagaaagugaacaaucuggcuuuccugaaggaaauucaagaucucgccgaagaaauccaugggaugauggacaaagcaaagaacuuaaagagacugugggucgagagguccaauacgccugauucuucguauggaucaaguuucuuuaccauggaccuuaacaaaacagaagaggugauuuugaagcuggaaagucuacaccagcagccacauaucugggauuuucuccugcuucugccccgguugcacacuucccacgaccauguugaggauggcauggacguggccgucaaucuccugcagaccauauuaaacucucugaucagccucgaggaucuugacuggcugccuuugaaucaaacauucucccaggugucagagcugguacugaacguuaccauuaguacucucacauuccugcagcagcacgguguggcugucaccgagccaguguaccaucuuagcaugcaaaauaucgugugggauccgcagaaaguccaguaugaccugaagucucaauuuggguucgacgauuugcacacggaacagauucucaacuccucagcagagcugaaagaaauccccacugacaccagcuuagagaagaugguuuguagugugcugucuuccacaagcgaggaugaagccgagaaguggggacacguaggcggcugccauccuaaauggucggaagcuaagaauuaccuagugcacgccgucucuuggcuccgcguguaucagcagguuuuugugcaauggcagcaggggucccugcuucagaaaacuuugaccggaaugggucauucacuggaggcgcuccgaaaccaauucgaagaggagaguaagccauggaaagucguggaagcacugcacacagcccuucuguugcucaacgacagccuguccgcugauggccccaaggacaaucauaccuuuccuaaaauauuacagcaccuguggaagcuacagucucuccugcagaaccuuccacaauggcccgccuugaagagauuccugcagcucgauggggcacugaggaaugcuauugcccagaacuuacacuuuguacaggagguucugaucugucuugaaacgagcgcgaaugacuucaaaugguuugaguugaaccaacucaagcuggaaaaagauguguucuuuugggagcuaaagcagaugcuggccaaaaaugcagucugcccgaacggacgguucucagagaaggaaguguuucucccucccggcaauaguuccauuuggggugggcugcagggacuuuuguguuacugcaacagcucugagacuucaguccugaauaaguuacucggcaguguggaagacgcugaucguauccugcaagagguuaucacauggcauaaaaacaugagcgugcuuauuccagaggaauaccuggacuggcaggaguuggaaaugcagcucuccgaggccucucugucgugcacccgccuauuccugcuccugggcgcugacccuagccccgaaaaugauguauucuccucagacuguaagcaccagcuugucaguacugugauauuucauacauuggagaaaacccaauucuuucuggagcaggccuauuacuggaaggcauucaaaaaguuuaucagaaagacgugcgaaguugcccaguaugugaacaugcaggagucuuuccaaaauagguuacucgcuuuuccagaagagagccccuguuucgaagagaacauggauuggaaaaugauuuccgacaacuacuuucaguuccugaauaaccuucugaagucaccuaccgcgagcaucucucgggcacuaaauuuuacaaaacaccuccugaugauggagaagaaauugcacacucuggaagaugagcagaugaacuucuuacucuccuuugucgaguucuucgagaagcugcuucugccaaauuuguuugacaguagcauagugccgucuuuccauucccuccccucacugaccgaagauauucuaaacaucaguagccuguggacaaaucaccuuaagucgcucaaacgagacccuuccgccacugaugcucagaagcuguuggaguuugggaacgagguaaucuggaaaaugcaaacccugggaucucauuggauucgcaaggaacccaagaauuuacucagauucaucgagcugauucuuuuugaaauaaaccccaagcuguuggagcucugggccuaugguaucagcaaaggcaagagggcaaagcuggagaauuucuuuacacuacugaacuucucagugccugaaaaugagauucuuaguaccuccuuuaacuucucucagcucuuucacagcgacuggccaaaaucccccgccaugaauaucgauuucguucggcugucagaagcuaucauuacuagcuugcaugaguucggguuuuuagaacaggagcaaauaagugaggcccugaacacggucuacgcaauccgcaacgcgucugaccucuucuccgcucugagcgaaccgcagaagcaggagguggauaaaauucuuacacacauccaccugaauguguuucaggacaaggacucggccuugcuacugcaaauuuauucaucuuucuacagauacaucuaugaacuccugaacauacagaguaggggauccagccuuaccuuuuuaacucagaucucuaaacauauucuggauaucauuaagcaguucaauuuucaaaacaucagcaaggcauucgccuuucucuucaaaaccgcugaggucuugggcgguauauccaauguuucauacugccagcagcugcucaguauuuuuaacuuccuggaacuucaggcccagagcuuuaugucuacagaggggcaggagcuggaagugauccacaccacuuugacaggccuaaagcagcugcucauuaucgacgaggauuuccguauauccuuauuccaguauaugucacaauuuuucaauaguagcguggaagaccugcuugauaacaaaugucugaucuccgacaauaagcauauuucuucgguaaacuacagcacgucagaggaauccaguuuugucuucccucucgcacagaucuuuucuaauuugagcgcuaacguguccguuuucaauaaauuuaugucaauucacugcaccgugucuuggcugcagauguggacugagaucugggagacaauaagccaacucuucaaguuugauaugaacgucuucaccagucugcaucacggauuuacacagcuucuagacgaacuggaggaugacgugaagguuuccaaaagcugucagggcauuuugccaacucacaauguggcccgguuaauccugaaccucuucaagaacguaacccaggcgaaugauuuucauaacugggaagacuuccuggaucuucgagacuuccuggucgcccucgggaaugcuuuggugucugugaaaaagcugaaccuagagcaagucgagaaaucacuguuuacgauggaagcagcccuccaccagcuuaagaccuuccccuuuaaugaguccacaaguagagaguuccugaacagcuuauuggagguuuuuaucgaguucucgucuacuuccgaguauauugugaggaaucuggacagcaucaacgauuuucucucaaauaaccugaccaauuacggagagaaguucgaaaacauuauaacagagcuucgcgaagcuaucguauuucugcggaaugugagucaugacagagaucucuucucuugcgccgacauuuuucagaacgucacugaguguaucuuggaagaugguuuccuguaugugaauaccucccagaggauguuacgcauucuagacacgcugaacagcacauuuucaagugagaauaccaucagcucccucaaaggcugcauaguuuggcuugaugugaucaaccaccuguacuugcugucuaacagcuccuucucacaagggcaccuccagaauauucugggaaacuuccgagacaucgagaauaagaugaacucuauucuuaaaaucgucacuugggugcucaauauaaagaaaccucuguguaguucgaacggcagccauauuaauugcguuaacaucuacuugaaggaugugacagacuuucugaauaucgucuuaaccacuguauucgaaaaagagaagaagcccaaauuugaaauucuacuggcacuccuuaacgauuccaccaagcaagugcggaugucuauaaauaaccugacaacggacuucgacuuugcgucacagagcaauuggcguuauuucaccgaguugauccugagaccaauugaaauguccgaugagaucccuaaccaauuucagaauauuuggcuccaccugaucacucuugguaaagaguuccagaaguuaguuaaagggauauacuuuaacauccuggaaaacaauaguucuagcaagacagagaaccucuugaauauuuucgccaccucacccaaggaaaaagacgugaacuccgucggcaauaguaucuaucaucuggcuagcuaccuagccuuuucucugucccacgaucuccaaaacucaccaaagauuaucauaagcccggagauuaugaaagcaacaggacuuggcauccagcugaucagggacguguucaauucguugaugccuguagugcaucacacuucuccccagaacgcuggguauaugcaggcccugaagaaagucaccaguguuaugcgcacgcucaagaaggcagauauugaccuguuaguggaucaacuugaacagguguccgucaaucugauggacuuuuucaaaaacaucagcucagugggaacagguaaucucguuguaaaccuacuggugggcuugauggaaaaguucgccgauuccucucacagcuggaaugucaaccaucugcuccagcuuagucggcuguuuccaaaagacgugguugaugcugugauagacgucuacuauguguugccccacgcgguaagacugcuccagggggucccuggaaagaauauuaccgagggcuuaaaagauguguacuccuucacucugcuucaugguaucaccauuagcaacaucacaaaggaagacuuugccauaguuauuaagauccugcuagacacuaucgagcucgugucugauaaaccagacauuaucucagaagcacuggcuugcuuccccgucgugugguguuggaaccacaccaauaguggguuuaggcaaaacuccaagauugauccuugcaauguucacggcuugaugaguucuucguucuacggaaaaguggccucaauacuggaccauuuucaccucagcccgcagggcgaggauuccccauguaguaacgagucuagccgaauggaaaucacacgcaaggucgugugcauuauccaugagcuuguagacuggaacuccauccuguuagaacugucagagguguuccacguuaacauuaguuuggucaaaacggugcagaaguuuuggcauaagauacuccccuucgugccuccaucuaucaaucagacccgggauagcauuuccgaacugugucccucagggagcaucaaacaagucgcccuacagauuaucgagaaacuuaaaaacguaaauuuuacuaaggugacaucuggagagaacauacuggacaaacucuccagucugaauaagaucuugaacauuaaugaagauaccgagacuagcguucagaacaucauuucguccaaucuggaaagaacagugcagcucaucucugaggacuggucacuugagaaaagcacccacaaccuguuaagucuguucaugauguugcaaaacgcuaaugucacgggcuccucucucgaggcacugagcucauuuauagagaaguccgaaacuccuuauaacuucgaggaacuauggccgaaguuccagcagauuaugaaagaucuuacccaagacuuuaggauccgucaucugcucagugagaugaauaaggguauuaaaagcaucaacucuauggcccugcagaagauaacauugcaguucgcgcacuuuuuagagauccuggauucacccucccucaaaacccuugaaauuaucgaggacuuccugcuagugacuaagaauuggcugcaggaauacgcuaacgaggacuauagccgcaugauugaaacacucuuuaucccaguuaccaaugagucuaguacagaggauauagccuugcuggcaaaggccauugcuacuuucugggggucgcuuaaaaacaucucccgggcaggaaauuuugacguggccuuccugacccaccucuuaaaccaagaacagcugacgaauuuuagcgucgugcaguugcuguucgagaacauccucauuaaucuuaucaacaaucuggcgggcaacucacaggaagcugccuggaaccuaaaugauacagaccugcaaauaaugaacuuuauuaaucucaucuugaaccauaugcagucugagaccagcagaaagacuguacugucccuuaggaguauuguggauuucaccgaacaguuucugaaaacauucuucucauuauuucucaaggaggacucugagaauaaaaucagccuguugcugaaguacuuccacaaggauguuauagcagaaauguccuuugucccuaaagacaagauccucgagauucuuaaacuggaucaguuccuaacucugaugauccaagaccgacucaugaacauuuuuaguagcuugaaggaaaccaucuaucaccugaugaaauccucuuucauuuuagauaauggugaguuuuacuucgacacgcaucagggccuuaaguuuaugcaggaccuguucaacgcccuccugcgggaaacaucaaugaagaauaaaaccgagaacaauaucgacuuuuucacuguggugagccaauuguucuuucacgucaacaagucggaggaccuguucaaacucaaucaggaucuuggguccgcucugcaucuaguucgcgaaugcaguacagagauggccagacuguuagacaccauacuccacucucccaacaaggauuuuuaugcacuguacccaacuuugcaggaagugauucuugcuaaucugacagaccuccuguucuuuaucaacaacagcuucccuuugaggaaucgggccacccuggagaucacgaaaagacugguaggagcgauuucaagagccuccgaggaaucucaugugcucaagccccuucuggagaugaguggcacuuuagucaugcugcucaacgauagcgcagaccugcgcgauuuggcuaccuccauggacucaauagugaaacuucugaagcucguuaagaaagugagcgggaagaugucuacagucuuuaaaacccacuucaucaguaauacaaaggauuccguaaaauuuuucgacacucuguacagcauuaugcagcaaucagugcagaaccuaguuaaggaaaucgccaccuugaagaaaauugaucacuuuacguucgagaagaucaaugaccugcucgugccauuucuugaccuggcuuucgaaaugauaggagucgagccguauaucucuuccaacucggauauuuucagcaugaguccuucuaucuuauccuacaugaaucagagcaaagacuuuucagauauucuggaggaaaucgcagaguuccucacaagugugaagaugaaccuggaagacaugagguccuuggccgucgccuuuaauaacgagacucagaccuucagcauggauucugugaaucuucgugaagagauacugggcugucucguucccauuaacaauaucacaaaccaaauggacuuucuguauccaaaucccaucucaacccauagcgguccucaggauauuaaaugggagauaauccacgaagugauuccauuccuagacaagaucuuaucccagaacucuacugagauugggaguuuucugaagaugguaaucugcuugacccucgaagcucuguggaaaaaccuuaagaaagauaauuggaacgugucgaauguccugaugacauucacgcagcaucccaacaaucuccugaagacuauagagaccguuuuggaagcgagcuccggaaucaaaucagacuacgagggcgaucuuaacaagucucuguauuuugacacaccucuaagccaaaauauuacccaccaucagcucgagaaggcaauccacaacgugcugagucggauugccuuauggagaaaaggucuguuguucaauaacuccgaauggaucacuucaacaaggacccucuuucagccgcuguucgagauuuuuauaaaggcuacgacuggcaaaaaugucacaucugaaaaggaggagcgcaccaaaaaggaaaugaucgacuucccauacagcuucaaacccuuuuucugucuugagaaguaucuagggggacucuuuguguugaccaaguacuggcaacagauuccucugacugaucaguccguaguggaaaucugcgagguuuuccagcaaacagugaaacccagugaagccauggagaugcuucagaaggucaaaaugauggugguccgagugcugaccaucguugcagagaacccaagcuggacaaaggacauuuuaugugccacucuaucuugcaaacagaauggcauaagacaccucauccugucagcuauucaggggguaacgcuggcgcaagaucauuuucaggaaaucgagaagauuugguccagcccuaaccaguugaauugcgaaagucucucuaagaaccuguccucgacccuugagagcuucaaaucaucccuggaaaacgccacaggacaggacuguacuucucaaccccgguuagagaccgugcagcagcaccucuacaugcuggcaaagaguuuggaggaaacauggagcucaggcaauccaaucaugaccuuucuuuccaacuucacugucacggaggaugugaaaauaaaggaccugaugaaaaauaucaccaagcuaacagaagaacucaggagcucuauucagaucaguaacgaaacuauucauuccauccuggaggcuaauauaagccacucaaagguucuguuuucugccuugaccguggcacucucggguaaaugcgaucaagagauucugcaccuucuguuaacauucccuaagggggagaaaagcuggaucgccgcugaagaacucuguucccugccgggaaguaaggucuauucucuaauuguguugcugucacgcaaccuugacguacgugccuuuaucuacaaaacccucaugcccagcgaggcgaauggccugcugaacuccuugcuugauauagugaguucucucagcgcacuguuagccaaggcucagcauguuuucgaguaucugccagaauuucuacacacuuucaagaucacagcccuccuggagacguuggacuuccagcaagucucccagaaugugcaggcuagaucaagcgcauuugguucuuuccaguuugugaugaaaauggucugcaaggaucaagccuccuuccugagugacucaaacauguuuauuaaucuuccucggguuaaagaacuccuggaggaugacaaggaaaaauucaacauccccgaggacagcaccccauuuuguuuaaagcuguaccaggagauuuugcagcucccuaauggcgcucugguguggacuuuccuuaagcccauccugcaugggaaaauacuauauacaccgaacaccccagaaauuaauaagguaauccagaaagccaacuacaccuuuuauaucguggauaagcucaaaacacugucggagacuuugcuggaaauguccucucuuuuccaaaggaguggaagcggccagauguuuaaucagcuccaggaggcacugcgcaacaaguucguccgaaacuuuguggaaaaucaauuacacauugacguugauaaacugacggagaaguugcagaccuacgggggacuccuggacgagauguucaaccaugcgggcgccgguagauuccgguuucuugggucaauccuggugaaucuauccucuugcgucgcucucaacagguuccaggcccugcaaagcguggauauauuggaaacaaaggcacacgagcugcuucagcagaauagcuuuuuagcuuccauuaucuucagcaacucucuguuugacaaaaauuuccgcucagaauccguaaagcucccuccccacguuagcuacacuauuagaaccaacgugcuguauagugucaggacagauguggugaaaaauccaucuuggaaguuucauccccagaaccuaccugccgacggauucaaauacaauuaugucuuugcaccguugcaagauaugaucgagcgggccauaauccugguucagaccggccaggaagcucucgagcccgcggcccagacucaagcagcuccauacccuugucacacgucagaccuuuuccugaacaaugugggcuuuuucuuuccccucauuaugaugcugacauggaugguauccguggccagcaugguccguaaguuaguguaugagcaggaaauccagauugaggaauacaugcgcaugauggggguucauccugugauccacuucuuggccugguuccuggagaacauggcaguccuuaccauuucgucugcuacucuggccaucgugcucaagaccaguggaauauuugcgcacuccaauacauucaucguauuucuguuccuacuugauuuugguaugagcguugugaugcugucauaucucuugucugcuuucuuuagccaggccaacacugcagcccugugcaccuccuuagucuacaugauuaguuuccugccauacaucgugcuccuuguucugcauaaccaauugucauuugugaaucagacauuccugugucuccuaagcacgaccgcuuuuggccagggggucuucuuuauuacuuuccuggagggacaggaaacaggcauacaauggaacaauauguaucaggcacuugagcagggugggaugaccuucggaugggugugcuggaugauccuguuugacuccucucucuacuucuuguguggcugguaucugaguaacuuaauucccggcacuuuugggcugcgaaaaccuugguacuucccauuuacagccagcuauuggaaguccguaggauuccucguggaaaaacgacaauacuuucuuucaucuucgcuguucuuuuucaaugagaacuuugauaauaaggguagcuccuugcagaacagggaaggcgagcuggaggggagugcgcccggagucacccucguuucugugacgaaagaauaugagggccacaaggcugucgugcaggaccuaagccugaccuucuaccgggaccagaucacagccuuacuggguacuaauggggcaggaaagaccacaauuaucucaaugcucacuggccuucauccgccuaccuccggcacaauaaucauuaacgggaaaaauuugcaaaccgaucugagccgcguaagaauggaacugggagugugcccacagcaggacauccuccuugauaaccugacuguuagggagcacuugcuacucuucgccucuauuaaggcuccccaguggacgaaaaaggaacuacaucaacaggugaaucagacacugcaggacgucgauuuaacccaacaccagcacaaacagacucgggcccuuagugguggccugaagcgaaagcucuccuuggggaucgcauuuaugggaaugucaagaaccgugguucuggacgagccuacaagcggcgucgauccaugcucucgccauucgcugugggacauacuccuuaaauacagggagggucggacgauuaucuucaccacucaccaucuggaugaagcugaggccuuguccgaccguguggcggugcuacaacacgggagacugagguguugcggacccccguuuugucucaaggaagccuauggccagggcuuacgccugacacuuacccggcagccuaguguacuggaggcacaugaucucaaagacauggcuugcgucacuagcuugaucaagauuuacauaccccaggccuuccugaaagacucaucuggguccgaacugacauauaccaucccaaaggauacagacaaagcaugucucaagggacuauuucaagcucuggaugagaaccuucaccaguugcaccugacugguuacggcauuagcgacaccacgcucgaggaaguguucuuaaugcugcuucaggauaguaauaagaaaucacauaucgcccuggggaccgaguccgaacuccagaaccaccgaccuacaggacauuugagcggcuauugcgguucucuggccagacccgcgacuguucaaggggugcagcuacugagggcucaggucgcagccauucucgcucgccgguuaagacguacccugagggccggaaagaguacacuugcagaccuguugcucccagugcuguuuguugcccuugcuaugggccuguucauggugcggccccucgcgacugaguacccuccauugcgccugaccccgggccacuaucagcgagccgagacguacuuuuucagcuccgggggagauaacuuagaccugacaagaguacuccuaaggaaauuucgggaucaagaccugcccugugcagaucuuaauccucgccagaagaacucuucaugcuggagaaccgacccauucagccaccccgaauuucaggauuccugugguugcuugaaauguccuaauaggucggcuucugccccauaccugacuaaccaucucggccacacacugcuuaaucugaguggguucaacauggaggaauaucucuuggcacccagcgagaagccucgacugggaggcuggucauucgguuuaaagaucccguccgaagccgggggcgcuaauggaaacauaucuaaaccacccacccuagccaaggucugguacaaucaaaaaggcuuucauagccugccuuccuaucucaaccaccugaauaaccuuaucuuguggcagcaucugcccccaacuguggacuggcggcaguacgggauuacccucuauagucacccuuacggaggugcgcuguuaaaugaggacaagauccuggagucaauucgucagugcggcguggcacuuugcaucguucucggguucagcauacugucugccuccauuggaaguagcgucgugagagaucgcguaaucggcgcuaaaagguugcaacacauuucaggucuaggguaucggauguacugguuuacaaacuuccuguacgacaugcucuuuuaucuggugucugucugucuuugcguggccguuaucguggcauuccaguugacggcuuuuaccuucagaaagaaucuggccgcuacugcccuccuguuaucccuguuuggcuacgcaacacuucccuggauguaucucaugucgcgcaucuucagcaguuccgaugucgcguuuauuucuuacgugucacuaaacuucauauuuggacuguguaccauguugaucacuauuaugccaaggcugcucgccaucauuagcaaggcuaaaaaccugcagaauaucuaugacguucuuaaguggguguucacaauauucccgcaguuuugcuugggccaagggcugguagaacucuguuacaaccagaucaaauaugauuuaacccauaauuucggaauugacuccuacgucucuccuuuugagaugaacuuccuggguuggaucuuugugcagcuagccagccagggcacgguucugcuucuccugcgaguguugcugcacugggaucuccugcgguggcccagagggcauaguacacuucaaggaaccgucaagucauccaaagacacugauguggaaaaggaggaaaagaggguauucgagggccgcaccaauggugacauuuuagugcuguacaacuugagcaaacacuaucgucgguuuuuccagaauauaaucgcaguccaggauauuucucucgggaucccaaagggcgagugcuuuggacugcuaggcguuaacggggcuggaaaaaguacaacuuucaagaugcugaauggcgaagugucccuuaccagcggucacgccaucauuagaacacccaugggggacgcaguggaucucucaucggccggaacggcgggcguccugauagguuacuguccucagcaagacgcuuuggacgagcugcucacuggcugggaacauuuauauuacuauugcucucugagggggaucccacgccaguguauucccgagguggccggagaucuuauccgacggcugcacuuggaagcacaugccgacaaaccuguugcuaccuacagcggcgggacaaagagaaaacucuccaccgcccuggcccuaguaggaaagccggauauucugcuucucgacgagccaaguucaggcauggaucccugcucuaagagguaucuguggcagacuaucaugaaagaggugcgcgaagguugugcugccgucuugacaagccacuccauggaggaaugcgaggcgcugugcaccagauuagcuauaauggugaacgggaguuuuaagugucucggaagcccucaacauaucaaaaaucgguucggcgacgguuacacgguuaagguguggcugugcaaagaggccaaccagcacuguacugucucugaucaccuuaagcuguacuuuccaggcauucaguucaaggggcagcaucuaaaucucuuggaauaucacgugcccaaaagguggggaugccuggcagaccuguucaagguaaucgagaacaauaaaaccuuucuuaacauuaagcauuacuccaucaaccaaacaacccucgaacagguguucauaaauuuugccucagagcagcagcaaacucugcagagcacauuagauccuucgaccgacucccaccacacacaucacuugcccauuuga

SEQ ID NO: 52263 - RNA, 6786 nt, Artificial Sequence
  derived and/or modified sequence opt3 from ABCA1__Homo_sapiens__NP_005493
auggccugcuggccccagcugagacuccuucuguggaagaacuugaccuucaggcggcgccaaacaugucaguuacugcuagagguggcuuggccucucuuuaucuuccugauucuuauaagcguccgacuguccuacccaccguaugaacagcacgagugccauuuucccaauaaagcaaugccuucugccggcacuuugccauggguucaggggaucauuuguaacgcgaauaaccccugcuuccguuacccuacgccaggagaagcucccggugugguaggcaauuuuaacaagucaaucguggccagacucuucagugacgcaaggcggcugcugcucuauagccaaaaagauaccuccaugaaggacaugcgcaaagucuuaagaacacugcagcagauuaagaagucuucgucaaaucuuaaauugcaggauuuucugguggacaacgagacuuucagcggguuucuauaccacaaucucagucugccuaaguccaccguugauaaaaugcuuagggccgacgugauccugcauaaggucuucuugcaaggauaucagcuccaccugacaucuuuauguaacggcagcaaauccgaagagaugauacagcugggugaucaggaggugucagaacucugcgggcuuccacgggagaagcuggcugcagccgaacgcguauugcgaaguaauauggacauccuaaagccgauucugagaacccucaacagcacuucucccuuuccuuccaaagagcuggcugaggccacaaagacccuucugcauucauugggaacgcucgcgcaagaacuguucagcaugaggaguuggucugauaugcggcaggagguuauguuuuuaacuaaugugaacuccagcucgucuuccacccagaucuaccaagcagucucacguauuguguguggccacccagaaggcgggggacugaaaaucaagagucuaaauugguaugaggacaacaacuacaaagcccucuucgguggcaaugggacagaagaggaugcugagacuuucuacgacaacagcaccacacccuauugcaaugaucugaugaagaaccuugaauccucuccuuugagccgcauaauuuggaaagcccugaagccacuccuggugggaaagauccuuuacacccccgacacgccggcaacuagacaggucauggcugagguuaauaaaacauuucaggaacuggccguguuccacgacuuggagggcaugugggaagagcucucaccuaagauuuggaccuuuauggagaacagucaggaaauggaucugguaaggauguuacuggacucccgggauaaugaccauuucugggagcaacagcuagauggucucgacuggacugcgcaggauaucguggccuuucuggcaaaacaccccgaagacguccagagcucuaacgggucaguguauacauggcgagaggcuuucaaugaaaccaaccaagccauccgcacgauuaguagauuuauggaguguguuaaucuuaacaaguuggagccaauagcuaccgaaguguggcugaucaauaaaagcauggagcuccuggaugaaaggaaguucugggccggaauugucuuuacaggcaucacuccuggcuccauagaguuaccccaucacgugaaguacaaaauucggauggacaucgauaacguagagcgcaccaauaagaucaaagacggguauugggacccaggacccagagcagauccuuucgaagacaugagguacguuugggguggcuuugccuaucugcaggauguggucgagcaggcuauuauccgugugcuuacagggacugaaaagaaaaccggagucuacaugcagcaaaugccauacccgugcuauguggacgauauuuucuugcggguuaugucucgaucgaugccccucuuuaugacacuggcguggauauacagcguggcaguaaucauuaagggcaucgucuaugagaaggaagccagacuaaaagagaccaugaggaucaugggucuggacaacuccauucucugguucucaugguucauaaguucucugaucccucuuuuggugagcgcugggcuguuaguugugauucucaagcugggcaaccuucugccauacuccgaucccucagucguguuuguauucuugagcguguuugccguugucacuauccuccaguguuuccugauuucuacgcuauuuucccgcgcaaaucuggccgcugccugcggaggcaucauauauuucacacucuaccugccuuaugugcuuugcguggcauggcaggacuacgucggguuuaccuugaaaaucuucgcgagucuguuaagcccaguugcuuuuggauucgguugugaguacuuugcccucuucgaagagcagggcauuggggugcaaugggauaaccuguuugaaucucccguggaggaagacggauucaaucuuacuaccuccguaucaaugaugcuguucgauacauuucuauauggcgucaugaccugguacaucgaggcaguguucccgggucaguaugggauuccucggccaugguacuuucccugcacuaagaguuauugguucggcgaggaaagcgacgagaaaucgcacccuggauccaaccagaagagaaucucugaaauauguauggaggaagagcccacacaucucaagcugggcguuagcauucaaaauuuggugaaagucuacagggaugggaugaagguggccguugacggacuggcuuuaaacuuuuaugagggucagaucacgucauuccucggccacaauggggccggaaaaaccacuacaaugaguauucugaccggccuuuuuccaccuacauccgguacugcauacauccuggggaaggacauacgcucugaaaugagcaccauccgacagaacuugggcgugugcccccagcauaauguacucuucgauaugcugacggucgaggaacacauuugguuuuacgcucggcuaaaaggacuguccgagaagcaugugaaagccgagauggaacaaauggcgcuugacgugggccucccaucaagcaagcugaagaguaaaaccucucaguuguccgggggaaugcagcguaagcugagcgucgccuuagcuuucguuggcgguucgaaagugguaauccucgaugagccgacagcagggguggacccuuauucaagaaggggaauuugggaacugcuucugaaguaccgccagggccggacuaucauauugucuacccaccacauggaugaggccgacguccucggugauagaauugcuaucaucagucauggcaaacuguguugcgugggguccagccuauuucugaagaaccaacuuggaacaggcuauuaccucacucugguuaagaaagacguggaaucuagcuuguccucauguaggaauaguagcucuaccgucuccuauuuaaagaaagaggauucagugagucagagcuccucugacgccgggcugggaucggaucacgagagcgacacgcucacaauugauguuucagcaaucuccaaccugauucgaaagcaugugagugaagcgcgccuugucgaggacauaggccacgaacugaccuacguauugcccuaugaggccgcuaaagaaggugccuucguggagcuauuccacgagaucgacgaucggcugucugaccucgggauuagcuccuacggaaucucagaaacuacacuggaggaaauuuuucuuaagguugcagaggaaucuggcguggaugcugagaccagcgacgguacuuuaccagccagaaggaaucgucgcgcauucggcgauaagcagaguugccugcggcccuuuaccgaggacgaugccgcugacccuaacgauuccgacaucgauccagaaagcagagagacagaccucuugucugggauggacggaaaaggcucauaccaggucaagggguggaaacugacgcaacagcaguucguggcgcuccuguggaagaggcuucugauagcccgacggucccgcaaaggauuuuucgcacaaaucguauugcccgcuguguuugucuguauugcccuaguuuucagucugaucgugccuccguuuggcaaguauccaagccucgaauuacagcccuggauguacaaugagcaguauaccuucgugucgaacgaugccccugaggacacugguacacuggaacuucugaacgcucucaccaaggauccaggguuuggaacaagaugcauggagggcaaucccauuccugacacuccgugucaggcaggugaagaggaauggaccacggcccccgucccacaaacaaucauggauuuguuccagaacggcaauuggaccaugcagaacccuucucccgcgugccagugcuccagcgacaaaauaaagaaaaugcugccaguguguccucccggggcuggaggccucccaccgccucaaaggaagcagaauacugccgauauucugcaggaccuuaccgggcggaacaucucagauuaccuaguuaaaacauauguacagaucauugcaaagagucugaaaaauaagauaugggugaacgaguuucgauacggaggcuucucuuugggugucuccaauacucaagccuuacccccaagccaggaggugaacgacgcuaucaagcagaugaaaaagcaucugaaacucgcaaaggauucaagugccgacagauuccugaauagccuugggcgcuuuaugaccggacuggauacaaaaaacaauguuaaggugugguucaacaauaagggcuggcacgcgauuuccucuuuucucaacgucaucaacaaugcuauuuugagggccaaccugcagaaaggcgaaaaucccagccauuaugggaucacggcauucaaccacccucuaaaucugaccaagcaacagcucuccgagguggcccuuaugacuacaucaguagacguccuggugucuauaugcguuaucuuugcuaugaguuucgugccagccucguuugucguguucuuaauucaggaacguguuagcaaagcaaagcauuugcaauuuaucuccggagugaaacccgucauuuacuggcugucuaacuucgugugggacauguguaauuacguagugccugcuacccucguuaucauaauuuuuaucugcuuccagcagaagucauaugucagcuccacuaaccugccggugcuugcccugcucuugcuguuauacgguuggaguaucacaccacuaauguaucccgcgucuuuuguguucaagauuccuagcaccgccuacgucguacugacgucagugaaucucuucaucggcauaaacggguccguugcaacuuuugugcuugagcuguucaccgauaauaaauugaacaauauuaacgacauccugaagagugucuuucucauuuucccccacuuuugucugggacggggccuuaucgauauggugaaaaaucaggcuauggccgacgcucucgaaagauucggugagaacagguuuguuagcccacugucuugggauuugguggggcgcaaucuguucgcaauggccgucgagggagugguauuuuucuuaauaacagugcuaauucaauaucgauuuuucaucagaccucggcccguuaacgccaagcuguccccacucaacgacgaagaugaggacgucaggcgcgaacgucagagaauccuugauggcggcgggcagaaugacauucuggagaucaaagaauugaccaagauuuaccggaggaagcgcaaaccugcuguggaucgaauaugcgugggaaucccgcccggugaguguuuuggccugcucggggucaacggagcgggcaagucaagcacuuucaaaaugcugacaggugacaccacaguuacuagaggggaugcauuccuuaauaagaacucgauuuuaucuaauauccacgaggugcaucagaacaugggauauugcccacaauuugacgccaucaccgaacugcucacgggccgggagcacguagaauucuuugcuuugcugaggggcgugccugagaaagaggucgggaaggugggagaaugggccauucgcaagcuaggucugguuaaauacggcgagaaguacgcagggaauuauaguggaggcaacaaaagaaagcucuccacagccauggcucuuauaggugggcccccaguggucuuccuggacgaaccuaccacuggaauggaucccaaagcgaggcgguuuuuguggaauugugcccugagcguagugaaggagggccguucaguugugcucaccucccauucuauggaagagugcgaggcacuguguacacgcauggcuaucauggucaacggccgauucagaugcuuagggagcgugcagcaccuuaaaaauagguuuggagacgguuacacuauugucgugcggaucgccggcaguaacccggaucugaagccaguucaggacuucuuugggcucgcauucccuggauccgugcuaaaggaaaaacaucgcaauaugcugcaguaucaauugcccagcucucugucaagucucgccagaauuuuuuccauccuuagccagucuaagaaaaggcugcacauagaggauuacucgguaucacagaccacguuggaccaaguguucgucaacuuugcuaaggaucagagcgacgaugaccaccugaaagaucucuccuuacauaagaaucagacaguuguggacgucgccgugcugaccaguuuccuucaggacgaaaagguaaaagagucuuauguguga

SEQ ID NO: 52264 - RNA, 7311 nt, Artificial Sequence
  derived and/or modified sequence opt3 from ABCA2__Homo_sapiens__NP_001597
augggauuccugcaccagcuccaacuucuguuguggaagaacgugaccuuaaaaagaaggucccccuggguccuggccuuugaaaucuucauuccucugguucucuuuuucauacugcuugggcugcggcagaagaaaccaacaaucuccgugaaggaaguaucuuuuuacacugcugcaccguugacgucagccggcauucuccccgugaugcagagucuguguccugacggucagcgcgaugaguucggcuuucugcaauaugcgaauagcaccgucacacagcucuuagaacgacuggaccgugugguugaggaagggaaccuuuucgauccagcuagacccuccuugggaucugagcuggaggcccugaggcagcaccucgaagcacugucggccggcccugguacuucagggagccaccuugaccggaguaccguguccucuuuuagccuggauuccgucgcucgcaauccacaggaguuguggagauuccucacacaaaaccugucauuacccaauaguaccgcacaggcccugcucgcugccaggguggacccuccagaaguauaccaucuucuguuuggaccgagcucugcguuggauucccagucaggccuacacaaaggccaggagcccuggagccggcuagggggaaacccucucuuccgcauggaggaacugcuucuggcaccagccuugcucgagcaacugacuuguacacccgguaguggcgaauuagggcgaauccugaccguuccugagucucagaagggagcucuacagggcuauagagacgccgugugcuccggucaagcagcugccagggcgcggcguuuuagcgggcucucggccgaacugcgcaaucagcuugaugucgcaaaggugucucagcaguugggacuggacgcuccaaacggcuccgauucaaguccccaagccccgccucccagaaggcuccaggcucugcuuggcgaccuguuggaugcccagaaagugcuccaggacgucgacguucugagcgcauuagcccugcuacucccacaaggggcuuguacgggacggacuccuggucccccagcguccggcgcagggggagccgcuaauggcaccggugccggggcagugaugggccccaacgccacagcugaggagggagccccuucugcagcggcucuggccacuccagauacccuucagggccagugcagcgcauucguacaguugugggccgggcugcaaccgauucucuguggaaauaaccgaacaaucgaacccgaggcucugcgcagagguaauaugucaaguuuaggcuucaccuccaaggaacagaggaaccuggggcuuuuggugcaccucaugacgagcaauccuaaaauacuguacgccccagcaggaucugaggucgaccgggugauccuaaaggcuaacgaaacuuuugccuucguuggcaacgugacacacuaugcgcaggucuggcugaauauuucagccgagauccgcaguuuucucgagcaggguagacugcaacagcaccuuaggugguugcagcaauacguggcugaacugcguuuacaucccgaggcacucaaccugagccuugaugaacugccuccagccuugcggcaggacaauuucucccuccccucugggauggcucugcuacagcagcuggauaccauugacaacgccgcaugcggcuggauccaauuuaugucgaaaguaagcguugauauauucaagggauuuccggacgaggaauccauugugaauuauacucucaaccaggcguaccaggauaaugucacaguguucgccucagucaucuuucagacccgaaaggacggcagucugccuccacacgugcauuacaaaauuagacaaaacucuagcuucacggagaagaccaaugagaucaggcgcgcuuauuggcggcccgggccuaacacaggagguagauuuuacuuccuuuauggcuuuguuuggauccaggauaugauggaaagggccauuauagacacuuucguggggcacgacguagucgagcccggauccuacgugcagauguucccauauccuuguuacacccgcgaugacuuuuuguucguuaucgaacacaugaugccccugugcauggugauuucaugggucuauagcguggcaaugacaauccagcauauaguagcugagaaagagcaccgauuaaaggaagugaugaaaacuaugggccucaauaacgccguucauugggucgcaugguuuauuaccgguuucgugcaacugucuaucuccgugacagcccuuaccgcuauccugaaguacgggcagguccuaaugcacagucauguugugauuaucuggcucuuucuggcgguguacgccguagcaacuauuauguucugcuuuuuggucagcgugcuguauucuaaagcuaaguuagccuccgccugcggcggaauaaucuacuuccucucauauguuccauacauguauguggcuauucgggaggaagucgcacacgauaagaucacggccuuugagaaauguaucgcgagucugaugagcacaaccgcuuucggccuugggucgaaguacuuugcccuguaugaaguggcaggaguuggcauucaguggcacacuuucucccaaucuccgguggagggugacgauuuuaauuugcuccuggccguaaccaugcuaauggucgacgcugugguguacgggauacugacaugguacaucgaggcaguccauccuggaauguauggccuuccccguccaugguacuucccccuccagaaaagcuauuggcuggguucaggcagaaccgaagccugggaguggaguuggccuugggcgaggacuccacgcuuguccguuauggaagaggaucaggcuugcgccauggaaucucggagauucgaggagacaagggggauggaagaggaacccacgcaucugccuuuagugguaugcguggacaagcucaccaaagucuacaaggaugacaagaaacuggcacuuaacaagcugagcuugaaucucuaugagaaccaggugguuuccuuucugggacauaacggcgccgggaaaacuacaaccaugucaauucuaacaggacuguucccgccaacuagcggcagugcuaccaucuacggucacgauauucgaacggaaauggacgagauccgcaagaaucuugggauguguccccaacacaacgugcucuuugaucggcugaccgucgaggaacauuugugguucuauucuagauuaaaauccauggcccaggaggaaauaaggcgugagauggacaagaugaucgaggaccuggaacucagcaauaagcgccacucgcuggugcagacacuuucaggaggcaugaaacggaagcugucuguugcaauugcuuuuguggguggcaguagagccaucauuuuggaugagccuacugcgggggucgacccauacgccaggcgagcaaucugggaucuaauacugaaauacaagcccggacggaccauucuccuguccacacaucacauggacgaagcugaucuuuuaggcgaccgcaucgccauuaucagccaugggaaacugaagugcuguggaucuccucucuucuugaagggcacuuauggugauggguacagacugacccucguaaaaaggccggcugagcccggaggcccacaggaaccuggucuggcaagcucacccccaggccgggccccucuuagcaguugcagcgagcugcaagugucucaguuuauacgaaagcacguugccuccuguuugcuagugucagacacgaguacagagcugagcuauauccuccccuccgaagcugcgaaaaagggggcauucgagagauuauuucagcaccuggaacgcucucuugaugcccugcaucucucgagcuucggauugauggacaccacucuggaggaagucuuucucaaagugucagaggaggaucagucccuggaaaacagugaggcugacguaaaggaaucuaggaaagaugugcuuccaggcgccgaggggccggcaagcggagaaggccacgccgguaaucuagcucguugcuccgagcugacacaaucacaggcgucuuugcagagcgccaguuccgucgggagcgcacggggagacgagggcgcuggcuacaccgacguuuauggggauuacagaccuuuauucgacaacccccaggauccagacaaugugucucugcaagaaguggaggccgaagcacucucaagggucggacaggguucccgcaagcuggauggcggguggcuuaaggugcgacaguuccauggacugcucguuaaaagauuucacugugcccggaggaacaguaaggcuuuguucagccaaauucugcuacccgccuuuuucguaugcguggcgaugacugucgcacugucggugccugagaucggcgaccucccaccccuuguucugucuccuucccaguaucauaauuacacccagccgcgcgguaacuuuauuccauacgccaaugaggaacguagagaguaucgguuaagguugagccccgaugcuucaccucagcaacuggugaguacauuccgccuccccucuggggucggagccacgugugugcugaaauccccagcuaacggcagccuuggcccuacccugaaucucucaaguggggaaagccgauugcuggcagccagauuuuucgacuccaugugcuuagagucuuuuacucagggacuaccccugagcaacuucguaccaccuccgcccuccccagcuccuucagauucucccgccaguccagacgaagaucuccaggcauggaaugucucgcuuccucccacagcggguccggagauguggaccagcgccccaucccugccucgguuggugagggagcccguucgcuguacaugcucugcucagggcacuggguuuucaugcccaagcuccgugggaggccaucccccucaaaugagagucgugaccggugacauccugacggacauaacagggcacaacguuagugaauaccuccuguucaccucugauagguuucggcuucaucguuauggagccauuacuuucggcaacgugcucaagagcaucccggcaucauucggcacccgcgcucccccaaugguccgaaaaaucgccgugagaagggcagcccagguauuuuacaauaacaagggguaucacuccaugccuacauaccugaauaguuugaacaaugcuauucugcgggcgaacuuacccaagagcaaaggaaauccugccgcauaugguaucacugugaccaaccauccaaugaauaagacaucugcuucccuaucacuggacuaccuccuucagggcacggauguugucauugccauauucaucauuguggccaugagcuuugugcccgcaucguucgucguauuucugguggcugagaaaucuaccaaggccaaacacuugcaguucguuaguggguguaacccuaucauuuacuggcuggcgaauuaugugugggacaugcucaacuaccuggucccagcuacuugcugugugaucauacuuuuuguuuucgauuuacccgccuauacauccccgaccaauuuuccugcagugcugagccucuucuugcuguacggauggucaaucacuccaauuauguaucccgccuccuuuugguucgaagucccuucuagcgcuuacguguuucuaaucguaauuaaccuguucaucggcauaacagcaaccguggccacguuccuccuucaacuguuugagcacgacaaggauuugaagguugucaauaguuaucugaaauccugcuuccucauuuuuccaaacuacaaccugggucauggguuaauggaaauggcguacaaugaguauaucaacgaguacuaugcuaagaucggacaguucgacaaaaugaaaagccccuuugaaugggauauugugacucgcggccuuguggccauggcagucgagggcguugugggguuccugcucaccauaaugugucaguacaauuuucuaagaaggccgcaacggaugccuguaucuacaaagcccguggaagacgaugucgacguggccucagagcgacagagaguucugcgcggagaugcugacaacgacauggugaagaucgaaaauuugaccaaggucuauaaaaguaggaagauuggucggauccuggccguagaucgucucugccuuggcgugagaccaggggaguguuucggacuguugggcguuaacggugcagggaaaacuuccacauuuaagaugcugaccggagacgagagcacaacuggcggcgaggcuuucgugaaugggcacucuguccucaaagaguuacuacaggugcagcaaucgcuuggauacugcccucagugugaugcccuguuugacgaacuaaccgcgagggagcaucuccagcuguauacgcgcuugcgggguauuucauggaaggaugaggcccgagucgugaaaugggcacuggaaaagcucgagcuuacaaaguacgcugacaaacccgccggcaccuacagcgggggaaacaagagaaaacuguccacugcaaucgcuuuaauaggcuauccagccuucaucuuucuggaugaacccaccacagguauggacccuaaggccaggcgcuucuuguggaaucucauucuggaucuaaucaaaacugggcggaguguugugcuuaccucucacagcauggaggaaugcgaggcgcuguguacgagacucgcuauuaugguaaacggccgucugaggugcuugggauccauccagcaucugaagaaucgguucggcgacggguacaugauaacagugcgcaccaagucaagucaaucugucaaagauguugugcgauuuuucaacagaaauuuuccagaggcaaugcucaaggaaaggcaccacacuaaaguccaguaucagcuuaagagcgagcauauuucccuggcccagguguucucaaaaauggaacaaguaagcggaguguuagguaucgaggacuacucuguuucccagacaacccuggauaacguguuugucaauuucgcuaagaagcagagugacaacuuggaacagcaagagacugagccgcccagcgcccuccagucgccucugggcugccuacuuucccugcuccggccacgcucugcacccacagaacugagagccuugguggcugacgagccugaagauuuagacaccgaggaugaagggcugaucucauuugaggaggaaagggcgcagcucagcuucaauacggacacucuuuguuga

SEQ ID NO: 52265 - RNA, 5115 nt, Artificial Sequence
  derived and/or modified sequence opt3 from ABCA3__Homo_sapiens__NP_001080
auggccgugcugagacagcucgcacuucuguuguggaagaacuacaccuuacagaaaaggaagguccugguuacagugcuagagcuauuccugccccuucuguucucgggcaucuugauuuggcuccggcugaaaauacaauccgaaaauguaccuaacgcaacuaucuauccagggcagucuauucaggagcugccacucuucuuuacguuucccccuccgggagacaccugggaauuagccuacauccccucacacagugaugcggcuaagacagugacugagaccguccgccgagcccuggugauuaauaugcguguuagagguuuuccuagcgaaaaagacuucgaggauuauaucagguacgacaacugcuccucuucggugcuugcugccgucguguuugagcauccauucaaucacucaaaggaacccuugccucuggcuguaaaguaucaucuccgguuuagcuacacacgcagaaacuauauguggacccaaacuggcaguuucuuucucaaagagacagaaggguggcacaccacgucccuguucccacuuuuuccgaaucccggaccuagggagccaacuucucccgauggcggugagccuggguacauacgggaaggauuccuggcaguucagcaugccguggaccgcgcuaucauggaguaccacgccgaugcggcaacccgacaguuguuccagagacucacagucacuauuaagagguuuccauaucccccguucaucgccgacccuuuucugguggcuauucaauaccaguuaccccugcuccuucuguugagcuucaccuauacagcccuaaccaucgcacgggcugugguccaggaaaaagagcgucgccugaaggaauacaugagaaugaugggccucuccucauggcugcacuggagugccugguuucuucuguucuuuuuguuccuccugauagcggccagcuuuaugacguuacuguucuguguuaaagugaagccaaacguagcagugcuaucuagguccgauccuucacucguccuggcuuuucuuuugugcuucgccauuagcacuaucaguuuuucuuucaugguguccacauucuuuagcaaggcuaauauggccgcagccuucggcggguuucuguauuucuuuaccuacauucccuauuucuuuguugcuccacgguacaacuggaugacucucucgcagaaacuguguucuugccuucuguccaauguggcgauggcaaugggagcccaauugaucgguaaguucgaggcuaaaggcauggggauccaguggcgagaccuccugucacccgucaacguggaugacgauuuuuguuucggacagguauuaggcaugcugcuacucgacaguguucuguacggucuugugacaugguauauggaggccgucuuuccugggcaauucggagugccacagccgugguacuuuuucauuaugcccagcuauuggugcggcaagccucgcgcagucgccggcaaagaagaggaagacuccgauccagagaaggcuuugagaaaugaauacuucgaggccgagcccgaagaccugguggcagggauaaaaaucaagcaucucucuaagguuuuuagggugggaaacaaagaucgggcggcuguacgcgaccugaauuuaaaccuguaugagggucagauuaccguccuuuugggccacaacggggccggaaagacgaccacacucagcaugcugacuggccuauucccuccaaccucagguagagcauacaucaguggguaugaaauaucccaggauauggugcaaauuaggaaaagccugggccucuguccccagcaugacauccuguuugauaaucuuacaguugccgagcacuuguacuucuacgcucagcugaagggauuaucucgucagaaaugcccggaagaggugaagcaaaugcuccacaucauuggccuggaggacaaguggaacucacggagucgauuucuuagcgggggaaugagaaggaaacuguccaucgguauugccuugauagcaggcucuaagguccucauccuggaugaaccuacuucggggauggacgcuauuagccgccgggccaucugggaucuacugcagagacagaaauccgacaggaccaucgugcucacaacccauuucauggacgaggcggaucugcuuggagaccgcauugccauaauggcuaagggcgaauugcaguguugcgguucaagucuguuuuuaaaacaaaaguauggggcaggcuaccacaugacucucguaaaggagccacauuguaaucccgaggauaucucucagcuggugcaccaucacguuccuaacgccacgcuugaaagcuccgcuggagccgagcugucauucauucuaccccgagaaagcacacaccgguuugagggccucuucgcaaaacuggaaaagaaacagaaggaguuggggaucgcgucuuuuggagccuccauuaccacuauggaggaagucuuccugcguguggguaaauuaguggacaguagcauggauauccaggcuauacaacucccagcccugcaguaucagcaugagagaagggcaucugacugggcugucgauuccaaucuuugcggcgccauggacccuucagaugggaucggagcacugauugaagaggaacgcaccgccguuaaguugaacacaggccucgcucugcacugccaacaguucugggcgauguuucuaaagaaagccgcauacaguuggcgggaguggaagaugguggcugcccaggugcugguaccccuuaccugugucacucucgcccuguuggcuaucaauuauagcucggagcuguucgacgauccaauguuaagacucacacugggugaauacgggaggacggugguuccguuuuccgugccuggcaccucucagcuuggacaacagcugagcgagcauuugaaagacgcacuccaggccgaaggccaggagccccgagaaguccugggggaucuagaggaguuccugauuuuucgcgcgucaguggaaggaggcgguuucaacgagcggugccuuguugcugccaguuuuagagacgugggggaaaggacuguagucaaugcacucuucaacaaucaagccuaucacuccccagcuacagcacuggccgugguggacaacuuguuauuuaagcugcucuguggaccccacgcgucuaucgucguuagcaauuucccucagccacguuccgcucugcaggccgcaaaagaucaguuuaacgagggccgcaaggguuucgacauagcccuuaaucuguuguuugcuauggccuuccuagcaucaaccuucagcauucuggcugugagugagcgggccguacaagcgaaacaugugcaguuugucucuggcgugcacguugccuccuucuggcucagcgcacugcuuugggauuuaaucucguuucugauucccucacucuugcugcucguggucuucaaggcuuuugacgugagagccuucacaagggaugggcauauggcugacacucugcuucuguugcuacuguacggaugggcaaucauaccucucauguacuuaaugaacuuuuucuuucugggcgccgccaccgcuuauacgcgacuuaccaucuucaacauucugucugggaucgcgacauuucucaugguuacuauuaugcggaucccggcagugaaguuggaagaacugaguaaaacccucgaucacgucuuccugguacuuccaaaucauugccuaggaauggccguguccagcuuuuacgaaaacuaugagacacgcagauacuguacuucuagcgaaguugcugcccacuauugcaagaaauacaauauacaguaucaagagaacuucuacgcaugguccgcccccggcguggguagguucgucgcuucaauggcggccagugggugugcauaccugauuuuguuauuucugaucgagaccaaucuccugcagcggcuucgaggaauccugugcgcucucagacgcaggcguacguugacagaacuguauacccggaugccugugcuaccagaggaccaggauguagccgacgaaagaacuaggauucuggcacccagcccugauucucuccuucacacaccgcugaucauuaaggaguuauccaaaguguacgaacagcgcguccccuugcuggccguugaccgacucucacuggcugugcaaaagggcgaguguuucggucuucugggcuuuaacggggccggaaagaccacuaccuucaaaaugcucacaggcgaggaaaguuugacgagcggggaugcguuugugggaggccauagaauauccucugacgucgguaaggugcggcagaggaucggguauugcccacaguucgacgcacuguuagaucacaugaccggacgcgagaugcuaguuauguacgcccgucugagaggcauuccugaacggcauaucggugcuuguguagagaauacucucaggggccuucuguuggaaccccacgccaacaaacuggugcgcacauauagcgggggaaauaagcgaaaacucagcaccggcauugcucugaucggggagccagcagucauauuucuugacgagccuucaacaggaauggaucccguggccagacggcuccugugggacacuguugcuagggcccgcgaauccggcaaggcaaucauuaucaccagucauucuauggaggaaugcgaggcguugugcacgagacuggccauuauggugcagggucaauucaaguguuuagggagcccacagcaccuaaaauccaaguuuggaucaggcuacucucugagggcuaaaguccagagcgagggccagcaagaagcccucgaggaguucaaggcauuuguggaucuuacauucccggggaguguacuggaggacgaacaccagggaaugguccauuaucacuugccuggucgggaucuguccugggcuaaaguguuuggcauccucgagaaggccaaggagaaauacgggguugacgauuacagcgugucucagauaucacuggaacaggucuuccuuuccuucgcacauuuacaacccccaaccgccgaggaaggacguuga

SEQ ID NO: 52266 - RNA, 4929 nt, Artificial Sequence
  derived and/or modified sequence opt3 from ABCA5__Homo_sapiens__NP_758424
augagcaccgccaucagagaggugggcgucuggaggcagacacggacucugcuccuuaagaacuaccugauuaaaugccgcacgaagaaauccucuguucaagaaauauuguuccccuuauuuuuccuguuuuggcuaauccucauuucaaugaugcacccuaauaagaaauaugaggaagugccaaacaucgagcugaauccgauggacaaguucacccuuaguaaccugauuuugggguacacacccguaacuaauaucaccagcuccauaaugcagaaggugucuacagaucaucucccugacgucaucauuaccgaagaguauacuaacgagaaagaaaugcugacaucgucacugagcaagccaaguaauuuugugggaguuguguucaaagauuccaugucuuacgagcuccgauuuuuccccgacaugaucccugucagcuccauuuauauggauucacgugcugguuguaguaagagcugcgaagcagcccaguacuggucuuccggcuuuaccguguuacaggcgucaaucgacgcugccauaauucaacugaaaacgaacguaagccuuuggaaggaguuggagaguacuaaggcaguuaucaugggggaaaccgccguggucgagauugauacauucccaagaggagugauccugaucuaucuagugauugcuuuuucucccuucggcuacuuucucgcaauacacaucgucgccgaaaaagagaagaaaauuaaggaauuucugaaaaucaugggucuucaugacacugcuuucuggcuguccuggguuuugcucuacaccagccugauauuuuuaaugucgcugcucauggccgugauugcgacagcaucucuucuguucccucaguccucaaguaucguaaucuuuuugcuauucuuucuguaugggcucagcuccguguucuuugcccugaugcuuaccccacuguucaagaaaucuaagcacgucggaauuguggaguuuuucguuacgguggcuuuuggcuucaucggcuugaugauuauacucaucgagagcuuuccgaagucacuggucugguuauucagucccuucugucauugcacuuuugugauugggaucgcccagguaaugcaccuggaagauuucaaugagggagcauccuuuagcaaccuaacagcugguccuuacccacucaucauuaccauaaucaugcugacucuuaauucuauuuucuauguuuugcuggccguguaccucgaccaggucauccccggcgaauuugggcugaggcggucaagucuuuauuuccugaaaccuagcuacugguccaagucuaaacgcaacuaugaggaauugucggagggaaaugugaacggcaauauuagcuuuuccgagaucauagaaccagucucaagugaguucguggguaaggaagcgaucagaauuucugggauccaaaagacauacaggaagaagggagagaacguugaagcccuccggaaccugagcuuugauauuuacgagggccagaucaccgcauuacugggccacuccgggacgggaaaaucaacccuaaugaauauacucuguggucugugcccuccgagcgacggcuucgcuucuauuuaugggcaucgcguguccgagaucgaugaaauguuugaggcccgaaagaugauuggaaucuguccucagcuugacauacacuucgacguauugacagucgaagagaaccugaguauccucgcuagcauuaaaggcauccccgccaauaacauuauccaggaggugcaaaagguucuguuagaucuggacaugcagacuauaaaagauaaucaggcaaagaaacuuucuggugggcagaaaagaaaguugucccucggcauugccgugcugggaaacccaaaaauccuacugcucgacgaaccuaccgcuggcauggaucccugcucaaggcauaucgucuggaaucugcuuaaguaccggaaagcgaaccgugugacaguauuuaguacucacuucauggacgaggcagauauuuuggccgaccgcaaggcugugaucagccaagggaugcugaaguguguuggaucguccauguucuuaaaaucuaagugggguauuggcuauagacucagcauguacauagauaaauauugcgccaccgaaucacugaguucccuugucaagcagcacaucccaggggcaacacuguugcagcaaaaugaccagcagcucguguacucucugcccuuuaaagauauggacaaguucagcggacuauuuuccgcccuggacucacauagcaaccucggcgugauuaguuauggugucucuaugaccacucuggaggauguuuuccuuaaauuggaaguggaggcugagaucgaccaggccgauuacuccguguuuacgcaacagccucuggaagaggaaauggacagcaagucguucgaugagauggaacagucauuacucauucugucugagacaaaggcagcgcuuguaaguaccaugucccuguggaaacagcaaauguacacuaucgcuaaguuucacuucuuuacccuaaaaagggagagcaagucuguccggagcgugcuccuguugcuguuaauauucuuuacaguucagaucuucauguuccucgugcaucacuccuuuaaaaaugccgucgugccaauuaagcugguuccggaccuuuauuuccugaagcccggggauaaaccucauaaguacaaaaccucauugcuccugcagaacagugcagacagcgauaucucugaccuaauuuccuuuuucacuucacagaauaucauggugacaaugauaaacgauagugacuauguaagcgucgccccacacuccgcugcccugaaugugaugcacucugaaaaggauuacguguuugcagcugucuucaacucgacgaugguuuauagccuucccauucucgugaacaucaucucaaauuacuaucuguaccauuugaacguaaccgagacuauucaaauaugguccacaccuuucuuccaggaaaucaccgacauuguguuuaaaaucgagcuguacuuccaggccgcguuacucggcauuaucgucacagccaugccacccuauuuugcuauggaaaaugcagagaaccacaagauaaaggccuacacucaacugaaacuuaguggacuguugccgucugcuuauuggaucggccaggccgugguugacauuccucucuucuuuaucauucugauccuaaugcuggggagccuucucgcauuccauuacggacuguauuucuacaccgugaaguuuuuggcggucguguucuguuuaauagguuauguuccauccgugauucuguuuacguacaucgccucauucaccuuuaaaaagauccucaauacaaaagaguucuggucuuuuauuuacagcgucgcugcccuggcaugcaucgcuauaacugaaauuaccuucuuuaugggcuauacaaucgccacuauucuucacuacgcauucugcaucauaauucccaucuauccucuguuggggugucuaaucaguuuuauuaagaucuccuggaagaacguacgcaaaaauguggauaccuacaaccccugggaccgacugagcguugccgugauuucuccauaucuccagugcguccuguggauauuccuuuuacaguacuaugagaagaaauacggaggcagaucaaucaggaaggaucccuuuuuccggaaucuguccacgaaaaguaagaaccgcaaacuccccgaaccaccggacaaugaggaugaggacgaagaugugaaggcugagagauugaagguaaaagaacugauggguugucaaugcugugaggaaaagccuagcauuauggugucgaaccuccacaaagaguacgacgauaagaaagacuuccugcuuucuaggaaggucaagaaaguugcgacaaaguauaucuccuuuugcgugaaaaagggggagauccugggcuugcuaggacccaauggcgccgggaaaagcaccauuauaaacauccuggugggagauauugaaccaacuucaggccaggucuuccucggugacuacaguucugagacauccgaagaugacgacagcuuaaaguguaugggguauugcccccagaucaauccucuguggccagauaccacucuucaggagcauuuugaaauuuacggagcagugaagggcaugucagcuagugacaugaaagagguuaucagccguauaacccacgcccuggaucucaaggagcauuugcagaaaacaguaaagaaacugcccgccgguaucaagcggaagcucuguuucgcucuguccaugcuuggcaacccucaaauuacgcuacuggacgaaccgucuaccgggauggauccaaaagcaaagcagcacauguggcgagccaucagaacugcguuuaaaaacaggaagcgcgcugccauuuugacaacccauuauauggaggaagcagaggccgugugcgaccgggucgcuaucauggugagcggacaguuaagauguauaggcacaguucaacaccugaaauccaaguucgggaagggauacuuucucgaaauuaaacugaaggauuggaucgagaaucuugagguggacaggcugcagcgcgaaauucaguauaucuuccccaacgcaucacgacaagagucuuuuaguucgauacucgccuacaaaaucccuaaggaagauguccagagcuugucccagucuuucuuuaaacuggaggaggcgaagcacgcuuucgccauugaagaguacucauuuagccaggcaacucuagaacaaguguucguagagcugaccaaagaacaggaggaggaagacaauuccugcggcacgcucaacaguacacuuuggugggagcggacccaggaagaucgugucguguucuga

SEQ ID NO: 52267 - RNA, 4854 nt, Artificial Sequence
  derived and/or modified sequence opt3 from ABCA6__Homo_sapiens__NP_525023
augaacaugaagcagaaaagcguguaccaacagaccaaggcccugcucugcaaaaauuuccuuaagaaauggagaaugaagagggagucccuguuggaauggggcuuaucuauccugcuagggcucuguauugcucuguuuucaaguagcaugcggaacguccaguuccccggaauggcaccucagaaucuuggucgcguugacaaguuuaacuccucuucgcugauggugguauauacaccaauaucaaauuugacucaacagaucaugaacaaaacggcccucgcgccgcugcugaagggcaccagcgugauuggggcucccaauaaaacacacauggaugagauccucuuagaaaaccugccuuacgccaugggaauuaucuucaaugagacuuuuaguuauaaacuuauauucuuucagggcuacaacuccccauuguggaaagaagacuucucugcacauugcugggaugguuauggggaguuuagcuguacccugacaaaguacuggaaucgaggauucgucgcccuacagaccgcuaucaacacugcaauuaucgagauuacaaccaaucaccccgugauggaggaacucauguccguuacggccaucacuaugaagacccugccuuuuauaacaaagaaccuucugcauaaugaaauguucauuuuguuuuuccuccugcacuucucaccauuaguguauuuuaucagucugaacgucacuaaggagcguaaaaagagcaaaaaccucaugaagaugaugggccuucaagacucugcuuucuggcuguccuggggcuugauuuacgccggguuuaucuucaucauuucaauauuugugaccaucauuaucacauucacccagauaauuguaaugacgggauuuaugguuaucuucauccuauuuuuccuguacggucucagccugguggcgcuugucuuucugaugaguguguugcucaaaaaggcagugcugacuaauuuagucguuuuccugcuaacacucuuuuggggcugccugggguucaccguguucuaugagcagcuucccucuuccuuggaauggauucugaacaucuguagcccuuuugccuucacuacaggaaugauucagauaaucaagcucgauuacaaucugaacggcguaauuuuuccagacccgucgggugauucuuauaccaugaucgcuacguucuccaugcuucuguuggacgggcucaucuaccuguuacuggcccuauauuuugauaaaauucuccccuacggagacgagagacauuauucaccucuguucuuucuuaauaguagcuccugcuuccaacaccagaggaccaacgcaaaggugauagaaaaagagaucgaugcugaacacccaucugacgauuacuuugagcccgucgccccugaguuccagggcaaggaagcgauucggauccgcaaugugaaaaaggaguacaagggcaaaagcgggaagguugaagccuugaaaggacugcucuuugacauuuaugagggucaaaucacagcaauacugggccauucaggggcuggaaagaguuccuuacugaacauccuuaauggcuugagcgugccaacugaagguucugucaccauuuacaacaaaaaucucucagagaugcaggaccuggaggaaaucagaaagauuacagggguguguccccaguucaacguacaguuugauauccuaacuguuaaggagaaucugagucucuucgccaaaauaaagggcauucaccugaaagaaguggagcaagaaguccagaggauccuuuuggagcuggacaugcagaacauucaggauaauuuagcuaagcaucucagcgagggacaaaaacggaagcugaccuucggcaucacaauacuuggggacccgcagauccuguugcucgaugaaccuaccacuggacuggaccccuuuucccgcgaucagguguggucucuacugcgagagagaagggccgaccacgucauucucuucucgacgcagagcauggaugaagcagacauccuggccgaucggaaggugauuauguccaacggucgucuuaaaugcgcuggcucaaguauguuuuugaagcgcagaugggggcugggauaucacuuaucucuccauaggaacgagaucuguaauccagagcaaauaacauccuucauuacccaccauaucccugacgcgaaacugaagacugaaaacaaagagaaacuuguuuacacccugccccuagaacggacaaauaccuuuccagaccucuucuccgaucuggacaagugcucagaucagggcgugacugguuaugacaucagcaugucuacauugaacgagguauuuaugaagcuggaagggcaguccacgauugagcaggauuucgagcaagucgaaaugauccgagacagugagagcuuaaaugaaauggagcucgcacacucuuccuuuucagaaaugcagaccgccgugagugauaugggccuguggcgcaugcagguuuucgcuauggccagacuuagguuucugaaguugaaacggcaaacuaaggugcuccugacacuacugcuugucuucggaauugcaauauucccccucaucguggagaacauuauguacgccaugcugaaugagaaaaucgacugggaauuuaagaacgaguuguauuuccugagcccuggccaguuaccacaggaaccgcgcaccucgcuccugauuaucaauaacacagaguccaauauagaagauuuuaucaaaucucuuaagcaucagaacauucuguuggagguagacgauuucgagaauagaaacgggacugacggacucagcuacaauggugcuaucauugugucaggcaagcaaaaagauuacagguuuaguguugucuguaacaccaagcgucugcacugcuuccccauccuaaugaacauaauuuccaaugggcugcuucagauguuuaaccacacgcagcauauccggaucgaaucuagcccuuucccacucucccacauuggacuguggaccggcuugcccgacgguucauuuuucuuauuucuggugcucugcagcauaaguccuuauaucacaauggggucuauuuccgacuacaaaaagaaugccaaaagccagcuguggaucucgggccuuuauacuucagcauacugguguggacaagcgcugguggaugucucuuucuuuauuuugauccuacugcucauguaucugauauucuacaucgagaacaugcaguaucuuuuaauuaccagucagaucguuuucgcucuggugauugugacaccaggcuacgccgcaucccucguauuuuucaucuacaugauuagcuuuauauuccgaaagagaaggaaaaauucuggguuguggagcuuuuauuucuuuuucgccuccacuaucauguuuucaaucacccugauuaaccauuucgaccucaguauccugauaacgacaaugguccuugugcccagcuacacccuguugggauuuaagacuuuccuagaaguucgcgaucaggagcacuaucgggaguuuccggaagcuaauuucgagcugucugccacagacuuccucgugugcuuuauuccuuacuuccaaaccuuacuguuugucuucgugcuuagauguauggaacugaagugcggcaaaaagaggaugcgcaaagauccaguuuuucgaaucagcccccagucacgggacgcaaagccuaaccccgaggaaccaauugaugaggacgaggauauccagacugaacguauaagaaccgcuacagcccucacgaccaguauuuuggacgagaagccugugaucaucgcgagcugucugcacaaagaauaugccggucaaaagaaauccugcuucucuaagaggaaaaagaaaauugcugcacgcaauaucucguuuuguguacaggagggggaaauucucggacugcuuggccccaacggugccggcaagagcucauccauacggaugaucagugggauuacuaagccaacagcuggagaggucgagcuaaaaggcugcucuagcgugcuggggcauuugggauacuguccgcaggaaaauguguuauggccuaugcugacccucagagagcaccuggaagucuaugccgcaguuaagggccuuaggaaagcggaugcccgacuggcuaucgcccgccucguguccgcauucaaguugcaugagcagcugaacguacccgugcaaaaacuaacagcugguaucacucggaagcugugcuuuguccucucacuucugggaaauucuccaguguuauugcuggacgaacccagcaccgggauugauccuacgggccagcagcagauguggcaagccauacaggcaguugugaagaacacagagagagguguccuccugaccacucacaaucuugccgaggcugaagcgcugugugacaggguggccaucaugguuaguggccgucuccgcugcauuggguccauccagcauuugaaaaacaagcugggaaaagacuacauuuuagagcuaaaggugaaagaaaccagccaggucacacugguacacacugagauccucaaacuuuucccacaagcagcuggccaggagcgguacucuucacuguugaccuauaagcugcccguggccgauguuuacccucucucccagacauuucacaagcuggaagccgugaagcauaacuucaaucuugaggaauauagucucagccagugcacgcuggagaaagucuuuuuggaacugucgaaggagcaagagguggggaacuucgacgaagagauagauaccacuaugagauggaaauuacuaccgcacucugacgaaccauga

SEQ ID NO: 52268 - RNA, 6441 nt, Artificial Sequence
  derived and/or modified sequence opt3 from ABCA7__Homo_sapiens__NP_061985
auggccuucuggacacagcugaugcuccuucuguggaagaauuuuauguacagaagacggcaacccgugcaguuguuagucgagcugcuauggccucucuuccuguuuuucauccuuguugcugugcgccacucucauccaccgcuggaacaccaugagugccacuuucccaauaaaccuuugccauccgcuggcacuguacccuggcuccaggggcugauuuguaacgugaauaacacuugcuucccucagcugacgccaggagaagaacccggucgacucucuaauuuuaacgauucauuagucagucgucugcuugccgaugcgagaaccguguugggcggggcuagcgcccauaggacacuggcuggacuaggcaagcucaucgccacucugcgggcugcacgcuccaccgcccaaccucagccaacaaaacagucuccgcuugaacccccuaugcuggacguugcugaguugcucaccucgcuguuaagaacugagucacugggucucgcccuugggcaggcgcaagaaccacugcacagcuugcuagaggcagccgaagaucuggcucaggagcuccuggcccuuaggagucugguggaguugcgggcacuccugcagcgcccccgaggaacauccggcccuuuagaacugcuaucugaggcucucuguagcgucagaggcccauccucaaccguggggcccagucugaauugguaugaagccagcgaccuuauggaguugguaggacaggaaccggagucugcgcugccugauuccucacucagccccgccugcagugagcugaucggugcacuugacucucacccacuguccagguugcucuggcggcgucugaagccuuuaauucugggcaaacuacucuucgcucccgauacgccauuuacucgcaagcugauggcccaaguuaacagaaccuucgaagaacuuacauugcugagggacgugcgggaagucugggagaugcucgggccccgaaucuuuacuuucaugaaugauagcucgaacguggcuaugcugcagcgcuuacugcagaugcaagacgaaggaagaaggcagccucggccaggcggucgcgaucauauggaggcccuuaggagcuuuuuggacccgggguccggaggcuacucauggcaggaugcacacgccgacgugggccaucucgucgggacccugggaagaguuacagagugucuaagucuggacaagcucgaagcugcgcccagcgaggcagcccuggugucccgugcacuucaguugcuggccgaacaccgguucugggcggguguaguguucuuaggcccugaggauucuagcgacccaaccgaacaccccacgccugaucucgggccaggacauguccgaauuaaaaucagaauggacauagaugugguuacuaggacaaauaagauccgcgaccgguuuugggaucccggcccggccgcugacccucugaccgaucuuagauaugugugggguggguucgucuaccugcaagacuugguggagagggccgcaguacgcguucucucaggcgcgaacccacgagcuggacuguaucuacagcagaugcccuacccuugcuauguggaugacgucuuucugcgggugcucagucguucccugccccuuuucuugacucuggccuggauuuacagcgucacauuaaccgugaaagcaguugugagagagaaggaaacgaggcuccgcgacaccaugcgggccaugggccugucuagagcuguacuuuggcuggggugguuucuaucaugucucggaccauuccuguugagugccgcacuguuaguccucgugcugaaacuuggugauauccugccuuacagccaccccggcguuguguuuuuguuccucgcugccuuugcggucgccacagugacucaguccuuccugcuaucugcauuuuucucgagggcaaaucuggccgcugccugcgggggacuugcauauuuuagccucuaccugccauauguauuguguguggcguggcgagaccgccugccggccggcggucggguugcugccuccuuacucucaccugucgcauucggguucggcugcgagagucuggcacuucuggaggaacaaggagagggcgcccaguggcauaacguggggaccagacccacagcagauguguuuucuuuggcccaggucagcggacuccugcuacuggacgcugcgcuuuacggucucgccacuugguaucuggaagcaguuuguccaggccaguacgggauucccgagccuuggaauuucccauuuaggcguuccuauuggugcggaccccgcccuccgaagucaccagcucccugcccuaccccauuggaucccaagguguuaguggaagaggccccuccgggccugagccccgguguaucuguccggucccucgagaaacgguucccagggaguccucaacccgcccugaggggccuuagccuggacuuuuaccagggacacaucacagcuuucuugggccauaacggggcaggaaagaccacuacgcuaucuauacuguccggccucuuuccaccuucaggugggagugccuucauucugggacacgaugugcgaagcucgauggcggcuauccggccccaccuuggcguuuguccacaguacaacguguuauuugacaugcugacagucgaugagcaugugugguucuauggucgccucaaaggcuuguccgccgcaguuguggggccggagcaggacagacugcuccaagauguaggacuggucucuaagcagagcgugcagaccaggcaccuuucaggcgggaugcaacggaaacugaguguggccauugcuuuugucggaggcucccagguugugaucuuggacgaaccuacugcugguguagaucccgccucucgaagagggaucugggagcuacugcucaaguaccgcgaaggaaggaccuuaauucugagcacacaucaccuugacgaggcggaacugcucggcgaccguguggcugucguggccgguggccgguugugcuguugcggguccccacuguuccucagaaggcaccugggaucaggcuauuaccuuacccuaguuaaagcacgccugcccuugacuacaaaugagaaggccgauacggacauggaggggagcguggauacccgacaggaaaagaaaaacggaagucagggcucuagagucgguacuccucaauuacuggcucucgugcagcauuggguuccaggggcccggcugguggaggaacuuccccacgagcugguccucguauugccuuauacaggagcacaugacggcuccuuugcuacccuguucagggaacuagauacacgccuggccgagcuccgucuuacugguuacggcauaagcgacaccucgcuggaggaaaucuucuuaaaggugguugaggaaugugcggccgauacggacauggaggaugggucaugcggacagcacuuguguaccggcauugcagggcuggacgugacacucagacugaaaaugccgccacaggagacugcucuugaaaauggagagcccgccggcucugcuccugaaaccgaucaagguagugggcccgacgcagucggacgggugcagggcugggcccugacaaggcagcagcuccaagccuugcuguuaaagcgcuuucuacuggcucgaagaucccggaggggccucuucgcgcagaucguacuuccagcacuguuugugggguuggcccuggucuucagccucauaguuccucccuuuggacauuauccagcucugcgccuuucuccuacuauguacggugcccaggugagcuucuuuuccgaggaugcaccgggcgaccccgggagagccaggcuccuggaggcuuugcugcaagaggcgggauuagaggaaccaccugugcagcacucaagucaccgguucagcgcccccgaggucccagcagaaguggcuaaaguucuagccucuggcaacuggaccccugagucccccucaccggcaugccaguguagucguccaggugcccgccgacugcucccugacugccccgcugccgcagggggaccacccccuccgcaggcaguaacgggcagcggcgaagugguccaaaaucuuacagggagaaaccuguccgacuuuuuggugaagaccuaccccaggcugguucggcagggacucaagacuaaaaagugggugaaugagguccgcuaugguggcuucucucuagggggaagagacccaggccuuccuucgggucaggaguuagggaggagcguggaggaacugugggcccucuugucaccccugccuggaggcgcucuagaucggguacugaaaaaccucacagccugggcucauucccuugacgcacaggauagucugaagauuugguuuaauaacaaaggcuggcacucuauggucgccuucgugaaucgagcuagcaacgccaucuugagagcacaucugccacccgggccugcgcgccacgcccauuccaucaccacucucaaucacccacugaacuuaaccaaggaacaacuuucagagggagcucugauggccucuagcguugacgugcucgucaguauuugugugguuuucgcaauguccuuugugcccgcuagcuucacccugguccugaucgaagagagggugacgcgggccaagcacuugcagcugauggguggccucucuccgacccuuuacuggcuggggaacuuuuugugggauaugugcaacuaucugguaccugcaugcauugugguucucauauucuuagccuuucagcagcgugcuuacgucgcgccagccaaccugcccgcacuucugcuacuccuguugcuguauggauggucaaucacuccucucauguacccagcuuccuucuuuuucagugugcccagcacagccuaugugguccuuaccuguauuaaucuguuuaucggcaucaacgguucgauggccacauucguauuagagcuguuuucugaccaaaaauugcaggaaguguccaggauucucaagcagguuuuccugauauuuccgcauuucugccuagggaggggacuuaucgauauggugcgcaaucaggcaauggcugacgccuucgagcggcugggcgaucgacaauuucagagcccucucagaugggaagucgugggcaaaaaccuguuggcgaugguuauucaggggccccuguuccuccuuuuuacucuguuacugcaacacaggucacaguugcucccacagccucgcgugcggagucugccccuacuuggagaggaggacgaagacgucgcuagagagcgugaaagggugguacagggugccacccaaggcgaugugcugguucuccggaaucugacgaaggucuaccgcgggcagcgaaugccagcaguggacagauuguguuuaggaauacccccuggcgagugcuucggucugcucggggugaacggagccggcaaaacaucuaccuuuaggauggucacuggcgauacccuugcuuccagaggggaagcaguucuggccggacauagcguggcgcgcgagccaucagcugcccaccuaaguauggguuacuguccgcagagcgacgcaauuuucgagcugcucacaggcagagaacacuuggagcugcuugccaggcugcgagggguacccgaagcucagguggcccaaacugcaggauccggccucgcucgguuaggucugucuugguaugccgaucguccugcggggaccuacagcggcggaaauaagagaaaguuggccacagcacuggcucucgucggcgacccagccgugguuuuucuugaugagcccacgaccgggauggacccuuccgcacgcagguuccuguggaacucacuacuggcugugguccgggaaggaagaucuguaaugcucacaagucauucgauggaggagugcgaagccuuguguagccgccuggccaucauggugaaugguagguuucgaugccuuggcuccccacagcaccugaaagggcgguucgcggcuggacauacauuaacccucagaguucccgcagccaggucucagccugcugccgcauuuguggccgcugaguucccgggcgcggaacugcgcgaggcccacggugggcguuugcgguuucagcugccacccggcggaagaugugcacucgcuagggucuucggcgaacuugccgugcauggggcagagcacggagucgaggauuucucagugagccaaacuaugcuggaagagguuuuucuauauuucuccaaggaccaggguaaagaugaagacacagaggagcagaaggaagccggcguggggguagauccugcucccggacugcaacacccaaaacgcgugagucaguuucucgacgacccuucuaccgccgagacggucuuguga

SEQ ID NO: 52269 - RNA, 4875 nt, Artificial Sequence
  derived and/or modified sequence opt3 from ABCA9__Homo_sapiens__NP_525022
augagcaagagaaggauguccgugggccagcaaaccugggcccugcucugcaaaaacugucuuaagaaauggcggaugaagcgccagacacuguuggagugguuauucucuuuucugcuaguccucuuccuguacuuguuuuucucaaaucugcaccagguucaugacacuccccagaugaguagcauggauuuggggcgaguggacuccuuuaacgauacgaauuauguaaucgcuuucgcaccugaaucuaaaaccacacaagagauuaugaacaagguggccucggcgccauuucucaagggacguacuauaauggguuggccggacgaaaaaucaauggaugagcuggaccugaauuacagcaucgaugcugucagagugauuuucaccgacacauuuaguuaucaccucaaguucuccuggggccauaggauccccaugaugaaagaacaccgggaucauucugcccacugccaggcaguuaacgagaagaugaaaugugaggggagcgaauuuugggagaagggauucguggccuuucaggcugcaauuaaugccgcuaucauagaaaucgccaccaaccacuccgucauggagcaguuaaugucagugacuggcguacauaugaagauucugccuuucguugcgcaaggugggguggcaacagacuucuuuaucuucuuuugcauuaucaguuucagcaccuuuauauacuaugucucugugaaugugacgcaggagcgccaguacauuacuucccuuaugaccaugaugggauugagagaaucagccuucuggcugagcuggggccuaauguaugcuggcuuuauccucauuauggccacacugauggcacuuaucgucaaaagugcucagaucguugugcugacuggguucguaaugguguuuaccuuguuccuccuguacggauuaucucugauuacacucgccuuucuuauguccguccugauaaagaaaccauucuugaccggucuagugguuuuucugcucaucguguucuggggcauucugggguuccccgcgcuuuacacgaggcugccugccuuuuuggaguggacucucugucuguuaagcccauucgcauuuacagucggaauggcucaacugauccaccuagauuaugacgugaacucgaaugcccaucucgauucuucccagaaccccuaccugauaauugcuacccuuuucauguugguauuugacacucugcucuaucugguucuuacacuguacuucgacaagaucuugccugccgaauauggccaccggugcucaccacucuuuuuccugaaaaguuguuuuugguuccagcacggucgcgcaaaucauguggucuuagagaacgaaaccgauagcgacccgacgcccaaugauugcuuugagccuguguccccagaguucugugggaaggaagccauccgaauuaaaaaccugaagaaggaguacgcuggaaaaugcgaaagagucgaggcgcuaaagggcgugguuuuugacaucuaugaaggccaaauuaccgcacuccuggggcacucuggagccgguaaaacaacucuuuugaacauacugagcggccucucagugcccaccaguggguccguaacagucuacaaucauacucugagcaggauggcugauaucgagaacauuucuaaguucaccggauucuguccucagucaaaugugcaguuuggcuucuuaacaguuaaagagaaccugcggcuuuuugccaagaucaaggguaucuugccacacgaaguggagaaagaaguccagcgugugguacaagagcucgaaauggagaauauucaggacauacuggcacagaaccuaagugggggccagaaucgcaagcugaccuucggaaucgccauucucggcgauccccaagugcugcuuuuggacgagccgacugcugggcuggauccuuuaagcagacauaggaucuggaaccuccugaaagaaggaaaguccgaccggguuauucuguuuucuacgcaguucaucgaugaggccgacauacuugcagaccgaaaagucuuuaucucgaaugguaaguugaagugcgcgggcagcucccucuuccugaaaaagaaaugggggauuggauaccaccuaucacugcaccucaacgaacgcugcgaucccgagaguaucacaucucuggugaagcagcauauuagcgacgcuaaacuuaccgcccaguccgaggaaaaguugguguauauccugccauuagagagaacuaauaaguuuccugaacucuacagggaucuggaccgguguucaaaccaaggcauagaggauuauggugucagcauuaccacacuuaaugaaguuuuccugaaacuagaggggaagucuaccaucgacgaguccgauauuggcaucuggggacagcuccagacugacggcgcaaaagauauagggagucugguggaauuggaacaggugcugagcucuuuucacgagacacgcaagacgaucuccggaguagccuuauggagacaacaggucugcgcuauugccaaagugagguuccucaagcugaaaaaggagcguaagucacuuuggaccauccugcuucucuucgguauuaguuuuaucccccagcugcuagaacaucuguucuacgagagcuaucaaaaaucguacccaugggagcuuucccccaacacuuauuuucucucuccuggccagcagccacaggacccgcugacacacuugcugguuauaaauaagaccgggagcacaauugauaacuucuuacacucacuccggcgacaaaacaucgcaaucgaaguggacgcuuuuggaacuagaaauggcaccgaugaccccaguuacaacggugccauuaucgucuccggggacgagaaagaucauagguucucuauugcguguaauacgaagcgccugaacugcuuuccugugcuucuggacguuauaagcaauggcuugcucggaaucuucaacuccucagaacacauucagaccgaucggagcacauuuuucgaggaacauauggacuacgaguauggcuacagaaguaauaccuuuuucuggaucccaauggccgcuucuuuuacucccuauauugcaauguccagcaucggggauuacaaaaagaaggcccacucgcagcugaggauaucaggacuauauccuucugcuuacugguucggccaggcccugguggacguaagucuuuauuuccucauccuguuguuaaugcaaauuauggauuacaucuuuuccccagaggaaauuaucuucauaauucagaaccugcucauccagauccuguguagcauugguuacgucucuagccuuguguuucugacauaugugauauccuucaucuuucgcaaugggcgaaagaacucaggaauuuggaguuucuuuuucuugaucgucguuauuuuuagcaucguggcaacugaccuaaaugaguacggcuuccugggucucuuuuucggcaccaugcugauacccccguuuacgcuuaucgggucuuuauucauuuucuccgaaaucucaccugauaguauggacuaucugggagcgagcgaguccgagauuguauaccucgccuugcugaucccauaucuccauuuucugauauuccuuuuuauucugcggugcuuggaaaugaacugucguaagaaacuaaugagaaaggaucccguguucaggaucucuccucgcucgaaugcuaucuuucccaacccagaggaaccugagggcgaagaggaggacauucagauggaacggaugagaacagucaaugccauggcagugagggauuucgacgagacccccguuaucauagcuagcugccugcgaaaagaauacgccgggaagaagaaaaacuguuuuucaaagcgcaaaaagaaaauugcaacucggaacguguccuucugcgucaagaagggagaggugaucggccucuuaggucacaauggggccggaaaaaguacaaccauuaagaugaucacuggcgacaccaaaccaacagcuggucaaguuauacugaagggcucugggggaggcgaaccgcuuggguuucugggauauuguccucaggagaacgcgcucuggcccaauuugacggugagacagcaccuggaggucuacgccgcaguaaaaggccucaggaagggugaugcuaugauugccaucacccgucugguggacgcccuuaaacuacaagaucagcugaaggcuccaguuaagacuuugagcgaagggaucaaacgcaaguuaugcuucgugcuguccauucucggaaaccccucagucgugcugcuugacgagccuucuacaggcauggauccagaaggucagcagcaaauguggcagguaauccgggcaaccuuuagaaauacagagaggggcgcccugcucacuacccauuacauggcggaagcugaggccgugugcgaccgagucgcaauuaugguuagcgggcgguugcgcuguauaggaaguauccagcaccugaaauccaaguucggcaaagauuaucuacuggagaugaagcucaagaaccuugcccagauggaaccccugcaugcugagauuuuaagauuguuuccucaagcagcccagcaggaaagguucagcucucugaugguguacaaacucccgguggaggacguccggccacugucacaggcguucuuuaaacuugagaucgugaaacaauccuucgaucuggaagaguauagucucagccagucgacguuggaacagguuuuucuggaguuaucuaaggaacaggagcuaggggaccuggaggaagauuucgaccccuccguaaaauggaagcuccuucugcaagaggaaccuuga

SEQ ID NO: 52270 - RNA, 3966 nt, Artificial Sequence
  derived and/or modified sequence opt3 from ABCB11__Homo_sapiens__NP_003733
augagcgacuccgugauccugagaucuauuaagaaauucggcgaggaaaacgauggguuugagucagacaagaguuacaauaacgauaaaaagagcaggcuccaggacgagaaaaagggagaugguguccggguuggcuucuuucaacuuuuccgcuuuuccucuucgaccgacauauggcugauguucguggggucauugugcgccuuuuuacacggaaucgcucagcccggcguacugcuaauuuucgguacaaugacugauguguuuaucgacuaugaugucgaacuccaggaacugcagauuccugggaaggcaugugugaauaacacgaucguuuggaccaauagcagucuuaaccaaaauaugacaaacggaacucgaugcggccuguugaauauagaguccgagaugaucaaauucgccucuuacuaugcgggcauugcuguggccguccucaucaccggguacauucagaucuguuuuugggugauagcagccgcucgucagauucagaagaugagaaaauucuauuuuaggcggaucaugcgcauggaaauuggaugguucgacugcaacagcguaggugagcugaauacaagauucuccgaugacaucaacaagaucaaugaugcaauugccgaccaaauggcucuguuuauacagaggaugaccucaacuaucuguggcuuccucuuaggguuuuuccggggauggaaacugacacuuguuauuaucagugugagcccauugauaggcauuggugccgcgaccaucgggcugucugucuccaaguuuacggacuacgaacuaaaggcauaugccaaagcuggagugguggccgaugaggucaucucaagcaugcgcacuguugcagcuuucggcggcgagaagcgagaaguggagagauacgagaaaaaccucguauuugcccagaggugggggauucggaagggaaucgugauggguuucuuuaccggcuucgucuggugccugauuuuucuuuguuacgcgcuggccuucugguaugggaguacauuggugcucgacgaaggagaauacacuccgggcacccugguucagauauuuuuaucugugaucgucggugcacugaaucucgggaacgcuucccccugccuugaggccuucgcuacaggccgugccgcagccaccagcauuuucgagacgaucgaucgcaaaccuaucauugacuguaugucggaagauggauauaagcuggacagaauaaaaggcgagaucgaauuucauaacgugacuuuccacuacccaucuaggcccgagguaaagauuuugaaugaucuaaacaugguuaucaagccuggggaaaugacagcucuggugggaccauccggugcgggcaaaucaaccgcacuccaacugauucagcgguuuuaugaccccugcgaggggauggucacuguggauggacaugacauccgaagucuuaauauacaguggcugcgcgaucaaaucggcauugucgagcaggaaccuguguuguucagcacaaccaucgccgagaacauuagauacgguagggaagacgcuacgauggaggacaucguucaggccgcaaaggaagccaaugcuuauaacuuuauaauggaucucccacagcaauucgacacccuggugggggagggcggaggccagauguccgggggacagaaacagcggguagccauugcacgcgcguuaaucagaaauccgaagauucugcuacucgauauggcuacaucugcccuggacaacgagagcgaagcaaugguccaagaggugcuuucaaaaauccagcacggucauacuauaaucaguguugcccacagguuguccaccgugcgugcugccgauacaauuaucggcuuugaacacgggacugcagucgagcggggaacccaugaggaacugcucgagcgaaagggcguguacuucacacugguaacccuucagagccaggguaaucaagcucugaacgaagaggacauuaaggaugccacugaagacgauauguuggcgagaacguuuucuagggggucauaccaggacagucuccgcgccagcauccggcagagauccaaaucucagcugucguauuuagugcacgagcccccucuggcuguugucgaucauaagagcacauacgaggaagacaggaaagauaaggacauaccagugcaagaggaaguggagcccgcaccuguccgccggauucuaaaauucuccgccccagaauggcccuauaugcucguuggcucagugggagcugccgugaauggcaccguaacuccgcuguacgcauuucuuuucagucagaucuuggggaccuuuucuaucccugacaaggaggagcagcgaagccaaauuaacggagucugucuccuguucguggcgaugggcugcguuucccuguucacacaguuuuuacaggguuaugccuucgcuaagucaggggaacugcuuaccaaacguuugagaaaguuuggauucagggccaugcucggccaggauaucgcaugguuugacgaucugcgcaauagccccggugcucuaacuacacggcuggccacggacgcaucucaagugcagggcgccgcugggucccagauuggaaugauagucaacaguuucaccaaugugacuguugcgaugaucauugccuuuagcuucucuuggaaacucucccuggugauccuuugcuuuuucccauuuuuggcacugucaggcgcuacacagaccagaauguuaacaggguucgccaguagggauaagcaagcccucgagaugguaggacagauuacuaacgaagcucugagcaacauccgaaccgucgcaggcauagguaaagagcgccgguucaucgaagcccuugagacggagcuggaaaagccuuuuaagaccgcgauucagaaagcuaauaucuacggguucuguuuugccuucgcacagugcauuauguuuaucgccaacucggcuuccuauagauacggaggcuacuugauaucuaaugagggucuccacuucagcuauguguuuagggugauuucagcagucguucugagugccacagcgcuaggccgugcuuucuccuacacucccucuuaugccaaggcaaaaaucagcgccgcucgcuuuuuccaacugcucgaccggcagccacccaucuccguguacaacaccgccggggaaaagugggauaauuuucagggaaaaauugacuucguagauuguaaguuuacauauccuucaagaccagacagccaagugcugaacggccuuagugucucuauauccccggggcagacuuuggcauucgugggaagcucgggcugcgguaaaucaaccucuauccagcuguuagagagguucuacgaucccgaccaggggaagguuaugauugauggacacgacaguaagaaagugaauguccaauuucuccgauccaacaucggcauugugagccaggagccuguucuguucgcuuguucuaucauggacaauauaaaguauggugauaacacgaaagaaaucccaauggagcgggugauugccgcggccaagcaggcacagcuucaugacuuugucaugagccugcccgaaaaauacgagacaaauguaggcucccaagggucacagcuaagucgcggagaaaagcagagaaucgcuauugccagggcuaucgugcgggauccuaagauacuccuguuggacgaggcaaccagcgcccuggauacugagucugagaaaacaguucagguggccuuagacaaggcucgagaaggcagaaccugcauugucaucgcgcaccgccucuccacuauccaaaacgcagauauuaucgccgugauggcucaggggguagugauagaaaaaggaacccaugaggaacugauggcccagaagggcgcauacuauaaacuugucacaacggguucaccaauuaguuga

SEQ ID NO: 52271 - RNA, 3843 nt, Artificial Sequence
  derived and/or modified sequence opt3 from ABCB1__Homo_sapiens__NP_000918
auggaccuggagggcgauagaaacgggggagccaagaaaaagaauuucuuuaaacucaacaauaagagcgaaaaagacaagaaggagaaaaagcccaccguguccgucuucucuauguuuagguacucaaacuggcuugauaaacuguauaugguuguggguacauuggcugcaaucauucacggcgccggguuaccucugaugaugcuaguauucggagaaaugacugacauauuugcgaaugcuggcaaccucgaggaucugaugaguaauaucacgaaccggagcgacauuaaugauaccgguuucuuuaugaaccuugaagaggacaugacacgcuacgccuauuacuauuccgggaucggagcaggcgugcuggucgccgcuuacauucaggugucuuucuggugcuuggcagccggccgacaaauccauaagauacguaaacaguuuuuccacgcuaucaugagacaggagauugggugguuugauguucaugacgugggagaacucaauacuaggcugaccgaugacgucucgaagaucaacgaggguauuggcgauaagaucgggauguucuuucagucaauggccacauucuucaccggauuuauagugggcuucacucgggguuggaaacugacacucguaauuuuagcgaucagcccaguucuggggcuuagugcagccgugugggcuaagauuuuguccucuuuuaccgacaaagaacugcuagccuaugcaaaggcuggagccgucgcggaggaggugcucgccgcaauccgcacggugaucgcuuucggcggccagaaaaaggaacuggagagauacaauaaaaaccuugaagaggccaagaggauugggauaaagaaagcuaucacugccaauauuagcaucggagcagccuuucuguugauauacgcuuccuaugcgcucgcauucugguacgguaccacacuggucuuaucaggcgaauauaguauugggcagguucugacuguguuuuucagcguacucaucggagccuuuucugugggccaggcuuccccgucaaucgaggccuucgcaaacgcccggggugcugccuacgagauuuuuaagaucauugacaacaaacccagcauagauaguuauucuaaguccgggcacaaaccugacaauaucaagggcaaccuugaguuccgcaauguccauuuuagcuacccaucgcgaaaggaagugaaaauucugaagggauugaaccuaaaaguucagucuggccaaaccguggcacuggucggaaauuccgggugugguaagucaacaaccgugcagcucaugcagagacuguaugaucccacggaaggcaugguaaguguugacgggcaggauaucaggacuaucaacgugcgguuccuucgugagauuauaggagucgugagccaagaaccuguccuguucgcgacaaccaucgcugagaauauucgcuacggcagagagaacgugacuauggacgaaaucgagaaagccguuaaggaagcaaaugccuacgauuuuauuaugaaguugccacacaaauucgacacacucgugggugagaggggcgcucagcuguccgggggacagaagcaacggaucgccauagcacgagcuuuaguacgcaaccccaaaauccugcuacucgaugaagccaccucugcgcuggacacggagagcgaggccgucgugcagguugcucuugauaaggcaagaaaaggcaggaccacaauugugaucgcccaccgguugucaacuguccgcaaugcugacgugauugccggguuugacgauggaguaaucguggaaaaggguaaccaugacgagcugaugaaggaaaaaggcauauauuucaagcucguuaccaugcagacagcagggaaugaggucgagcuggaaaacgcggccgaugagaguaaauccgaaauugacgcucuugagaugagcucuaaugauucaagaaguagccugaucaggaagcguuccacucggcgaucugugagaggaucgcaggcccaagacaggaaauugagcaccaaggaagcacucgaugaguccauuccuccagugucauuuuggcgcaucaugaaacugaacuuaacagaguggccguacuucgucguuggcguguuuugcgcuauaaucaacggugggcugcagcccgccuucgcaauuaucuuuaguaagauuaucggcguguucacccggauagacgauccugaaacuaagagacaaaauucuaaccuauuuagccuccuguuccuugccuugggaauuaucuccuuuaucacguucuuccugcagggcuuuacauucgggaaagcuggagagauucucaccaagaggcugcgcuauaugguauuucgaucaauguuacggcaagacgucagcugguucgaugaccccaaaaauacuaccggcgcgcugacaacccgucuugccaacgaugcagcucaggugaagggugccaucgggucuagauuggccguuauuacucagaauauagcuaaccucggaacaggcaucauuaucuccuuuauuuacgguuggcagcugacgcuacugcuccuggcaaucgugccaauaaucgccauugcgggcgucguggaaaugaaaaugcuuagugggcaggcuuugaaggacaagaaagagcuggaaggaagcggcaagaucgccaccgaggcaauugagaauuucaggacuguugugucuuuaacacaagaacagaaauuugagcacauguaugcccagucccuccaaguaccuuaccgcaacucacugcggaaggcucauaucuucgggauaaccuuuaguuucacacaggcaaugauguauuuuagcuacgccggauguuucagauucggcgcguaccuugucgcucacaaacugaugucguuugaagacguguugcucguguucuccgccgucguuuuuggugcaauggccguggggcagguaucuagcuucgcuccagauuaugccaaggcaaagauuucagcugcccacaucaucaugauuauagagaaaacuccccugaucgacaguuacuccaccgaaggacuaaugccgaauacgcuggagggcaacgugaccuuuggugaggucguguucaauuauccuacaaggcccgauauuccaguucuccaaggccugucucuugaagugaagaaagggcagacuuuggcgcuggucggaagcuccggcugcgggaagucaaccgugguucaguuacucgagcgauuuuacgacccucuggccggaaaagugcuucuggauggcaaggaaaucaagcgccuaaacguccaguggcuccgggcacaucuggguauuguaagccaagagcccaucuuguucgacuguaguauagcugagaauaucgccuauggggauaacucuagagugguuucccaggaagagauugugagggcugcaaaagaagccaauauccacgccuuuauugagagccugccaaacaaguacucgacaaaagucggagacaagggcacucaguuaucagguggccagaaacaacguaucgcuauagcgcgcgcacucgugcggcagccccauauucugcuucuggaugaagccaccucugcuuuggacacggagagugagaagguagugcaggaagcccucgauaaagcaagagaggggaggacaugcaucgucaucgcccaccgacuguccaccauucagaacgcugaccuaaucguuguguuccaaaauggacgggugaaggaacauggcacucaccagcagcugcuugcgcaaaaggggauauauuuuagcauggucucugugcaggccggaacaaaacgccaguga

SEQ ID NO: 52272 - RNA, 3840 nt, Artificial Sequence
  derived and/or modified sequence opt3 from ABCB4__Homo_sapiens__NP_000434
auggaccuggaggccgcuaagaacggcaccgcauggagacccacaagcgccgaaggggauuucgagcucggaaucuccucuaaacagaagaggaaaaagacuaaaacggugaagaugauugguguccuuacccuguuucgguacucagacuggcaagauaaguuguucaugaguuuaggcacaauaauggcgaucgcucacgggagcggacugccucuaaugaugauuguuuuuggcgaaaugacugacaaauucguggauaccgccgguaauuuuuccuucccaguaaacuuuucucucucgcugcuuaauccggggaagauccuggaggaagagaugacacgcuaugcauacuauuacucaggauugggcgccggcgugcucgucgcugcauauauucaggugagcuucuggacccuggccgcugggcgacagauccguaaaauaagacagaaguuuuuccaugccauccugaggcaagagauuggaugguuugacaucaacgauacuacagaacucaauacccgguuaacggacgauauuaguaaaaucuccgaggguauaggcgacaagguugggauguucuuucaggcgguggcaacuuucuucgccggauuuauugucggcuucauccgcgguuggaagcugacccuugugauuauggcuaucucucccaucuuggggcugagcgccgcaguaugggcuaaaauucuauccgccuuuucagauaaggaacucgcggccuacgcaaaagcuggagccguugcugaggaggcccugggcgcaauaagaacagugaucgccuucggcgggcagaacaaggaacuugagagguaucagaaacaccuggaaaaugcuaaggagauuggaaucaaaaaggcgauaagugcaaacauuagcauggguaucgccuuuuugcucaucuacgcuucuuacgcccuggcauucugguauggcuccacuuuagucauuucaaaggaauacaccaucgggaaugccaugacaguguuuuucagcauucugauaggagcuuuuagugugggccaagccgcaccuugcaucgacgcguucgcuaacgcccggggugcagccuaugucauuuuugauaucaucgacaauaacccaaaaauugacucuuucuccgagcgcgggcauaagcccgauagcauaaaaggcaaucucgaguuuaacgacguucacuucucguacccuucucgagcuaaugugaagauccuuaaaggacugaacuugaagguacaguccggccagaccguggcccuagucgggucaaguggaugugguaagagcacgacugugcagcugauucaaagacucuaugauccagacgaaggcacaaucaacauugaugggcaggacaucaggaauuucaacguuaauuaccugcgggagauaaucggaguggucucccaggaacccgugcucuuuucuaccacuauugcagagaacaucugcuauggccgugguaauguaacaauggaugaaauuaaaaaggcuguuaaagaggccaacgcguacgaguucaucaugaagcugccucaaaaauuugacaccuuggugggggaacgcggcgcccagcucagcggaggccagaagcagagaauagcuauugcaagggcccugguccggaauccaaagaucuuacugcuagaugaggcuacgucagcccucgacaccgaaagugaggcagaagugcaagcggcccuggauaaagcucgagaggggcgcacaacuauugucaucgcccauagacuuuccaccgugaggaacgcagacguuauagcuggauucgaggacggugugaucguagaacagggcagccacucugaguugaugaagaaagaaggggucuacuuuaagcuggugaauaugcagacaucaggaagucagauucaaagcgaggaguucgaacucaacgaugagaaagccgcaacucggauggccccgaauggcuggaagucccgccuguuuagacacucuacccagaagaaccuuaaaaauucgcagaugugucaaaagagccuggacguugaaacagaugguuuggaggcuaacgugcccccugucuccuuccucaaagugcugaaguuaaauaaaaccgaauggccauauuuuguaguggggacuguuugcgcgaucgccaacggcggacugcaacccgcauucucagucauuuuuagugagaucauagcuauuuucggcccuggggacgaugccgugaagcagcagaaauguaacaucuuuucucuaaucuuccucuuccugggaauuaucagcuuuuucacguuuuuccuucagggcuuuacauucgguaaggccggggagauuuugaccaggcgucugcgguccauggcuuuuaaggcaaugcuccgacaagacaugucaugguucgaugaccauaaaaauagcacuggagcccugucuaccagauuagcgacagaugcugcccaggugcagggcgcaaccgguacuaggcuggcccuuauagcucaaaacaucgcaaauuugggcacagggauuaucauuuccuuuaucuacggauggcagcucacgcugcuacugcucgccgucguuccaauaaucgcggugaguggcauuguggaaaugaagcugcuugcugggaacgccaaacgcgacaagaaagaguuggaagcagccggaaagaucgcuaccgaggccauugaaaauauccggacuguagucagccugacacaggagagaaaguucgagucuauguauguggaaaaauuauacggccccuauaggaacuccguucagaaggcacacauauacgguauuaccuuuucaaucagucaggcuuucauguauuucagcuacgccgggugcuuucgcuucggagcguaccucaucgugaauggccauaugcgauuucgggaugucauucugguguucucggccauaguuuuuggugcaguggcucuuggccacgccuccucuuucgcuccggacuaugcaaaagccaagcugagcgccgcucacuuguuuaugcuuuucgagcgucagccucugaucgauucauacagugaagaggggcuaaaacccgacaaguuugaaggaaacauuacauucaaugagguagucuuuaacuauccaacuagagcgaaugugccugugcugcagggccucucccuggaggucaagaaagggcagacccuugcauugguuggaucuagcggcugugguaaguccacggugguacaacuguuagaaagguucuacgacccccucgccgggaccgugcugcuugauggacaggaggcuaaaaagcugaacguccaguggcuacgcgcccagcucggcaucgugucacaagaaccaauucuguuugacugcagcaucgcagagaauauagccuauggugauaacagucggguugugucucaggacgagaucgucuccgcugcgaaagccgcaaauauucaucccuucaucgaaacauugccucacaaguacgagacuagagugggcgauaaggggacccagcugagcggaggccaaaaacagaggauugcuaucgcccgagcauuaauacgccagccacagauucuccugcuugacgaagccacaucggcucuggauacugagucagaaaagguugugcaagaggccuuggacaaagcgcgggaggggagaaccuguaucgucaucgcacauaggcucucuacgauucagaacgccgaucugaucguaguguuccagaacggacguguuaaggaacacggcacacaucagcaacuacuggcucagaaagguauauauuuuaguaugguguccguccaggccgggacccagaaucuuuga

SEQ ID NO: 52273 - RNA, 3774 nt, Artificial Sequence
  derived and/or modified sequence opt3 from ABCB5__Homo_sapiens__NP_001157413
auggagaacagcgaaagagccgaggaaaugcaggagaauuaccaaaggaacggcaccgcugaggaacagcccaagcugcggaaagaggcagugggguccaucgaaauuuuccgcuuugccgacggacucgauauaacacuuaugauccuggguauuuuggcgucuuuagucaauggcgcuugccugccucuaaugccacucguucugggggagaugucagacaaccuuaucaguggaugucuggugcagacuaauacgaccaacuaucagaauugcacacaaagccaggaaaaguugaacgaggauaugacucuccugacccuguacuauguaggcauugguguggccgcacucaucuucggguacauacagaucuccuuauggauuaucacagccgcucgacagaccaaacguauuagaaagcaauuuuuccacucuguccuggcacaggacaucggaugguuugauucgugugacauaggcgagcuuaauacuaggaugacagaugacauugauaaaaucucagacggcauuggggauaagaucgccuugcuguuccagaacaugagcaccuuuaguaucggacuagcugugggucucguuaagggcuggaaacugacgcuugugacucuguccaccucuccguugauuauggccagcgcggcagccugcucccggauggucauaucacucacaaguaaggaacugagcgcuuauucuaaagccggggcaguggcugaggaaguauuauccucaauccgcacuguuauugccuucagagcgcaggagaaggaacugcaaagguacacccagaaucucaaagacgccaaggauuuuggaaucaagcggacaauagcaagcaaagugagucuuggcgcugucuauuucuuuaugaacgguaccuacgggcuggccuucugguacggaacgucuuugauucuaaauggcgagcccggcuauacuaucgggacagugcuggcuguguuuuucuccgucauccauagcucguacuguauuggagccgcaguuccucacuucgagaccuuugccaucgcucgcggugcggcauuccauauuuuucaggugauagacaagaaaccaucuaucgacaacuucuccacugccggcuauaagcccgaaucaauugaggggacaguagaauuuaaaaaugugaguuucaacuacccuagccgaccauccaucaagauccucaaaggacugaaccuuagaauuaagucuggcgagaccgucgcucugguggguuugaaugggagcggcaagucaacgguugugcaacuccugcagagguuauaugaucccgacgauggauuuauaauggucgacgaaaacgauauccgggcccugaaugugcgucacuaccgcgaccauauuggcguaguuagucaggagccugugcuauucgggaccacaaucuccaacaauauuaaauauggaagagaugacgucacugaugaggaaauggagagggcagcccgggaagcuaacgccuacgacuuuaucauggaguucccaaauaaguuuaacacccucgugggugaaaaaggcgcacagaugagcgggggacaaaagcagcgaauagcgaucgcucgcgcccuggucagaaauccgaaaauucuuaucuuggaugaggcaacaucugcccuggacucagagaguaagagcgcugugcaggccgcacucgaaaaggcuuccaaaggcaggacuaccauuguuguggcccaccggcugucuacaauccgcucggcggaccuuauaguaacccugaaggaugguauguuggccgagaaaggggcucacgcagaacucauggccaagagaggccuguacuauagcuuagucaugucccaggacauuaaaaaggcugaugagcaaauggagucaaugacuuacaguacggaaaggaagacaaacucucugccccuacauagcgugaaauccaucaagucagacuucauugauaaagccgaggaaagcacccagucuaaggagaucucccucccugaaguuagucugcuuaaaauauugaagcugaauaagccagaguggcccuuugugguccucggaacucuggcaagcguguuaaacggcaccguacacccuguguucucuaucauuuucgcgaaaaucauuacaauguuugggaauaacgacaagaccacucugaaacaugaugccgagaucuauuccaugauauucguuauucuuggagucaucugcuuugugucauacuucaugcaggguuuguuuuauggccgugcuggggaaauccucacaaugcggcugcgacaccuagccuucaaggcaaugcuguaccaggacauugcuugguuugaugagaaagaaaauaguacgggaggccucaccacuauccuggccauugacauagcacaaauccagggugccacagggagcagaauuggcgugcuuacccagaacgcuacaaacaugggauugucggucaucauuuccuucaucuauggcugggagaugacuuuucugauauuaucuaucgcgccaguucucgccgugaccgggaugauugaaacggcagcuaugaccggauucgccaauaaggauaaacaggagcugaagcacgccggcaagaucgcuacagaggcacuugaaaacauuaggacuaucgugagccugacccgcgagaaagccuuugaacaaauguacgaggaaauguugcagacacagcaucggaauacuucaaagaaagcgcaaauaauugguaguuguuacgcuuucucccacgccuuuaucuauuucgcauacgccgcuggguucagauuuggagcauaucucauccaggccggcaggaugacccccgaggguauguucauuguauuuacggcgauagcuuacggcgccauggcaaucggggagacacugguccuagccccggaauauucuaaggcuaaaagcggagccgcacaucuguucgcucuccuggagaagaagccuaacauugacucccgcucacaggaaggcaaaaagcccgauaccugcgaggggaaucuugaguuucgagaagugagcuucuuuuacccaugucggccugacguuuucaucuugcguggacugaguuuaucuauugagagaggcaaaacuguggccuuugucgguuccagcgggugcggaaagucgacaucagugcagcuccugcaaaggcuuuaugaccccguucagggccaggugcuguucgaugguguagacgcgaaagaacuaaacguccaguggcuccgcucucaaaucgccauagugccacaggagcccgugcuguuuaauuguaguaucgcagaaaacauugcuuacggcgauaauucccgggucguuccuuuggacgagaucaaggaggccgcuaacgcagccaauauucacagcuucaucgaagggcugccagagaaguacaacacccaggugggauuaaaaggcgcccagcucucugggggacaaaagcagagacuggcuauagcgagggcacuucugcagaaaccgaagauuuugcuccuggaugaagccacuagcgcucuagacaaugauuccgagaaaguagugcaacaugcccuggacaaggcacgaaccggccgcacaugccuugucgugacgcaccggcucucagccauccagaacgcugaucugaucguuguguugcacaaugguaagauuaaagaacaggggacccaucaggagcuguuaagaaacagggacaucuauuucaagcucgucaacgcgcaaagugugcaguga

SEQ ID NO: 52274 - RNA, 2529 nt, Artificial Sequence
  derived and/or modified sequence opt3 from ABCB6__Homo_sapiens__NP_005680
auggugaccgucggcaacuacugcgaggccgaagggcccguuggaccugcuuggaugcaggacggucugagcccauguuucuuuuucacacucgugccguccacuagaauggcacuuggcacgcuggccuugguauuagcgcugcccugcaggcggcgcgagcgaccugcuggggccgauucucuaucauggggagcaggcccacguaucagucccuaugugcuccaacugcuucuggccaccuugcaggcugcacucccucuggccggucuggcugggagagucggaacagccaggggcgcgccacuccccagcuacuuacugcuugcauccguguuggaaucucuggccggcgcuugugggcuauggcuccugguuguggagcggucgcaggcccgccagagacuugcaaugggaauuuggauaaaguuuaggcacucaccuggucuguugcuccuguggacugucgcuuucgccgcggaaaauuuagcccuggugagcuggaacaguccacaaugguggugggcacgggcugaccucggccagcagguacaguuuucccuuuggguucugcgcuauguggucucugggggauuguucgugcuaggccugugggccccgggucuccgaccccaaagcuacacccuucaggugcaugaggaggaucaggacgucgaaagaucccagguuaggucagcugcccaacagaguacauggcgggauuuugggcguaaacugcgccuguugagcggauaucucuggccuagaggcucuccagcacugcaguuagugguacugaucugccuaggccucauggggcuggagagggcccuuaauguguugguccccauuuucuaccggaacaucgugaaucugcucaccgaaaaggcuccuuggaacucccuggcguggacuguuacaucauauguguuucuuaaauuccugcaaggagguggcaccgggagcacgggauuugucaguaauuugcgaacuuuccucuggauucgcgugcagcaguuuaccucuagaaggguagagcuguuaaucuucucccaucugcacgagcuaagccuccgguggcaccugggccgcagaacaggugaaguucuuaggauagcagaccgugggacuucgucugugaccggcuugcuguccuaccucgucuucaacgugaucccaacacuggccgauauuaucauuggaaucauauacuuuucaauguucuuuaaugcuugguucggcuuaauugucuuucuguguaugagucuuuauuugacccucacgaucgugguuacugaguggcggacaaaguucagacgagccaugaacacccaggaaaaugcaacuagggcccgcgcuguggacagccugcuaaacuuugagacaguaaaauacuauaaugccgaauccuacgaggucgagcgguauagagaagcaauuaucaaguaccaagggcuggaguggaagucuagcgcgucacucgugcugcuuaaccagacccagaauuugguuaucggacuggguuuacucgcuggcagucugcuuugcgccuauuucgugacggaacagaaacugcaagucggggauuacguguuguuuggaaccuacauuauacagcucuauaugccccugaacugguucggcacauacuauaggaugauccagacuaacuuuauugacauggagaauauguucgaucuacugaaggaagagaccgagguaaaagaccucccgggugcagggccucugcgcuuucagaagggccgaaucgaguucgaaaacgugcauuucuccuacgccgauggacgggaaacacuucaagacguuagcuuuacugucaugcccggccagaccuuggcucugguggggccaucuggagccgguaaaucaacaauauuacgucuccuguucagauuuuaugacauuaguagcggcuguaucaggaucgaugggcaggacauuucccaggugacccaagcaucucuucgcucgcacaucggagucguuccucaggauacugugcuguucaaugacacgauugcugauaacauacgguacggcagagugacagccgguaaugacgagguagaagcggccgcucaggcagccgggauccacgaugcuauuauggccuuucccgagggcuauaggacccaagucggagagcgaggccuaaagcucagcgggggagaaaagcagcgcguggcaaucgcgcggacuauccugaaagccccaggcauuauauugcuggacgaggcuaccuccgccuuagauacaucaaacgaaagagcaauccaggcuagucucgccaagguuugcgcaaauaggaccacuauuguggucgcccaucgucugucuacagugguuaacgcugaccagauccuugugauuaaagaugguuguaucguagagcgcgggcggcacgaggcgcuguugagcagaggaggcgucuacgccgacauguggcaacuccagcagggucaggaagagacguccgaagacaccaagccccaaacuauggagagguga

SEQ ID NO: 52275 - RNA, 2259 nt, Artificial Sequence
  derived and/or modified sequence opt3 from ABCB7__Homo_sapiens__NP_001258625
auggcccugcucgcuaugcacagcuggagaugggcagccgcggcugccgcauucgagaagaggcggcauuccgccauccuuauucgcccccuggugucugucucaggcagugggccucaguggcgaccacaccaauugggagcuuuagguaccgcacgugccuaccagauaccggaaagccugaaauccaucacauggcagagacuaggcaaggggaacucuggacaguuucucgacgcugccaaagcgcugcaaguuuggccccuuauugagaagaggacuugcuggcauggccacgccggugggggacugcauacggauccuaaagaaggcuugaaggacguggauacccggaagaucauuaaagcaaugcucucguauguauggccaaaggaccgccccgaucugagagcuaggguggccaucucacugggcuuccucgggggagcaaaagcuaugaauauagucgugccuuuuauguucaaguacgccguugacagcuuaaaccagaugagugguaauaugcugaaccuuuccgaugcgccaaauacaguggccacuauggcaaccgcugucuugaucggcuauggggugucucgggccggagcugccuuuuucaacgagguacgcaaugcaguuuuuggcaaaguggcccagaacagcauucgaagaaucgcuaagaaugucuuccugcaccuacacaaccucgaccuggguuuucaucuuuccaggcagacaggggcgcugucaaaggcaauugaucggggaacccguggcaucaguuucguguugagcgcccucguguuuaaucuguuacccauaauguucgaagucaugcugguuucuggcgugcucuacuauaaauguggggcucaauuugcccuuguaacucugggaacauuggguaccuacacggcauucacuguggccgucacccgcuggagaacaagguuccggauugagaugaacaaggcugacaaugaugccggcaacgcagcgaucgacucccuacugaauuaugagacugugaaauacuuuaacaacgaacgauacgaggcucagcgcuaugauggguuccucaagaccuacgaaacagccucacugaaaagcaccaguacgcuugcaaugcugaauuuuggacagucugccauuuucuccguuggcuugacugcuaucauggugcucgccagccaggguaucgucgcagggacacugaccgugggcgacuuaguaaugguuaacggacugcuauuucaacucucgcugccucuuaauuucuugggcacuguguauagagagacaaggcaggcucugauugacaugaacacccucuuuacgcugcuuaaggucgauacccagauaaaagacaaggugauggccucuccacugcaaaucacaccgcagacugcgaccgucgccuucgauaaugugcacuuugaguacauugaagggcagaagguuuuguccggaaucucauucgaggugcccgcugguaaaaagguagcaauagucggcgggaguggaagcggcaaauccacaauugugcggcuccuguuucgcuucuaugaaccucagaaggguucuaucuacuuagccgggcaaaacauccaggacguuagccuggagucacuaagaagggcugugggcgucgugccacaggaugccguacucuuucauaauacuauuuauuacaaccugcuuuacggaaauaucagugcaucccccgaagagguguaugcgguugccaaauuggcuggccugcacgacgccauucuccguaugccucacggguacgauacccaggucggagagcggggucugaaguuaagcggcggggaaaagcaacgaguggcaauagcuagagccauccugaaagacccacccgugauucuuuaugaugaggcaacaucuucauuggacaguaucaccgaagagacuauccucggagccaugaaggaugucguuaaacauaggacgagcauuuucauagcucaccgccuguccacagugguggacgcggacgaaaucauuguacuagaucagggcaaggucgccgagcgggguacccaucacgggcugcucgcaaacccgcauucuaucuacucggagauguggcacacucagagcuccagagugcagaaucacgacaacccuaaaugggaagcuaagaaggagaauauuucaaaagaagaggaaaggaagaaacugcaagaggagaucguuaacagugugaagggcugcggaaauuguucuugcuga

SEQ ID NO: 52276 - RNA, 2208 nt, Artificial Sequence
  derived and/or modified sequence opt3 from ABCB8__Homo_sapiens__NP_001269220
augcuggugcaccucuucagagucggcauccgagggggacccuuuccuggucggcuucugccaccguugcgcuuccagaccuuuagcgccguucgaaacacauggcguaauggcaagacugggcaauuacauaaagcugagggagaauacuccgacggcuauagaucuucaagucugcuaagggcaguggcccaccuccggagccagcugugggcgcaucuuccccgcgcuccucuggccccaagauggucccccucugcauggugcuggguagguggggccuugcucggaccuauggugcugucgaagcacccacaucugugucucgucgcuuuaugcgaggcagaagaggcucccccugcuucaagcacgccacacgugguuggcaguagguucaacuggaaacuguuuuggcaguuccuucacccgcauuugcuggugcuaggcgucgccgugguacucgcgcugggggcagcccuuguuaaugugcagauuccccuguugcucggacaacuggucgaagugguggcuaaguacacccgggaucacgucgguuccuuuaugacagagucucagaacuuaagcacucaucugcucauacuuuauggcguucaggggcuguugaccuucggauaccuagugcugcucucccacguaggcgagcgcauggccguggacaugaggagagcacuguuuucaagucuucugaggcaggauaucacauucuuugacgcuaauaaaaccggucaauuggucagccggcucacuacagaugugcaggaguucaagucuuccuuuaagcugguuauuucacagggguuacguagcuguacccagguggccggaugccuggucagucuaucuaugcucuccacgcgccugacucuuuugcugaugguggcgaccccugcccucaugggcguaggcacacugauggggagcggacuuagaaaacugucgaggcaaugucaggaacagaucgcacgggcuauggguguugccgacgaagccuugggcaacgugcgaacuguccgcgccuucgcaauggagcaaagagaggaagagagguauggggccgaacucgaggcuugccggugucgcgcggaggaacugggaagaggcauugcauuauuccagggucugucuaauaucgccuuuaacugcauggugcuagggacccucuucauaggcggaucccuggucgcuggccagcagcuuacagggggagauuugaugucauuucugguggccagucaaaccguucagaggagcauggcaaaucucuccgugcuguucggucagguaguccguggcuuaucugccggggcucggguguuugaguacauggcccugaacccauguaucccccuuagcggaggcugcuguguuccuaaggaacaguugcgagguucagugacguuccaaaaugucugcuuuaguuauccaugcagacccggguucgaggugcucaaagacuuuacucugacacuaccgccuggcaagauuguagcacuggugggacaguccggcgggggaaaaaccacuguugcgagccuccuggaaagguucuacgaucccacagcuggugucgugaugcuugacggccgcgauuugcggacccuggacccaucuugguuaagaggacagguggucggguuuaucucacaggagccuguucucuucggcacgaccauuauggaaaacaucagguuugguaagcuggaggccagugaugaggaaguguacacagcagcccgcgaggcuaaugcccacgaguucauaacuagcuuccccgaaggguauaacaccgugguaggcgaacgaggaacaacucuuuccggcgggcaaaagcagcggcuggcaauugcucgugccuugaucaaacagccaaccguccucauucuggacgaggcgacaucugcccuagacgcugagucggaaagagugguucaggaggcacuggauagggccagcgcuggacgcaccgugcucgucaucgcccaucggcuguccacugugagaggcgcacacuguaucguugugauggcggacgguaggguaugggaagccgggacgcaugaggagcuuuugaagaaaggaggccuguacgcugaauuaauucgacgccaagcccucgaugcaccccggacagcugccccuccaccgaagaaacccgaggguccuagaucacaccagcauaagaguuga

SEQ ID NO: 52277 - RNA, 2112 nt, Artificial Sequence
  derived and/or modified sequence opt3 from ABCB9__Homo_sapiens__NP_001229942
augagacuguggaaggccguggucguuacccucgcuuucaugagcguggacaucugcguaacaacugcaauuuacguguuuucccaccuugauaggucucuguuggaggacauacggcauuucaacaucuuugauucagucuuagaccugugggccgcgugucuauaucgcaguugccuccugcuuggcgcuacgauugggguggccaaaaauagcgcacugggaccccgacguuugagagccuccuggcucguuaucacccuggugugucuguucgucgguauuuacgcuauggugaagcucuuacuguuuucugaaguaaggcggccuauccgcgauccaugguucugggcacuuuuuguuuggacauauauaucguugggcgccucauuccugcuaugguggcuccugagcacugugagaccggggacccaggcucuugagcccggagccgcgacagaagcagagggcuuuccugguagugggaggccacccccugaacaagccuccggagcuacccugcagaaauugcucucuuacacuaagccagacgucgccuuccugguggcagcuagcuuuuucuuaaucguggccgcgcugggcgagacauuucuccccuauuacaccggccgggccauugaugggaucgucauucagaaauccauggaccaguucucaacggcaguugugaucguaugccuucuggcuauaggaaguagcuucgccgcugguauucgcggcgggaucuuuacuuugauuuucgcccgacuaaacaucagacugaggaauugucucuuucggucucuggugucccaagagaccucauucuuugaugaaaaccguacaggagaccuuaucagccgccugaccagugauacuacaauggucucugacuuggugucccagaauauuaacguuuuccucagaaauaccgugaaggucacgggcgugguaguuuuuauguucagccugucguggcaguuaucucuggugacuuuuauggguuucccuauaaucaugauggucuccaacauuuaugggaaguacuacaaaaggcuaucaaaggaggugcagaaugcacucgcccgggcuaguaacacagcggaagagaccaucagcgcaaugaaaacuguccgauccuuugccaaugaggaagaggaagcugagguguaucugcgcaaacuucaacagguuuacaaguugaacagaaaggaagccgcagccuauauguacuauguguggggaucuggccugacacuccugguaguccaggugagcauacuuuacuauggcgggcaccugguuauuucaggacagaugaccagugguaauuugaucgcuuucaucauuuacgaguuugugcucggcgauugcauggagaacgucuccuucagccugucuccagggaaggugacggccuuaguaggaccgucaggcagugguaaaagcuccugugugaauauccuggaaaacuucuacccccuagaagggggcaggguucuccuggacggaaagccuauuucugcauaugaccauaaauaccuucaccgggucauaucguuggugagccaagagccagugcuguuugcgcgcuccaucaccgauaacauuucauauggccuccccacagucccuuucgagaugguuguggaagcugcccagaaggcaaaugcccauggguuuaucauggagcugcaggacggauacaguacugagaccggugaaaaaggcgcucaauuaucugggggacagaagcagagaguggccauggcaagggcucugguacguaacccacccguccuuaucuuggaugaggccacaagcgcgcucgacgccgaauccgaguaucugauucagcaagcuauacacggcaaucuacagaaacacacugugcugaucauugcacaucggcucucaaccguugaacacgcccaucugaucgugguccuugauaagggucgagugguucagcaggggacacaccaacaguugcuggcucagggcggauuauacgccaagcucgugcagagacaaaugcugggccuucagccggcagcggacuucaccgccgggcacaacgagccuguagcuaauggaagccauaaagccuga

SEQ ID NO: 52278 - RNA, 4479 nt, Artificial Sequence
  derived and/or modified sequence opt3 from ABCC10__Homo_sapiens__NP_001185863
auggagagacugcucgcccagcuuugcggcagcuccgcugcauggccccugccuuugugggaaggggacaccacaggacacuguuucacucaauuagugcugucugcccuaccacaugcgcuccuggcuguccuuucagccugcuaccuggguacgccgaggagucccgauuacaucuugccuuguagcccaggcuggcggcuccgccuggcagccuccuuucugcucucuguuuuccccuuacuggaccuuuugccuguggcucugccacccggggcaggaccuggcccaauuggucuagagguacucgccgggugcguggcugccgucgcguggauaucgcacucacuggcacuuugggugcuggcccauagcccgcacggacauagucgaggccccuuggcucucgcccugguugcauuacugccugcuccagcccucgugcuuaccguccuguggcacugucagcguggcacauugcuacccccucugcucccagggcccauggcgagacugugccuucugaucuugcagcucgccgcacuguuagcuuacgcccugggaugggcugccccggguggcccuagggaacccugggcacaggagccacuacucccugaagaucaagagcccgagguggccgaagacggggaguccuggcugucucgguuuagcuaugcuuggcuugcgccauugcuggcacgcggagccuguggcgaacucagacagccccaggauauuugcaggcugccucaccggcuucagccaacuuaccuggcucgcguauuccaagcccauuggcaggagggugcacgauuguggagagcccucuauggggcuuuuggaagguguuaccuggccuuaggccugcuaaagcucguuggcaccaugcugggguucuccggaccgcuuuugcugucacuccuggugggguuuuuagaggaaggccaggagccccugagucacgggcuuuuguaugcacucggacuggcgggcggugcuguccuaggggccgugcugcagaaccaauacggcuacgaaguguauaaagucacacuccaggcacggggagccguucugaauauccuuuacugcaaggcuuugcagcugggcccuagccguccacccaccggggaggccuuaaaccuccugggaacugacucugaacgccuucugaauuucgcagguuccuuucaugaggcuuggggcuugccucuccaacuggccauuacacuauaucugcucuaccaacagguggggguagcguucgugggaggccugauccuugccuugcuguuagucccagugaacaaaguuauagcuaccagaaucauggcaucaaaucaggagaugcuccaacacaaggaugccagggugaaacuggucacggaacuucugagcgguauucgggugaucaaguuuugugggugggagcaggcucuaggcgcccgaguagaagcaugccgcgcgagagagcucggaaggcugcggguuauuaaguauuuggacgccgcuugcguguaccugugggccgcauuacccgucgugaucaguauagucauuuucaucacuuaugugcucaugggccaccagcugaccgcuacaaaaguuuuuacugcccuugcacuggugcgcauguugauucucccgcugaacaauuucccuuggguaaucaacgggcuacuggaagccaaggucucucuugauagaauccaacucuuccuggacuugccaaaucauaacccccaggcuuacuacuccccugaucccccagcggagccuagcaccgugcuggaguuacacggagcccucuuuucgugggaccccguugguacaucucuggaaaccuucauuucccaucuugaggugaaaaagggcaugcuggucgggauagugggaaaaguaggcugugguaagucaaguuugcucgcagcuaucgccggggaacugcacaggcuacguggccauguggccguucggggacugagcaagggcuuugggcuugcuacgcaggagccauggauucaguucgcaacuauccgagauaauauacucuuuggaaaaacauucgacgcccagcuguauaaggaagucuuggaggcgugcgcuuuaaacgacgaucuguccauucucccggccggcgaccagaccgaggugggugaaaaaggggugacucugucuggaggccagagagcaaggaucgcccuugcucgcgcagucuaccaggagaaggaacuguauuugcuagaugacccucuggccgcgguugaugcugacguggccaaucaccuccugcaccgguguauccuugguauguuaagcuacacaaccagacugcucugcacgcauaggaccgaguauuuggagcgcgcagaugccgugcugcucauggaagcuggccgacugauucgggccgggcccccaucagagauccuuccccugguacaggcagucccuaaagccugggcugaaaacggacaagagagugacuccgcgacagcccagagcgugcagaauccagaaaagacuaaagagggcuuggaggaggagcaaucuaccucagggcgucuacugcaggaagagaguaagaaggaaggagcaguugcucuccacguguaccaggccuauuggaaagcugucggccaggguuuagcacuggccauucuuuuuagccugcucuugaugcaagccacaagaaacgcugcggauugguggcugucccauuggauaucucagcucaaggcagagaacucgagccaggaggcccagcccuccacuucaccggcuaguauggggcuguucucuccucaacuucuacuguuuagcccaggaaauuuguacauccccguguucccuuuaccaaaagccgcacccaacggcuccucagacauuagguuuuaccugaccguuuaugccacaaucgcuggugugaauagccucuguacccugcuucgcgcgguacuguucgccgcaggcacucuccaggcugccgcaacguugcaccggagacugcuacacaggguccugauggccccugugacauuuuucaacgcuaccccgacugggcgaauccucaaucgcuucucuuccgauguggccugcgcggacgacagucuucccuuuauucugaacauauuauuggcaaaugccgcuggacugcucggccugcuugccguccuggggagcggacucccaugguugcuguuacuacugccuccccucucuaucauguacuaucauguucagcggcacuacagagcuuccucaagggaacuucgucgccugggcaguuugacccugagcccacucuauucgcaucuggcagauacacuugccggucucuccgugcugcgggcuaccggggccacuuacagauucgaggaagagaacuugaggcuguuagaacuaaaucagcgaugucaauuugcaacaucugcgacgaugcaguggcuggacauucggcuccagcuuaugggagccgcuguagugagcgccaucgcaggcauugcucugguccaacaccagcaggguuuggccaacccuggccugguggggcucucacugaguuaugcacuuuccuuaaccggacugcucucuggcuugguuagcuccuucacucagacagaggccaugcuggugucagucgagcgccuagaagaguauaccugcgaucugccccaagaaccacaggggcagccgcuccagcuuggaacaggcuggcugacucaaggugggguggaguuucaggacguuguguuggcuuacagaccuggacugcccaaugcgcucgauggcgucaccuucuguguacagccaggcgagaagcuggggaucgugggaaggacggguagcggcaaaaguucuuuacuucugguucucuuucggcuacuggaacccuccagcgggcgaguguugcuggacggagucgauaccucgcagcucgagcuugcccaacugagaucacaguuggcaauaaucccucaggaaccauuccuguuuucuggcacagugcgcgagaaccucgacccccaggguuuacauaaggauagggcucuguggcaagcccuuaagcagugccaccugagugaaguaauuacuuccauggguggacuagacggcgagcucggcgaagggggacguagccugucuuugggucagcggcaacugcucugucuugccagagcacuguuaaccgaugcuaaaauccugugcauugacgaagccacagcgagcguggaucagaagacugaccaguugcuccagcaaaccaucugcaaaagguucgcuaauaagacgguccugacaauagcccaccgccuaaacaccauucuuaauuccgaccgaguucuggugcuccaggcaggcagaguggucgagcuggauaguccugccacuuugcggaaccagccgcauucacuguuucagcaacuccuucagagcucucagcagggggugccagcuucccugggaggccccuga

SEQ ID NO: 52279 - RNA, 4149 nt, Artificial Sequence
  derived and/or modified sequence opt3 from ABCC11__Homo_sapiens__NP_115972
augaccagaaagaggacauacugggugcccaacagcuccggcgggcuggucaaucggggaaucgacauuggugaugacaugguuucuggccucauauauaaaacuuacacgcuucaggaugggccuuggucacaacaggagcgcaacccagaagccccgggacgagcugcagugcccccuuggggcaaguaugacgccgcgcugcguaccaugaucccauucagacccaaaccuagguuuccagcuccccagccuuuggauaaugccgguuuauucaguuaccugacaguaagcuggcuaacuccacucaugauucagucccugcggucucgccuugacgagaacaccaucccgccccugucggugcacgaugcaucagacaagaauguccaaagauugcauaggcucugggaagaggaagugagccggcgcgggauugagaaagccaguguucugcuggugaugcuccgauuucagagaacaagguuaaucuucgaugcucugcuuggaauaugcuuuuguaucgcauccgucuugggcccuauucugaucauuccaaagauccuagaguauucugaggaacagcucggcaacgugguacacgggguuggacugugcuucgcccuuuuucugagcgaaugugugaaguccuugucauucaguagcucuuggauaauuaaucagcggaccgcuauccguuuucgcgccgcggucuccucauucgcauuugagaaacucauucaauucaagagcgugauccauaucacaaguggugaggccauuuccuuuuucacuggcgacgugaacuaccuguucgaaggggucugcuauggacccuuaguucugauaaccugugcuucucucgugaucugcagcauuucgucuuacuuuaucauaggcuacacggccuucauugcaauccuuuguuaucuguugguauuuccucuagcuguguucaugacuagaauggccgucaaagcgcagcaccauaccuccgaggugucagaucagaggauccggguuacaagugaagugcugacuugcauuaagcucaucaaaauguacaccugggagaagccauuugccaagauuauagaagaccugcgacgcaaagagagaaaacuucuggagaaaugugguuugguccagagccucacauccaucacccuguucauuauccccacgguggcaacugcuguauggguuuuaauccacacaucucugaagcuaaaacucaccgccagcauggcuuuuucaaugcuggccagucuuaauuugcugaggcucuccguguucuuugucccgauugcagugaaggggcugacuaacagcaaaucugccgucaugcgguucaagaaguuuuuccuucaagaaucaccuguguuuuauguucagacacugcaggaucccaguaaggcuuugguguucgaggaagcgacccucagcuggcaacagacgugcccaggaauaguaaauggcgcacuggaguuagaacgcaacggccacgccuccgaggggaugaccagaccuagggacgcucugggacccgaggaagaggguaauucucuaggcccagaacuccauaagaucaaccuggucgugucgaaagggaugaugcuuggaguuuguggcaauacagguagcgggaaguccucauugcugagugccauucucgaggaaaugcaccuguuagagggcucugugggaguccagggcagccuggcauacgugccccagcaagccuggaucguauccgggaacauucgugagaacauccuuaugggaggugcuuaugacaaagcccgguaccuccagguguugcauugcugcucacugaaucgagaucuagaacugcucccuuucggcgacaugacugagauaggggaaagaggacugaaccuuagcggcggucagaagcagaggaucucuuuggcacgcgcgguuuauuccgaucggcaaauuuaccuguuagacgauccacucagugcugucgacgcccacguggggaagcacaucuuugaggaguguauuaaaaagacccugagaggcaaaacagugguccuuguuacucaucagcugcaguacuuggaauuuugcggacagaucauacuccuggagaauggcaagauuugugaaaacgggacccacagcgagcuaaugcagaaaaagggaaaguaugcacaacugauccagaaaaugcauaaggaagccacaucugauaugcuccaggacaccgcuaaaauugccgagaagccgaaaguggagucccaagcacuggcuacuucacuugaagagaguuugaaugguaacgccgugcccgaacaccagcugacgcaggaggaagagauggaggaaggcagcuuaucguggaggguauaccaucacuauauccaagcggccgggggauacauggucuccugcauaaucuuuuucuuugugguucucauuguguuccugacaaucuuuucuuucugguggcuuagcuauuggcuggagcagggcucagguaccaauaguucccgcgaaucuaacgggacuauggcugaucuaggcaauauugcagacaacccucagcucagcuuuuaccagcuggucuauggauugaaugcccuguuacucaucugugugggcguuugcuccucagggauauucaccaaggugacacgaaaggcuagcaccgcccugcacaacaaacuuuuuaauaagguauuccgguguccaaugaguuucuucgauacuauucccaucggacgucuguugaacugcuucgcaggcgaccucgagcaacuggaccagcuacugccuaucuuuucugaacaguuccuuguccucucccugauggugauugcgguguugcugaucgucagcguuuuaucgccauacauucuccugaugggugccauaaucauggugauuuguuuuaucuacuauaugauguucaaaaaggcuauugggguauuuaaaagacuugagaauuacucaaggucuccccuguucagucauaucuugaacucccuccagggacugagcucuauacacguguauggcaagacagaggauuuuaucagccaauucaaacgccuaacggacgcccagaacaauuaccugcuucucuuucuguccucaacccgguggauggcauugagauuagaaauuaugacuaaccuggucacacucgcuguggcccuguucguugcauuugguaucaguagcaccccguauucuuucaaggugauggccgucaauauugugcuucagcuggcuuccucauuccaggcgacagccaggaucggcuuggagacugaagcacaauuuaccgcuguugagcgaauacuacaguacaugaagaugugcgugagugaggccccucugcauauggaagggacgagcuguccacagggauggccccaacacggcgagauuaucuuccaggauuaucacaugaaauaccgcgacaacaccccuacaguccuccaugggaucaaucugacuauucggggacacgaaguagugggcauaguugguagaaccggguccggaaagucuucgcuuggcauggccuuauuuaggcugguggagcccauggcuggucguauccucauugauggcgucgacaucugcagcauuggguuggaagaucugcgcucaaaacucuccgugaucccacaggacccuguacugcuuaguggaacaauacgguucaaccuggaucccuuugacagacauacugaucagcaaaucugggacgcauuggagaggaccuuccuaacgaaggccauuucuaaauuuccaaagaagcugcacacagauguggucgagaauggcgggaacuucagcguuggagaacgacagcucuuaugcaucgcgcgggcugugcugcgcaauuccaaaauuauccuuauagacgaggccaccgcaucaauugacauggaaacugauacacugauccagagaaccaucagggaggccuuucagggcuguacugugcucgucauugcucaucgggugaccacaguuuugaacugcgaccacauccugguaauggguaaugggaagguggucgaguucgaucgaccggaagugcuccgcaaaaagccuggaucucuguuugcagcccuuauggcgacggcuaccagcagucuaagauga

SEQ ID NO: 52280 - RNA, 4080 nt, Artificial Sequence
  derived and/or modified sequence opt3 from ABCC12__Homo_sapiens__NP_150229
auggugggcgaggggcccuaccugaucagcgaccucgaucagagaggaaggcggcgcuccuucgccgaacgauaugacccuucucuuaagaccaugauuccaguccguccgugcgcuagacuggcacccaacccuguugaugacgccgguuuguuaucauuugcgacauucaguuggcugacuccagugaugguaaaaggcuacaggcaacggcuaacgguggauacccucccaccucugagcacauaugacuccucugauacuaaugcuaagcgcuuuagaguccuuugggacgaggaaguggccaggguugggccagagaaagcaucgcugucacacguggucuggaaguuccagcggacccgcguguugauggauauaguagccaacauccucuguauuaucauggcugcaauuggacccguuauccugauacaucagauccugcagcaaacagaacgaaccagcggcaaagugugggucgguauugggcucugcaucgccuuauuugcuacugaguucacaaagguguuuuucugggcccuggcgugggcaauuaauuacagaaccgccaucaggcuuaagguggcuuugaguacgcuggucuuugagaaccuaguuuccuucaaaacucucacccacauaucugugggagaaguacugaauauucuuagcuccgacucauauagucuguuugaggccgcauuguucuguccucucccagcuacaaucccgauucugaugguguuuugcgccgcguacgccuucuucaucuuaggccccacugcacugaucggcauuagcgucuaugugauauuuaucccuguucagauguucauggcuaagcucaacucugccuuucggcguuccgcuauucuugugaccgauaaacgcguccagacaaugaaugaguuccugaccuguaucagauugauaaagauguacgccugggagaaaucauuuacgaacacuauucaggacaucaggcggcgagagcgcaagcuacuggaaaaggcaggguucgugcaaagcggaaauagugcccucgcuccaaucguaucuacaauugcgaucguucugacccuuuccugccauauucuguugagaaggaaacucacugcacccguggccuuuagcgucauagcuauguucaacgugaugaaguuuucgaucgccauucugccuuucucuaucaaagcaauggccgaggcuaaugucuccuuacggcgcaugaagaaaauccugauugauaagucaccacccaguuacauaacacagccggaagacccugacaccgugcuacuccuggccaacgcaacgcuuaccugggagcacgaagcgagcagaaaauccacacccaagaaguugcagaaucagaaaaggcaucuguguaagaaacaacguucugaggcuuauagcgagcggucacccccugccaagggugcaacuggccccgaagaacagagugauucccucaaaagcguucugcacucuaucucauuugugguacgaaaggggaagauucuuggaaucugcggcaacgucgguagugggaaaagcucccuguuggccgcucuccugggacagaugcaauuacagaagggcgugguugccgugaauggcacccuggcauacgucucucagcaggcuuggauuuuccacgggaacgugagagaaaacauccuauuuggagagaaauaugaccaucaaagguaccagcacacaguacgcguguguggucuccagaaggaucugucgaaucuuccauauggcgacuugacugaaauaggggagcggggacugaaccucagcggcggucagagacaaaggaucucccuggcccgcgcgguuuacucagaucgacaguuauaucugcuugacgaucccuugagugccgucgacgcucauguggggaaacacguguucgaggaaugcauuaagaagacccuccggggcaaaacagucguucuggugacccaccagcuacaguuccuggagucuugugaugaagugauccuccuggaggacggagaaauuugcgagaagggcacucauaaagagcuuauggaggaacgugggagauacgcaaaguugauccacaaucugaggggauuacaauuuaaagauccugaacaucucuacaacgccgcuaugguagaggccuucaaggagagcccagcagaacgcgaggaagacgcggguauaauuguccuggccccgggcaaugagaaggacgaagggaaagaguccgagacgggaucagaauuuguggauacaaagguucccgagcaccagcuuauccagaccgaaagcccucaggagggcacugugaccuggaaaacauaucauaccuacauuaaggcuucugguggguaucuguugucccucuucacugucuuucuguuccuacugaugaucggcagugccgcauuuagcaacugguggcucggacuguggcuugacaaaggcucucggaugacaugcgggccacaaggaaauagaacgaugugugaagugggugcuguuuuggccgauauaggccagcacguguaccaguggguauauaccgcauccauggucuucaugcugguguuuggggugacuaagggauucgucuuuacaaaaaccacauuaauggccucaaguagccuccacgacacuguuuucgauaagauccugaagucgcccauguccuuuuucgacaccacgccuaccggcaggcuuaugaaccgauucucuaaagauauggacgagcuggaugugcgccuaccauuucaugcugagaauuuccuccaacaguuuuucaugguaguguuuauucuggucaucuuggcggccguguuccccgcaguucuguuaguggucgcuagccucgccgugggguuuuucauucugcuucggaucuuucacagagggguucaggaacugaagaaaguggagaacgucucaaggaguccgugguucacacauauaacuuccucuaugcagggcuugggaauuauccacgccuacggcaagaaagaaagcugcaucaccuaucaccuccuguacuuuaauugugcucuacguugguucgcacugcgcauggacguacuuaugaacauucucacauucacuguggcccuguugguuacccuguccuuuucaagcaucaguacgucuuccaagggguuaagccucucguacauuauacaacugucaggacuucuucaggugugcguccggacaggcaccgagacucaggcgaaguucacaucuguggaauugcucagagaguauaucaguaccuguguaccugagugcacucauccacugaaaguggguaccugucccaaggauuggccuuccaggggugaaauuacauuucgagacuaccagaugcgguaucgcgauaauacgccccuaguccuggacagccuuaaccucaauauccaaucuggacagaccguuggcauuguggguagaacuggcagcgggaaauccucacugggaauggcuuuguucagguuaguggagccagccaguggcacaaucuuuauagacgaagucgauaucugcauucugagccucgaggaccugcggaccaagcugacagugaucccucaggaucccguucuguucguagggacugugcgauacaacuuggacccauuugagucucacaccgaugaaaugcuauggcagguccuggagagaacguucaugcgcgacacaauuaugaaacucccggaaaagcugcaagcagaggugaccgaaaacggagagaauuuuuccguuggcgagaggcagcuuuuauguguggcccgugcucugcuccggaacucaaagaucauauugcuggaugaagcaacugccaguauggacagcaaaaccgauacacucguccagaauacuauuaaggacgcguucaaagguugcaccgugcugacaaucgcucauagacuuaacacgguacugaauugugaucacgucuuggugauggagaacgggaagguuaucgaauuugacaaaccugaggugcuagccgaaaagcccgauuccgcauucgccaugcugcucgcugccgaggucagguuauga

SEQ ID NO: 52281 - RNA, 4596 nt, Artificial Sequence
  derived and/or modified sequence opt3 from ABCC1__Homo_sapiens__NP_004987
auggcccugagaggcuucugcagcgcugacggguccgauccccucugggacuggaacgugaccuggaauacaucuaacccugauuuuacuaaguguuuccagaauacgguccuuguuugggugccaugcuuuuaccugugggcauguuucccguuuuauuucuuguacuuaucaaggcacgaccggggauauauccaaaugacaccccugaacaaaaccaagacugcccuagguuuucuccuguggauuguaugcugggcggaucuuuucuacaguuuuugggagcgcagccgaggcauauuccuggcuccuguguuuuuggucuccccaacccuccuggggaucacaaugcugcucgccaccuucuuaauucagcuggaacguagaaaaggagugcagucuucgggcaucaugcuuacuuuuugguugguugcacuggugugugcccuagcuauucucaggucaaagaucaugacagcacugaaagaggacgcccaggucgaucuuuuccgggacauaaccuucuauguguacuuuagccuguugcucauccaacugguauuaaguugcuucuccgaucgcucuccccuguuuagcgaaacgauucaugacccuaauccaugucccgaguccucagcuaguuuccucagcagaaucacuuuuugguggauuaccggucuuaucguuaggggguaucggcagccucuggaaggaucugauuuguggucccuaaacaaggaggacacaucagaacagguggucccagugcuggugaagaauuggaaaaaggaaugcgccaaaacucgcaagcagccggucaaaguuguguacagcaguaaggaucccgcgcaaccuaaggagucuuccaaaguagacgcaaacgaagagguggaggcccucauagucaagagcccacagaaagaauggaaucccucgcuguucaaggugcuuuacaaaaccuuuggcccuuauuuccugauguccuuuuucuuuaaggcuauucacgacuugaugauguucucuggcccacagauccucaaacuguuaauuaaguuuguuaacgauacaaaggcccccgacuggcagggguacuucuauaccgugcugcuauucgucacggcaugucuccaaacucuggugcuucaucaguacuuucacaucugcuucguaucaggaaugcgaaucaaaacagcuguuauuggugccguguauagaaaggcguuggucauaaccaauagugccaggaaaagcuccacugugggcgagaucgucaaccugaugucuguggaugcacagcgguuuauggaccucgcuacauacauuaauaugaucuggagcgccccgcugcaaguuauacuugcucuguauuugcucuggcugaacuuagggccuucagugcuggccggaguagcagucauggugcuaaugguucccgugaaugccgucauggcuaugaagaccaaaacguaccagguggcgcauaugaagaguaaggauaaccguauuaaacucaugaacgaaauccugaauggcaucaagguacuuaaauuguacgcaugggagcuggccuucaaggacaaagugcucgcuauucgccaggaggagcugaagguuuuaaagaaauccgccuaucugagcgcagucgguaccuuuacauggguguguacuccauuccuuguggccuugugcaccuuugcugucuacguuacaaucgaugagaacaauauucucgacgcccagacugcauucgugucucuggcgcuauuuaacauacugagauucccucucaauauccugcccauggugauuucaaguaucguacaagcuagcgucucccuuaagagguugcggaucuuucugucucacgaagaguuagaaccagauucgauugagcgacgccccgugaaagacgggggaggcaccaacagcauaacaguuagaaaugccaccuucacuugggcaagguccgauccuccaacgcucaacggcaucacauuuucaauuccggaaggggcccugguggcugucgugggacagguugguugcggcaagaguucucuucugagcgccuugcucgcagagauggacaaaguggaggggcacguagcuaucaagggauccgucgccuaugugccccagcaggcguggauucaaaaugacucacugcgggaaaacauccuauucggcugucagcuggaggaaccuuacuaucgcagcgugauacaggccugcgcucuccugccagaucuugagaucuugcccucuggugacagaaccgaaauuggggagaagggcgucaaucuguccggaggccagaaacaaaggguuaguuuagcacgugccguguacagcaacgcugauaucuaucucuucgacgauccucugucugccguagacgcacauguggggaagcacauuuuugagaaugucaucggaccaaaagguaugcuuaagaacaaaacucggauacuggugacccauuccaugucauaccuaccccagguugaugugauuaucgucaugaguggcgggaagauuagcgaaaugggaucguaccaggagcuccuggcgcgagacggcgccuucgcugaauuuuugagaacauaugccuccaccgagcaggagcaagaugcagaagagaauggugugacugggguuucuggcccgggaaaagaagcuaagcagauggagaacggcaugcuggugacagacagcgccgggaagcaguuacaaaggcagcucucaaguuccucuagcuacuccggagauaucucacgccaccacaacagcacggcagaacugcagaaagccgaggcuaagaaagaggaaaccuggaaacuuauggaggcggacaaggcccagacuggucaagucaagcugaguguauauugggauuacaugaaggcaauaggcuuguucaucucuuuucucuccauuuuccuguuuauguguaaucaugugagcgcucuagccucgaacuauuggcugucacuuuggacagacgacccuaucguuaaugggacccaggaacacacaaaagugcggcucucugucuacggagcccugggcauuagucaggguaucgcuguguucggguauuccauggcaguaagcauaggcggaauuuuggccucuagaugccugcauguggauuuacuccacagcauccugagguccccaaugucauuuuucgagcgcacucccaguggcaaccuugucaaucgauuuagcaaggaacuggacaccguugauucuaugaucccugaggugauuaaaauguucaugggguccuuguucaacgugaucggagcguguauugucauacuccuggcuacgcccaucgccgcaauuaucauuccaccucuaggccugaucuacuuuuucgugcagcgguuuuacguugccucaagucgucaacuuaagagacucgagagcguauccaggucucccguguauucgcauuucaaugaaacccuguugggugucagcgugauacgcgcuuuugaggaacaggagcgguucauccaccagucagacuuaaaaguugaugaaaaccagaaggcauacuauccauccauuguggccaauagauggcuggcggucaggcucgagugcguggggaacuguaucguacuguuugcugcccuuuucgcagucauuagucgacacucucugagcgccggauuggugggccuauccguuucauacucucugcaagugacaacuuaucucaauuggcugguccgcaugagcagugagauggaaaccaacaucguggcuguugagcggcuuaaggaauacuccgagacagagaaagaagccccguggcagauacaggagacugcaccucccagcucuuggccacaaguggguagagucgaauuuaggaauuauugcuuacguuaccgcgaggaccuggauuucgugcuccggcauauuaacguaaccaucaauggcggggaaaaggugggaaucguuggcagaacgggggcuggaaaaucauccuugacacugggccucuuuaggauuaacgagagugccgagggugaaauaaucauugacgggaucaacauugcgaagaucggacugcacgaucuucgauucaaaauaaccaucauuccccaggacccuguccuguuuagcggcucguugcggaugaaucuagauccauucucucaguacuccgacgaggaaguguggacuagccuggagcucgcccauuuaaaggauuucgugucagcacugcccgacaaacuugaccacgaaugugcugaggguggcgagaaccugagugucgggcagcgccaacucguaugcuuggccagagcucugcucaggaagacaaagauccuggugcuugaugaagcaaccgccgccguugaccuagagacugaugaccugauucagucuaccauccggacacaguuugaagauuguacgguguugaccauagcucaccgauuaaauacuauuauggacuauacaagagucaucgugcuggauaaaggagagauccaggaauacggcgcgccuuccgaccuccugcaacagcgcgggcuuuucuauagcauggcaaaggaugccggacugguuuga

SEQ ID NO: 52282 - RNA, 4638 nt, Artificial Sequence
  derived and/or modified sequence opt3 from ABCC2__Homo_sapiens__NP_000383
augcuggagaaguucugcaacagcaccuuuuggaacuccucuuuccucgacucacccgaagccgaucuuccucuguguuuugagcagacaguguuggucuggaucccauuaggcuuccuguggcuacucgcuccguggcaacugcuucacguuuacaaaaguagaacuaagaggagcuccacgaccaaacuguauuuggcaaaacagguguuuguaggguuccuccugauucuggccgcgauagaacucgcuuuagugcugacagaggacucuggacaggccacuguccccgcagugcgguacaccaauccuucgcuuuauuuggguacauggcugcuaguucuccugauccaguacucacgccaauggugcgugcagaaaaauagcugguuucuuagucuguucuggauuuuguccauccucuguggcaccuuucaguuccagacucugauucgaacauuacugcaaggggauaacucuaaucucgccuauagcugcuuauuuuucaucuccuacggauuucagauacugaucuugauuuucucagcuuucagugaaaacaaugagagcucuaacaauccauccucaaucgcgagcuuucuaaguucuauuaccuauuccugguacgacagcaucauacugaagggcuacaagcguccccucacgcuggaggaugucugggaaguggacgaggaaaugaaaacuaagacccuuguaucgaaauucgagacacauaugaagagagagcugcagaaagccaggcgggcuuugcagcgcagacaagaaaagucuucccagcagaacucaggugccaggcucccugggcugaauaagaaccaaagucagagccaggaugcguuaguucuggaggacguggaaaagaagaaaaagaaauccggaacuaagaaagaugucccaaagucuuggcuaaugaaggcacucuuuaaaaccuucuauauggugcugcuuaagagcuuuuugcugaaacucgugaaugacauuuucacauuugucucaccccagcugcuuaagcuguugaucaguuucgccuccgaucgggacaccuaccucuggauuggcuaucugugugcuaucuuacuguuuacggccgcacuaauccagagcuucugccuccaauguuacuuucagcugugcuucaaacuuggcguuaaggugcgcacugcuauuauggccucuguauauaagaaagcguugacacugucaaaccucgcccgaaaggaguacaccgugggggaaacugucaaucugaugaguguggaugcacagaaauuaauggacguuacaaacuuuaugcacaugcuguggagcuccgugcuucaaauagucuugucuaucuucuuccucuggagagagcugggaccuucggugcuagcugguguaggcguuauggugcuggucauuccaaucaacgccauacucagcaccaaguccaaaacgauucaggugaagaauaugaagaacaaagacaagaggcugaaaaucaugaaugagauccuuucagggauuaagaucuugaaauauuuugcuugggaaccgaguuuccgggaucagguccagaaccugcguaagaaggagcuuaaaaaucuccuggccuuuucucaacuucagugugugguuauuuucguguuucagcugacccccguauuggucagcgugguuacauucuccguguacguccucguggacucaaacaauauacuggaugcacagaaggccuuuacuagcaucacccuauucaacauucugcgcuuuccucucucuaugcugccaaugaugaucuccaguaugcuucaagcuagcguaucuacagaaagauuggagaaauaccugggaggcgacgauuuagacacuuccgcgaucaggcaugauugcaauuucgacaaggcaaugcaguuuucagaagccaguuucaccugggagcacgauagcgaggcuacagugcgggacguuaaccucgauauuauggccggucagcuggucgcagugauagggcccgugggaucgggcaaauccucucuuaucagcgccaugcugggcgaaauggagaauguccaugggcacauuaccaucaagggaacuacggcuuauguuccucaacagucauggauucagaacgguacaaucaaagacaauauacuauuuggcaccgaguucaacgaaaagcgauaccagcaagugcucgaagccugugcacuguugccagaccuggagauguuacccgggggagaucucgcggagaucggcgaaaaggguauuaaucugagugggggccagaaacagcgcaucucccuugcuagagccacuuaucagaaccuggacauuuacuugcucgaugacccgcugucugcaguggaugcccacguaggaaagcauaucuucaacaaaguccuaggcccuaaugggcugcuuaagggaaaaaccaggcuccuggugacacacagcaugcacuuuuugccccaaguugacgagauagugguccuggguaacggcaccauuguggaaaagggguccuauucagcuuuacucgccaagaaaggagaguucgcaaagaaucugaaaacuuuucuucggcauacaggcccagaggaagaggcuacgguucacgaugguagcgaagaggaagacgaugacuacgggcugaucaguucuguggaggagauuccugaagaugccgcguccaucaccaugcgcagagagaacagcuucaggcguacuuugucgcggucaucucgaaguaauggcagacaucucaagucccugaggaacagccuaaaaacacgcaauguaaacucucugaaggaagacgaggaacuugucaagggacagaaacucauaaagaaagaguuuaucgagaccggcaaggugaaauucagcauuuaucuggaauacuugcaggccaucggguuauuuuccauuuucuuuaucauacuggcuuucgugaugaacucagucgcauuuauuggaaguaaucucuggcugagcgccuggacaucugauuccaagaucuucaauucaacugacuaccccgcuagucagcgggacaugagaguugguguguauggcgcccuugggcuggcacaaggaaucuucguauuuauugcgcacuucuggagcgccuuuggcuucgugcaugcuuccaacaucuugcacaagcagcuacugaauaacauucucagggccccaaugcgcuuuuucgauaccacgcccaccggucgaauagucaaucgguuugcaggggacaucucuacaguggaugacacucugccucagucgcuucguagcuggauuaccugcuucuuaggcaucauuucaacacugguuaugaucugcauggcuacuccaguguuuaccauaaucgucauuccgcucggaaucauuuacguguccguucaaauguucuaugugaguacgucuagacaguugaggcgccuggauagcgucacacggucccccaucuacucacauuuuucugagaccguaagcggccucccugugauaagagccuucgaacaccagcagagguuucugaaacacaacgagguucgaauugacacuaaccaaaaguguguguucaguuggaucacauccaaucgcuggcuugcaauccggcuggaauuggucgggaaccuaaccguguucuuuagcgcccugaugaugguaauuuauagagauacucucucuggagacaccgugggcuucgucuuaucaaaugcucugaacauaacacagacgcuuaauuggcugguuaggaugaccuccgagaucgagacuaacauuguggcgguggaacguaucacagaguacaccaaagucgaaaaugaggccccaugggugacagauaagcggcccccuccagacuggcccaguaaagguaagauucaguuuaacaauuaucagguucgcuacagaccggagcucgauuugguacugagggggaucacuugcgacauaggaagcauggagaaaaucggcguggucggucgaaccggcgcagggaagucgucucucacgaacugucuguuccggauucuugaagcugccggaggccaaaucauuaucgaugggguggacauagccuccauuggacuacaugaccugcgcgaaaaguugacaaucaucccucaggauccaauuuuauuuagcggcucacugagaaugaaucucgaccccuucaacaauuacagugaugaggaaaucuggaaagcucuggagcuugcacaccugaagucuuuuguugccucccuccaguugggucugagccaugaggugaccgaagcagggggaaaccuaucaauaggccagaggcaacugcucugccuuggucgggcucuguuacgaaaaaguaagauuuugguccuggacgaggccacugcagccguggaucucgaaaccgacaaucugauccagacaacuauucagaacgaguucgcucacuguaccguaaucacaauagcacacagacuucauacgauuauggauagcgacaaagucauggugcuggauaacggcaagaucaucgaaugcggguccccugaggagcucuugcagauucccggaccauuuuauuucauggccaaggaagcgggcaucgagaauguuaacucuaccaaauuuuga

SEQ ID NO: 52283 - RNA, 1719 nt, Artificial Sequence
  derived and/or modified sequence opt3 from ABCC3__Homo_sapiens__NP_001137542
auggacgcccugugcggcagcggggagcucggauccaaguucugggauucuaaccuuucagugcacaccgaaaaucccgaccugacaccuuguuuucagaacaguuuguuagcuugggucccaugcaucuaccuguggguugcacuaccguguuaucuccuguaccuuagacaucacugcagggguuauauuauacugagccauuuguccaaacucaagauggugcugggcguacugcucuggugugugucuugggccgauuuauucuacucguuucacgggcugguccauggacgggcgcccgcuccuguguucuuuguuacuccacuuguggucggcgugacgauguugcuggccacccuacucauccaauaugagcgccugcaggguguacagucaagcgggguucuuauuaucuucugguuucugugcguggucugugcaauugugcccuuccgaaguaaaaucuugcucgccaaggcugaaggagagauauccgacccuuuucguuucacaacuuuuuacauccacuucgcacugguguuaucugcccugauucucgcuugcuuuagagaaaaaccacccuucuucagcgccaagaaugucgauccuaacccauauccggagaccuccgcgggcuuucuuucaaggcuguucuuuuggugguucacaaagauggcaaucuacggcuaccggcaccccuuggaggaaaaagaccuauggagucugaaggaggaagaucgcagccagaugguugugcaacagcuccuggaggccuggagaaaacaggagaagcagaccgcuaggcauaaagccucugcagcuccugggaagaaugccuccggagaagacgagguacuucugggugcgcggccacgcccccgaaagccuucauuuuugaaagcccuccuggcaacuuucggcagcaguuucuuaauuucugcuuguuuuaagcugauccaagaucuacucuccuuuauaaacccacagcugcuuagcauuuugaucagauucauuucgaaucccauggccccgucuugguggggguuucugguggcuggacucauguuccugugcuccaugaugcagucacuuauccugcagcacuauuaccauuauaucuuugucacaggcgugaaauucaggaccgguauuauggggguuauauaccggaaggccuuggugaucacgaacagugucaaacgugcaagcacugugggagaaauuguaaaucucauguccguugacgcccaacgcuucauggaucuggcucccuuuuuaaaccugcuauggucugcgccucuccagaucauacuggcaauuuauuuccuuuggcagaauuugggcccaagcgugcuggccggcgucgcuuuuauggugcuccugaucccuuuaaacggggccgucgcagugaagaugagagccuuccaaguuaaacagaugaagcugaaggacucaaggaucaaacuuaugagugagauuuugaauggaaucaaggugcucaaacuguacgcuugggaacccuccuuucuaaagcagguagaggguauucggcagggcgagcugcaacuccugcgaaccgccgcauaucuucacacaacuaccacauucaccuggauguguagcccauuuuugguccgccuggggacgggauuaggccccugccuccaggguucugggugcccuggcauggcgagagcucacuggacucugccauga

SEQ ID NO: 52284 - RNA, 2580 nt, Artificial Sequence
  derived and/or modified sequence opt3 from ABCC4__Homo_sapiens__NP_001098985
augcugcccguguaccaggaggucaagccuaacccacuccaagacgccaaucuuugcagcagaguuuucuuuugguggcugaacccguuguucaaaaucggccacaagaggcgguuagaagaggaugacauguauuccgugcugcccgaagaucgcucucagcaucuaggggaggaacuccagggauuuugggacaaagagguacugcgagcugagaaugaugcacagaagccuucacuuacccgugccauuauaaaauguuacuggaagaguuaucugguguuggguaucuucacacucauugaagagagcgcgaaggucauccaaccaauuuuucugggcaaaaucauaaacuacuucgaaaauuaugaccccauggauuccguggcucugaacacugccuacgcauaugccacgguucucaccuuuugcacauuaauccuggcuauucuucaccauuuguacuucuaccacgugcagugugcagggaugagacugagggucgccaugugccauaugaucuaucggaaggcucuacgccucucuaauauggccaugggaaaaacuaccacaggccagauugugaaccugcuuucgaaugacguaaacaaguuugaucagguuaccguguuccugcacuuuuugugggcggguccucuccaagcaaucgccgucacugcucuguuauggauggagauagggauuucaugucuggccggaauggcagugcucaucauucuucugccauugcagagcugcuucggcaaacuauuuaguucccugagaucuaagacagcuaccuucacggacgccaggauccggacuaugaaugaggugaucaccggcauucgcauaaucaagauguacgcgugggaaaaaucuuucuccaaccucauuacaaaucugcgaaagaaagagaucucaaagauacuuagaaguagcugucugagggggaugaacuuggccagcuuuuucuccgcaucaaaaauuaucgucuuuguuacuuucaccacauaugugcuccugggaagcguaaucaccgcuagucggguguuugucgccgugacguuauacggugcuguucgucugacugugacacuauucuuucccucugccauugaacgcgucuccgaggcaaucgugagcauuagaaggauacagaccuuccuccugcuugaugaaaucucgcagcggaaucgacaauugccuucugacggcaagaaaaugguacacguucaggauuuuacugccuucugggacaaggcuuccgagacaccaacccugcaggggcucucauuuacggugcgcccgggagagcugcuugcggucgugggccccgucggugcagggaagaguagccuguuguccgccgugcucggagaacuggcuccuucucauggcuuaguuagcgugcacggcagaauugccuauguaucacaacagccaugggucuucagugggacccugagguccaacauccuauuugguaaaaaguacgagaaagaacgguaugagaaggugaucaaagcaugcgcccucaagaaggaccugcagcuuuuggaagauggagaccugacaguuauuggcgaucgcgggacuacccucagcggaggccagaaagcuagagugaaccuggccagggcagucuaccaagacgcggauauauacuuacuggacgauccccuuucugcuguggacgccgagguaucacgucauuuguucgagcucuguaucugccagauucugcacgaaaagaucacaauucuagugacucaccagcugcaguaucucaaagcagccagucaaauccugauacuuaaggaugguaaaaugguucagaaggggaccuacacagaguucuuaaagagcggcaucgacuuuggaucccuguugaaaaaggauaaugaagagucugaacagccuccaguccccggcaccccgacucuccggaaccgaacguucucggagagcuccguguggucacagcaaaguucuagaccuagccugaaagacggggcucuugagucccaggacacagaaaaugugcccgucacccugucagaggaaaacaggagcgagggaaagguugguuuucaggccuauaaaaauuacuuccgcgcaggcgcucauuggauuguguuuaucuucuugauucuccugaacacugccgcccagguggcguauguacuacaagauugguggcugucuuacugggcuaauaagcaguccaugcucaacgucaccgugaaugggggaggcaacguuacagagaagcuggaccuuaauugguauuuggguaucuacagugggcugaccguggcaacugucuuauuuggcauagcccggagccuccugguguucuacguucuugugaacucuucccagacacugcacaauaaaauguuugaaucaauucuaaaggcuccaguacucuucuuugauagaaacccuaucggaaggauucugaaucgcuucaguaaagacaucggccauuuggaugaccuguuaccccucacguuucuggauuucauacaacgaugggaccuugccguccugagcugguuggugucgaacuccuga

SEQ ID NO: 52285 - RNA, 627 nt, Artificial Sequence
  derived and/or modified sequence opt3 from ABCC5__Homo_sapiens__NP_001018881
augaaggacaucgauauuggcaaagaguacauaauccccagcccuggguauagauccgugagggaacggaccucuacaucaggaacucaccgcgaccgagaggauaguaaguuccguagaacgaggccacuggaaugccaggacgcccucgagaccgcugcacgggccgaaggucuuagccuggaugcguccaugcauucucaauugcgcauuuuagacgaggagcacccgaaaggcaaguaccaucacgggcugucggcucuaaaacccaucagaacaacuucaaagcaucagcacccugucgauaacgccggacucuuuagcuguaugaccuucaguuggcuguccucucuugcaaggguugcccacaagaaaggcgaacugagcauggaggacgugugguccuugucaaagcaugaaaguagcgauguaaauugccggcgccucgagcgacuguggcaggaggaacugaacgagguggguccagacgcugcaucucucagaagggucguguggaucuuuugucggacacguuuaauucuguccauaguuugccuuaugaucacccaguuggccggguucucaggacccaauuuucaagauggcuguauucugcgcagcgaauga

SEQ ID NO: 52286 - RNA, 300 nt, Artificial Sequence
  derived and/or modified sequence opt3 from ABCC6__Homo_sapiens__NP_001072996
auggccgcucccgcagagccuugcgccggccaggggguguggaaccaaaccgaaccagagccggcggcuacaagccugcucucccuuuguuuccugagaacugccggagucuggguucccccuauguacuuguggguguuagguccaaucuaucugcuauuuauucaccaucacggcaggggguaccuccggaugucuccccuguucaaggcaaaaaugguagccgcuauaccuggaucacuugaaccaggcaaugugcgcggucgacaggggacgggauggaaccuggucaagaguuga

SEQ ID NO: 52287 - RNA, 4746 nt, Artificial Sequence
  derived and/or modified sequence opt3 from ABCC8__Homo_sapiens__NP_000343
augccccuggccuucugcggcagcgagaaccacuccgcugcauacagaguggaccaggggguccucaauaacggauguuuuguugaugcccuuaaugugguaccucauguguuccuguuguuuaucaccuucccaauuuuauuuauagguuggggcucucaaucaaguaagguccacauccaucacagcacauggcugcauuucccggggcacaaccuaagguggauucucacuuuuaugcugcuuuucgugcugguuugcgaaaucgcggagggaauuuuguccgacggcgugacggaaucucaccaucuccaccuguauaugcccgcugguauggccuuuauggcagccgucaccucggugguauacuaucauaauaucgagacaucaaacuucccuaaacugcucauagcuuuacugguuuacuggacucuugcauuuaucaccaagacaauuaaauucgugaaguuuuuggaucacgccaucggguucagccagcugcgguucugucuaaccggacuccuggucauucuuuauggcaugcuguugcucguggaagugaaugucauccgcguucgacguuacauauuuuucaaaacuccaagagaggugaagcccccugaggaccugcaggauuuaggcguaagguuucugcagccauucgugaaccuccuuaguaaggggacauauugguggaugaaugcuuuuauuaaaaccgcccacaagaaacccaucgaccugcgggcgauuggaaaguugccuaucgcaaugcgcgcccuaacgaacuaccaaagacugugcgaggcuuucgaugcccaggucaggaaagacauccaggguacucagggcgcacgggcuauuuggcaagcccucucccaugcguuugggcgccgacuggugcuuucuagcaccuucagaauacuggccgauuugcucggauuugcaggcccacuguguaucuucgguauuguugaccacuuagggaaggagaaugauguguuucagccgaagacacaguuccugggagucuacuuuguguccucacaggaauuucuagcuaacgccuauguacucgcuguucugcuuuucuuggcccugcuccugcaaaggacuuuucuucaggcaaguuacuauguggccaucgagaccggcauaaaucugcggggcgcuauucagacaaaaaucuacaacaagaucaugcauuugagcaccucuaaucucuccaugggggagaugacggcgggacaaauuugcaaccuggucgcaaucgacacuaaccaguuaaugugguucuuuuuccugugucccaaucuaugggccaugccugugcagauuauagucggugugauccuccuguauuacauucuuggcguuucagcuuugaucggggccgcagugaucauucugcucgccccaguacaguauuuugucgcuacaaaacugagccaagcccagcguaguaccuuagaauacucuaacgagcgccugaagcagacuaaugaaaugcuuagaggaauaaaauugcucaagcuguacgcaugggagaacaucuucaggacacggguggaaaccacgcgacgcaaagagaugaccucccuaagagcguuugcuauuuauacaagcaucucgauuuucaugaauacugccauccccauagcagccguucugaucaccuuugugggccacgucucuuucuuuaaggaggcugauuucuccccuucaguggccuuugcaagucucagccuguuccauauucuuguaacaccauuguuccuguuauccucugugguuaggagcacugucaaggcucucgugucagugcagaaacugagugaauuucuuuccagcgccgagauccgggaagaacaaugcgcgccccacgaaccgaccccucagggucccgccucuaaguaccaggcugucccacugcgcguugugaacagaaaaaggccugcacgugaggacugucggggguugacaggcccccuccagucacuggugccaagugccgacggagaugcugacaauugcuguguacaaauuaugggcggguauuucaccuggacucccgauggaaucccuacgcuaagcaacauaacaauucgaaucccaagaggucagcugaccaugauugucggccagguggggugcggaaaguccucucuccugcuugccgcauugggcgagaugcagaaaguuucgggugcgguguuuuggagcucccugccggacucagaaaucggggaggaucccaguccugaaagggagacugccaccgacuuagauauacgcaagcggggcccagucgcuuacgccucucaaaagcccuggcuccugaaugcaacaguggaagagaacaucauuuucgagagcccuuuuaauaaacagagauauaagaugguuaucgaggcuugcucccuucagccagacauugauauccugccccacggagaccaaacccagauaggcgaaagggggauuaaccuaucaggaggucagcgccagcgaaucagcguggcccgggcacucuaccaacaugccaauguagucuuccuggaugacccguuuucugcuuuggacauccaccuguccgaucauuuaaugcaggcgggcauucucgaacugcuucgugacgauaaaagaacuguggugcuggucacacacaaguugcaguaucucccucacgccgacuggaucauugcaaugaaagaugggacgauacagagggagggaacccugaaggacuuccaacgcagugagugucagcuauuugaacauuggaagacucugaugaaccggcaggaucaggagcuugaaaaagagacaguuaccgaaagaaaggcuacagagccaccccaaggccucagcagggccaugucuucccgagacggucuguugcaggaugaggaagaggaagaggaagaggccgcugagucagaagaggacgauaaucugaguagcauguuacaccagcgcgcagaaaucccuuggcgggccugcgcgaaauaccucucguccgcugggauucugcuucugucuuugcucguguucagccaacugcuaaagcauaugguacugguggccaucgacuacuggcuugcaaaauggacugauucagcccucacccugacgcccgcugcaagaaacuguaguuugucccaggagugcaccuuagaccagacagucuaugccaugguguuuacuguucuguguucucucggcauugugcugugccuugucaccagcgugacaguugaauggacuggacugaagguggcgaagagguugcaccguucccuacugaaccgcaucauacucgcuccaaugcgguucuucgagaccacgccucugggcucaauccuuaauagauuuagcagugacuguaacacaauugaucagcauauccccucuaccuuagagugccuguccaggagcacucucuugugugucucggcccuggcaguaauuucauacgugacaccaguuuuccucguggcccugcuuccgcuggcuaucgucugcuauuuuauacaaaaauacuuccgaguggccucucgggacuugcagcagcuagaugacaccacucagcugccucucuuaagucacuuugcagaaaccguagaggggcugacaacgauucgcgcuuucagauaugaagccagguuucaacagaaacuucuggaguacaccgauuccaauaacaucgcgagccucuucuugacugccgcaaaucgguggcuggaggugcgaauggaauauaucggagcuugugucguucucauugccgcugugacaucuauaagcaacucccugcacagagagcuuucagcaggccuagugggucugggguugaccuacgccuuaauggucaguaauuaccugaacuggauggugcgcaaucucgccgacauggaacugcagcuuggagcuguuaaaaggauccauggccugcucaagacagaggcggaaagcuaugaggguuugcuggcacccucucuaauuccaaagaacuggcccgaucagggcaagauccaaauucagaaucuguccguacguuacgacucaagucucaaaccugugcuuaagcacgucaacgcccugaucgcuccagggcagaagauaggaaucugcggccggacugggagcggaaaauccucuuuuucguuagccuucuuuagaaugguggauaccuucgagggccauauuaucauugacgguaucgauauagcaaaguugccccugcacacgcucaggagccgccugucaauuauccuucaggacccuguucuguuuuccgggacaauccgauucaaucucgauccggaaagaaaaugcagugacucuaccuugugggaggcccuggaaauugcucaauuaaagcuaguggucaaagcgcugccaggaggccucgacgccaucauaacugaggguggcgaaaacuucagccaggggcagcggcaacuuuucugucuggcaagggcuuucgugcgcaagaccuccauuuuuaucauggaugaggccacagcaucaauugacauggccacugagaauaucuugcagaagguagucaugaccgcuuucgccgaucguacagugguuacgauagcgcauagagugcacaccauucugucugcagaccucgucaucgugcugaaacggggagccauccuugaauuugauaagcccgagaaacuccugagcaggaaggacaguguuuucgcuuccuuugugcgcgccgauaaauga

SEQ ID NO: 52288 - RNA, 4650 nt, Artificial Sequence
  derived and/or modified sequence opt3 from ABCC9__Homo_sapiens__NP_005682
augagccuguccuucugcggcaacaauaucucuucauacaacauuaaugacggggugcuccagaacaguuguuuugucgaugcccuuaaucugguuccccacguguucuuguuauuuauaaccuucccuauccuguuuauuggaugggguagccaauccucuaagguacagauccaucacaacacauggcuacauuucccaggccacaaucucagauggauucugacuuuugcacuucuguucgugcaugucugcgagaucgcugaagggauagugucggacucaaggcgggagagccgccacuugcaccucuuuaugccggccguuaugggauucguggcgacgaccacaaguaucgucuauuaccauaacauugaaacuuccaauuuucccaaacugcugcucgcuuuauuccuguauugggugauggccuuuaucaccaagacaauuaaacuuguaaaguacugucagucuggcuuggauaucagcaaccugcgauucugcauaaccgguaugaugguuauucuaaaugggcuccugauggcaguggagaucaacgucauucgugugagaagguauguguucuuuaugaauccucagaaagucaagccacccgaagaccuucaagaucugggaguucgguucuugcagccuuuugugaaccuccuguccaaggccacuuacugguggaugaauacauuaaucaucucagcucacaaaaagccaauugaccugaaagcaauaggcaagcuccccaucgccaugcgcgcuguaaccaacuaugugugucuuaaagaugccuacgaggagcagaagaagaaagucgcggaccauccuaacagaacgccaaguauuuggcuggcaauguacagggccuucggccggccgaucuugcuaagcucuacuuuucgcuaucuggcugaucuccugggguucgccggaccccuuugcauauccgguauugugcagcgaguuaaugaaacccaaaacggcacaaauaacacuaccgggaucucagagacacugagcaguaaggaauuuuuggagaaugcauacgugcucgcuguccuguuauuccuggcccuaauccuccagagaaccuuucugcaggcgucuuauuacgugacgauugagacuggaaucaaccuuaggggcgccuugcuggcaaugauuuauaauaaaauacuccggcuguccacaagcaaccuuucgaugggugaaaugacccuggggcagaucaauaacuugguagcuauugagacuaaucaacucaugugguuccuguuuuuauguccuaaccugugggccaugccaguucagaucaucaugggagugauucuacucuacaaucugcuugggucuuccgcuuuggucggcgccgcagugauaguccugcucgcccccauccaguauuucauugcuacaaagcuggcggaagcacaaaaaucaaccuuagacuacaguacggagcgucugaagaaaaccaacgaaauccuuaaggggauuaaguugcucaaacuguacgccugggagcacaucuuuugcaagagcguggaggaaacacgcaugaaagagcuauccucucugaagacuuucgcucucuauaccagccugucaauauucaugaaugccgcaaucccuauugccgcuguucuugccacauuugugacucacgcauacgcgaguggaaacaacuugaaaccagcugaagccuucgcaucccugagcuuauuucauauccucguaacuccccuguuccuucugucuacagucgugagauuugccguuaaggcuauuaucucagugcagaaguugaaugaguuccuccugagugaugaaauaggugacgauagcuggaggaccggcgaguccucucuaccguuugagucguguaaaaagcacacugggguccagccuaaaacgauuaaccggaagcagcccggacgauaucaucuggacagcuacgaacaauccacacgcagacucaggccagccgagaccgaagacaucgcaauuaaagugacuaauggcuauuucucaugggguagugggcuggcuacccuuucuaacaucgauauacggaucccuacaggccaguugaccaugauuguaggacaggugggcugcggcaagagcucccuguuacucgccauccugggagagaugcagacucuugaagguaagguucacuggucaaaugucaacgagagcgagcccucuuuugaagcgacacgcuccagaaauagguacaguguggccuaugcugcacaaaaaccauggcugcuaaacgccacgguggaggaaaauauuaccuucggcagccccuuuaacaagcagcguuacaaagcugucacugacgccuguucucuccagccugauaucgaccuguugccauucggggaucagacagagauaggagagcggggcauuaaucuguccggugggcaacgacagagaaucugcguugcaagggcguuauaccagaacaccaauaucguguuucucgacgauccguucucagcccuggacauucaucuuagugaucaccugaugcaggaaggcaucuugaaguuccuccaagacgauaaacgcacacuggugcuaguaacucacaagcugcaguaucuuacccaugcugacuggauuauagccaugaaggacggaagcguccuccgggagggcacgcugaaagauauccagaccaaggacguggaauuguacgagcacuggaaaacacugaugaacagacaagaucaggaauuagagaaggacauggaggcagaucagacuacccucgaaaggaaaacacugcgccgagcuauguauucgcgggaggccaaggcacagauggaagacgaggaugaagaggaggaagaggaagaggacgaagaugacaauauguccacuguuaugcgucuuagaaccaaaaugcccuggaagacgugcuggagguaccugacaucugggggauuuuucuugcucauucugaugaucuuuagcaagcuacugaaacauucagugauugucgccaucgauuauuggcuugcuaccuggaccagugaguacuccauaaacaacacagguaaggcggaccaaaccuauuacguggccggcuucucuauccucuguggggcaggaauuuuucugugcuugguuacuagcuuaaccguggaguggaugggccugacagcugccaaaaaucuccaccacaaccugcuuaauaagaucauucuggguccuauccgcuucuuugauacgaccccauuggggcuaauacugaaccgguucuccgccgacacuaauauuaucgaccagcauauucccccuacacucgaaucacugaccagaagcacacuuuuaugucugagugcuaucggcaugauaucuuacgcaacuccaguauuucucgucgccuugcugccccucggaguggcguucuauuuuauccagaaauacuucaggguggcuuccaaggaucugcaggagcuugacgauagcacccaacugccguugcuaugccacuucucggaaacggccgagggccugacaaccauucgagcauuucgccaugagacucgguucaagcagagaaugcucgaauuaaccgacacaaacaauaucgccuaucuguuucuuucagcugcaaacagguggcuggagguccguacugauuaccucggggccuguauuguuuugaccgcgucuaucgcuaguauauccggaagcucuaauagcggccuggugggucucgggcugcuuuaugcccuaacaaucacgaacuaccugaauuggguagugcgcaacuuggcagacuuagaaguccagaugggagccgugaaaaagguuaauuccuuccugaccauggagucagaaaacuaugagggcacuauggauccuagucaggugccagagcacuggccccaagaaggugagauuaaaauccaugaccucugcguccgguacgaaaauaaccugaagccugugcuuaaacacguuaaggcuuacauuaagcccggccagaaaguggggaucuguggaagaacaggcagcgggaagucuucccugucacucgccuuuuucaggauggucgauauauuugacggaaaaauuguaaucgauggcaucgacauuaguaaguugccacugcacacccuacgaagccggcuguccaucauacuccaggauccuauucuuuucucugguucgauccgcuuuaaccuggaccccgagugcaaauguacugacgauagauuaugggaagcauuggagauugcucaacugaagaauaugguuaagagccucccagggggacuggacgccguggugacagagggcggugaaaacuucucagucggccagaggcagcuguuuugccuugcgcgggccuucgugcgaaaauccaguauccucauaauggaugaggcaaccgcuucuauugacauggccacggaaaauaucuugcagaagguagugaugacugcuuuugcagauagaaccgucguuacaaucgcccaucgcgugagcuccauuauggacgccgggcugguguuagucuucucagagggaauccuaguggaaugugauaccguuccgaaccugcucgcucacaaaaauggccuuuucucuacucugguaaugacaaacaaguga

SEQ ID NO: 52289 - RNA, 2238 nt, Artificial Sequence
  derived and/or modified sequence opt3 from ABCD1__Homo_sapiens__NP_000024
augcccgugcugagcagaccuaggccauggcggggcaacacccucaagcgcacagccguccuucuggcuuuggcagccuacggggcgcacaaaguuuauccguuagugcgacagugccuggcucccgcccguggacuacaagcuccugccggugagccaacucaggaagcauccggcguagcagccgcuaaggccgggaugaauagaguguuccuccagaggcugcuuuggcuguugcggcuccuguuuccccgcguccuguguagagagacgggacucuuagcgcugcauucugcagcccuugugucaaggaccuucuugaguguuuacguggcucggcuggacggccgccuagcccgaugcaucgucagaaaagauccuagggcauuugguuggcagcuccugcaauggcuucugauugcuuugccagccacauucgugaacagcgcgauacgguaucucgaagggcagcuggccuuauccuuucguucucgccugguagcacacgcuuacagacucuauuucucgcagcagacuuacuauaggguuucaaauauggacggacggcuucgaaaccccgaucaaagccugaccgaggacguggucgccuuugcugccaguguggcacauuuguacuccaaucuaacaaagccucugcucgauguggccgucaccucuuacacucugcuucgcgcugcgagaagcaggggcgcaggcacagccuggccauccgcuaucgccgggcugguuguguucuugaccgcaaacguacuccgggccuuuucaccgaaauucggagaacugguggcugaggaggcccgcagaaagggugaauuaagguauaugcacagucgugucguggcaaauagcgaggaaauugcguuuuacggcgggcaugagguugagcuggcucuacuccagcggucuuaucaggaccuggccucccagaucaaccuuauuuugcuggaacgacucugguacgugaugcuggagcaauuccuuaugaaguaugucuggucagcaagcggacuguugaugguggccguacccaucauaacggcuacuggcuacagugaaucugaugccgaggcaguuaaaaaggcugcccucgagaaaaaggaagaggaacugguguccgagagaaccgaagcguuuacaaucgccaggaauuuacugacugcugcagccgacgcuauugagcgcaucaugagcucguauaaagaagucaccgagcuagccgguuacacagcacgggugcacgagauguuccaggucuucgaagaugugcagagaugucacuuuaagaggccucgcgagcucgaagacgcgcaagccgggucuggaaccauuggccgauccggcguucggguggaggggccacugaagauccguggacagguagucgauguggaacaggguauaauuugcgagaacauccccauuguuacgccuucaggcgagguggucguggcuagucuuaauaucagaguagaagaggggaugcauuugcugaucacuggaccaaacggcugugguaaaagcucccucuucaggauuuuagggggccuguggcccacauacggaggcgugcuguauaagccgccuccccagcgcauguuuuacauaccacaacggccuuauaugucuguugggagccuuagagaccaggucaucuaccccgauucaguggaagacaugcagaggaaaggauauagugagcaggacuuggaggccauucucgaugugguccaucugcaccacauccuacaacgagaagguggcugggaggcaaugugcgacuggaaggauguucuguccgggggagaaaaacagcgcauaggcauggcucggauguucuaccacagaccaaaguaugcccuccuggacgaguguaccagcgcagugucuauugauguggaagguaaaaucuuucaggccgcuaaggacgcggggaucgcccuuuugucaauuacucauaggcccagucuguggaaguaccacacacauuuacuccaguucgauggcgagggaggcuggaaauuugagaagcuggacagcgcagcucgucuuucccugaccgaagagaaacaacgcuuggaacagcagcucgccgggaucccuaagaugcagcggagacugcaagagcuaugccagauucugggagaagccguagcuccagcacacgucccggcccccucuccucaggguccaggcgggcuccaaggagcgucgacguga

SEQ ID NO: 52290 - RNA, 2223 nt, Artificial Sequence
  derived and/or modified sequence opt3 from ABCD2__Homo_sapiens__XP_011536329
augacccacaugcugaacgccgcugcagacagagugaaguggacaaggagcuccgccgcgaaacgggcugccugccucgucgcagccgcuuacgcacuuaagacucuguaucccaucauuggcaaacgcuugaagcagucugggcauggaaagaagaaggccgcugccuacccugcggcagagaauacggaaauauuacacuguaccgagacaaucugcgaaaaaccaucaccggguguuaacgccgauuucuuuaagcaacugcuagagcuccgaaaaauucuguuccccaagcuggugacuaccgaaacaggcuggcuguguuugcauaguguagcucucaucagccguaccuuucuguccauuuauguggccgggcuggacggaaaaaucgucaagucuauaguggagaagaaaccuagaacuuucaucauuaagcucaucaaaugguuaaugauugcaaucccagcuacauuuguuaauucggccauaagguaccuggagugcaaacuugcguuggccuuccggacccgccugguggaucacgcauaugaaacguacuuuacuaaccagaccuauuacaaagucauuaauauggacggcagacuagcuaaccccgaucagucacucacagaggacaucaugauguucagccagaguguggcccaucuguacuccaaucuuacuaagccuauucuggauguaauguugaccucuuauacacucauccaaaccgcuacgagcaggggugccuccccaaucgggcccacucuguuagcaggacugguuguguacgccacagcuaaaguccucaaggcguguucaccuaaguuuggcaaacuuguggcagaagaggcccaccggaagggcuaucugcgcuacgugcacagucgaauuauagcuaacgucgaggaaaucgccuucuauagagggcauaaaguugagaugaagcaguugcagaaaagcuacaaggcacuagccgaccagaugaaucugauucucucuaagaggcugugguauaucaugauagaacaauuucuuaugaaauacgugugguccucaagcggacugauuaugguagcuaucccaaucauuaccgccacugguuucgcagauggcgaggacgggcagaaacaggugauggucagugaacggacagaggcguuuaccacggcucguaacuugcucgccucuggagcagaugccaucgagcgcauuauguccagcuacaaggaagugaccgagcuggcuggcuauacagccagaguuuacaauauguucuggguguucgacgaagucaagagggguauauauaaacggacugcagugauccaggagucggaaucucacuccaagaacggggcuaagguagaguuaccgcugucagauacccuagccauuaaaggaaagguuaucgacguggaccauggcaucauuugcgagaauguccccauaaucacuccugcgggcgaaguggucgccagucgacucaacuuuaaaguggaggaagggaugcaccuucuuauuacaggaccaaaugguuguggcaagagcuccuuguuccgcauccugucugggcucuggcccguuuacgagggagugcuguauaaaccuccaccccaacacauguuuuacauuccgcagagaccuuauaugagccuuggcucacugagggaucagguaaucuaccccgacagugucgaugacaugcaugauaaggguuacaccgaccaagauuuggaacggauacuccacaacgugcaucuguaucacaucguucagcgcgaagggggcugggacgcugugauggauuggaaggacgucuuauccggaggcgagaaacagagaauggggauggcaaggauguucuaccauaagccaaaauaugcccugcuagaugagugcacaagcgcugugucuauugacguagagggaaagaucuuucaggccgcaaaaggugcgggcauuucacuccugaguaucacccaccguccuagccuuuggaaguaccacacucauuugcugcaauucgacggggaaggaggcuggcgguuugagcagcucgauacggccauacgacugacauuauccgaggaaaaacagaagcuggagucucagcuugcugguauucccaagaugcaacagagauugaacgaacucuguaaaauccugggggaggacucggugcuaaagaccauuaaaaaugaagaugagacuagcuga

SEQ ID NO: 52291 - RNA, 1044 nt, Artificial Sequence
  derived and/or modified sequence opt3 from ABCD3__Homo_sapiens__XP_011540179
augggcuucaucgacagcauuauagccaaguaccuggcuaccguggucggguaucucguuguguccagacccuuucuugaucugucucacccuaggcauuugaaaucaacacacagugaguuacuggaagacuacuaucagagcggacggaugcuacuccgcaugucccaagcacugggucgaaucguacuugccggccgugagaugacuagacuggcgggguucacggcuaggauuaccgaauugaugcaagugcucaaggaucugaaccauggaaaauacgagcggacaauggucucucagcaggaaaagggcaucgagggugugcagguuauuccacugaucccgggggccggagagauaaucauugcagacaauaucauuaaauuugaucacgugccccucgccacuccuaacggcgacgucuuaauccgcgaucugaauuucgaagugagaucgggcgcuaacguacuuauaugcgggccaaauggaugugguaagucaagccuuuuuaggguucugggcgagcuauggccccucuucgggggacggcugaccaagccugaacgcggcaaauuguuuuaugugccacagcgacccuacaugacacuggguaccuugagagaccaggucauuuauccugaugggagggaggaccagaagcggaaaggaaucagugaucucgugcugaaggaguacuuagacaacgugcaacugggccauauucucgaacgugagggcgggugggauuccguccaggacuggauggacguucuuucuggaggugaaaaacagcgcauggcaauggccagacuguucuaccacaagccacaguuugcuaucuuggaugagugcacuagcgccguguccguagacguggaaggcuauaucuacucacacuguaggaaggucgggauuacacuauucaccgugagucaucggaaaagccuguggaagcaccaugaguauuaccuccacauggauggacgaggcaauuaugaguuuaaacaaauaacggaagacacuguugaguucgguucuuga

SEQ ID NO: 52292 - RNA, 1821 nt, Artificial Sequence
  derived and/or modified sequence opt3 from ABCD4__Homo_sapiens__NP_005041
auggccguggcuggccccgcaccuggggccggagcgagaccaaggcuggaccuccaguuccuucaacgguuucugcagaucuugaaggucuuauucccgagcugguccucucagaacgcucugauguuucuaacccuccugugccuuacacuguuggagcaguucguuauuuaccaagugggucucauacccucacaguauuacggcguacuggggaauaaagaucuggaaggauuuaagacucucacguucuuagccgugaugcugaucguccuuaacaguaccuugaaaaguuuugaccaguucacauguaaucugcuauauguguccuggcgcaaggaucucacugagcacuugcaucgacuuuacuuucguggcagagcauauuacacccugaacguuuugagggacgauauugacaauccugaucagcggaucucucaagacguggaacgcuucugcagacagcucucgucaauggccagcaaacugauuaucaguccauuuacauuagucuauuacaccuaccaguguuuccaguccacugguuggcuggggcccgugucuauauuuggauauuucauccucggcacaguaguuaacaagacccuuaugggcccuauugugaugaagcugguccaccaagagaaauuggaaggggauuucagguuuaagcauaugcagauccgggugaaugcugagccagcagccuucuaccgcgcuggacacguggagcauaugcgaacggacagaaggcuacagcggcugcuccaaacucagcgugaacugaugagcaaagagcuuuggcuguauauugguaucaacaccuuugauuacuugggcuccauacucucauaugucguuauugccauccccauuuucagugggguguacggagaccugagcccugcggaauuaucuacacugguauccaagaaugcauuugugugcaucuaucuaaucucauguuucacucagcucauugaucugagcaccacacuuagugacgucgccggcuacacccaccgcauaggucaguugagagagacgcugcucgacaugucucugaaaucccaagauugcgagauccuuggggaaagcgaguggggacuggacacuccaccgggcuggcccgcugccgaaccugcagauacagcuuuucugcucgagagggugucgauuucugccccauccucagacaagccccugaucaaggauuuaagucugaaaauaagcgaaggccagucccuacucauuaccgggaacacuggaacagguaagaccucucugcuucggguuuugggcgggcuguggacgagcacccgaggaucagugcagaugcucacagacuucggcccucacgguguccuguuuuuaccacagaaacccuucuuuacugaugggacccugcgcgagcaagugaucuacccgcuuaaggagguauauccugacaguggcuccgcggaugacgaaagaaucuugagguuccucgagcuggccggacuaagcaaucugguugcacggacagaaggccucgaucaacagguggacuggaacugguacgacguccugucucccggggagaugcagcgccuuucauuugcuagauuguucuaucugcagccaaaauacgccguguuagaugaagcuacuagcgcccucaccgaggaggucgaaagcgagcuguauaggauuggacagcagcuugguaugacauucaucuccgugggccaucgucagucucuggaaaaguuucacucguugguucucaaacugugugggggaggccggugggagcuaaugcgaauuaagguggaauga

SEQ ID NO: 52293 - RNA, 1800 nt, Artificial Sequence
  derived and/or modified sequence opt3 from ABCE1__Homo_sapiens__NP_002931
auggccgacaagcugaccagaaucgcuauugugaaccacgauaaaugcaagcccaaaaaguguaggcaggagugcaaaaagagcuguccugucguucggaugggcaagcucugcauagaagugacaccacaauccaaaaucgcauggauuucugagacucuuuguaucgggugcggaauuuguaucaagaaaugcccguucggugcccugucaauaguaaauuugcccaguaacuuagaaaaggagacgacccaucgcuauugugcgaaugcuuuuaaacugcaccgacuaccuaucccacgucccggcgaagugcucgggcuggucggaacaaacggcauugguaagagcacugcccuuaagauccuggcagggaaacagaagccuaauuugggaaaauaugacgauccacccgacuggcaggagauucucaccuacuucagaggcuccgagcugcagaacuauuuuacaaagauccuggaagaugaccucaaagccauaauuaagccucaauacguggaucagaucccaaaagcugcaaagggcaccguugggucuauuuuagacaggaaggaugagacuaaaacacaggccaucgugugccagcaacuggaccuuacccauuugaaggaacggaaugucgaggaucugucgggaggugagcuacagcgcuucgcuugugccgugguaugcauccagaaagcggacauuuuuauguucgaugaaccgucaagcuaucucgacguuaagcagagacugaaagcagccauaacgaucaggagucuuauuaaccccgaccgguacaucauaguggucgagcacgaucuguccguguuggacuaucucucugauuuuauuugcugucuguacggcgugccuagcgcuuacggggucguuacuaugccauucuccgugcgcgaaggaaucaauaucuuuuuagacggcuauguacccaccgagaaccugcgauucagagaugccucacucguguuuaaggucgcagaaacagcuaaugaggaggaagugaagaaaaugugcauguacaaguauccugguaugaaaaagaaaaugggggaguucgaacuugccauuguugcgggagaguuuacugacagugaaaucauggugaugcugggcgagaacggcaccgggaagacaaccuucauuaggauguuggccggacggcuaaagccagaugaggguggcgaaguccccgugcugaauguaagcuacaaaccgcaaaagauaucuccuaaauccacggggucaguucgucagcuccugcaugagaagauccgcgacgcauauacucacccccaguucgugacagaugucaugaaaccacuucaaauugaaaacaucaucgaccaggaggugcagacccugagcggaggcgaauugcagagagucgcucucgcccuguguuuagguaagccugcugauguguaccugauugacgagcccagugccuaucuagacucugagcaaaggcucauggcagcccggguugugaagcgauuuauacugcacgcuaaaaagacugcguucguagucgaacaugauuuuaucauggcaacauaccuugccgaccgcgugauuguuuucgauggggugccauccaaaaauaccgucgcuaacagcccccagacguugcuggccggcaugaacaaguuucucucgcagcuggagaucaccuucagaagggacccuaauaacuaccggccacgcauuaauaaacuuaacucuaucaaggauguggaacagaaaaaguccggaaauuacuuuuuccuggacgauuga

SEQ ID NO: 52294 - RNA, 2538 nt, Artificial Sequence
  derived and/or modified sequence opt3 from ABCF1__Homo_sapiens__NP_001020262
augcccaaggccccuaaacagcaaccaccggagcccgaauggaucggcgacggggagagcaccuccccuucugauaagguggucaaaaaggggaaaaaggacaagaaaauuaagaaaacauucuuugaagaacuggcuguugaagauaagcaggccggugaggaggaaaaagugcucaaggagaaggaacagcagcaacagcagcagcaacagcagcagaaaaagaaaagagacacuaggaagggccggcgcaaaaaggauguagacgaugacggggaggagaaagaacuuauggagcgacugaagaaguugucagugccaacgagugaugaagaggacgaaguccccgcaccuaaaccacguggaggcaagaaaaccaagggugggaacguguucgcggcuuuaauacaagaucagagcgaggaggaagaggaagaggaaaaacaucccccuaagccagccaagccggagaaaaauagaaucaacaaggcaguuuccgaggaacagcaacccgcccugaaaggaaagaaaggcaaggaggaaaagucuaaaggcaaggcuaaaccucagaauaaguuugcagcccuagacaacgaggaagaggauaaagaggaagagauuaucaaggaaaaggagccacccaaacaggggaaggagaaagcuaagaaagccgaacagggaucggaggaagagggugaaggcgaggaggaagaggaagagggaggagaaucaaaggcggacgacccuuacgcacaccucagcaaaaaggagaagaaaaagcugaaaaagcaaauggaguaugaaaggcaaguggccagucuuaaagcugccaaugcagcugagaacgauuucuccgucucucaggccgaaaugagcucccggcaggcgaugcuggagaaugccucagacauuaaguuggaaaaguuuaguaucagcgcacacggcaaagaacucuucgugaacgcugaucuguacauaguagccggucgcagauaugggcugguuggaccaaauggcaagggcaaaacaacucucuuaaagcauaucgcuaacagggcccugucuauucccccgaauaucgacgugcuuuugugcgagcaggaagucguggcagaugagaccccugccgugcaggcuguccugcgggcggacacaaaacgccuaaagcuccuggaagaggagcgaagacuucaggggcagcuggaacaaggagaugacaccgcagccgagagguuggaaaagguuuacgaggaacuccgggcuacuggugccgcagccgcugaggccaaagcacgucgcauucuggcgggcuuaggguuugaucccgagaugcagaacagaccaacacagaaguucuccggaggcuggaggaugcgggugucacuggcucgagcccucuuuauggaaccuacccuucugauguuggacgagcccacgaaucaccuagaucugaacgcaguaaucuggcucaauaacuaucugcaggguuggcgcaaaacucuucugauagugagccaugaccaaggguucuuggacgaugucuguaccgacauuauccaccucgaugcccagagacugcacuacuauaggggcaacuacaugacauuuaagaaaauguaccagcaaaagcagaaggaauuacugaaacaguaugagaagcaggagaaaaagcuaaaagagcucaaggcuggaggcaaaaguacuaagcaagccgagaagcagaccaaagaagcacugacacggaagcagcagaaaugccgcagaaagaaucaagacgaggaaucucaggaggcuccagaacuuuugaaaaggcccaaggaguacaccgugcguuucacguuuccugauccaccgccccuguccccuccaguucucgggcugcauggagugacuuucgguuaucagggccagaagccccuuuucaaaaaccuggacuuugggauugauauggacagccggaucuguaucgucggaccuaauggcguggguaagucgacauugcuccuguuacugaccgggaaacuaacuccaacacacggcgagaugcgaaagaaccauagacucaaaauuggauucuuuaaucaacaguacgccgaacagcugaggauggaggaaacccccacggaguaucuucaacgcggcuucaacuugccguaccaggaugcgcggaagugccuggggagauuuggacucgagucucacgcccacaccauacagaucuguaagcuguccgguggccagaaagcuaggguaguuuucgcagaauuagccugccgcgagccugacgugcugauucuugaugaaccaacaaauaacuuggacaucgagucaauagaugcucucggggaagccauuaaugaguauaagggagcagucaucguggucagucaugacgcgcgacugaucacugagaccaacugucaacuaugggugguugaggagcagagcgugucccagauugacggcgauuuugaagacuacaaacgggagguacuggaagcccucggugaggucauggugucucgucccagagaguga

SEQ ID NO: 52295 - RNA, 1905 nt, Artificial Sequence
  derived and/or modified sequence opt3 from ABCF2__Homo_sapiens__NP_005683
augcccagcgaccuggccaagaaaaaggcugcaaagaagaaagaggccgcgaaggcuagacagaggccucggaagggccacgaagagaacggggauguggucaccgaaccacaaguugccgagaaaaaugaagcaaacggacgcgagacaacugagguggaccuccuuacgaaggaacuggaggauuucgaaaugaaaaaggccgcugcacgagccguaaccgguguguuggcuucccaucccaauucuacagacguccacaucauuaacuuaucacugacuuuucauggccaggagcuacucagugauaccaaacuggagcuuaauagcgggcguagauacggacugauaggcuugaacgguaucgggaaguccaugcuccugucugccauuggaaagagggaagugccgaucccugagcacauugacaucuaucaucugacacgggaaaugccacccucggauaaaaccccucuccacugcguuauggagguggacacugaacgcgcgauguuagagaaggaggcagaaagacuggcccacgaggaugcugaaugugagaaacuuauggaauuguacgagaggcuggaggaacuagacgccgauaaggcagagaugcgggcuucacgcauacuccauggccugggcuucacaccagccaugcagcgaaagaaacuuaaagacuuuagcgggggauggagaaugagggucgcgcuggcccgggcauuguucauccgucccuuuaugcuccuguuagaugaaccuaccaaucaccuggaccucgacgcuugcguguggcuugaggaggaacugaagacguucaagcgcauuuugguacucguuagucauucccaggauuuucugaacgguguguguacuaauaucauucacaugcacaacaaaaagcucaaauauuacaccggcaauuaugaccaauacgucaagacaagacuggagcuugaagagaaccagaugaaaagguuccauugggaacaggaucagaucgcccacaugaagaauuauauagcucgguuugggcauggaucugccaagcuggcacgacaagcccagagcaaagagaagacuuugcagaaaaugauggcuuccggccucaccgagcgcguggugucagacaagacacugaguuucuacuuuccaccgugcgguaaaauucccccuccagucaucaugguucagaacgugagcuucaaguacaccaaggaugggcccuguauuuauaauaacuuagaauuuggaaucgaccuggauacgagaguagcgcuagugggcccuaacggcgcagggaaaucuacucuccugaaacuuuugacaggagagcugcucccaaccgacgguaugaucaggaaacacucccaugucaagauuggccgguaccaccaacaucugcaggaacagcuugaucuggacuugucaccccucgaguauaugaugaaaugcuacccggaaauaaaggagaaggaggaaaugcgcaaaaucauugggagauauggacugacuggcaagcaacaggugagcccuaucaggaauuuaagugauggucagaaaugucguguuugccuggccuggcuagcuuggcagaacccccacaugcuauuccuggacgagccaacaaaucaccuugacauagaaaccauugaugccuuggcagacgccaucaacgaguucgaagggggcaugaugcuggugucucaugauuuucggcucauccaacaggucgcucaggagauuugggugugugagaagcagacgaucaccaaauggccuggagacauucuggccuacaaggaacacuuaaaauccaagcugguagaugaggaaccccaacuuacaaagcgaacucacaauguuugcaccuugacacucgcaagccugccaagacccuga

SEQ ID NO: 52296 - RNA, 2037 nt, Artificial Sequence
  derived and/or modified sequence opt3 from ABCG1__Homo_sapiens__NP_004906
auggccugccugauggcugcauucagcgugggcaccgccaugaacgcguccucuuacucagcugagaugacagaacccaagagugucuguguuagcguggacgagguaguguccucuaauauggaagccacugagacggaucuccuuaacgggcaccugaaaaaggucgacaauaacuugaccgaagcacagagauuuucgucauuaccuaggcgggccgcugugaauaucgaguuccgcgaucugagcuauaguguuccagagggaccgugguggcgaaagaaggguuacaaaacacuacucaagggcauuuccgggaaguuuaacucuggagaacugguggcaauaaugggccccagcggugccgggaaauccacucuuaugaauauccuggcuggauaucgugagaccggcaugaagggcgccgucuugauuaacgggcucccuagagaccugaggugcuuccggaaagugucauguuacaucaugcaagaugacaugcugcucccacauuuaacaguacaggaagcgaugaugguuagugcacaccugaaacuucaggagaaagaugagggacgcagagaaauggugaaggagauuuugaccgcccugggucuacucagcugcgcuaauacuaggacaggcucucuguccgggggacagcggaagcgccuugccaucgcacuggaauuggucaacaaucccccugugauguuuuucgacgagccaaccucaggccucgauagcgcuaguuguuuucaaguggucucucugaugaaagguuuagcccaagggggacgauccauaaucugcacgauucaucagcccagcgcgaagcuguucgaacucuuugaccagcuuuauguucugucgcagggccaguguguguacagaggcaaaguaugcaacuuggugccuuaucuaagggaucuggggcucaauuguccaacuuaccacaacccggccgacuucgucauggagguggcaucuggagaguacggugaucaaaauucccggcugguucgugcugugcgcgaaggcaugugcgacucagaccauaagagagaucuugggggagacgccgaggucaaccccuuucuguggcacaggccuagugaagaggugaaacagaccaagcgguugaaaggccuccgaaaggauagcuccucuauggaagguugucacagcuucucagcuaguugccugacacaguuuugcaucuuauucaagcgcacuuuccuguccauuaugagagacagcguacuaacccaucucaggaucacaucucacauagggauuggccugcuuaucggauugcuguaucucggcauugggaacgaggccaaaaagguucugucaaauaguggauuucuuuucuuuagcaugcuguucuugauguuugcagcccucaugccaaccgugcugacguuccccuuagagaugggugucuuucugcgggaacaucuaaacuacugguauucccucaaggcuuacuaucuggcgaagacuauggcagaugugccuuuccagaucauguuuccagucgccuacuguucuaucguguauuggaugacaucgcagcccagcgacgcuguucgcuucgugcuuuuugccgcauugggcaccaugacuucccugguagcccaaucacucgggcuguuaauuggagcugccaguacaucucugcaggucgcaaccuucgugggcccgguuacggcgauaccugugcuuuuguuuagcgguuucuucgucuccuuugauaccauccccacauaccuccaguggaugucauacauuagcuaugugagauacggguucgagggcguaauccugucuauauauggacuagacagggaagaucugcacugcgacauugaugagacuugucacuuucagaaauccgaagcuauccuccgugagcuggacguggagaaugccaaacuuuacuuggacuucaucguucugggcaucuuuuucauuaguuuacggcucauugcauauuuuguccugcgauacaagauaagagccgaaagguga

SEQ ID NO: 52297 - RNA, 1836 nt, Artificial Sequence
  derived and/or modified sequence opt3 from ABCG2__Homo_sapiens__NP_001244315
augagcuccucuaacguggaggucuucauccccguuucacagggcaauaccaacggguuuccugccacagcuaguaaugaccugaaggcauucacugaaggagccgugcucagcuuucacaacauuugcuacagaguaaaacuuaaguccgguuuccugccauguaggaaaccgguggagaaggaaauauugucuaauaucaacggcauuaugaaacccggguuaaaugcgauccugggaccuacgggcggugggaagucgucacuacucgauguccuggcugcccggaaggacccaagcggacuuaguggcgaugugcugauuaacggcgcaccccgcccugccaauuuuaaaugcaacuccggguauguugugcaagacgaugucgugaugggaaccuugacaguacgagagaaucuccaguucucugcugcacugcgucuggccacuaccaugacaaaccaugaaaagaaugagagaaucaacaggguuauacaggagcucgguuuagacaaaguggcugauagcaaggucggcacccaguuuauccgcgggguguccggaggcgaacggaaaagaacuucaauugguauggagcugaucacagacccaaguauucuuuucuuggaugaacccaccacggggcuggacagcucuacugccaaugcggugcuacuccugcuuaagaggauguccaagcaaggacggaccaucauauuuucaauucaccagccucgcuacagcaucuucaaacuguuugauaguuugacacuccuggcaucuggccgauuaauguuccauggcccagcccaggaggcucugggguauuuugaguccgccggauaccacugugaagcauauaacaacccggcugacuucuuccucgauauuaucaauggugacagcacugccgucgcgcuuaacagagaggaagacuuuaaggccaccgagaucauugaacccucgaaacaggauaagccucugauagagaaauuggcagagaucuacguuaauucuuccuucuauaaggaaacaaaagcugagcuacaucaacugucaggcggggaaaagaagaaaaagauuaccguguuuaaagagaucaguuacacgacuagcuucugccaccagcucagguggguauccaagcggucuuuuaaaaaccugcuuggaaauccacaggccagcauagcucagauuaucgugacagucgugcugggcuugguuaucggugccauuuacuucgggcucaagaacgacucaaccggcauccaaaaucgugcaggagugcuguuuuucuuaacuacaaaccaguguuuuaguuccgucagcgccguggaacuguucguaguugagaagaaacuauuuauucacgaguauauaucuggcuacuaucgcgugucaaguuacuuccucgggaagcugcuuagcgauuugcugcccaugagaaugcucccuuccaucauuuuuaccugcaucgucuauuucaugcugggacuuaaaccaaaggcugacgcguucuuugugaugauguucacgcugaugauggucgcauacucugccucgagcauggcuuuggccaucgcagccggucaguccgugguuucaguggcuacccuccugaugacaauuuguuuuguauucaugauggucugcuggaguauaucucaacccuuacaucugggcugucacggguuuagcacuuccgccuuccaugauauggaccuaaggcucugcucaaucaugaauuuuugggauaaaaccagcgcacaggacucuaugcagcaggaaacaauucuggugacuaugcaacacguucuugcgaagaacaucugguga

SEQ ID NO: 52298 - RNA, 1941 nt, Artificial Sequence
  derived and/or modified sequence opt3 from ABCG4__Homo_sapiens__NP_001135977
auggccgagaaggcucuggaagcagugggcugcgggcucggacccggugccgucgcgauggcuguuacccuugaggacggcgccgaaccuccagugcugacaacucacuugaaaaagguagagaaccauaucacggaagcacagagauucagccacuuaccgaaaagguccgccguggauauugaguuugucgagcugucuuacucagugcgggaagggcccuguuggcgcaagcgaggauauaaaacccuacucaagugccugaguggcaaguucugucguagagagcuuauagguaucauggggccuagcggagcuggcaaauccacauuuaugaauauucuggcaggcuacagggaaucugggaugaagggacaaaucuugguuaacggucggccacgcgagcucagaacuuucaggaaaaugucgugcuauauuaugcaggacgauaugcugcugccccaucucaccguguuagaggccaugauggucucagcuaaucugaagcucagcgaaaaacaggaggugaagaaggaauugguaacagagauccugaccgcccuaggccucaugaguuguucccacacucggacagcgcugcuuucugggggacagcgcaaacgacuggcaauagccuuggaacucguuaacaauccuccagugauguuuuucgacgagcccaccagcggccuggauuccgcuucaugcuuucaagucgugaguuuaaugaaaagccuggcccagggugggagaacgaucauuuguacuauccaucagccuucugcaaaacucuucgagauguuugacaagcucuacauucugucccagggacaaugcaucuucaaaggcguggucaccaacuugauaccauaucuaaagggccuggggcuccacuguccgacauaccacaaucccgcugauuuuauuaucgaaguugccucaggagaguauggugaccugaacccuaugcuuuucagggcggugcagaauggccugugcgccauggcagagaaaaagagcaguccagaaaagaacgaaguacccgcuccuuguccacccugcccgccugagguggaucccauugagucucauacuuuugccaccuccacauugacccaguucugcauccucuucaaacggacguuucugagcaucuuacgugacacuguccugacacaccuacgcuucaugucgcaugugguuauuggggugcucauaggacugcuuuacuugcacaucggcgaugacgcuucuaaggucuuuaauaacaccgguugucuguucuuuuccaugcuuuuccugauguuugccgcacuuaugccaacugugcugacauucccuuuggaaauggccguauuuaugagagagcaccucaauuacugguauucacugaaggcuuacuauuuagcgaagaccauggcagauguucccuuccagguggucugcccaguggucuacuguaguauuguguauuggaugacggggcaacccgccgaaaccagcagguuucugcuauucuccgcucucgccacagcaacugcccugguugcucagucucuuggcuugcugaucggagccgcaagcaacucacuccagguggcgaccuuuguaggcccugucacagcuauaccagugcuguuauucaguggguucuuuguuuccuucaaaacuauuccgaccuaccugcaauggagcucuuaucuuucauacgugcgguacggauuugagggugucaucuugacaaucuauggcauggaacgaggggaccuuaccugccuggaggagcgcugucccuucagagaaccucagaguauucuaagggcccuggacguggaggaugcaaagcucuacauggacuuucugguacuuggaaucuucuuuuuggcccugcgguuacucgcuuaucuggugcuucgcuacagaguuaagagcgaaagguga

SEQ ID NO: 52299 - RNA, 1956 nt, Artificial Sequence
  derived and/or modified sequence opt3 from ABCG5__Homo_sapiens__NP_071881
augggcgaccugagcucccucacccccgggggaucuaugggucuucaggugaacagaggcucacaaaguagccuggagggggccccugcuacagcaccagaaccgcacuccuugggaaucuuacaugccucuuacucggucucacacaggguucggcccuggugggauauuacuagcugccgccagcaguggacgcgacagauacugaaggacgugagucuauauguagaguccggccaaaucauguguauucucgguucuagcggguccggaaaaaccacacugcuugaugcgaugucaggccgucugggcagagcugggacuuucuugggagaaguguacgucaaugguagggcccuccggcgcgagcaguuucaggacugcuucaguuaugugcugcagagcgauacccugcucucuuccuuaacaguuagagaaacccugcauuacacugcacuuuuggccaucaggcggggcaacccugggucauuucaaaagaaaguggaggcugucauggcagagcugagccuaagucacguggccgaccgccucauuggaaauuauucucugggcgguaucuccacaggggaacgaagaaggguaagcauagcugcccagcuucugcaggauccaaagguuauguuguucgacgagcccaccacgggacucgauuguaugacugcgaaccagaucgugguccuguuaguggaacuggcacggcguaaucgcauugugguccucaccauccaucaaccuagaucggagcuuuuucagcuguucgacaaaauugccaucuugucuuuuggcgagcuaauauucugcggcacaccagcugaaaugcuggacuuuuucaacgauuguggguaccccugcccugagcacuccaauccauuugauuucuauauggaccucacuucaguugacacccagaguaaggaaagggagauugaaacaagcaagcgggugcaaaugaucgaguccgccuacaaaaagucugcaauuugucacaaaacccugaagaacaucgagcgaaugaaacaucuuaagacgcugccgaugguacccuuuaagacuaaagauagcccuggaguguucucaaaguuggguguccuccugcgcagagugacaaggaauuuaguucggaacaaacuggcugugaucacccgccuacuccagaaucugauuaugggccuuuucuugcuguuuuucguccucagagugaggaguaacguacugaagggggccauacaggaccguguuggacuucuguaccaguuugugggcgcgacuccauauacagguauguugaaugccgucaaccucuuccccgugcugcgggcagucuccgaucaagaaagccaggacggguuauaccagaaauggcagaugaugcuggcuuaugcccuacacgugcucccuuuuucuguuguggcuaccaugaucuucucaaguguaugcuacuggacgcugggccuucauccagaggucgcccgauuuggauauuucagcgcagccuugcuggcuccccaccucauuggcgaauuucugaccuuagugcugcuugggaucguucaaaauccgaacauagugaacuccgucguggcguugcucucuauugcaggaguacugguggguucgggcuuccuaagaaauauccaggagaugccuauccccuuuaagauuaucagcuacuucacauuucagaaauauuguuccgaaauucugguugucaacgaguucuacgggcucaauuucacuugcggaucaaguaacgugucugugaccacaaauccaaugugugccuuuacucagggcauacaauucaucgagaagaccugcccuggugcuacaagcagguuuaccaugaacuuccugauucuuuacuccuuuauccccgccuuggucauccuggggauuguuguguucaagauacgcgaucacuuaaucucacgguga

SEQ ID NO: 52300 - RNA, 2022 nt, Artificial Sequence
  derived and/or modified sequence opt3 from ABCG8__Homo_sapiens__NP_071882
auggccggcaaggcugcagaggaaagagggcugcccaaaggagccaccccucaggacacaagcggucuccaagauaggcuuuucuccucugagucagacaacagucuguacuuuacuuauagcggccagccaaauacguuggaagugcgggauuuaaacuaccaggucgaccuggcgucccagguuccgugguucgagcaacuagcucaguuuaagaugcccuggaccucuccuucgugccaaaauucaugugaacucgggauccagaaccugagcuucaaagugcgcaguggacagaugcuugccauuauaggcuccucugguugcgggcgagcaagccuguuggauguaaucacaggacguggccacggcgggaagauuaaauccggacagaucuggauuaauggucagccaucaaguccccagcucgugagaaagugugucgcccaugugaggcaacacaaccagcugcugccuaaucucacuguucgggagaccuuagcuuuuaucgcacagaugcgccugccaagaacauucagccaagcccagagggacaagcggguggaggaugucauagcugaacuucgcuugcgacagugcgccgacaccagagugggcaacauguauguaagggggcugucuggaggcgagcggcgucgcguuuccaucggugugcagcuacucuggaaucccgggauucugauccuugaugaaccuacuucaggacuggacagcuuuacagcgcauaacuuggucaaaacccucaguagacuggcaaagggcaauagguuagugcugauuucucuccaccaaccacgguccgauaucuuccgacuuuuugaccugguguugcuaaugacgagcggcacuccgauauaccugggggccgcucagcauaugguccaguauuucaccgccauuggauaccccuguccucgcuauucgaacccagcagauuuuuacguugaccucacaucuaucgacagaaggucccgggagcaggagcuggcuacucgcgaaaaagcccaaucacuugcggcccuguucuuggagaaggugagagaucucgacgauuuucuguggaaagcagaaaccaaggacuuagaugaggacacaugcguagaaaguagcgugacgccccuggauaccaauugucuaccuuccccaacuaagaugcccggugcuguccagcaguucacaacccucauuaggcgucagaucucuaacgacuuccgggaucugccgacucuuuugauccacggcgccgaggcuugccugaugagcaugacaauuggguuucucuacuucggacacggcucaauacaacugaguuuuauggacaccgccgcacuucuguucaugaucggugccuugauuccuuuuaaugugauccucgauguuauauccaaauguuauagcgagcgagcuaugcuguacuaugaauuagaggacgggcuguacacgaccggccccuauuucuuugcgaagauucuaggagaacucccagagcauugcgcauacaucaucauuuauggcaugccuacauacuggcuggccaaccuuagacccggguugcagccauuccugcuccacuuucuguuaguguggcuggucguguucuguugcaggaucauggcucuugccgcagccgcuuugcuccccacuuuucauauggccucuuucuuuucaaacgcacuguacaauaguuucuaucuagcgggagguuucaugauuaaccugagcucccucuggaccguaccugcuuggauaucuaaaguuucguuucugcgcuggugcuucgaaggccuuaugaagauccaguuuagccggagaacauacaaaaugccauuggggaaucugacuauugccguguccggagacaagaucuuaucagucauggagcucgauaguuauccgcuguacgcaaucuaucuuauugugauaggccugucugguggguucauggucuuguacuaugugagccucagguuuaucaaacagaagcccucccaagacugguga

SEQ ID NO: 52301 - RNA, 1089 nt, Artificial Sequence
  derived and/or modified sequence opt3 from ABHD12B__Homo_sapiens__NP_001193602
auggacgcccaggauugccaagcugcagccagccccgagccuccaggcccgcccgcgagauccuguguggcugccuggugggacauggucgauaggaaccugcgguacuucccucacucuugcucaaugcucgggcgcaagaucgcagcccuuuaugacaguuuuaccagcaaaucccugaaggaacauguuuucuugccauuaauugauaugcugauauacuuuaauuucuuuaaagcucccuuccuaguggaccucaagaaaccugagcugaagaucccacacacaguaaacuuuuaucuucgaguggaacccggagucaugcuggguauuuggcauacugugccuucuugucguggcgaggaugcaaaggggaaagacugcuguugguacgaagccgcuuugagagauggaaauccaaucauuguuuaucuccacggcucggccgagcauagggcggcaucacaccggcugaagcuggugaaaguccucagcgacgguggguuccacguguuaaguguagauuaccgcggauuuggcgacuccacgggcaagccgaccgaggaagggcugacaacugaugccaucugcguuuaugaguggaccaaagcuagaucuggaauaacacccgugugucuuuggggucauagcuugggcaccggggucgccacuaacgcagcuaaggugcuggaagagaagggaugcccuguggacgccaucguccuagaggcgccauucacaaauauguggguugccuccauuaacuacccccuccugaaaaucuacaggaauauuccuggcuuucuucggacccugauggacgcauugcgcaaggauaaaaucauauucccaaacgacgaaaaugugaaguuucucucaaguccccuguuaauucugcacggugaggaugaccgaacgguaccgcucgaauaugggaaaaagcuguacgagaucgcuagaaacgccuauaggaauaaagaacgggugaagauggucauuuucccucccggauuccagcauaaccuuuuguguaagagcccaacucuacugaucaccgugcgugauuuucucucuaaacagugguccuga

SEQ ID NO: 52302 - RNA, 1197 nt, Artificial Sequence
  derived and/or modified sequence opt3 from ABHD12__Homo_sapiens__NP_001035937
augagaaagaggaccgagcccguggcccuggaacacgagcggugcgcugcagccggcagcuccucuucagggagugcggcugccgcacucgacgccgauugucgccuuaaacagaaccugcgauugacaggaccugcugcagccgaaccacguugcgcugccgacgcggguaugaagagagcauuaggcaggcggaaaggggucuggcugcgccuaagaaagauccucuucuguguucugggacuuuacauugccauaccguuucugaucaaauugugccccggcauucaagcuaagcucaucuuccugaauuuugugaggguaccuuauuucauugaucugaagaaaccacaggaccagggucucaaccauacuuguaauuacuauuuacagcccgaggaagaugugacgaucggggucuggcacaccgugccugccguuugguggaagaacgcacaaggaaaagaccagaugugguacgaggaugcucuggccagcucccauccaauaauccuuuauuugcacggcaaugcgggcacacgcgggggagaccaucggguggagcuguacaagguccuaucuucgcucgguuaucacgugguaacuuuugauuaccgaggcuggggagacucaguugggacccccagcgaaagaggcaugacauacgaugcccugcacguguucgacuggauuaaagcaaggaguggugauaacccugucuauaucugggggcauucccuuggaaccggcguggcuacuaaucuggugcggcguuugugcgagcgcgaaacaccaccggacgcccucauucuggagucucccuuuaccaacaucagagaggaagcuaagagccacccuuucuccgucauauacagguauuuuccaggcuucgacugguuuuucuuagaucccauuacgucaagugggaucaaguuugccaaugacgagaacguuaaacauauuagcuguccucugcucauccuucacgcagaagaugacccagugguacccuuccagcugggacggaaguuguacucuaucgccgcuccggcgcgauccuuccgcgauuuuaaagugcaguucgucccuuuucacucagaccuagguuauagacauaaguacauuuauaaaagccccgagcugccaaggauacuccgggaguuccugggcaagagugaaccugagcaccaacauuga

SEQ ID NO: 52303 - RNA, 1578 nt, Artificial Sequence
  derived and/or modified sequence opt3 from ABHD16A__Homo_sapiens__NP_001170986
augcccccuccagcccuguuccucagcucccuuuacccgagacuggaguuucagaacgacuucuauaggucuugcauccggcgcucaaguccccaaccuccacccaauuuggcuuggcgaccugaaaguuuauacuccggcgagcuggcagggggagguuaucuaucucucucgaagguggucccauuuucacacuacgccggcacccugcuucuguugcucgcggggguugcuugucugcguggaauuggcagauggacaaacccccaguauaggcaguucauaacuauccuggaagccacgcaucggaaucagagcagugagaacaaacgccaacucgcaaauuacaacuuugauuucagauccuggccuguggacuuucacugggaagaaccaucuagcaggaaggagucccggggugggccgucacgccgaggaguagccuuacugagacccgaaccucuucauaggggcaccgcugauacauugcugaaucgggugaaaaagcuaccaugccagauuacuagcuaucucgucgcacacacccugggccgucgcaugcuuuaccccgggagcguguaccuguugcagaaagcccucaugccuguucuguuacagggacaagcuagacugguggaggaauguaacgguaggcgggccaagcuccuugcgugcgacggcaaugagaucgauacaauguucgucgaccgacgcgggaccgcagagccacagggacagaagcuggugauuuguugcgaaggcaacgccgguuuuuaugagguaggguguguuucuacucccuuggaagcuggauacuccgugcuaggcuggaaucauccgggcuucgccgggucaacaggagucccuuuuccccagaacgaggcaaaugcuauggauguggugguccaauucgccauccacagacuggguuuucagccacaggacauaaucauuuaugcguggagcaucggcggguucaccgccacgugggcagcuaugaguuacccugauguuucugccaugauucucgacgcuuccuucgaugaccuggugccccuugcccugaaaguaaugccagauagcuggaggggauuggugacucggaccguccgccaacaccucaaccugaauaacgcagaacaguuaugcagauaucagggccccgugcugcuaaucaggcguacaaaggacgagauaauuacuaccacaguuccugaggacaucaugucgaaccgggguaaugaucuccugcuuaaauugcugcagcaucgauacccaagagugauggccgaagaggggcucagggucgugcgccaauggcuggaggcuucuucccagcuugaggaagcgucaauuuauagucggugggagguagaggaagacuggugucugagcguuuugagauccuaccaggcagagcacggcccggauuuucccuggucugugggagaagacaugagcgccgauggcaggcgccagcucgcucuguucuuagcccgaaagcaucugcacaacuuugaggcaacccacugcacgccucuaccagcccaaaauuuccagaugcccuggcaucucuga

SEQ ID NO: 52304 - RNA, 867 nt, Artificial Sequence
  derived and/or modified sequence opt3 from ABHD17B__Homo_sapiens__NP_001020951
augaacaaucugagcuucuccgagcucugcugucuguuuugcugucccccuugcccaggcaagaucgccucuaaacuugcuuucuugccgcccgacccuaccuacacauuaaugugugaugaaucagggaguagauggacucugcaccuaagcgagagggcagacuggcaguauuccucucgggaaaaggaugccauugagugcuuuaugacgcgcaccucgaaaggaaaccgaauagcguguauguucgugcguugcucaccaaaugcuaaguacacacuccuguuuagccaugguaacgccgucgaccuuggccaaaugaguuccuucuauaucgggcugggaucuagaauuaauuguaacaucuuuagcuacgauuauuccggcuacggugcaucaagugggaaacccacugaaaagaauuuguaugccgacauugaggcugcauggcucgcccugaggacccgguacggaauccgcccugagaacguuauaaucuacggccagagcauuggcacagugccaucuguagaucuggcugccagauaugaauccgcggcagugauccuccacucacccuuaaccagcgggaugagggucgccuucccugacacuaagaaaacauacugcuuugaugcuuucccaaauauugacaagaucaguaaaauaaccucuccggugcugauuauccauggaacggaggaugaaguuauugacuuuucccacggucuugccuuguucgagcggugucagcgccccguggagccucugugggucgaaggcgcagggcauaacgauguggagcuauauggacaguaccucgaacgacugaagcaauuuguaagccaggagcuuguuaaucuguga

SEQ ID NO: 52305 - RNA, 1278 nt, Artificial Sequence
  derived and/or modified sequence opt3 from ABHD2__Homo_sapiens__XP_005254890
augaacgccaugcuggagacccccgaacucccugcuguguucgacggcgucaaacuugcagccguugcggcugugcuguacguaaucgugagaugcuugaauuuaaagagcccaacagccccgcccgaucuguauuuucaggacuccgggcuaucuagguuccuccugaagucauguccucuucugacuaaagaguacauuccacccuugauauggggaaagaguggucacauccaaacggcacucuauggcaaaauggggcggguccgcagcccucauccauacggacaccgaaaguuuauuaccauguccgauggcgccacaucuacuuucgaccuguuugaaccccuggcugagcauugcgugggugaugacaucaccaugguuauuuguccugggaucgcaaaccacucggaaaagcaguauauacguacauucguggauuacgcccagaaaaauggauauagaugcgcuguccucaaccauuuaggcgcccugccaaauaucgagcuuaccucaccgaggauguuuacuuacggcuguacaugggaguucggggcgauggugaacuacauuaagaaaaccuaucccuugacgcagcugguaguugugggauuuagccuagguggcaauaucgucugcaaguaccucggggaaacucaagcaaaccaggagaaagugcuguguugcgugagugucugucagggauauuccgcccuucgggcucaggaaaccuucaugcaaugggaccagugccgcagauuuuacaauuuccugauggccgauaacaugaagaagauuaucuugucucacaggcaggcacucuuuggcgaccacguuaaaaagccucagagccuggaggauacagacuuaucccggcuguauacugcuaccucacucaugcaaauagaugacaaugugaugcgcaaauuccaugguuacaacagucuuaaggaguauuacgaagaggaaagcuguaugcgauaccugcacagaauuuauguaccauugaugcuagugaaugccgcggacgauccccugguccaugagucucuccugacaaucccuaaaucccuuucagaaaagagggagaacgugauguucguucugccauugcacgggggacaccucggcuuuuucgagggcagcgugcuguuucccgaaccguuaaccuggauggacaaacuggucguggaguacgccaaugcaauuugccagugggaacggaacaagcuacagugcagugauacggagcaaguagaagcugaccucgaguga

SEQ ID NO: 52306 - RNA, 1050 nt, Artificial Sequence
  derived and/or modified sequence opt3 from ABHD5__Homo_sapiens__NP_057090
auggccgcugaggaagaggaaguggacagcgcagauaccggcgagagauccggguggcugacaggauggcuccccacuuggugcccuacgucuaucucacaccuuaaggaagccgaggagaaaaugcugaagugugucccaugcaccuacaaaaaggaaccgguuaggauuaguaacgguaauaaaauauggacauugaaguucagccauaacaucuccaauaagacucccuuagugcugcuacacggcuuugggggaggccucggucugugggcgcuuaacuucggggaccuguguaccaaucggccuguauaugcuuuugauuugcucggauucggccgaucuucgcgcccacguuuugacucagaugccgaggaaguggagaaccaguucgucgagagcauugaagaguggagaugcgcacugggccuggacaaaaugauccucuuagggcauaaucugggagguuuucuugccgcugcauacaguuugaaguaucccuccagggugaaccaccugauucuaguugaaccuuggggcuucccagagcggcccgaucucgccgaccaagaucgcccuaucccaguguggauaagagcucugggggccgcgcuuacaccguuuaauccccuggcaggauugaggaucgccggcccuuucggucucucucugguccagcgguuacgcccagacuuuaaacgaaaguacagcuccauguucgaagaugacaccgugacugaguauauuuaccauuguaacguacagacacccucaggggagaccgcuuuuaaaaauaugacgaucccuuauggaugggccaagagaccaaugcugcagaggauuggcaagaugcaccccgauaucccgguuagugugauauucggcgcacggagcugcauugacgggaacucuggaacuuccauccaaucacuccguccucacagcuacgucaaaaccauugcuauccuuggugccggccauuacguguaugcggaccagcccgaagaguucaaucagaaggugaaagaaaucugugauacagucgacuga

SEQ ID NO: 52307 - RNA, 1014 nt, Artificial Sequence
  derived and/or modified sequence opt3 from ABHD6__Homo_sapiens__NP_065727
auggaccuggauguggucaacauguucguuaucgccggcgggacccucgcuauucccauacuugcauuuguggccagcuuccuguuguggccuuccgcguuaaucagaauuuacuauugguacuggaggcggacacugggaaugcagguacgcuaugugcaccaugaggacuaccaauuuugcuauucuuuccgaggucguccaggccacaagccgucaauccuaaugcuccauggguuuagugcucacaaagauauguggcugagcgucgugaaguuccuucccaaaaaucugcauuugguuuguguggacaugccuggacacgaaggcacuacgagauccucucucgaugaccugucgauugauggucaggucaagaggauccaccaguuuguggagugccugaaacucaacaagaagccauuccauuuaguagggaccucaaugggaggccagguugccggcguguacgcagccuauuaccccagcgacgucaguucccugugucuugugugcccugcuggguugcaauacucuacagauaaucaguuugugcagcggcugaaagaacuacagggaagcgcagccgucgagaagauaccacucauccccuccacuccugaagagaugucagagaugcugcaacuuuguaguuauguucgcuucaaagugccacagcagauucugcaggguuugguagacgugagaaucccgcacaacaauuuuuacaggaaacucuuccuggaaauugucagcgagaagucucgguauuccuuacaucaaaacauggauaagaucaaggugcccacccagauaauuuggggcaaacaggaccaaguucuggaugugucaggggcugacaugcucgccaagagcaucgcgaauugccaggucgaacuucuggagaacuguggacacagugugguaauggagcgcccucgaaaaacagcaaaguugauuaucgacuuucuagccucuguucacaauaccgauaacaauaaaaagcuggacuga

SEQ ID NO: 52308 - RNA, 1446 nt, Artificial Sequence
  derived and/or modified sequence opt3 from ABI1__Homo_sapiens__NP_001012768
auggccgagcugcagaugcuccuugaagaggaaauccccagcggcaagagagcucugauugaguccuaccaaaacuugaccaggguggcagacuauugcgaaaauaacuacauacaggccacagauaaacggaaggcguuagaggagacuaaggcuuauacgacccagucucuggccucagucgcauaccagaucaaugcccuagcuaacaauguucuccaacugcuugacauucaggcaagucagcugcgccgaauggaaagcuccaucaaccacauuucucagacaguggauauccauaaagagaaaguagcccguagagaaauagggaucuugacuaccaauaagaacacaucgaggacccacaagauuaucgcuccugccaauauggagcggccagugcgcuauauuagaaaaccgaucgacuacacuguccucgaugacgugggacaugguguuaaguggcugaaagcgaagcacggcaacaaucaacccgcaaggacagggacccugucacggacgaacccuccaacucagaaacccccuagcccacccaugaguggacgcggcacccucggucgaaauacaccuuauaagacuuuagagccagugaagccgcccaccgucccuaacgauuacaugacauccccagccagacuggggucucagcauagccccggaaggaccgcuucccuuaaucagcggccucguacgcacucaggcaguagcggcgggucuggaucccgcgaaaacucagguagcaguucuauaggcauuccaaucgccgugcccacuccguccccucccacaauugggccagcagcuccuggaagcgcccccggcucgcaauacgguaccaugacuagacagaucucuaggcacaacuccacaaccucaaguacgagcuccgggggauaucggcgaaccccaucuguaacagcgcaguucagcgcccaaccccauguuaauggcggcccuuuguacucacagaacaguaucuccauugcaccaccgcccccuccaaugccccagcugacuccucagauaccacuaaccggguuuguggcucgcguccaagagaauaucgccgacagccccacaccgccuccacccccucccccagaugacauuccuauguucgaugacucucccccaccgccucccccacccccuguggauuaugaagacgaggaagcugccgugguccaguacaacgacccauaugcagauggagaccccgccugggcuccuaaaaauuacaucgagaagguuguggcgauauaugauuacacuaaagacaaggaugacgagcucucauuuauggaaggugcaauuaucuacguaaucaaaaagaacgaugacggcugguaugaggggguguguaauagagucaccggacuguucccgggcaacuacguggaaaguauuaugcacuauacagauuga

SEQ ID NO: 52309 - RNA, 1542 nt, Artificial Sequence
  derived and/or modified sequence opt3 from ABI2__Homo_sapiens__NP_001269854
auggccgagcugcagaugcuccuugaagaggaaauccccggcgggagaagggcucuguucgacagcuacaccaacuuggagcggguggcagauuauugcgaaaauaacuacauucaauccgccgacaagcagcgcgcguuagaggagacaaaggcuuauacuacgcagucucuggccucagucgcauaccuaauaaauacccucgccaacaauguucugcagaugcuugauauccaagcuagucagcugcgacguauggaaagcuccauuaaccacaucucucagacaguggacauucauaaagagaaaguagcaagaagggaaaucggaauauugacuaccaauaagaacacaucgcggacccacaaaaucauugccccugcuaaucucgagcgcccagugagauauaucaggaagccgauugauuacacuauccuggacgauauaggucauggcgucaaguggcugcuccgguuuaaagugucaacacagaacaugaagaugggaggguuaccccgcaccacgccuccaacucaaaaacccccuagcccacccaugaguggcaaggguacccuggggcgacacuccccuuauagaacacuugagccaguuaggccgcccguggucccuaaugacuacgugccaucucccacucggaacauggccccuagccagcaguccccaguacguaccgcgucaguuaaucagcgcaacagaacauacaguagcucuggauccucaggcggcagccaucccaguucuagguccagcucgcgggaaaauucuggguccggaucagugggugucccgauugcagugccuacccccaguccaccuagcguguuccccgccccagcuggcuccgccgggacgcccccuuugccagcaacuucugcuagcgccccggcgccccuggucccugccacaguuccaucaaguaccgcacccgaugcugccgcuggaggcgcccaaacucuagcagacgguuuuacauccccuaccccacccgugguaagcucuacgccgccuaccgggcacccagugcaguucuauucaaugaaccgacccgccagucgccacacaccucccacuaucggaggcagccucccauacagaaggccucccuccauuaccucucagacaucgcugcaaaaccagaugaauggcgggccauuuuauagccagaacccggucuccgauacuccucccccacccccuccaguggaggaacccguuuucgacgagucaccuccgccacccccuccacccgaagauuacgaggaggaagaggcugcgguggucgaauauagugacccuuacgcagaggaagacccgcccugggccccacggucuuaucuugagaaagugguagcuaucuacgauuacaccaaggacaaggaggaugaacugagcuuucaggagggagccaucauuuauguuaucaaaaagaaugacgaugguugguacgaaggcgugaugaacggggucacaggauuguucccuggcaauuauguggaguccauaaugcauuacucagaauga

SEQ ID NO: 52310 - RNA, 3228 nt, Artificial Sequence
  derived and/or modified sequence opt3 from ABI3BP__Homo_sapiens__NP_056244
augagaggcgggaagugcaacaugcugagcucccucggaugucuucuguugugcgguucuaucaccuuagcccugggcaaugcucagaaacuacccaaggggaaaaggccuaaccucaaggugcacauuaauacaacuucagacaguauacugcuuaaauuccugcggccaagcccgaacgucaaguuggagggacuccugcugggcuacgguuccaauguuucucccaaccaauauuuuccucucccagcagaagggaaguucacggaggccaucguggaugcggaacccaaauacuuaauuguagugcgcccugcuccacccccuucgcagaagaaaucauguagcggaaagacccgaagucguaaaccacugcagcuugucgugggcacauugacuccguccucuguuuuucugagcuggggcuuccuaaucaauccccaucacgacuggacccucccuucccauugcccaaacgauagauuuuauacaauuagguaccgggagaaggacaaggagaaaaaguggaucuuccagauaugucccgccaccgagacuaucguggagaaucugaaaccuaacacagucuaugaauuuggggugaaggauaauguagagggagguauuuggucaaaaaucuucaaccacaagaccguugugggcaguaaaaaggucaaugggaagauucaaagcacguacgaccaggaucauacugugccagcauaugugccccgcaaacuuaucccgauaaccauuaucaagcaggucauucagaacguuacacacaaagacucugccaaguccccugaaaaagcuccccugggaggcgugaucuugguacaccucaucauuccaggucugaaugagacuaccgugaaguuaccugcaucacugauguuugagauaagcgaugcccucaagacacaacuugcuaaaaacgaaacccuggccuugcccgcggagaguaagacgccagaagucgagaaaaucucugcaagacccacuacagugaccccugaaacuguuccaagguccacaaagccgaccacgagcucggcccuagacgugucugagaccacacuggcuuccucagagaaacccuggauugucccuacugccaagaucagugaagauagcaaggugcuccagccacagaccgcaacauacgacguauucuccucucccacuaccagcgaugagccugaaauaucagacaguuacacagcuaccuccgaccggauucuggauagcaucccacccaaaacuucucgcacgcuugagcagccgcgagccacacuggcgccuucagaaaccccauuuguuccccaaaaguuggagaucuucacuucgccugagaugcagcccaccacaccagccccucagcaaaccacuagcauucccuccacaccaaaaagaaggccgcggccuaagcccccacguacgaaacccgaacgcaccacuucugcagggacaaucaccccuaagauuaguaagagcccagagcccacauggacuaccccugcuccgggaaaaacgcaguuuauaucccucaagccaaaaaucccccugucaccugaagugacccauacaaagccagcccccaaacagacuccuagagcuccgcccaagccaaaaaccaguccuaggccccggauuccacagacacaaccuguccccaaggugccacagcgagucacugccaagccgaaaaccucuccuagccccgagguguccuauacgacaccagcacccaaggacguuuuacugccucacaaaccauaccccgaagugucacagagcgagccugccccgcuagagacccgcggcaucccauucauccccaugauuucuccuucccccagucaggaagaacuccaaacuacacuggaagagaccgaucagagcacucaggagccauucaccacaaagauaccuagaacgaccgaacuugcuaaaacuacacaggcgccccauagguuuuauaccacaguacggccacgcacuucugacaagccucacaucagaccgggcgucaagcaagcacccaggccauccggggccgaucguaacgugucaguugacaguacccacccuacgaaaaagcccggaacacggcgaccaccuuugcccccgagaccaacccauccuaggcgcaaaccccugccacccaauaacgugacugguaagccuggcagcgcugggauuaucucguccggaccgauuaccacacccccacuccggucuacuccuagacccaccggcacaccucuggagaggaucgaaacggauauaaaacagccaaccguccccgccagcggugaggaacuugagaauaucacugacuucucaaguuccccuacacgcgagaccgauccacuggggaagccccgauuuaagggcccgcacgugcgguacauucagaaaccugacaacucuccaugcagcaucacugauuccguaaagcguuuccccaaagaagaggcaacagaaggaaaugccaccucaccuccacagaaucccccgacgaacuugacugugguuaccgucgagggcuguccuagcuuugugauucucgacugggaaaagccccugaacgacacagugaccgaguaugaggucaucaguagagaaaaugggucuuucuccgguaaaaacaagagcauacaaaugacuaaucagacauuuucgaccguugagaacuuaaagccaaauacaucauacgaguuccaggugaaaccuaagaacccccugggagaaggcccagugucuaauacuguagcuuuuaguaccgaauccgccgaucccagggucagcgagccugugucugcagggcgcgacgcgauuuggacggagcggccauucaacagcgauuccuauucagaaugcaaaggaaagcaauacguuaaaagaacaugguacaagaaauuugugggcguccagcuauguaacagucucagguauaagaucuaccugagcgacucucuuaccgguaaguucuauaauauuggggaucagcgaggccauggagaggaccacugccaguuuguggauuccuucuuggacggccgcacugggcaacagcugaccucagaucagcucccgaucaaagaaggauacuuccgggcuguuagacaggagcccgugcaauuuggugagauaggcgggcauacacagaucaacuauguacagugguacgaauguggaacuaccauuccuggcaagugguga

SEQ ID NO: 52311 - RNA, 1083 nt, Artificial Sequence
  derived and/or modified sequence opt3 from ABI3__Homo_sapiens__NP_001128658
auggccgagcugcagcaacuccaggaguucgaaauccccaccggcagagaagcucuuagggggaaccacagcgcacuguugcggguggccgacuacugcgaggauaauuauguccaggcgacagacaagcgcaaagccuuagaagagacuauggccuuuacgacccaggcacuggccuccguugcuuaccaagugggaaaccuagcaggucauacacuccgaaugcuggaucuucagggcgccgcucugcgucagguagaggccagaauggugaauaugcacauggaaaaggucgcgaggcgggagauugggacuuuggcaaccgugcagcgccucccuccaggacaaaaaguuauagccccggaaaaccugcccccucugacaccauauuguagaaggccccucaauuucggcugcuuagacgauaucggucaugggauuaaggaccugucuacccagcuuucacggacuggaacauugagucgcaaaagcaucaaggcuccugccaccccagcauccgcuacgcugggccgacccccuaggauuccagagccggugcaccuacccgucgugccugauggcagacucucugccgcgucgucagccagcagucuggcauccgcugggucugccgagggaguagguggcgcuccaacucccaaggggcaggccgcaccuccagcucccccgcuuccuagcucccuggaucccccaccucccccagcugcgguugaaguguuucagcggcccccuaccuuggaggaacucucaccaccgcccccugacgaggaacugccauuaccccuggaccucccuccacccccgccucuugauggagacgagcugggcuugccacccccucccccagguuucgggccugaugagcccaguugggucccagcaagcuaccuagaaaaaguggugacacuguauccguacacuucucaaaaggacaacgagcucuccuuuucagaaggaaccgucaucuguguuacacgucgcuauagcgacggcuggugcgagggcgugaguucugaagggaccggauucuuuccugguaauuacguagagcccuccuguuga

SEQ ID NO: 52312 - RNA, 3393 nt, Artificial Sequence
  derived and/or modified sequence opt3 from ABL1__Homo_sapiens__NP_005148
augcuggagaucugccucaaacuugugggcuguaagagcaagaaagggcuguccucuucaaguagcugcuacuuggaagaggccuuacagagacccgucgcuuccgacuucgaaccucaaggacugucugaggcagccagguggaacucgaaggaaaaucuacucgcggguccaucagagaacgauccgaaucuguuuguugcucuuuaugacuucguggccagcggcgauaacacccugaguauuacaaaaggggagaaguugcggguacucggauacaaucacaacggcgaauggugugaggcacagacuaagaauggucaggggugggugcccuccaacuauauaacgccugucaauucucuggaaaaacauagcugguaccacggaccagugucccgcaacgccgcugaguaucugcucucaaguggcaucaauggcagcuuuuuaguucgagagucugaauccucacccgggcagcguagcauuagucugagauacgagggaaggguguaucauuaccggaucaacaccgcaucugacgguaaacuuuacgucuccagcgaaucgcgcuucaauacauuggccgagcuggugcaccaucacucuacuguagcugauggccuaauuaccacacuccacuauccugccccaaagagaaacaagcccaccguuuacgggguguccccuaauuaugacaaaugggaaauggagaggacugauaucacaaugaagcauaagcugggaggcggucaauacggggaggucuaugaaggaguguggaaaaaguacucacuuaccguggcggucaaaacgcugaaggaggacacuauggaaguugaggaauuuuugaaagaggcagccgugaugaaggagauaaaacacccaaaccucguacagcuguuaggcgugugcacccgggaaccgcccuucuauaucauuacagaguuuaugacuuacggcaaccugcucgauuaccuucgcgaauguaaucgacaggaggucaacgcugugguucuguuguauauggccacccagaucaguagcgcaauggaauaccuagagaagaagaauuucauucauagagaccuggcugccaggaacugccucgugggggagaaucaccuggucaaaguggcggauuuuggacuuucccggcugaugacaggugacaccuauacggcccacgcaggcgcuaaguucccuaucaaauggacugccccagaaucuuuggcuuacaacaaguuuagcauaaaaucagauguaugggccuucgggguucuccugugggagauugcaacauauggaaugagucccuacccuggcaucgacuuaucccaaguguaugaacugcuagagaaggacuaccguauggagcgcccagaagguugucccgagaaggucuacgaacucaugagagccugcuggcaguggaauccgagcgauaggccuucuuuugcugagauucaucaggcguucgaaaccauguuccaggagucaaguaucagcgacgagguggaaaaagagcuggggaagcaaggcguccggggagcaguguccacucuuuugcaggcccccgaacugccaacaaaaacccgaacgucucgcagagcugccgagcacagggauaccacagacguuccugaaaugccccauucgaagggccagggggagagcgauccacucgaccacgagcccgcaguguccccucugcuuccacggaaagaacgcggaccgcccgaggguggccugaacgaagaugagagauugcucccuaaggacaagaaaacuaaucuguuuucagccuuaaucaagaaaaagaaaaagaccgcuccaacacccccuaagaggaguucuagcuuccgugaaauggaugggcaaccagagcggcgaggagccggcgaggaagaggguagagacauuuccaacggggcacuggcguuuacuccccuagauaccgcugacccggccaaaucaccuaagccaagcaauggcgcaggaguacccaacggcgcccucagggaaucugggggauccgguuuccgcaguccucaucuguggaaaaagagcucuacacuuaccuccucacgguuggcuacuggcgaggaggaagggggaggcaguagcucgaaaagauuucugagguccuguucugccagcugcgucccccacggugcaaaggacacggaguggcgcucagugacacucccacgagaucugcagaguaccgggcggcaguucgacuccucuacuuuuggcggacacaaaagcgaaaagccugcuuuaccccguaagagagccggcgagaauagguccgaucagguuacccgcgggacagugaccccaccgccucggcuggucaaaaagaacgaagaggcggccgacgagguguucaaagauauaauggaaucaagccccggaaguucuccacccaaucuuacuccuaagccauugagaaggcaaguaacaguggcucccgcauccggccucccucauaaagaggaagccgguaaggggagcgcucugggaacgccggccgcagcggagccaguuacccccacuucgaaggccggcucaggugcuccuggcgggacaucuaaaggaccagccgaagagagucgaguccgccggcacaagcauuccagcgagucucccggcagagacaaagggaagcuaagcaggcugaaaccugcaccgcccccaccucccgcugccuccgcaggaaaggccggcgguaagccaucacagaguccuagccaggaagcugcgggggaggccgugcucggagcaaaaaccaaggcuacaucucugguggaugccgucaacuccgacgccgcuaaacccucacagccaggcgaaggucuuaagaaaccgguuuugccugcaacucccaagccacaaagugccaagcccagcggcaccccuaucuccccagcgcccgugccuucuacgcugccgucggcuagcucagccuuagcaggggaucagccauccaguaccgccuuuauuccccucaucucuacacgugugagccugcgcaaaacucggcagccucccgagagaauagcuuccggagcaauuaccaagggcguaguccuugacucaacagaagcccuguguuuggcgaucucuaggaacagcgagcagauggcuagucacuccgccgugcucgaggcagggaaaaaucuguauacuuucugcguuagcuacguggauucuauccaacagaugcgaaacaaguuugccuuccgggaagcuauuaauaaacuagagaacaaucugcgcgaacuccagaucugcccagccaccgcaggaucaggcccugcugccacgcaggacuuuuccaagcugcuuaguagcgucaaagagauuucggauauagugcaaagauga

SEQ ID NO: 52313 - RNA, 3195 nt, Artificial Sequence
  derived and/or modified sequence opt3 from ABL2__Homo_sapiens__NP_001129472
auggugcugggcaccguccuccuucccccuaacagcuacgggagagaccaggauacaucccugugcuguuugugcacugaggccucugaaucagcuuuaccagaccugacggaucacuucgcaaguuguguugaggacggauuugaaggugauaagaccggcgggagcuccccggaggcccuacauaggcccuauggaugcgacguggaaccucaagcgcucaaugaggcuauccgguggucuucgaaagagaaccugcuuggcgccacagaaucagauccaaaucuguucguagcauuguacgacuuuguggccagcggugauaacacucucaguauuaccaagggggagaaacugcgcguccugggauauaaucagaacggcgaaugguccgaggugcgaucuaagaauggccagggguggguucccagcaacuacauaacaccugucaauucccucgagaaacacucaugguaucauggaccagugagucguagcgcugcagaauacuuacugucuucccuuaucaacgguucauucuuggugagagagagcgaaaguucucccggccagcuguccauuagccuaagguaugaggggcggguauaccacuaccgcaucaauaccacugccgacggaaagguuuaugugacagcugaaucgagauuuucuacccucgccgagcugguccaucaccacuccacgguggcggauggccuugugacuacccugcauuacccugcaccaaaguguaacaaaccgacagucuaugguguuucacccauucacgacaagugggagauggaaaggacugauaucaccaugaaacauaagcucgggggaggccaauacggcgagguguauguagggguguggaaaaaguacaguuugacagucgccgugaagacccugaaagaagacacgauggagguugaagaguucuuaaaggaggcugccgugaugaaagaaauaaagcacccuaaucugguccagcuccuuggagugugcacucuggagccacccuuuuauaucguaacagaauacaugccuuacgguaacuugcuagacuaucugcgggaguguaaucgcgaagagguuaccgcagugguccuccuguacauggcuacucagauuagcuccgccauggaguaucuugaaaagaagaacuucauccaccgagaucuggcggccagaaacugcuuggugggcgagaaucaugucgugaaaguugcagacuuugggcucucuaggcugaugacaggagauaccuacacggcucacgccggcgcuaaguucccaauuaaguggaccgcccccgagagcuuagcauauaacacauuuucaaucaaaagugacgugugggccuucgguguacugcuaugggaaauagcuacuuacgggauguccccguauccuggcauugaucucagccaggucuacgaccugcuugagaagggauaccggauggaacaacccgagggcuguccaccuaaaguguaugaauugaugcgugcgugcuggaaguggucucccgcagaucgcccaucauuugccgagacccaucaggcuuucgaaacaauguuccacgacaguagcaucuccgaggagguugccgaggaacuggggagagcagccucuucgagcuccgugguccccuaccucccuaggcugccaauucuuccgucaaaaacucggacccugaagaaacagguggaaaauaaagagaacaucgaaggagcucaggaugccacagagaauagugcaucuagcuuggcgcccgguuuuauccgaggcgcucaagccuccucagggagcccugcacucccacgcaagcagagagacaaaucucccuccagucuguuagaggaugccaaggaaaccuguuucacuagggaccggaaaggaggcuuuuucagcucuuuuaugaagaagcgcaacgcuccuacgccacccaaaagauccucaaguuucagggagauggaaaaucagccgcauaagaaauaugagcugacaggucuaccugaacaagaccguauggccaugacccucccacggaacugccagcgaagcaagcugcagcuugagagaacuguaucgaccuccucucagcccgaggaaaauguggauagggcaaacgacauguugccuaaaaagagcgaggaaucagcugcccccagucgcgagcggccaaaggcgaaacugcucccuagaggggccacagcucugcccuuaaggaccccauccggcgaucuggcaauuacugagaaggacccgccuggaguuggcgucgccgggguggcugccgcacccaaaggaaaggagaaaaaugguggcgcgcgccuugggauggccggagugccagaagauggcgaacaacccgguuggccuucuccagcuaaggccgcacccgucuugccuacaacgcacaaccacaaaguuccggugcucauaagcccaacccugaagcauacucccgcugacgugcagcuaaucgggacagauucccagggcaauaaguuuaaacugcucucagagcaccagguaaccagcaguggagacaaggaucgaccucggcgugucaaaccaaagugcgcacccccuccgcccccagugaugagacugcuucaacauccuucuauuuguuccgaccccacagaggaaccaacugccuugaccgccggccagagcacgucggagacccaggaagggggcaaaaaggcugcgcugggagccguuccuaucucagguaaggcagggaggcccgugaugccaccgccucagguccccuuaccaacaucuaguauaucccccgcuaaaauggccaacggaacugccggcaccaagguggcucuccgcaaaacaaagcaagcagccgagaaaauuagcgcggauaagaucucuaaggaagcucugcuugagugcgccgaccuguugagcuccgcacucacugaaccuguuccaaauucacagcugguggauaccggucaccagcuacuggacuacuguaguggcuauguagacugcaucccccagacgcggaacaaauucgccuuuagagaggcugucagcaagcucgagcugucucuucaagaauugcaaguguccucagcagccgcgggggugccuggaacaaacccgguccugaauaacuuacucaguuguguucaggagauuagcgaugugguacagagguga

SEQ ID NO: 52314 - RNA, 2157 nt, Artificial Sequence
  derived and/or modified sequence opt3 from ABLIM1__Homo_sapiens__NP_001003407
augcugaugacccucgagaugacagaacuuacugacccccaccauacgaugggcgauuacaagguggcccacccucaggacccacaucacccgagcgagaaacccgucauccauugccacaaguguggggaaccuugcaaaggagagguucugagagugcaaaccaagcacuuccauauuaaauguuuuacaugcaagguaugugguugcgauuuggcucagggcggguucuuuauaaagaacggagaauauuuauguacucuggacuaccagaggauguauggcacccggugccacgguuguggggaguucguggagggagaagucgugacagcacuaggcaaaaccuaccauccaaauugcuuugccuguacuaucugcaagcgccccuucccuccaggcgaucgaguuacauuuaacgggcgugacugccucugucagcugugcgcgcaacccauguccucuucaccuaaagagaccacguucaguagcaauugugcuggaugcgguagagauauuaagaacggccaggcccuucuggcauuggacaaacaguggcaccucggguguuuuaagugcaaguccuguggaaaagugcugacuggcgaauauaucucuaaggauggugccccauacugcgagaaagacuaucaggggcuguucggagucaagugugaggcuugccaccaauuuauuaccggcaaagugcucgaagcaggcgauaagcauuaccacccgucgugugccaggugcucacggugcaaucagauguucacagagggggaagagauguacuuacagggaagcacuguauggcaucccgacuguaaacagaguaccaagacagaagagaagcugcgcccuaccagaacguccucugagagcaucuauuccaggccagguucaaguauacccggcagcccugggcacacuaucuacgcuaaaguugauaacgaaauucuugacuauaaggacuuggccgcgaucccaaaagugaaggcaauuuacgauaucgagcggcccgaccugauaacauaugaaccguuuuacaccucuggauaugaugacaaacaagagcgccagucccuaggcgaaucaccucgaacucucagccccacaccaagugccgaggguuaccaggaugucagagacaggaugauucaucggucuaccucccaagggagcaucaauucgccuguguacucucgucacuccuauacgcccaccacaucacgcaguccacagcacuuccauagacccggcaacgagccuagcuccggaaggaacucuccacugccguaccggcccgauagccgaccucuuacuccaaccuaugcucaggcccccaagcacuuccaugugccugaccagggcauuaauaucuaccgcaagccacccaucuauaaacaacacgcagcucuggccgcgcagucaaagaguuccgaagauauuauaaaauuuagcaaguucccggccgcacaggcuccugacccaucugagacacccaaaaucgaaacugaucacuggccugggcccccaucauuugccgucguuggaccugacaugaagagaaggaguagcggucgggaggaagacgaugaggaguugcuccgcagaaggcagcugcaagaggaacaguuaaugaagcucaauuccggccuggggcagcuuauucugaaagaagagauggagaaggaaucucgugagcggucgagcuugcuagcuucccgauacgacucacccaucaacagugccucucauauaccaagcuccaaaaccgcaucacugccgggauauggcagaaauggucuccacaggccugugagcacagauuucgcccaguacaacucuuacggggacguauccggcggagugcgcgauuaucaaacccugcccgacggccauaugccagcuaugcggauggauagaggggucaguaugcccaauaugcuugaaccuaagauuuuuccauacgagaugcugauggugacuaacaggggacgcaacaaaaucuugcgagaaguugaccggacgcgucucgagagacaccuggcgcccgagguguucagggaaaucuuugguaugagcauucaggaguucgaucgcuuaccucuguggcggagaaaugacaugaagaagaaagcaaagcuauuuuga

SEQ ID NO: 52315 - RNA, 1938 nt, Artificial Sequence
  derived and/or modified sequence opt3 from ABLIM2__Homo_sapiens__NP_001123555
augagcgccgugucccagccccaagcugcaccuucuccacuggaaaagucaccgaguaccgccauccucugcaacacauguggcaaugucugcaaaggggaaguucuuagagugcaggacaaguacuuccacauuaaauguuuuguaugcaaggcguguggaugcgaucuggcugaggguggcuucuuugugaggcagggggaauauauauguacuuuggacuaccagcgguuauauggaacgcgcugcuucagcugugaucaauuuaucgagggcgaagucguguccgcccuggguaaaaccuaccaucccgacugcuucguuugugcagugugccgacuaccuuuuccacccggggaucgugucacauucaacggaaaggagugcaugugucagaagugcucucucccugugucgguaggcucaagcgcccaccugagucagggccuuagauccugugggggaugcgguacugagauuaaaaauggccaggcucugguugcauuggacaagcauuggcaccucggguguuuuaaaugcaagucuuguggaaaacugcugaacgccgaauauaucagcaaggauggccucccauacugcgaggcugacuaucaugccaaguucgguauuaggugugauuccugcgaaaaauacaucaccgggcggguguuagaggcgggagagaagcacuaccaccccucaugugcacugugcguccgcugcggccaaauguuugccgaaggcgaggaaauguaucuucaggggaguagcauauggcauccugcuuguagacaggccgcaaggacagaggaccggaauaaagaaacccgcacuucuuccgagucaaucauuagcgugccagcuaguucuacauccggaagcccgucgcgagugaucuacgccaaguuggguggcgagauucuggauuauagagaccuagcggcccuccccaaaucuaaggcaaucuacgauauagacaggccugacaugauuuccuauucaccauacaucagucacagcgcuggggaucggcaguccuauggagaaggcgaccaagaugaccguucuuacaaacagugccgcaccagcucacccaguuccacggguagcgucucucuggggagauacacuccuaccucaaggaguccacagcauuauagccggcccgccggcacaguuuccgugggaacuucuucgugucuuagccugucccaacacccgucaccuaccaguguauuccgacaccauuacauucccuauuuucgcggcucugagagcgggagauccacaccaucauugagcgugcucucugauuccaagccucccccaaguaccuaccagcaggcucccaggcacuuccaugucccugacacgggagugaaggauaacaucuaucggaaaccaccgaucuaccgccagcacgccgcaagaaggagcgacggugaagauggcucucuggaccaagauaaucguaagcagaaauccucaugguuaaugcugaagggggacgccgacacucggacaaacagucccgaucucgacacccagagccuuucgcauuccucuggaacugaucgagacccucugcagagaauggcuggcgauagcuuccacucaagguuuccauauaguaaauccgaccccuugccuggucacgggaagaauggccuagaucaacgcaacgcgaaucuggcaccaugcggagccgaccccgaugcuucuuggggcaugcgggaguacaagauuuacccguaugacagccucauaguuacaaacagaaucagggugaaacugccuaaggaugucgaccgcacccgacuugaacggcaucuguccccagaggaguuccaggaaguguuugggaugucaauugaggaguucgaucguuuggcccucuggaaaagaaaugaccugaagaaaaaggcauuacuguuuuga

SEQ ID NO: 52316 - RNA, 1065 nt, Artificial Sequence
  derived and/or modified sequence opt3 from ABO__Homo_sapiens__NP_065202
auggccgaggugcugagaacccucgcuggcaagcccaagugccacgcacuuaggccuaugauccuguucuugauuauguuaguccugguucuauuuggguacggagugcucagcccacggucccugaugccggguucucuugaacgcggcuucuguauggccguacgagagcccgaccaucugcagcgugugucauugccuagaauggucuauccacaacccaaggugcucacaccuugcaggaaagauguucugguggucacuccauggcuggcgcccauagugugggaagggacguuuaacaucgacauucucaaugagcaguuccgguuacagaacaccacaaucggacugacuguauuugcuauuaagaaauacguugccuuccuuaaguuguuucuggaaaccgcagagaagcacuucauggugggccaucgcguccacuauuacguguuuacagaucagccugccgcugugccaagagucacccuagguacugggaggcaacucaguguucuggaggugcgggcauauaaacgcuggcaggacguaagcaugcgaagaauggaaaugaucuccgauuucugugagaggcgguuucuuucugaaguggacuaccuggucugcguggauguugacauggaguuccgugaucaugugggagucgagauauugacaccgcucuuuggcacccugcaccccggcuucuaugggucgucacgcgaagccuucacguacgagagaaggccucagagccaggcuuacaucccaaaggacgaaggagauuuuuauuacuuagguggcuucuuugggggaagugugcaagagguacagcggcugacucgagccugucaccaggcgaugaugguugaccaggcaaauggcauugaagccguguggcaugaugagucccaccucaacaaauaucuucugcgccauaagcccaccaaagucuugucuccugaguaccuaugggaccaacagcugcucgguuggccagcugugcugagaaaacuuagguucacagccguccccaagaaucaccaggcagugcggaacccguga

SEQ ID NO: 52317 - RNA, 1146 nt, Artificial Sequence
  derived and/or modified sequence opt3 from ABRA__Homo_sapiens__NP_631905
auggcccccggcgagaaggaaagcggggagggaccugcuaaauccgcacugagaaagaucaggaccgccacacucgugauuucucuugcgcgggguuggcagcaaugggcuaacgaaaauucaauacgccaggcccaggagccaacuggcuggcugcccgggggaacgcaggacaguccccaagcaccuaaaccaaucaccccgccuacaagccaccagaaggcccaguccgcuccaaaaucucccccucgauugccagaaggccauggugaugggcagucgucagagaaggcaccggaggucagccacauuaagaaaaaggaaguuaguaaaacugugguauccaagaccuacgagcguggaggcgacgugucucauuuaagccacagauaugaaagggaugccggcguccuggagcccgggcaaccugagaacgacaucgaucggauucuacauucccacggaucaccaacacgcagaaggaaaugcgcuaaucucgugagugaacugaccaaggguuggcggguuauggagcaggaggaacccacuuggcgcagcgacucuguggauacagaagacuccggcuacgggggagaggccgaggaacgaccugagcaggauggcguccagguggcgguaguuagaaucaagaggccacuucccucacaagugaaccgguucaccgaaaaacugaauuguaaggcacagcagaaauauagcccggucgguaacuugaaggggcguuggcaacagugggccgacgagcacauacagagucagaaacucaauccuuuuucugaagaguucgauuacgagcuggcuauguccacgcgccugcauaagggagacgaaggcuauggcagacccaaagaggggacuaagaccgccgaaagggcaaagcgggcugaggaacacaucuaccgagagaugauggauaugugcuuuauuaucuguacaauggcccgccauagaagggacggaaaaauucaagugacuuucggugaccucuuugaucgguaugugcgcaucagcgacaaggucguuggcauauuaaugagagcgaggaaacacgggcugguggauuucgagggagaaaugcuuuggcagggccgugacgaucacguagugauuaccuugcugaaguga

SEQ ID NO: 52318 - RNA, 2442 nt, Artificial Sequence
  derived and/or modified sequence opt3 from ABR__Homo_sapiens__NP_001153218
augcccuacaucgacgagagcccuaccauguccccacagcugucugccagaucacaaggcgggggagauggugugaguccgacacccccugaaggccucgcuccaggggucgaggcaggaaagggccuugaaaugaggaaacugguuuugagcgguuucuuagccuccgaggaaauuuauauaaaccagcuggaggcgcuacuccugcccaugaagccucuuaaagcuacugccacgaccucucagccagugcugacaauccagcaaauugagacuaucuuuuacaagauucaggacaucuaugaaauacacaaagaguucuacgauaauuugugccccaagguacagcagugggacucgcaagugaccauggggcaucucuuucagaagcuggcaucacagcugggagucuauaaagccuucguggauaacuacaagguugcucucgaaacagcagagaaauguagccagaguaauaaccaauuucagaagaucuccgaggaauuaaaagugaagggcccuaaggacucuaaagauagccacaccuccgucacuauggaggcccugcuuuauaagccaauugaccgggugacacgcucaaccuugguacugcaugaucuacucaaacacacgccgguugaccaucccgauuacccucugcuucaggacgcucugcgaaucagucaaaauuucuugagcucuauuaacgaagauaucgacccacguagaacugccgugaccacacccaagggcgagacuaggcagcucgucaaagacggguuucugguggaaguguccgagucaagccggaaguuacgccacgucuuccuguuuaccgauguucuccuuugcgcgaaacugaagaagacaagugcaggaaaacaccagcaguacgacuguaagugguauauaccuuuggccgaucuaguguucccaucucccgaggaauccgaggcuagcccgcaaguacauccuuuucccgaccacgaacuggaggauaugaaaaugaagauuucggcccucaaaucugaaauccagaaggagaaggcaaauaaaggucaguccagagcuauugagaggcugaagaaaaagauguucgaaaacgaguuucuucuguugcucaauucaccaaccaucccuuuccggauccauaaccgcaauggcaaaaguuaccuguucuuacugagcuccgacuaugaacgaucugaguggagagaagccauucagaagcuacaaaagaaagaucuccaggcguuugugcugagcucagucgagcuucagguguugacggggaguugcuucaagcugaggacuguucacaacauacccgugacauccaauaaagacgaugacgagagcccaggacucuacggcuuucugcacgucaucgugcauucugccaaggguuucaaacagucagcaaaccuuuauuguacccuggaaguagauaguuuuggguacuucguuagcaaggcuaagacucggguguuucgugacacagccgagcccaaaugggacgaagaguucgagauugaauuggagggaucccaaucucuccgcauccugugcuaugaaaaguguuacgauaaaaccaaggucaauaaagacaacaacgagauaguggauaagauuaugggcaaaggccagauccaguuagacccucagacggucgaaaccaagaauuggcacacagaugugaucgagaugaacgggauuaagguugaguuuucgaugaaauucacuagcagagacaugucccugaagaggaccccaaguaaaaagcaaacaggaguguuugguguaaaaaucucagucgugacuaagcgggaacgaucuaagguuccguacauugugcgccagugcgucgaggaaguggagaaaagaggcauagaagagguagggaucuauaggauuagcggaguggcuaccgauauccaggcccuaaaggcaguuuucgacgccaauaacaaagauauccuccugaugcuuuccgacauggauauuaaugcuauagcgggcacauugaagcuguacuuucgggagcuccccgaaccucuguuaaccgaccgccuguauccagcauucauggaggguaucgcccuuucagaucccgcugccaaagaaaacuguaugaugcauuugcucagaagccugccugacccaaaucuaauuacuuuccuguuucuccuggagcaccuuaagagggucgcagaaaaggagcccaucaacaaaaugucuuugcauaaucuggccacgguguucgggccgacauuacuccguccuuccgagguggaaaguaaggcucaccugaccagcgccgcagacauuuggucucacgaugucauggcgcaaguucaggugcuucuguacuauuugcagcauccacccaucuccuuugcugagcucaaacggaacacucuguacuucucaaccgacguguga

SEQ ID NO: 52319 - RNA, 819 nt, Artificial Sequence
  derived and/or modified sequence opt3 from ABT1__Homo_sapiens__NP_037507
auggaggccgaagagagcgaaaaggcugcaaccgagcaggaaccccuggagggcacagagcaaacucucgacgccgaagaggaacaggaggaguccgaagaggcggcuugcgggucuaaaaagagaguggucccuggaaucguuuaccuuggucacauuccaccgagguuccggccccugcaugugcgcaacuuguuaucagccuauggcgaaguagggcgaguguuuuuccaggcagaggaucguuuugucagaaggaaaaagaaagccgcugcagccgcuggaggcaagaagcggaguuacacgaaagacuauaccgaagguuggguggaguuccgcgauaagagaauagccaaaaggguugcggcaagccugcacaauacaccuaugggggcccggcgccgauccccauuuagauacgaccuauggaaccucaaguaucugcauagguucacuuggucucaccuuucggagcaucuggcuuuugaacgucaggugcggcgccaaagauugagggccgaggucgcacaggcuaaacgggaaaccgauuucuaccuccagucaguggagcgaggacagcgcuuucuggccgcggacggcgaucccgccagaccugacggcagcuggacauucgcacaaaggccaaccgaacaggagcugcgggcucgcaaggccgcuagacccgggggaagggagcgugcccggcucgcaacugcccaggauaaggcucgaaguaauaaagguuuacuggcgagaaucuuuggcgcaccuccaccguccgaaucuauggaggggcccagccuuguaagggacuccuga

SEQ ID NO: 52320 - RNA, 996 nt, Artificial Sequence
  derived and/or modified sequence opt3 from ACAA1__Homo_sapiens__NP_001123882
augcagagacugcaagugguccucggccaccuuagggggcccgccgacagcggauggaugccucaggcugcaccaugccuguccggugccccgcaggcgucugcugccgauguugugguagugcauggccggcgcaccgcaaucugucgagccgggcguggaggcuucaaggacacaacucccgaugaguuguuaucagcugucaugacggcagugcugaaagacguuaaccuaagaccugaacagcucggugauauuugcguggggaauguccugcaaccaggagccggcgcuauaauggccaggaucgcgcaguuucuuagugacauucccgagaccgugccucugagcacaguaaaccggcaguguuccucuggcuugcaggcaguugccucgaucgcuggggguauucgcaauggaucauacgauaucggcauggccugcgggauaacuagcgaaaacguggcagagagauucggaaucaguagggaaaagcaagacaccuuugcucucgccucccagcagaaagcggcccgggcacagucuaagggcuguuuccaagcugagauugucccagugacaaccacugugcacgaugacaaagguacaaagcgcagcaucaccgucacgcaggaugaggggauucgacccuccacuaccauggaaggacuggccaagcugaaaccugcuuuuaagaaagacggcucaacaacugccggccucaccguuagugauguggacaucuucgagauaaaugaagcauuugccagccaggcugcguauugcguagagaaguuaagacugccaccggagaaagugaacccccuugggggagcagucgccuugggucauccucugggcuguacaggggcuaggcaagugauuacccuacucaaugaacugaagcggcguggaaagcgcgccuacggcguugugucuaugugcaucgguacggggaugggcgcagccgcugucuucgaguauccaggaaacuga

SEQ ID NO: 52321 - RNA, 1194 nt, Artificial Sequence
  derived and/or modified sequence opt3 from ACAA2__Homo_sapiens__NP_006102
auggcccugcucagaggcguguucgucguugcugcaaagaggacccccuuuggggccuacggaggucuucugaaagacuucacagcgacugauuugagcgaguuugcugccaaggcagccuuauccgcuggcaaagugucuccugaaacgguagacucagugaucauggggaacguccugcagaguagcuccgaugcaauuuaucuagcccggcacgugggacuccgcguuggcauaccaaaggagaccccggcucugacaaucaaucgacuuugcgguucuggguuccaaucgauugugaacggaugucaggaaaucugcgucaaagaggccgaagugguacuguguggcggcacugagucaaugagccaggcgcccuacugcguucguaaugugagauuugggaccaaguugggaagugacauuaagcucgaggauucccugugggucucucugacagaccagcaugugcaacucccuauggcaaugaccgccgaaaacuuagcugugaaacacaagaucagcagggaggaaugugauaaauaugcccugcagucccagcagcgguggaaggcagcuaaugacgccgguuacuucaacgaugagauggcgccaauagaggucaaaacuaagaagggcaaacaaacaaugcagguugacgaacaugcccgcccccagaccacgcuugagcaguugcaaaagcugccuccaguguuuaaaaaggaugggacuguaaccgcaggaaaugcuucaggcguggccgacggugcuggggccgucaucauugcaagugaagaugccgugaaaaagcacaacuucacaccccuagcuagaaucguuggauauuuugugagcggcugcgacccuucuauuaugggcaucgggccagucccggcgauauccggagcacucaaaaaggccggucugucacuuaaggacauggaucugguggagguaaaugaagccuucgcuccccaguacuuggcaguugagaggagccucgaccuggauauuaguaaaacuaacgugaauggcggggccaucgcuuuaggacauccucugggcgguucugggucccggauuaccgcccaccucguccacgagcuucgccgaagaggcggaaaguaugcagugggcagcgcguguaucgggggaggucagggcaucgcugucauuauacaaucgacagccuga

SEQ ID NO: 52322 - RNA, 7152 nt, Artificial Sequence
  derived and/or modified sequence opt3 from ACACA__Homo_sapiens__NP_942131
augugguggagcacccugauguccauccucagagccaggucuuucuggaaguggauuucaacacagacugugcggauaauccgcgcuguccgagcacacuuuggcgggauuauggacgagcccaguccucuugcccaaccacuggaauugaaccagcauagccguuucaucauuggauccguuucugaggauaauucggaagacgagaucucaaacuuagugaaacuggaucuacucgaagagaaggaggguagccugaguccggcguccguaggcucugacacgcuuagcgaucuggggauauccucauugcaggacggacucgcucugcacaucagaaguagcaugucuggccugcaucucgugaaacaggguagggaucggaagaaaauugacucccaacgcgauuuuaccgucgccucacccgcagaauucgugacaagauuugggggaaauaagguuaucgagaagguguuaauugccaacaauggcaucgcugcagucaaaugcaugaggagcauacggcgcuggaguuacgaaauguuccgaaacgagagagccauuagguuugugguaaugguuacuccugaggaccugaaggcuaaugccgaauauaucaaaauggcggaucacuacgugccaguccccggcgggccuaacaauaacaauuaugcaaacguggagcuuauuuuggacaucgccaagcggaucccagugcaggcugucugggccggauggggucaugcaucugaaaaucccaaacugccugagcuacuccugaagaacggcauugcuuucauggggccaccgucccaggccaugugggcgcuuggagauaagauagccagcucgaucguugcacagaccgcuggcauucccacacugccuuggucugguuccggguugcguguggacuggcaagaaaaugacuuuucaaaacgcauccucaacguaccacaggagcuguacgagaagggauaugugaaagaugucgacgauggcuuacaggccgcugaagaggugggcuaccccguuaugauaaaggccagugaagggggagguggcaaagggauuagaaaggugaacaaugcagacgauuucccuaaccuguuuaggcagguccaagccgaggugccaggaagccccaucuucguaaugcggcucgcuaaacagucccgacaccuugaaguucagauccuggcggaccaauauggcaaugcaauuucuuuguuuggucgcgauuguagcgugcagagaaggcaccagaagaucauugaggaggccccggcuaccauagccacuccugcagucuucgaacauauggagcagugcgccgugaagcuagcuaaaauggucggguacgugucagccggcacaguugaauaccuguauagucaagacggauccuucuacuuucucgagcugaacccccggcuucagguggaacacccauguaccgagaugguagcagaugucaaucugccugcggcucaguugcagaucgccaugggcauuccccucuaucgcaucaaggacaucagaaugauguacggggugagcccauggggagauucucccauugacuucgaggacucagcacauguuccuugcccaaggggucacgugauagccgcucguaucacgagugaaaacccggaugagggcuuuaaacccagcuccgggacuguccaagaacugaauuuccggucuaacaagaauguguggggauauuuuucgguagccgcagcuggcgguuuacacgaguucgccgacagccaguuugggcauuguuucuccuggggcgagaaccgagaagaggcgauuucaaauauggugguugcccugaaagaacuaaguaucagaggagauuuuaggaccacagucgaguaccucauuaagcugcuugaaacugagucuuuccagaugaaccgcaucgacaccggcugguuggaucggcugauagcugagaaggugcaggcagaaagaccugacacaaugcucgggguggucugcggagcccugcacguugcugaugugagccuuaggaauuccgugucaaacuuucugcauagcuuggagcgcggucaaguacucccagcccacacccuguuaaauacggucgacguggaacugaucuaugagggcguuaaauacgugcuaaaggucacucgacagucucccaacuccuacgugguuauuaugaacgggaguuguguggaaguagauguccaucggcucagcgacggaggccugcuuuugucuuaugaugguuccucauacacaaccuauaugaaagaggagguggaccguuacagaaucacuauugggaauaagacaugcguguucgaaaaagagaacgauccuagugucaugaggagcccaucggcaggcaagcugauccaguauauaguugaagacggaggccacguguuugcggggcaguguuacgccgagauugaaguaaugaagauggugaugacccucacggcugucgaguccggaugcauccacuaugugaaacgccccggcgccgcacuggacccggguuguguuuuagcuaagaugcaacuggauaauccuucuaaagugcagcaggccgagcuucauaccgggagcuugccacggauucaaucaacagcacucagaggagaaaagcugcacagggucuuccauuacgugcuagacaaccugguuaaugugaugaacggcuacugccuccccgauccuuucuuuaguuccaaagucaaggacuggguagagcgacugaugaagacucuucgcgaucccucuuugccacuguuagaacuccaggacaucaugaccagcguguccggucggauaccucccaauguugagaaaucaaucaagaaagagauggcccaguaugcuagcaacauuacaagugugcugugccaguucccaucucaacagaucgcgaauauucuugauucccacgccgcaacucugaacagaaagagcgaaagggaggucuuuuucaugaauacccagucgaucgugcaguugguacaacguuaccgcucaggcauacgggggcacaugaaagcuguggucauggaccuccugagacaguaucuaaggguugaaacacaguuucagaacggacauuacgauaaguguguguucgcccugcgagaggaaaauaaaucugacaugaacaccgugcucaauuauauuuuuagucacgcccaagucacuaagaagaaccugcuugugacgauguugaucgaucagcugugcggccgggacccgacauuaaccgaugagcuccugaacauccuuacugagcugacccagcuauccaaaacaaccaaugcuaagguugcacuccgcgccagacaaguacugauugcgagccauuugccuucuuacgaacugaggcacaaccagguggagagcaucuucuuauccgcuauugacauguaugggcaucaguuuuguauagaaaaucuccagaaacugauccuuucagagacuaguauuuucgacguccugcccaacuuuuucuaccacagcaaucaagugguucggauggccgcauuggaaguguacguccgaagagccuauaucgcuuacgagcucaacucugugcagcaccgccagcugaaggauaauacaugcguagucgaguuucaguucaugcuaccaacgucccaucccaacaggggaaauauuccuacccugaaccguaugucauucaguagcaaucuuaaccacuauggcaugacucauguggcauccguuucugacgugcuccuggauaauucguuuacaccacccugucaacggaugggugggauggucagcuucagaaccuuugaagacuucgugaggaucuuugaugagguuaugggaugcuucucagacuccccuccgcagaguccaacauuucccgaagccggccacacuucuuuguacgaugaggacaaagugccucgcgaugaaccaauacauauccugaacgucgcgauuaagaccgacugugauaucgaggacgaccgauuagcugccauguucagagaguuuacgcagcagaauaaggcaacccucguggaucacgguauucggaggcugacauuccuuguagcccaaaaagacuuucgcaagcaggugaacuaugaaguugaucguagauuccaccgggaguuccccaaauuuuucacuuuuagggcucgcgacaaguucgaagaggaucgaaucuacagacaucuggagccugccuuggcauuucagcucgaacugaaccggaugaggaauuucgaccuaaccgcuauaccgugcgccaaccacaaaaugcaucuguaucuuggcgcggccaaggucgagguggggacagaagugacugauuaccgcuuuuucgucagagcaauuaucaggcacagcgaccucguaaccaaggaggcuuccuuugaauaccugcagaaugagggagagcgguuguuacuggaagccauggaugagcucgaaguggcuuucaacaauacgaacguucguacagacuguaaucacaucuuucugaacuucgugcccaccgucauuauggauccaucaaaaauagaggaaucugugcgcagcaugguuaugcgauauggcaguagacuuuggaagcugaggguguugcaagcagagcuaaaaaucaauauucggcugacuccuacagggaaggccauccccauucgccucuuucugaccaacgaguccggauacuaucuugacaucagcuuauacaaagaagucacugauucuagaaccgcccagauaauguuccaggcuuauggcgacaagcaagguccacugcaugggaugcucaucaauacaccuuacgugacgaaggacuugcugcagucaaaaagguuccaggcgcagucccucggaaccacuuauauuuacgauauccccgagauguuucggcaaagucugauuaagcuuugggaaagcaugucgacacaggcauuccugccaucuccgccuuugcccuccgacaugcuaaccuacacagagcugguacucgaugaccagggccaguuagugcacaugaaccgacugccagguggcaaugaaaucgggaugguugccuggaaaaugacuuuuaagagccccgaguauccugagggaagagauauaauugucaucggcaacgacaucaccuaccgcauugggucauucggaccacaagaagaucuucuguuucucagggcuagugaguuggcccgggcagaaggcaucccccguauauaugugucugccaauuccggugcuagaauugggcuggcggaggagaucaggcauauguuccacguggccugggucgacccugaagauccguacaaaggauaucgcuaccucuaucugacgccacaggacuacaagcggguuagcgcacuuaacucagugcauugcgagcacguagaagaugagggcgaaagucgauacaaaauuacagacaucauaggcaaggaggaggggauuggacccgaaaaucuaagagguagcggcaugaucgcuggggaguccucucuggccuauaacgaaaucauuaccaucagcuuggugacuuguagggcaauuggaauaggcgccuacuuaguccgccugggucagcggaccauccagguggagaacucccaccucauucugacaggggcuggagcccuuaauaagguucugggcagagaaguguauacuucaaacaaucaacucggcgggauccagaucaugcauaacaauggagucacccacugcacaguaugcgaugacuuugaggguguguucacgguuuugcauuggcugucuuacaugccuaaaagugugcacucgagcgucccccuacugaacuccaaggacccaauugaucguauaaucgaguuugugccuaccaaaacucccuaugacccaagguggaugcucgcgggccggccucacccgacacagaaggggcaauggcuuucuggauucuuugauuacggcucauucagcgaaauuaugcagcccugggcacagaccgucgugguuggucgcgcccgacuggggggaaucccagugggcguaguggcugucgagacuagaacaguugaauuauccauuccugccgaccccgcuaauuuggauagugaggcaaaaaucauacagcaagccggccaggugugguuuccagacucugcuuucaagaccuaucaggccaucaaggauuucaacagggaagggcugccucucauggucuuugcaaauuggcggggauucagcgguggcaugaaagacauguacgaucaggugcugaaguuuggggcguacauuguagacggacuucgcgaguguugccaacccgugcugguuuauaucccgccacaggccgagcucagaggcgguucauggguggucauugauuccaguaucaacccuaggcauauggaaauguacgcugaccgagagagccgggggucuguguuggaacccgagggaacggucgagauaaaauuccguagaaaggaccuggugaaaacuaugcgcaggguugauccaguauauauucacuuagccgaacggcuaggcacccccgagcuguccacagcagaaagaaaggagcucgaaaauaagcuuaaagagcgcgaggaauuucugaucccuauuuaccaucagguggcuguccaguucgccgacuugcacgauaccccgggcaggaugcaagagaagggggugaucucagacauacuggauuggaaaacuagccgaacauuuuucuauuggcggcucagaaggcugcuucucgaagaccugguuaagaaaaagauccauaacgcaaaucccgaguugaccgauggacagauucaggccaugcugcgccguugguuuguggaagucgaggguacagugaaggcuuacguaugggacaacaauaaagauuuagcggaguggcuagaaaagcagcugacugaggaagacggcgugcacucgguuaucgaggaaaacauuaaauguaucucucgggauuauguccucaagcaaauaagaagucuugugcaggccaacccagagguggcaauggacuccauuauccacaugacccagcauaucagcccuacgcaaagggcugaggucauucgcauccugucaacaauggauucccccucuaccuga

SEQ ID NO: 52323 - RNA, 7377 nt, Artificial Sequence
  derived and/or modified sequence opt3 from ACACB__Homo_sapiens__XP_011536564
auggugcugcuccuuugccugagcuguuugauauucuccugcuuaaccuuuucuuggcugaagauuuggggaaaaaugacagacucaaagcccauaacuaaaaguaagagcgaagccaaccuaaucccuucccaggaaccauucccggcuucugauaauucgggggagacgccccaacggaacggagaaggucacacccucccuaaaacaccaucacaggccgagcccgccagccacaagggcccuaaggacgcggggagacggcgcaauagucugccacccucccaccagaaaccuccacgaaacccgcuuucuagcuccgaugcugcccccucaccugaacugcaggcaaauggaacuggcacccaagguuuggaggccacagacaccaacgggcucaguagcucugcucguccacagggacagcaggcaggcucccccucaaaggaggauaaaaagcaagccaauauuaaaagacagcugaugacuaacuuuauccugggcagcuucgacgauuacaguucugacgaagauuccgucgcugggagcucgagggagucuacacggaagggaucccgcgccucacucggugcguuaagucuggaagcauaucuuaccacgggcgaggccgagacuagaguuccuaccaugaggccaagcauguccggguugcaucuggugaagcggggacgcgaacacaaaaagcuagaccuccaucgagauuuuacaguagcuucucccgccgaguucgugacuagauuuggcggugacagggucauugaaaaagugcugaucgcaaauaacgggauagcugccguuaaguguaugcggagcauccgucgcugggcguacgagauguucagaaaugaaagggccauucgguuuguggucauggugaccccggaggaucuuaaagcaaacgcugaguauaucaagauggccgaccacuacguaccuguucccggaggcccaaauaacaauaacuaugcuaacguggaacugauugucgacaucgccaaacgaauaccugugcaggcagugugggccggcugggggcacgcuucagagaaucccaaguugccagaacuccugugcaagaacggagucgcguucuuaggucccccuagugaggcaaugugggcccugggcgauaaaauugcuuccacaguuguggcccagacccuccaaguaccaacgcuuccguggagcgggucuggacugacuguggaauggacagaggacgauuugcagcagggcaagcgcaucucaguccccgaggacguguacgauaaagguuguguuaaggacguggaugaagggcuagaggcagccgaaagaauuggcuuuccucugaugaucaaagcuagugagggaggcgggggaaaggguaucaggaaggccgaaagcgcagaggacuucccaauucucuuucggcaaguccaguccgagauacccggcucuccuaucuuccugaugaaacuugcgcagcaugcucgccaccuggaagugcagauuuuggccgaucaauaugggaaugcaguaagccucuucggaagagacugcagcauccagaggcgucaucagaagauaguugaggaagccccagcuaccauugcaccccuggcaaucuuugaguucauggagcagugugcuauccgguuagccaaaacugugggcuacgucuccgcggguacaguggaauaccuguauucacaagaugggaguuuucacuuccuagagcucaacccgcgacugcaggucgaacacccuugcaccgagaugauugccgacgugaaucuuccagcugcacaguugcagaucgccaugggcguuccccugcauagacucaaggacauuaggcugcuuuacggagaaucuccuuggggcgugacgcccaucucguuugagaccccauccaacccuccccuggcucgcgggcacguaaucgccgcacggauuacaucagagaauccagaugaaggauucaaaccgagcucugguacuguccaagaguugaacuuuagauccaguaagaauguguggggcuauuucagcguugcggccaccgggggacuccaugaauuugcugacucucaguucggccacuguuuuuccuggggugagaacagggaagaggccaucucaaauaugguggucgcacugaaggaguuaaguauccgcggggauuuccgaacaacuguggaauaccugauuaaccuacucgagaccgagagcuuucagaauaacgacauagauacaggcuggcuggacuaucuuaucgcugagaaaguacaggccgaaaagccugauauuauguugggagugguuugcggcgcacugaaugucgccgacgcuauguuccggaccuguaugacugauuuccuccauucgcuggagcgugggcaaguguuacccgcggacucccugcuuaacuugguggaugucgagcucaucuacggaggcguuaaauauauucugaagguggccagacagucucuaacgauguuugugcugaucaugaacgguugccacauagaaaucgacgcacacaggcucaaugaugggggacugcuuuugagcuacaacggcaauucauacacaaccuauaugaaagaggaaguagacaguuaccgcauuacuaucgguaacaagaccugcgucuucgagaaggagaaugacccaacagugcugcggucccccucugcuggcaaauuaacccaguauacuguugaagaugggggacauguggaggccggcagcuccuacgccgaaauggaggucaugaagaugauuaugacacucaacgugcaagaaagagggaggguuaaauauaucaagcgaccuggagcugugcuggaggcaggcuguguagucgcccgccuugagcuggacgauccaucaaaagugcaccccgcggaaccuuuuacgggugaguugccggcucagcagacccucccaauacugggggaaaagcuacaucagguguuccacagcguccuggagaaucucacuaacguuaugaguggauuuugccugcccgaaccuguguucucuauuaaacuuaaggaguggguacaaaaguugaugaugacacugcggcacccauccuuaccccuccuggagcuucaggaaaucaugaccagcguggccggcaggauuccugcaccggucgagaaaucggugagacguguuauggcccaguacgcuucaaauaucacaucugugcugugucaguuucccagucaacagauagcaacuauccuagacugccaugccgcgacccuccagcgcaaggcugaucgggaagucuucuuuauuaacacgcaguccaucgugcaacugguucagagauauaggagcgguauucgaggcuacaugaaaaccguggucuuggaccuguuacggcgcuaccucagaguagagcaccauuuccagcaagcccacuaugauaagugugugaucaaucugagggaacaguuuaaaccagacaugucucagguucuugauugcauauucagccaugcacagguggccaagaagaaccaacuggucauuauguugaucgacgagcucugugggccugaucccucccugucagacgagcuaaucaguauucugaaugaacuuacacagcucagcaaaucugagcacugcaagguggcucugcgggcccgacagaucuugauugcaucccaucugccaucauacgaauuaagacauaaccagguagagaguauauuucucagcgcuaucgauauguauggacaccaauucuguccugagaaucugaagaaacuuauucuguccgaaacuaccaucuucgacguguugcccacauuuuucuaccaugccaacaaagucguuugcauggcgucucucgagguguaugugcgcaggggcuacauugccuaugaacugaacucgcuacagcaccgucagcugccagacgggacuugugucguggaguuucaguucaugcuuccgagcucacauccuaaucggaugaccguucccaucuccauaacgaacccagaucuccugagacacaguacagaauuguuuauggacucuggauucagccccuuaugccaaaggaugggcgcaaugguagcuuuucgccgauucgaggauuuuaccagaaauuucgacgaggugaucuccugcuuugccaacgucccuaaagauacuccacuguucucagaagcucggacaucucucuacagcgaggacgauuguaagagucugagggaagaacccauucacauccuuaauguguccauucagugcgcagaccaucuggaagaugaggccuugguuccuauccuacgcaccuucgugcagagcaaaaagaacauacuggucgacuacggucuccguagaauuacuuuucugaucgcccaggagaaagaguucccgaaguuuuucaccuuucgggcuagggaugaguucgcggaagaccgcaucuaucgacaccuugagccagcauuagccuuucaacuggaacucaauagaaugcggaacuucgacuugacagcugugcccugugccaaucauaaaaugcaccuguaccucggggcagccaagguaaaggagggagucgaggugacggaucacagguuuuucauucgcgcuauaaucagacauucugaccugauuaccaaagaagcgucauuugaguaucuucagaacgaaggcgagaggcuguugcuagaggccauggaugaacuggagguugcauucaauaacacuuccgugcggacagacugcaaucacaucuuucucaacuucgucccuaccgugauuauggaucccuucaagaucgaagagaguguucguuacauggugaugcgcuaugguagccgauuauggaaacugagaguccuucaggcugaagugaagauaaauaucaggcaaacaacuaccggcucggccguaccaauucggcuguuuaucacgaacgagucuggguacuaucucgacauuuccuuguacaaagaggugacagauagccgcucaggaaacaucauguuccauaguuuuggcaauaagcaggggccucagcacggaaugcugauaaacacccccuacguuacuaaagaccuccugcaggcaaagagauuccaagcccagacccuuggcacaacuuauauuuacgauuuuccagaaauguucaggcaggcucuauuuaagcugugggguucuccugacaaauauccgaaggauaucuugaccuacacagaguuaguccuggacucccaggggcaacucguggaaaugaaucggcugcccggaggcaacgaggugggcauggucgccuucaaaaugcgauuuaagacgcaggaauauccagaggggagagauguaaucgugauuggaaaugacaucaccuuccgcauagguagcuuuggcccuggggaggaccuucuguaccucagggcgucagaaauggcacgggccgagggcauucccaaaaucuauguugcugccaacaguggcgcucguauugguauggcagaagagaucaagcauauguuccacguggccugggucgauccagaagacccucacaagggguuuaaauacuuguaccugacuccccaggauuauacaagaauaagcucccuaaauucugugcauuguaagcacauugaggagggaggcgaaagcagguacaugaucaccgacaucauuggcaaagaugacgggcugggaguugagaaccuccgcgguuccggcaugaucgcuggggaaucaucucuugccuaugaggagauugugacuauaagucuggucacaugccgggcaaucggaauuggcgcguacuuagugcgauugggucagagaguaauccaaguggaaaauucgcauaucauucugaccggggccagcgcucucaacaagguucugggaagggaggucuauacguccaauaaccagcuuggcggcgugcagauaaugcacuacaauggggugucucacaucacugucccggaugacuucgaaggaguuuauaccauucuggaguggcucucauacaugccaaaagauaaccauagcccugugcccaucauuacaccaaccgaccccaucgaucgcgaaauagaguucuugccuucccgggccccguacgaccccagauggaugcuggcaggucguccacacccuacuuuaaagggcacauggcaaaguggguuuuucgaucauggaucuuuuaaggagaucauggcucccugggcccagaccguagugacaggcagggcacggcuaggugggauuccugucggagugaucgccguugaaacucgcaccguggaggucgcuguaccagcggaccccgccaaucuggacagcgaagcaaaaauuauccagcaggcuggccaagugugguucccugauucagccuauaagacggcccaggcaguuaaagacuuuaaccgagagaagcucccacuuaugauauucgcuaauuggagaggcuuuuccgggggaaugaaagauauguacgaccaggugcugaaguucggugccuauauugucgauggcuugaggcaguacaagcaacccauccugauuuauaucccgccuuacgcggaacucagagggggaaguuggguggucauagacgcuacaaucaacccacuguguauugagauguaugccgauaaagagagccgcggcggugugcuugaacccgaggggaccguugaaaucaaguuuaggaagaaggaccucauuaaaucuaugaggcgaaucgauccugcauacaagaagcugauggagcaguugggagaaccagaccuguccgauaaagaccggaaggacuuagagggccgucuaaaagccagagaggaucugcuccuucccauauaccaccagguggcuguacaguucgcagacuuucaugauacuccgggccgcaugcuggaaaagggggugauuucagacaucuuggaguggaaaaccgccaggacauuccuguauuggcggcucagacgccugcuuuuagaagaucaagucaagcaggagauccugcaggcgagcggagagcucucgcacguucacauucagucuauguugaggcgaugguuuguggaaacugagggugcugucaaagccuaccugugggacaacaaucaagugguagugcaguggcuagaacagcauuggcaagcaggcgaugggccucggaguaccaucagagagaacauaacguaucugaagcacgacuccguucucaagacaauuaggggacuuguggaagagaaucccgaggucgccguggauugcgucaucuaccugagccagcauauuucaccagcugaacgcgcccaggugguucacuugcuguccaccauggacucuccugcaagcacuuga

SEQ ID NO: 52324 - RNA, 3273 nt, Artificial Sequence
  derived and/or modified sequence opt3 from ACAD10__Homo_sapiens__NP_001130010
augugcgugagaagcuguuuccagucccccaggcugcaaugggucuggcggaccgccuuucucaagcacacacagcgccgacaucagggcucucaccguuggacucaucuugggggaucaacguacagagcuguuaucuucgacauggguggcgugcugauuccuaguccagggaggguagcagccgagugggaagugcagaaccggauaccgagcggaaccaucuugaaagcguuaauggagggcggugaaaaugggcccuggaugcgcuuuaugagagcugagauuacagccgaaggauuccugagggaguuuggccggcuaugcuccgagaugcucaagacuucugucccuguggauucguucuuuucacugcuuaccagcgaacgcguugcaaaacaauucccagugaugacagaggccaucacccagauucgagcuaagggccugcagacugcagucuugaguaacaauuuuuaucuccccaaccagaaauccuuccugccucuggacagaaagcaauuugaugugaucguagaaucuuguauggaggggauaugcaagccagaccccaggaucuacaaacucuguuuagagcagcugggacuucagccuagcgaauccauuuucuuggaugaccuggguacaaaucuaaaggaggccgcucggcucggcauccacaccauuaaacgucagggguuugccguucugccaaagcuggugucaaacaguugggcgcaagcaaucuauccgcccuacccuccaaaagucgugcgccuucaggugaaugaucccgaaacggccgucaaggaguuggaagcucuccugggauucacuuuaagaguuggcgugccuaacaccaggccaguaaagaaaacaauggagauacccaaggacagccugcagaaauaucucaaggaucuucuggguauucaaacuaccgggccguuggagcuacugcaguucgaccauggacagucuaauccuacauacuauauccggcucgccaaccgagaucuggugcuucgcaaaaagcccccaggcacccuguugccuuccgcacacgcuauugaaagagaguuuaggaucaugaaagcccucgcgaaugccggcguccccgugccaaacguucuggacuuaugcgaagauucaagcgugaucgggacgcccuucuacgucauggaguacuguccuggacugauuuauaaggacccaagucuaccgggucucgaacccucucaccggcgcgcaauauacacugcuaugaauacagugcugugcaagauccauuccguagaccuucaggccguuggcuuggaggauuaugggaaacaaggagacuacauuccuagacaggugaggaccugggucaagcaguaucgugcuagcgagacuucgacaaucccagccauggaacggcugauagaguggcucccccugcaccuuccucgacagcaaagaaccacggugguccauggcgauuuuaggcuggacaacuugguguuccacccagaggaacccgaaguucucgcagugcuggauugggaguuaucuacccugggugacccgcuagccgauguagcuuacuccugucucgcgcacuaucugccuucaaguuuuccaguccuucgcgggauuaaugacugcgauuugacacagcugggcauccccgcagccgaggaauacuuccggauguacugucuccagaugggacugccucccacugagaacuggaacuuuuauauggcuuucagcuuuuucagaguggccgcaaucuuacagggcguuuacaaaaggucccugaccgggcaagccucuagcacauaugcugaacagacuggaaaacuuaccgaguuugugucaaauuuggccugggacuucgcagucaaggaggguuuucgcguguucaaggaaaugccauucacaaacccucucacccgaaguuaccauacuugggcgcggccccagucccaguggugcccaacgggcagccguucuuauucaaguguaccggaggcuagcccugcccacacauccagagggggacuggugauuucucccgaaucgcuaagcccacccguuagggagcuguaccaucgccucaagcacuuuauggaacaacgggucuauccugcagagccagagcugcagucccaucaggccucagcugccagauggagucccucuccucuuaucgaagauuugaaagagaaggcaaaagcugaaggccuguggaauuuauuccucccgcuggaggccgacccagaaaagaaauacggugcggggcuuaccaacguggaguacgcccaccugugcgaguugaugggcacuagccucuaugcucccgaaguguguaauugcuccgcaccugacaccggaaacauggagcugcuagucagguacggcacagaagcccaaaaggcucgauggcugauuccacuccuggaggggaaggcccgcucauguuuugcaaugaccgaaccccagguugcgagcucugaugccacuaauauagaggcuuccauccgggaggaagacaguuucuaugugauuaacggacacaaaugguggaucacagguauccuugauccuagaugccaguuguguguguuuaugggcaagacggacccgcaugcccccaggcaccgucagcaaagcguacuguuagucccaauggauaccccugggauuaaaauaauccgcccccucacuguguacggacuggaggacgcaccaggcggucauggggaaguucgguucgagcacgugagagucccuaaggagaauauggugcuuggccccggaaggggcuuugaaauugcucaggggcgacugggaccaggccggauccaccauugcaugcgccuaauugguuucucugagagagcccucgcacugaugaaagccaggguuaagucccgguuggcuuuugggaagccgcugguggaacagggaacaguauuagcggauaucgcccagucacgagucgagauagaacaagcaagacuccuggugcuucgcgcugcccaccugauggacuuggccggcaacaaagcugcagcccucgauaucgcgaugauuaagaugguggcuccuaguauggccagcagggucaucgaccgugcaauucaggccuucggugcugcaggccugucguccgauuauccccuagcccaguuuuucaccugggcgcgggcucugagauuugccgacgggccagaugagguucauagggcaacaguggccaaacuugagcucaagcaccgcaucuga

SEQ ID NO: 52325 - RNA, 1248 nt, Artificial Sequence
  derived and/or modified sequence opt3 from ACAD8__Homo_sapiens__NP_055199
augcuguggagcggcugcagaagguucggggcccggcucggaugucuucccgguggccugcgcguguugguccagaccgggcaccgauccuuaacaucuugcaucgacccuucaaugggacugaacgaggaacaaaaggaguuucagaaaguugcuuucgauuuugcagcccgugaaauggcgccaaauauggcugagugggaccagaaggaacuauucccgguggauguaaugagaaaagccgcacagcucggcuuuggugggguguacauucaaacugacgucggaggcaguggccugagcaggcuugauacguccgugauauucgaggcccuggcuaccggguguacaucuacuaccgcauauaucucgauucauaacaugugcgccuggaugaucgacucauuuggaaaugaggaacagcggcacaaguucugucccccuuugugcacaauggagaaauuugcuagcuacugucucaccgaaccagguaguggcuccgaugccgcgucucugcugacuagcgcaaagaagcagggggaccauuauauucucaacggauccaaagccuucaucucaggcgcuggugagagugauauauacguugugaugugccgcacagggggacccggcccuaagggcaucagcuguauugucguggagaaagggaccccaggauuaucuuuugguaagaaagaaaagaagguaggcuggaacucccagcccacgagagccguuaucuucgaggacugcgcagugccugucgcuaauaggauugggucagaaggacaaggcuuucugaucgccgugcggggucuuaaugggggccgcauaaacauugcgagcuguaguuugggagccgcacacgcuucugugauccugacucgagaucaucuaaaugucagaaaacaguucggcgagccacucgccuccaaccaguaucugcaguucacccuugcugacauggccacaaggcugguugcagcccgguugauggugcguaaugcugcgguagcacuccaagaggaacgcaaggaugccguggcucugugcagcauggccaaauuauuugcaacugacgagugcuucgccauuuguaaccaggcucugcagaugcacgggggauacgguuaucucaaggacuacgccguccaacaguacgugagagauucgaggguucaccagauccuugaaggcucuaaugaggugaugcggauccugauuucccgaucauugcuacaggaauga

SEQ ID NO: 52326 - RNA, 1866 nt, Artificial Sequence
  derived and/or modified sequence opt3 from ACAD9__Homo_sapiens__NP_054768
augagcggcugcgggcuguuccucagaaccacagccgcugcaagggccugucggggacuuguggucuccacugcgaaccgccgacuguugcguacgucucccccuguuagagcuuuugccaaggaguuauuccuggguaaaaucaagaaaaaggaaguguuuccauucccggagguaucacaggacgaacuaaaugagauuaaccaauuucucggccccguggaaaaauucuuuaccgaggaggucgauaguaggaagauagaccaggaagggaagaucccugaugagacacuggaaaaacuuaagagccugggauuguucggccuccaggugccagaggaguacggugggcugggauuuuccaauacuauguauucucggcugggcgaaauuaucucgauggacggcucaauuaccguuacacucgcagcccaccaggcuaucggguuaaaaggaauaauccuggcagguaccgaggaacaaaaggccaaauaccuucccaaguuggcuagcggcgagcauauugccgcguucugccugacugaaccugcaaguggguccgaugccgcuucuauccgcagcagagccacacuauccgaggacaagaaacacuauauucucaacggaucaaagguguggaucaccaauggcggucuggcaaacauauuuacggucuucgcuaaaacugaggugguagauagugacgggagcguuaaggauaaaauuaccgccuuuaucguggaaagggacuucggaggcgucacaaauggcaagccagaggauaaacuugggauucggggaucuaacacuugugaagugcauuucgagaauaccaagauccccguggaaaacauccugggugaggucggcgacggguuuaagguugcgaugaauauuuugaacuccggacgcuucucaaugggcagcgugguagccggucuccugaaacgauuaauagagaugacagcagaauacgcuugcaccagaaagcaguuuaauaaaaggcugagugaguucgggcucauccaggaaaaguuugcccuuauggcucagaaagccuaugugauggagucuaugacguaccugacugcaggcauguuggaucaaccuggauucccagacuguuccauugaagccgcuauggucaagguguuuagcucggaggcggcauggcagugcguuucugaggcccuacagauccugggcgggcucggauauacacgggacuacccguacgaacguauacugcgcgauaccagaauccuucugauuuucgaggguacuaacgaaaucuugaggauguauauugcucucacaggccugcagcacgccgggcggaucuuaaccacgcgcauucaugagcugaagcaagcaaaaguguccaccgucauggacacagugggacgaagacuaagggauucacucggccggacuguagaccugggucuuaccgggaaucacggcguugugcaccccaguuuggccgauagcgcuaacaaguuugaggaaaacacauacuguuucggacgcacugucgagacccugcuccugagauuuggcaaaacaauaauggaggaacagcuugugcugaagagggucgccaauaucuugauuaaccucuaugggaugaccgcagugcugucccgugcgucucggagcauccgaaucggauuaagaaaucaugaccacgaaguucugcuagcuaacacuuucugcguggaggccuaccuccagaaucuguuuucacuuagucaauuggauaaauaugcaccugagaaccuggacgaacagauuaagaagguaucccagcagauacucgagaaaagggccuacaucugugcucauccacuggaucgcacgugcuga

SEQ ID NO: 52327 - RNA, 1293 nt, Artificial Sequence
  derived and/or modified sequence opt3 from ACADL__Homo_sapiens__NP_001599
auggccgcuagacugcucaggggcagccuucgggugcugggagggcaccgcgcaccccgacaguugccugccgcgcguugcucccauucugguggcgaggaaagauuagagaccccaucagcuaagaaacugacagacaucgggauuaggcggauauucaguccggaacacgauaucuuucgcaagagcgucagaaaauucuuucaagaggaaguuauuccccaucacuccgagugggagaaggccggagaagugucuagggagguaugggaaaaagcaggcaagcagggucuacucggggugaacaucgccgagcaucugggaggcauuggcggggaccuuuacucggcugcaaucgucugggaggaacaggccuauucaaauuguagcggaccugguuucaguauacacuccggcaucgugaugucuuacauuacuaaccacgggagcgaggaacagaucaagcauuuuauuccacaaaugacggcuggaaaaugcaucggcgccauagcgaugaccgagcccggugcaggguccgaucugcagggaauuaagacaaaugccaaaaaggacggcucagauuggaucuugaacggcaguaaaguuuucauuagcaaugggucucucuccgacguggucaucgugguagcuguuacuaaccacgaagccccuucaccagcacauggaaucagccuguuucugguggagaaugguaugaagggcuucauuaaggggcggaaacuccacaagaugggauuaaaagcucaggauaccgccgagcuguuuuucgaagacauacgccuucccgcgagugccuugcugggcgaggaaaacaaggguuuuuauuacaucaugaaagagcuaccucaggaacgacuccugauugcagaugucgcuaucucugccuccgaguucauguuugaggaaacaagaaauuaugugaagcaaaggaaggcuuucgggaaaaccguggcccaccuucagacuguccagcauaagcuggcagaguugaaaacacacauauguguuacccgggccuucguggacaacugccuccagcugcaugaagcuaagcguuuagauagcgcgacggcauguauggccaaauacugggcuucggagcugcaaaauucuguagccuaugacugcgugcagcuccacggcggauggggcuacaugugggaauacccaauugcaaaggccuaugucgaugcucgcgugcagccgaucuacgggggaacuaacgagaucaugaaagagcuuauugccagagaaaucguuuuugacaaguga

SEQ ID NO: 52328 - RNA, 1299 nt, Artificial Sequence
  derived and/or modified sequence opt3 from ACADSB__Homo_sapiens__NP_001600
auggagggccuggccgugagacuccuuagggggagccggcuguugcgccgaaacuucuuaaccugccuguccucuuggaagauucccccucacgucucaaaaaguagccaguccgaagcucuacucaauaucacaaacaauggaauacauuuugcaccacugcaaacuuucacggacgaggaaaugaugaucaagucuucgguuaaaaaguuugcccaggagcagauugcgccgcuugugucaaccauggaugaaaacagcaaaauggagaagaguguaauccagggucuguuccaacagggcuugauggggauugagguggaccccgaauacggaggcacaggugcuuccuuucucucuacuguccuggugaucgaggaacuggccaagguugaugcaagcguggccgucuucugugagauacagaauacccucaucaacacauuaauucguaaacacgggaccgaggaacagaaggcuacuuaucugccucaacuuacaaccgagaaagugggauccuuuugcuugucagaagcaggcgccggcagugacagcuucgcucugaagacgagagccgauaaagagggggacuacuauguacuaaauggaucuaagauguggaucuccucagcggaacaugcaggucucuuucugguuauggccaacguggauccaacuauuggcuacaaggggaucaccagcuuccuugucgacagggauacacccggacugcacauaggcaaaccugagaauaaguugggucuccgggcuaguucuacuuguccacugaccuuugagaacgugaaagugcccgaagccaauauuuuagggcagaucggacauggcuauaaguacgcaauuggcucccugaacgaggggcgcaucggaaucgcugcccagaugcucggucuugcgcagggcugcuucgacuauacaauuccuuacauaaaagaaagaauccaauuugggaagaggcuguucgauuuccagggauugcagcaccaagucgcccacguugcaacccagcuagaggcugcccggcugcucacguacaaugcugcccgccugcuugaagcaggcaaaccauuuauuaaggaggccagcauggcuaaguauuacgcgucggagaucgcaggucagacuacaucuaaauguauagaauggaugggcggggugggauauaccaaggacuacccgguagagaaauauuuccgagaugccaagauuggcacuaucuacgaaggggcuuccaacauccagcugaauacaauugccaaacauaucgacgcagaguauuga

SEQ ID NO: 52329 - RNA, 1239 nt, Artificial Sequence
  derived and/or modified sequence opt3 from ACADS__Homo_sapiens__NP_000008
auggccgcugcacugcucgccagagcgagcggccccgcuaggcgggcccuuugcccucgcgcauggcgacagcugcacaccaucuaccaauccguggaguugccagaaacacaucagauguuacugcagacuugucgugacuucgccgagaaggaacuauuuccgauugcugcacaggucgauaaagagcaccucuuccccgccgcucaaguuaagaaaaugggagggcugggucuucuggccauggacgugccugaagaguugggcggggcgggacucgauuaucuggcauacgccauagcuauggaggaaaucucuagaggcugcgccucaacggguguaauuaugagugugaacaauagccuguaucucgggccaaucuuaaaguuuggauccaaagagcagaagcaggcaugggucacccccuucacaucuggcgacaagauuggcuguuuugcucugucggaaccugggaacggaucagaugccggugcggccagcacuaccgcaagggcugagggcgacaguugggugcuuaaugggacaaaagccuggaucaccaacgcuugggaggccuccgcagccguuguguucgcuucuacugaucgggcguugcagaauaagggaauaagcgcauuucuggucccaaugcccacaccuggccuaacccucgguaaaaaggaagacaaacuggggauccgcggauccucaacggccaaccuuauuuucgaggauugcagaaucccaaaggacaguauucugggcgaaccgggcaugggguuuaagaucgcuaugcaaacuuuggauaugggaaggauagguauugccagccaggcacucggcaucgcccagaccgcucuggacugugccgugaauuacgcagagaaccggauggcguucggggcucccuuaacaaaacugcagguaauucaauuuaagcucgccgauauggcacuugcccuggaaucugcucgcuugcuaacuuggcgagccgcaaugcugaaagacaauaagaaaccuuucaucaaggaggcugccauggcgaaacucgccgcuuccgaggcagccaccgcuaucucacaucaggccauucagauacugggaggcauggguuauguuacagaaaugccagcagagagacacuacagggacgcgcggaucaccgaaauuuaugaggggacgagcgaaauccaacgucuugugauagccggccaucuguugcgcaguuacagaucuuga

SEQ ID NO: 52330 - RNA, 1968 nt, Artificial Sequence
  derived and/or modified sequence opt3 from ACADVL__Homo_sapiens__NP_000009
augcaggccgcuagaauggcagccagccugggcaggcaacuccuucggcugggaggggguuccucucgcuugaccgcguuacugggccagccccgaccugggccagcucguagaccguacgccggaggcgcagcccagcuagcucucgacaagucagauagucaccccagcgacgcacugacaaggaaaaagccugccaaagcugaguccaagucuuucgccguggguauguuuaaagggcagcuuacuacggaucaagucuucccauaucccucgguucugaacgaagaacagacccaguuuuugaaggaacucguggagccuguaucacgguucuuugaagaggugaaugacccagcgaagaacgaugcacuggagauggucgaagagacaacuuggcagggacugaaagaacucggcgccuucggcuuacaagugcccagcgagcuugggggaguuggucugugcaauacccaguacgcucgcuugguggagaucgucggcaugcaugaccugggggugggaauuacacuaggcgcccaccagaguauagguuuuaaggggauccuccuguucggaaccaaagcacagaaggaaaaauaucuuccuaagcuggcuuccggcgagacuguagccgcguuuuguuugacagaaccaucuagcggcuccgaugccgcaucaauuagaaccagugcuguuccgagccccugcgggaaguacuauacgcucaacggaucuaaacuguggaucuccaaugguggcuuagccgacauuuucacuguguuugcuaagaccccugucacagauccagccacuggggcagugaaagagaagaucaccgccuucguggucgaaaggggauuuggcgguauaacacaugggcccccugagaaaaagaugggcaucaaagcuaguaacaccgcggagguuuucuucgacggagugcggguaccaagcgaaaaugugcugggcgaggucgggaguggauuuaagguggcaaugcacauucucaacaauggucgcuucggcauggccgcugcccuugcagggacgaugcgaggaaucauugccaaggcuguugaucaugccacuaacagaacacaauuuggcgagaaaauccacaauuucggucugauacaggagaaguuggcaaggauggugaugcuacaguacgucaccgaaucuauggcguauaugguguccgcuaacauggaccaaggggccacugauuuucagauugaggcagccaucagcaaaauuuucggcucggaggcugccuggaagguaacagacgaauguauccagaucaugggaggcaugggguuuaugaaagagcccggaguugaacgggugcugcgugaccuccgcauuuucagaauauuugaggguaccaaugauauccugaggcuuuucgucgcacugcagggcugcauggacaaggggaaggaauugucuggacucggcuccgcucugaaaaacccguuugguaaugccggguuacugcuaggcgaggcgggaaagcaacuccggcgacgcgccggccuggggucaggacuuaguuugagcggccuggugcacccugagcucuccagaucuggugaacuggcugucagggcacuugagcaguucgccacggugguugaagcuaaacugauuaagcauaaaaaggggaucgugaacgagcaguuuuugcuccagcggcuggccgauggagcaauagacuuauacgcgaugguagucgugcugagccgcgccucaagaagucuauccgagggccaccccaccgcucaacaugaaaagaugcucugugauacauggugcauugaggccgcagcuaggauccgugaagguauggccgcacugcagagcgacccauggcagcaggagcuuuaccggaacuucaaaucuaucucaaaggccuugguugaacgaggcgggguggucacuucaaauccucugggauucuga

SEQ ID NO: 52331 - RNA, 7296 nt, Artificial Sequence
  derived and/or modified sequence opt3 from ACAN__Homo_sapiens__NP_001126
augaccacacugcucuggguguucgucacucuuagaguuaucacggccgcugugaccguagagacaagcgaccacgauaacucccugucugugucaauuccccagccuaguccauugagggucuuacugggcacuagccuaaccauaccgugcuacuuuaucgaccccaugcauccugugacaaccgcaccauccacugccccccucgcgccucggauuaaguggucucgcguuucgaaagaaaaggaggugguccugcuuguggcuacagaagggcgaguacguguuaauucagccuaucaagauaaagugagccugccaaacuaccccgcaaucccuagugacgccaccuuggagguccagucccucagaucuaaugauagcggaguguauaggugugaagugaugcacgguauugaggacuccgaggcuacgcuggaagucguugugaagggcaucguauuccauuaccgggcaauaucaacucgcuauacccuggauuuugacagagcccagagggcuugccuccagaacagugccaucauugcgacaccagagcaauuacaggcagccuacgaagauggguuccaccagugugacgcuggauggcuggccgaucagacugugcgguauccgauccauaccccccgcgagggcugcuacggugacaaagaugaguuuccugggguccgaacauacggaauuagagacaccaaugaaacguaugacguguacuguuucgcagaggaaauggagggcgaaguuuuuuaugcuacuagcccagagaaguucacauuucaagaggccgcgaacgaaugcaggcggcuuggcgcccguuuggcaaccacugggcagcuguaccuagcuuggcaggccggaauggauauguguucugcugguuggcucgccgaccgcuccgugagauaucccaucucaaaggcaaggccuaauugcggcgggaaccugcuuggaguccggacaguguacguacacgccaaucagaccggcuauccagaucccagcagucgauacgacgcuauauguuacacgggugaggauuucguugacauuccggaaaacuuuuucggggugggaggcgaggaagauaucaccguccaaacagugacuuggccugacauggagcugcccuugccacgcaauauuaccgagggcgaagcgagagggucugucauccucacagugaaaccuaucuuugagguuucccccagcccacuggaacccgaggaaccuuucacuuucgcaccagagauuggagccaccgcuuuugccgagguggaaaacgagacaggugaagcaaccaggccguggggcuuccccacuccuggguuaggaccagccacggcuuuuacaucggaggaucugguaguccaggugaccgccguucccggccagccucaccucccaggugggguggucuuccauuaucggcccggcccgacucgcuacucucuuaccuuugaggaagcacaacaggcgugccugagaacaggagcugugauagccuccccugagcaguugcaggcagccuaugaagcuggcuacgagcaaugugacgccggguggcuaagggaucagaccguacguuauccaaucgugucaccccggacuccuugcguuggagacaaggacaguagccccgguguccgaacauacggcgugagaccauccacggaaaccuaugauguguacugcuucgucgacaggcuggagggggagguuuuuuucgcaacucgccucgaacaguuuacauuccaggaggcucuggaauuuugugagucucacaaugccacccuugcgacaacuggacaacuguacgccgcuuggagccggggcuuggauaaaugcuaugcagguuggcucgccgacgggucacugagauacccuauugugacccccaggccagcuuguggcggagauaagccgggcgugcgcacgguauauuuauacccuaaccagaccgggcugcccgacccacuaagucgacaucacgccuucugcuuucggggaaucuccgcaguccccagcccuggugaagaggagggcgggacaccaacuucucccucaggaguggaagaguggauaguuacccagguggucccuggcguggcggccguuccgguggaagaggaaacaacugcuguaccaaguggugagaccacggccauucucgaguucacaaccgaacccgagaaucagacugaaugggagccugcauauacaccagucgggaccagcccccugccuggcauccuuccgacuuggcccccaaccggagcugccacagaggaauccacggagggcccuucugcaaccgaagugcccucggccagcgaggaaccauccccuucagaggugcccuucccaagugaggaaccgucuccuagcgaggaacccuuuccauccguccgucccuucccuucaguugaguuguuuccaagcgaagagcccuucccuucuaaagagccguccccaagugaagagcccagcgcuucugaagagccuuacacucccuccccaccugugcccucauggacagaacugccaaguagcggggaggagucgggagcgccugauguauccggcgacuuuaccgguucuggggaugugagcggacaccucgacuucucaggccaacugaguggugauagagccuccggccuuccgucuggggaccuggauagcuccggauugacaucaacugucggcagcgggcuccccguggaaaguggacugccaucuggcgacgaggaaaggaucgaguggccuuccacccccacgguuggugaguuaccaagcggggcagaaauucuggagggaucggcuucaggcgugggugaccuaucuggccucccuaguggggaaguccuggagacauccgccagcggagugggcgaucuuucuggguugcccagcggagaaguucuggagaccacugccccgggcguggaggacaucuccggucucccaucaggggaaguccuggagaccacagcuccuggaguagaagauauuaguggcuuacccagcggugaggugcuggaaacuaccgcaccaggcguugaggacauaucugggcuucccuccggagagguguuggaaacaacggccccuggcgucgaggauaucucagggcucccgaguggagaagugcuggagaccacugcgcccggcguagaagacauuagcggucuaccauccggggaggugcuggagacaaccgcuccuggagucgaagauaucucuggccuccccucgggcgagguucuggaaacugccgcaccugggguggaggacaucagcggacuuccaucaggugagguguuggaaacagccgcucccggcgucgaggauauuuccgggcugccuaguggagaaguguuagagaccgcagccccaggcguugaagacauaucuggucuccccagcggggagguacuggagacggcggcuccgggaguggaagauaucuccggccuuccuucaggcgagguccuggaaacugccgcaccagggguggaggacauuucuggauugcccagcggugaaguucucgagaccgccgcuccuggcguggaggauaucagugggcugccauccggagaaguccuagagacagccgcacccggcguggaagacauuagcggucugccgucuggggagguacucgaaaccgcugccccuggagucgaggacaucucaggccugcccuccggcgaggugcuugaaacugcggccccagggguugaggauauaaguggauugccuagcggugaagugcuggagacagcagcucccggcgucgaggacaucucgggguuaccaucuggagaagugcucgagaccgccgcucccggcguugaagauauuuccggucugccuagcggggaggugcuugaaacagcagccccaggagucgaggacaucucaggccugccgaguggcgaggugcuagaaacugccgcucccgggguagaggauauuucuggacucccuuccggugaagugcuggagaccgcggcaccaggcguugaagacaucagcggguugcccucaggagagguccuggagacggccgcuccuggcguggaagauauaagugguuuaccaagcggggaggugcucgaaacagccgcacccggagucgaggacauuuccggccugccuucuggcgaaguacuugagaccacugccccggggguggaggaaaucagcggacugccauccggugagguuuuggaaaccacagcucccggcguggaugagauuucagggcucccuucuggagagguccuggaaacuaccgcgcccggcguggaggaaaucaguggucuaccaucgggggagguucuggaaacgagcacauccgccgugggcgaccuuucuggacucccuucaggcggggagguccuggagauaagcguguccggaguagaagauaucagugguuugcccucuggcgaggugguugaaaccagcgcaucagggauugaggacgucuccgaacugccaaguggagagggcuuagagacuagcgcuucugguguggaagaccucucccgccugccgucaggggaggaagugcuugagaucagcgccucgggcuuuggagaucugucuggcuugccuagugggggagaaggucucgagacauccgcaagcgaggucggcaccgaccugucagggcuacccuccggacgggaaggccuggagacuucugccagcggugcugaagaucuuagugggcucccauccggcaaggaggaccugguuggaagcgccucuggcgauuuggacuuagggaagcugcccucaggaacacucggcaguggucaggcgccugagaccuccgggcugccaagcggauucucuggcgaauauucggguguggaucuuggcucagggcccccuagcggacugccggacuuuuccggcuugccaaguggguuccccacgguaucucuaguggauagcacucuggucgaggugguuaccgcauccacagccucagaacucgagggaagaggcaccauugguaucaguggggcuggagaaauaucuggccugccuagcuccgagcuugacauuucagguagggccagcggcuuaccaucugggacagagcuguccggacaggcuaguggcagccccgaugugucgggggaaaucccuggacucuuuggcgucuccggucagcccucuggguucccagacacuucaggagagaccagcggcguaacggaauugaguggccuguccucugggcaaccgggaaucagcggugaggcaucaggcgugcucuacgggacaucccagccuuuuggaauuacugaucugaguggcgaaaccagcgguguucccgaccuuucugggcagccaucaggacugccuggcuucuccggcgccacaagcggggugcccgacuuggucucuggaaccacuagugguucgggcgaguccagcgggaucaccuucguggauacaucacuagucgagguggcuccaacgacuuuuaaagaagaggaaggacugggcucuguugagcucagcgguuuaccuuccggggaagccgaccugaguggaaagucaggcaugguggauguaucuggccaauucagcgggaccguggacuccaguggauuuacaagccagacccccgaguucuccggucuuccgucuggcauugcagaggucucaggggaaagcucgcgagcggagauaggauccagucugccaucuggcgccuacuaugguagcgggacuccuucauccuuucccacaguuucucucguggaucgcaccuuggucgaaagugugacgcaggcuccaacugcccaggaggcaggagagggccccagcggcauccuggaacucuccggggcucauucaggagccccugacaugagcggugagcacucuggcuuccuggaucuuagugggcuacaauccggacugauugaaccgagcggcgagccacccgguacaccuuacuuuucaggggacuucgcaucuaccaccaacguauccggagaaucgagcguggccaugggcacuaguggcgaggcuucuggguugcccgagguuacauuaaucaccuccgaauuuguggagggagucacagaaccaacuauuagccaggagcugggucagcggccucccgugacgcauaccccacagcucuucgaaucaaguggcaaagucuccacagcgggggauaucagcggagccacuccugugcugccgggcucugguguugagguaucaagcgugcccgaguccucuagugaaaccucggcauauccagaggcuggguuuggagccagcgccgcaccugaagcuuccagagaggacucaggcucucccgaucuuagcgaaacaaccagugccuuccacgaggcgaaccuggagagguccucaggccucggggucucuggaagcacuuugacguuccaagaaggugaggcuuccgccgcaccagaagugaguggcgagagcaccacaacuucugacguugggaccgaggccccuggacugcccucagcuacaccgaccgcauccggcgaucguacugaaauaagcggugaccuaagugggcauacaucucagcugggcguggucaucuccacgucgauuccagagagcgaauggacccagcagacucaacgcccugccgagacacaccucgaaaucgagucauccucucuucuguacaguggagaggaaacccacaccguggagacagcgacuagccccacggacgcuucaauuccagccucccccgaauggaagcgggagagcgaaucuaccgcagccgaucaggagguaugugaggaaggcuggaauaaauaucaggggcauugcuacagacacuuuccugacagggagacauggguggaugcugaacgacggugucgcgagcaacagagucauuuauccagcaucguuacucccgaagagcaggaguucgucaacaauaacgcccaggacuaucaauggauaggauugaaugauagaaccauugaaggugacuuuagguggucagauggccacccaaugcaguucgagaacuggcggccuaaucagccggacaacuuuuucgcagcuggggaagauugcguggugaugaucuggcacgagaagggagaguggaaugacguccccuguaacuaccaucugccauuuacaugcaaaaagggcaccgccacuacguacaagcgaagacuccagaaacgcucuucgaggcacccucgucggagcagacccuccacagcgcauuga

SEQ ID NO: 52332 - RNA, 1284 nt, Artificial Sequence
  derived and/or modified sequence opt3 from ACAT1__Homo_sapiens__NP_000010
auggccgugcuggcugcacuccuuagaagcggcgccaggucccggucuccccuguugcgccgauuaguccaggagauccguuacguugaaagaucauaugugaguaagccuacccugaaagagguagugauugucagcgcgacaaggacuccaauaggguccuuccuaggaucucucucgcugcuuccggcuacgaagcuggguucaaucgccauucaaggcgcaaucgaaaaagccgggauucccaaggaggaagugaaagaggcuuacaugggaaacguuuugcagggcggugaggggcaggcaccuacccggcaggccgugcucggagcuggccugccaaucagcacacccugcacuaccauaaauaaggucugugccaguggcaugaaggcgaucaugauggcaucccaaucucugaugugcgggcaccaggacgugaugguagccggagguauggaaagcauguccaacguuccuuaugugaugaaucgcggcucaacaccauacgggggagucaaacucgaggauuuaauugugaaggacggccugaccgauguguauaacaaaauccauauggguaguugugcugaaaauacugccaagaaacuuaacauugcaagaaaugagcaggacgcuuacgccaucaacagcuauacaaggucuaaggcggccugggaggcagggaaguuuggaaaugaagucauacccguuaccgugacgguaaaaggccagccugauguggucgugaaggaggacgaagaguacaaacggguugauuucuccaaggugccaaaauugaagacugucuuucaaaaagaaaacggcaccgugacagcugccaaugcuucaacucugaacgacggggccgcagcccuaguacucaugaccgcugaugcggcaaagcgccugaauguuacaccgcuugcccgaauuguggcuuucgccgacgcagccgucgagcccaucgauuuuccuauugcuccaguguacgccgcaagcaugguccugaaggacgugggauugaaaaaggaggauaucgcgaugugggaaguuaacgaggcuuucagucucgugguacuggccaauaucaaaauguuagaaauugacccccagaaggucaacauaaacgguggcgcagugucucuggggcacccuaucggaauguccggcgccagaauuguuggucaucucacccacgcucuuaaacagggggaguauggccuggccagcaucugcaauggaggcgggggagcaucggcuauguugauacagaagcuauga

SEQ ID NO: 52333 - RNA, 1281 nt, Artificial Sequence
  derived and/or modified sequence opt3 from ACAT2__Homo_sapiens__NP_001290182
augggcagccaccccgugcugagaaucugggggaacaggcgggccaccgcugcaucccucggacgcucugguggccgacuuucaaguccucgucuguugagagucguugccccaacauuaacuuucgcgcagacguccaggugcagcuuuaauggggcucuggccgcagugccgguacaagaccuaggaucuaccgugauuaaggagguccucaaacgggccacaguggcucccgaagauguuucggaggugauauucggccauguccuggcagccgguugugggcagaacccugugcgccaggcuucaguaggagccggcaucccauacagcguucccgcguggaguugccagaugauuuguggcuccgggcuuaaggcagugugccuggccguccaaucuaucggaauuggugacagcuccaucgugguggcuggcgggauggaaaauaugucaaaagccccucacuuggcauaucucagaacuggagucaagauaggcgagaugccacugaccgauaguauccugugugacggucucacagaugcuuuucauaacugccacauggggauuaccgccgaaaauguugcgaaaaaguggcaagugagcagggaggaccaggauaagguagccguguuaucucagaaccggacugagaaugcacagaaagcuggacauuucgacaaggaaaucguccccgugcugguuuccacacgcaaaggccuuauugaggugaagaccgaugaauuuccucgacacggcucaaacaucgaggccaugagcaaauugaagccauacuuccugacggacgggacuggaaccgucacaccggcuaaugccagugguauaaacgauggcgcagccgcugugguacuaaugaagaaaucugaggcggacaagagagggcucacuccccuggcaaggauuguuuccuggagccaggugggagucgaaccuucgaucaugggcauugguccaauccccgccaucaaacaggcugugaccaaggccggguggucucuugaggaugucgacauuuuugaaauaaaugaggcauucgccgcuguguccgccgcaaucguuaaagaacugggcuugaacccugagaaggugaauauugagggaggcgcgaucgcucucgggcacccacugggagccucagguugucggauauuaguaacacugcuccauacccuugaacguaugggccgcaguagaggggucgcagcccugugcauuggaggcgguauggggaucgcuaugugugugcagagggaguga

SEQ ID NO: 52334 - RNA, 1587 nt, Artificial Sequence
  derived and/or modified sequence opt3 from ACBD3__Homo_sapiens__NP_073572
auggccgcugugcugaacgcagagagacucgaagucagcguugacggccuuacccugucccccgauccugaggaaaggccaggggccgagggagcgccguuguuacccccuccacugcccccuccaucucccccugguucaggccgggggccaggagcuaguggcgaacagccggagcccggugaggccgcagccgggggagcugcagaagaggcccgccgacuagaacaacguuggggcuucggccucgaggagcuguacgggcuugcucugagauuuuucaaggaaaaagacggaaaggccuuucacccuacauaugaggaaaaauugaagcucguggcgcugcauaaacagguacugauggguccauacaaucccgauacuugcccugaggugggcuucuuugacguccucgggaacgauaggcggcgcgaaugggcagccuuaggaaauaugagcaaggaggacgcuaugguggaguucguuaagcugcuuaacagauguugccacuuguuuuccacguauguggccucucauaaaaucgaaaaggaggaacaggagaaaaagaggaaagaagaggaggaacggcgccgaagagaggaagaggaaagggagcggcugcagaaggaggaagagaagcgucgcagagaagaggaggaaaggcuacggcgagaggaagaggaacgcagaaggauugaggaggaacggcuccgccuggagcaacagaaacagcagauaauggcagcucuuaauucgcaaaccgccguccaguuccagcaguacgcggcccaacaguauccaggcaacuacgaacagcaacagauccugauuagacaguugcaggagcaacacuaucagcaguacaugcagcaacucuaccaggugcagcuggcacagcaacaggcugccuuacagaagcagcaagaaguaguuguggcugguucaagccugcccacaaguuccaaagucaaugccacugugccgucuaacaugaugagcgugaaugggcaggcaaagacccauacagauuccucagagaaagagcucgaaccugaggccgcugaagaggcgcuugaaaacggacccaaggagagucugccagucaucgcagccccuagcauguggaccaggccccagauuaaagacuuuaaggagaagauccaacaggaugcugacucuguuauaacugugggccguggcgaaguagugacaguccgggugccaacccacgaggaaggguccuauuuguucugggaguuugccacggauaauuacgacaucggauucgguguuuauuuugaguggacugauucacccaacaccgcagugagcguccacgugagugaaucuuccgacgacgaugaggaagaggaagagaauauuggcugugaggaaaaagccaagaaaaacgcuaauaagccucuacuggacgagaucguaccaguuuaccgaagagauugccaugaagagguguaugccgggagccaccaguacccgggaaggggcgucuaucuccugaaauucgacaacucguacucucuuuggcgcuccaagucaguguacuaucgggucuacuauacaagauga

SEQ ID NO: 52335 - RNA, 1026 nt, Artificial Sequence
  derived and/or modified sequence opt3 from ACBD4__Homo_sapiens__NP_001129176
augggcaccgagaaggaaagccccgagccugacugccagaaacaauuccaggccgcuguguccgucauccagaaccugccaaagaaugggucuuacagaccgucauaugaagagaugcucagguuuuacaguuauuacaaacaggcaacaaugggacccugucuuguuccucggccagguuucugggaucccauuggccgcuauaagugggacgccuggaacagccuggggaaaaugucccgagaagaggcgaugucugcuuacauaacugagaugaaguugguggcccaaaagguaaucgauacggugccuuuaggagaagucgcagaggacauguuuggcuauuucgaaccacuguaccaggugauucccgauaugccucguccaccggagaccuuucuaagaaggguuacagguuggaaagaacagguggucaauggggacgugggagccguaucggagcccccuugccucccaaaggagcccgcuccuccaucacccgcaagccugugggccguuacucuuccgaccccuccccagaguccaauccacccuggcacauggacccccagauucuccgugauuccauggucuagcuggucccugucaugguuuggccaaaguagcgggcagcauuuggaagagucugucauccccggaacugcuccuuguccaccgcagcgcaaaagagguugcggcgccgcgaggcgggggccccgcuccuggacauguggaugcuggggccaguucgaacacuaccgacgggcauguaggcggugccgucgcgguuguagagccuggagggcuugcccugggccacucucacggggacgaagccccggcccugugcugggccaugggccacugggaagucgcggucccagauguucuuccagcucgugcggcccgucuuccucaagugggagcuccgagugcuuuggaccuaagaggggcgauugucaauggcggggucucugcucucaguuacgccugagcuguugcgcccuuucauugccaagaguguga

SEQ ID NO: 52336 - RNA, 1473 nt, Artificial Sequence
  derived and/or modified sequence opt3 from ACBD5__Homo_sapiens__NP_001035938
auggccgacaccagaagcgugcacgagacaagguucgaagcugcagucaagguuauccagucccugcccaaaaacggcucuuuucaaccuacuaaugagaugaugcucaaguucuacucauuuuauaaacaggccacggaagggccaugcaaacuuagucggccgggauucugggaucccauuggucgcuacaagugggacgcguggagcucccugggcgauaugaccaaggaggaagcuaugauagccuauguggaggagaugaagaaaaucauugaaacaaugccuaugacugagaagguagaagaguuguuacgagugaucgggccauuuuacgagauugucgaagacaaaaagucuggacguucgucagauaucaccagcgaccugggcaacgugcuaacaaguacccccaaugcaaaaacuguuaacgguaaggccgaguccucugauagcggggcugaauccgaggaagaggaggcacaggaagaggugaagggagccgaacagucagacaaugauaaaaagaugaugaaaaagagugcugaccauaaaaaccucgaggucauagugacaaauggcuaugauaaggacggcuucguacaagauauccagaacgacauucacgccucuagcucccugaaugggagaucaaccgaagagguuaaaccuaucgacgagaaccuuggacagacggguaagagcgcgguguguauucaucaggauaucaaugacgaucacgucgaagacgugacuggcauacaacaucugaccagugauucugacuccgagguguacugcgauagcauggaacaguuugggcaggaggaaucguuggacucuuucacauccaacaauggaccauuucaguauuaccucggcggucacucaagucaacccauggagaacagcggguucagggaggauauucaggucccuccaggaaauggcaacaucggcaacaugcagguuguggcaguagaagggaagggagaggugaaacacgguggcgaagacgggcggaauaacuccggagccccgcaucgcgagaagagaggcggugagacugaugaauuuucuaaugucaggcgggggcgcggccaccgaaugcaacaucugagcgagggaaccaaaggcagacagguggggucaggaggugacggcgaaaggugggggagugaccggggaucccguggcagccugaacgagcagauugcucucguuuuaaugcgccugcaggaagauaugcaaaaugugcuucagagauugcagaagcuggagacacuaaccgcccuccaggcaaaaucuucaacgaguacucugcaaacagcuccccagccuaccagccagaggccauccugguggcccuucgagaugucuccugguguccuuacuuuugccaucaucuggccauucauugcgcaguggcugguguacuuguauuaccaacggcgacgcagaaagcucaacuga

SEQ ID NO: 52337 - RNA, 849 nt, Artificial Sequence
  derived and/or modified sequence opt3 from ACBD6__Homo_sapiens__NP_115736
auggccagcuccuuccugcccgcuggcgcaaucaccggggacucuggaggugagcucucaaguggcgaugacagcggggaaguggaguuuccucacuccccagaaauugaggaaacaucuugccuugccgagcuguucgagaaggcggcugcccauuugcagggauuaauacaagucgcaucgagagaacagcugcuauaccucuaugccagguacaaacagguuaaggugggcaacuguaauacuccgaaacccucauuuuucgauuuugaggguaagcagaaaugggaggcuuggaaggcacugggggacagcaguccuucccaagccaugcaggaauauaucgcuguagugaagaaacuugauccaggauggaacccccagauuccugagaagaaaggcaaggaagccaauacgggcuucgggggaccagucaucucuagccuguaccacgaggaaaccauucgggaggaagacaaaaacaucuuugauuauugccgcgagaauaacauagaccauaucacaaaggcgauuaaguccaaaaauguggauguuaacgugaaggacgaggaaggucgagcauugcuccacugggccugugaucguggccauaaagagcuggucacugugcugcuccagcacagagcugacaucaauugccaagauaacgaagggcagaccgccuuacacuacgcaucagcuugugaguuccuggacauuguagaacuuuugcugcagaguggagccgaccccacacuaagggaucaggacggcugccucccugaggagguuaccgguuguaagacugugagccugguccuucaacggcauacaaccgggaaagcguga

SEQ ID NO: 52338 - RNA, 1506 nt, Artificial Sequence
  derived and/or modified sequence opt3 from ACCS__Homo_sapiens__NP_115981
auguucacccugccccagaaggacuuuagagccccuacaacuugccucggcccaacguguaugcaagaucuugggagcucccacggagaggaccuggaaggugagugcucuaggaaauuggaucagaaguuaccggaacugcggggcgugggggaccccgcuaugaucucaagugauaccagcuaccuauccucucgcggacgaaugauuaaaugguucugggacucggcagaggaaggcuaucguacauaccauauggaugaguaugacgaggauaagaacccuucagguauaaucaaucucgggacuagcgaaaacaaacuguguuuugaccuucugaguuggagauugucccagagggauaugcagcgggucgagccaucucuccugcaauacgccgacuggcgcggacaccuguuccucagagaagagguugcgaaguuucugagcuucuauugcaagucccccgugccuuuaaggccagagaauguagugguccuuaacggcggcgcuucauuguuuagugcccuggcaaccgugcuaugugaagccggggaggcuuuccucauucccacaccuuacuauggagcaaucacccagcauguuugccuguacgguaauauucggcuugccuacguguaucuggauagcgaagucacuggcuuggacacacgcccauuucagcucaccguggagaaacuggaaauggcuuuacgagaggcccacucugaggggguaaagguuaaaggacugauccucauauccccgcagaacccccuuggcgacguguacucaccugaagaacugcaagaauauuuggucuucgcgaagagacauaggcuacacgugaucguggaugaggucuacaugcugagcguuuuugagaaaaguguggguuaucggucuguacucucccuggagcgucuuccagacccccagcgcacgcacgugaugugggcaacuagcaaggauuucgggaugucgggacugagauuuggcaccuuguacacagagaaucaggacgucgccacugcuguggccucucucuguagguaucauggccuguccggguuaguucaguaccaaauggcacagcugcuacgggaucgagacuggauuaaccagguguaccucccugaaaaucacgcucgccugaaggccgcgcauaccuaugucucagaggaacuuagagccuugggaaucccauuccugaguaggggugcaggcuucuuuauuuggguggaucuccggaaauaccugcccaaggggacauucgaggaagagaugcuucuguggcgcagauuuuuggacaacaaaguacuccugagcuucggaaaggcuuuugagugcaaagaaccgggcugguucagguuuguuuucuccgaucaagugcaccguuuaugucuggguaugcagcggguccaacaggugcuagccgggaagucucaggucgcugaggacccucgacccagccagucacaggaaccaagugaucagagaagguga

SEQ ID NO: 52339 - RNA, 1635 nt, Artificial Sequence
  derived and/or modified sequence opt3 from ACD__Homo_sapiens__NP_001075955
augcccggcagaugccagagcgacgccgcuaugagggugaacgggccugcaucccgggccccagcgggauggaccucugguucacugcacacaggcccgcgcgcugggcgaccccgugcccaagcaagaggagucaggggccggggucuccuucugcgcccuagaccagccaaggaguugcccuuaccuaggaaagggggagcuugggcaccagccggcaaucccggcccucugcauccacuagggguugcugugggaauggccgguaguggccggcucguacugcgcccguggauccgagaacuuauucuggggagcgagacucccuccucuccuagagcgggacaguugcucgaagugcugcaggaugcagaggccgcugucgccggcccaucgcacgcacccgacacgucagaugugggugcuacccugcucguuagcgacgggacacauagugugagguguuuagucacucgggaagcccuggauaccuccgacugggaggagaaggaguucggauuucguggcacagagggccgccuuuugcugcuacaggauugcggggugcacguacaaguugcggaaggaggugccccugcagaguucuaccuccagguggacagauuuucucugcuuccaaccgagcagcccaggcugcgggucccgggcuguaaccaggauuuggacgugcagaaaaagcucuaugauugccuggaagaacauuuaagcgaauccacuucaaguaaugcugggcugagccucucucaacuucuggacgagaugcgagaagaucaggagcaccagggagccuuggugugucuagcugaguccugccugacacucgaaggcccuuguaccgcacccccagucacgcacugggccgccucacgcugcaaagcuacuggugaggcgguuuacaccgugccuagcaguaugcuguguauaucugaaaacgaccaacuuauccuguccagcuuggggcccugccagagaacacagggcccagagcugcccccuccagacccggcacuccaagauuuaucgcugacucuaauugccucucccccuuccucaccaaguagcuccggaacccccgcucucccuggccauaugucuagcgaagagucagggacaaguaucucccugcuuccagccuugagccuggcagcccccgacccgggacagaggucuucaagucagccuagcccagcuauuuguuccgcccccgcaacccucacgccucggucuccccacgcgucgcgcacuccaagcuccccucugcagucaugcacacccagucuuucuccaagaagccauguaccguccccucaccaagcucuggugaccaggccccagaagccaucauuggaguucaaggaauuugucggucuccccugcaaaaaucguccuccauucccccggacuggcgccacacgaggggcacaggagccuuguagcgugugggaaccgccaaagagacacagggauggaucugccuuucaguaugaguacgaacccccuugcaccucccugugugcucgcguucaagccgugcgguuaccaccccagcugauggcaugggcucuacauuuccucauggacgcccagccuggcagugagccgacgcccauguga

SEQ ID NO: 52340 - RNA, 2418 nt, Artificial Sequence
  derived and/or modified sequence opt3 from ACE2__Homo_sapiens__NP_068576
augagcuccucuucauggcugcuccuuagucugguggccgucaccgcugcacagagcacaaucgaggaacaagccaagacuuucuuggacaaauuuaaccacgaggcggaagauuuauucuaccaguccucucuggcuucguggaauuauaacacgaauauuaccgaggaaaacguucagaauaugaacaaugccggcgacaaguggucagcauuucuaaaagagcagagcacacucgcccaaauguacccccugcaggagauacagaaccuuacugugaagcugcaguugcaagcucuccagcagaaugggaguuccguacugucugaagauaaaagcaagagacugaacaccauccucaauacaauguccaccauuuauucaacuggaaaggugugcaacccugacaauccacaggaguguuuacugcuugaaccggguuugaacgagaucauggcaaauagucuggauuacaacgagaggcuaugggccugggaaagcuggcggucugaggucggcaaacaacuccgcccccuguaugaagaguacgugguucuuaagaacgaaauggcucgagccaaucauuaugaggacuacggggauuacuggcguggagacuaugaggugaacggcgucgaugguuacgacuauuccagagggcagcugauugaagauguggagcacacauucgaagagaucaaaccuuuguacgaacaucuccacgcguauguaagggcaaagcugaugaaugccuacccaucauauauaagccccaucggaugcuuaccugcucaucugcucggcgacauguggggccgguuuuggaccaaccuuuacagucugacgguuccauucgggcagaaacccaauauugaugugacugacgccauggucgaccaagcaugggaugcucagcgcaucuuuaaggaggccgagaaguucuuugugucugugggauugccuaacaugacccaggguuucugggaaaauuccaugcuaacagacccaggcaacguccagaaagcgguuugucacccgacugccugggaucuggggaagggagacuuuaggauucucaugugcaccaaagugacaauggaugacuuccugaccgcacaccaugagaugggccacauccaauacgauauggcuuaugccgcucagcccuuucuucugagaaauggugccaacgaaggguuccaugaggcaguaggagaaauaaugagcuugucggccgcuacgccuaagcaccucaaaucuauuggccuguuauccccagacuuccaggaggauaaugagacugaaaucaacuuucugcuaaagcaggcgcucacaauugugggcacccugcccuucacuuacaugcuugagaaauggcgguggauggucuuuaagggggaaaucccuaaggaccaauggaugaaaaaguggugggagaugaaacgcgagaucgugggaguuguggaaccagucccccacgaugagacauauugugacccggcaucauuguuccaugugaguaaugacuacagcuuuauucgauauuacaccagaacgcuguaucaguuccaguuucaggaagcccucugccaagcugccaagcacgaggguccucugcauaaaugugauauauccaacucuaccgaagcaggccagaaacuuuucaauaugcugagguugggaaagagcgagcccuggacacucgcccuggagaacguaguuggggcuaaaaacaugaaugugcggccauuacugaacuacuuugaaccucuauucacuuggcucaaggaccagaauaaaaacucauuugucggcuggaguaccgauuggucccccuacgccgaccagagcaucaaggugcguauuucucugaaaucagcacuuggugauaaggcguaugaguggaaugacaacgaaauguacuuguuccgcaguagcgucgcuuaugccaugagacaauacuuucugaaggugaaaaaucagaugauccucuucggggaggaagauguuaggguggcaaaccugaagccacggauauccuucaauuucuucguaacagcccccaaaaacgucucugacauuaucccucgaacugagguggagaaggcuauccgcaugucgagaagcaggauuaaugaugccuuucgguuaaacgacaauucccuggaauuucuuggcauccagccaaccuugggaccgcccaaccaaccuccaguuucaauuuggcucauaguguuuggcgucgugauggggguaaucgugguuggaauugucauccugaucuucacagguauucgcgauagaaagaagaagaauaaagcaaggaguggcgagaaccccuaugcuucuauagacaucagcaagggggaaaacaauccuggauuucagaacaccgaugacgugcagacuuccuucuga

SEQ ID NO: 52341 - RNA, 3921 nt, Artificial Sequence
  derived and/or modified sequence opt3 from ACE__Homo_sapiens__NP_000780
augggcgccgcuagcgggagaaggggacccggucugcuccuuccucugccauuguuacugcuacucccgccccagccugcacuggcccuugacccaggccugcaacccgggaacuucuccgcggaugaggcuggagcccaguuguuugcacagucuuacaauucaagugccgaacaggugcucuuucaaagcgucgcugcauccugggcccacgacaccaacaucacagcugagaaugcccggcgccaggaagaggcggcacugcugucucaggaauuugccgaggcuuggggccagaaggccaaagagcucuaugaaccuauuuggcaaaacuucacugauccacaguuacgacguauaaucggugcaguuagaacgcuggggucggcuaaucuucccuuggccaagaggcagcaguacaacgcgcugcuaucaaauaugagccggauuuauaguaccgccaaagugugccucccuaacaagacagcaacuuguuggucccuggacccagaucuuaccaauauccuggcuucuagccgcuccuacgccauguugcucuuugcuugggagggauggcauaacgccgcaggcauuccgcugaaacccuuauaugaagacuucacagcccugucaaaugaggcuuacaagcaagauggcuuuaccgacacuggggcguauuggagaaguugguacaacagcccuacauucgaggaugaccucgaacaccuuuaccagcagcuggagccauuguaucuaaaucugcaugcauuuguaaggcgggcccuccaccgccgauacggagauagauauaucaaccugaggggucccauaccugcucaucuucugggcgacaugugggcccaaucuugggaaaauaucuacgauaugguggucccauuccccgacaagccgaacuuggacgugaccuccacgaugcuccagcagggguggaacgcaacucacauguuucggguugccgaggaguucuuuaccucacuggaauuaagcccuaugcccccagaguucugggaaggaaguaugcuggagaaaccugcugauggccgugaaguggucugccacgccucugcaugggacuucuauaaucgcaaggauuuuagaauuaaacaguguacaagggugacuauggaccaacuauccaccguacaucacgagaugggucauauccaguacuaucuccaguacaaggaucugcccguuagccuucggcgaggggcgaacccaggauuccacgaagcuauuggcgacguguuggcccugucggucucuacacccgagcaccuccauaaaaucggccugcuugaucgcgugaccaaugacacggaguccgauauaaacuaccuguugaagauggcacucgaaaagauugccuuucugccuuucggguauuuaguggaccaguggagauggggagucuuuucagguaggacuccaccgagucgguacaauuucgauuggugguaucugcgcacaaaauaccaaggcaucugucccccuguuaccagaaacgagacucacuuugacgcuggggccaaguuccaugugccaaauguaacacccuauauuagguacuuugugagcuucguccuacaguuucaguuccacgaagcacucugcaaagaggcuggauaugaaggcccucugcaucagugcgacaucuaccguuccaccaaggccggugcgaaacuucggaagguguugcaagccgggucuagccgaccauggcaggagguucugaaagauauggugggccucgacgcucuggaugcacagcccuuacugaaguacuuucagccggucacgcaauggcuucaggagcagaaccaacagaauggagaaguguugggcuggccugaguaucaguggcacccaccccucccugacaacuaccccgaagggaucgaucugguaaccgacgaggccgaggcuucaaaguucguugaagaguaugauagaacaagucagguggucuggaaugaauacgccgaggcaaacuggaauuauaacacuaauauuaccacagaaacuuccaaaauacuacugcaaaagaacaugcagaucgcgaaccacacccucaaauacggaacacaggccaggaaguucgacgugaaucagcugcaaaacaccacuauuaaacgcaucauaaagaagguccaggaucuugagcgggcugccuugccagcacaggagcuggaagaguauaauaaaauuuuacucgacauggaaacgacauacagcguggcuaccguuugucauccuaacgguucuugccugcagcuugagcccgaucugacuaaugugauggccaccucaagaaaguacgaagacuugcucugggcaugggagggcuggagggauaaagccgggcgcgcuauccugcaauuuuauccaaaguacguagagcuaaucaaccaggcggcccgacugaauggauaugucgacgcaggcgacaguuggcggagcauguacgaaacaccgucccucgagcaggaucuggaacgucuuuuccaagaguugcagccucuguauuuaaaccuccacgcuuacgugagaagggcccugcaucgccacuauggugcccagcacauuaaucuugaagggcccaucccagcucaucugcuaggcaacaugugggcacagaccuggucuaauauuuacgaccucguugugcccuuuccuucggccccaagcauggauacuacagaggcgaugcugaaacaaggauggacgccccggagaauguucaaggaggcugacgauuucuucaccuccuugggccuguuaccugucccgccagaauuuuggaacaagucaaugcucgagaaacccacugacgggagggaagugguaugucacgccagugcaugggauuucuacaauggaaaggacuuucgaauaaaacagugcacaaccgugaaccuggaggaucuuguugucgcccaucacgagaugggucauauccaguauuucaugcaguacaaggaccugccuguggcuuugcgcgaaggcgcaaauccaggguuucacgaggccauuggagaugugcucgcgcugucugucagcacacccaaacaccuacauucccugaaccuucucucaagcgaaggcgguucugacgagcacgauaucaacuuccugaugaagauggcuuuggacaagaucgccuuuauuccuuucuccuaucugguugaccaauggcgguggagaguguucgaugggaguauaacuaaagaaaauuacaaccaggagugguggagcuuaaggcucaaguaucagggccuguguccgcccgugccacguacccagggagacuuugauccuggcgcaaaauuccauauccccucuuccguaccauacauucgcuauuuugucucauucaucauucaauuucaguuccacgaggcccuuugccaggcugccgggcauacgggaccucugcacaagugcgacaucuaccagaguaaagaagcaggccaacgguuggcuaccgccaugaagcucgguuuuagcagacccuggccagaggcgaugcagcugauaacagggcagccgaauaugucggccuccgcaaugcuaucuuacuucaaaccucugcuugauuggcucaggacugaaaacgagcugcacggagaaaaguugggcuggccccaauauaauuggaccccaaacagcgcucgaucagagggucccuuaccugacaguggccggguguccuuucuggggcucgaucuggacgcccagcaggcucgcguuggacaguggcuucuguuguuccuaggcaucgcacugcucguggccacacuggggcuuucucaaagauuauuuagcauuaggcaucggucccugcaccgacauucacacggaccacaguucggcagcgaggucgaacucagacacaguuga

SEQ ID NO: 52342 - RNA, 828 nt, Artificial Sequence
  derived and/or modified sequence opt3 from ACER2__Homo_sapiens__NP_001010887
augggcgcuccccacuggugggaccagcugcaagccgggagcuccgagguggauuggugcgaagacaacuacaccaucgucccugcaauugccgaguucuauaauacaauaucuaacguucucuuuuucauccuuccaccgauuuguaugugccuguuuagacaguacgcgacuuguuucaauucaggaaucuauuugauuuggacguuacuggugguaguggguaucggcagugucuacuuucaugcuacccucagcuuccuagggcagaugcuggaugaacuugccgugcuguggguuuugaugugcgcacucgccaugugguuucccaggcgguaucugccuaagauauuccgcaacgaccgaggacguuuuaaaguggucguguccguacugucugcuguuacaacuugucucgcauucgugaagccagccaucaauaacauuucguuaaugacccugggcguccccugcacagcucuuuugaucgccgagcugaaaagaugugauaauaugaggguguuuaagcuaggucucuucucagggcugugguggacccuugcgcuguuuugcuggauuagcgaccgggcauucugugaauugcucaguuccuucaacuuuccuuaccugcacugcauguggcauaucuuaauaugucuggccgcuuaucucggaugcgugugcuucgccuacuuugaugcagcuucugagauuccagagcagggccccgucaucaaauucuggccuaaugaaaagugggccuuuauuggcguuccauacgugagccuucugugugcgaacaagaaauccucaguaaagaucacuuga

SEQ ID NO: 52343 - RNA, 693 nt, Artificial Sequence
  derived and/or modified sequence opt3 from ACER3__Homo_sapiens__NP_001287882
auggcccccgcugcagacagagagggcuacugggggccuaccacaagcacucuggauuggugcgaagagaacuauuccgugacgugguacaucgccgaguuccucgucggaauggguucuugguguuuucacaugacccuuaaguaugaaaugcagcuguuggacgaauuaccaaugauuuacucaugcuguauauucguuuauugcauguuugaguguuucaaaaucaagaauagugugaacuaccaucugcuauuuacacucguacuguucagccuuauugugacuaccgucuaucugaaagugaaggagccgaucuuucaccaaguuauguacggcauguugguguucacacucguccugagguccauuuacaucgugaccuggguauaucccuggcugcgggggcucggauacacuucuuuaggcauauuucugcuugguuucuuguuuuggaauaucgauaacauuuucugcgaaucgcugcgcaauuuucguaaaaagguuccuccaaucauugggaucacaacccaguuccaugcgugguggcacauacuaacgggacucggcucauaucugcauauucuuuucagccuguacacucgaaccuuguaucucagauacaggcccaaggugaaauuucuguucggcaucuggccugucauuuuauuugagccacugcggaagcacuga

SEQ ID NO: 52344 - RNA, 1581 nt, Artificial Sequence
  derived and/or modified sequence opt3 from ACHE__Homo_sapiens__NP_001269378
augagacccccucagugccugcuccacaccccaagccuugccuccccgcuguuguuacugcuacucuggcugcuuggcgggggagugggugcugagggcagggaagacgcagagcuguuggucacaguucggggaggacgccuccgaggcauccgucugaagacucccggugggccugugucugccuuccuggggauuccauuugcggaacccccuaugggcccaagaagguucuuacccccugagccaaaacaaccguggucaggcguaguggaugcuacgaccuuucagagugucuguuaccaguauguggacacacucuaccccggguucgaaggaacugagauguggaacccuaaucgggagcugagcgaagauugccuuuauuugaacguuuggaccccauacccccgcccuacauccccaacccccgugcuggucuggauauaugguggcggguuuuacucuggagccucgucacuagacguguaugauggcagauuccucguacaggcagagaggacuguucuggugagcaugaauuaccgggucggugccuuuggguuccuugcucugccgggaagucgcgaagcaccuggcaacgugggcuugcucgaccaacgacuggccuuacagugggugcaggagaaugucgcugccuuugggggagaucccacauccguuacccuguucggugagucugcgggcgcagccagcguggggaugcaucuccuuuccccaccuucaagaggacuguuucacagggcuguauugcagaguggcgcccccaacgguccaugggcaacgguggggaugggcgaagcucggcgucgcgccacucaacuagcgcaucuggucggaugucccccuggcgggaccggagguaaugacacagagcucguggccugccugagaacuaggccagcacagguucuugugaaccacgaauggcauguccugccgcaggagagcguguuccgguuuucuuucguacccguuguggauggcgacuucuuguccgauaccccugaagcucucaucaaugccggggacuuucacggacugcaguuagcuggccgacuggccgcacaaggugcccgcgucuacgcuuauguguucgagcacagagcgucaacacuaagcuggccacucuggaugggggucccccauggcuacgagauugaauuuaucuucggcauuccucuggauccaaguaggaacuauaccgcagaggaaaagaucuuugcccagcggcuuaugcgcuacugggcuaauuucgccagaacgggagaccccaacgagccgagggacccuaaagcaccacaguggcccccuuauacugccggggcucaacaguacgugucuuuggaucugcguccccucgaaguucggcgaggacugagagcccaggcaugugcguuuuggaauagguuccuuccaaagcuguuguccgcuacagacacccucgaugaggccgagcgccaguggaaagcagaauuucaccgguggagcucguauauggugcauuggaagaaccaauucgaccacuacucuaagcaggauagaugcuccgaccuguga

SEQ ID NO: 52345 - RNA, 3987 nt, Artificial Sequence
  derived and/or modified sequence opt3 from ACIN1__Homo_sapiens__NP_001158286
auguggagaaggaagcacccccggaccagcggcgggacacgcggagugcuguccgguaaccgaggcgucgaguacgggucuggacguggccaucucgguacuuucgaagggagauggaggaaacuuccuaagaugccagaggccguuggaacggacccgucaaccagucggaaaauggcugaacuggaggaagugacauuggauggcaagcccuuacaggcacugcgcguaacugaccuaaaagccgcgcucgagcaaagaggccuggcuaagagcgggcagaaguccgcccuugugaaaaggcugaagggagcauugaugcucgagaaucugcagaaacacucuaccccucaugccgcuuuucagccaaacucgcaaaucggugaagagaugucacagaauagcuucauuaagcaguaucuggaaaaacagcaagagcucuuacggcagcgccuggagcgagaagcaagagaggccgcugaacuugaggaagccagugcggaguccgaggaugaaaugauacaccccgagggcgucgcaucuuugcugccuccagacuuucagagcucccuagaaaggcccgagcucgaacugucacggcauaguccucguaagucuucuuccaucucagaggagaagggggauagcgacgaugaaaaaccacgcaagggagagagaaggaguucucgggugcgacaggcccgcgcugccaaacuuuccgaaggcagccaaccggcagaggaagaggaggaccaggaaacacccucgagaaaccugaggguucgggcugaucgcaauuugaagaccgaggaagaggaggaagaggaagaggaagaggaggaagacgaugaggaagaggaaggugacgaugaggggcagaaaucuagagaggccccuauucucaaggaguucaaagaggaaggagaggaaaucccaagggugaagcccgaggagaugauggacgaacguccuaagacucggucccaagagcaggaaguccuggagcgaggcggcagauuuacaaggucacaggaggaagcgcgcaaaagucacuuagcccggcagcaacaggagaaggaaaugaaaaccacgagcccacuggaggaagaggagagagaaauuaaguccucucaggggcucaaagaaaagagcaagucacccaguccgccuaggcuuacugaagaccgcaaaaaggcaucccugguggcuuugcccgagcagaccgccagcgaagaggagacaccaccuccccuacugacuaaagaagcuagcucaccacccccucacccacaacuccauagugaggaagagaucgaaccgauggagggacccgccccuccaguacugauacagcuuagcccaccuaacaccgaugcagacacacgagagcuguugguuucccagcacaccgugcagcucgucgguggccugucuccauuaucgagccccuccgauacgaaggccgaaucaccggcugagaaagugccugaagagagugugcugccccuaguccaaaagucuacucucgcggacuacagcgcacagaaggaucuggagcccgaauccgaccggucagcccagccucuucccuugaaaaucgaggaacuggcucucgccaaggggauuacagaggaaugccugaaacagccaagccuugagcaaaaggagggacguagagcaucucauacccuguugccuucccacaggcucaaacagagugccgauucuagcuccucacgcaguagcucguccucuagcucaaguucccggucuagaagcaggucccccgacucaagcggcagucgaucucacuccccacugcgcagcaagcagcgggauguugcucaagccagaacucaugcaaauccgaggggucguccuaagauggggucgcgcucaacaucugaaagucgguccagaagcaggucucgaagccgguccgcgucaaguaacagccgcaaaucuuuaucccccggcgugucaagagacaguagcaccuccuauacggagaccaaggauccaucuucgggacaggaaguagcuacacccccugugccacagcugcaggucugugagcccaaagaaaggacuagcaccucauccaguucugugcaagcccggcgacuaagccagccugaguccgcagagaagcacguuacacagagacuccagccggaacgcggcucacccaaaaagugcgaggccgaagaggcugaacccccugccgcaacucaaccacagaccucugagacacagaccagccaucugcccgagagugaaaggauccaccauacuguggaggaaaaagaggaggucacgauggacacauccgaaaaucguccugagaacgacgugccggaacccccaaugccuauugcugaucagguaagcaaugacgaucggcccgaggggucuguugaagacgaggagaagaaggaaucaucccuuccaaaaaguuucaagagaaaaaucagcguggucucgaccaagggagugccugccgguaacucugauacugagggcgggcaacccggaaggaaacgccgauggggcgcguccaccgccacaacccagaagaagccaagcauaucaauuacuacagaaaguuugaaagaggcugucguggaccugcacgcagaugacucuagaaucuccgaagaugagacggagcggaauggugacgaugggacccacgacaagggccucaaaauuuguaggacuguuacacaggugguaccggccgaaggacaagagaacggccagcgcgaagaggaagaggaggaaaaggagccugaagcugagcccccagucccaccucaggugagcguugagguggcccugccacccccugcagaacaugaggucaaaaaggugaccuuaggggauacacugacucguagaucaaucagucagcaaaagagcggaguauccaucaccauugacgacccggugcggacggcgcagguuccaucucccccuagggguaaaauaagcaauaucguccacauuuccaaccuugugcgccccuuuaccuugggccagcucaaggaacugcuagggcgaacaggaacucugguggaggaagccuucuggaucgauaaaauaaagucacauugcuuugucaccuacucuacaguugaggaggcuguggccacuagaaccgcacuccacggcgugaaauggccacagaguaacccuaaguuccugugugcugacuaugccgaacaagaugagcuugacuaccaccgggguuugcugguagauaggcccucggaaacgaagacagaggaacaggggauuccacgcccuuuacauccgcccccaccucccccaguccagccuccccagcacccgagagcagagcaaagggagcaggaacgggccgugcgugagcagugggcugaacgcgagcgagaaauggagagaagggagcggacccgcagcgaaagagagugggacagggauaaaguucgggaaggcccacgauccagaucucgcucaagggaccggcguagaaaggagagggcgaaaagcaaggagaaaaaguccgagaaaaaggaaaaggcccaggaggaaccucccgcaaaacuccuggaugaccuuuuucgcaagacuaaagcugccccaugcaucuauuggcugcccuugacagauagucaaaucgugcagaaggaagccgagcgggcugagcgagcaaaagaaagagagaagaggcgcaaggaacaggaggaagaggagcaaaaagaacgggagaaggaagccgagagagaacguaauaggcagcucgagcgggagaaacgccgagaacauucuagagagagggaccgggaacgcgagagagagagggaacgagaucggggagaccgugacagagaucgcgagagggaccgggaaagaggccgcgagagggaucgacgggacaccaagagacacagcaggucacgcucccguaguacuccuguccgggauagagggggaaggcgcuga

SEQ ID NO: 52346 - RNA, 1017 nt, Artificial Sequence
  derived and/or modified sequence opt3 from ACKR1__Homo_sapiens__NP_001116423
auggccagcuccggcuacgugcugcaggcugagcucucucccucaaccgaaaacaguagccaacuugacuucgaggaugucuggaacuccucuuaugggguuaaugacucguuuccugauggagacuacggugcaaaucuggaagccgcggcuccaugccacucauguaacuuguuagaugacagcgcccugccguucuuuauccuaacaagugugcucggcauucuggcauccucuacuguacuuuucaugcuguuuagacccuuguucagguggcagcucugcccuggguggccagugcuggcccagcuggcugucggaagcgcacucuuuuccauagugguucccguguuagccccuggccuggguucaacgcggaguagcgcucuuuguucuuugggguauugcgucugguacggauccgccuucgcgcaggcacugcuacucggcugucaugccucacugggccaccgccuuggggcuggacaagugccaggucugaccuugggccucacaguagggaucuggggaguugccgcacuguuaacucugcccgugacccucgcuagcggcgccaguggugggcuuugcacacugauuuauucuaccgaguugaaggcgcuacaggccacucauacagucgcaugucuggcuaucuuugugcuccugccucuuggacuguucggcgccaaaggcuugaagaaagcucucgggaugggaccagguccguggaugaauauucugugggccugguuuaucuucugguggccccacggcguggucuuagggcuggauuuucuaguucgauccaagcuccugcuuuugagcacgugccuggcacagcaggcccucgaccugcuucugaacuuggcugaagcgcucgcaauacugcauuguguggccaccccuuuacugcuagcucucuucugccaccaagccacucguacccugcuuccaucguugccccugccugagggauggucuucccaccucgauacacugggcucaaaaaguuga

SEQ ID NO: 52347 - RNA, 1155 nt, Artificial Sequence
  derived and/or modified sequence opt3 from ACKR2__Homo_sapiens__NP_001287
auggccgcuaccgcaagcccccagccucuggccacagaggacgcggauuccgaaaacucuucauucuacuauuacgacuaucucgaugagguggcuuuuaugcuuugcagaaaggacgccgucguuaguuucggcaaaguguuucugccaguauucuacagcuugaucuuuguguuagggcuguccggaaaucuacuccugcuuaugguccuguugagguaugugccgcggcgccgaaugguugaaauuuaccuccugaaccuggcaauaucuaaucucuuauuccuggugacucuucccuuuugggguaucucggucgccuggcacuggguguucggcucauuuuuguguaagaugguaagcacgcuguauaccauuaacuucuacagugggaucuuuuucauuuccugcaugucucuagauaaauaccucgagaucguucaugcucaaccuuaucaccgucugagaacaagggcaaagagccuucuguuggccacuauagugugggcugucucccucgccgugucaaucccagacaugguguuuguccagacccaugaaaaucccaaaggaguuuggaacugucacgcggauuucggcggucaugggacaauuuggaagcuguucuuacgguuucagcagaaucugcucggauuccuucugccuuugcuagcaaugaucuuuuucuacagucgcauuggcugcgugcugguaagacucaggccagccggccaagggcgggcucugaagaucgccgcagcucuuguggucgccuuuuucgugcugugguuucccuauaacuugacccucuuccugcacacuuuacuggaccuacagguuuuuggaaauugugaggugagccagcaccucgauuacgcgcugcaggucacagagucuauagccuuccuucauugcuguuuuuccccuauuuuguaugcauucucaagccaccgcuuucgacaauaccugaaggcuuuccucgccgcugugcuggguuggcaucuugccccaggcaccgcacaggccagucugucuuccugcagcgaaucgucuaucuugacggcucaggaggaaaugacugggaugaacgaccucggagagagacaguccgagaauuauccgaacaaagaagauguaggcaauaaaucagcguga

SEQ ID NO: 52348 - RNA, 1089 nt, Artificial Sequence
  derived and/or modified sequence opt3 from ACKR3__Homo_sapiens__XP_005246155
auggaccugcaccucuucgauuacagcgagcccggcaacuuuuccgacaucucuuggccuugcaauucaagugauuguauuguggucgacaccguuaugugcccaaacaugccgaauaagagcgugcuucuguauacauuguccuucauauacaucuuuauuuucguaaucgggaugauugccaacucuguggucguguggguuaauauccaggcuaaaacuacgggauaugauacccauuguuacauauuaaaccuggcaaucgccgaccuaugggugguccucacaauucccguguggguaguuucgcuggugcaacacaaucaguggccuaugggugaacuuacuugcaaggucacccaucugaucuuuucaauuaacuuguucggcagcaucuuuuuccucacauguaugaguguggauagauaucuguccauaaccuacuuuacuaauacaccaucuagcaggaaaaagauggugcggcgcgucguuugcauucugguguggcucuuagcguucuguguaucccugcccgacaccuauuaccuuaaaacggugacuucagcuaguaacaaugagaccuacugccgaucuuuuuauccugaacacucuaucaaggagugguugauugggauggaacuggucuccgugguucuaggauucgccgugccauuuucaaucaucgcagucuucuacuuccuccuggcccgugcuauuagcgcaaguucugaucaggagaagcauuccagcagaaaaauaaucuuuucguaugugguaguuuuccuuguguguuggcugcccuaccacgucgccguguugcucgacauuuuuagcauccugcacuauauaccuuucacaugcagguuagagcaugcucuguuuacugcccuccacgucacccagugucuuucccuggugcauugcugcguuaacccaguguuguacucauucauuaaucggaacuaucgcuacgaacuaaugaaggcguuuaucuucaaauacagugcaaagacaggccugaccaaacucaucgaugccagcagaguauccgagacggaauauucugcucuggagcaaagcacuaaguga

SEQ ID NO: 52349 - RNA, 1053 nt, Artificial Sequence
  derived and/or modified sequence opt3 from ACKR4__Homo_sapiens__NP_848540
auggcccuggagcagaaccaaagcaccgacuacuauuacgaagagaaugaaaugaacggcacauaugauuacucccaguaugagcucaucugcauuaaggaagacgugagagaguucgcuaaagucuuucuucccguuuuccugacuauaguguuuguaaucggguuggcaggaaauucuaugguggucgccauuuacgcguauuacaagaaacagaggacgaagaccgauguguacaucuuaaaccuggcuguugccgaccuacuccugcuuuucacacugccuuuuugggcagugaaugccguccacgguuggguguugggcaaaauuauguguaagaucacuucagcucucuauacccugaacuucguaagugggaugcaguuucuggcaugcauaagcaucgaucgguacguugccgugacaaaggucccaucccaaucuggagugggcaaaccguguuggauuaucugcuucuguguguggauggcugccauucucuuaucgaucccccagcuggucuuuuauaccguuaaugacaacgcgcgcugcauaccuauuuucccacgauaccuugguacuucaaugaaggcauugauccagaugcuggagauuuguaucggguuugugguacccuuccuaaucaugggagugugcuauuuuauuacagcccguacccucaugaaaaugccuaauauaaagaucagcagaccacugaaaguccuucugacggugguuauuguguucaucgucacucaguugcccuacaacauagugaaguucuguagggcuauugauaucaucuauagucucauuaccuccugcaauaugucuaagcggauggacaucgccauucaaguaacagaaagcauagcacuguuucauuccuguuuaaacccuauccuguacguuuucaugggcgcuucauuuaaaaauuacgugaugaaggucgccaaaaaguauggcaguuggcgcagacagaggcagagcguggaggaguucccauuugauucugaagggccgacugagcccaccuccacauucucaauuuga

SEQ ID NO: 52350 - RNA, 3468 nt, Artificial Sequence
  derived and/or modified sequence opt3 from ACLY__Homo_sapiens__NP_001290203
augggcgccggaaagagccccgcugggccuggucagaaaccagacccgggcaagcugcccgcagccggggugcucagaauccuuaggggauccucuggccuguggaaaaagcggcgcgcgcgaaccucagcugagacaggucgugccggguugagugcagccaugagcgcuaaagcaauuuccgaacaaacuggaaaggaguuacuguacaaguucauaugcacgaccucugccauccagaacagauuuaaauaugcuagggucacaccugauacugacugggcccggcuacuccaggaucacccauggcugcuuucgcagaaucugguugugaagcccgaccaauugauuaaacgcagaggcaagcucggccugguaggggugaaccugacccucgauggagucaaaucaugguuaaagccuaggcugggucaggaagcgacagugggcaaggcaaccggguuccuuaaaaauuuucuuaucgagccauucguuccccauagccaggccgaagaguuuuacguguguauuuaugcuacucgggagggagacuacguccuguuccaccaugaaggcgguguggauguaggggacguugaugccaaggcacagaaacuacucgugggagucgacgagaagcugaacccugaagauaucaaaaagcaccuucuggugcaugcuccagaggacaaaaaggagauauuggccaguuuuaucuccggccucuucaauuuuuaugaagaucuguacuucacauauuuagagauuaacccgcugguggucaccaaggacggcguuuacgugcucgaccuugcggccaaaguagaugcaacggcugacuacaucugcaaggugaaauggggagauauugaauuucccccuccauucgggcgcgaggccuaucccgaagaggcuuacaucgccgaccuggaugcaaagucuggugccagcuugaaacuaacucugcucaauccuaagggccgaauauggaccauggucgcugggggaggcgcguccgugguuuauucagacacaauuugugaucuggguggggugaacgagcuugcaaauuacggcgaauauaguggagccccaagcgagcaacagacuuacgacuaugcuaagaccauccugucuuugaugacaagagaaaaacaccccgauggcaagauucucaucaucgggggauccauugccaacuuuaccaaugucgcagccacguucaaagguauagugagggcuauccgggacuaccagggcccgcugaaggagcacgaaguaacuauuuucguucgucgcgggggaccuaacuaccaggagggcuuaagagugaugggugaggucgggaaaacaaccggcauccccauacauguguuuggaacugaaacacacaugaccgccauugucggcauggcacuggggcauaggccaaucccuaaucaacccccaacggcggcucacaccgccaacuuccuacucaaugcaucaggaagcacaaguacucccgccccuucucggaccgcuuccuuuagcgagucgcgagccgaugaaguggcaccagcuaagaaggccaaaccggcgaugccccaggacucuguuccuuccccacgcucacugcaggguaagaguacaacucuuuucagcagacacaccaaagccaucguguggggcaugcaaacaagggcuguacaggggauguuggacuuugauuaugucugcucccgggacgagcccucuguggcagccaugguuuacccuuucaccggagaucauaagcagaaauuuuauuggggccacaaggaaauucugaucccaguguucaagaacauggcugacgccaugcgcaaacaucccgaggucgaugugcucauuaacuuugcaagccugagaucagcguacgacaguacuauggagacgaugaauuaugcccagauaaggacaaucgcuauuaucgccgaagguaucccggaggcacuuacccguaagcugauuaaaaaggcugaucaaaaagggguaacuauaaucggcccugccaccgugggaggcauuaagccaggguguuucaaaaucggaaacacaggcgguauguuggacaauauucucgcauccaagcuguaccggcccgggagcguugccuaugucucucgaucaggaggcaugaguaacgaauuaaauaacaucauaagcagaaccacugaugguguguacgagggcguggcuaucgggggagacagguacccuggcuccacauuuauggaucacguccugcgcuaucaggacacgcccgggguuaagaugauuguggugcuaggagagaucggcgguaccgaagaguacaaaauuugccgggggaucaaggaaggaagacucacuaaaccaauaguauguuggugcauuggcacaugugcgaccauguucucuucggagguccaguuuggucaugccggcgcaugcgcuaaucaggccagcgaaacagccguggcuaagaaccaagcacugaaagaggccgggguuuucgugccuagguccuucgaugagcuuggagaaaucauucagucagucuaugaggacuugguggcgaauggcguuaucgugcccgcucaggaaguaccaccgccuacuguccccauggacuacaguugggcccgcgagcuggggcucauacgaaagccagcaucuuuuaugaccagcaucugugaugaacggggacaggagcugauuuaugccggcaugcccaucacggagguguucaaggaagagauggguauugggggaguguuaggccugcuuugguuucaaaaacguuugccuaaguacuccugccaguucaucgaaaugugccucauggucaccgcugaccacgguccagcaguuucaggcgcccacaacacaauaauuugugcgagagcugggaaagaucuggugagcucucuaacuuccggacugcucaccaucggcgacagguuugggggagcccuggaugcagccgcuaagauguucaguaaagccuuugacagcggcaucauucccauggaguucguaaauaagaugaagaaagaagguaaguugaucauggggauuggacaucgcgugaaaucuauaaacaauccugauaugcggguccagaucuugaaggacuaugugagacagcacuuuccggcaacaccacuguuagauuacgcucucgagguugagaaaauuacuaccuccaagaagcccaaccugauccuuaauguggacggccugauuggcgucgccuucguggauauguugaggaacugcgggucauuuacgcgagaagaggcggacgaauacaucgauauaggagcccucaacgguaucuucguucugggccgcaguaugggguuuauuggacauuaucuagaccaaaaacggcugaagcagggccucuacagacacccuugggacgauaucagcuaugugcugccagagcacaugucgauguga

SEQ ID NO: 52351 - RNA, 1011 nt, Artificial Sequence
  derived and/or modified sequence opt3 from ACMSD__Homo_sapiens__NP_612199
augaagaucgacauucacagccauauacugcccaaagaguggccugaucucaagaaaagauucggcuacgggggaugggugcagcuucaacaccauuccaagggugaagccaaacuguugaaggacggcaaggucuuuaggguugugcgggagaacugcugggauccagaaguacgcauccgagagauggaccagaaaggggugaccguccaggcuuuaucuacagugccgguuauguucucauauugggcaaagcccgaagauacucugaaucuaugucagcuccugaacaaugaccuugccaguacgguggucagcuacccucguagauuugugggacugggcaccuugccaaugcaagcgcccgagcucgcuguaaaagagauggaaaggugcguuaaggagcuggguuucccuggggugcagauuggaacacacgucaacgaaugggaucugaaugcccaggagcucuuuccaguguaugcagccgcugagcgguuaaaauguucccuguucgugcaucccugggacaugcagauggauggccgcauggcaaaguacuggcuuccuugguuggucggcaugccagccgaaacuaccaucgcuauuugcucuaugaucaugggagggguuuuugagaaguucccgaaacugaagguguguuuugcccacgguggcggggcguuccccuuuacaguaggaagaauaucgcacggcuucucaaugaggccugaccuaugcgcacaagauaacccaaugaaucccaaaaaguaucucgguagcuuuuacaccgacgcccuggugcaugauccucuuagucugaaauugcucacugacgucaucgggaaggacaaagugauucugggaacagauuauccauuccccuuaggcgaacuggagccgggcaagcucaucgaauccauggaggaguucgacgaagagaccaagaacaaacuuaaggcugggaaugcccuggcauuuuugggacuagaacggaaacaguucgaguga

SEQ ID NO: 52352 - RNA, 2670 nt, Artificial Sequence
  derived and/or modified sequence opt3 from ACO1__Homo_sapiens__NP_002188
augagcaaccccuucgcccaccuggcugagccucucgacccagugcagccgggcaagaaauuuuucaaucuuaacaagcuggaagauuccagauacgggagguugcccuuuucuauccgggucuuacuggaggcagccauucgcaauugcgacgaguuccuaguuaaaaagcaagauauagaaaacauccuccauuggaaugugacccagcacaaaaacauugaaguaccuuuuaagccagcgcgagugauccugcaggacuucacaggaguccccgcugugguugauuuugccgcaaugcgugacgccgugaagaaacuugguggcgauccugagaagauuaauccagucugucccgcugaccuggugaucgaucauucaauacagguagacuucaacagaagggcagauaguuugcagaaaaaucaagaccucgaguuugaacggaaccgcgagagauucgaauuucugaagugggggagccaggccuuccacaauaugaggaucauuccuccaggauccggcaucauucaucagguuaaccuggaguaucucgcucggguggucuuugaucaagacgguuacuauuacccggacucuuuaguggggacugauucgcacacgaccaugaucgacggacugggcauacuuggcuggggagucggggguauugaggccgaagcggugauguugggccagcccaucucaaugguucugccucaggugauuggguaucgccuaaugggaaaaccacacccccucguaacaagcacugauaucgugcugaccaucacaaagcaucuucgacaggucggcgugguugguaaguucguggaguucuuugggccuggagucgcacaacugaguauugccgacagagcuaccauagccaauaugugcccagaauacggcgcaacugcugccuucuuucccguggaugagguauccaucacauauuugguucagaccggcagggacgaagagaaacucaaguacauuaaaaaguaccugcaggcgguggggauguuccgggauuuuaacgacccgucucaagauccugacuucacgcaggucguggaguuagaucugaaaacugucgugcccuguugcagcggaccaaagcguccucaggacaaaguugccguguccgacaugaagaaggauuuugaaucaugucucggugcaaaacagggcuucaagggguuucaaguagcucccgagcaccauaaugaccacaaaaccuucaucuaugauaacacagaauuuacucuugcccacggaagugucgugauagcugccauuaccagcugcacaaacaccucuaauccauccguuaugcugggcgcagguuugcuagccaagaaagcuguggacgcggggcugaacgucaugcccuacaucaagacgucacucagcccuggcaguggagugguaacuuauuaccugcaggagucuggcgugaugccauaucuuucccagcugggguucgauguugucggauacgguuguaugacaugcaucggcaauagcgggccguugcccgaaccugugguggaggcaauuacccagggagaccucgucgccguuggcgugcugucggguaaccgcaauuuugaggggagagugcauccaaacacuagggcuaauuauuuagccucucccccucugguaaucgcauacgccauugcuggcacaauacggaucgauuucgaaaaggagccacuaggagucaacgccaaaggccaacagguguuccucaaggacauuuggcccacccgagaugaaauccaggcaguugagcgccaguacgugaucccggggauguuuaaagaagucuaucaaaagauugagacggugaaugaguccuggaacgcgcuggcuaccccuucagacaaacuuuucuuuuggaauaguaagagcacauacauaaaguccccacccuucuuugaaaacuugacucuggaucuccagccucccaaaucuaucguugacgccuaugugcugcuuaaucugggagauagcguaaccacagaccacauuucaccagcagguaacaucgccagaaauaguccugcugccagguacuugacuaaccggggccucacaccccgcgaguucaacuccuaugggagcagaaggggaaaugacgcagucauggcucguggcaccuuugccaacauucggcuguuaaaucgauuccugaacaagcaggcgccacagaccauccaucuaccgucuggugaaauacucgauguguuugacgccgcugagagauaccaacaggcagggcugccucuuaucguguuggccggcaaagaguauggagcuggcucaaguagggauugggccgcaaaggggcccuuccugcucggaauuaaagcgguccuggccgaaagcuacgagcgcauccaccgguccaauuuaguuggcaugggugugauuccacuggaauaccuucccggggagaacgcugacgccuugggacucacuggccaggaaagauauacgaucauaauuccugagaaucugaagccacaaaugaagguacaggugaaacuagauacagguaagaccuuucaggcagucaugagguucgacacugauguggagcugaccuacuuucucaacggcgggauccugaauuauaugauucgcaaaauggcuaaguga

SEQ ID NO: 52353 - RNA, 2343 nt, Artificial Sequence
  derived and/or modified sequence opt3 from ACO2__Homo_sapiens__NP_001089
auggcccccuacagccugcucgugaccagacuucagaaggcucugggcgucaggcaauaucacguugcauccguguugugccagcgggccaaaguagcgaugucucauuucgagccuaacgaauacauccacuaugacuuacuggagaagaauauuaacauagugcgcaaacgacuaaaucguccacucacacugucagaaaagaucgucuacgggcaucuugaugacccggcuagucaggagauugaaagaggaaaaagcuaucugagguugcggcccgaucgcguggccaugcaggacgcaacugcccaaauggcuaugcuccaguuuaucuccucuggucugucgaagguugcagugccuucaacgauucacugugaucaucugaucgaggcccaggucggcggggagaaggaccucagaagggcuaaagauauaaaccaggaaguguacaauuucuuagccaccgcgggagcaaaguauggcguagguuuuuggaaaccagggagcggaaucauucaccaaaucauucuggagaacuacgccuaccccggcguucuuuugaucggcacagacagucacacuccuaaugggggaggucugggcgggauaugcauuggagugggcggugcugaugccgucgacgugauggcagggaucccaugggaacuaaagugucccaaagugauuggagucaagcucaccggcucccugucuggcuggagcuccccuaaggauguuauccuuaaaguggcugggauccugacaguaaagggagguaccggcgccauuguggaguaucaugggccaggagucgacucaauaaguugcacuggcauggcgacaaucuguaacaugggugccgagauuggggcaaccacgagcguguucccguacaaucaccggaugaaaaaguauuugucuaaaacuggccgcgaagauaucgcuaaccucgccgacgaguuuaaggaccaucugguucccgauccuggaugccacuacgaccaguuaauagaaauuaaucuguccgagcucaaaccacacaucaacggccccuucaccccugaucuugcucauccaguggccgaagucgggaagguggcagagaaggagggauggccccuggacauccgaguagguuugauuggcucauguacaaauagcaguuaugaagauauggggagaucugccgcuguugcgaaacaggcacuagcccacggacugaagugcaaaucccaguuuacuaucaccccgggcagcgagcaaauuagggcuacaauagaacgggacgguuacgcccagauccuccgugaucuugggggcauugugcuggcaaacgccuguggaccuugcaucggccagugggaccgcaaggauaucaaaaagggggagaagaauaccauugucacgucguauaacagaaacuucacuggaaggaaugacgcuaaccccgaaacacaugccuuugugaccucuccagagauagucacugcacuggcgaucgcugguacauugaaauucaauccugagaccgauuaccucacgggcaccgacgggaagaaauuucggcuggaagcccccgacgcagaugaguuaccaaagggagaguucgaccccggccaagauacauaccagcacccuccaaaagacuccucaggucagcauguggauguuaguccgacuagccagcgacugcaacuacucgaacccuuugacaagugggaugggaaggaccuggaagaucuucagauuuugaucaaagugaagggcaaauguaccacagaccacauuuccgccgcuggaccuuggcugaaguuccgcggccaccucgauaacaucucuaauaaccugcuuauaggggccaucaauauugagaacggaaaagcaaauagcguaagaaacgcugucacucaggaguucggcccagugcccgacaccgccagguauuacaagaagcaugguauccgguggguugugauuggggaugaaaauuauggagagggcucaagucgcgaacacgcggcccuggagccuagacauuuggguggcagggcuaucauaacaaaauccuuugcacguauucacgagaccaaccucaagaaacaggggcuguuaccacugacuuucgccgaccccgcugacuacaauaagauccacccggucgauaaacuaacgauucaaggacucaaggacuuuacaccuggcaaaccacugaagugcaucauaaagcaucccaacgggacccaggaaacuauccuuuugaaucacaccuucaacgagacacagauugaaugguuucgggccggaagcgcacugaaccgaaugaaagagcuccagcaauga

SEQ ID NO: 52354 - RNA, 354 nt, Artificial Sequence
  derived and/or modified sequence opt3 from ACOT13__Homo_sapiens__NP_001153566
auggugagaaagaucacccuggucagcgccgcucccggcaaaguuauuugcgagaugaagguggaagaggaacacacaaacgcaauagggacucuccauggaggucuuacggccacccugguagacaauaucuccacaauggcguuguuauguacugagaggggcgcuccuggggugucugucgauaugaacauuaccuacaugucaccagccaaacugggagaagacaucgugauuacagcacacguucuaaagcagggcaaaacccucgccuucacaaguguggaucugacuaauaaggcuaccgguaaacuuaucgcacaagggcggcauacgaagcaccugggaaacuga

SEQ ID NO: 52355 - RNA, 1266 nt, Artificial Sequence
  derived and/or modified sequence opt3 from ACOT1__Homo_sapiens__NP_001032238
auggccgcuacccugauccucgagcccgcaggcagaugcuguugggacgaaccugugaggauugccguccgggggcuugcgccagagcagccgguuacacugcgcgcuagcuugcgagaugaaaagggagccuuauuccaagcacacgcccguuacagagcugacacucugggugagcuagaucucgaaagggcacccgcccugggcggguccuuugcuggacuugagccuaugggccuguugugggcccucgagccagaaaaaccccuggugcggcugguaaagcgcgacgugagaacgccucucgcggucgaguuagaagugcuggauggucaugacccagaucccgggaggcuuuugugccggguucgccacgagcgauauuuccugccuccaggagugagaagggagccgguccgggcaggccgugugcgcggcacccuauuucugcccccugaaccagggcccuucccuggaauaguagacauguuugguacaggcgggggacuccuugaguacagagccucucuguuggcuggcaaagguuucgccguuauggcacucgcuuauuacaacuaugaagaucugccaaagacuauggagaccuuacaucuggaauacuuugaggaggccgugaauuaucuccuuucacaccccgaagucaaagggccgggagugggccuguugggcaucaguaaagggggagagcuaugucugagcauggcguccuuccucaaggguauuacagccgcaguggucaucaacggcucuguugcuaauguagggggaacccugagguacaagggcgaaacucuuccucccgugggugugaaccggaaucgaauuaaggucacaaaagacggguacgccgauaucguggacguucugaacucgccauuggagggcccugaucagaagucauuuauacccguggaacgcgcugagagcaccuuccucuuucuggucggacaggacgaccauaauuggaaaagugaguucuaugccaacgaagcaugcaagagauuacaggcccacggcaggcggaagccacaaaucauuuguuaccccgagacggggcacuauaucgaaccuccauacuuuccgcugugccgcgcuucccuacaugcgcucgugggaucucccauuaucugggguggcgagccuagagcacacgccauggcucagguagaugccuggaaacagcugcagacuuucuuccauaagcaccuugggggacacgaaggcaccauaccaagcaaaguuuga

SEQ ID NO: 52356 - RNA, 1452 nt, Artificial Sequence
  derived and/or modified sequence opt3 from ACOT2__Homo_sapiens__NP_006812
augagcaacaagcugcucucuccccacccucauuccgugguccuuagaucagaguucaaaauggccaguagcccagcuguucugagggcaucccgguuguaccaguggucuuuaaagucgucagcccaauuucugggcagcccgcagcuacgccagguggggcagaucauucgaguacccgcgcguauggcugccacccucauacuggaaccugcaggaagaugcuguugggacgagccagugaggaucgccguccggggucuugcucccgaacaaccugugacacugcgcgcaaguuugagagaugagaaaggcgcccucuuccaggcucacgccagguaucgggcggacacucugggggaacuggaucucgagcgcgcaccagccuuaggaggcuccuuugcuggucuggagcccauggggcuuuugugggcccuggaaccugagaagccacugguucgacucgugaaaagagacgucaggacgccgcuggcaguggaacuugagguacuggauggacaugaccccgauccuggccgguugcucugccagacccgucacgagcgcuacuuccugccacccggcguuagaagggaaccugugcgggucgggcgagugcgcggaacauuauuucugccacccgagccggguccuuuccccggcauuguggacauguuugggacuggaggcggucuccuugaauauagagcuucucuguuggccgggaagggauucgcggucauggcccuagcauacuauaauuacgaggaucugccaaagaccauggaaacacuccaucuggaguauuuugaggaagcuaugaacuaccuucugagccacccugagguuaaaggccccggcgugggguugcucggaaucuccaaggguggcgaacuguguuuaucaauggccaguuuccugaaagggauuaccgcugccguagugaucaauggaagcgucgcaaacgugggcgguacucuacacuacaagggggagacacucccacccguuggcgugaauaggaaccggauaaaagucaccaaggacggauaugccgauaucguggacguacuaaauucuccucuugaaggcccagaucagaaguccuuuauuccgguugagcgcgcugagucaacguucuuguuucugguggggcaagacgaccauaacuggaaaagcgaguucuacgcgaaugaagcaugcaagagacuccaggcccacggaaggcguaaaccccagaucauuuguuauccugaaacuggucauuacaucgagccacccuauuucccucugugccgggcuagucuucacgcccuggucggcucuccaauaauuuggggaggggaaccccgagcacacgccauggcucagguggaugccuggaagcaauugcagaccuuuuuccauaaacaccucggcggucaugaggggacaaucccguccaaggucuga

SEQ ID NO: 52357 - RNA, 1320 nt, Artificial Sequence
  derived and/or modified sequence opt3 from ACOT9__Homo_sapiens__NP_001028755
augagaagggccgcucugcggcucugcgcacuuggcaaggggcagcugacccccggacgcgguuugacacaaggcccucagaacccgaaaaagcaggggaucuuccacauucaugaggugcgagacaaauuacgugaaauagucggagccagcacuaauuggagagaucacguuaaggcgauggaggaaaggaaacugcuacauuccuuucucgcuaagucucaggacggccugccaccccggcgcaugaaggauucauacaucgaggugcuucugccuuuggguagugaaccagagcucagagagaaauaucugacgguacaaaacaccgugagguucgggcggauucuggaagaccucgauagcuuaggaguccugaucuguuacaugcacaauaagauucauuccgccaaaaugucuccccuuucgaucgugacagcauugguugacaagauagauaugugcaaaaagucacugagcccugagcaggacaucaaguuuaguggccacguguccugggucggcaaaacuucuauggaagugaagaugcagauguuccagcuacacggggaugaguuuuguccaguacucgacgccaccuucguuaugguggcucgcgauagcgagaacaaaggacccgcauuugucaauccucugauuccagaauccccggaggaagaggaacuuuuccgacaaggugagcugaacaagggcagaaggaucgccuuuucaaguaccagcuugcucaaaauggcucccucugccgaggaacggacaacuauucaugagauguuccuguccacauuagacccuaagaccaucucauuucguagccgcgugcugccaaguaaugcgguguggauggaaaacucuaaacucaagucccuugagauaugccacccccaggaaagaaauauuuucaacaggaucuuugggggauuccugaugcggaaggcauaugaguuggccugggcuacggccuguagcuucggcgguucgcgaccuuuugucguugcaguggaugacauuauguuccagaaaccaguagagguggggucucuacuguuucucuccucacaggucugcuucacucaaaauaacuacauccaggugcgcguucauagugaaguggcuagccugcaggagaagcaacacaccacaacuaaugucuuucacuucaccuuuauguccgaaaaagaggugccccuuguauucccgaagacauauggagaaucuaugcuguacuuggacggccagagacauuuuaacagcaugucaggcccugccacccucaggaaagauuaucugguugagcccuga

SEQ ID NO: 52358 - RNA, 1869 nt, Artificial Sequence
  derived and/or modified sequence opt3 from ACOX1__Homo_sapiens__NP_001171968
augauccugaacgaccccgauuuccagcacgaggaccucaauuuucuuaccagaagccaaagguacgaaguggccguccggaaguccgcuauuaugguuaaaaagaugcgcgaguucggcauagcagauccugacgaaaucaugugguuuaaaaacuucgugcaucgagggcguccagagccgcuggauuugcacuuaggaauguuucugcccacacuacuccaucaggccacugcggaacagcaggagagauucuuuaugccugcuuggaaucuggagauuaucgguacguaugcccaaaccgaaaugggccacgggacacaucuuaggggacuggagacuaccgcaacauacgacccagaaacccaggaguucauuuugaacucucccacuguaacaucaaucaagugguggccuggcggucucgggaaaaccaguaaucacgccauagugcuggcucagcugaucacgaagggaaagugcuauggccuccacgcauuuauugucccaauccgggagauuggcacucauaaacccuuaccugggaucaccgugggagauauagguccaaaguucggcuacgacgaaauugauaacggguaucugaaaauggacaaucaccgcaucccgagagagaacaugcuuaugaaguacgcccagguuaaacccgauggaacauaugugaagccuuugagcaauaagcugacuuacggcaccauggucuuugugagguccuuccuaguaggugaagcugcccgggcgcucucuaaagcauguacaauugccauccgcuacucggcuguucgacaucaaucagagaucaagccaggggaacccgagccucagauucuggacuuucagacccagcaauauaaacuuuucccacuguuggccacggcauacgcuuuccaguuugugggagccuauaugaaggagacuuaccacagaauaaacgaaggcaucggccagggggaucucagcgagcugcccgaauuacacgcgcugacagccggacucaaagcauucaccaguuggacugcuaauacagguauugaggccugcaggauggcuuguggcgggcauggauauucccacugcucuggccuuccgaacaucuacgucaauuuuaccccuagcuguacguucgaaggugagaacaccgugaugaugcugcaaacagcccgguuuuugaugaaguccuaugaccaggugcauucagggaagcuagucugcggcaugguuaguuaccugaaugaccuccccagccagcguauacagccacaacagguggcaguauggccuacuaugguggauauuaacucucccgagucccugaccgaagccuacaaacuucgcgcugcgagacuggucgagaucgcagccaagaacuugcagaaagaagugauccacaggaagucaaaagagguugcuuggaaucucacaagcguggaccugguccgggccagugaagcacauugucacuaugugguaguuaaguuauucucugagaaacugcuaaagauucaggauaaggccauccaagcugugcuccgaucccugugccuuuuguacagccuguauggaauuucgcagaacgccggcgacuuucuccaggggucuauaaugacugagccacagaucacccaagucaaucagcgcgugaaagaacugcuuacacugauuagauccgaugcagucgcguugguggacgcuuucgauuuucaggacguuacccucggaucagugcuggguagguacgauggcaacguauaugagaauuuauucgaaugggccaagaacaguccccugaauaaagcagagguccacgagagcuacaagcaucuaaaaucccuccagucuaagcuguga

SEQ ID NO: 52359 - RNA, 2046 nt, Artificial Sequence
  derived and/or modified sequence opt3 from ACOX2__Homo_sapiens__NP_003491
augggcagccccgugcacagagucucccugggggacaccuggucuaggcagaugcauccugauaucgagucagaacgguacaugcaaaguuucgacguugagcgccucacaaacauucuugauggaggugcccagaauacugcucugcgacguaagguggaaagcauaauccacuccuauccagaguuuucuugcaaagacaacuacuucaugacgcagaaugaaagauauaaggcagccaugaggcgggcguuucauauucgcuugaucgcuagaagguuaggcuggcuggaggaugggcgggagcuaggauacgccuaucgcgcacucucgggcgacguagcccugaacauucaccgaguguucgucagagcucuuaggucacuggguagcgaagaacagaucgcaaaaugggauccguuguguaagaauauacaaaucauugccaccuacgcucagacagaacucgggcauggaacuuaucugcagggccuggagaccgaggccacauacgacgcggcaacccaggaauuugugauccacagucccacucucacagccaccaaaugguggccuggcgauuuagggcgguccgcuacgcacgcccugguucaagcacagcuuauuugcucuggagcucgucgcgguaugcaugccuucaucgugccaauaagaagccugcaggaccacacuccccugccuggcauuaucauuggggauaucggaccaaagauggacuuugaucagaccgacaacggcuuccuacaacucaaucaugucagggugccccgggagaacaugcugucccgauuugcgcagguacuuccugacgguacauacguuaagcuggggacugcccagucaaauuauuugccaaugguggucgugcgcguggaacuccugaguggagagaucuuaccgauucugcaaaaagcaugugucauagcuaugagauacagcguuaucaggcggcagucucgccucagacccuccgauccugaagccaaggugcuugacuaucagacccagcaacagaaacuguucccacaguuggcuauuucauacgccuuucacuuccuagcaguaagccugcucgaguuuuuccagcacaguuauacagccauccugaaccaagauuucucuuuucuucccgagcugcaugcuuuguccaccggcaugaaggcgaugaugagcgaguucugcacgcagggcgcagagauguguaggcgugccugcgggggacacgguuacucgaaacucucuggccugccuuccuuagugacuaagcugucagcuaguuguacauaugaaggggagaauaccguccuauaccuccagguggcccgguuucugguuaagagcuaccuucagacucaaauguccccaggaucuacaccccagcgaucauugagcccgaguguggcauaucugaccgccccugaccucgcuagaugccccgcccagagggcagcggauuuccuguguccagaacuuuacacgaccgcuugggcccaugucgcagugcgccugauaaaagacuccguacagcacuugcaaacacucacucagagcggcgccgaucagcaugaggcuuggaaccaaaccacaguuauucacuugcaggccgcaaaggugcacugcuauuacgucacugugaaagguuuuaccgaggcuuuagaaaagcuggagaaugaaccugccauccagcagguccuaaaacggcucugugaccugcaugcgauccacgggauucuuacaaacucuggcgauuucuugcaugacgccuuucugucaggagcucaaguggauauggcaagaaccgccuaucucgaccuguuaaggcugauccgcaaggacgcuauucuuuugacugaugccuucgacuuuacggaucagugccucaauagugcacugggcugcuacgacgggaacguuuaugagcgacuauuccagugggcgcagaaaagccccacaaacacccaagaaaauccagccuacgaggaguacauacggccccugcuccaguccuggcguucuaagcuguga

SEQ ID NO: 52360 - RNA, 1875 nt, Artificial Sequence
  derived and/or modified sequence opt3 from ACOX3__Homo_sapiens__NP_001095137
auggccagcaccguggagggcggggacacagcucugcuccccgaguucccuagaggaccacuugaugcauacagggcccgggcguccuuuucuuggaaggaacuggcuuuguucacugaaggugagggcauguuacgcuuuaaaaagacgaucuucucagcccuggaaaacgacccgcuauuugcacgaagucccggggccgaucucagccuggagaaauaucgugagcuuaauuuccugagaugcaagaggauuuuugaauacgacuucuuguccgucgaggauauguuuaaaucuccucucaagguuccagcucugauacagugucugggaauguaugacucgucacucgcagccaaguacuuacugcacagccuuguguucggcagugcuguauauuccucugguagcgaacggcauuugaccuacauccagaaaauuuuucgcauggagaucuucgggugcuuugcccugacagagcuaucccacggaucaaacacuaaggcgauuagaaccacagcacauuaugaucccgccaccgaagaguucaucauacacaguccugacuucgaagcugccaaauuuugggugggcaauaugggcaagacugcaacacaugcugucguguucgccaaacucuguguuccaggggaucaaugccacggacugcaccccuuuaucgugcagauuagggacccuaagacccuucugccaaugccgggugucauggugggcgauaucgggaagaaauugggacagaacggccucgacaaugguuucgcgauguuucauaagguacggguuccccgccaaagccuguuaaaccgaaugggggaugugacgccugagggaacuuacgucucuccauucaaagacgugagacagagguuuggcgccucccugggcucacucagcagugggcgggugucuauugucucccuugcaauccugaauuugaagcuagcuguugccauagcucugcguuucagcgccacccgcagacaguuuggacccacagaagaggaggaaauuccugugcucgaguacccaaugcagcaauggaggcugcuucccuaucuggcagccguauacgcuuuggaccacuucucgaaaucucucuuucuggauuuaguggaacugcagcggggucuagcguccggcgaccgaucagcacgccaggccgagcucgggagagaaauccaugcucuggccagugcaagcaagccgcuugccuccuggacuacccagcaaggcauucaggaguguagggaggcuugcggaggucacggguauuuggccaugaaccggcugggcguccuccgcgaugacaaugauccuaacuguacauacgaaggagacaauaacauccugcuucagcaaaccucuaauuaucuguugggccuccuggcacaccaggugcaugauggggcgugcuucagaagccccuuaaaaucaguugacuuucuggaugcuuacccaggaauccuagaccagaaguucgaggugaguuccgucgccgauugucucgacagcgcaguggcccuggcugccuauaaguggcuuguaugcuacuugcugagggaaacguaccagaaacucaaccaagagaagcguucugguucaagugacuucgaagcacggaauaaaugucagguuagccacggccgaccucuggcuuuagccuuuguggagcugacugucgugcagagauuccaugagcacguccaucagcccuccgugccacccucucuuagggcgguuuuggggcgccucucggcccuguaugcucuauggagccugucccggcacgcagcccuccuguacagagcugaaaggcgcugcucaugcccuggacgacgggaucguaguucuuga

SEQ ID NO: 52361 - RNA, 1743 nt, Artificial Sequence
  derived and/or modified sequence opt3 from ACOXL__Homo_sapiens__NP_001136279
augagagcccugaccgugcagagggucaaguucgcuauggaccucccccuucugaaacgggcaggccaagauuuggccgagaagacaaagaacuuuguuagccgcuccuuagugaucggggaaguacugucuauggcggacauggcuacuggagugaagugcgguauuauauacuggcuauucggcggggccauccgaaaucucggaucaccugagcacgucacgaaaugguuucagccacugcaggaacagaaguauaccggcauguucgcaaugacagagcguggucaugggaguaacgccagaggcauucaaacugaagcuaccuuugaucuuagcgcacaggaguucgugaucgacacaccgugugagaaugccgaaaagauguacauuggaaacgcuauguauggcaauuacgccgcgguuuuugcacagcugaucauagaugggaggucccagggaccccacugcuucaucgugccuguccgggacgagaacgguucuuuguauccaggcgugaccgccauugauaugauguacaaagaagggcuccauggaguagacaauggcauccugauuuuugauaagguucgcauccccagagagaaccugcucgacaaauucgguucgguggcuccugaugggcaauaucacucaccaauaaggaauaagagcgcccgguuuaacgcaauguuagcugcccugacucccagucgccuugcggucgccuuccaggcaaugggagcuaugaaauugggccugacaauugccauccgauacucccauucuagaaggcaguuuggcccuaagaccaaggaggaagugaaaauuaucgagcaccagacgcaaacucuacggcucaugccacaccuggcuaccgcccuugcacugacauucgugagccguuacgccggggcuuugcucgacgaagaugucuuccagggaaaggagcugguuaauucccgcucauuacaggcgcugguggcaggucucaaagccuauaguacuugggaaaacaucagaugucuucaagacugcagggaguguaccggcgggaugguagugggacgggagcuguuggcucaguacacaaagcaguaugaagagaaaccgcuauuuggccugcuccagaauugggccgaaagcgucggugacaagcugcgaaccucuuuccuugcauuuaacauggauacgguggacgaucuggccuucuugcucaaagcuguuaaguuucgcgagagagugcugcaaaggggguuagucgcccggauuuacuauaaggugaaaacuaagaaagaagacuucuuucaugcauggaacuccugccugcaccauguagcgucacuaagccucgcucacacacaccgcguuacccuggagcaguucagucuugccgugaagucuugucccgaucaggaggaccagacuuugcugaugaaauuuugccuccuguacggcacaaaacuugucuuccaagaaagagcaugguaucuggagcauaaguacuugaccccuauggccuccacgaggauacguaaucagcuccuggauuuaugugacagcgugaaagaugacgcucggcgagucaucucgaccuuuaacauuccacacacauaccugcaugcccccaucgcaggaauaucuaauccuagagcugccugggcguucuauccagcuccccuacagccgaggccucgcgaagaggcccgguccagaaggcccaagcucggcgcaaaacuguga

SEQ ID NO: 52362 - RNA, 339 nt, Artificial Sequence
  derived and/or modified sequence opt3 from ACP1__Homo_sapiens__NP_001035739
auggccgagcaggcuaccaagagcgugcuguucgucugccucggcaacaucuguagaucccccauugcagaagccguuuuuaggaaacuugugacagaccaaaauauaucugagaacuggcggguagauucagcggcuacgaguggguacgaaaucggaaauccuccagacuaucgcggucagagcugcaugaagcgacacggcauuccgaugucccauguggcccgucagguccccucucuggauuugaaauuaugugugcugugcuucucggggucacuaacugcaguucucuuucugaccggaacaugggccggcccucagacucaagagcuuuga

SEQ ID NO: 52363 - RNA, 1176 nt, Artificial Sequence
  derived and/or modified sequence opt3 from ACP2__Homo_sapiens__NP_001289419
auggccggcaagagaagcgggugguccagggcugcacugcuccagcuucuguugggagugaacuuagucguuaugcccccuacccgggcccgcucucugcgauucgugacacuagaggguaugcuccaacacugggaacugggccaggcgcuucgucagagauaccauggguuucugaauacuucauaucacaggcaggagguauacgugcggaguacggacuucgaucgcaccuugaugagcgcugaagccaaccucgcaggacuguuuccaccgaauggcaugcaaagauucaaccccaauaucuccuggcagccuauuccaguccauacagugcccauaacugaggacaggcugcucaaauuuccuuuagguccaugcccccgguaugaacagcugcagaacgagacccgccaaacaccugaguaccagaaugaaucuucgcgaaacgcccaguuccuugauaugguugcuaaugagaccggguugacugaccugacacuagaaaccguguggaacgucuaugauacgcucuuuugugagcagacucacggacugagacuuccaccgugggcaucaccccaaaccaugcagaggcugagccgguugaaggacuucaguuuucguuuccucuuuggcaucuaccagcaagccgagaaagcucgccugcagggcgggguguuacuggcccagauuagaaagaaucucacacuuauggcgacuaccucccagcugccuaaauugcuaguauauucugcacaugauacaacccugguugcccuccaaauggcucuggacguguacaacggagaacaggccccauacgcaagcugccacaucuucgagcuuuaucaggaagauuccgguaauuuuucagucgagauguacuucaggaacgaaagugacaaggcucccuggccucugagcuugccaggcuguccccaccggugcccgcuccaggauuuccugcgauuaacggagccuguggugcccaaggacuggcaacaggagugucagcuggccucugggccagcggauacugaagucauuguugcccuagcagugugcggauccauccucuuucugcuuauaguauugcugcucacagugcuguuccgcaugcaggcucaaccucccggcuauagacaugucgccgacggugaggaccacgcuuga

SEQ ID NO: 52364 - RNA, 978 nt, Artificial Sequence
  derived and/or modified sequence opt3 from ACP5__Homo_sapiens__NP_001104506
auggacauguggaccgcccugcucauccuucaggcucuguuguuacccagccuggcagauggcgccacuccugcgcuaagauucguggcugucggggacuggggagguguuccaaacgccccguuucacacagcaagggagauggccaaugcuaaggaaauugcacggacggugcaaauacucggcgccgauuucauccugucccuuggggacaacuuuuacuucaccggaguacaggauauuaaugacaaacgcuuucaggagacauucgaagauguguuuucugaccgaucacugcguaagguccccugguauguguuggcuggcaaccaugaucaccucgguaauguuagugcccagaucgcguacagcaaaauuuccaagagauggaacuucccuucuccauuuuauaggcugcauuucaaaaucccccaaacuaaugugucggucgcaauauuuaugcuggacaccgugacacucugcgggaacucagaugacuucuuaagccagcagccugagcggccacgcgauguaaagcuggccagaacccagcuuaguugguugaagaaacaacuggcugccgcaagggaagacuacguucuaguggcuggacacuaucccgucugguccaucgccgagcauggcccuacucacugucucgugaagcagcugcggccacuucuggcgacauacggcgugaccgccuauuugugcgggcacgaccauaaucuccaguaccugcaggaugagaacggagucgguuacguuuuaucuggcgcagggaauuuuauggacccgagcaaacgccaccaacgaaaggugcccaacggauaucugagauuccauuacggcacggaagauucccucgguggguucgcuuauguagagauuucaaguaaagaaaugacugugaccuacaucgaggccagcggaaagucucuuuuuaagacaaggcugccucggcgugcucgcccauga

SEQ ID NO: 52365 - RNA, 1206 nt, Artificial Sequence
  derived and/or modified sequence opt3 from ACP6__Homo_sapiens__XP_011507903
augaucaccggcguguucagcaugagacuguggacacccgucgggguucucacuucccuugccuacugccugcaccagaggcggguggcuuuggcagaguuacaagaagccgacggacaguguccuguagaucgcucucugcuaaagcucaaaauggugcaggucguguuucgacauggugcgcguucaccacugaagccgcuuccccuggaggaacagguugaguggaacccucaauugcucgaagugccaccccagacgcaguucgacuauaccgucacaaaucuggcuggcgggccuaaaccauacagucccuaugauagccaguaccacgagacuacccugaagggaggcauguuugccggucaacucacaaaaguggggaugcagcagauguucgcauuaggagagagacugaggaagaacuauguagaagacauuccuuuucuuuccccaaccuucaauccgcaggagguuuuuauacggucuacuaacaucuuccgcaauuuggaaucgacaagaugccugcuagccggccucuuucaaugucagaaggagggccccauuaucauucauaccgaugaggcugacucagaagugcuguacccuaacuaucagagcugcuggagucuuaggcaacggacgcgcgggcgaagacagacugcaucccugcagccaggaaucucugaggauuugaaaaaggucaaagacaggauggguauagauagcuccgacaagguggauuucuuuauccuccuggacaauguggccgcugaacaggcccacaacuuacccucauguccuaugcugaaacgguucgcgcguaugauugagcaacgcgcagucgauaccagucucuacauccuuccaaaggaagacagagagagccugcagauggccguuggccccuuuuugcauauucuagagucuaaucugcucaaggcuauggacuccgccacagcaccggauaaaaucaggaagcuguaccuuuaugcugcccacgacgugacuuucauaccucuguugaugacccucgggauuuucgaucacaaauggcccccauuugcgguagaccugacaauggaauuauaccagcaucuggagucaaaggaaugguucgugcagcuauauuaccacggaaaagaucuccaagucgccagcaucaccggcaugaagaaaauucugggucuuuuucagccucauuga

SEQ ID NO: 52366 - RNA, 1161 nt, Artificial Sequence
  derived and/or modified sequence opt3 from ACPP__Homo_sapiens__NP_001090
augagagccgcuccccugcuccuugcaagggccgcgagccuguccuugggcuucuuauuucugcuauucuuuuggcucgaccggucugugcuggcuaaggagcuuaaauucgucacccugguuuuucgccacggggaucgaucaccuaucgacacauucccaacugauccgauuaaggaaaguagcuggccccagggauuuggucaauugacgcagcucggcauggagcagcauuacgaacugggggaguauauacguaaaagauacaggaaguuccugaacgaauccuauaaacacgaacagguguacauccggucuaccgacguagaucgcacacucaugucggccaugacuaauuuagcagcccuguuuccuccagagggagugucaauuuggaaccccauccuuuuguggcaaccuauuccaguccauaccgugccccugagcgaagaccagcuacucuaucugccuuucagaaauugcccaagguuucaggagcuugaaagugagacacugaaguccgaggaguuccagaagcgguugcacccguacaaagauuuuaucgcuacccucggcaagcugucugguuuacaugggcaagaccuguucggaauauggagcaaaguuuaugauccccucuacugugaguccgugcacaacuucacucuuccuucaugggcaacagaagacaccaugacgaagcugcgcgaguugagugaacuaagccugcucucucuguacggcauccacaaacagaaggagaagucccgacuucagggcgggguccuggugaaugagauuuugaaccauaugaaaagagccacucagaucccaucauauaagaaacucauuauguacagcgcucacgauaccacaguaaguggacugcaaauggccuuagacguuuauaauggucugcuacccccuuacgcgucuugccaucucacugaacuguauuuugagaagggcgaauacuucguggagauguauuacaggaacgaaacccagcacgagccauacccccuuauguugccgggguguuccccuagcugcccccuggagcgguuugcagaacucgucggaccagugaucccucaggauuggucgacagaguguaugaccacuaauucucaccaaggcacggaagacuccacagacuga

SEQ ID NO: 52367 - RNA, 1632 nt, Artificial Sequence
  derived and/or modified sequence opt3 from ACRBP__Homo_sapiens__NP_115878
augagaaagcccgccgcuggcuuccugccuagccuccuuaaagugcuguuguuaccacuggcaccggccgcggcucaggacuccacccaagccucuacacccgggucaccucuaaguccaacugaguacgaaagguuuuucgcacuccugacgcccaccuggaaggccgagacaacuugccggcuucgcgcuacccacggaugucgaaacccuacacugguccaguuggaucaguaugaaaaucauggucucguuccagacggcgcagugugcagcaaccugcccuacgccuccugguuugagucuuucugucaguuuacccacuaucguugcucgaaucauguauacuaugcuaaaagagugcuguguucacaaccugucagcauccucaguccaaacacuuuaaaggaaauugaggccuccgcggaggugucuccgacaaccaugacgagccccauauccccucacuucacuguuaccgaaaggcagacauuucagccauggcccgagcggcugucaaauaacguggaagaacuuuugcagaguagccugucucuagggggacaagagcaggcaccugaacauaaacaggagcagggcgucgaacaccgccaagagccaacucaggaacacaagcaggaggagggucaaaagcaggaggagcaggaagaggaacaggaggaggaagggaaacaagaggaaggacagggcaccaaggagggcagagaagccgugucccagcuccagacagauucagagcccaaauuccauagcgagagucugucuuccaauccgagcucguuugcuccuaggguacgggaaguugagucuacccccaugaucauggaaaacauucaagagcuuauccgcuccgcccaggagauugacgaaaugaaugagaucuacgaugaaaacucauauuggcgaaaucagaacccagggagucuguugcagcucccucacacggaggcacuguuagugcugugcuacagcauagucgaaaauacuuguaucauuacacccaccgcuaaggccuggaaauacauggaggaggaaauccucggauucgguaaguccgugugcgacucucuuggcagaaggcauaugagcacuugugcgcugugcgauuuuuguucauugaagcuagagcaaugccacagugaagccucccugcagcggcagcagugcgacacaagccacaaaaccccauucgugucuccccuccuggcaucacaaagucuuagcauugggaaccaggucggauccccugagucuggccguuuuuauggucuggauuuguacgggggacuccauauggacuucuggugugcucgccuggccacgaagggcugcgaagauguuagagugucgggcugguuacagaccgaguuccugagcuuucaagacggggauuucccaacaaaaaucugugacacugacuauauacaguacccgaauuauugcuccuuuaagucacagcagugucuaaugaggaaccggaaccgaaaaguaagucgcaugagaugccuccaaaaugagaccuacucugcucugagccccggaaaguccgaagaugugguccuuagguggucacaggaguucagcacauugacucugggucaguuuggcuga

SEQ ID NO: 52368 - RNA, 2076 nt, Artificial Sequence
  derived and/or modified sequence opt3 from ACRC__Homo_sapiens__XP_011529367
auggacggcugcaagaaagagcugcccagacuccaggaaccugaggaagaugaggacuguuacauccuuaacgugcaaagcuccucugaugacaccucagggaguagcgucgccaggcgggcuccaaagcgccaggcauccugcauucugaauguucagucucgaucgggagauacaucagguagcaguguggcccguagagcgccgaaaaggcaggcuuccucuguaguggucauagacagcgauuccgacgaagagugucacacucaugaggaaaagaaagccaaguuguuagagaucaacucagaugacgaaagucccgagugcugucacgugaagccugcaauucaagagccacccaucguuauuagcgaugacgauaaugacgacgauaacggcaaugaccuggaagugccugaugacaacucugaugacuccgaggccccagaugacaauucagaugacagcgaagcucccgaugacaacagugacgauucugaggcaccugacgauaauuccgacgauagcgaagccccagacgauaacucggacgauucugacgucccggaugacaauuccgaugacucaagugacgauaacagcgacgauuccucugacgauaauagcgacgauucagacgugcccgaugacaaaagugaugacuccgauguaccugacgacagcucugaugacucagauguuccagacgauaguagcgacgauuccgaggcucccgacgauucuucggacgauagcgaggccccugacgacuccucagaugacagugaagcgccagaugacucuagcgaugacuccgaggcacccgaugacucaagcgaugacucugaagccuccgaugacaguagcgaugacucugaggcuuccgacgauucaagugacgauagcgaagccccggacgauaagucggacgauuccgacgugccugaggauaaaucugacgauagcgacguccccgaugacaacucagacgaucuagaggugccagugccugcagaagaccucugcaaugaggggcagaucgcuagugaugaagaggaacuggucgaggccgcggccgcaguuucccagcaugacucuagcgaugacgcuggagagcaggaucuuggcgaaaaccuguccaagcccccaucagaccccgaggccaacccugaagugagcgagcggaaauugccaacggaggaggaaccggcucccguaguggaacaaagugguaagcgcaagucuaaaaccaagacaauagucgagccuccaagaaaaaggcagacuaagaccaaaaauaucguggaacccccucggaagcgccagacaaaaaccaagaacauuguugagccacuccgaaagagaaaagccaagacuaaaaauguguccgucacacccgggcacaagaaaaggggaccgagcaagaagaaaccuggcgcagccaagguggagaaacggaagacccguacgccaaaauguaagguacccggcugcuuccugcaggaucuggaaaagucgaaaaaguauucagggaaaaaccucaagcgcaauaaagacgaguuaguucaaagaaucuacgaucuguuuaacaggucugugugugacaagaaacuuccugaaaaguugcggauuggauggaauaacaagauggucaaaacugcuggucugugcaguaccggcgagaugugguaucccaaguggcgacgcuucgcgaaaauccagauagggcuaaaggugugugacuccgcagauagaauuagggacacacucauccaugaaaugugccacgccgcuagcuggcugauugauggaauccacgacucucauggcgaugccuggaaauacuaugcacgcaagagcaaucggauccacccagagcuuccuagagucacuaggugccauaacuacaagauuaauuauaaagugcacuacgaguguaccgguugcaagacacguauaggguguuacaccaaaucccuggacacgucacgguuuaucugcgccaaguguaaaggaaguuugguuauggugccccucacucagaaggauggcacacgaauuguaccacacgucuga

SEQ ID NO: 52369 - RNA, 1266 nt, Artificial Sequence
  derived and/or modified sequence opt3 from ACR__Homo_sapiens__NP_001088
augguggagaugcugcccaccgccauccuccuuguccuggcuguuagcgugguagcaaaggacaacgccacaugcgauggcccuuguggguugagauucaggcagaauccacaaggaggugugcggauugucggcgggaaagcggcucagcacggagccuggccguggaugguguccuuacagauauuuacuuacaacucucaucgcuaucacacgugcggcgguucacugcuaaauagucgauggguucucaccgcagcccauuguuucguggggaagaacaauguccacgacuggcgucugguguuuggagcuaaagaaaucacauacggcaacaauaagcccguaaaagcaccucuucaggagagauauguugaaaagauuaucauucaugagaaguacaacagcgccacugaaggcaaugauaucgcucugguggagauaaccccacccaucuccugcgggagguucauuggaccugguuguuugccacacuuuaaagccggccucccccgggggucucaaucgugcugggucgcgggauggggcuauaucgaggaaaaggcaccucgcccaucaagcauucugauggaggccagaguggaccugaucgaucucgacuuauguaacaguacacagugguacaaugguagggugcagccgaccaacgucugcgcuggguaucccguuggaaaaauagauacuugucagggcgacuccggcgggccucugaugugcaaggauucuaaagaaagcgccuacgugguagugggaauuacauccuggggugucggcugugcacgggcuaagcgcccagggaucuacaccgccacguggcccuaucuuaauuggauugcgucaaagaucggaaguaacgccuugcgaaugauccaaagcgcaacuccuccacccccgaccacaagaccucccccaauuaggccucccuucucucacccaauauccgcucaucugcccugguacuuucagccuccaccgcggccccuaccuccacgucccccugccgcucagccaagacccccgccuucaccacccccucccccaccucccccagccagcccgcucccucccccacccccuccacccccuccgacuccaaguucuaccacaaaacugccccagggccuuuccuucgcaaagcgccugcaacaguugaucgaggugcucaaagguaagaccuauagcgacgggaaaaaucacuacgauauggagacgacugaacugccugaguuaacaucgaccucuuga

SEQ ID NO: 52370 - RNA, 798 nt, Artificial Sequence
  derived and/or modified sequence opt3 from ACRV1__Homo_sapiens__NP_001603
augaacagauuccugcuccuuaugagccuguacuuguuaggcuccgccagggggaccucuucacagcccaaugagcugaguggaagcaucgaccaccaaacauccgugcagcagcuaccuggugaauuuuucucucucgagaacccaucggaugcugaagcacuguaugagacuucaagcggccuuaauacgcugagugaacauggguccucugagcacggaagcuccaagcauaccgucgccgagcacacaucaggcgaacaugcggagagugaacacgcuagcggugagccggccgcaacugagcacgccgaaggggagcauaccguuggagaacagcccucuggcgagcaaccuuccggcgaacacuugucaggggagcagccacucagcgagcuggaaaguggagagcagcccucugacgaacagccuuccggugagcauggcagcggggaacaaccaucgggagagcaggcuucuggcgagcagcccuccggugaacacgcaucaggggagcaggccaguggagcuccuauuagcuccacaucuaccggcacuauacugaacugcuacacaugugccuauaugaaugaucaaggcaaaugccuccgcggggaaggaaccuguaucacgcagaacagccagcaaugcauguuaaagaaaauuuuugaggguggcaagcugcaguucauggugcaggggugugaaaauaugugcccaucaaugaaccuuuuuagucacggaacucggaugcagaucauuuguugccgaaaucaauccuucuguaacaaaaucuga

SEQ ID NO: 52371 - RNA, 2175 nt, Artificial Sequence
  derived and/or modified sequence opt3 from ACSBG1__Homo_sapiens__NP_055977
augcccagaaacagcggcgccggguacggaugcccucacggugacccauccaugcuggauucuagggagaccccgcaggaaucacggcaagacaugaucgugcgcacaacucaggagaagcucaaaacgaguagccuuaccgaucgacagccccuguccaaggaaucuuugaaucaugcuuuagagcugucggucccugaaaaaguuaacaaugcacagugggacgccccagaggaggcgcuauggacaacucgugcugauggcagagugaggcuccggauugaccccucauguccucaacugccauauaccguacaccgcauguucuacgaagcccuugauaaguauggggaccugauagcauugggauuuaaaagacaggauaagugggagcauaucagcuacagucaguauuaccuccuggccaggcgggcugcaaagggcuuccugaaacucgguuuaaagcaggcccacuccguggcuauucugggguuuaacucucccgaaugguucuuuagcgccgucggaacaguguucgcgggcggcaucguuaccgggauuuauacuacauccucaccugaggcaugccaauacaucgccuacgacuguugcgcuaaugugauaauggucgauacccagaaacagcuugagaagaucuugaaaauuuggaagcagcugccacaucuaaaggccgugguaaucuauaaagaaccgcccccuaacaagauggcaaauguuuacacgauggaggaauuuauggagcucggaaacgaagugccagaggaggcucuggacgccauuaucgauacucaacagcccaaucaguguugcguccuuguguauaccagugguacaacuggcaacccuaaaggggugaugcugagccaagacaauauaaccuggacagcgcgcuacggaucucaggccggcgacauucgaccagcagaaguccagcaggagguugugguauccuauuugccccucucacacaucgcugcccaaauuuacgaucuguggaccgguauccaguggggagcucagguguguuucgccgaaccggacgcauuaaagggaagccuggucaacacgcucagagagguggaaccuacaagucacaugggcguucccagggugugggagaaaaucauggagcggauucaggaagucgccgcucaaucuggcuuuauacgucgcaagaugcuucugugggcgauguccgugacuuuggagcagaaucuaaccugcccagggagcgaucugaaaccuuucacuacaagacucgcagacuaucugguacuugccaagguuaggcaggcucugggauuugccaagugucagaaaaacuucuacggugcagcccccaugauggcugaaacccaacauuucuucuugggccucaauauccggcuguacgccggguauggauuaucggagacgucuggcccacacuucauguccucacccuacaacuaucgacuguacaguagcgguaagcuagugccugggugccgcgucaaacucgugaaccaggaugcagaaggcauuggagagaucugucuguggggcagaaccauauuuaugggguaucuuaauauggaggacaagacaugcgaagcgauugaugaggaaggaugguugcauacuggugacgcuggcaggcuggaugccgacggguuccucuacaucaccggacggcugaaagagcuuaucauuacagcaggcggugagaacgucccaccggugcccaucgaagaggccguuaagauggaacugccuauuauauccaaugcuauguugaucggggaucagcgcaaguuucucucuaugcuguuaacucugaaaugcacccuagacccagacacaagcgaucagaccgacaaccucacugagcaagccauggaauuuugucagagagugggcucaagggcaacgacaguaagugagauuaucgagaagaaagaugaagcugucuaucaggccaucgaggaagggauucgucgggugaauaugaacgcggccgcucgacccuaccacauacaaaagugggcaauccuggagagagacuuuuccauuagcggcggggaacuuggaccuaccaugaaauugaagaggcugacuguucucgagaaguacaaagguaucauugauucuuucuaucaggagcagaagauguga

SEQ ID NO: 52372 - RNA, 2001 nt, Artificial Sequence
  derived and/or modified sequence opt3 from ACSBG2__Homo_sapiens__NP_001276107
augaccggcacacccaagacucaggagggggccaaagaccuggaaguggauaugaacaagacggaggucaccccuagacucuggacaacuugcagggacggagaaguucuucugcgguugagcaaacacgguccaggccaugagaccccgaugacaauccccgaguucuuucgcgaauccgugaaucgauucgggaccuacccugcuuuagcaucuaagaacggaaagaagugggagauucugaauuuuaaccaauauuacgaagccugucguaaggcggcuaaaucacuaauaaagcucggccuggagagauuccacgguguagggauccuuggauuuaauagugccgaaugguucauuacugcagugggcgccauccuggcuggcggguugugcgucggaauuuaugcaacaaacagcgccgaggugugucaguacguuaucacccaugcuaaagugaauauacuccuggucgagaacgaucagcagcugcaaaagauccucuccauuccacagucuucguuagaaccccugaaagccaucauucaguauaggcuuccuaugaagaagaauaacaauuuguacucaugggacgauuuuauggagcugggucggagcaucccagacacgcagcuagaacaagugauagagagucagaaagcgaaccagugcgcaguacucauuuauacuuccggcaccacagggauccccaagggaguuaugcugucucacgauaauauuacuuggaucgccggcgcugugaccaaagacuucaaacuuacagauaaacaugaaaccgucgugagcuaccugccuuugucccacaucgccgcacagaugauggacauuugggugccaauaaagaucggugcucucacguacuuugcccaagcggaugcccugaaagggacuuuagucucaacacugaaggagguuaagccgaccguguucauuggaguaccccagaucugggagaaaauacacgaaauggugaagaaaaacagugcaaagagcaugggccucaaaaagaaggcuuuugucugggcccgcaauauuggcuucaaagugaacucuaagaaaaugcuugggaaguauaacacuccuguuuccuacagaauggcuaaaacacugguguuuucaaaggucaagaccagcuugggacuagaccauugucacaguuucaucucugguacggccccacugaaucaggagaccgcagaguucuuucucucccuggauauccccauuggcgaacuuuaugggcugagcgaaucgucuggaccucauacaaucuccaaccaaaauaacuacagguugcucucaugcggcaaaauucugacugguuguaagaauauguuauuccagcagaacaaagacgggauaggcgagaucugccuguggggacggcacauuuuuaugggcuaucuagagagugaaaccgagacaacugaagccaucgacgaugagggguggcuccacagcggagaccugggucagcuugauggcuugggguuccuguacgugaccggacauaucaaggaaauucucauaacagcuggcggugagaauguaccacccaucccgguugagacccuggugaaaaagaagauuccuaucauuuccaacgcgaugcuugucggggacaaacugaaguuuuugucuaugcuccugacuuuaaaaugugaaaugaaucaaaugagcggcgagccccuggauaagcuaaacuucgaagcaaucaauuuuugccgcggacucggcucacaggccaguacggugacagagauagucaaacagcaggacccacugguguauaaggcuauccaacaggggauuaacgccguuaaucaggaggcaaugaacaaugcccagcgaaucgaaaaaugggugauucuugagaaggauuucuccaucuacggaggugaauugggcccuaugaugaagcugaaaagacacuuuguagcucaaaaguacaaaaagcagauagaccauauguaucacuga

SEQ ID NO: 52373 - RNA, 1731 nt, Artificial Sequence
  derived and/or modified sequence opt3 from ACSF3__Homo_sapiens__NP_777577
augcugccccacgugguccucaccuucagaaggcuuggcugcgcccuggcuagcugucgguuggccccugcacgccaucgaggguccggauuacugcacacagcgccaguugcucguucugacagaucagccccgguguuuacuagggcacuagccuucggugaucggaucgcucucguagaccagcauggccgccacacguacagagagcuguauaguaggagccuucggcugucccaagaaauuugccgcuugugugggugcgugggaggcgaucuccgagaggaaagagucucuuuucugugugcaaacgacgccucguacgugguugcucagugggccucauggaugagcggugggguggcggucccccuguauaggaagcauccugcagcccagcucgaguacgugauaugcgauagucaguccucuguaguuuuagcuagccaagaauaucuggagcuuuuguccccagugguccggaaacugggagugccccuacucccucugaccccagccaucuacacaggcgcaguggaggaacccgcugaggucccuguuccagaacagggcuggcguaauaagggggccaugauuaucuauacuucaggaaccacaggucgcccgaaaggcgugcuuaguacccaccagaacauuagagcgguagugacugggcugguccacaagugggccuggacaaaagacgaugugaucuugcauguucucccccugcaccaugugcacggagucgugaaugcauuacuguguccucucuggguaggcgcuaccugcguuaugaugccagaguucagcccccagcaagugugggagaaguuucuuucuuccgaaacgccuaggauaaacgucuucauggccgugccaacuaucuacaccaagcugauggaguacuaugaccggcacuuuacacagccccaugcucaggauuucuugcgagccgucugugaagagaaaauucgccuaauggugucagguagcgcagcccugccgcucccuguucuggaaaaguggaaaaauaucacugggcacacccuucuggagagauacggaaugacagagauuggcauggcuuugaguggcccccucaccacggcggugaggcugccagggucuguaggaacuccuuuacccgguguccaggugcggaucguuuccgaaaacccacaacgcgaggcaugcagcuauacaauacaugccgaaggcgacgagagagggaccaaggugacucccggauuugaagagaaagagggcgaacugcuagucagggguccuucgguguuccgugaguacuggaauaagccagaagagacaaagucugcuuuuacccucgaugggugguucaaaacgggcgacaccguaguguuuaaggauggacaguauuggauucggggccgaacauccguugacaucauuaaaacugggggauacaaggucucagcccuggaaguggaguggcaccuuuuggcacauccgaguaucaccgacguggccgucaucgguguucccgauaugacauggggccagagagugacugcugugguaacccugagggaggggcacagccucucccaccgcgaacugaaagagugggcccggaacguccuugcaccuuaugcggugccaucugaacugguuuugguggaggagauucccagaaaucaaaugggaaagauagacaaaaaggcucucaucaggcauuuccacccuagcuga

SEQ ID NO: 52374 - RNA, 1995 nt, Artificial Sequence
  derived and/or modified sequence opt3 from ACSL1__Homo_sapiens__NP_001273640
augcaggcccacgagcuguucagauacuuuaggaugcccgaacucguggacuuccggcaauauguccgcacccuuccuacaaacacucugaugggcuuuggggcuuucgcagccuugacgaccuuuugguacgcgacacgaccaaagccguuaaaacccccuugcgaucugagcaugcaguccguugagguggcuggaucugguggcgcccguagaucagcacuacucgacagugaugaaccacugguauauuucuacgacgaugugacuacccuuuaugagggguuucagaggggaauccaggucagcaauaacggccccugucuggguucccggaagccugaccaaccauacgaaugguugucuuauaaacagugggugauuauagagcaggggugcuucgccuacucgaugguuaucgugccccucuacgauacacugggaaaugaggcuauuaccuauaucgucaacaaggcagaacugucacucguguuuguagacaaaccugagaaggccaaguuacugcuugaaggcguugagaauaaauugauuccaggccugaagaucauaguggucauggaugcuuacgggagcgagcuaguggaacgcggacagagaugugguguggaggucacaaguaugaaagccauggaagaccucggcagggcgaaccggcgcaagccgaaacccccugcaccagaggaucuggccguuaucugcuucacuuccgggaccacgggaaaucccaagggcgcuauggugacucaucgaaacauuguaucugacuguagcgccuuugugaaggcaaccgaaaauacagucaacccuugcccagaugacacucuuaucuccuuccugcccuuggcucacauguuugagagagugguugagugugugaugcucugccauggugccaaaauuggguucuuccaaggagacaucaggcuguuaauggaugaccugaagguccuccagccgaccguguuuccuguaguuccccggcuucugaaucguauguucgaucgcauauuuggccaggcgaacacaaccuugaaaagauggcuacuggacuucgccucaaagaggaaagaagcagagcuccggaguggcauuauccgaaauaacagccugugggaucgccuuauuuuucacaaggugcagucuucccugggagggagagucagguugauggugacgggugcugccccagucucagcuacugugcucacauuccugcgggccgcauuaggcugucaauuuuaugaaggguacggacagaccgagugcacugccggcuguugccugacaaugccuggugacuggaccgcugggcauguuggcgcgcccaugccaugcaaucuaaucaaacucguggauguagaagagaugaacuauauggcagccgagggagaaggcgaggucugugugaaggggcccaacguuuuccagggauaccugaaggacccugcuaaaacggccgaagcacuugauaaggacgguugguugcacaccggcgauaucgggaaauggcugccaaauggaacacucaagauuauagaccgcaaaaagcacaucuuuaagcuggcccaaggcgaguauauugcuccggagaaaaucgaaaacauauacaugagaagcgagcccguggcccaggucuucgugcauggugaaagucuucaggcauuucugauugcgaucguagugccugacguugagacuuugugcucuugggcucagaagaggggguucgaaggcuccuuugaggagcucugucguaauaaagaugucaagaaagccauccuggaagacauggugcgguuaggaaaggauagcggccugaagccauucgagcaagugaaagggauuacccuacaccccgaacucuucucgaucgacaacggacugcuuacaccuacuaugaaggcaaaacgaccagaguugagaaauuacuuuaggucucagauugaugaccuguauuccaccauaaaggucuga

SEQ ID NO: 52375 - RNA, 2163 nt, Artificial Sequence
  derived and/or modified sequence opt3 from ACSL3__Homo_sapiens__NP_976251
augaacaaucacgugagcuccaagcccucuaccaugaaacugaagcauacaaucaacccuauucuccuuuacuucauacacuuucugaucucauuguauacuauuuuaacguacaucccauucuacuuuuucagugagagcagacaggaaaaauccaauaggauuaaggccaaaccggucaacucuaagcccgacucggcuuaucggucaguuaauagccuggauggccuagcaagugugcucuauccugggugcgacacccuggauaagguauuuacauacgccaaaaacaaguucaaaaauaagcgccuucugggaacucgagagguguugaacgaagaggacgaaguccaaccaaaugguaaaaucuuuaagaaggugauacucggccaguauaacuggcuguccuacgaggauguuuucgugcgugcguuuaauuucgggaacggacugcagaugcucggccagaaacccaagaccaauaucgcuaucuuuugugagacaagagccgaauggaugauugcagcccaagcaugcuucauguacaacuuucaguuagucacccuguaugcaacucuuggugggccugccauugugcaugcuuugaaugagacagaaguaaccaacaucauaacgucuaaagagcugcuacagacuaagcucaaagacauuguuagccuggugccaaggcuucggcacaucauuaccgucgauggaaagcccccuacaugguccgaguucccaaaaggcaucaucgugcauacuauggccgcgguggaagcacugggcgccaaggcuucaauggagaaccagccgcacaguaagcccuugccuagcgacauugccgucauaauguacaccucuggguccacaggacucccaaaagguguuaugaucucacacagcaauauuaucgcaggcauaaccgggauggcugaacgcauucccgagcugggagaagaggauguguauaucggcuacuuaccucuggcccauguacucgagcuuagugcggaacugguguguuugucucacgguugcagaaucggguauuccagcccacaaacgcuagccgaccagucgucuaagauuaaaaagggauccaaaggcgauacuucaaugcugaagcccacacucauggcagcugucccggagaucauggacaggauuuacaagaacgugaugaauaaaguuagugaaaugagcuccuuccagcggaaccuguuuauacuugccuauaauuacaagauggagcagaucucuaaaggccgcaacaccccucugugugauagcuucguguuucgaaaggucagaucauugcucgggggaaauauuaggcuguuacugugcgguggcgcuccccuaagugccacuacacaacgguucaugaacaucuguuuuugcuguccaguggggcagggauacggccucaccgaauccgcuggugccgggacgaucagcgagguaugggacuauaauaccggccguguuggagcuccucuggugugcugugagauuaaacuuaagaacugggaagagggcggguacuucaauacagacaagccccauccacgcggagaaauauugaucgguggccagucugucacuaugggguauuacaaaaacgaggcgaagaccaaagcagacuuuuucgaagaugagaauggacaaagauggcugugcacaggcgauauuggugaguuugaacccgacgggugccucaagaucauugauaggaaaaaggaccuggugaaacuucaggccggcgaguaugucucacugggaaagguggaagcugccuugaagaaccucccucugguugauaauaucugugcauacgccaacaguuaucacagcuacgugauaggcuucguagucccaaaccagaaagaguuaacugagcuggcucggaagaaagggcuaaagggaaccugggaggaacucugcaauuccugugaaauggagaacgaagugcugaaaguucuuucugaggccgcaaucucggcgagcuuggagaaguuugaaauuccggugaagauccgacugucccccgagccuuggacaccagaaaccggucucgucacugacgcuuucaaacugaagcgcaaagaguuaaagacgcacuaccaggccgauauugaaagaauguauggcaggaaauga

SEQ ID NO: 52376 - RNA, 2220 nt, Artificial Sequence
  derived and/or modified sequence opt3 from ACSL5__Homo_sapiens__NP_057318
auggacgcccugaagcccccuugccucuggagaaaccacgagaggggcaaaaaggaucgggacagcugugggcgcaaaaauuccgaaccaggaucuccgcauucacuugaggcucugcgagaugcagcccccagucaggguuugaacuucuuacugcuauuuaccaagaugcuauucaucuuuaauuuccuguuuagcccucuuccaacacccgcgcugauuugcauauugacuuucggcgcugccaucuuucucuggcugauuacgcguccucaaccagugcugccccucuuagaccugaacaaucaguccgucgggaucgaaggaggcgcaagaaaagguguuucucagaagaacaaugaucuuaccucguguugcuucucagacgccaagacaauguacgagguguuucagaggggguuggcuguaagcgauaacggaccuugucugggcuaucggaaaccaaaucaaccguaccgcuggcuaaguuauaaacagguguccgacagagcagaauaccucggcucuugccugcuucacaagggguauaagagcucccccgaucaguucgucggaauuuuugcccagaacaggccugaguggaucauaucagagcuggcuuguuacacuuauaguaugguggccguuccauuguacgacacccucggucccgaagcgaucgugcauauugucaauaaagcagauaucgccauggugauuugcgacacaccucaaaaggcucugguauuaaucggcaacguugagaagggguucaccccaagccugaaagugauaauucucauggaucccuuugacgacgaucuuaagcagcggggagaaaaaucuggcaucgagauucuguccuuguacgacgccgagaaucuagguaaggaacacuuccgcaaaccggucccucccucaccagaggaucugagcgugaucuguuucacuagcgggacaaccggagacccuaagggcgcaaugaucacgcaucagaacauugugucuaaugcugccgcguuucucaaaugcgucgaacacgccuaugagcccacuccagaugacguugcaauauccuaccugccccuugcucacauguucgaacgaaucgugcaggccguaguguauagcuguggcgcuagagucggguuuuuccaaggagauauuaggcuguuggccgacgauaugaagacccucaagccuacacuguuuccagcagugccgcgguuacugaaccguaucuacgacaaaguucagaacgaggccaagacuccccucaaaaaguuccuccugaaacuugcugugucgucuaaguuuaaggaguugcagaaagguauaauucgccaugauuccuucugggacaagcugaucuuugcgaaaauccaagacucacucggcgggagagucagggugauuguaaccggagcagccccuaugaguacaagcguuaugaccuucuuucgggcugccaugggcugccagguguaugaagcauacggucagacggagugcacugggggcuguacauucacccugccaggagauuggacuuccggccacgucggggugccccuugccugcaauuaugucaagcuggaagacguggcugauaugaacuacuuuacaguuaauaacgagggagaaguguguaucaaagguaccaauguauucaagggcuacuugaaggacccugagaaaacgcaggaggcccucgauucugacggguggcugcauaccggagauauuggccgaugguuaccaaacgguacacugaagauaaucgaccgcaaaaagaauauuuucaaacuagcacaaggggaauauaucgcgcccgagaagaucgaaaacauuuacaauagaagccagccgguccuccagauauuugugcacggcgagucacugaggaguucccuuguuggaguggucgugccugauacugacguauugccaaguuucgcugccaagcugggcgugaaagggucuuuugaggaacucugccagaaccaaguuguccgggaggcaauccuggaagauuuacagaagauuggaaaagagucaggucugaagaccuucgaacaggugaaagccaucuuucuucaccccgagccuuucaguauugagaauggcuugcucacacccacucugaaggcuaaacgcggggaacuaagcaaguauuuuagaacccagaucgacucccuguacgagcauauacaagauuga

SEQ ID NO: 52377 - RNA, 2169 nt, Artificial Sequence
  derived and/or modified sequence opt3 from ACSL6__Homo_sapiens__NP_001009185
augcugaccuucuuucucgugagcggcgggucccuuuggcuguucgucgaguuuguuuugucuuuacuggaaaagaugcagacacaagagauccuaaggauucucagacugcccgaacuuggagaccugggucaguucuuucggucauugagugccacuacgcucgugagcaugggcgcucuggcagccauacuggcguacugguucacccaccgcccuaaagcucuccagccaccgugcaacuuacugaugcaguccgaggaaguagaggauucugggggagcccgacguucggugaucggcucagguccccaacuuuugacacauuauuacgacgaugcaagaacuauguaucaggucuuuaggcgggggcugagcauuaguggaaauggcccuugucuaggcuuccgcaagccaaaacagcccuaccaguggcucuccuaucaagagguggccgacagagcugaauuucuggggucuggacuucugcagcacaacugcaaggcauguaccgaucaguucaucgguguuuuugcccagaauaggccugaguggauuaucguggaauuggcuugcuacacauauagcauggucgugguaccacucuacgacacccugggccccggggccauacgguacaucauuaacacugcggauaucuccacaguuauuguggacaaaccucaaaaggcagucuuacugcucgagcauguggagcgcaaggaaaccccaggacuuaaacugaucauauugauggauccguucgaggaagcccuaaaggagcgaggccagaaaugugguguggucauuaagucaaugcaggcuguugaagacugcgggcaagagaaucaccaggcccccgugccuccacagcccgaugaccugaguaucguauguuuuacgagcggaacuaccggcaacccuaaaggcgcaaugcucacacaugggaauguggucgcugauuucucuggauuccugaaggugacugagaagguuauuuuuccaagacaggacgacgugcuuaucuccuuccugcccuuggcccacauguuugaaagggucauccaaucagugguauauugccacgguggccggguuggguucuuucagggagauauucgucuccugagcgacgauaugaaagcguuauguccgaccauauucccuguggucccccgccugcuaaacagaauguacgacaagaucuuuagucaggccaauacaccacucaaaagguggcugcuugaguucgcagcuaagcggaaacaggccgaagugcgaucuggcauuauccgcaacgauuccauaugggacgaguuguuuuucaauaagauucaagcuagccugggugggugcgucagaaugaucgugaccggcgccgccccugccucgcccacgguucucggauuucugagggcugcgcuuggcugucagguguaugaaggguacggacagacugagugcacagcagguugcaccuucacuacaccaggcgauuggaccucugggcauguaggagcaccccugccuuguaaccacaucaaauuggucgacguggaggaacucaauuauugggcuugcaagggcgagggugaaauuuguguucgggggccaaacguguuuaagggcuaccugaaagauccggaccgcacgaaggaggccuuagauuccgacggauggcugcauaccggcgacaucgggaaauggcuacccgcaggaacacucaagauuauagauaggaaaaagcacaucuucaagcuggcccagggugaauaugucgcuccugagaaaauugagaauaucuacaucagaucacaaccaguggcccagauuuacguacacggcgacagucuuaaggcauucuugguggggauaguuguccccgauccugaagugaugccaagcugggcgcagaaacguggaaucgagggcacuuaugcugaccugugcaccaacaaggaucucaaaaaggccauucuggaagacauggugcgguuagguaaggaguccgggcugcauucuuuugagcaggucaaagcaauccacauucauagcgauauguucucaguucaaaacggccuuuugacacccacucucaaggccaaacgaccggaacugagagaguacuuuaagaaacagaucgaggaacuauauaguauauccauguga

SEQ ID NO: 52378 - RNA, 1734 nt, Artificial Sequence
  derived and/or modified sequence opt3 from ACSM1__Homo_sapiens__NP_001305819
augcaguggcugaugagauucaggacccucuggggcauccacaagagcuuucauaacauucaccccgccccuucccaacuucggugccgcucucugucagaguucggggcuccacgauggaaugacuacgaagugccggaggaauuuaacuucgcaaguuaugucuuggauuacugggcccagaaagagaaggaaggaaaacguggucccaauccugcguuuugguggguuaacggccagggggacgaggugaaguggagcuucagagagaugggagauuuaacaaggcggguagcuaauguguuuacucagacguguggccugcaacagggugaccaucuagcccucaugcugccacgcguccccgaaugguggcuuguggcaguugggugcaugagaaccggaauaaucuucauuccugccacaauccuguugaaagcuaaggauauucucuauaggcugcagcuguccaaggcaaaaggcaucgugacuauagacgcccucgcuucugaggucgauucgaucgccucacaguguccaagccuuaagaccaaacugcuugugagugaccacucccgggaaggcugguuggauuuucgcucucugguaaagagcgcgucccccgagcauacaugcguuaaaucaaagacccuagacccuauggugauuuucuuuaccagugggacaaccggauucccaaagauggcaaaacacagccacggucucgcccugcaaccgucuuuucccggcucccgaaaguuaagaucacugaaaacgagcgaugucaguugguguuugucugacuccggguggaucguggcuacuauuuggacccucguggagccuuggacagccggaugcacugucuucauccaucaucugccacaguucgauaccaagguuauaauucagacauuacugaaauaccccaucaaccacuuuuggggcgugagcucgauuuauaggaugauccuccagcaagacuucaccucuauccgguuuccugcacuugaacacuguuacacggguggggagguagugcugccaaaggaccaggaagaguggaaacgucgcacuggauugcuacuguaugaaaauuacggccaguccgagacaggccucauuugcgcuaccuacugggggaugaagauaaagcccggauucauggguaaagccacuccgccuuaugauguccaagugaucgacgauaagggcucaauucugcccccaaacacagaggggaauaucggaauaagaauuaaaccuguuaggcccgugagucuuuuuauguguuacgaaggcgacccagagaagaccgcgaaagucgaaugcggugauuucuauaacacgggggaccggggcaagauggaugaggaaggauacaucuguuuucugggccgaagcgacgauaucauuaaugccuccggguaucgcaucggacccgcagagguggagucugcuuugguagaacacccugccguugcugagagcgccguggucgguucaccagacccgauuagaggcgaaguggucaaggcauucauagugcucacuccccaguuucugagucaugauaaagaccaguuaacaaaggagcugcagcaacacguuaaauccgugacugccccuuacaaguauccaaggaaaguagaguucgucagcgaacuacccaagaccaucacagggaagauugagcggaaagaacuccgcaagaaagagacuggacagauguga

SEQ ID NO: 52379 - RNA, 1734 nt, Artificial Sequence
  derived and/or modified sequence opt3 from ACSM2B__Homo_sapiens__NP_001098539
augcacuggcugagaaaggugcagggccucugcacccuuugggggacacaaaugagcuccaggacucuguacaucaacucucggcaguuggucucauuacaguggggacaucaggagguucccgccaaauucaauuuugcuagugacgugcuggaucacugggcagacauggaaaaggccgguaaacgccuaccuagcccagcgcucugguggguaaacggcaaggggaaagagcugauguggaauuuccgagaacuuuccgagaacucucaacaggcugccaauauucugucgggagcauguggcuugcagcguggugauagaguggccgucaugcucccgagggugcccgaaugguggcugguuauacuggggugcauccgggcuggacucauuuuuaugccuggcacgauccagaugaagucaaccgacauuuuauaucgccugcaaaugagcaaggcaaaagccaucguggcuggcgaugaggucauacaggagguggacacaguagccagugaauguccaucccuuagaaucaaguugcugguuucugagaaaagcugcgauggguggcuaaacuucaagaaacuccugaaugaagcguccacuacccaucacuguguggagacaggaucacaggaggcaagugccauuuacuuuaccagcgguacuucuggccuucccaagauggcugaacauuccuauucaagccugggguugaaggccaaaauggacgcaggauggacaggccuccaggcuagugauaucauguggaccauuucugacacggguuggauccugaacauauuagggucccugcucgagagcuggacucuuggagccugcaccuucguccaccuguugccuaaguuugauccccuagugauucugaaaacacucucgucuuacccaaucaaguccaugaugggcgcgccuauuguguauaggaugcugcuucaacaggaccugucaaguuacaaauucccacacuugcagaauugucucgccggcggggaaagccuguuaccggagacucuggaaaacuggcgggcacaaaccggacuagauauccgcgaguuuuauggucagacagagaccggccucacgugcauggucuccaagacuaugaaaaucaagcccggguacaugggaacagcugccucuuguuacgacguucaggugauugacgauaagggcaauguacugccuccagguaccgaaggggacauaggcauccgagugaaacccauuagaccuaucggaauauucagcggcuaugucgagaacccagauaagacugcugccaauauuaggggagacuuuuggcuuuugggggaucgggguaucaaagacgaagauggcuacuuccaguuuauggggcgugcagacgauaucauuaacucaaguggauaucgcaucggccccuccgagguggaaaaugcccugaugaagcauccggcuguuguggagacagcggucauuagcucuccugaccccgugagaggugagguaguuaaagcauucgugauacucgccucacaauuccugagucacgauccagaacagcuuaccaaggagcugcagcagcaugucaagagcgugacggcuccuuacaaauaucccaggaagaucgaauuugucuugaaccucccaaaaaccgugacagggaagauucaacggacuaaacugcgagacaaggaguggaagauguccggcaaagcccgcgcacaguga

SEQ ID NO: 52380 - RNA, 1761 nt, Artificial Sequence
  derived and/or modified sequence opt3 from ACSM3__Homo_sapiens__NP_005613
augcuggccagagugaccaggaagaugcuccggcacgcuaaaugcuuccagcgccuugcaaucuuuggcagcguccgagcccugcauaaggacaaccguacagcgacuccccaaaauuucuccaacuacgagucuaugaaacaggauuuuaaguuggggauuccugaauauuucaauuuugcuaaagacguuuuagaucaguggacggacaaggagaaggccgguaaaaagccaucaaacccggcauucugguggauaaauagaaacggagaagagaugagguggaguuuugaggaacugggcagccuaucccggaaauucgccaauauccucucugaggcuuguucgcugcagcgcggggauagagugauucuuauccugcccaggguaccugaauggugguuggcaaacguggccugccuccggaccggaacaguccugauuccaggcacuacccaacugacacagaaggacauccucuaccgcuuacagucaagcaaagcuaauuguauaaucaccaacgaugugcuggcccccgcgguugacgcaguggccaguaagugcgagaaucuucacuccaaguugauugucucugaaaacagccgagaggguugggggaaucugaaagagcuaaugaagcaugcuuccgauucacacacuugugugaaaacaaagcauaacgaaaucauggccaucuuuuucaccaguggaacgagcggcuauccuaaaaugacugcacacacccacucuuccuuuggccucgggcugucaguaaauggaagauucuggcuugaccugacaccaagcgauguuauguggaacaccagugacacugguugggcuaagucugccugguccagcguguuuucgcccuggauucagggcgcgugcgucuucacacaucacuugccuagguucgagccaaccucuauacuccaaacgcuguccaaauacccgauuacuguguuuuguucagcccccacaguguaucggauguuaguccagaacgauaucaccaguuacaaguucaagagccugaaacauugcguuuccgcaggggaaccuauuacuccagacgugacagagaaguggcguaauaaaaccggacucgacaucuaugaaggcuacggucagacggagaccguacuuaucugugggaacuuuaagggaaugaaaauuaagcccggcucuaugggcaagccuagcccagcuuucgaugugaaaauagucgacgugaaugggaacguucugcccccgggacaggagggugauaucggcauucaaguguugccuaaucgccccuuugggcuauucacacacuacgucgacaacccaucaaagacugccaguacccugagaggaaauuuuuauaucacaggcgauagggguuacauggacaaagauggguauuucugguuuguggcucgggccgacgauguaauacucuccagcggcuaccgaauuggaccuuucgaaguugagaacgcacugaaugaacaccccucuguggccgagucagcugucgugaguagcccagaccccauccgcggcgaagucgugaaggcguuuguugugcuuaacccugauuauaaaucccaugaccaggagcagcugaucaaggagauucaagaacacguaaagaaaacuaccgcaccauacaaguauccgagaaaagucgaguucauccaggaauugcccaagacaauuucugggaaaaccaagaggaaugagcuccggaagaaagaauggaagacuauauga

SEQ ID NO: 52381 - RNA, 1707 nt, Artificial Sequence
  derived and/or modified sequence opt3 from ACSS1__Homo_sapiens__NP_001239605
augagaaggcggaaggagcgccagcccugggaccgauuccacuuucugcauuucgccccucacggccgugaacuccuugagaccacaugcagacuggcuaacacuuugaaaaggcauggggugcaccggggagaucgcgucgcaaucuacaugccaguuagcccguuagccguggcggcuaugcuggccugugcaagaauuggugccguacauacggugauauuugcuggcuucuccgcagaaucucuagccgggaggaucaaugacgcuaagugcaaagucgugauuaccuuuaaccaaggacuccggggcggucgcguuguggagcugaagaaaaucgucgaugaagccgugaagcacugucccacaguacagcacguucuuguggcgcaucgaacugacaauaagguccacaugggggaucuggacgugccuuuggagcaggagauggcaaaagaagauccagugugcgcccccgagucaaugggaagugaagacaugcucuuuaugcuguauaccagcggcuccacaggcaugccuaaggggauuguccauacccaggcuggauaccugcucuaugccgcauuaacucacaaacugguuuuugaucaccaaccaggugacaucuucggcuguguggcugauauaggguggaucacaggacauucuuacguaguguauggcccccuuugcaacggugccaccucggucuuguuugagucaacgccuguguacccaaaugcggggagauauugggagacuguugaaaggcugaagauuaaccaguucuacggagccccgaccgcagugcggcuacuccugaaauacggcgacgcuugggucaagaaguaugaucguagcagucuucgcacacugggcuccgugggggagcccaucaauugugaagccugggagugguugcacagaguaguuggagacucuaggugcacucucguggacaccugguggcagacagaaaccgguggcauuuguaucgcuccucggccaagcgaggagggggccgaaauacugcccgcaauggccaugcgaccuuucuucggaauugucccaguguuaauggaugagaaaggcuccgucguggaagguucaaacguuaguggggcucugugcaucagccaggcguggcccggcauggcacgcacgauuuacggagaccaucaaagauuuguggaugccuauuucaaggcuuacccgggcuauuacuucacuggggacggagccuauaggacagaggguggcuacuaccagaucaccgggcggauggaugacguaaucaauauuucuggacaccgccucggcacugcagaaauagaggaugccaucgcugaccauccugccguccccgaguccgcagugauugguuauccacacgauaucaaaggggaagcggcuuuugccuucauaguugugaaggacucagcaggcgauagcgacgucgugguacaggagcuuaaaaguaugguggccacaaagauugcuaaauacgccguuccugacgaaauccuggucgugaagagauugcccaagaccaggucuggaaaagugaugcgucggcuacugcgaaagaucauuacguccgaggcacaggaacucggcgauaccacaacucuggaggacccaagcaucauugcugagauacuuucggucuaucaaaaauguaaggauaaacaggccgcggccaaguga

SEQ ID NO: 52382 - RNA, 2145 nt, Artificial Sequence
  derived and/or modified sequence opt3 from ACSS2__Homo_sapiens__NP_001070020
augggccugcccgaggaaagagugaggagcggguccggaucucggggucaggaggaagccggcgcugggggacgcgcacgaucauggaguccuccaccggaggucagccguuccgcccacguucccucucuccaaagauacagggaacuucaucggcgcucgguggaggagccuagagaguucuggggcgacaucgcgaaggaguuuuauuggaaaaccccaugccccgguccuuuccugagguacaacuuugauguaacaaaggggaaaauuuucauagaauggaugaagggagcuacuacgaauaucuguuauaacguguuggaccggaauguccacgagaaaaaguuaggcgauaagguggccuuuuacugggagggcaacgaaccaggggagaccacacagauuacuuaucaucagcugcuaguucaggugugccaauucucaaauguccuccgcaaacagggaauccagaagggugaccgaguggcaauuuacaugcccaugaucccugaacugguaguugccaugcuugcuugugcaagaauaggcgcccugcacagcaucguguuugcuggguucaguuccgagucuuugugcgaaaggauucucgauagcuccuguucacugcugaucaccacagacgccuuuuaucggggagagaaacucgucaacuuaaaggagcuggcggaugaagcacuucagaaaugccaagagaagggcuucccagugcguuguugcauuguggucaagcauuugggucgcgccgaacuggggaugggagacaguaccagccagucuccgcccaucaaaagauccuguccugauguucagggcaagcuaaaagagaagucaaaaagggugcagccacaaauaagcuggaaucagggcauugaccucugguggcacgaacugaugcaggaggcuggggaugagugcgaacccgaguggugugacgccgaagauccucuuuuuauccuguacacaaguggaucuacugguaagccaaaaggcguagugcacaccgucgggggauacauguuguauguggcaacgacuuucaaguacguuuuugacuuccaugcugaggacguguucuggugcaccgccgauauuggcuggaucacaggucacuccuaugucacuuacgggccccucgcgaacggcgccaccagcgugcuguuugaaggaaucccgacauauccugacguaaaucgguuauggucgauuguugauaaguacaaagugaccaaguucuauacggcacccacugcuauacgacugcucaugaaauuuggcgacgagccagucacaaagcauucucgcgccucccuucaagugcuggggaccgucggagagccuaucaaccccgaggcuugguugugguaccacagagugguuggugcccagaggugcccaauuguggauacuuucuggcagacagaaaccggcgggcacaugcuaacgccccugccuggagcaaccccaaugaaaccgggcucagccacauuucccuucuuugguguagcuccugcgauccucaaugaaaguggggaggagcuggaaggcgaggcagaaggauaccuugucuucaagcagccauggcccggcauaaugcggacuguguaugggaaccaugagcgcuuugaaaccacauacuucaagaaauuuccuggauauuacguuacuggugacggcugucaaagagaucaggacggguauuacuggauuaccggaaggaucgaugacaugcugaaugugagcggccacuugcucuccacagccgaggucgagucugcucugguggaacaugaggccguagcagaagccgcugugguuggucacccacaucccgucaagggggagugcuuauauuguuucgugacccugugcgauggccacacuuuuagcccgaaacuaacggaagaacucaagaaacagauccgugagaagauuggaccuaucgccacaccagacuacauucagaacgcacccggccugccuaagacccggucagggaaaauaaugcgaagagugcuuaggaagaucgcgcaaaaugaccacgauuugggagacaugaguacugucgcugaucccuccguuauuagccaucuguucucucaccgcugucucaccauccaguga

SEQ ID NO: 52383 - RNA, 2061 nt, Artificial Sequence
  derived and/or modified sequence opt3 from ACSS3__Homo_sapiens__NP_078836
augaagcccagcuggcugcagugcagaaaagugaccuccgccggcgggcucggagguccucuuccagggucuucaccggcuaggggcgcaggagccgcgcugcgggcuuuggucguucccggcccucgcgguggguuaggaggccgaggcugucgugcccugaguagcggguccggaucugaguacaagacacacuucgcagccucggugacugacccagaaagauuuugggguaaagcugcagagcaaaucucaugguauaagcccuggacgaaaacccuagaaaacaagcauagcccuaguacaaggugguucguagagggcaugcucaauauuugcuacaacgccguggaucggcacauagaaaaugggaagggagacaaaaucgcuauuaucuaugauuccccagucacuaacaccaaggccacauuuaccuacaaagaggugcuggagcagguuucuaaacuugcgggcgugcuggucaagcaugguauuaagaagggggacacugugguaaucuauaugcccaugauaccucaggcaauguacacaauguuggccugugcucgcaucggagccauucacagccucaucuucggcggcuuugcauccaaagaacugucaaguagaauugaucauguuaagccaaaaguggucgugaccgcuagcuucgggaucgagccgggaaggcggguggaauaugucccccugguugaggaggcccucaagauaggucagcacaaaccugacaagauuuuaaucuacaaucgcccaaacauggaagcggugccccuggccccuggccgagaucuugacugggaugaggaaauggcaaaagcucaaucucacgacugcguaccaguguuguccgagcauccccuguacauucuauauacgucagggacuaccggacucccgaagggcgucaucagaccuacagguggguacgccgugaugcugcacuggagcaugaguucuaucuauggccuucagcccggagaaguuuggugggcugccuccgaucugggcuggguggucgggcauagcuacauuuguuauggaccauugcuccacgguaauacuaccgugcuguacgagggcaagccuguagggacacccgacgcaggagccuauuuuaggguuuuagcugagcacggcguggcggcacuguucaccgccccaacggcuauacgggccauccgucagcaggaucccggugcagcccucgggaaacaauacucgcuuacucgcuuuaagacacuguucgucgcuggcgaaagaugcgacguggagaccuuggaauggucuaaaaacgucuuuagggugccuguucuagaccauugguggcagacugagacaggauccccaauuaccgccucaugugugggccuggggaauaguaagacgccgcccccuggacaggcagguaaaagcguaccaggcuacaacgucaugauccucgaugacaauaugcagaagcugaaggcgcggugccuugggaacauagugguuaaacugcccuugccuccaggagcuuucuccggccucuggaagaaucaagaagccuuuaaacaccuguauuucgagaaguuccccgguuacuaugauaccauggacgcaggguacauggaugaggaaggcuauuuauacgugaugucucgagucgacgaugugauuaacguagccggacaucgcaucagcgcuggcgccaucgaggaaucaauucugagucacgggacaguggcagacugugcuguugucggaaaagaggauccgcuaaagggccaugugccucucgcccugugcgugcuuagaaaggacaucaaugcgacugaggaacaggucuuggaggaaauuguuaaacacgugaggcagaacauagguccaguggccgcuuuucggaacgcaguauucgucaagcaacugcccaaaacccgcuccgggaagaucccuagaagcgcccucucugcuauugugaauggaaaacccuauaagaucacaucaacuaucgaggauccaaguauuuuuggccacguugaagagaugcugaagcaggccuga

SEQ ID NO: 52384 - RNA, 1134 nt, Artificial Sequence
  derived and/or modified sequence opt3 from ACTA1__Homo_sapiens__NP_001091
augugcgacgaggaugaaaccacagcccuggugugugacaacggcagcgggcucgucaaggcuggauucgccggugaugacgcacccagagcgguuuuuccuuccaucgugggcaggccacggcaccaggggguaauggugggaaugggccaaaaagauucuuacgucggugacgaggcucagucaaagcgcgggauucuuacucugaaauauccgauagaacauggaaucauuacgaauugggaugacauggagaagaucuggcaccauaccuucuacaacgaauugcgaguggcccccgaggagcacccuacauuacugacugaagcaccacuaaaucccaaagccaaccgugagaagaugacccagauuauguuugaaacauucaauguuccugcuauguauguggcaauccaggccguccucagucuguacgcuagcggcagaaccacuggcauagugcuugauuccggggacggaguaacacauaacguuccaaucuaugaggguuacgcccugccccacgcgauuaugagguuggaucucgcaggccgggaccugaccgauuaucugaugaagauccucacggagcgcggguacucuuuugugacuaccgccgaaagagagauugucagggacaucaaagaaaaguuaugcuacguggcucuggacuucgagaaugaaauggccacagcagcuucgucaagcagucuugagaaauccuaugaguugccugauggacaagugauaacuauuggcaacgaacgguuucgcuguccagagacccuguuccagccgucuuuuaucgguauggaaagcgccgggauucacgagacaaccuacaauuccaucaugaagugcgacaucgauauucgaaaagaccuauaugcgaacaaugucaugucaggaggcacgacuauguaccccggcauagccgauagaaugcagaaggaaaucacagcacucgcuccuaguaccaugaagauuaaaaucauagccccacccgagaggaaguauagcguuuggauugggggaucuauccuggcuucccuuucaacuuuccagcaaauguggaucacaaaacaggaguacgacgaagccgguccuagcauugugcaucggaaguguuuuuga

SEQ ID NO: 52385 - RNA, 1134 nt, Artificial Sequence
  derived and/or modified sequence opt3 from ACTA2__Homo_sapiens__XP_011538318
augugcgaggaagaggacagcaccgcccuggugugugauaacggcuccgggcucugcaaggcuggauucgccggugacgaugcacccagagcggucuuuccuucuaucguuggcaggccacggcaccagggggugaugguaggaaugggccaaaaagacucauacgugggugaugaagcucagaguaagcgcgggauucuuacacugaaauauccgauagagcauggaaucauuacuaauugggacgauauggaaaagaucuggcaccauagcuucuacaacgaguugcgagucgcccccgaggaacacccuacguuacugaccgaggcaccacuaaaucccaaagccaaccgugaaaagaugacacagauuauguuugagacuuucaaugugccugcuauguauguugcaauccaggccgugcucucccuguacgcuucuggcagaaccacaggcauaguccuugacucgggggauggagugacccauaacguaccaaucuaugaggguuacgcccugccccacgcgauuaugagguuggaccucgcaggccgggaucugacugacuaucugaugaagauccucacagaacgcggguacucauuuguuaccacggccgagagagaaauugugagggauaucaaagagaaguuauguuacgucgcucuggacuucgaaaaugagauggccacugcagcuagcaguuccucucuugagaaaagcuaugaauugccugacggacaagugauaaccauuggcaacgagcgguuucgcugcccagaaacacuguuccagccguccuuuaucgguauggagucagccgggauucacgaaacuaccuacaauaguaucaugaagugugauaucgacauucgaaaagaucuauaugcgaacaaugugcucagcggaggcacaaccauguaccccggcauagccgacagaaugcagaaggagaucacggcacuggcuccuucuacuaugaagauuaaaaucauagccccacccgagaggaaguauuccgucuggauugggggaucaauccuugcuagccugaguacauuccagcaaauguggaucucuaaacaggaauacgaugaggccgguccuuccauuguucaucggaagugcuuuuga

SEQ ID NO: 52386 - RNA, 1128 nt, Artificial Sequence
  derived and/or modified sequence opt3 from ACTB__Homo_sapiens__NP_001092
auggacgaugacaucgccgcucugguggucgauaacggcagcgggaugugcaaggcaggauucgccggugacgaugcgcccagagcuguuuuuccuuccauugugggcaggccacggcaccaggggguaauggugggaaugggccaaaaagacucuuacgucggugaugaggcccagucaaagcgcgggauacucacccuuaaauauccgaucgaacauggaauugugacaaauugggacgauauggagaagaucuggcaccauacuuucuacaacgaacugcgaguugcacccgaggaacacccuguguuguuaacggaggccccacugaaucccaaagcuaaccgugagaagaugacccagauuauguuugaaacauucaauacuccugcaauguaugucgccauccaggcugugcuaagucucuacgccagcggcagaaccacaggcauaguaauggacuccggggauggaguuacccauacugugccaaucuaugaggguuacgcgcugccccacgcaauucuuaggcuggacuuggccggccgggaucucacagacuaucugaugaagauccugaccgaacgcggguacucuuuuacgacuaccgcugagagagagauugucagggacaucaaagaaaagcucuguuacguggccuuagauuucgagcaagaaauggcaacagcugccucgucaagcagucuggagaaauccuaugaacuuccugacggacaggugauaacuauuggcaacgagcgguuucgcugcccagaggcguuguuccagccgucuuuucuggguauggaaagcugugggauccacgagaccacauucaauuccauuaugaagugcgaugucgacauccgaaaagaucuauacgccaacaccguucucucaggaggcacgacuauguaucccggcaucgcagacagaaugcagaaggaaauuacagcucuggccccuaguaccaugaagauaaaaaucauugcuccacccgagaggaaguacagcguguggaucgggggaucuauacuugccucccugucaacuuuucaacagauguggauuagcaaacaggaauaugaugagagugguccuucuaucguacaucggaaguguuucuga

SEQ ID NO: 52387 - RNA, 1131 nt, Artificial Sequence
  derived and/or modified sequence opt3 from ACTBL2__Homo_sapiens__NP_001017992
augaccgacaacgagcugagcgcccucguggucgauaauggcuccgggaugugcaaggcuggauucgguggcgacgaugcacccagagccguuuuuccuucuaugaucgggaggccacggcaccagggagugaugguaggcaugggucaaaaagacuguuacgugggggaugaagcgcagucaaagcgcggaguccuuacacugaaauauccgauugagcauggcgugguuacuaacugggacgauauggaaaagauaugguaccacacguucuauaaugaguugcgaguggcucccgacgaacauccuaucuuacugaccgaggccccacuaaaccccaaaauuaaucgugagaagaugacacagaucauguuugaagcauucaacacuccugccauguacgucgcuauucaggcagugcucagucuguaugccagcggcagaaccacagggaucguaauggauuccggagacgguguuacccacauagugccaaucuacgagggcuaugcuuugccccaugccauucugagguuggaucucgcggggcgggaccugacugauuaccugaugaagauccucacagaacgcggauacaauuuuaccacgacugcagagagagagauugucagggacgugaaagaaaaguuaugcuauguggcccuggacuucgagcaagaaaugguccgggcugccgcaucuucgucaccugagcgcagcuacgaacuuccagauggccagguuaucaccauagguaacgagcgauuuagauguccggaggcuauuuuccagcccaguuuucuugggaucgaauccucuggcauucacgagacaacuuucaauagcaucaugaaaugcgacguggauaucaggaaggaccuguaugccaacaccguacuauccggaggcucaacaauguacccugggauugcggaucggaugcagaaagaaauaaucacccucgccccaaguacgaugaagauuaagaucauagcacccccugagcguaaauauagcguguggauuggagguucuauccuggcuucccuuucaacuuuucaacagauguggaucagcaagcaggaauacgacgaggccggcccacccauuguccaccgcaaauguuucuga

SEQ ID NO: 52388 - RNA, 1134 nt, Artificial Sequence
  derived and/or modified sequence opt3 from ACTC1__Homo_sapiens__NP_005150
augugcgacgaugaggaaaccacagcccuggugugugacaacggcagcgggcucgucaaggcuggauucgccggugaugacgcacccagagcgguuuuuccuuccaucgugggcaggccacggcaccaggggguaauggugggaaugggccaaaaagauucuuacgucggugacgaggcucagucaaagcgcgggauucuuacucugaaauauccgauagaacauggaaucauuacgaauugggaugacauggagaagaucuggcaccauaccuucuacaacgaauugcgaguggcccccgaggagcacccuacauuacugacugaagcaccacuaaaucccaaagccaaccgugagaagaugacccagauuauguuugaaacauucaauguuccugcuauguauguggcaauccaggccguccucagucuguacgcuagcggcagaaccacuggcauagugcuugauuccggggacggaguaacacauaacguuccaaucuaugaggguuacgcccugccccacgcgauuaugagguuggaucucgcaggccgggaccugaccgauuaucugaugaagauccucacggagcgcggguacucuuuugugacuaccgccgaaagagagauugucagggacaucaaagaaaaguuaugcuacguggcucuggacuucgagaaugaaauggccacagcagcuucgucaagcagucuugagaaauccuaugaguugccugauggacaagugauaacuauuggcaacgaacgguuucgcuguccagagacccuguuccagccgucuuuuaucgguauggaaagcgccgggauucacgagacaaccuacaauuccaucaugaagugcgacaucgauauucgaaaagaccuauaugcgaacaauguccucucaggaggcacgacuauguaccccggcauagccgauagaaugcagaaggaaaucacagcacuggcuccuaguaccaugaagauuaaaaucauagccccacccgagaggaaguauagcguuuggauugggggaucuauccuugcuucccugucaacuuuccagcaaauguggaucagcaaacaggaguacgacgaagccgguccuaguauugugcaucggaaguguuuuuga

SEQ ID NO: 52389 - RNA, 1128 nt, Artificial Sequence
  derived and/or modified sequence opt3 from ACTG1__Homo_sapiens__NP_001605
auggaggaagagaucgccgcucuggugauugacaacggcagcgggaugugcaaggcaggauucgccggugaugacgcgcccagagcugucuuuccuuccauaguuggcaggccacggcaccagggggugaugguaggaaugggccaaaaagauucuuacgugggugacgaagcccagucaaagcgcgggauccucacccuuaaauauccgauugagcauggaaucgucacaaauugggaugacauggaaaagauuuggcaccauacuuucuacaacgagcugcgaguggcacccgaggaacacccuguuuuguuaacggaggccccacugaaucccaaagcuaaccgugaaaagaugacccagaucauguuugagacauucaauacuccugcaauguauguggccauacaggcuguccuaagucucuacgccagcggcagaaccacaggcaucgugauggauuccggggacggaguaacccauacuguuccaauuuaugaggguuacgcgcugccccacgcaauccuuaggcuggauuuggccggccgggaccucacagauuaucugaugaagauucugaccgaacgcggguacucuuuuacgacuaccgcugagagagaaaucgugagggacauaaaagagaagcucuguuacgucgccuuagauuucgaacaagagauggcaacagcugccucgucaagcagucuggagaaauccuaugaacuuccugacggacaggugauuacuaucggcaacgagcgguuucgcugcccagaagcguuguuccagccgucuuuucuggguauggagagcugugggauucacgaaaccacauucaauuccaucaugaagugcgacguggauauccgaaaagaccuauacgccaacaccguccucucaggaggcacgacuauguaucccggcauugcagauagaaugcagaaggagauaacagcucuggccccuaguaccaugaagaucaaaauuaucgcuccacccgagaggaaguacagcguuuggauagggggaucuauucuugccucccugucaacuuuucaacagauguggaucagcaaacaggaauaugacgagagugguccuucuaucgugcaucggaaguguuucuga

SEQ ID NO: 52390 - RNA, 1002 nt, Artificial Sequence
  derived and/or modified sequence opt3 from ACTG2__Homo_sapiens__NP_001186822
augugcgaggaagagaccacagcccuggugugugacaacggcagcgggcucugcaaggcuggauucgccggugaugacgcacccagagcggucuuuccuuccaucguuggcaggccacggcaccagauuuggcaucacucuuucuacaaugaacuucgcguggcuccggaggaacaucccacucuguugacggaggccccuuuaaacccaaaagcaaaucgagagaagaugacccaaauaauguuugaaacauucaacguacccgccauguauguggcuauccaggcaguccugucacuauacgccagugggcguacuaccggaauugugcucgauagcggcgacgguguuacacacaaugugccuaucuaugagggguacgcucugccacaugccauuaugagacuugaucuggcgggaagggacuugaccgauuaucucaugaaaauccugacugaacggggcuacuccuuugucacaaccgcagagcgcgagauagugagagacaucaaggaaaaacuguguuauguagcccucgauuucgagaacgaaauggcuacggccgcaucuucgagcucauuagagaagaguuacgaacugcccgacggccagguuauuacuaucgggaaugagagguuucggugcccugagacccuuuuccagccauccuuuauuggaauggaaucugcugguauccacgagacaacuuacaacagcauaaugaagugugauauugacauccgcaaagauuuguaugccaauaacgugcuguccggcgggaccacaauguacccgggaauugcggaccgaaugcaaaaggaaaucaccgcccuagcacccucaacgaugaaaaucaagauuauagcuccuccagagagaaaauauagugucuggaucggcgguagcauucucgccucucuguccacuuuccagcagauguggaucucaaagcccgaauacgacgaggcugggccuagcauagugcacaggaagugcuuuuga

SEQ ID NO: 52391 - RNA, 1290 nt, Artificial Sequence
  derived and/or modified sequence opt3 from ACTL6A__Homo_sapiens__NP_004292
augagcggcgggguguacggaggugacgaggucggcgcccugguuuucgauaucggguccuauaccgugagagcuggauacgcaggcgaagacugccccaagguagauuuuccuacagccauugguaugguggucgagagggacgaugggucuacucucauggaaauagacggagauaaaggcaagcagggcgggccaacguauuacaucgacaccaacgcgcuucgggugccgcgcgagaauauggaagcuauuucaccccugaaaaacggaaugguugaggauugggacaguuuccaagccaucuuggaucacacauauaagaugcaugugaaaagcgaggcauccuuacacccuguccugaugucugaagccccauggaauacucgagcuaagcgugagaagcuaaccgaacucauguuugagcauuacaacauucccgcauucuuucuguguaaaacagccgugcuuaccgcuuucgccaaugguagaucgacuggccugaucuuggacucaggggcgacacacaccacggcaauaccuguacaugauggauauguucuccagcagggcaucgucaagagcccacuggccggugacuuuauuacuaugcagugcagggagcuguuccaagaaaugaacaucgagcucgugcccccuuacaugauugcuaguaaagaagccgugcgggagggguccccagcaaauuggaagcgcaaagaaaaguuaccccaggugaccagaucuuggcacaacuacauguguaauugcgucauccaggacuuucaggcuagcguucugcaaguguccgauucaacauaugacgagcagguagccgcgcagaugccgacugugcacuacgaguucccuaacggauauaauugugauuuuggcgccgaaaggcuuaagauaccagagggcuuguucgaccccaguaacgucaaagggcugagcggaaauaccaugcuaggugugucucauguugugacaaccuccgucggcaugugcgauauugacauccggccugggcucuacggaucagugauuguagcaggcgguaacacgcugauccagagcuuuacugaucgccuuaaucgagaacugagucaaaagacaccacccucuaugagauugaaacucaucgcuaacaacaccacuguugagaggcgguucuccagcuggauugggggcucgauacuggccucuuuaggaacauuccagcagauguggaucuccaagcaagaauaugaggagggcgggaaacaguguguggaacguaagugcccguga

SEQ ID NO: 52392 - RNA, 1281 nt, Artificial Sequence
  derived and/or modified sequence opt3 from ACTL6B__Homo_sapiens__NP_057272
augagcggcgggguguacggaggugacgaggucggcgcccugguuuucgauaucggguccuuuucugugagagcuggauaugcaggcgaagacugccccaaggccgauuucccuaccacaguaggucuccuugcggcugaggaagggggaggccuggaguuggaaggcgacaaagagaagaaagggaagauuuuucacauagauacuaacgccuuacaugugccaagggacggagcagaggucaugucaccgcugaaaaaugguaugaucgaagauugggaguguuuccgggccauucuagaccacacguacaguaagcauguuaagagcgaacccaaccuccacccugugcugauguccgaggcuccauggaauacccgcgcaaaacgagagaaacuuacagaacugauguuugagcaguauaacauccccgccuucuuuuugugcaagacugcugugcucaccgccuucgcgaauggccguucuacagggcugguccuggauucgggagcaacccauacuacagccauuccugugcacgacggcuacguacuccaacaggguaucguuaagucaccauuagcuggggauuuuauaagcaugcaguguagagaacuguuccaggagauggccaucgacauuauucccccuuauaugaucgcagcuaaagaaccagugagggagggagccccgcccaacuggaagaagaaagagaaacuuccucaagucaguaaguccuggcacaauuacaugugcaacgaagugauccaggauuuucaggcgucuguguugcaggucagcgacuccccauaugacgagcaaguugccgcacagaugcccaccgugcauuacgaaaugccuaauggcuacaacacggauuauggcgcugagcggcugcgcauaccagaagggcuauucgaccccucaaauguaaagggacucagugguaacacuaugcugggcguggggcacgucgugaccacaagcauuggaaugugugauaucgacauuagaccgggccuuuacgguucuguuaucgugacugggggcaauacccuguugcagggauuuacagauaggcucaaccgggagcugucccagaaaaccccucccucaaugcgcuuaaagcugaucgccagcaauaguacgauggagcgaaaauucucuccauggauuggcggguccauacucgcuagccuuggaacuuuccaacagauguggaucucgaagcaggaauaugaggaagguggcaagcaaugcgucgagagaaaauguccuuga

SEQ ID NO: 52393 - RNA, 1176 nt, Artificial Sequence
  derived and/or modified sequence opt3 from ACTL8__Homo_sapiens__XP_011540513
augagccuguugcccccuagagaguccccagccgcuucuucaaguaccagcgugccgcccacauccgcaucugccauggcggcuaggacugucaucauugaccacggcucgggguuccuuaaggccggaacggcagguuggaacgaaccucagaugguuuuuccaaauauagugaacuaccugcccugcaaagagaauccuggcccaucauaugcccggcgccgaguaagccucgggaucgauauuugucaucccgacaccuucaguuacccuaucgaacguggaagaauuuuaaacugggagggcgugcaauaucugugguccuuuguccuagaaaaucacaggcgggagcaggaggugccaccgguuaucauaacagaaacuccccuccgcgagccugcugauagaaagaaaaugcuggaaauccuuuucgagcuguugcaugugccaucuguccuccuggcagaccagcugcagaugagccucuacgccuccgguuuacugaccggggugguaguugauucaggauauggccuuacaagggugcaacccuuucaccagggccggccuuugccagcuagugggaagacccuggaguucgccggacaggaccuaagcgcguaccuccugaaaucucuuuuuaaggaagauugcgaccgccgaugucuguuccaguuggagacugucgcagugacacaaaugaacaagugcuaugugccccagaaucucggugaagcccuggauuuuagagagaggcagcaguccgcuuuagacgaaucaaacaccuaccaacugccggauggcagccgggucgagcucacgccuaugcagcguguugcccccgagauguucuuuaguccacagguguucgaacaaccugggcccucuauuccacgcgcaaucguagaguccguggaaagcugugagauuucgcuuagaccccuguuggucucucaugugauggcuugcggaggcaauacucuauacccugguuuuaccaaaaggcuguuccgggaacucaugggggaccacguuuccucaacaaaggccacugugugggagggaaguaaccgaaauuucagcgucuggcugggcgcguccgugguagcccaccuuucuaccuaucagagcgaguggaugucacgcgaagaguacggcgaacauaugagaauguga

SEQ ID NO: 52394 - RNA, 1251 nt, Artificial Sequence
  derived and/or modified sequence opt3 from ACTL9__Homo_sapiens__NP_848620
auggacgccagcagacccaaguccucugagucacagaguagccuggaagcuccuaggccaggcccgaaccccuccccuaauguggucaacaaaccacuccaacgggauucucccgggaugguugcagaccgccuuccuccaaagaccggagccgugguaaucgauauggguacaggcacuugcaaagugggguucgcgggacaggcuucgcccacguacaccgucgccacaauucugggcugucagccuaagaaaccagcaacuucaggucagagcggguugcaaaccuuuauaggagaggccgcucgaguguuaccggaacugacacuuguucagccccuccguaguggcaucguggucgacugggaugcagccgagcugauuuggagacaccuucuggaacaugacuugaggguggcuacccacgaucauccucuccuguucuccgacccacccuuuucuccugccacuaaucgggagaagcugguagagguugcguucgaaagccuccgcuccccagcaauguauguggccucacagagugucuuaagcguguacgcucacggcagagugucugggcuggucguugauacaggacauggugugaccuauacgguacccguguuucagggcuacaaccuuuugcacgccacugagaggcuggaccuagcagggaauaaccucaccgcuuuccuggccgaaaugcuucugcaagcgggauugccgcucggccagcaggaucuggacuuagucgagaauaucaagcaccauuauugcuacguggccuccgauuuucagaaagagcaagcacggccugaacaggaguauaagcgcacacugaaacuccccgacggucgaacuguuacccuugggaaggaacuguuccaguguccagaguugcuauuuaacccucccgaagugccaggacugucacccgucggccucagcacaauggcuaaacaaagucugagaaagcuaucucuggagaugagggccgacuuggcucagaaugugcuccugugcggcggguccagcuuauucaccggauuugagggucgguuccgugccgaacugcuacgcgcacucccugccgagacgcacguaguuguggcugcgcagccaacuagaaacuuuucggucuggauuggcgggucuauccuggcaucccuuagggccuuccagucauguuggguguugcgggaacaauacgaggaacagggaccguacauagucuaucgaaagugcuacuga

SEQ ID NO: 52395 - RNA, 2679 nt, Artificial Sequence
  derived and/or modified sequence opt3 from ACTN1__Homo_sapiens__NP_001093
auggaccacuacgauagccagcaaaccaacgacuauaugcagcccgaggaagauugggacagagaucugcuccuugacccugccugggagaagcagcagaggaaaacauucacugcuuggugcaauucccaucugcggaaggcaggcacgcaaaucgaaaacauugaggaagauuuucgcgacggguugaaauuaaugcugcuacucgaggugauaucuggagagcgacuggccaagccagaacgugguaaaaugagaguccacaagaucucaaauguuaacaaggcgcuugauuucauugcuaguaaaggcgugaagcugguaagcaucggggccgaggaaauuguggacggaaaugucaaaaugaccuugggcaugaucuggacaauaauccucagguuugcaauucaggauaucuccguggaggagacuucugccaaggaaggucugcugcucuggugucagcggaaaaccgcuccguacaagaacguuaauauucagaacuuccauaucucguggaaggacggguuaggauuuugcgcacugauacaccgccauagacccgagcuuauugauuauggcaaauugaggaaggacgacccucugacaaaucuaaacaccgccuucgauguggcugaaaaauaccucgacaucccaaagaugcuggaugccgaggacauugucggcacugcgcggcccgaugaaaaagcaaucaugacauaugugagcucauuuuaccacgccuucaguggggcucaaaaggccgagaccgcagcuaaucgcaucuguaaaguacuugccguuaaccaggagaaugaacagcugauggaggacuaugaaaaguuggcguccgaucuccuggaguggauucgaagaacgauaccuugguuagaaaacagggugccagagaauacuaugcacgccaugcagcaaaagcuggaggacuuucgggauuaccgucgccuccauaaacccccuaagguccaggaaaaaugccagcuugagaucaacuucaacacccugcaaacaaaguugagacuaucuaauaggccagcauuuaugccgagcgaaggacggaugguguccgacauuaacaaugcuugggguugucuggaacagguggaaaaaggcuacgaggaguggcuccugaacgaaauccgacgccuugagagacuggaucacuuggccgaaaaguucaggcagaaggcuucaauacaugaggccuggacugacgggaaagaggcaaugcuccggcagaaggacuaugaaaccgccacacugagugagauuaaagcucuacugaagaaacacgaagcguuugagagcgaucuagcagcccaccaagaccgcgucgaacagaucgcugccaucgcacaggagcucaaugagcuggauuacuaugacucucccuccguuaacgccagaugccagaagauuugugaucaaugggacaaucuuggagcuuugacccagaagaggcgugaagcccuggagcggacggaaaaacuccuggagacuaucgaucagcuuuaccuggaauaugcaaagcgagcggcuccuuucaacaauuggauggagggcgccauggaggacuugcaggauacauucauugugcauaccauagaagagauccaaggucucacuacagcacacgaacaguuuaaagccacccugccagacgcugauaaggagagauuagccauucuggggauccauaacgaaguaucaaaaaucgugcagacguaccacgucaauauggcaggaaccaaccccuauacaacuauuaccccucaggagauaaauggcaagugggaccaugugaggcaauuaguuccacgccgggaucaggcucucacagaggaacacgccagacagcaacacaacgagaggcugcgcaagcaguucggcgcgcaggccaaugugaucgggcccuggauucagacuaaaauggaagagaucggacgaauuagcaucgagaugcaugguacccuugaagaccaauugagucaucugcggcaguacgagaagucuauagucaacuacaaaccgaagaucgaccagcucgaaggcgaucaccagcugauucaagaggcuuuaaucuuugacaacaaacacacaaauuauaccauggaacacauucguguggggugggagcagcugcuuacuacgaucgcaagaacaauaaacgagguagaaaaucagauuuugaccagggaugccaagggaaucucccaggagcaaaugaacgaguuccgcgcuagcuuuaaucauuucgaccgggaucacucgggcacucucgguccugaggaauuuaaagccugccugauuucucuaggguacgacaucggcaacgauccccagggagaggcagaguucgcgagaauaauguccaucguugacccaaauaggcugggcguggucaccuuucaggccuucauugauuuuaugucacgagaaacagcugacaccgauacugccgaccaagugauggcaaguuucaagauccucgcuggggauaagaacuauauuacaauggacgagcugcgccgggaacuuccucccgaccaggccgaguacuguaucgcaagaauggccccauauacgggacccgauagcgucccuggugcuuuggacuacauguccuuuucuaccgcgcuguauggcgaaagcgauuuauga

SEQ ID NO: 52396 - RNA, 2685 nt, Artificial Sequence
  derived and/or modified sequence opt3 from ACTN2__Homo_sapiens__NP_001094
augaaccagaucgagcccggcgugcaauacaauuaugucuacgacgaagaugaguauaugauucaggaagaggaaugggacagagaucugcuccuugacccugccugggagaagcagcagaggaaaaccuucacagcuuggugcaacagccaccuacggaaggcagggacucaaauagagaauaucgaagaggauuuucgcaacggauugaaauuaaugcugcuacucgaaguuauuuccggugagcgacugccaaagccggaccguggcaaaaugagauuccauaagaucgccaaugugaacaaggcgcuugauuacauugcuucuaaagggguaaagcuggugucaaucggagccgaggaaauagucgacggcaaugugaaaaugacguuggguaugaucuggaccauuauccucagguuugcaauucaggauaucaguguugaggaaacaagcgccaaggaggggcugcugcucuggugucagcggaaaacugcucccuaucgcaacgugaauauacagaacuuccacaccuccuggaaggacggauuaggccugugcgcacuuauucauagacacaggccugauuugaucgacuacucuaagcugaauaaagaugacccaauuggcaacaucaaucuagccauggaaaucgcugagaagcaucucgacauucccaaaaugcuggaugccgaggacauagucaacacaccuaagccagaugaacgggcgaucaugaccuaugugucguguuuuuaccacgcauucgccggggcugagcaagccgaaacugcagcuaaucgcauuugcaaaguacuugccguuaaccaggagaacgaacgacugauggaggaguacgaaagauuggcgucagagcuccuggaauggaucaggcggacaauacccugguuagagaaucguaccccugaaaagacgaugcaggccaugcagaaaaagcuggaggacuuucgcgauuauagaaggaagcacaaaccaccgaaggugcaagagaaaugucagcucgaaauuaacuucaauacucuucagaccaagcugcggaucagcaaccgacccgcauuuaugccuagugagggaaaaauggucuccgacaucgcuggugccuggcaacgcuuggaacaggcugagaagggcuacgaggaauggcuacugaaugagauuagaaggcucgaacggcuggagcaucuugccgaaaaguuccgccagaaagcaucuacacacgagacuugggccuaugggaaggagcagauccuguugcaaaaagauuacgaaagcgcuucccucaccgaggugagagcgcuguuaaggaagcaugaagcauuugagucagaccuggccgcucaccaggaucguguggaacagauugccgcaauagcccaggagcuaaacgagcucgacuaucacgaugcugucaauguuaacgaccggugccagaaaaucugugaccagugggaucgacugggaacacuuacccagaagagaagggaagccuuggagcgcauggaaaagcugcucgagacgauugaccagcugcaucuugaguucgcaaaacgggcggcuccauuuaauaacuggauggagggcgccauggaggaucugcaagacauguucaucgugcacaguaucgaagagauucagagcuugauaacugcacaugaacaguucaaggccacacuccccgaggcugauggugagagacagucuaucauggccauucaaaaugaaguagagaaagugauccaguccuacaacauuaggaucucaagcaguaauccuuauucuaccgucacuauggacgaacugcgcacaaagugggauaaagugaagcaguuaguuccaauacgagaccaaucccugcaggaggaacuagcacggcagcacgcuaacgagcgucucagaaggcaguuugccgcgcaagccaaugcuaucgggcccuggauucagaacaagauggaggaaaucgcacgcagcucgauucagaucaccggagcccuggaggaucagaugaaccaacuuaaacaguacgaacauaauauaauuaacuacaagaauaacaucgacaaauuggagggcgaucaccagcugauucaggaagcucucguguucgacaauaagcacacgaacuauaccauggagcauauccgggucggcugggagcuguuacugacaacuauagccagaaccaucaaugaaguggagacacaaauucuuacuagggaugcaaaagggaucacccaggaacagaugaacgaguuucgagcgucuuucaaucacuuugaccgccggaagaacggauugauggaccaugaagauuucagagccugccucauuuccauggguuacgaccugggcgaggcugaguuugccaggaucaugacacugguagauccgaaugggcaaggaaccguuacuuuccagucauuuauagacuucaugacgcgugaaacagcagauaccgacacugcugagcaagugauugccaguuuucgcauccuggcaagcgauaaaccuuauauccucgccgaagaacugcggagagagcuucccccagaccaggcucaauacuguauuaagaggaugccugcguauuccggccccgguucugucccaggggccuuggauuacgcagcuuucagcucagcccuguauggcgaaagugacuuauga

SEQ ID NO: 52397 - RNA, 2706 nt, Artificial Sequence
  derived and/or modified sequence opt3 from ACTN3__Homo_sapiens__NP_001095
augaugauggugaugcagcccgagggccugggggccggagaagguagauucgcuggcgggggaggcgguggggaguacauggaacaagaggaagacugggauagggaccuccuucuggauccugcaugggagaagcagcagcggaaaaccuuuacagccuggugcaacagccacuugcgcaaggcgggaacucagaucgagaauauugaagaggacuuccgaaacggcuuaaaacugaugcuacuccuggaagucauauccggcgagcgucuuccaagaccggauaaggggaaaaugagguuucauaagaucgcuaauguuaacaaggcccuggacuucauugcaucuaaaggagugaaguugguaucaaucggugccgaggaaauuguggauggcaaucucaaaaugacgcuggggaugaucuggaccauaauccugcgguuugcuauucaagacaucagugucgaggaaacaagcgcaaaggagggacucuuacuguggugucagcgcaaaacugcccccuauagaaacgugaauguucagaacuuccacaccuccuggaaggauggccuugcuuugugcgcccugauucauaggcaccggccugaccuaaucgauuacgcgaagcuccgcaaagacgauccaauagguaaucugaacacagcauuugaaguggccgagaaguaucuugacauucccaaaaugcuggacgcugaggauaucgucaauaccccuaagccagacgaaaaagccauuaugacuuacgugucuuguuucuaucaugcauuugcuggggccgagcaggcggaaacagccgcaaaccgaaucugcaagguauuggcuguuaaucaagagaacgaaaaacucauggaggaguacgaaaagcuggccucggaguuacuggaauggaucagaaggaccgugcccuggcucgagaaucgggucggagaaccuucaaugagcgcuaugcagcguaaacuugaggauuuccgcgacuauagaaggcugcacaagccaccgcggauucaggagaagugucaguuggaaauaaacuuuaacacgcuacaaacuaaacugcgacucagucaccgccccgccuucaugccuuccgagggcaagcuggugucugauaucgcaaaugccuggagaggccuugaacagguggagaaaggguacgaggacuggcuguugagcgaaauuaggcggcuccagcgccugcaacauuuagcugagaaguuuagacagaaggcgucccugcacgaagcauggaccaggggaaaagaggaaaugcuaucacagcgugauuacgacagugcccuccugcaggagguccgggcucuuuugcgaagacaugaggccuucgaaagcgaucuggcagcccaccaagacaggguugagcacaucgcugcccucgcacaggaacugaacgagcuugauuaucaugaagcggcuucuguaaauucccgcugccaggccauaugugaccagugggacaaccuggguacauugacucaaaagcggagagaugcacucgagaggauggagaaacuguuagaaaccauugaccgccugcagcuagaguucgcccgacgggcugccccauuuaauaacuggcucgauggcgcaguggaagaccugcaggauguguggcuuguccacucaguggaggaaacacagagcuugcugaccgcucaugaccaauucaaggccacgcuccccgaggcggaucgugagagaggggccaucaugggaauccagggcgaaauucagaaaaucugccagacuuacggucugaggccuuguaguacaaauccauauauuaccuuaucuccccaagacauaaacacuaagugggauaugguucgcaagcuggugccguccugcgaccagacacuucaggaggaauuggcucggcaacaggucaaugagagacucaggcgacaguuugcagcccaggcuaacgccaucgggccuuggauucaagcaaaaguggaggaaguaggccgccuggcggccggacuagcuggcagccuggaggaacagauggccgggcuccggcagcaggagcaaaauaucaucaacuacaagaccaauauugauagacuggaaggagaccaccagcuuuugcaggagucgcugguuuucgauaacaaacauacgguguauucuauggagcacauaagggucgguugggaacaguuacucaccuccaucgcacguacaauuaaugagguggaaaaccaaguccugacucgcgacgcuaagggccuuucacaggagcagcugaacgaauuucgggccaguuucaaucacuuugacagaaaacaaaacgggaugauggagcccgaugacuucagggcauguuugaucagcaugggauacgaucucggcgagguggaauuugcccgaauuaugaccaugguugacccaaaugcugcgggugugguaacauuccaggccuuuaucgauuucaugacucgggagaccgcagaaacagacaccacugagcaggucguggcuuccuuuaagauacuggccggggauaagaacuauaucacgccugaggaacuacgcagagagcugcccgccaaacaggcugaauacugcauuaggcggaugguuccauacaagggcucuggagcacccgccggcgcgcucgacuauguggcuuucagcucagcccuguacggggagagugaucuuuga

SEQ ID NO: 52398 - RNA, 2736 nt, Artificial Sequence
  derived and/or modified sequence opt3 from ACTN4__Homo_sapiens__NP_004915
augguggacuaccacgccgcuaaccagagcuaucaauacggccccuccucugcagggaauggagccgguggcgggggaucaaugggcgauuauauggcgcaggaggacgauugggacagagaucugcuccuugacccugcuugggaaaagcagcagaggaaaaccuucacagccuggugcaacagucaucugcggaaggcagguacucaaaucgagaauauugaugaagacuuucgcgauggguugaaauuaaugcugcuacucgaggucauaagcggagaacgacugccaaagccggagcguggcaaaaugagaguucacaagaucaacaaugugaacaaggcccuugacuucauugcuuccaaaggcguaaagcuggugucuaucggggcagaggaaauugucgauggaaaugccaaaaugacguuggguaugaucuggaccauaauccucagguuugcuauucaggacaucucgguggaggaaacaucagccaaggagggccugcugcucuggugucagcggaaaacugcgcccuacaagaacguuaaugugcagaacuuccauauuagcuggaaggauggguuagcauuuaaugcccugauccaccgccauagaccugagcuuauagaauaugacaaauugaggaaggacgauccagucaccaaccugaauaacgcuuucgagguggccgaaaaauaccuagacauucccaagaugcucgaugcagaggacaucguaaauacagcucggccugaugaaaaagccauuaugaccuauguuaguuccuuuuaccacgcguucucuggagcccaaaaggcagagacugcugccaaccgcaucugcaaagugcuggcugucaaccaggagaaugaacaccuuauggaggacuacgaaaagcuggccagcgauuugcucgaguggauccgaagaacaauuccauggcuggaagacagggugccccagaagaccauacaggagaugcaacagaaauuagaggauuuucgggacuaucgucgcgugcauaagccuccaaaaguccaggaaaagugucaacuggagaucaacuucaauacgcuccagacuaaacuuagacuguccaacaggccggcauuuaugcccucagaaggcaagaugguuagugauauuaauaacgguuggcagcacuuggagcaggccgaaaagggguacgaggaguggcuacugaaugaaauccggcgacucgagcgccuggaccaucuugcugaaaaauucagacaaaaggcgagcauacacgaggcauggaccgacggaaaagaggccaugcugaagcacagggauuaugaaacagcuacuuugucugacauuaaagcccucauccggaagcaugaggcauuugaauccgaucuggccgcucaccaggaccgcguggagcagaucgccgcaauugcgcaggaauuaaacgagcuggauuacuaugacucacauaauguaaacaccagaugccaaaagaucugugaucagugggacgcucuaggcagccucacacacaguaggcgugaggcccuggagaaaaccgagaagcagcuugaagcaauugaucaguugcaucuggaguacgccaaacgggcugccccuuucaauaacuggauggaaucugcaauggaggaccuccaagauauguucauagugcacacgaucgaggaaauugagggccugaucuccgcucacgaccaguuuaagagcacucuuccagaugccgaccgagaaagagaggcgauccuggccauucauaaagaagcucagaggauagcagagucgaaucacaucaaguugucuggguccaaccccuauacaaccgucacuccucagauuaucaauucaaagugggagaaagugcaacagcucguuccaaagcgcgaccaugcccuguuagaagaacagaguaaacaacagagcaacgaacaucugcggagacaguucgcuucccaggccaacguggucggacccuggauucaaacaaagauggaggagaucgguaggauaucuaucgaaaugaauggcacccuagaggaucagcucagccaccugaaacaguacgaacgcucaauuguggacuacaagccgaaccuugauuugcuggagcagcaacaccagcucauccaggaagcacugauuuuugacaauaaacacacgaacuauaccauggagcauauccgaguagggugggagcaguuacugacaacuauagcgcggaccauuaaugaaguugagaaccaaauccuuacacgugaugccaagggaauuagucaggaacagaugcaagaguucagagcuuccuuuaaucacuucgacaaggaucauggcggugccuuggggccugaagaguuuaaagcaugccucaucagccugggcuacgacguggagaacgauaggcagggagaagcugaguucaaucgcauaaugucucuagucgaccccaaccacucaggccuggugacuuuucaggccuucaucgauuuuaugagucgggaaaccacagacaccgauacugcagaccaggucauugccagcuucaaggugcucgcuggggacaaaaauuuuaucacggcggaggaacugagaagggagcuuccaccugaucaagccgaguauuguauugcacgaauggcucccuaccagggaccagacgccguucccggugccuuggauuauaaguccuucucuacagcucuguacggcgaaucggacuuauga

SEQ ID NO: 52399 - RNA, 1131 nt, Artificial Sequence
  derived and/or modified sequence opt3 from ACTR1A__Homo_sapiens__NP_005727
auggagagcuacgacgugaucgccaaccagcccgucguuauugauaauggcuccggggugauaaaggcuggauucgccggugaccaaaucccuaaauauugcuuuccaaacuacguaggcagaccgaagcacgugagggucauggccggggcgcuggaaggagauauuuucaucggccccaaagcugaggaacaucggggucuccuuucuauucgcuauccuauggagcacgggaucgugaaggacuggaaugauauggaacgaauauggcaguacguuuauucaaaagaccagcugcagaccuuuagugaggagcauccaguguuguuaacagaagcaccccugaacccucguaagaauagagagagggcagccgaagucuucuuugagacuuucaacgugccagcucuauuuaucagcaugcaagcaguacucucccuguacgccacgggacggaccacaggcguugugcuugauucuggcgacggggucacucacgcugugcccauuuaugagggauucgccaugccucauucgaucaugcgcauugauaucgcggguagagacgugucaagguuucugcgguuguaccuccgcaaggaaggcuacgauuuccacagcaguuccgaguuugaaauagucaaagcaauuaaggagcgagccuguuaucugucuaucaauccacagaaagacgaaacccuggagacagagaaggcucaguacuaucucccggaugggagcaccauugaaaucggacccuccagauucagggccccugaguuacuguuucggccagaccuuaucggcgaagagucagaagguauucacgagguuuugguguucgcaauacagaaaagugacauggaucugcgucgcacucuauucagcaacaucguacucucugggggauccacacuguuuaagggcuucggcgacagacuucugucagaggugaagaaauuggcucccaaggaugucaaaauuaggaucagcgccccucaagaacggcucuacaguaccuggauagggggaucuauucuggcguccuuagacacguuuaagaaaaugugggugagcaagaaagaguaugaagaggauggugcccgaucgauccaucgcaagacuuucuga

SEQ ID NO: 52400 - RNA, 1131 nt, Artificial Sequence
  derived and/or modified sequence opt3 from ACTR1B__Homo_sapiens__NP_005726
auggagagcuacgacaucauugccaaccagcccguggucauagauaauggcuccgggguuaucaaggcuggauucgccggugaccaaauuccuaaauauugcuuuccaaacuacgugggcagaccgaagcacaugaggguaauggccggggcgcuggaaggagaucucuucaucggccccaaagcugaggaacaucggggucuucugaccauucgcuauccuauggagcacggggugguccgagacuggaaugauauggaacguaucuggcaguacguguauucuaaggaccaguugcagacauuuucagaggagcauccaguuuuacugacugaagcaccccuaaacccuaguaaaaauagagagaaggcagccgaaguguucuuugagacguucaacgucccagcucucuuuauaagcaugcaagcagugcugucccuuuacgccaccggaaggacaacuggcguaguucuggauucuggcgacggggugacccacgcuguccccaucuaugagggauucgccaugccucauucgauuaugcggguggauaucgcgggucgcgacgugucaagauacuugaggcuccugcugcggaaggaaggcgucgauuuucacacaagcgcagaguucgaaguugugcgcaccauuaaagagcgagccuguuaccucaguaucaauccacagaaggacgaggcuuuagaaacugagaaaguacaguauacacugccggauggguccacccuugacgugggacccgccagauuuagggcaccugaauugcuguuccagccagaccuagucggcgaugagucugaaggucuccacgaggugguugcuuuugccauacauaagagcgacauggaucugcggcguacgcuuuucgcgaacauugugcuguccgggggaucaacuuuguucaaaggcuuuggcgaccgccuccugagugaagucaagaaguuagcccccaaagauaucaagauuaaaaucagcgcaccucaagagagacuguacucuaccuggaucgggggauccauucucgcuucacuugacacauucaagaaaaugugggugagcaagaaagaguaugaagaggaugguaguagggccauacaccggaagacuuuuuga

SEQ ID NO: 52401 - RNA, 1200 nt, Artificial Sequence
  derived and/or modified sequence opt3 from ACTR2__Homo_sapiens__NP_001005386
auggacagccagggcagaaagguggucguuugcgauaacgggaccggauucgugaaaugugguuacgccggcuccaauuuucccgagcacaucuucccugcucugguagggaggccaauuauacggucuacaacuaaggugggaaacaucgaaauuaaaaauaacaagaaaauggaccucauggucggcgaugaggcaucagaacuucgcaguaugcuggaggugaauuauccgauggaaaacgguaucguucgaaauugggacgauaugaagcauuugugggacuacacguuugggcccgagaaguuaaacauugauacccguaauugcaaaauccugcuaacagagccuccaaugaaccccacuaagaauagagagaaaauaguggaagucauguucgaaaccuaucaauuuagcggaguguacguagccauccaggcgguucucacacuguaugcucagggccuucugaccggcguggucguggacuccggggauggagugacucacauuuguccugucuacgaggguuucucuuugccacaucucacaaggcggcuggacaucgccggccgcgauauuaccagauaucugaucaagcucuuacugcuuaggggguacgcauuuaaccacucggccgacuucgagacgguucggaugauaaaagaaaaguugugcuacgugggauauaauauugagcaggaacaaaagcuggcucuagagacuaccguacucguggaaucauacacacugcccgauggccgcaucauuaaagucgguggggagcgauuugaggcaccugaagcccuuuuccagccacaucugaucaacguggagggaguuggcguggcugaauugcucuuuaauacuauccaggccgcggacauugacaccagaagcgaguucuauaagcacauaguccugaguggcggguccacaauguacccgggauuacccucuaggcuggaacgggagcucaaacagcuuuaucuggagcguguguugaagggugauguagaaaaacuaagcaaguuuaaaauccgcauugaggacccuccaagaaggaagcacaugguuuuccugggcggggcagugcucgccgauaucaugaaggacaaagauaacuucuggaugacccggcaagaauaccaggagaagggaguccgagugcuggaaaaacuuggcgucacggugcgcuga

SEQ ID NO: 52402 - RNA, 1047 nt, Artificial Sequence
  derived and/or modified sequence opt3 from ACTR3B__Homo_sapiens__NP_001035225
auggccggcagccugcccccuugcguggucgacugugggaccggauacacaaagcucgguuaugcuggcaacacugagccacaguucaucauuccguccugcauagcaaucagagaaucugccaaaguuguggaucaagcgcagaggcggguacuucgcgggguggacgaucuggacuuuuucauuggagaugaggcuaucgacaagcccacguacgccaccaaauggccuauucgacacggcaucauagaagauugggacuugauggagcguuuuauggaacaggucguguucaaguauuuaagagcagagccagaggaucauuacuuucugaugacagaacccccucuaaauacuccagagaacagggaauaucucgccgagaucauguucgagucauuuaauguucccggucuguacauugcugugcaggcaguccuugcccuggcugccaguuggaccagccggcaagugggggaacgcacauugaccggaaucguaauugacuccggcgauggcguuacucacgugaucccugucgcggagggguaugugauaggaucuuguauuaaacauaucccaauugcagguagagacaucacauacuucauccagcagcuccugagggaacgggaggugggcauuccgcccgaacagucgcuggagaccgccaaggcuauaaaggagaaauacugcuauaucuguccugauauugucaaggaauuugccaaauacgacguugacccacgcaaguggaucaaacaauauacggggauaaacgcaauuaaucagaagaaguucgugaucgauguaggauacgagcgauuucucggccccgaaaucuucuuucacccugaguucgcuaacccagacuucauggaaucaauuagcgauguggucgacgaggugauccagaauugccccauugauguuagaaggccguuauauaaaccugaguuuuuccaggugugucauacuaagaaagacuacgaagaguauggucccaguauaugccggcacaacccagucuuuggggugauguccuga

SEQ ID NO: 52403 - RNA, 1104 nt, Artificial Sequence
  derived and/or modified sequence opt3 from ACTR3__Homo_sapiens__NP_001264069
augaagggcguggacgaucuggacuucuuuaucggggaugaggccauugaaaaacccaccuacgcuacaaaguggccuauaagacacggaaucgucgaggacugggaucucauggaaagguucauggagcagguuauuuuuaaauaucuucgggcagaaccagaggaccauuacuuccuguugacugagccgcccuuaaacacgccugaaaaucgcgaguauaccgccgaaaucauguuugagagcuucaacgugccaggucuguacauugcgguacaagcugugcuagcccucgcagccuccuggacaucucgacaggucggcgagcguacucugaccgggacagugaucgauucaggagacggcguuacccacgugauacccgucgcugaagguuaugugaucgggaguugcauuaagcauaucccuauugcaggaagagauaucacuuacuuuauacagcagcuucugagggaccgggagguaggcauuccacccgaacagagcuuggagacagccaaagcuguuaaggaacgcuauuccuacguguguccugaucucgucaaggaguucaauaaauacgacaccgauggcucuaaguggaucaaacaauauacggggauuaacgccaucucgaagaaagaguuuucaaucgacgugggauacgaaagauuccuggguccagagauauuuuuccacccggaauuugcgaaucccgacuucacucagccuauuagcgagguggucgaugaaguuauccagaacugcccaauugacgugaggcggccccuguauaagaauaucguacucaguggcggguccaccauguuccgcgauuuuggacgaagauuacaaagggaccugaagcggacaguggaugcacgucuuaaauugucugaggagcugagcggcggucgccuaaagccuaaaccaauagacguccaggugauuacucaucacaugcagagauacgccguuugguucgggggauccaugcucgcuucaacccccgaauuuuaucaggugugucacacaaagaaagauuacgaggaaaucggcccgaguaucugcaggcauaacccugucuucggcgugaugagcuga

SEQ ID NO: 52404 - RNA, 1824 nt, Artificial Sequence
  derived and/or modified sequence opt3 from ACTR5__Homo_sapiens__NP_079131
auggccgcuaacguguuccccuuuagagacgcaagggccgcgccugauccaguccuggaggcuggcccgguugcccacgggccccucccugugccacuuguacuggacaaugggagcuuccaggugcgggcagguugggccugccccggccaagauccugggccagaaccccgcuugcaguuucgagcugucugugcacguggaagaggcggugccaggggagcuuccggaccucaggugggcaacgccuuaggcucucuggagccacuacgguggaugcuccgcucaccguucgacagaaauguucccgugaaccuggaacuucaggagcuguugcucgauuacaguuuucaacaucugggggucagcucccagggaugcguggaccacccuaucguacugaccgaagcgguuuguaauccacucuauucuaggcagaugaugucggaguuacuguucgagugcuacgguauucccaagguggcauauggcauagauucacuuuuuagcuucuaccauaacaaaccuaagaauaguauguguuccggguugaucauuucuagcggauaucagugcacacacguccugccaauccuagaaggccggcucgacgccaaaaacuguaagcgcauuaaucugggugggucccaagcugccggauaccuucagcgacuguugcagcucaaauaucccggccaucuggcagcuaucacuuuaucaagaauggaggaaauacugcacgagcacaguuacaucgccgaggauuacguggaagaacuccauaaguggaggugcccggacuauuacgaaaacaaugugcacaagaugcagcuuccuuuuagcucuaaacuguugggcuccacgcuaaccucagaggaaaagcaagagcggcgucagcagcaacugcgcagacuccaggagcugaacgcgaggcggcgagaagagaaacuucagcuggaucaggaacgcuuggacagacuccuguauguccaagaguuacuggaagaugggcagauggaccaguuccauaaggcccuaauugagcucaauauggacagccccgaggaacugcagaguuacauccaaaaacuuucuauugcaguugagcaggcuaagcagaagaucuugcaggccgaagugaaccuggagguagauguggucgacuccaaaccagaaacaccugaucucgagcaacuggagcccagccuugaagacguggagucgaugaaugauuuugacccacuguucucugaagagacucccggaguugagaagccugugaccacaguccagccaguguuuaacuuggcugccuaucaccaacucuucguagguaccgaaaggauacgggcaccggagauuaucuuccagcccucccugauuggcgaggagcaggccgggaucgcugaaacuuuacaguacauccuggaucgcuauccuaaagacauucaggagaugcuaguucaaaacguguuucucacaggaggcaauaccauguacccagguaugaaggcgagaauggagaaagaacugcuugagaugaggcccuuccguucaaguuuucagguccaguuggcaagcaacccugugcuggaugccugguacggggcucgggacugggcccucaaucaccuggaugacaacgaagucuggauaacgcgaaaggaguaugaagagaaaggcggagaguacuuaaaggaacauugugcauccaauaucuaugugccaauuagacugcccaagcaggccucuaggagcucagacgcucaagccaguuccaaaggcagcgcagcugggggagguggcgcgggggagcaggccuga

SEQ ID NO: 52405 - RNA, 1131 nt, Artificial Sequence
  derived and/or modified sequence opt3 from ACTRT1__Homo_sapiens__NP_612146
auguucaacccccacgcccuggacgugccugcugucaucuuugauaauggcagcgggcucugcaaggcaggacuuuccggugagauuggcccaagacauguuauaucuucagugcuggggcacuguaaauucaacguaccguuggccagguuaaaucagaaguacuuugugggacaagaagcgcuguauaaauacgaggcucuacaucuccacuaucccaucgaacggggccuggucaccgguugggacgauauggagaaacuuuggaagcaucuguucgaacgcgaguugggggugaagccuagucagcagccaguucucaugacagagcccagccugaacccucgagaaauucgugagaagcuggccgaaaugauguuugagacuuucuccgugccaggauuuuaccucucuaaucacgcagucgccgcuuuauaugcaucggccugcgugacgggccugguaguugacucaggcgauggggugaccuguacaguccccaucuucgagggauacagccuuccucacgcugugacuaaauugugcauggccgguagagacauuaccgaacaucugacaaggcuacucuuugcgaguggcuucaacuuuccauguauccugaauaaggcaguggucaacaauauaaaagagaaacuuugcuauaucgcccuggaaccggagaaggaauugcggaagucccgcggggagguucucggagcuuacagacugcccgauggccacgugauucauuucggugacgaguuauaccagguaccugaagugcuguuugccccagaucaacucgggauccacucucccggacuuagcaagauggucuccucaaguauuaugaaaugugacaccgauauccagaacaagcuguaugcagacauaguguugagcggcggcacuacacuacugccugggcucgaggaaaggcugaugaaagagguugaacagcuugcuucuaagggaaccccaauuaaaaucacggccucccccgaucggugcuucucagcguggauuggugccagcaucaugaccaguaugucuuccuucaagcagaugugggugacuagcgcagacuuuaaagaguacggcacaucggucgugcaacgccgauguuucuga

SEQ ID NO: 52406 - RNA, 1518 nt, Artificial Sequence
  derived and/or modified sequence opt3 from ACVR1B__Homo_sapiens__NP_004293
auggccgagagcgcuggcgcauccucuuucuuuccccuggugguccuccuucuggccgggucaggagguaguggcccuagagggguucaggcguuguuaugcgcuuguaccagcugccugcaagccaacuacacaugugaaacugacggagcaugcaugguguccaucuucaaucuagauggcauggagcaccauguaaggacguguauuccaaagguggaacucgucccggccgguaaacccuuuuauugccugucuucggaggaccuucggaacacccacuguugcuacacagauuauuguaaucgcauagaccugcgagugccuucagggcauuugaaggaaccagagcaccccagcauguggggaccuguugagcucgugggcaucauugcuggcccagucuuccugcuguuucucaucauuaucauaguguucuuaguaaucaacuaccaucagcguguuuaucacaauagacagaggcuggauauggaagaccccaguugcgagaugugucuuuccaaagauaagacuuugcaggaccugguguacgaucuaucuaccagcggguccggaucaggucucccucuguuuguccaacggacaguggcacgcaccauugugcuucaggaaaucauuggcaaagggagauucggagaggucuggaggggccgguggcgcgguggggacguugccgugaagaucuuuaguagccgagaggaaagaucuugguucagggaggcugaaauauaucagacuguaaugcugcggcacgagaacauuuugggauuuaucgccgcggauaauaaggacaacggcacauggacccagcucuggcugguguccgauuaccaugaacacggcucauuauucgacuaccugaaucguuauacggucacuauugaggggaugaucaaacucgcacuuagcgccgcuaguggacuggcccauuugcacauggagaucguggguacccaaggcaagccagggauugcacaccgcgaccuaaaaucuaagaacauacugguuaaaaagaauggaaugugcgcuaucgccgaucucggccuggcggugagacaugacgccgucacagauacuauugacaucgcaccgaaccagaggguggguaccaagcgguacauggcucccgaaguacuugaugagacaauaaauaugaaacacuuugacuccuucaagugcgccgauauuuaugcucugggguugguuuacugggaaaucgcccgacgcuguaacagcggcggagugcaugaggaauaucagcucccuuacuaugaccuggucccaucggaucccucuaucgaggagaugagaaaaguggucugcgaccagaaguuaaggccuaauauuccaaacugguggcaauccuacgaagcacugcgggugaugggcaaaaugaugcgcgaguguugguacgccaacggggcugcgagacuaaccgcacucaggaucaagaaaacgcugucacagcuuaguguucaggaagaugugaagauuuga

SEQ ID NO: 52407 - RNA, 1332 nt, Artificial Sequence
  derived and/or modified sequence opt3 from ACVR1C__Homo_sapiens__NP_001104501
augcugaccaacggcaaggaacaggugaucaaaagcugcgucucccuccccgagcuuaaugcccaaguuuucugucacucuucaaacaaugugacaaagacugagugcuguuuuacggacuucugcaacaauauuacccugcauuugccuacagcuaguccaaacgcaccgaaauuagggcccauggaacuggccauaaucauuacuguaccugugugucuacucagcaucgcggcuaugcugaccgucugggccugccagggaagacaguguuccuacaggaagaaaaagcggccaaauguggaggaaccccuuucugagugcaaccugguuaaugcagguaagacauugaaagaucucauuuaugacgugaccgccucgggcucagggagcggacugccucugcucguccagcgcacuaucgcucgaacaauaguguuacaagagaucguaggcaagggucguuuuggggaaguuuggcacggaagaugguguggcgaggauguggcagucaaaauuuucaguuccagggacgaacggucuugguuucgcgaggccgagaucuaccagaccgugaugcugagacaugaaaacauucuuggcuucaucgcugccgauaauaaggacaacgggacguggacucaguuguggcuggugagcgaguaucacgaacagggaucccuauacgauuaucucaauaggaacauagucaccguugcggguaugauuaaacuggcacuuucaaucgccaguggccuggcucauuugcacauggagauuguggggacacaaggaaagccagccaucgcacaccgggacaucaagagcaaaaauauucucguaaagaaaugcgaaacuugugcuauagccgaucugggcuuagcggugaagcaugacucuauccugaacaccauugauaucccccagaacccuaaagucgguacaaagcgcuacauggccccagagaugcucgacgauaccaugaaugugaacauauuugaguccuucaaacgagcagacauuuauucaguugggcuuguguacugggaaaucgcuagaaggugcagcgucggaggcaucguggaggaauaccagcugccguauuacgacaugguacccagugauccuucuauugaggaaaugcggaagguugugugcgaccagaaguuucguccauccauccccaaucaauggcagagcugugaggccuugcgcgucaugggcagaauuaugagggagugcugguaugcuaacggggccgcacggcuaacggcccugcgaaucaaaaagacuauaucgcagcucugugugaaagaagauugcaaggcuuga

SEQ ID NO: 52408 - RNA, 1530 nt, Artificial Sequence
  derived and/or modified sequence opt3 from ACVR1__Homo_sapiens__NP_001096
augguggacggcgucaugauccugcccguucucauuaugauagcccuuccuagcccauccauggaggaugaaaagccgaaagugaaccccaagcuguacaugugcguaugugagggguugucuugcggaaaugaagaccacugugagggucagcaaugcuucucaaguuuaagcaucaacgauggcuuucauguguaucagaaaggguguuuccaggucuacgaacagggaaagaugaccugcaaaacaccuccaucccccggccaagcuguggaguguugccagggugacugguguaauagaaacauuacugcacagcugccuacgaaggggaagucuuuuccaggaacccagaauuuccaccuagagguuggccucaucauucugucgguggucuuugccgugugccuucuggcguguuugcucggcguagcucugaggaaauucaagcggcgcaaccaagaacgacugaauccccgugauguugaguaugggacaaucgaaggacucauaacuaccaacgugggugacucaacauuagccgaucugcuugaccauagcugcaccaguggcuccgggucuggauugccuuuucugguccagagaacuguggcaaggcagaucacacuacucgagugcgugggcaaaggucgguacggggaggucuggcgcggaagcuggcagggcgaaaauguugccgugaagauuuucuccucaagagaugagaaaaguugguuuagggaaaccgagcuguauaacacgguaaugcuucggcacgaaaauauccugggcuucauugcuagcgacaugacuucucgccauuccucaacccaauuguggcucaucacacacuaccacgagauggggagccuguaugauuacuuacagcugacuacccucgacacagugaguugucuucgaauaguccugucuauugcauccggauuggcccaucuacacaucgagauuuuugguacccagggcaagccagcuaucgcccauagagaucugaaaagcaaaaacauccucgugaagaaaaaugggcaaugcuguauugcggaccugggacuugcaguuaugcacucgcagucuacgaaccagcuggacgugggcaauaacccgagggucgguacuaagcgguacauggcccccgaaguguuggaugagacaauacagguagacugcuucgauuccuauaaacguguugacaucugggcuuuugggcucgugcugugggaagucgcccgcagaauggugucaaacggcauugucgaggauuacaagccuccauucuaugacgugguucccaaugauccuaguuucgaagacaugaggaaagugguaugugucgaucaacagcggccaaacauccccaaucgaugguuuagcgacccgaccuuaacuucccuggcaaagcuaaugaaggagugcugguaccagaacccuucugcucgccucacagcccugagaauaaagaagacccuuacgaaaauugauaauagcuuggacaagcugaaaaccgacuguuga

SEQ ID NO: 52409 - RNA, 1542 nt, Artificial Sequence
  derived and/or modified sequence opt3 from ACVR2A__Homo_sapiens__NP_001265508
augggcgccgcugcaaagcuggccuucgcgguguuccucaucagcugcuccucuggggcuauucuuggaagaucagagacccaggaaugucuguucuuuaacgccaauugggagaaagacaggacaaaccaaacuggugucgaacccugcuacggcgauaaggacaaacggcgccacuguuucgcaacguggaagaauauaagugggagcaucgagauuguuaaacagggaugcugguuggaugacaucaacuguuaugaucgaaccgacugcguggaaaagaaggauuccccugagguauacuuuuguugcugugagggcaauaugugcaacgaaaaauucucuuauuuuccagagauggaagugacacagccgacuucgaaucccgucaccccuaagccacccuacuauaacauuuuacuguacagccuagugccucucaugcugaucgccgguauaguuaucugugcuuucuggguguaucgucaucacaaaauggcauacccacccguccuugugccuacacaggacccagggccgcccccuccaucaccccuguugggacucaagccucugcaacugcucgagguaaaagccagaggcagguuuggcugcguuuggaaggcucaguuacugaaugaguacguggccgucaagauuuucccaauccaggauaaacagaguuggcaaaacgaauaugagguguacucccuucccgggaugaagcaugaaaauauuuugcaguuuaucggagcggagaaacgggguaccucuguggacgucgaucuguggcuaauaacugcauuccacgaaaagggcagccucuccgacuuucugaaagccaacguugugucauggaaugagcuuugccauauugcugagacaauggcccgcgggcuggcauauuugcacgaagauaucccgggacucaaggacggccacaaaccugcuauuagucauagagacaucaagagcaagaacguacugcugaaaaauaacuuaaccgccuguaucgcggauuucggucucgcccuuaaguucgaggcagggaaaucugcuggagacacgcacggccaggugggcacuaggcgguacauggcccccgaaguccuggagggggcuauuaacuuucagcgcgaugccuucuugcgaauagacauguaugcaaugggucuagugcugugggaacucgccuccagaugcaccgcugcggauggaccaguugacgaguacaugcugccuuuugaggaagagaucggccaacaucccucacuugaagauaugcaggagguggucgugcacaagaaaaagaggccaguacugcgggacuauuggcagaagcacgcagggauggccauguugugugaaacaauugaggagugcugggaucaugacgcugaagcccgucucagcgcaggauguguuggcgagcgcaucacucaaaugcagagacugaccaauauaauuacaaccgaagauaucgugacggucgugacuauggucacaaacguggacuuucccccuaaagagaguucuuuauga

SEQ ID NO: 52410 - RNA, 1539 nt, Artificial Sequence
  derived and/or modified sequence opt3 from ACVR2B__Homo_sapiens__NP_001097
augaccgcccccuggguggcucuggcacuccuuuggggcagccugugcgccggguccggaagaggugaggcggaaacaagggaguguaucuacuauaacgcuaauugggaauuggagcggacuaaccagucuggcuuagaacgcugcgagggggagcaagacaagcgacugcacuguuacgccucauggcguaauaguagcggaacgauugaacuggucaaaaagggcugcuggcucgaugacuucaacuguuaugauagacaggagugcguugcaaccgaagagaauccucagguguacuuuuguugcugugaggguaacuucugcaaugaaagguuuacacaucugccagaggccgggggaccggaaguaacuuaugagcccccuccaaccgcucccacacuucugaccguguuggcauacucccuccugccuauaggcggccugucucucaucgucuuacuggccuucuggauguaucggcaccgcaaaccacccuacgggcauguggacauucacgaagauccuggaccaccgcccccuucgccacuuguugguuugaagccccugcagcuacucgagaucaaagcuagaggcagguuuggguguguguggaaggcccaacugaugaacgacuucgucgcggugaagauuuuuccucuucaggauaaacagucauggcagagcgagcgggaaaucuucaguacuccaggaaugaagcaugagaaucuguugcaauuuauagcagccgaaaaacgcggcuccaaccucgagguagaacugugguuaaucacagcuuuccacgacaaggguucucugaccgauuaccucaaagggaauauuaucacguggaacgagcuuugccacguugccgagacuaugagccgaggacuguccuauuugcaugaagacgugcccuggugcagaggcgagggccacaagccgucaauugcacauagggauuuuaagaguaaaaauguccuacuaaagagcgaccucaccgcugugcuggccgauuucgggcuugcggugcgguuugaaccuggaaaacccccaggugacacacacggccaggucgggacucgucgcuacauggccccugagguucuggaaggagcaaucaacuuccagagagacgcuuucuugaggauagauauguaugccaugggccucgugcugugggaguuaguaucucgguguaaggcugccgacggucccguggaugaguacaugcugccauuugaagaggaaauugggcagcaccccucccuagaggagcuccaagaagucgugguucauaaaaagaugcgaccuaccaucaaagaccacuggcugaagcauccaggccuugcacaguugugcgugacaauugaggaauguugggaucacgacgccgaggcucgccugucagcgggaugcgucgaagagagagugagccucaucaggcggaguguaaauggcaccacgucugauugucugguuucccuugugacuagcgucacaaacguggaccugccgcccaaggagucgucuaucuga

SEQ ID NO: 52411 - RNA, 1512 nt, Artificial Sequence
  derived and/or modified sequence opt3 from ACVRL1__Homo_sapiens__NP_001070869
augacccugggcagccccagaaaggggcuccuuaugcuguugauggccuuagugacacagggagacccugucaaaccauccagggguccgcugguuacuugcacgugugagucuccccacugcaagggcccuaccugucgcggggcuuggugcacaguggugcuaguacgggaagagggacgacauccacaagaacaccguggcugugguaaccuccauagagagcugugcagggggcggcccacugaguucgucaaucacuacuguugcgauucacaucuuuguaaccacaaugugagucugguuuuggaagcaacccagccuccaagcgagcagcccggaacagacggccagcucgcccugauccugggcccugugcucgcguuacuggcucuugucgccuugggggugcugggacuauggcacguacgcagaaggcaagaaaaacagcggggucuccauuccgagcugggcgaaucuucgcuuauucugaaggcaucagagcagggggauagcauguugggagaccuccuggauagugacugcaccacuggcuccgguucuggguuaccauuucugguucagcgcacaguggcccgacaagucgcucucguggagugugugggaaaaggcagauauggcgaagucuggagggggcuuuggcacggagagagcguugcagugaagauauucuccucacgggaugaacagaguugguuucgugagaccgaaaucuacaacacgguacuguugcgccaugacaauauucuagguuucaucgccagcgauaugacuucuagaaacuccucaacccagcuguggcucauuacacacuaucacgagcauggcagccuguacgacuuucuucagaggcaaacucuggagccgcacuuggcucuccggcuggccgugagugcggcaugcggguuagcccaucugcacgucgaaaucuucggaacccagggcaagcccgcuauagcccaucgagauuuuaaaucucgcaaugugcuaguuaaguccaaccuccagugcuguaucgcagaccugggucuugcugugaugcacagccaagggucggauuauuuggacauuggcaauaacccuagagucggaacaaaaagguacauggccccagaggugcuggacgaacagauccggaccgauugcuucgagucuuauaaguggacggacauuugggcguuuggccucguacugugggaaaucgcccgcagaacuauaguuaaugggauuguggaggauuacaggcccccuuucuacgacgucgugccaaacgaucccuccuuugaggacaugaaaaaggucguguguguugaucagcagacaccgaccaucccuaaucgucuugcagcugaccccgugcugucaggauuggcccaaaugaugcgggaaugcugguauccaaacccuagugcucgacucacugcccugagaauuaagaaaacauuacagaagaucagcaauucccccgagaaaccaaagguaauccaguga

SEQ ID NO: 52412 - RNA, 1227 nt, Artificial Sequence
  derived and/or modified sequence opt3 from ACY1__Homo_sapiens__NP_001185824
augaccagcaagggccccgaggaggaacacccuuccgugacacuguucagacaguaccucaggauccggacuguccaaccaaaaccggacuauggggccgcuguugcauuuuucgaagagacggcccgccagcuuggacuggguugccagaagguggaaguagcgcccggcuacguggucaccguguugacauggccugggacuaacccaaccuuaucuucaauucugcuaaauagucauacagauguugugcccgucuuuaaagagcacuggagccaugacccuuucgaggcuuuuaaggauuccgaaggauauauauacgcccgaggcgcacaggacaugaaaugugugucuauccaauaucucgaggccguacguagacugaagguugaaggucacagguucccacggaccauucauaugacuuuugugcccgaugaggaggucgggggacaccagggcauggaacuuuucgugcagcgcccugaguuucacgcucugagagcaggcuucgccuuggacgaagggaucgcuaacccaacagaugccuuuaccguguucuacucggagaggucaccgugguggguccggguuacgagcacuggacgccccggucaugcgagucgauuuauggaagacaccgcagccgagaagcuccacaaagugguaaauuccauucuggcuuucagagagaaggaauggcagaggcugcaaucuaacccucaucucaaagagggcagcgugacauccgucaauuuaacuaagcuggaagggggaguggccuauaacguuaucccagcaaccaugucagcuaguuucgauuuucggguggcccccgacgucgauuucaaagcguuugaggaacagcuucagagcuggugccaggccgcaggcgagggugugacauuggaguucgcucaaaaguggaugcacccucagguaaccccaacggacgauucuaaucccuggugggccgcuuuuucccguguuuguaaggacaugaaccugacucuagaaccggagauaaugccugccgcaacagacaaucgcuacaucagagccguggggguccccgcucucggauucucaccaaugaacaggaccccugugcugcuucacgaucaugacgaacggcugcacgaggcggucuuuuugcgaggcguggauauuuacacucgccuccugcccgcauuagccagcguuccagcucugcccagugacucuuga

SEQ ID NO: 52413 - RNA, 960 nt, Artificial Sequence
  derived and/or modified sequence opt3 from ACY3__Homo_sapiens__NP_542389
augugcagccugcccgugccuagagagccacucaggcgggucgccguuaccggcgggacacacggaaacgaaauguccgguguguaccuugcucgccauuggcugcacgcaccggccgaguugcagcgagcgucuuucucagcuguacccguguuagccaauccugcagccacuuccggcugucguagauaugucgaccaugaucugaacaggacguuuaccagcuccuuccuaaauucucggccaacacccgacgauccuuacgaagugacucgcgcuagagagcucaaccaacugcuugggccaaaggcaucgggacaggccuuugacuucguucuggauuugcacaauaccacagcuaacauggguaccugccucaucgccaaaucaagccaugaaguguuugcgaugcaccuguguaggcaucugcagcuccaguaucccgaguuaaguugccaagucuuccuguaccagcgguccggcgaggaaucuuauaaucuugacagcguggcaaagaacggguugggacuggagcuaggcccucagccacagggcguacuccgcgccgauauuuuuagucgaaugagaacucugguugcuacagugcuugacuucauagaacuguuuaaucaagggaccgccuucccggcauuugagauggaggcuuacaggcccgucggagugguggauuucccucggacggaagccggucacuuggcgggcacuguccacccacagcuccaggaccgugauuuucagccccugcaaccuggggccccaaucuuccagauguucucaggagaggacuuacuguaugaaggcgagaguaccguuuaccccguguuuauuaacgaagcagcuuacuaugagaaagguguagccuucgugcagacagagaaguuuacuuucaccgucccggcuaugccugcccucacacccgcaccaagcccugccucuuga

SEQ ID NO: 52414 - RNA, 300 nt, Artificial Sequence
  derived and/or modified sequence opt3 from ACYP2__Homo_sapiens__NP_612457
augagcaccgcccagucccugaagucuguggacuacgaggucuucggcagaguucaaggggugugcuuuaggauguauacagaagaugaggcucggaaaaucggaguaguggguugggucaagaacacuucaaaaggcacggugaccgggcagguucagggacccgaagacaaggugaauaguaugaaaagcuggcucuccaaggucggcucuccuucgucacgcauugaucgaacaaacuucagcaaugagaagacuauaaguaaacuugaauacuccaacuuuucuauccguuauuga

SEQ ID NO: 52415 - RNA, 1698 nt, Artificial Sequence
  derived and/or modified sequence opt3 from ADAD1__Homo_sapiens__NP_001152757
auggccagcaacaaucacugguuccaguccucucaagugcccucauuugcucagaugcugaagaaaaaccucccuguccagccagcaaccaagacaaucacuacgccgaccggcuggaguagcgaguccuacgggcuuucuaaaauggccucgaagguuacacaggugacuggaaauuuccccgaaccucuguugagcaaaaacuuaucaaguauuuccaauccaguacugcccccuaagaagauaccaaaagaguuuaucaugaaguauaaaagaggugaaauuaaccccgugucugcgcuacaucaauucgcucagaugcagaggguccagcucgaccugaaggagaccgugacaaccggcaauguuauggggccuuacuuugccuucugcgcaguggucgauggaauccaauauaaaacuggccuuggucagaacaagaaggaaagccgguccaaugccgcuaaacuggcauuggacgagcuccugcagcuggaugagccagaaccgcgcauucucgagacaucagggcccccuccauuucccgccgaaccugugguauuaagugagcuggcuuacguuagcaaggugcacuaugagggacgacauauccaguacgccaaaauaucucaaaucgucaaggaacguuucaaccagcuuauuuccaauagaucagaguauuugaaauacagcaguucucuggcggcauuuaucauugaaagggccggccagcacgaggugguggcuaucggcaccggggaauacaacuauucccaagacauaaagccagauggacggguccuacaugacacgcacgccguugugacugcacgcagaagccuccugucgaaaaaucccgcuaugauggagaagucuauuuucuguaccgagccgacauccaaccuucugacuuugaagcagaauaucaacauuugccucuacaugaaccagcugccuaaagguucagcccagaucaagagucaauuaaggcugaauccccacagcaucuccgcguuugaagccaacgaggaacucugucuucauguagcaguggagggcaaaauuuaucugaccgucuacugcccaaaggauggggugaaucggauaucuagcaugucaaguuccgacaaauugacacgcugggaaguucuaggagugcagggcgcucugcucagccacuucauccagccugucuauauuucuucaauccugauaggugaugggaacuguagugacacccgaggacuugagauugccaucaagcagagaguggaugacgcucugacgagcaaguugcccauguuuuaccucguaaauaggccacauaucucccugguucccucugccuauccuuuacaaaugaaccuggaguacaaauuccuaucgcucaauugggcacagggcgaugugagccuggaaauugucgacggccuuuccgggaagaucacugagucaaguccauucaaaucuggaaugagcauggccucccgguugugcaaggcugcgaugcugucacguuuuaaccuccuggcaaaagaagccaagaaggagcuucuggaagcugguacauaccacgccgcaaaauguaugagcgccucuuaucaggaggcuaagugcaaauugaaguccuaccuccagcaacacggcuaugggaguuggauugugaaaagcccguguauagagcaguucaauauguga

SEQ ID NO: 52416 - RNA, 1092 nt, Artificial Sequence
  derived and/or modified sequence opt3 from ADA__Homo_sapiens__NP_000013
auggcccagacccccgcuuucgacaagccuaaaguggagcugcacguccaucucgauggcagcaucaagccagaaacaauucuuuacuaugggagaaggcggggaauagcacugccggccaacacugcggaggguuuguuaaauguuaucggcauggacaaaccccugacgcuaccugauuuucucgcuaaguucgacuacuauaugccagccauugcagggugccgcgaagccaucaaacgaauugcuuacgaguuuguggaaaugaaggcaaaggagggaguaguguaugucgaggugcguuacucuccccaucugcuugccaacuccaaaguugaaccuaucccauggaaucaagcugagggcgaucugacccccgacgaaguggucgccuuggugggucaggggcuccaggagggagagagagauuucggcguaaaggcgaggucaauacuguguugcaugcggcaccagccuaacuggaguccaaaaguuguggaacuguguaagaaauaucaacagcagacagucguggcaaucgaccucgccggcgaugagacuauuccggggagcuccuuacugcccggacacgugcaggcuuaccaagaagccgucaagucugguauccaucgcaccguucacgcaggcgagguggggucggcugaaguagugaaggaggccgucgacauucuuaaaacagagagauugggacacggcuaccauacccuggaagaucaggcgcuauauaauaggcuccggcaggagaacaugcacuuugaaaucugcccuuggucaagcuaccugacuggugccuggaagccagacacagagcaugcagugauacgccuuaaaaaugaucaggcuaacuauagucugaauaccgacgaccccuugauuuucaaguccacgcucgauacugacuaccaaaugaccaaacgagauaugggguuuacagaagaggaguucaagagacugaacaucaaugccgcuaaaucuagcuuuuuaccugaagacgagaagagggaacugcucgaucuucuguauaaggccuacggaaugccacccuccgcaucagccggccagaacuuguga

SEQ ID NO: 52417 - RNA, 2247 nt, Artificial Sequence
  derived and/or modified sequence opt3 from ADAM10__Homo_sapiens__NP_001101
auggugcugcucagaguccuuauccuguuguuaagcugggccgcuggcaugggagggcaguacgguaacccccugaauaaguauauuaggcacuacgagggccuauccuauaacguugacucucuccaucaaaaacaccagcgggcaaagcgcgccgugucacaugaagaucaguuccugcgacuugacuuucacgcgcaugggcgucacuucaaucugagaaugaaaagggauaccaguuuguuuagcgacgaguucaagguagaaacauccaacaaagugcucgauuacgacacuucucacauauauacgggacauaucuacggcgaggaagguucguuuucacacgggagcgucauugauggacgguucgagggcuuuauccagacccgcggcgggacauucuauguggagccugcugaaagauacauuaaggacaggacucugccauuucauaguguuaucuaccacgaggaugacauaaauuauccgcacaaguacggaccccaagguggcugcgccgaucauuccguguucgaacggaugcgcaaauaucagaugaccggggucgaggaggugacacagaucccucaggaagaacacgcagccaacggaccagaacugcuccgaaagaaaagaaccacuucugcugagaagaauacaugucaauuauacauucagaccgaccaucuguuuuucaaauauuacggcacgagggaagcaguaaucgcccagauuagcucccacguuaaggcuaucgauacuauauaucagaccacagacuuuucagguauucggaacaucaguuucauggugaagcguauucgcaucaauacuaccgccgacgagaaagaucccacaaacccuuucagauuuccaaauaucggggucgagaaguuccuugaauugaacagcgagcaaaaucaugacgauuacugccuggcguacguguuuaccgacagggauuucgacgauggagugcuaggccucgcaugggucggcgcccccucuggguccucaggagguauuugugagaaaagcaagcuguauagugacggcaaaaagaaaucucuuaacacggggauaaucacuguucagaauuacggaucccacgugccuccaaagguaagccacauuacauuugcucaugaggugggccacaacuucgguucgccgcaugauucugggaccgaaugcacucccggcgaguccaagaaccugggacagaaagagaauggcaacuauaucauguacgcccgggcaacaucaggggacaaguugaauaacaauaaauuuagucucuguagcauacgaaacauuucccaaguccuggaaaagaaacgcaauaacugcuucguggagucuggacagccuaucugugguaauggcaugguugaacagggggaggaaugcgauuguggauauagcgaccagugcaaggacgaguguugcuuugaugcuaaccaaccagagggcagaaagugcaaauuaaagcccgguaaacaguguucaccuagucaggggccaugcuguaccgcccagugcgcguucaaguccaaaagcgaaaaguguagggacgauucugacugcgcccgggagggcaucuguaauggauuuacggcacugugccccgcuucagauccgaagccuaacuucaccgacuguaaucgccacacacaagugugcauuaacggccagugugccgggaguaucugcgaaaaauacggacucgaggagugcacuugugcuagcuccgaugguaaggacgauaaagaacuuugccacgucuguugcaugaagaaaauggaccccucuaccugugccucgacaggcagcgugcagugguccagacauuuuucagggaggacuauuacccugcagccaggaaguccuugcaaugauuuccguggcuauugugacguauucaugcggugccgauugguugaugcagacgguccccuagccagacugaagaaggcuauauuuucuccagagcucuacgaaaacaucgcggaguggauuguggcacacuggugggccguccugcuuauggggaucgcucugaucauguugauggccggcuucauuaaaauauguagcgugcauacacccuccucaaacccuaagcucccaccgcccaaaccucugccaggaaccuuaaagaggcgccggcccccucaaccaauccagcagccccagagacaaaggccgcgcgaaagcuaccagaugggccacaugcgacgguga

SEQ ID NO: 52418 - RNA, 2310 nt, Artificial Sequence
  derived and/or modified sequence opt3 from ADAM11__Homo_sapiens__NP_002381
augagacugcucaggcggugggccuucgcugcacuucuguugagcuuacugcccaccccuggccuagggacacagggaccagccggugcgcuccgcuggggcgggcugccgcaacuuggaggccccggugcuccugaggugacugaaccaucccgacugguccgugagucuucagggggagaaguuagaaagcagcaguuggacacgagggugcggcaggagcccccuggcggcccacccguacaccucgcccaagugaguuuugucaucccugcauucaacagcaauuuuacccuggaucuggaacucaaccaucacuuacuguccucucaguacguggagcgccauuucucgagagaggggacaacucagcacucaaccggagccggugaccauugcuauuaccagggcaaacuuagggggaauccacacagcuuugcugcauugaguacaugucaaggacugcacggcguuuucuccgaugguaaccuaaccuauauuguggaaccgcaggaggucgccgggcccuggggagcuccucagggcccacucccccaucugauauaccggacuccucuucugccagaccccuugggcugccgcgaaccggggugucucuuugccgugccugcgcagucugcacccccaaaucgaccuagacugaggcggaagcgucaaguacgcagaggacaccccacaguucauagcgagaccaaauauguggaguuaaucgucauuaacgaucaccagcuguucgaacagaugaggcaauccguggugcucacgucaaauuuugccaagagugucguuaaccuugcugacgugaucuacaaagagcagcugaauacucggauuguauugguggccauggaaaccugggcagauggugacaagauccagguccaggaugaccuacuggagacacucgcucgacugaugguguaucgcagagaaggccuuccagagcccagcgaugccacucaccuguucucugggaggaccuuucaauccacaucaagcggagcggccuacguuggcgguauaugcaguuugucucaugggggcggagugaacgaguacggcaauaugggggcaauggcugucacccucgcccagacgcugggacagaacuuagguaugauguggaauaagcaccgguccagcgcuggcgacuguaaaugcccugauaucuggcugggguguauuauggaagacacuggauucuaucuaccacgcaaguuuucgagaugcucuaucgacgaguacaaccaguuccuccaagaaggcgguggguccugucuguucaauaaaccgcuuaaguugcuggaucccccugagugcggcaacggauuuguggaagccggcgaggagugugacugcgggucaguacaggaaugcaguagggcaggagguaacuguugcaaaaaguguacacucacccaugaugccaugugcagcgacggccuguguugccgucgguguaaguaugagccacgagggguuuccugcagagaagcugugaaugagugugauauugcggaaacuugcacaggagacucuagccagugucccccuaaccuucacaaacuggauggcuacuauugcgaccaugagcaggguaggugcuacgggggccgcuguaagacccgggauagacaaugccaggucuuguggggacacgcagccgcugacagguucuguuaugagaaacucaauguggaaggcacggagcgcgggucaugcggacgaaagggcagugguuggguccaguguuccaaacaggaugugcugugcggguuuuuacuguguguuaacaucagcggagccccacggcuaggcgaccucgugggugacauaucuucaguaaccuucuaccaccaaggcaaggaacuggauugccgugggggacauguccagcuugcagacggcagugauuugagcuacguggaggacgggacagccuguggacccaauaugcugugccucgaucacagaugucugccggcuuccgccuuuaacuucucuacuugcccuggcucgggugagaggcgcauuugcagccaucacgggguuuguuccaaugaaggaaaaugcaucugucagccagacuggaccggcaaggauugcucaauucacaaccccuuaccuacaagucccccaacuggugagaccgaacgguauaagggcccuucugggacaaauaucaucauuggaagcauagcaggcgcggugcuggucgcugccaucgugcuugggggaaccggcugggguuuuaaaaacauuagaagggggcgauccggaggcgcauga

SEQ ID NO: 52419 - RNA, 2208 nt, Artificial Sequence
  derived and/or modified sequence opt3 from ADAM12__Homo_sapiens__NP_001275904
auggccgcuagaccccugccugugagcccagcaagggcccuccuucuggcguuggcuggcgccuuacuggcaccgugcgaggcccgcggggucucccuauggaaccagggacgggcugacgaaguugugucugcaucaguagguaguggcgaucucuggauccccgucaagagcuucgacuccaaaaaucacccugaggugcugaacauucgacuucaacgugaaucuaaggagcugauaaucaauuuggaaagaaacgaggggcucauugccucgucauuuaccgagacacauuaccugcaggauggaacugacgugagccuggcuaggaauuauacgggccacuguuacuaucauggucacguucggggguacagugauuccgccgugucucucagcacaugcuccggauuacgcggccugaucgucuucgaaaacgagucauaugugcuugaaccaaugaaaagugcgaccaauagauacaaguuguuucccgcaaagaagcuaaagagcguaaggggcucuugugggucccaucacaacacuccuaaucuggccgcuaaaaacguuuucccacccccuucacagaccugggcccggcgccacaagcgagagacacucaaagcaaccaaguauguggagcuggucauuguggcugacaauagagaauuucagaggcaaggaaaagaucuugagaaggugaagcagcggcugaucgaaauagccaaccaugucgacaaauucuaccguccauugaauauccgcauuguucucguggguguagagguguggaacgauauggacaagugcagcgucagucaggauccguuuacuucucugcacgaguucuuagacuggagaaaaaugaagcugcuccccaggaaaucccaugauaaugcgcagcuugugagcggcguuuacuuucaagggacaaccaucggaauggccccuauuaugucgauguguacggcagaccagucuggcgguaucgugauggaccacuccgauaacccacugggggcugccgucacuuuggcucacgaacuaggacauaacuucggcaugaaucacgacacccuggaucggggcugcucaugucagauggccguggagaaagggggaugcauaaugaacgcaaguacagguuaucccuuuccuaugguauucagcuccuguucucgaaaagaccucgaaacuagccuggagaagggcauggggguuugccuuuuuaaucugccagaagugcgcgagucauucggaggccagaagugugguaacagauucgucgaagagggggaggaaugcgauugcggcgagcccgaagaguguaugaauaggugcuguaacgccaccacaugcaccuugaaaccggacgcugugugugcgcauggacucugcugugaagauugccaacugaagccugcaggcacggccugucgggacaguuccaauagcugcgauuuacccgaguuuuguacuggggcuucuccacacugcccugccaacgucuaccugcaugacggacacucaugccaggauguggacgguuauuguuacaauggcauuugccagacacacgagcaacaguguguuacccuaugggggcccggagcaaaaccagcccccggcaucugcuucgaacgcgugaacagugcuggugacccuuaugggaauuguggcaagguaagcaaauccucuuuugccaagugcgagaugagagaugcaaaguguggaaaaauucagugccagggcggggcgucgaggccagucaucggaacuaacgcugugagcaucgaaacaaauauuccgcuccaacaggguggccguauacugugucgggggacccauguuuaccuuggagacgauaugcccgacccuggcuuggugcuggccgguacgaagugcgcagaugggaaaaucugucucaaccgacagugccagaauauuuccgucuucggcgugcacgagugcgccaugcaaugucauggaagaggcguaugcaacaacaggaagaauugucacugcgaggcucacugggccccacccuuuugugacaaauucggguuuggaggcucaaccgauagugguccuauccgccaggcagaagcucggcaggaggccgcggaaucuaacagagagagggggcagggacaagaaccagugggcagccaggagcaugccuccacagcuucacugacucuuauauga

SEQ ID NO: 52420 - RNA, 2475 nt, Artificial Sequence
  derived and/or modified sequence opt3 from ADAM15__Homo_sapiens__NP_001248393
augagacuggcccuccuuugggcucugggcuuguuaggggcaggaagcccccugccuuccuggccacuaccgaacaucgugcucucuugggguguccugggccccgccgggggaaccgaggaacagcaagcggagucagaaaaggcuccuagggagccacuugaaccccagguucugcaggacgauuugccuauuagucucaaaaaggugcugcagacaagccugccagagccccuccggauaaaauuagagcuggacggcgauucccacauccuugaauugcugcaaaaucgcgagcuaguaccuggucgaccaacucucgugugguaccagccggacgggacgcgugucgugucugaaggacauacccuggagaacugcuguuaucagggcagaguuaggggcuacgccgggucgugggugucaauuugcacauguagcggacuucggggucuggucguguugacucccgagcgcaguuauacccucgaacagggcccuggggaucugcaaggaccacccaucauuuccagaauccaggacuuacaucugccuggccacacaugcgcacucucuuggagggagagcguacacacccagaagccacccgaacauccgcuuggucagcggcacauacgccgaagaagggauguugugacugagacaaaaaccgucgaacuggugaucguggccgaccacuccgaggcucaaaaguaccgggauuuccagcauuugcuaaaucguacgcuggaggucgcacuccugcuugacacuuucuuccgcccucugaacguuagaguggccuugguagggcucgaagcauggacccagagggaucugguggagauuucacccaauccagccgucacauuagaaaacuuucugcacuggcggcgagcgcaucuacucccucgccugccccacgacagugcacaacuugugacuggaaccagcuucucuggcccaacaguuggcauggccauccaaaauuccauuuguucacccgauuuuagcgggggagugaacauggaccacaguaccucuaucuugggugucgcuuccagcauagcccaugagcugggccacucgcucgggcuggaccaugaucuuccuggaaauucuugcccauguccgggccccgcuccugcuaagacgugcauuauggaagccuccacugacuuccugccagguuugaacuuuucaaauuguaguagaagggcgcucgagaaagcccuguuagaugggaugggcagcugccuguucgagcggcuacccucccucccuccaauggcagcuuuuuguggaaacauguucguggaacccggcgagcagugcgacugcggguuucuggaugacuguguagauccgugcugugacucucuuacaugccaguugcgcccuggagcccagugugcuagcgaugguccaugcugucagaauugccagcugagacccucaggcuggcaguguaggccuacccguggggacugcgaucuccccgaauuuuguccaggagacaguucccaaugcccucccgacguuagccugggcgauggugagccaugcgccgggggccaggcaguguguaugcacggacggugcgccucuuaugcucagcagugucaaucauuauggggcccgggggcgcagccugcagcuccccugugccuucagacugcuaacacacgaggaaaugccuuugguaguuguggcagaaacccaagcggguccuacgucucuugcacccccagggacgcaaucuguggacaguugcaaugccagacgggccgcacccagccucuccuggguucgauucgggaucuacugugggaaacaaucgacgugaacgggacugagcucaauuguagcuggguccaucuggaucuuggcuccgacguggcccaaccauugcugaccuuacccggaacagcuugcggcccugggcucguuuguaucgaucacagaugccagaggguggaccugcuuggagcccaggagugccgcucaaagugucacggccaugguguaugcgauaguaaccgacacuguuauugcgaagaggggugggcaccgccagacuguacuacccagcugaaagcgacaucuagcuugaccacuggacuccugcuaucccugcucguccugcuuguguugguuaugcugggcgcuucauacugguaccgggcccguuuacaucaaagacucugccagcugaagggucccacgugucaguauagggcagcccagagcggcccuucugaacgcccagggcccccucaacgggcccuucuggccagaggaacaaaaucccagggcccggcaaagcccccaccucccaggaagccacuaccugcugauccccaggggcgaugcccaaguggagaccucccgggcccuggugccgggauucccccacuggugguccccagccgcccugcgccacccccuccgaccgugucuuccuuguaccuguga

SEQ ID NO: 52421 - RNA, 2475 nt, Artificial Sequence
  derived and/or modified sequence opt3 from ADAM17__Homo_sapiens__NP_003174
augagacagagccugcucuuucuuaccuccgugguccccuuuguucuggccccuaggccaccggacgaucccggcuucgggccucaccaacgguuggagaaguuagacucucugcuaucagauuacgacauccucagucugagcaacauucagcagcauuccgugcgcaaacgagaucuucagacaucuacucacguagaaacgcuguugaccuuuucggcucucaagcgucauuucaaacuguaucugacaucaagcacugagagauuuagucaaaauuucaagguggucgugguugacggaaagaacgaauccgaguacaccgugaaguggcaggauuucuucacaggucacgucgugggcgaaccagacucuaggguacucgcacauauacgggaugacgauguuaucauucgcaucaauaccgacggggccgaguauaacauugagcccuuauggagauuugugaaugauacuaaggacaaaaggaugcuggucuacaagagcgaagacaucaaaaacgugucccggcuucagucaccuaaggugugcggauauuugaaagucgauaaugaggaacugcuaccaaagggccucguugaccgcgagcccccugaggaacuggugcaccgaguaaagagaagggcggauccagacccgaugaaaaacacauguaaacuucugguggucgcugaucaccgguucuaccguuauaugggucgcggggaggaaaguaccacgacuaauuacuugauagagcucaucgacagaguggaugacauuuacaggaacaccagcugggauaaugccggauuuaaaggcuauggcauccagauugaacaaauccggauacugaagucuccccaggagguuaaaccuggggagaagcauuacaacauggcaaaauccuauccaaaugaagagaaggacgccugggaugugaagauguuacuggaacaguucucauuugacauugcugaggaagcaagcaaagucugccucgcccaccuuuucacauaccaggacuucgauaugggaacucuggguuuggcuuaugugggcaguccccgagccaacucucaugggggaguauguccuaaggcguacuauuccccaguuggcaaaaagaauaucuaccuaaacagcggucugaccucgacaaagaacuacgggaagaccauucucacgaaggaggcagaccuggugacuacacacgagcuuggacacaauuuuggcgccgaacaugaucccgacggccuggcugagugcgccccgaacgaagaucaagggggaaaauaugucauguacccuaucgcagugucuggugaccacgagaauaacaagauguucuccaauuguucaaaacagaguaucuauaagaccauugaaagcaaagcucaggagugcuuucaagagcgcuccaacaaggucuguggcaauucuagaguggaugaaggggaggaaugcgaccccggaauaauguacuugaacaaugauacuuguugcaacagcgacuguacacucaaggagggcguucagugcucagauaggaauaguccaugcuguaaaaacugccaguucgagaccgcccagaagaaaugucaagaagcgaucaaugccacgugcaaggguguguccuauuguaccgggaacagcucugagugcccucccccaggcaaugcagaagacgauacaguaugucuggacuuaggaaaaugcaaggacggcaaguguauucccuuuugcgagcgggaacagcagcuggagucaugugcuugcaacgagacugauaacaguugcaaagucuguugccgcgaccuaagcgggagaugugugccuuacguugaugccgaacagaagaaucucuuccugaggaaaggaaagccaugcaccguggguuuuugugacaugaacggcaaaugcgagaagcguguccaagaugugaucgaacgguucugggacuuuauagaucagcuuuccauuaauacauucgggaaauuuuuggcugacaacaucguaggaucugugcugguuuucucgcucaucuuuuggauuccguucagcauccugguccauuguguggauaagaaacuugacaaacaguaugagucccugucauuguuccaccccaguaauguggaaaugcucucuagcauggauuccgccucaguccgaauuauaaagccuuuuccagcaccccagacuccuggcagacugcaaccagcccccguuaucccgagcgcuccugcggcaccaaaauuagaccaucagaggauggauaccauucaggaggaccccucuacagacucccacauggaugaggacgguuucgaaaaggauccuuuucccaacaguagcaccgccgcuaaaucuuucgaggaccugacugaucacccagugacgcgcuccgaaaaggccgcaucauuuaagcuacagcggcaaaauagaguggacaguaaagagacagaaugcuga

SEQ ID NO: 52422 - RNA, 2757 nt, Artificial Sequence
  derived and/or modified sequence opt3 from ADAM19__Homo_sapiens__NP_150377
augcccggcggggccggagcugcaagacugugccuccuugccuucgcgcugcagccuuugaggccacgggcugcccgcgagccggguuggacccgaggcagcgaagaggggucccccaaguuacaacacgaacugaucauuccucaguggaaaacaucugagucaccagugcgugaaaagcauccccuaaaagcagagcucagagucauggccgagggaagggaacugauacuugaccuggagaagaacgaacaguuguuugcuccuaguuacacugagacgcacuauaccagcuccggcaauccacagacaacuacccggaaacucgaggaucauuguuucuaccacgguacaguucgcgaaaccgagcugucuucggugacucugucaacaugcagagggaucaggggacucauuaccguaagcaguaacuuauccuaugugaucgaaccccugccugacucuaagggccaacaucuuauuuaccggagcgagcacuugaagccaccgcccggcaauuguggguuugaacacuccaaaccuacgacucgcgauugggcacugcaguucacccagcagacaaagaaacgaccaagaaggaugaagcgggaggaccuaaacucaaugaaauaugucgagcucuaccugguggccgauuaucuugaauuucaaaagaaucgucgcgaccaggaugcuacuaagcauaaacugaucgagauagccaacuacguugacaaguucuacagaaguuugaauaucaggauugcgcucgugggacuggaagucuggacccacgguaacaugugcgaggugagcgaaaaucccuauucuacauuaugguccuuucugucauggcggcgaaaacuccuugcacagaaguaccaugauaacgcccagcugaucaccggcaugagcuuccacgggacgacuauuggauuggcuccucuaauggccauguguaguguauaucaaucuggcgguguuaauauggaccacuccgagaacgcaaucgggguggcugccacaauggcgcaugagaugggacacaauuuuggcaugacccaugauagcgccgacugcuguucggcaucugcugccgauggcgggugcauaauggcugccgcaacuggacacccauuccccaaagucuuuaacgguuguaaucgcagagaacuggacagguaccuccaguccggcgggggaaugugccugucaaacaugccggacacacggaugcuuuauggcggucgcagaugugggaacggcuaccuggaggauggagaagagugcgacugcggcgaagaggaggaauguaauaacccuugcuguaaugccaguaacugcaccuugaggcccggggcugagugugcgcauggaagcugcugucaccagugcaagcuccuggcaccagguacguuaugucgugaacaagcccggcagugcgaucugccugaguucuguaccggcaaauccccacacugcccaacaaauuuuuaucagauggacgggacucccugcgagggaggccaggcuuacuguuacaacgguaugugccuaaccuaucaagaacagugucagcagcucugggggccuggcgcccgaccagcaccggaucugugcuucgagaaggugaauguggccggagacacauucggcaacugugggaaggauaugaauggagaacauagaaaaugcaacaugagggacgcuaagugugguaaaauucaaugccagucuagcgaggcccgcccccuugaaucaaaugcagucccuaucgauacuaccauuaucaugaacggccggcagauccaguguagagggacacacguuuacaggggaccagaggaggaaggcgacauguuggaucccggucuggugaugaccgggacuaagugcggcuauaaucauauuuguuuugagggacaaugccgcaacacgaguuucuuugaaacagagggcugcgggaaaaaguguaauggacacggcguaugcaacaacaaucagaacugucacugccucccugguugggcgccacccuucuguaauaccccggggcauggaggcuccauagacagcgguccuaugccacccgaaucugugggcccugucguggcugggguucugguggccauccuuguccuggcaguguugaugcucauguacuauugcugucgacagaacaauaagcugggacaguuaaaacccucagcccugccaaguaagcuacggcaacaguuuagcugcccuuuccguguaucccagaacucuggcacugggcacgcuaaucccaccuuuaaacuccaaacaccacagggaaagagaaaaguuauuaacaccccggagauccugaggaagccuucgcagcccccaccccgcccuccacccgacuaccuucggggcgguagcccuccggccccauugcccgcacaucuguccagagcugcccgaaauucaccugggccaggaagucagauagagaggacugaaucuagccgccggcccccuccguccagacccauucccccugcgcccaacuguaucgugucacaagauuucagcaggccacguccuccccagaaggcccucccagcuaauccggucccuggccgccggucucugcccagaccagguggcgcaucccccuuaaggccuccaggggccggaccccagcagagucgaccucuggcugcccuugcaccgaaauuuccagaguaucggagccaacgcgcgggcgggaugaucucuuccaagauuuga

SEQ ID NO: 52423 - RNA, 2331 nt, Artificial Sequence
  derived and/or modified sequence opt3 from ADAM20__Homo_sapiens__XP_005268209
auggugcagcugcaccaagacaccgauccccagaucccuaagggccagccaugcacacucaacagcuccgaagggggagccagaccggcugucccccauacucuuuucucuucagcacuggacaggugguugcacaaugauaguuuuauuauggccguuggugagccuuuagugcauauacggguaacgcugcuacuccugugguucggcauguuucuuagcaucuccgggcacucucaggcgcgcccaucgcaauacuucaccucacccgagguggucauuccucugaaagugaucagccgaggacguggcgcuaaggccccagguugguugaguuauucccucagauuugggggacagagguacauuguucauaugcgggugaacaaacugcuguucgcagcccaccuccccgucuuuacauauacugaacagcacgcuuuacugcaggaccaaccuuucauccaggaugacuguuacuaucauggcuacguggagggcguaccagaaucucuuguugcauugagcacaugcuccgggggauuucuggguaugcuacagauaaaugaucucguguaugagaucaagccgauuucagucagugccaccuucgagcaccugguguacaaaaucgacagcgaugacacccaguuucccccuaugcgcuguggccuuacugaagagaagauugcucaucaaauggaacugcaguugucuuacaacuucacacucaagcaguccucauuuguggggugguggacccaccaaagauucgucgagcugguugugguaguggauaauaucagguauuuauucagccagaguaacgccacgacuguccagcacgagguguuuaauguugugaacauagucgacucuuucuaccauccacuggaaguggauguaauucucaccggaaucgacauuuggacagcguccaauccccuuccuacuagcggcgaccuggauaacguuuuggaggacuuuucgaucuggaaaaauuauaaccuaaauaaccggcugcagcacgauguggcacaucucuucaucaaggacacccaagguaugaaacugggggucgccuacgugaagggaauuugccagaauccauuuaacacaggcgucgauguguucgaagacaaccgccuuguuguguuugcuauaacccugggccacgaguuggggcauaaucucggaaugcagcacgauacgcagugguguguaugcgaacugcaaugguguaucaugcacgccuaucgaaaagucacuacaaaguucucuaacugcuccuacgcacaguauugggacucaaccauuaguagcgguuuauguauccagcccccgccuuaccccggcaauauauuuagacugaaguacugcgggaaccuagugguugaggagggagaagagugugauugcggcacuauuaggcagugcgcuaaagacccauguugccuccugaauuguacacuucauccuggugccgcgugcgccuucgggaucuguugcaaggauuguaaauuuuugcccuccggcacccugugccggcaacaggugggagaaugugaccucccagaguggugcaacggcacgucucaccagugucccgacgaugucuaugugcaggacgggaucagcugcaauguaaacgcauucugcuacgaaaagaccuguaauaaccaugauauucaaugcaaagagaucuuuggacaggacgcucguucagccagucaguccuguuaucaagagauuaauacacaggguaaccgcuucggccacugcgggauagugggaacuaccuacguuaaguguuggacaccugauaucaugugcggcagaguccagugugaaaaugugggugugauuccaaaccugaucgagcacagcacuguccagcaauuccaucuuaaugacaccacaugcugggggaccgauuaucaccugggcauggcuaucccggacauuggagaaguuaaagauggcacugugugugggcccgagaagauaugcaucaggaagaaaugugccucuauggugcauuugucacaggcaugccagccuaagacgugcaacaugcggggaauuuguaacaauaaacagcacugccauuguaaccacgaaugggccccacccuacugcaaggacaaagguuauggcgggagugcugauagcggaccuccacccaagaauaacauggagggccucaauguaauggguaagcugcgauacuuaucccugcuaugucuccugccgcuugucgcguuuuugcuguucugccuccacgugcuguuuaaaaagcgcacaaaaucuaaggaggacgaagagggguga

SEQ ID NO: 52424 - RNA, 2169 nt, Artificial Sequence
  derived and/or modified sequence opt3 from ADAM21__Homo_sapiens__NP_003804
auggccguggacggcacccuggucuacaucagaguuacacuccuucuguugugguuagggguguuccugagcauuuccggauauugccaggcuggucccucucaacacuuuacuucaccugagguagugauaccacuaaaggucaucaguaggggccggagcgcaaaagccccgggguggcucuccuacucucugcgcuucggaggccagaagcaugugguucacaugcgagugaaaaagcugcuugucucgcgucauuugcccguguuuacguauaccgaugacagagcgcuccuggaagaucagcuguucauuccugacgauuguuacuaucacgguuacguagaggcugccccagaaucacucguuguguuuagcgcaugcuucgggggauuuaggggcgucuuaaaaaucaguggccugacauaugagauugaacccauccggcauuccgccacuuucgagcaccuuguguacaagauaaacucuaaugagacccaguuuccugcuaugcgcuguggguugacagaaaaggagguggcaagacaacagcuggaguucgaggaggccgaaaacagcgcucuagagccaaaauccgccggagacugguggacccacgcgugguuucucgaacuggucguugugguaaaucaugauuucuuuaucuacucacagaguaacauuagcaaggugcaggaggacgucuuccuugugguuaauaucguggauucuauguauaaacaacuggguacuuacauuaucuugauaggcauugaaaucuggaaccaggggaaugucuuccccaugacauccauugaacaggugcucaacgacuuuucacaguggaagcaaaucagccugagucaguuacagcacgaugcagcccauauguucaucaaaaauucucugauuuccauacucggacuugcuuauguagccggcaucugcaggccuccaauugacugugguguugauaacuuucaaggggacaccuggagccuguucgcaaauacgguggcucacgaguugggacacacucuaggcaugcagcaugacgaagaguuuugcuucuguggcgaacgggggugcaucaugaacaccuuucgcgucccggccgagaaguucacaaauuguucguacgcggauuuuaugaagacuacccugaaccagggaucuugccuccacaaucccccucgacugggugaaauauucaugcuuaaaagauguggcaacgggguggucgagagggaggaacagugcgacugcggauccgugcaacagugugagcaggaugccugcugucuguugaacugcacacuccggccaggcgcagcuugugccuuuggucugugcuguaaggacugcaaauucaugcccucaggggaauuaugucgucaggagguuaaugaaugcgaucugccugagugguguaacggcaccagucaucaaugcccagaggaccgcuaugugcaggauggcauucccugcagcgacuccgcuuacuguuaucagaagagaugcaauaaccacgaucagcauuguagggaaaucuuuggaaaagacgccaagucugcaagccaaaauugcuacaaagagaucaacucacaggggaaucgguucggacacugugguauuaacggcacgacuuaccuaaagugccacaucagugauguauucugugggcgaguccagugcgaaaaugugcgcgacauuccgcuccugcaggaccauuuuacacuucaacacacccauauaaacggaguuacuuguuggggcaucgauuaucacuugagaaugaauauuuccgacaucggugaggugaaggaugggacagucugcggcccuggaaaaaucuguauucacaagaaaugcgugagccugucuguacucucacaugugugccugcccgagaccuguaacaugaagggcauaugcaauaacaaacaccauugucacugcggguacggauggaguccaccuuauugucagcauagggguuacggcgggagcaucgacuccggacccgccucugcuaagcggggcguuuuccuuccacugauugucauccccucguugagcgugcucacguuucuguucaccguggguuuacugauguaucuacgccagugcuccgggccuaaggaaacaaaagcgcacucaaguggcuga

SEQ ID NO: 52425 - RNA, 2613 nt, Artificial Sequence
  derived and/or modified sequence opt3 from ADAM22__Homo_sapiens__NP_057435
augcaggccgcuguggcagucagcguucccuuccugcuccuuugcgugcugggcaccuguccuccagccagaugcgggcaagcgggagacgcuuccuugauggaguuagaaaagaggaaagagaaccgguuuguagaacgccagucuaucgugccgcugcgacuaauuuaccguucagguggcgaggaugaaaguagacacgacgcccucgauacaaggguccgcggggaccugggaggcccccagcuuacucauguggaucaggccagcuuccaaguugacgcauuugguacguccuucauacuggauguggucuugaaucacgaccuccugucuucggaguauaucgagcggcauauugaacacgggggaaagaccguggagguaaaaggcggcgaacauuguuacuaucaggggcacaucagaggaaacccugauucauuuguugcucugagcacaugccacggucuccauggcauguucuacgacgggaaucacacuuauuuaauugagccagaggaaaacgauaccacacaggaggacuuucauuuccacaguguguacaaguccaggcuguuugaguucucucuugaugacuugcccagcgaauuucagcaagucaauaucaccccuuccaaauucauacugaagccacggcccaagcgcucaaaacgacagcuaagaagguauccucggaacguggaagaggagacuaaguacaucgaacucaugauugugaaugaccaccugauguuuaaaaagcaucgucuuagugucguucacacaaacaccuacgcaaaaagcgugguaaauauggccgaucugaucuauaaggaccaguugaagacgcgcauugugcucgucgcuauggagacuugggccaccgauaacaaauucgcgaucucugaaaauccacugauaacauuaagagaguucaugaaguacaggcgggacuuuauuaaagaaaaguccgaugcagugcaucuguucucaggaagccaguuugagaguucucgauccggcgccgcuuauaucggugggauuuguagccuccuuaaaggaggcggcguuaacgaguucgggaagacugaccugauggccgugaccuuggcacaaucgcuagcucacaauaucggaaucauuucugauaaacgcaagcuggccuccggugaaugcaagugugaggacacauggucaggcugcauaaugggggauaccggauacuaucucccgaaaaaguuuacgcaguguaacaucgaagaguaccaugacuuccugaauaguggcgguggggcgugccuuuuuaacaaacccagcaagcuguuggauccuccagaauguggcaacggauucauugagacuggcgaggaaugcgacugcgggacacccgccgaguguguccucgaaggagcagagugcuguaaaaagugcacccugacucaggacucccaauguucugaugguuuaugcuguaagaaaugcaaguuucagccuaugggcacaguguguagagaggcuguaaaugacugcgauaucagggaaaccuguagcgggaacucaagucagugcgccccaaauauacacaaaauggacggauauuccugcgauggcguucaggguauuuguuucgggggccggugcaagacgcgcgacagacaauguaaauacaucuggggacagaaggugaccgcuagcgauaaguacugcuaugagaaacugaacaucgaaggcacagagaaggggaauuguggaaaagacaaggauacuuggauucagugcaacaaaagggacguccuaugugguuaccuccugugcaccaauaucggcaacauuccccgucuuggggaauuggauggagagauaacaucuacucuggugguccagcaaggccggacccucaauuguucaggugggcacgugaagcuggaggaagacguugaucuuggcuauguggaggacggaacaccgugcggcccucagaugaugugucuggaacaucgaugcuugcccguagccaguuuuaacuucagcacuugccucuccucuaaggaggggaccaucuguucgggaaauggcgucugcagcaacgaacugaaaugugugugcaauagacacuggauugguuccgacuguaacacguacuuuccacauaaugaugacgcaaagacagggaucaccuuaucaggaaacggcguugccgguacuaacaucauuauaggcaucauugcugggaccauccuggugcuagcgcucauucugggaaucacagcauggggcuauaaaaauuacagggagcagcgcaguaacgggcuuucucacagcugguccgagcggauaccugauaccaagcacaucucagacauuugcgaaaauggaagacccaggagcaacucuuggcagggcaauuugggugggaacaaaaagaaaauccgcggaaagcgauuccggccacguuccaauaguacugagacacugagccccgccaagucuccuuccucaaguacgggcagcauugcuucguccagaaaauauccauacccgaugcccccucucccagaugaagacaagaaagucaacaggcaaucugcccgccugugggagaccagcaucuga

SEQ ID NO: 52426 - RNA, 2499 nt, Artificial Sequence
  derived and/or modified sequence opt3 from ADAM23__Homo_sapiens__NP_003803
augaagcccccuggcagcuccucuagacagccaccgcuggccgggugcucacucgcuggagcaaguugugguccccaaaggggcccugccgggagcgugccagcguccgcucccgcccggaccccuccaugccgccuucuguuggucuuacugcuacugcccccucucgcagccucuucgcgaccacgugcuuggggagcagccgcuccgucagcgccccacuggaacgagacagccgagaaaaaucuuggcguucuggcagacgaggauaacacuuugcagcagaauagcaguuccaacaucucuuacagcaaugccaugcagaaggaaauuacgcucccuuccagacugauauauuacaucaaccaagacucagagaguccauaucaugugcuggauaccaaagcuaggcaccagcagaagcauaauaaagccguacaccucgcacaggcuagcuuccaaauugaagccuuugguucuaaguucaucuuagaccugauucuuaacaauggguugcuguccucagauuacguggagauccauuaugagaacggaaagccccaguacagcaaaggcggcgaacacuguuauuaccacgggaguauacggggagucaaggacucuaaaguggcgcuauccacaugcaauggucuccauggcauguuugaggaugacacuuucguuuacaugaucgaaccucuggagcuugugcacgaugaaaagagcaccgggcgcccacauauuauccagaaaacacuggccggacaguauucgaagcaaaugaagaacuugaccauggaaagaggcgaccaguggcccuuucucucugagcugcagugguuaaaaaggcggaagcgcgcagucaauccgucccgagguauuuucgaagagaugaaauaccuggaacucaugaucgugaacgaucacaagacuuauaaaaagcacagaucaagucaugcucacacaaauaacuuugccaaaagcguaguuaaccuuguggacuccauauacaaggagcaacugaauaccagggucguguugguggcugucgagacguggacugaaaaggaucagauugacaucaccacaaacccuguucagaugcuacaugaguucucuaaauaucggcagcguauuaagcaacacgccgacgcagugcaucugaucagccgcguaacuuuucacuacaaaagaucaagucucuccuauuucgggggaguguguagcaggacccggggcgucggcgugaaugaauacgggcugcccauggccguugcucaggugcuuucucagucacuggcgcagaacuugggaauccaaugggagccaaguagccgaaagccuaaaugcgauuguacagaauccugggguggcugcauuauggaggagaccggggucucucacucgcgcaaguuuagcaaguguuccauacucgaauacagagacuuccugcagaggggaggcggugcaugcuuauuuaaucggcccacgaaacuguucgagccaacugaaugugggaacggcuauguggaggccggagaagagugcgauugcggcuuccauguagaguguuacgggcuaugcuguaagaaaugcucacucaguaauggagcucacuguucugacggucccugcuguaacaauacaagcugccuguuucagccucgcggcuaugaauguagagaugccguuaacgagugcgacaucaccgaauacuguacuggggauuccggacagugcccaccgaaucuucauaagcaagacggcuaugcaugcaaccagaaucaggguagguguuacaacggggagugcaaaacacgugauaaucagugucaauauauuuggggcaccaaggccgcuggaucagacaaguucugcuacgagaaauugaacacggaaggcaccgagaaggggaacuguggaaaagauggugaccgguggauccagugcagcaagcacgacguguuuuguggcuuccugcucugcacaaaucugacucgagcccccagaauagggcagcuucaaggagaaauuaucccuaccucuuuuuaccaccagggcagggucaucgauuguuccggugcacaugugguccuggacgaugacacagaugugggguauguugaggacggcacuccaugcggacccaguaugauguguuuggaucgcaaaugccuccagauucaggcgcugaacaugagcucuugcccuuuagacuccaagggcaagguguguucagggcacggaguaugcaguaaugaagcuaccuguaucugcgauuucacaugggccggcaccgacuguagcauucgggauccagucagaaaccugcaucccccgaaagacgaggguccuaaggggccaucggcaacuaaucuaauaaucggauccauugccggcgcuauccucguggccgcaaucguucuggguggcacgggguggggauuuaaaaacgugaagaaaaggcgcuucgaucccacacaacagggcccuauuuga

SEQ ID NO: 52427 - RNA, 2328 nt, Artificial Sequence
  derived and/or modified sequence opt3 from ADAM28__Homo_sapiens__NP_055080
augcugcagggccuccuucccgugagccuguuguuauccgucgccguuucugcuaucaaggagcugccuggggugaaaaaguacgaaguaguguauccaauuagacuacacccgcuccauaaaagggaggcaaaggaacccgagcaacaggaacaguucgagaccgagcugaaauacaagaugacaauaaacggaaagaucgccguccuuuaucugaaaaagaauaaaaacuugcucgcgccugguuacacugaaacguauuacaauucaaccggcaaggagauuacaaccaguccacagaucauggacgauugcuauuaccaagggcacauucugaacgaaaaagugagcgacgcuuccaucucuacuugucggggacugcgcggcuacuuuucgcagggugaucagcgauauuucauagagccccucucaccuauccaucgugacgggcaggagcacgccuuauuuaaguacaauccagaugaaaagaacuaugacagcacaugcggaauggauggcguucugugggcacaugaccuucaacagaauauugccuugcccgcuaccaaacuggugaagcuaaaagauagaaagguccaggagcacgaaaaauacaucgaguauuaccucgugcuggacaacggcgaguucaagagguauaaugaaaaccaggaugagauucggaaacgcguauuugaaauggcaaauuacguuaacaugcuuuacaagaagcugaauacucacguggccuuggucgggauggagaucuggacagacaaagauaagauaaaaauuaccccuaacgcuaguuucacgcucgaaaauuuuuccaaguggagaggaucugugcugagcaggcggaaacgccaugacaucgcccaauuaauuacugcgaccgagcuggcagguacaacugugggccucgccuucauguccaccauguguucaccauauagugucgggguugugcaggaccacagcgauaaccuucugcgaguagcuggaacaauggcccaugaaaugggccacaacuuugguauguuccacgacgauuacucuugcaaguguccguccaccaucugcgugauggacaaggcauugucauuuuauauccccacggauuucagcaguuguucuagacuauccuacgacaaauuuuucgaggauaagcugagcaauugccucuucaacgcuccucugccaacugacauuauaucgacacccaucugugggaaucagcuugucgagaugggagaagauugcgacuguggcaccucugaggaaugcacuaacauuugcugugaugccaaaacaugcaagaucaaagcgaccuuucaaugugcccugggcgagugcugugaaaagugccaguucaagaaagcagggaugguguguaggccugcuaaggacgagugcgacuugccagagauguguaauggaaaauccgguaacugccccgaugaccgguuucagguuaauggcuucccgugucaucacgggaagggacauugccucaugggcacgugcccuacccugcaggaacaauguacagaguuauggggucccgggacugaaguggccgauaaaucaugcuauaaccguaaugagggcggaaguaaguacggcuauugucgcagagucgacgauacccugauaccaugcaaggcuaacgacacaaugugugggaaacuauuuugccagggagguagcgauaaucucccuuggaagggcaggauugugacuuuccugaccuguaaaacauuugaccccgaggauaccucccaggaaaucgggaugguagccaacggaacuaagugcggcgacaauaaaguuuguaucaacgcagagugcguggauauugaaaaggccuacaaaucuacgaauuguagcucaaagugcaagggucacgcugucugcgaccaugagcuucagugucaaugcgaagagggguggaucccacccgauugugacgacaguuccguggucuuccacuuuagcauugugguuggcguguuguucccuauggcgguaauauuugucgugguugcaauggugauccggcaccagucuucacgagagaaacagaagaaagaucagcgcccacugaguacaaccggaacuagaccgcauaagcagaaaaggaagccccaaauggucaaggccgugcagccucaggaaaugagccaaaugaaaccacacguauacgaccuccccguggagggcaacgaaccuccagcuuccuuccauaaggauaccaacgcccugcccccgacaguuuuuaaagacaauccugucucuaccccaaaggauucgaaccccaaagcauga

SEQ ID NO: 52428 - RNA, 2463 nt, Artificial Sequence
  derived and/or modified sequence opt3 from ADAM29__Homo_sapiens__NP_001265056
augaagaugcugcuccuucugcacugcuugggcguguucuuaagcuguuccgggcauauccaggacgagcacccccaauaccauucuccuccagaugucguuauuccggugagaauaaccggaacaacuagggguaugacgcccccuggcuggcugucauauauccuaccauuugggggacagaaacacauuauccauauuaaggugaaaaagcuccuguucaguaaacaccuucccguauuuaccuacacagaccagggcgccauccuggaagaucagccuuucguccaaaacaauugcuauuaccacgguuauguggagggggacccagagagcuugguuucccucucuacuuguuuuggaggcuuccagggcauacugcagaucaacgauuuugcuuacgaaauuaagccccuggcauucucgaccacauuugaacaucucguguauaagauggacucagaggagaaacaguucagcaccaugcggaguggguuuaugcaaaaugaaaucacuugccgcauggaguucgaagagauugauaacuccacacagaagcagucuagcuacgucggaugguggauccacuuucgaauaguggagauuguaguugugaucgacaauuacuuauauauucguuacgaaagaaacgauuccaaacugcuugaggacuuguaugucaucgugaauaucguggauucaauucuggacgucauagguguuaaggugcuacucuucggccuggaaaucuggaccaacaaaaaucuuauuguaguggaugacgucaggaagagugugcaucuguacuguaaguggaaaagcgagaacaucacgccucggaugcagcacgacacuucucacuuguucaccacacucgggcugcgcggauuauccggcauaggugccuuuagagggaugugcacuccacauaggucaugugcgauuguuaccuucaugaauaagacacugggaaccuuuagcaucgcuguggcccaccaucucggccacaaccuuggcaugaaucaugaugaagacacgugccgguguagucaaccgcgcugcaucaugcacgaggggaaucccccuauuacuaaauucucuaacuguuccuauggagauuuuugggaguacacagucgaacgaaccaagugccuguuggagacugugcacacaaaagacaucuucaacguaaagagaugcgguaacggcguuguggaagagggggaagagugugauugcggaccacuaaaacauugugcaaaggaccccugcugucugagcaauugcacccucacggauggcucgaccugugccuuuggucugugcuguaaggacugcaaauuccuuccuucugggaaggucuguaggaaagaggugaacgaaugcgaucugccagaguggugcaauggcacaucccacaagugucccgacgauuuuuaugucgaagacggaauaccgugcaaagagcggggcuacuguuacgaaaagucaugccaugaccguaacgagcagugucgcagaauauucggggcuggagcaaauacugccagugagaccugcuauaaggaauugaacacacucggugauagggugggccacugugggaucaaaaaugcuacuuacauuaagugcaacaucagcgacguucaguguggacggauccaaugcgagaaugugaccgaaauuccuaacauguccgaucacacaaccguacauugggcccgauuuaaugacauaauguguuggucuacugauuaucaccugggcaugaaaggucccgacaucggggaggucaaggauggcacggagugcggaauugaccauaucugcauucaccgccauugugugcacaucacaauauuaaacagcaauugcucaccagcguucuguaacaaaagaggcaucugcaauaacaagcaccauugucacugcaacuaccugugggauccucccaauugucuaauuaagggguauggagguaguguugacuccggcccacccccuaaaaggaagaaaaagaaaaaguuuugcuaccucuguauccugcuuuugauugugcuguucauccuccugugcugucuuuaucggcugugcaagaaaagcaagccaauuaaaaagcagcaggauguccagaccccgucugcaaaagaagaggaaaagauucaacgcagaccccaugaguugccuccacagucacagcccugggugaugccuagucagagccaaccacccguaacuccgucccagucucacccucaggugaugccaucgcagagccaacccccuguuacccccucccagucacagccaagggucaugccuagucagucucaacccccagugaugccgagccagucccauccucagcucacacccucacaaagccagccacccgugaccccuucucagcgucagccacaacugaugcccucccagagucagccuccggucacuccaagcuga

SEQ ID NO: 52429 - RNA, 2151 nt, Artificial Sequence
  derived and/or modified sequence opt3 from ADAM2__Homo_sapiens__NP_001265042
auguggagagugcuguuccuccuuagcggccugggaggguugaggauggacuccaacuuugauucuuuacccguccagaucaccguuccugagaagauucggucaauaaucaaagaagguauugagagucaagccagcuacaagaucgugauugaaggcaaaccauauacaguaaaucugaugcagaagaacuuccuaccgcacaauuuucgcguguacuccuauucugggacuggaaucaugaaaccccucgaccaggauuuccagaacuuuugccauuaccaaggcuauauagaggguuacccuaagucggucgugaugguuucaacguguaccgggcugcgaggagugcuucaguucgaaaaugucagcuauggcaucgagccacuggagaguuccgugggcuuugaacacguaauuuaccagguuaagcauaaaaaggcugacgugucuuuguacaacgagaaagauaucgaaagccgugaccucuccuucaagcugcagucagucgaguauaaucacauggggagugauacaacugugguggcacaaaaagucuuucagcugauuggacucaccaacgccaucuucguuagcuuuaauauaacaauuaucuuaucuucccuggagcuuuggauugacgaaaacaagaucgcgaccacuggugaggcuaaugaauugcugcauacauuccuaagauggaagaccucauaccucgugcugaggccccacgauguagccuuucuucugguguaucgggagaaaagcaacuacgucggcgcaacguuccaggggaagaugugcgacgccaauuaugcuggaggcgugguuuugcacccucgcacuaucagucucgaaucucuggcagugauuuuagcccagcugcucucccuuagcauggguauaaccuacgaugacaucaacaaaugucaaugcucgggggcugucuguauuaugaauccagaggccauccauuucucuggagugaagauauuuuccaacugcucauucgaggauuuugcgcacuucauuaguaaacaaaagagccagugucugcauaaccagcccagauuggacccauuuuucaaacagcaggcaguaugcggcaaugccaagcuagaagcuggcgaggaaugugacugcgggacagagcaggauugugcccugaucggagaaacuugcugcgacaucgcaaccuguagguuuaaggcugguuccaacugcgccgagggcccuuguugcgagaauugucucuucaugucuaaagaacggaugugccgcccgagcuuugaggaaugugaucugcccgaguauugcaacgggucaagugcguccuguccugaaaaucacuacguucaaacaggacacccaugcggccuuaaccaguggauuuguaucgacggugugugcaugagcggggauaagcagugcaccgacacguucggcaaagaggucgaguuuggacccucugaauguuacucacaucugaauaguaagacugaugugagcggcaacugcgggauuuccgacucuggauauacacagugugaggccgauaauuugcaaugcgguaaacucauauguaaguacgucggcaaguuccuguuacagaucccucgagcaaccauuaucuaugcuaacaucucggggcaccugugcauugccguggaauuugcuagcgaccaugccgauucccagaaaauguggauaaaggacggaacuucauguggcaguaauaaaguuugcagaaaccagaggugugugucuagcuccuaccuagguuaugacugcacaaccgauaaguguaaugaccgugggguaugcaacaauaaaaagcacugccauuguucagcaagcuaccucccacccgauugcucuguccaauccgaccuguggccgggcggaaguaucgauagcggcaacuucccucccguggccauuccagcucggcuuccugagcgcagauauaucgagaacauuuaccacucuaagcccaugagguggccauucuuuuuguucauccccuuuuucauaaucuuuuguguucugauugcgaucauggugaaagucaauuuccagcggaagaaauggcgaacggaagacuacuccucagaugagcagccugaaagugagagcgaaccaaagggguga

SEQ ID NO: 52430 - RNA, 2439 nt, Artificial Sequence
  derived and/or modified sequence opt3 from ADAM33__Homo_sapiens__NP_001269376
augggcuggagacccaggcgggcccgcgggaccccucugcuccuucuguuguuacugcuacuccuguggccagugccgggagcugguguccuucagggccacauccccgggcaaccuguuacaccacauugggugcuggacggacagcccuggcgaacugugagcuuggaggaaccuguauccaagccagauaugggccucgucgcacuggaggccgaaggucaggagcugcucuuagaacuggagaaaaaccaccgucuuuuggcgcccggguacauugagacgcauuauggaccugacggccagccagugguucuggcuccgaaucacaccgaucauugccacuaccaaggcagagugaggggguuccccgacucuugggucgugcuauguacaugcucaggaaugaguggucucauaacucugagccggaacgccuccuauuaccuucgcccuuggccacccagaggcucuaaggauuuuucgacccacgaaaucuucaggauggagcagcuguugacauggaaagggaccuguggacaucgggacccuggcaauaaggcagguaugacuucacucccagggggaccccagagccgcggccgaagagaagccaggcggacacguaaauaucuggaguuauacauuguagcugaucacacccuguuucucacgcgccauagaaaccuuaaucacacuaagcagaggcuguuggagguugcaaacuauguggaccaacuacugcggacccucgauauccaggucgcccugacaggccuugaaguguggacugagcgagaccgcaguagagugacccaggaugcuaaugccacacugugggcguucuugcaguggaggcgggggcucugggcacaacgcccgcacgacuccgcccagcuguuaaccgggagagcuuuucagggugccacggucggccuggcaccuguugaagggaugugcagggcugagucuagcggaggcguguccacugaucauucagaacuacccauuggugccgcggccacaauggcacacgagaucgggcauagucucggccugagccacgacccagacggauguugcguagaggcugccgcugaaucuggcgggugugugauggccgcagccaccggacauccuuucccccgugucuuuuccgcuugcucacggcgacaacuuagagcguucuuuaggaaggguggcggggcauguuugagcaacgccccagaucccggacugccugugccaccggcucucugcggcaaugguuucguugaggccggggaagagugugacugcggccccggacaggaaugccgcgaucuguguugcuuugcacacaacuguagucuucggccuggcgcccagugcgcucacggggacuguugcgugagaugucuguugaaaccagccggagcacucugcaggcaggcgaugggugauugugaccugcccgaguucugcacuggcacaucuucccauuguccuccagaugucuacuuacuggacgggagccccugcgcucgcggaucgggcuacugcugggauggugccuguccgacccuagagcaacagugccagcagcucugggggccuggcucucacccagcacccgaagccuguuuucaagugguaaauuccgcuggagacgcccauggcaacugcgggcaggauucagagggacacuuccugccuugugcaggccgagacgcucuuugcgguaaguugcagugucagggaggaaaacccagucugcucgccccacacaugguuccuguggacagcacgguccaucuggauggccaagaagugaccugccggggugcguuagcccugcccuccgcucagcuugacuugcucggccuggggcuagucgagccaggaacacaguguggcccgcguauggugugccagucuagaaggugucgcaagaaugcauuccaagaacugcagcggugccucacugccugccacagccaugggguuuguaacucaaaucacaacugccauugugcuccuggaugggcacccccauuuugcgauaaacccggcuucggugggaguauggacuccggaccugugcaggccgagaaccacgauaccuuucugcuugcgauguugcugagcguauuacucccacugcuucccggcgccggucuggcuugguguugcuauagauugccuggcgcccaccuccaaagguguucuugggggugccgacgcgacccggcauguucaggaccaaaggauggcccccaucgggaccacccucuagggggaguccauccaauggagcugggccccacagcuacuggucagccuuggccgcuggaucccgaaaauagucacgagccaagcucccauccugaaaagccccucccagccgugucuccugacccccaggaucagguucaaaugccaagaucgugccugugguga

SEQ ID NO: 52431 - RNA, 2265 nt, Artificial Sequence
  derived and/or modified sequence opt3 from ADAM7__Homo_sapiens__NP_003808
augcugcccggcugcaucuuccucaugauucuucugauaccucaggugaaggagaaauuuaucuugggggucgaaggacaacaguuaguuagaccaaagaaacugccgcuaauucagaagagggacaccggucacacacaugaugacgauauccucaaaacuuacgaggaagaacugcuuuaugaaauuaagcugaaccggaagacguuggugcuccaucugcugcgcagccgagaguuccucggcuccaauuacucugagaccuuuuauucaaugaaaggggaagccuucacacgucacccccagaucauggaccacuguuuuuaccaaggaaguauaguacaugaguaugauagcgcugcauccaucucuacuugcaacggcuuaagagguuucuuuaggauuaaugaccagcgguaccugaucgaaccugugaaguauucggaugagggggagcaccuugucuucaaauacaacuugcgcgugccauacggagccaauuauucauguaccgaacugaacuuuacaagaaagaccguucccggcgacaaugagagcgaagaggauaguaaaauuaagggcauccacgacgaaaaguacguggagcuauucauagucgcggaugacacuguguauaggcggaacgggcauccucacaauaaacuccgcaaccgaauuuggggaaugguaaauuuuguuaacaugaucuacaagacacugaauauucaugugacccuugucgguaucgagaucuggacgcacgaagauaaaauugagcuguauuccaacauagaaacuaccuugcucagauucucuuuuuggcaggagaagauccugaaaacaaggaaggacuucgaccacgugguguuacugagcggcaaauggcucuacucccauguccaggggauuucauauccaggaggcaugugccuucccuacuacaguacuagcaucauaaaggaucuguugccugacaccaauauuaucgcuaaccggauggcccaccaacuaggucauaaccuggggaugcagcacgaugaguucccauguacaugcccgucuggaaaguguguuauggacuccgauggcucaauccccgcacucaaauuuagcaagugcagucagaaucaguaucaucaauaccugaaagacuauaagccuaccuguaugcuuaacauuccauuccccuacaauuuucacgauuuccaguuuugcggcaacaaaaagcuggacgagggggaggaaugugauugcggaccugcccaggagugcacgaauccauguugcgacgcucacacuuguguguugaagcccgguuucacaugcgcagaaggcgaguguugcgaaucuugucaaaucaaaaaggccggguccauuugccguccggcuaaagaugagugugacuuuccugagaugugcaccggacauagccccgccuguccaaaggaccaguuccgcguaaacggcuuuccuugcaaaaauucggaagguuauugcuucauggggaagugucccacuagagaggaucagugcucugaacucuuugacgaugaggcgauagagucccacgacaucuguuacaagaugaacacaaaaggcaauaaguucggauauugcaaaaacaaggaaaauagguuucugccaugugaggaaaaagaugugcggugcggcaagauuuacuguaccgggggagaguuaucaagucugcuaggugaagacaagacguaccaucucaaagauccccagaagaacgcaaccgucaaaugcaagacaaucuuccuguaucacgacagcacugauaucggccuuguggccuccgggaccaaauguggagagggcaugguuugcaauaacggugaguguuugaauauggaaaagguguacauuucuacaaacugcccuagccaaugcaacgagaauccagucgacgggcacggccugcagugucauugcgaagagggacaggcuccgguggccugugaagagacucuccacguaaccaacauaacaauccugguugugguccuugugcuggucauugugggcaucgggguuuugauucuccuggugcgauaucgcaaaugcaucaaguuaaagcagguacaaucacccccuaccgagacucugggagucgaaaauaaagguuacuucggcgaugagcagcagauaagaacggaaccaauccuacccgagauucauuuucucaacaagccugcaaguaaagacuccagggggaucgcugauccaaaucagagcgccaaguga

SEQ ID NO: 52432 - RNA, 2475 nt, Artificial Sequence
  derived and/or modified sequence opt3 from ADAM8__Homo_sapiens__NP_001100
augagaggccuggggcucuggcuucugggagccaugauguugcccgcuaucgcaccuagcaggccaugggccuuaauggagcaguacgaagugguccugccguggcggcuacccgguccucgcguucgacgugcgcucccaucccaccugggccuucaucccgagagagugucuuauguacugggggcuaccggacacaacuucacauugcaucucaggaagaaucgggaccugcugggcucagguuacacugaaacguauaccgccgcaaacgggagugaggugacagaacaaccucgcggacaggaucacugcuuuuaccagggccaugucgagggcuauccagacagcgccgcuucccucucuacuugugcaggguuaagaggauucuuucagguggguucggaucugcaccuuauugagcccuuggacgaaggcggggagggaggcaggcacgccguuuaccaagcugaacaucugcuacagaccgccgguacaugcggggugucagaugacagccucggaagucugcuuggcccucggaccgcggcagucuuccgcccacgaccgggcgauucccugcccucuagagagacuagguauguggaguuguacguaguuguggacaaugccgaauuucagaugcucgggagcgaggcugccguccggcaccgugugcuggaaguggucaaccauguugauaaauuauaccagaagcugaauuuccgcgugguacucgugggacuugagauauggaacucccaagacagauuucacgucucaccugauccaagugugacacuggaaaauuugcuaaccuggcaggcaaggcagcggacgcgacgccaccuucaugacaacguucagcucaucacugguguggauuucaccggcacaacugucggguuugcuagagugagcgccauguguucucacuccucaggagcgguaaaucaagaccauagcaaaaaccccguuggcguggccugcaccauggcacacgagaugggucauaaucuggggauggaccacgaugagaacguccagggcuguaggugccaggaacgguucgaggcuggacgcuguauuauggccggcaguaucgggucuuccuuuccuagaauguucagcgacugcucgcaggcuuaucuugaaucuuuucuggagaggccacaauccguguguuuggccaaugcacccgaucucucacaccuggucggagguccggugugcggcaacuuauucguugaacguggggagcagugugacugcggaccucccgaggauugccggaaucgauguugcaacaguacaaccugucagcuggccgaaggcgcucaaugcgcgcaugguacguguugccaggaguguaaggugaaaccagcaggggaacuaugcagaccuaagaaggacaugugugaucucgaggaguucugcgacggcaggcaccccgaauguccagaggaugccuuucaggaaaacggaacucccugcagcggcggguacugcuauaauggagcuuguccuacacuggcccagcaaugccaggcauucugggguccaggcgggcaggccgcugaggaauccuguuuuucuuacgacauucuuccgggaugcaaagccagccgcuaucgggcagauauguguggcguauugcagugcaagggugggcaacagccccugggcagagcgaucuguauagucgacgugugccaugcucucaccacugaggacggaacagccuacgagccuguuccagaaggcaccaggugugggcccgagaaagugugcuggaagggacgcugucaggaucugcacgucuaucgaucaaguaacugcuccgcacagugccacaaucauggcguguguaaccacaaacaagaaugccauugucacgccgguugggcuccuccacauugcgccaagcugcugacggagguacacgcagcuagcgggucuuugcccguguucguugucguggugcucguccuguuagccguugugcuggugacccuagcgggaaucauuguauaccggaaggcccguucaagaauccucaguaggaaugucgcuccgaaaacaacuaugggccgcagcaacccucuguuucaccaggcagccucccgggugccagcuaaggguggcgcccccgcaccuucuagagggccccaggaacuuguuccaaccacacauccuggacaacccgcgaggcacccagccucgagcguggcuuugaaacgaccgccucccgccccacccgucacuguguccucaccuccauuccccguuccuguguacacccgccaggcaccgaagcagguaauuaaaccaacauuugcucccccugucccacccgugaagccuggcgccggggcagccaauccgggacccgcugagggcgcgguggguccaaaagucgcccugaagccucccauccagcggaagcaaggggcaggagcuccaaccgccccuuga

SEQ ID NO: 52433 - RNA, 2460 nt, Artificial Sequence
  derived and/or modified sequence opt3 from ADAM9__Homo_sapiens__NP_003807
augggcagcggggccagauuccccuccggaacccugagggugcgguggcuccuucuguuggguuuagucggcccuguucugggggcugcacgcccaggauuucagcaaacaucucaccuaucaaguuacgagaucauuacuccguggcgacucacgcgugaaagaagggaggcaccccggccuuauagcaaacagguguccuacguaauacaggcggaaggcaaggagcauaucauucaccuggaacgcaacaaggaccuucugccagaggauuucguggucuauaccuacaauaaagaggguacauugaucacugaccaucccaacauucagaaucacugccauuauagaggguacguggaaggaguucacaacucuucgaucgcucucucagauuguuuuggccugaggggccugcuccacuuagagaaugccagcuaugggauagaaccucugcaaaacaguucccauuucgagcacaucauuuaccggauggacgauguguacaaggagccacuuaaaugcggagucucuaauaaggacaucgaaaaggagaccgcaaaagaugaagaggaggaacccccuagcaugacacaguugcugcgccgaagaagggccgugcuaccacagacccgguauguagagcucuuuauuguuguggacaaggaacguuacgauaugaugggucgcaaccagacugcugucagagaggaaaugauccugcuugcaaauuaucuggacuccauguacauaauguugaacauuaggaucgugcucgugggccuggagauuuggacaaaugggaacuuaaucaauaucgucggaggcgccggugauguucuggggaacuucgugcaauggcgggaaaaauuucucauuacccgacgcagacaugacucagcucagcuuguacugaagaaaggauucggcggcacggccgggauggcguuugugggaacugucuguaguaggagccacgccgguggcauaaauguguucgggcagaucaccguugagacauuugccucuauuguggcucacgaguugggacauaaccuaggcaugaaccacgaugacggucgggacugcuccuguggggccaagucaugcaucaugaauagcggcgcaaguggaucucgcaacuucuccagcuguucggcugaagauuuugagaagcugacucucaauaaaggcgggaacugccugcuuaauauaccgaagcccgacgaagccuauucugcgccuuccuguggaaacaaacuggucgaugccggugaggaaugcgacuguggcaccccaaaggagugcgaguuggaucccugcugugaagggucaacaugcaaacucaagaguuucgcagagugugcuuacggagacugcuguaaagauugcagauuccugccuggcgguaccuuauguagggggaagacgagcgaaugcgacgugccagaguauuguaauggcuccucucaguuuugccaacccgauguauucauucagaacggauacccgugucagaauaacaaggccuacugcuauaauggcaugugccaauacuaugacgcucagugucagguuaucuuugggagcaaagccaaggcagccccuaaagauugcuucaucgaggugaacucaaagggagaccguuuugguaauuguggcuucagugggaacgaauacaaaaagugcgcuacuggaaaugcgcuguguggcaagcuacagugcgagaacguccaagaaauucccguguuugguaucgucccagcaauuauacagacaccuucccgggggaccaaauguuggggcguggacuuccagcucggaagcgauguucccgacccaggcauggugaacgaggggacuaagugcggagccggcaaaaucugucgaaauuuucagugcguagaugcuucuguccugaacuaugacugugaugugcaaaagaaaugccauggucacgggguuugcaauucaaacaagaauugucauugcgaaaacggaugggcacccccuaauugugagacaaagggcuacgguggcaguguggacagcgggccaaccuauaacgagaugaauacggcccuuagagauggauugcuggucuucuuuuuccucauugugccgcugaucguaugcgccaucuuuauuuucauaaaaagggaccagcuuuggcgcuccuacuuccggaagaaaagaucucagaccuacgaaucggauggcaagaaccaggcuaaucccagcaggcaaccuggguccgugccacgccacguuucacccgucacaccuccacgagaggugcccaucuaugccaaccgguuugcagugccgacuuacgcggcuaaacagccucagcaguucccaagucgucccccucccccacaaccuaaggucucuagccagggaaaucugauucccgccagaccagcaccggccccucccuuguauuccucacucaccuga

SEQ ID NO: 52434 - RNA, 1176 nt, Artificial Sequence
  derived and/or modified sequence opt3 from ADAMDEC1__Homo_sapiens__NP_001138743
augauccugaacggcgaggaaauuauacucagccuucagaagaccaaacaccuguuggggcccgacuacacagagacuuuauauuccccuagaggagaagagaucacgaccaagccagaaaauauggagcauugcuacuauaaagguaacauucugaaugagaagaacucuguggccucaaucaguacaugugauggccuaaggggguacuucacucaccaucaccaacgguaucagauuaaaccgcucaagagcaccgacgaaaaggagcaugcugucuuuacauccaaucaggaggaacaggaucccgcaaaccauaccugcggaguuaaaucuacugacggcaagcaagguccuauccgcauaucgcgaucacugaaaagcccagagaaggaagauuuccuucgugcccagaaauacaucgaccuguauuuggugcucgauaaugcguuuuacaagaacuacaaugagaaccugacacugauuagaaguuucguauuugacgugaugaaucucuuaaacgucaucuauaauaccauugaugugcagguugcucugguggggauggaaaucugguccgacggagauaagauaaaagucgugcccucugccagcacgacuuucgacaacuuucuuagguggcacuccucaaauuugggcaagaaaauucacgaucacgcacagcugcuaaguggcaucagcuucaacaaccggcgcguagggcucgccgcuucuaauucccuguguucaccuagcaguguugcagugauugaggccaagaaaaagaacaaugucgcucuugugggagugaugucucaugaacugggucacgucuugggcaugccagacguucccuuuaacaccaaaugcccuuccgggagcugugugaugaaucaauaccucucgucuaaguucccaaaggacuuuuccacaucaugcagagcccacuucgagagguaucuguuaagucagaaaccgaagugucugcuccaggcgcccaucccuacuaacaucaugaccacaccaguaugcggaaaucaucuucuggaggugggcgaagauugugacugcgguagccccaaagaguguaccaacuugugcugcgaagcacuaacguguaagcugaaaccugggacugauugcggaggcgacgccccaaaucacacaaccgaguga

SEQ ID NO: 52435 - RNA, 3312 nt, Artificial Sequence
  derived and/or modified sequence opt3 from ADAMTS10__Homo_sapiens__NP_112219
auggcccccgcuugccagauccugagaugggcacucgcccuuggccugggguugauguucgaggugacccacgcguuuaggagccaagacgaguucuuauccucucuggaaucauacgaaauugcuuuuccuacacgggucgaucauaacggagcccuacucgcauucaguccaccgcccccucgccgacagcguagagguacuggcgccacggcugagagcaggcuguuuuauaagguugcauccccaucuacccacuuccuucugaauuugacacggucgucacgccuccuggccgggcaugugagcguagaauacuggacuagagagggacuggcuuggcagagggccgcgcggccccacugucucuaugcaggccauuuacagggucaagccaguuccucucacguggcuauaagcacaugcgggggacugcacggccuuaucgucgccgacgaggaagaguacuugauugaaccucugcauggcgggccaaaaggaucccgcucacccgaggagagugguccucacgugguuuauaagcgaagcucucuaagacauccacaccucgauaccgcauguggcgugagggacgaaaaaccguggaaggggcggcccugguggcugcguacccuuaaaccuccacccgcucgcccucugggaaacgagacugaaagaggccagccagguuugaagagguccgucucacgggagcgauacguggaaacacucguaguugccgauaagaugaugguggcguaucacgggcgcagagacgucgagcaguacgugcuggccaucaugaauauuguggcaaaauuauuucaggauagcagucugggaucuaccgucaacauccucguuacgaggcuuauacuguugacugaggaccaacccacccuagaaaucacacaucacgcuggcaagucccuggauagcuucugcaaauggcagaagucgauugugaaucauucuggccacgggaacgccaucccggagaauggaguagcuaaccaugacacugccgugcucauuacccgguacgauaucuguauauauaaaaauaagccuugcgguacacugggccuugcacccgucgggggaaugugugaacgcgagagauccugcucagugaacgaagacauuggccuggccaccgcuuuuacgaucgcgcacgagauuggucacacuuucgggaugaaucaugauggcguuggaaacaguuguggcgcaagggggcaggacccagccaaguugauggcugcccacaucacaaugaaaaccaauccuuuuguguggagcuccugcucucgugacuacaucacuagcuuccucgauucaggacuggguuuaugucugaacaaucggcccccacgacaggacuuugucuaucccacaguggcaccuggccaagccuacgaugcugacgagcagugcagauuccagcaugggguaaagaguaggcaaugcaaauauggagaaguuuguuccgagcuauggugccucagcaagucuaaccgcuguauuaccaacucaauaccagccgcagaaggcacgcugugccagacccacacaaucgauaaagguugguguuacaagcgggugugcgucccguucgggaguagacccgagggcguggacggagcguggggcccuuggacuccauggggagauuguagcaggaccugcggggguggcgucuccucuucgagccgccacugugacuccccacgaccuacaauugggggaaaauauugccuuggcgaacggcguagacauaggucauguaauacugaugacugcccacccgguagucaggauuuucgcgaggugcagugcucugaguucgacagcaucccguuucgggggaaguucuacaaguggaaaaccuacagaggcggaggcguuaaggcuuguuccuugacaugccuggccgaaggguuuaacuucuauaccgagagggcagccgcugugguagacggaacuccuugucgaccagauacggucgacauaugcgugucaggcgaauguaaacacguugguugcgaucgcgugcucgggagcgaccugcgggaggauaaguguagagucugcggaggcgacgguucugccugugagacaauugaaggcguguuuucccccgcaaguccuggggcuggauacgaggauguaguguggauccccaaaggcagcguucauaucuucauucaagaccuuaaucugucuuugucccaccucgcccugaagggggaucaggaaucauuacugcuagagggacucccaggcaccccucagccccauaggcugccacuugcggguacuaccuuucaguugcgucaagggccggaccagguccagagucuggaagcccucggaccuaucaacgcuagccugauugugaugguguuagcacgcacagagcugcccgcccuucgguauagauucaaugcuccaauagccagggauucguugcccccuuacuccuggcacuaugcaccauggaccaagugcucugcgcagugugccggcgguagccaaguccaggcuguugagugccgaaaccagcucgacucaagugccguggcaccccacuacugcuccgcucauucuaaacugccuaagcggcagcgcgccuguaauacugaaccgugcccacccgauugggugguaggcaacuggagccuauguuccagaucaugcgacgcaggggucaggagccggagugugguuugucaacgaagagugucugccgcugaggaaaaagcgcuggacgauuccgccugcccucagccaaggcccccuguccucgaggcaugucacggaccgacaugucccccagaaugggcugcccuggacuggagcgagugcacgccuucgugcggccccgggcuucgccaucgugugguuuuguguaagucagccgaucaccgggcuacccugcccccugcacauugcucucccgccgcgaaaccaccggcuacuaugagaugcaauuuaaggcgcuguccucccgcccgauggguggcaggagaguggggcgaaugcagugcccagugugguguagggcaaagacagcgguccgucaggugcacaagccacaccggacaggcuucucacgaguguacagaagcacuccgcccacccacuacccagcaaugcgaggccaagugugacagcccuacgccaggcgauggucccgaagagugcaaggacgugaacaaaguggcguauuguccucugguccuuaaguuucaguucugcucccgugcuuacuuuagacagauguguugcaaaaccugccauggccacuga

SEQ ID NO: 52436 - RNA, 4785 nt, Artificial Sequence
  derived and/or modified sequence opt3 from ADAMTS12__Homo_sapiens__NP_112217
augcccugcgcccagagaagcuggcuggcuaaccucuccguggucgcacaacuucugaauuucggcgccuuguguuacgggaggcagccucagccaggaccgguucgguuucccgaccgccgacaggagcacuucaucaaggguuuaccugaauaucaugugguaggcccagugcgugucgaugcgucugggcacuuucugucauacggacuacauuaucccauuaccaguagcagaaggaaacgggaccucgauggcuccgaggacuggguguacuaucgcauaucucacgaagagaaggaucuguucuuuaaccuuacaguuaaucaagguuuccugucgaacucauacaucauggagaaaagauaugggaauuugagccaugugaagaugauggcuaguuccgccccucucugccaccugucuggaacuguccugcagcagggcacgagggugggcaccgcagcccucagcgcuugucacggguuaacaggauuuuuccagcugccacauggugacuuuuucauugagcccguuaaaaagcacccucuuguagagggcggguaccauccacacaucguguaccggcgccaaaaggucccggaaacuaaagagccuaccugcggauugaaggauuccgugaacauuucacagaaacaggaacuguggcgagagaagugggagagacacaaucuacccaguaggagccucucucggcguuccaucucaaaagaacgcuggguggagacacuggucguugcagacaccaagaugauagaauaucauggcagcgagaacguggaaaguuacauccuuacuauuaugaauaugguaacaggucuguuucacaacccaucuaucgggaaugccauucauaucguggucgugagauugauacuccuggaggaggaggaacagggauuaaagauuguucaccaugcugagaaaacccuguccagcuucuguaaguggcaaaaaucgaucaaccccaagucugaucucaauccugugcaccacgacgucgccgugcuucugacgaggaaagauauuugcgcgggcuuuaaccggccaugugaaacuuugggccuaucccaucugucagggaugugccagccccaccgaaguuguaauaucaacgaagacagcggacucccgcuggcauucaccaucgcccaugagcuuggucacuccuucggcauucagcacgaugggaaggagaacgacugcgaaccuguaggacgccaucccuauauaaugucuagacaacugcaguacgacccaacaccuuugacuuggagcaaauguucagaggaauauaucaccagguuucucgaucggggcugggguuucugccuggacgauauucccaagaagaaaggguuaaagaguaaaguuaucgcuccaggcgugauauacgacguccaccaucagugccagcugcaauauggacccaaugccacauuuugucaggagguggaaaacgucugccagacccuaugguguuccgugaagggcuucugccgcagcaaacucgaugcagcugccgacgggacgcaguguggagagaagaaguggugcauggcggguaaauguauuacuguuggcaagaaaccugagucuaucccagggggauggggcagauggucaccguggagucacugcagcaggacauguggugccggggugcaauccgcagaacgucugugcaauaaccccgagccuaaguuuggcggaaaauacuguaccggcgaacggaagcgauacagacuuugcaauguacauccaugcaggucugaggcucccacuuuccgccagaugcaguguucggaguuugauacagucccuuauaagaacgaauuguaccacugguucccaaucuuuaaucccgcccacccgugcgagcuguauugucggccuauugacgggcaguucagcgagaaaaugcucgaugcugugaucgacggaaccccaugcuuugaagguggcaacuccagaaauguuuguauuaacgggauaugcaagauggugggaugugauuacgaaaucgacucaaaugccacggaggacaggugcggcgucugucugggugaugggaguucuugccaaaccgugcgcaaaauguucaagcagaaagagggcagcggauauguagacauuggccuuauccccaagggggcacgagauauccgggugauggaaauugagggagccggcaacuuucuggcuauacguuccgaagacccugagaaguacuauuugaaugguggguucaucauucaguggaacggaaauuacaaacucgcgggcacaguuuuccaguacgauagaaagggugaccuggaaaaauuaauggcaacuggccccaccaacgagucagucuggauccaacugcuauuucaggugacaaacccagggauuaaguaugaguacacuauccagaaagauggacucgacaaugauguggaacaacagauguauuucuggcaguacggccauuggaccgaguguagcgucacaugcgggaccggaauaaggcgccagacugcccacugcaucaagaaaggccgggguaugguuaaggcuacguuuugugacccugaaacacaacccaacgggagacagaagaaaugccaugagaaggccuguccaccgagguggugggcaggagaaugggaggccugcucugcuaccuguggcccucacggugagaaaaagcgaacugugcugugcauucagaccaugguguccgaugaacaggcccuucccccaacagacugucaacauuugcugaaacccaagacccuccugaguugcaaucgcgauaucuuauguccuagcgacuggacuguaggcaacuggucugagugcuccgucucaugugggggaggcgugcggauuagaaguguuacaugcgcaaagaaucacgacgaaccaugcgaugugacgaggaaacccaacagccgugcgcugugugggcuucagcagugcccuucgucccgccgggucuugaagccgaauaaaggaaccaucucuaacggcaagaauccacccacucucaaaccugugccacccccuacaagcagaccgaggaugcugaccacacccacugguccagagucaaugaguaccuccacgccugcuauaucuagccccuccccaaccacagccucaaaggagggggaccuaggaggcaagcaguggcaagauagcaguacucagccugaacugucuucccgauaucucauuagcaccgguucgacaucacagcccauccugacuucucaaagucuuuccauucagccaagcgaggaaaacguuucuagcuccgacaccggcccgacgucagaagggggauugguggcaacaaccacaaguggcagcgggcugucuuccucacggaauccuaucacuuggcccguaaccccauucuacaacacuuuaaccaaaggacccgaaauggagauacacaguggcagcggugaggaacgcgagcagccugaagauaaggacgaguccaauccagucaucuggacaaaaauuagagugcccgggaacgaugccccuguggaaucuacggagaugccgcucgcuccaccccugaccccugaccuuucgagggagagcugguggcccccauuuucaacugucauggaaggacuguugccuucccagcggcccacaaccagugagacaggcacuccacgaguugaaggcauggugaccgagaagccugccaauacgcuccugccgcuagggggagaucaucaacccgaaccaucugguaaaacagcaaacagaaaccaccugaagcucccuaauaacaugaaucagaccaagagcuccgagcccguacugacugaggaagacgcuaccucacuuaucacagagggcuucuugcugaacgccucuaauuauaaacaguuaacuaacgggcauggaagcgcgcacuggauugugggcaauuggagugaauguuccaccacaugcggucucggggccuacuggcgcagggucgaguguagcacgcagauggauucugacugcgcugcaauccaacguccagauccugccaagcggugucaccugagacccugcgcuggauggaaagugggcaacuggucaaaguguuccaggaauugcaguggcggguuuaaaauacgcgagauucaguguguugacagccgagaccauagaaaccuucggccguuccacugccaguuucuggccggaaucccaccuccccuaucgaugucuugcaauccagaacccugugaggcauggcaaguggaaccuuggucccagugcagcaggucaugugguggcgggguccaggagcgcggaguguucugcccgggcggucucugugauuggaccaagcgucccacaaguacuaugucuugcaacgaacaucuguguugccacugggcgaccgggaauugggacuuguguuccacuagcugcggaggcggcuuucagaaaagaacaguucagugugugccaucagaggggaacaagaccgaggaucaagaccagugccugugcgaucauaagccucggcccccugaguucaaaaaguguaaucagcaagccugcaaaaagagugcugacuuacucuguacgaaagauaagcugagcgccuccuuuugccagacucuuaaggcaaugaaaaaguguucugucccaaccguaagggcugaaugcuguuucagcugcccccagacacacaucacccacacucagcgccaacgaagacagcggcuguugcagaaauccaaggaacucuga

SEQ ID NO: 52437 - RNA, 4284 nt, Artificial Sequence
  derived and/or modified sequence opt3 from ADAMTS13__Homo_sapiens__NP_620594
augcaccagagacaucccagggcccggugcccuccacuguguguggcuggcauccucgcaugcggguuccuucugggauguugggguccgagccacuuucaacaguccugcuugcaggccuuagagccccaggcggucucuucauaccugaguccuggcgcuccacuaaaggggcgacccccuagcccaggauuccaacgccagcgucagagacagaggcgggccgcaggcgguauucuccaucuggaacuucugguugccguggggcccgacguauuucaagcucaccaggaggauaccgaacgcuauguguugacaaaccucaauauaggagcagagcugcugagagacccuucccucggcgcccaguucaggguccauuuagugaaaaugguuauccugacugaaccagagggcgcuccgaacauuacggccaaucuuaccucuucguugcugucaguguguggguggagccagacaaucaaccccgaggaugacacugauccuggacacgcggaccuaguccucuacauuacccgguuugaucuggaacuuccagacgguaaucgccaagugcgaggcguaacacagcugggaggggcaugcagucccaccugguccuguuugaucacugaggauacaggcuucgaccucgguguuaccauagcccacgaaaucgggcauucuuuuggacuggagcacgauggcgcuccuggcagcgggugcggaccauccggucaugugauggccucagacggcgcagcucccagagccggguuagcguggaguccguguagcaggcggcagcugcucucucuucuguccgccggacgugcacgcugcgucugggauccucccagaccacaaccuggcucagcuggucaucccccagacgcccagcccggguuguauuacagcgcuaacgagcaguguaggguggccuucggcccuaaggcaguggccugcacguuugcucgggaacaccuagacaugugccaggcgcugaguugucacacugauccacucgaccaaucuuccugcagccgacugcuugucccgcuguuggauggaaccgaguguggcguugaaaaauggugcucgaaggggcgcuguagaucucucguggagcugacacccauugcagccguacacggaaggugguccucaugggguccucggaguccaugcagccgcuccuguggcgggggaguggucacuagaaggcgucagugcaauaacccccggccugcuuucggcggucgagccugugugggggcagacuuacaggccgaaaugugcaauacccaggcuugugagaaaacacaacuggaguuuaugucucagcagugcgccagaaccgauggccagccacuaaggagcucacccggaggcgcaaguuucuaucauuggggagcggcuguuccgcacucccaaggggacgcccucugccgccauaugugucgggcaaucggugagagcuuuauuaugaagagaggcgauucuuuccuggacgggacgaggugcaugccuucaggaccacgcgaggauggcacucuuaguuugugugugagcgguuccugccgaacauucgggugugacggccggauggauucucagcaggucugggaccguugccagguguguggaggcgacaacucgaccugcagccccagaaagggguccuuuacugccggaagggcucgcgaauacguaacauuccugaccguuacgccuaaucucaccucaguguauaucgccaaccaccggccccuguuuacacaccuugcagucagaauaggcgguagguacguggucgcugggaaaaugaguauuucuccaaauacuaccuacccuagccuguuggaggauggacgaguggaauaucgcguugcccucacagaggaccggcugcccagauuagaggaaaucaggauuuggggcccacugcaagaggaugcggacauccagguguaccgucgcuauggugaagaguacggcaaccuaacucggccggauaucaccuucacauauuuucagccuaagcccagacaagccuggguaugggcugcagucagggggccauguuccgugucaugcggagccggccuccgauggguuaauuacagcugucuggaccaggcucggaaagaacuuguggagaccguccagugccaggggucucaacagcccccugccuggccagaggcaugcguguuggaacccuguccuccguauugggcgguaggagauuucggcccaugcuccgccaguuguggugggggacugcgcgagagacccgugaggugcguugaagcucagggcagccuccugaagacuuuaccuccagcccggugucgagccggugcucagcaacccgccgucgcacuggagacgugcaacccucagccgugucccgccagaugggaggugucugaaccauccucaugcacaagugcuggcggggcgggacuugccuuggagaacgaaaccugugugccuggcgcagacgggcucgaggcucccgucacugaaggaccaggcagcguugaugagaaacugccugcccccgagccaugcguggguaugucguguccgccuggguggggacaucuagacgccaccuccgcuggcgaaaaggcacccucuccaugggguagcauucgcacaggcgcccaggcggcucacguguggacccccgccgcagggucaugcaguguauccugcggaaggggccugauggagcuccguuuucuguguauggauucugcccuucgggucccugugcaggaagaguugugcgggcuggcuagcaagccaggauccagaagggaaguuugucaagcagugcccugcccugcccgcuggcaguacaaauuagcggcuuguucagucagcugcggccgaggugugguuagacggauacucuacugugccagggcacauggggaggacgauggagaggaaauccugcuugacacucagugccaaggccugccgcgcccagagccccaggaagccuguaguuuggagccuugucccccacguuggaaggugaugucucucggcccuugcuccgcuagcugcgggcugggaacagccagacggucgguagcaugcguccagcuagaccagggucaagauguggaaguggacgaggcugccugugcggcccuggucaggcccgaggcaucaguuccaugccucauugcugauuguacguaucgcuggcacgugggcaccuggauggaaugcucuguaaguuguggggacggaauccagcgaagacgggauacuugccugggcccucaggcccaggcuccggugcccgcagacuucugucaacaccuuccaaaaccugucacagugagggguugcugggccgggcccuguguuggacagggcaccccauccuuggugccucaugaggaagccgcugcgcccggccgcacaacugcaaccccggccggggcuagccuggaguggucucaggccagaggauuacucuuuagcccagcaccucagcccaggcggcugcuuccagguccccaagaaaauuccguccagucaagugccugcggccgucagcaccuggaaccuacggggaccauagauaugcgcggaccgggccaggcugacugugcgguggccauuggucgaccccuaggggagguugugacacucagaguccuggaaagcucuuugaacugcuccgcaggagauaugcuguuacucuggggcaggcugacuuggcggaagaugugccgcaaacuucuggacaugaccuucucaaguaagacaaauacuuugguagugagacaaagguguggccggccagggggagguguucuccugcgauacggcagccagcuagcuccugagaccuuuuauagagaaugcgauaugcagcuguucgggcccuggggagagaucguguccccuucucuuucgccagccacgagcaacgcaggcgguugucgccucuuuaucaaugucgcaccccaugcuaggauugccauccacgcgcuggcaacaaacaugggggccggaaccgagggcgcuaaugccucauacauuuugauacgggacacucauucccugcguacaaccgcuuuccacggccaacagguguuauauugggaaagugagucuagccaggcagaaauggaguucuccgaaggguuucucaaagcccaggcuucacugagaggacaauacuggacucuucagucuuggguaccugagaugcaggauccacagagcuggaaggguaaggagggcaccuga

SEQ ID NO: 52438 - RNA, 3672 nt, Artificial Sequence
  derived and/or modified sequence opt3 from ADAMTS14__Homo_sapiens__NP_542453
auggcuccccugagagcccuccuuagcuaccuguugccuuuacacugcgcacugugugccgcggcuggcuccaggaccccagagcuacaucucucugggaagcugucagacuauggagugacagucccgugcaguacugauuuccggggucgcuuucuuagccacguuguguccggccccgccgcagccucugcugggucgaugguaguggacacgccuccaacccugccccgacauucaagccacuugcgugucgcaagaaguccucuccauccaggaggcacacuguggcccgguaggguggggcggcacucccuguacuucaacguuacuguguuuggaaaagaacuccacuuacgccugagaccuaauaggcggcuugucgugccaggcucuagcguagaguggcaggaagauuuccgcgaguuguuucgacaaccgcugagacaggaauguguuuauaccggcggggugacaggaaugcccggugccgcugucgccaucuccaacugcgacggccuagcggggcucauuaggaccgauucaacugacuucuuuauagagccucuggagcggggacagcaggaaaaggaggcaaguggccguacacaugugguguaccgcagagaagccguccaacaggagugggcugagccagauggugaccuucacaaugaagccuucgggcugggagauuugcccaaccuccugggcuuaguuggcgaccagcugggggauaccgagaggaaacggcgacaugcaaagccuggaagcuauucuaucgaagugcuccuuguaguggacgauuccgucgugcgcuuucacgguaaagagcacguucagaauuacgugcugacguugaugaacauugucgacgaaaucuaucaugacgagucacuaggcgugcacauuaauaucgcucugguaagacucauaaugguuggguacaggcaaagccugagucuuaucgagcggggaaacccaucucgcucccuggaacagguguguagaugggcccauagccagcagaggcaagaucccucgcacgcggagcaucacgaccacgucguguucuugacucgucaggauuuuggcccgucugguuacgccccugucaccgggaugugccauccccuccgguccugugcacugaaucacgaagacggcuucucaagugcuuuugugauugcccaugagacaggacacguuuuaggcauggaacacgaugggcagggaaacgguugcgcugacgagacuagccugggcuccgugauggccccucuaguacaagcagccuuccaucgauuccacuggucuagauguagcaagcucgagcugucaagguaucuuccaaguuacgauugcuugcuggacgaucccuuugacccagcuuggccccagccuccagaacucccggggaucaauuauuccauggaugagcagugucgcuucgacuuuggaagcggcuaccagaccugccuggcguuccggacauuugaacccugcaagcaacuuugguguucucauccugacaacccauauuucugcaaaaccaagaaaggucccccucuggaugggacggagugugcaccaggcaaguggugcuuuaaaggacacuguauuuggaagucacccgaacagacuuacggccaggacgggggauggaguagcuggacaaaguucgguuccugcucuagaucguguggcgggggagucaggagccgcucccgaucaugcaauaacccgaguccugccuauggcggucgguugugucucgggccaauguuugaguaccaggugugcaauucugaggaaugucccggcaccuacgaggauuuccgugcucaacagugcgccaaaagaaacagcuauuacguucaucagaacgcaaagcacuccugggugccuuaugaacccgacgaugacgcccagaaaugcgagcugaucugucaaucagcugauacuggagacgucguguuuaugaaucagguagugcacgauggcacaaggugcagcuaccgcgacccauauucuguuugugcccggggagagugcgucccugugggaugugauaaggaagugggcuccaugaaagcagacgauaagugcggugucugugggggagacaacagucauugcagaaccguuaaaggcacguuagguaaggcgagcaagcaggcuggcgcccugaagcuagugcagauacccgcaggggccaggcacauucaaaucgaggcucucgaaaaaucuccacaucgaauuguggugaaaaaucaggucaccggauccuucauccugaacccgaagggcaaagaggccacaucacgcacuuuuaccgcaauggggcuugaaugggaggacgcuguggaggaugccaaggaaaguuugaagacaagcggaccucugcccgaggcgaucgccauucucgcucugccacccacugaaggcgguccucggucguccuuagcauacaaauauguuauacacgaggaccugcuuccauugaucgggucuaauaacgugcuccuggaagagauggauaccuacgagugggcccuaaagagcugggcucccuguucaaaagccugcggaggcgguauucaguucacaaaguacggcuguagaaggcgucgcgaccaucacaugguccaacggcaccugugcgaucauaaaaagagaccuaagccgaucaggcgacggugcaaucagcacccauguagucagcccguguggguuaccgaagaguggggagcaugcucccgcucuuguggaaaacucggcgugcagacuagagggauacaaugccugcuuccuuugagcaacggaacgcauaagguaaugccagcgaaagccugugcuggcgacaggcccgaagcccggcgaccuugccugagagucccgugucccgcacaguggcgcuuaggugcuuggucccagugcucagccacauguggggaggggauucagcaaaggcagguagugugccguaccaaugcaaacagccucggccacugugaaggugaucggccagacacuguccagguuugcagucugccugccugcggcgggaaucaccagaacucuaccgugagagcugauguaugggagcuuggaacacccgagggccaaugggugccacaguccgaaccucugcaucccaucaauaagaucagcucgaccgagccauguacuggggacaggucagucuucugccagauggaaguguuggaucgcuauuguucuauuccgggauaccaccgacucugcuguguuaguugcaucaaaaaggcguccggcccuaaccccgguccagaccccgggccuacaagccugccacccuuuucuacgccuggaagcccgcuaccaggcccccaagauccugccgacgcagcugagcccccaggcaagccuaccggguccgaggaccaucagcacgggagagccacucagcugcccggugcccucgauacaucaaguccaggcacccagcauccuuucgcuccggaaacacccauuccaggggcaagcuggucuauauccccuacuacccccggaggccugccaugggguuggacgcaaaccccuacacccgugccggaggacaaagggcagccaggagaagaucuucggcacccuggcacuucauugcccgccgcgaguccagucaccuga

SEQ ID NO: 52439 - RNA, 2853 nt, Artificial Sequence
  derived and/or modified sequence opt3 from ADAMTS15__Homo_sapiens__NP_620686
augcugcuccuuggcauccugaccuuggccuucgcugggagaacagcaggagguagcgagcccgaaagggagguggucguuccuauucgguuagacccagauauaaacggccgccgauacuauuggcgugggccggaagacuccggagaucagggccugaucuuucaaauuacugccuuccaggaggacuuuuaccuacaccucacgcccgaugcgcaguuccuggcuccugccuuuucuaccgaacaucuuggugugccacugcagggguugacaggaggcucaagugaccucagaaggugcuucuauagcggcgauguaaaugcagagcccgacuccuuugccgcugugucucugugugggggacugcggggugcauucggcuaccgcggggccgaguaugucaucucgccucucccaaacgcuucagcccccgcggcacaaagaaauagccagggagcccacuuacugcagaggcggggcgugccuggugggccaaguggagauccgacuucccgcugcggcguugcuucuggcuggaaccccgccauucuucgagcauuggacccuuacaagccaagaagggcuggguuuggagaaagccggucccgucgcagaucagguagggccaaacgguucgugaguaucccccgauaugucgagacccuggugguagcggaugaaagcaugguuaaguuucauggcgccgaccuagagcacuaccuccugacacuucuggcaaccgcugcccgcuuguacagacauccuucuauacucaauccaaucaacauuguggucgugaaagugcuguuacugagggaucgggacuccgggcccaaggucacuggaaaugcugcccucacacuucgcaacuucugugcauggcagaaaaagcugaauaagguuucagacaaacacccggaguauugggauaccgccaucuuguuuacgagacaagaccuaugcggcgcuacuaccugugauacacuggguauggcggacguggggacuaugugcgauccuaagaggagcuguaguguaauugaagacgauggccuccccucugcauucaccacagcccacgagcugggacauguguucaacaugccacacgacaaugucaaagugugcgaagagguuuuuggcaaacuucgugcuaaccauaugauguccccuacccugauccagauagaucgggccaaucccuggagcgcauguucggccgcuauuaucacggacuucuuggauucugggcacggagacugccuccuggaccagccauccaagcccauuucauuaccugaagaucugccaggugccaguuacacucuaagccagcaaugugagcucgcauuuggcgugggguccaagccgugccccuauaugcaguacugcacaaagcugugguguaccggaaaagcgaagggccagauggucugccaaacucgacacuucccuugggcugacgguacaucuuguggggagggcaaacuuugcuugaagggagccuguguggaaagacauaaccugaauaaacacaggguagauggcagcugggcaaagugggacccauaugggcccugcucacgcaccuguggagguggcguucagcucgcccggagacagugcacgaacccuaccccagcuaacgggggaaaauacugugagggcgugagggucaaguaucgcaguugcaaucuggaacccuguccguccagcgccucugguaagucauuucgagaggaacagugcgaggcauucaacggguacaaucauaguacaaaccggcuuacucuggcuguggccugggucccuaaauacagcggcguguccccacgugauaagugcaaauugaucuguagagcgaauggaaccggcuauuuuuacguucucgcccccaaggugguagacgggacacugugcucuccugauucgacuagcgucugugugcaaggaaaaugcaucaaggcuggcugugacgguaacuuaggguccaagaaaagguucgauaagugcggaguuuguggcggugacaauaaaucaugcaagaaagugaccggccuguuuacaaagcccaugcacggguauaacuucgucguggcaauuccagccggagcuaguucuauagauauccgccagcggggcuacaaggggcuaauuggagacgauaauuaucucgcccugaaaaacagccagggcaaguaccuuuugaauggucauuuuguaguguccgcaguugagagagaccuggucgugaaagggucacuccugagguauagcggaaccggcacugcgguggaaucuuuacaggccucccgaccuauccuggagccccuuacggucgaaguuuugaguguggguaagaugacaccaccgcgcgugcgguacagcuucuaccucccuaaagagcccagagaagacaagucuucccacccaaaggaucccaggggcccuucaguacugcacaacaguguccuaagccugucgaaucaaguggagcagccagacgaucgucccccugcucgcuggguugccggguccuggggaccguguucugcaagcugcggcucagggcuccagaaacgggcuguggacuguagaggaagugccggccagaggaccgucccagcaugcgaugccgcucaucgacccguggagacucaagcgugcggugaaccuuguccaaccugggagcuguccgccuggucucccugcagcaaguccugugggcggggauuucagcgcagaucacuuaaaugcguuggccacgguggcagguugcuggcacgggaccaguguaacuuacaucgaaagccucaggaacucgauuucugcgugcugagaccguguuga

SEQ ID NO: 52440 - RNA, 3675 nt, Artificial Sequence
  derived and/or modified sequence opt3 from ADAMTS16__Homo_sapiens__NP_620687
augaagcccagagccaggggcuggcgggggcuggcugcacucuggaugcuucuggcccagguggcggagcaagcuccugccugcgcaaugggaccagccgcugcagccccggguagccccuccgucccucgcccacccccuccagcugaacgacccggcuggauggagaaaggggaauacgacuugguuucugccuaugagguggaucaccguggagacuacguaucacaugaaaucaugcaccaucagagaaggcggcgcgcggugccugucagugagguggagagcuuacaccugagacuaaagggcuccaggcaugauuuccacauggaccuccggaccucuucgucacugguugcaccagguuuuauugugcagacacuugggaaaacuggaaccaagagcguccagacccugccgcccgaagauuucuguuuuuaucaaggcaguuugcgcucccaccgaaacucuagcguggcccucuccacaugccagggccugucagggaugauaagaacugaggaagcugacuacuuccugaggccucucccaagucauuuaagcuggaaacugggacgggccgcacaggguucuucccccucacacguacuuuauaagcguagcaccgagccucaugcuccaggcgccagugagguuuuggugacaucucgcaccugggaacuggcgcaccagccccuacacuccagcgaucucagacuggggcuuccgcaaaagcagcauuuuuguggaaggcggaaaaaguacaugccucagcccccaaaagaggaccuguucaucuugccugaugaauauaagucgugccuccgacacaaacgcucucuguuaagaucccauaggaaugaggaacugaacgucgagacucucgugguggucgacaagaagaugaugcagaaucacggccaugagaacauuacaaccuacguucuuacgauccugaauauggugucagccuuguuuaaagaugguacuauugggggaaacaucaauauagcaaucguaggccuaauucugcucgaagacgagcaacccggccuggugaucagucaccacgcugaucauacccuuagcuccuucugucaguggcagucugggcugaugggaaaggacgguacacggcacgaccaugccauuuugcucacuggccuggauaucugcagcuggaaaaacgaaccaugugacaccuuaggguuugcucccauaucaggaaugugcaguaaguaccgcuccuguacaauuaaugaggauaccggccugggucuagccuucacgaucgcacacgaaagcgggcacaacuuuggcaugauucaugacggagagggcaauaugugcaaaaagucugaggggaacaucaugucaccuacucucgccggaagaaauggugucuucaguuggagcccauguuccaggcaauaucugcacaaauuucuuucuacagcucaggcgaucugcuuggcagaucagccgaagcccgugaaggaauacaaauauccugagaagcugccaggcgaacucuacgacgccaacacccagugcaaauggcaauucggggagaaggcuaaacuguguaugcuugauuucaagaaggacauuugcaaagcccuguggugucaucguauaggacggaagugcgaaacuaaauuuaugcccgcagccgagggcacaaucuguggucacgauauguggugccgagggggccaguguguuaaguauggagacgagggcccuaaaccaacccaugggcacuggucggauuggagcuccuggucacccugcaguagaacguguggagguggcgugucucacaggagccgcuugugcaccaauccgaagccuucccaugggggaaaguucugugaaggcucaacacggacucucaaacugugcaacagccagaagugcccaagagacucugucgacuuuagggcugcccagugugcagagcacaacucccgccgauuccggggucgucauuacaaauggaagcccuauacccaaguggaagaucaggacuuaugcaaacuguacuguauugcggagggguuugauuucuuuuucagucuaagcaauaagguaaaggacggcacaccuugcucugaggauuccagaaacguuuguaucgacggaauaugcgaaagggugggcugugauaauguccucgggucagacgcuguggaggaugucugcggaguguguaacggcaauaacagugccugcacuauucaccgcggucuguacaccaaacaucaccacacaaaucaguauuaccauaugguuaccauccccagcggggcacggucgaucagaauuuaugaaaugaacguguccacuucuuacaucagcguaaggaaugcccuucgacgcuauuacuugaacggacacuggacggucgacuggccaggccgguauaaguuuucagguacaaccuucgauuacagaaggaguuacaaugagccugaaaaccugauugcuacuggccccaccaaugagacacucauaguggagcuguuauuucaggggcguaacccaggaguugccugggaauauuccaugccgcgccugggcaccgagaaacaaccucccgcacagccaucuuacacuugggcuaucgugcggagcgaauguuccgucucaugcgggggaggccagaugacagugagagaggguugcuauagggaccuuaaguuccagguaaauaugagcuuuuguaaccccaaaacgcgaccugugaccggguugguuccaugcaaggucagugccugucccccuucuugguccgugggaaacuggagcgcgugcucgcggacuuguggcgguggcgcccaaucacgcccggugcagugcacaagaaggguccauuacgauucugaaccaguucccgcuagucucuguccucagccagcacccuccagccggcaagccugcaauucucagagcuguccuccggcuugguccgccgggcccugggcagagugcucacacaccuguggaaaaggcuggcgaaagagagcgguggccugcaagaguacaaacccaagcgcucgcgcccagcugcuaccugacgcagugugcacuucugagcccaaaccaaggaugcacgaggcuugucugcuccagcguugccauaagccuaaaaagcugcaauggcuuguauccgccuggucacaguguagugucacgugcgaacgggggacgcagaaaagauucuugaagugugcagaaaaguaugugagcggaaaauacagggagcuggccuccaagaaaugcucucacuuacccaagccaucgcucgaacuggagcgcgcuugugcgccgcuuccuugcccccgacauccacccuucgccgcagcuggcccuagcagagguucaugguuugccuccccauggagucaguguaccgccucuugcgggggaggcguucaaacacggagcgugcagugucuggcugguggcaggcccgcauccgggugcuugcuccaccagaaaccuucagccucucuggcgugcaauacucauuucuguccgauugcugagaagaaggacgccuuuugcaaagauuauuuccacugguguuaccuagucccacagcacggaaugugcagccauaaguuuuacggcaaacaauguugcaagaccuguaguaaauccaaccuguga

SEQ ID NO: 52441 - RNA, 3288 nt, Artificial Sequence
  derived and/or modified sequence opt3 from ADAMTS17__Homo_sapiens__NP_620688
augugcgacggcgcccugcuucccccucucgugcugccagucuuguuacugcuaguuugggggcucgauccgggaaccgcugugggugacgcagccgcggauguagaagugguccugcccuggagagugaggccugacgauguucaccuuccaccccugccugcugccccaggcccccggcgccgacguagaccuaggacaccaccggcagcccccagagcucgcccuggggaaagagcauugcuccugcaucugccagccuucggaagggaccucuacuuacagcugcggcgcgaucuucgauuuuugagcagaggcuucgagguggaagaggcuggugccgcgaggcggcgugggcgccccgcagaacuguguuuuuauuccggaagaguccuaggccacccuggcucucucgugucacugagugccugcggggcugccggaggucuuguaggccugauccaauuggggcaggagcagguucucauucagccacugaacaauagccaaggacccuucuccggcagggagcauuuaauacggcgaaaguggucucugacuccgucgccuucagcagaagcucagcgccccgagcagcucuguaaagugcuuacggaaaagaaaaagccaaccugggguagaccuagcagggacuggcgggagcgcagaaacgccaucaggcugacaagugagcacacugucgaaaccuuggugguggcggaugccgacaugguccaguaccauggggcagaggcugcccaacguuuuauucuaacaguuaugaauaugguguauaacauguuccagcaccagucccugggaaucaaaauuaauauccagguaaccaagcucgugcugcuucggcaacgacccgcuaagcugucuauaggccaccauggcgaacggagcuuggaguccuuuugccacuggcagaacgaagaguacgggggagccagguaucucgguaauaaccaggucccaggcgggaaagaugaucccccucugguggacgcagccguuuucgugacucgcacagacuuuuguguccauaaggacgagccaugcgauaccgugggaaucgcuuacuuaggcgguguauguucagcgaaacggaagugcguucuggcagaagacaaugggcuaaaccucgccuucacgauugcucacgagcugggccacaaucuuggaaugaaccaugaugacgaucacaguagcugugccggcagaucucauaucauguccggggaaugggugaaaggaaggaauccgucagacuugagcuggaguucuugcucccgcgaugaccuggagaacuuucucaagagcaaggucucgacuugucugcuugugaccgauccccgaucucaacacacaguccggcugccucauaaauugccagguaugcacuauuccgcaaaugaacagugccagauucucuucggcaugaacgccacuuuuugccguaacauggagcaccugaugugugcuggguuauggugccugguggagggagacaccucauguaagacaaaacuagaucccccucucgacggcaccgaaugcggugccgacaagugguguagagcaggggagugcguuaguaaaacgccaauccccgaacauguggauggcgacuggagcccguggggagcgugguccauguguucuaggacuugcggcacaggggcucgcuuccggcagagaaagugugauaauccuccacccggaccugguggcacccacugccccggggccagcguagagcaugcagucugugaaaaccugccaugcccuaaaggacuucccucauucagggaccaacagugccaggcccacgaucgauugaguccaaagaagaaaggccugcucacugcugugguuguggacgauaagccgugugagcuguacugcuccccuuuagguaaagagagcccccugcuugucgccgaccgcguguuggaugggacaccauguggccccuacgaaaccgaccucugcguacacggaaagugucagaaaauaggcugcgaugggauuaucggaucugcagcuaaggaggaccgguguggcgugugcucaggugaugggaagacgugucaucugguuaaaggagacuuuagucacgccagaggcaccgcgcuaaaggacagcgguaaaggcuccauuaauucugauuggaagaucgaacugccuggggaguuccaaaucgccggaacaacugucagguaugugcgucgcggccucugggagaaaauuucggcuaaggggccaaccaagcugccccuucauuugauggugcuguuauuucacgaccaggauuacggaauacauuaugaauacacagucccuguuaaccggacugcagagaaucagagcgaaccggagaaaccacaggacucccucuucaucuggacccacucaggcugggaagguugcagugugcaaugugggggaggcgagagaaggacaauugugucuugcacccgaaucguaaacaagacuacgacacuggucaaugauagcgacugcccccaggccucccggccugagccacaggugcgcagauguaaccuucaccccugccagucaagguggguugcugguccuuggagcccguguucugcaaccugcgaaaaaggcuuucaacaucgggaggugacuugugucuaucagcugcagaaugggacccacguggccacacgacccuuguacugcccaggaccuagacccgcggccguucaauccugugaaggccaggauugccucaguauaugggaggcuagcgaauggucucaguguuccgccucaugcgggaagggaguguggaaacgcaccguagcauguacuaacagucagggcaagugcgacgcuagcacaaggccacgugccgaggaggcaugcgaagauuauucggguuguuacgaguggaagacgggggacuggucuaccugcuccagcacuuguggaaaaggccugcaaucacgggucgugcagugcaugcauaaggugacagguagacacggcagugaauguccugcccuauccaaacccgcuccauacaggcagugcuaucaggaggucuguaaugaucgcauuaacgcgaauaccaucacaucuccgcgacuggccgcacucacuuacaagugcaccagagaccaauggacgguuuauugucgggugaucagggagaaaaaccugugccaggauaugcgcugguaccagcguuguugccagaccugcagagacuucuaugcuaauaagaugcggcaaccucccccaaacagcuga

SEQ ID NO: 52442 - RNA, 3666 nt, Artificial Sequence
  derived and/or modified sequence opt3 from ADAMTS18__Homo_sapiens__NP_955387
auggagugcgcccugcuccuugcuugugcauuccccgccgcgggcagcgggccuccaagaggacuggcugguuugggcaggguggccaaggcauuacagcugugcugucuaugcugugccuccgucgcugcagcccucgcuucugacucaaguagcggggccuccggacugaacgaugacuacguuuuugugaccccgguagaaguggauucugcgggcucguauaucucacacgacauucuucauaauggucggaaaaagcgcagcgcacaaaacgcccgaaguucccugcacuaccguuucucugcuuuugggcaggaguugcaucucgaacugaaacccagcgccauacuguccucacacuucaucguccaggugcucggaaaggauggcgcaagugagacacagaaaccugaaguucaacagugcuuuuaucagggcuucauuagaaaugacagcagcuccucaguggcugucagcacuugugccggguuaaguggacugaucaggacgcggaagaacgaguuucuuauuucuccauugccccagcugcuagcgcaagagcauaauuacuccagcccugccggucaccacccacaugugcucuauaagcgcaccgcagaagagaaaauccagagauacaggggcuaucccgggucgggacggaacuacccuggcuacucuccaucccacauaccgcaugcuucacagagucgcgaaacagaguaucaccaccgaagacugcagaagcaacauuucugcgguaggcggaaaaaguacgcccccaaaccuccaacugaggauaccuaucuucguuuugacgaauacgggagcuccggacgccccagaaggucugcuggcaagagccagaagggccugaauguagagacauugguuguggccgauaaaaagauggucgaaaaacacgggaagggaaacgugaccacuuauauccucacagugaugaauauggucucaggucuguucaaagacggcaccauugggagugauaucaacguugugguaguguccuuaauucugcucgagcaggaaccuggaggccuucugaucaaucaucacgcagaccaaagccuuaacucuuuuugucaguggcagucagcccuaauagguaagaaugggaaacggcaugaucacgcuauucugcucacgggcuucgacaucugcaguuggaagaacgagccaugugacacucugggauuugcgcccauuagcggcaugugcuccaaguaccgaucuugcaccaucaaugaggauacagggcuuggacuggcauucacuaucgcccacgaaucgggucauaacuucggcaugauucacgacggggagggaaacccgugucgcaaagcugaaggcaauauaaugagcccuaccuugacagguaacaauggggucuuuuccuggucaaguugcucuagacaguaucucaagaaauuccugagcacgccccaagccggcuguuuaguggaugagccaaagcaggcaggacaguacaaauacccugacaagcugcccggccagaucuaugaugccgacacccaaugcaaguggcaguuuggggcuaaagccaagcuauguucccucggauucguuaaagauauuugcaagucacuguggugucauagggugggucaccggugcgaaacuaaauuuaugccagcagcggagggcacagucugugggcuuagcauguggugccgccagggacagugugugaaguucggcgaguugggucccagaccuauccacgggcaauggucugcuugguccaaguggagugaaugcagcaggaccugcggcggaggcguaaaauuucaggagcgucauuguaacaauccaaagccgcaguacgggggacuguucugccccgguucuucccggauauaucagcucuguaacauuaauccuugcaacgaaaauucacuggacuuucgagcccaacagugugcagaguacaacaguaaaccauucagaggcugguuuuaucaguggaagcccuacacuaaaguugaagaggaggauaggugcaaguuguauuguaaggccgaaaauuucgaguuuuucuucgcuaugagcgggaaagugaaggacggaacaccuugcucgccaaacaaaaaugaugucuguaucgacggcgugugcgaacuggucgguugugaccacgaguugggcuccaaggccgugucugaugcaugcgggguuugcaaaggagacaacagcaccuguaaguuuuacaaaggccucuaccugaaucaacauaaggcuaacgaguauuaccccgugguauuaaucccggccggggcgcgcucaauugaaauccaggagcugcaggucaguuccucuuaucuagccgugcggagccucucccagaaguacuaucugacgggaggcuggucaauugauuggccuggugaauuuccauuugcugggaccacauucgaguaccaaagaucuuuuaacaggcccgaacgccuuuaugcaccuggacccacuaaugagaccuugguuuucgagauacugaugcagggcaaaaacccagguaucgccuggaaguacgcucucccuaaagugaugaauggcacacccccagccacuaagcgaccggcauacaccuggaguauuguccagucugaaugcuccgugagcugugggggaggcuauaucaacguaaaagcgaucugccugcgggaccagaauacacaagugaacucgucauuuuguucugccaagaccaagccuguuacugagcccaaaauuugcaaugcuuucaguuguccagccuacuggaugcccggggaaugguccacgugcagcaaggcaugugcuggaggccagcagucucguaaaauacagugcguccaaaagaaaccuuuucagaaggaggaagccguguuacacagccuguguccaguguccacacccacccagguccaagcaugcaacucacaugccugcccuccgcaguggagucuugguccauggagccaguguucuaagacuugcgggagaggaguuaggaaacgcgaguugcucuguaagggcuccgcugcggagacccugcccgaaucacagugcacaagucuaccucggccagagcugcaagaagguugugugcucggcagaugccccaaaaauagcaggcugcaguggguggccuccucuuggucggaguguagcgcaaccugcgggcuuggaguacgaaagcgcgaaaugaaauguucagagaagggcuuccaggggaaguugaucacuuuuccugagcggagaugcaggaacauuaaaaagccgaaucuggauuuagaagagacauguaaccgucgcgcuugccccgcccacccagucuauaauaugguggccggaugguacucccucccuuggcagcaaugcacgguuaccuguggcgguggggugcagacucggaguguccacugcgugcagcagggaagacccucuagcuccugucugcuucaucaaaaaccaccuguucugagggcuugcaacacaaauuucugucccgcaccagaaaagcgagaggacccgucaugcguggauuucuucaacuggugucacuugguaccucagcauggcgucugcaaccacaaauucuauggcaagcaguguugcaaaucuuguacccggaagaucuga

SEQ ID NO: 52443 - RNA, 3624 nt, Artificial Sequence
  derived and/or modified sequence opt3 from ADAMTS19__Homo_sapiens__NP_598377
augagacugacccacaucugcuguugcugucuccuuuaccagcugggcuucuugagcaacgggauuguguccgaguuacaauuugcccccgacagggaagagugggaagucguuuucccugcucuguggcggcgcgagccaguggauccggcaggagguucuggcgggucagccgaccccggauggguacgaggcgugggugggggaggcagugcgcgugcucaggccgcaggcagcuccagagaagucaggucuguggccccuguuccacuagaggagcccguggaagggcggucggagucacgccucagaccuccacccccuagcgaaggagaggaggaugaggaacuggaaagucaggagcuuccaagggguuccucuggcgcugcagcccugagcccgggggcucccgccuccuggcagccuccacccccuccacaacccccgccuucacccccuccagcgcagcaugcagaacccgacggagaugaggucuugcuccggauaccagccuuuagucgcgaccuguaucugcucuuacgaagagauggcagguuccuggcuccccgguuugccguggagcagcguccuaauccagguccggggcccacaggagcagcuagcgccccucagccacccgcgccuccagacgccggcugcuucuacacuggcgcaguacuucgccaccccgggucuuuggcuuccuuuucaacguguggagguggccugaugggguucauccaacuaaacgaagauuuuauuuucaucgagccgcucaaugacaccauggccauuacaggacauccucacagaguuuauaggcagaagcggagcauggaagagaaagugacugaaaagagugcucugcauucucacuacugcggcaucauauccgauaaaggucgaccacgcagcagaaagaucgccgagucggggaggggcaaacgguauucuuacaaacuuccccaggaguauaacauugaaaccgucgugguggcagacccugccauggucuccuaccacggagcugaugcggcacgcagauuuauccugacaauuuugaauaugguuuucaaccucuuucagcauaagucacugagugugcaaguaaauuuaagggugaucaaacugauacuccuucacgagacucccccagaacuguacauuggccaucacggggagaagauguuggaaucauucuguaaauggcagcacgaggaguucggaaagaaaaacgacauccaucuagaaauguccaccaauuggggugaggacaugacaucugucgaugccgcuauucugaucacccguaaggacuuuugcgugcacaaggaugaaccuugugacacgguuggcaucgccuaucucagcgggaugugcucagagaaacggaaguguauuauagcagaggauaacggacugaaucuugccuucacuaucgcucaugaaaugggccacaacauggguauuaaucaugacaacgaucaccccaguugcgccgacgggcugcacaucauguccggcgaguggauaaaaggacagaauuugggcgaugugagcuggucucgaugcucaaaggaagaccucgagagauuucugaggaguaaagcaagcaacuguuuacugcaaaccaacccacaguccgucaauucugugaugguaccgucgaagcuaccugggaugacauacacugcggaugaacagugccagauucucuucggaccccuggcuagcuuuugucaagagaugcagcauguuaucugcaccggucuuugguguaaaguggagggcgaaaaggagugccgcacaaaguuggacccacccauggacgggaccgauugugaccugggaaaauggugcaaggccggcgaauguacgucccggacuucagcaccugagcaccucgccggugaauggagucuguggucuccaugcagcagaacauguuccgcugggaucucaagcagggagcgcaaaugccccggccuugauucugaggcccgagacugcaacggaccucggaagcaguaucguauuugugaaaauccgccaugccccgcaggccugccuggguucagagauuggcagugucaggcuuacuccgucaggaccaguagcccaaaacauaucuugcaauggcaggccgugcucgacgaggaaaagcccugcgcgcuguuuuguucuccugucggaaaggagcagccgauuuuacuguccgaaaaagugauggauggcacuucaugcgguuaucaagggcuagacauaugugccaacggacgcugccagaagguuggcugugauggucuccugggcagucuugcucgggaggaccacugcgggguguguaauggaaacggcaaaagcugcaagaucauuaaaggggauuucaaucacacaagaggagcaggcuacguagaggucuuggugauccccgccggugcuaggcgaaucaagguuguggaagagaagccagcccauucguaucuggcacuccgcgacgcggggaaacaguccauuaacucugauuggaagauagaacacagcggagccuuuaaucuggcuggcaccacgguccauuacgugcggagagguuuaugggagaaaaucucagccaagggcccuaccacagcaccccugcaccuuuugguacuccuguuccaggaccaaaacuacgggcuacauuaugaguacacuauuccaagugacccucugcccgaaaaucaguccucuaaagcuccagagccgcucuuuauguggacccacacaagcugggaagauugcgacgccacuuguggaggcggggagaggaagaccacaguguccugcaccaagaucaugagcaaaaacauuagcaucguugauaaugaaaaguguaaauaucugacuaagccugagccccagauacguaaaugcaacgagcaaccaugucagacgcgcuggaugaugacagaauggacccccugcagucggacuuguggaaagggcaugcagucuagacaggucgcaugcacccaacagcuuuccaaugguacauugaucagggcccgagagcgggacuguauugggccuaaaccagcuagcgcgcagcgcugcgaaggacaggauuguaugaccgugugggaggccggcguguggucggaaugcucagucaagugcgguaagggcaucagacacaggacuguucgguguacaaacccccgaaagaagugcgugcugucuacgagaccucgcgaggcagaggacugugaagauuacaguaaaugcuauguguggaggaugggggacugguccaaguguagcauuaccugcggaaaaggcaugcaaucucguguaauccaguguaugcauaagauaacugggcggcacggaaacgagugcuucagcuccgaaaagccggcugccuacagaccaugucauuuacagcccugcaaugagaaaauuaacgucaauacaaucaccucaccuaggcucgccgcucugacauuuaagugucuuggcgaucaguggcccguguauugccgcguuauucgagagaaaaaccugugccaagacaugagaugguaccagcgguguugcgaaacuuguagggauuucuacgcacagaaguugcaacagaaaaguuga

SEQ ID NO: 52444 - RNA, 2904 nt, Artificial Sequence
  derived and/or modified sequence opt3 from ADAMTS1__Homo_sapiens__NP_008919
augcagagagccgugcccgagggcuucgggaggcggaagcugggaagcgacauggguaacgcugaacgcgcaccuggcucccgaucuuuugggccagucccgacccuccuucuguuggccgcggcuuuacuggccguuucagaugcacuaggacgucccagugaggaagacgaggaacucgugguaccugagcuggagagagccccaggccacgguacaacuaggcuucggcugcaugcuuucgaucaacaguuggaccucgaacugcgccccgauagcuccuuucuggcaccuggguucacgcuccagaaugugggaagaaaaucuggcucggagaccccauuacccgaaacagaccuggcccacugcuuuuacucaggcacugucaacggggauccuagcagugcugccgcgcuuuccuugugugagggagugaggggugcauucuaucugcuaggcgaggccuacuuuauccagccacucccggcugccucugaacggcuggcaaccgcugcccccggggagaagccuccagcgccccuucaauuccaucuguugcgccgaaauagacagggagacguuggcgguacaugcgggguggucgaugacgaaccuaggccaaccggaaaagccgagacugaagaugaggacgagggcacagaaggcgaggaugaaggggcacaguggagcccccaggacccggcucuccaaggagugggucagccuaccggcacgggguccauucggaagaaacguuuuguaucaagucaccgcuauguugagacuaugcugguggccgaccagagcauggcugaauuucauggaucuggcuuaaagcacuaccugcucacccuuuucuccgucgccgcaagacuguauaagcaccccucaauaaggaacagcgugaguuugguggucguuaaaauccuagugauucaugaugagcagaaggguccagagguaacaucuaaugccgcucugacucuccggaacuucuguaauuggcaaaaacagcacaacccucccuccgaccgagaugcggaacauuacgacaccgcaauccuguuuacacgccaggaucuuugcgggagccaaaccugugacacgcugggcauggccgaugugggaacugucugcgacccaucgagaucuuguuccgugauugaggaugacggcuugcaggcugccuucacaaccgcacacgaacucgggcacguuuucaauaugccccaugaugacgccaagcagugcgcuucacugaacggagugaaucaggacagucacaugauggccagcauguuauccaaccuggaucauucucaaccuuggagcccauguucagcauauaugaucacuagcuuucuagacaauggucacggcgagugccucauggauaaaccgcagaaccccauacagcugccuggggaccuuccaggaacauccuacgaugcgaauaggcagugucaauucaccuuuggcgaagacagcaagcauugccccgaugcugccucuacgugcucaaccuugugguguacagguaccagugggggcguccuggugugccagacuaagcacuucccuugggcagacggaacaagcuguggcgaggggaaauggugcaucaacggaaaguguguaaacaaaacugaucggaagcacuuugacaccccauuccaugguuccuggggcaugugggggcccuggggagauugcucucgcacauguggcggugggguucaguacaccaugagagagugcgacaauccggugccuaaaaacggcggaaaguauugugaaggcaaaaggguccguuaccggucgugcaaucucgaggauuguccagacaacaaugggaagacuuuucgagaagaacagugcgaggcccacaacgaguucagcaaggcuuccuuuggaucaggccccgccguggaguggauuccuaaauaugcuggugucagucccaaggacagaugcaaacugaucugucaagcaaaggggauuggauacuucuuugugcuucagccaaaaguuguggauggcacgccuugcucucccgacagcacauccguauguguccagggucagugcgugaaggccggcugugauaggaucauagacucaaagaaaaaguucgauaaaugcgggguuuguggaggcaaugggaguaccugcaagaaaauuucuggauccgugaccagugcgaagccaggcuaucaugacaucauuacuaucccgacaggugccaccaacaucgaagucaagcaacgcaaucagcgggggagcagaaacaauggaucuuuucuggcuauuaaagcagccgauggcacuuacauauugaacggugacuauacacucuccacgcuggagcaggauaucauguacaagggcgugguauuaagguacucagggaguagcgcugcccuggaacgcauucgaucguucuccccucuaaaagagccccucaccauccaagugcugacuguuggaaaugcacuucggccaaagauaaaauauacauacuucgucaagaagaaaaaggagucuuuuaacgcgauucccaccuucagcgccugggugaucgaagaguggggcgaauguucaaaaaguugcgaguugggguggcagcguagacugguggaauguagggacaucaauggacagccugcuuccgagugcgccaaggaggucaaaccagcaucuacacgccccugcgcugaucacccuuguccgcaguggcaacucggcgaauggagcuccugcucaaagacuugugguaaaggguauaagaagcggagccugaaaugcuuaagucacgacggaggcguucugucucaugaguccugugauccacuuaagaaacccaagcacuuuauugacuucugcaccauggccgaauguagcuga

SEQ ID NO: 52445 - RNA, 5733 nt, Artificial Sequence
  derived and/or modified sequence opt3 from ADAMTS20__Homo_sapiens__NP_079279
auguggguggccaaguggcugaccggccuccuuuaccaccugagcuuguucaucacaagauccugggaggucgacuuucaucccaggcaggaagcuuuaguucggacucugacgucuuaugaggugguaauuccugaacgcgugaacgaguucggggaagucuuuccacaaucacaccauuucagucgacagaaacguagcuccgaggcacuagagccgaugcccuuuagaacccacuacagguucacagccuauggacagcucuuucagcugaaucuuacugcggaugcuucuuuccuggccgcagguuacaccgaagugcauuugggcacaccugagcggggggccugggaaucggacgcuggaccaucagaucuccgccacugcuuuuauagaggccaaguuaacagccaggaggacuacaaggcaguggucagucuguguggugggcugaccggaacuuucaaaggccagaauggcgaguauuuucucgaacccauaaugaaggccgaugggaacgaguacgaagacggacacaauaaaccucauuuaaucuacaggcaggaucugaacaauuccuuccuucaaacauugaaguauugcucugugagcgagucccagauuaaggaaaccucacugccauuucacacguacaguaacaugaaugaggaccuaaacguaaugaaagagcggguucucggucauacuagcaagaaugugccccugaaagaugaacgccgacacucuagaaagaaaaggcuuaucuccuauccucgguacauugagaucauggucaccgcugacgccaagguggugucagcgcacggcagcaaccugcagaauuauauauugacacucaugaguaucgucgcaacuauuuacaaggauccaucuaucgggaaccugauucauaucguugugguaaaauuagugaugauacaccgugaagaggaaggaccggucauuaauuucgacggcgccaccacacugaagaacuucuguuccuggcagcaaacccagaacgaucucgacgacgugcaucccagccaccaugauacggcuguucuuaucacucgcgaggacauuugcucgucuaaagagaaguguaauaugcuggguuuguccuaucuagggacaaucugcgauccucugcagucauguuuuaucaacgaagagaaaggacucauuagugccuucaccauagcacacgaacugggccacacucuuggcgugcaacaugacgauaauccaagaugcaaggagaugaaagucacaaaguaccacgugauggcucccgcccugagcuuucauauguccccuuggucuuggagcaacuguucaaggaaguacguaaccgaauucuuggacacgggguauggagagugccuccuggauaaaccagacgaggaaaucuacaauuuacccagugagcugccggguucccgguaugauggcaacaagcagugugaacuagcguuugggccuggaagccagaugugcccccacauuaauaucugcaugcaccucugguguaccucuacagagaaacugcauaagggcugcuucacucagcacguuccaccugccgacgguaccgauugugggcccggcaugcauugccgacacggacuuugugugaacaaagagacagaaacucgcccagucaauggcgagugggggcccugggaaccuuacucaaguugcagcagaaccuguggagguggcauagaguccgcaacaaggcggugcaaccgcccagaaccgagaaaugggggaaacuauugugugggcaggcguaugaaguuucggucuugcaauaccgacucgugucccaaggguacucaagacuuccgagagaaacagugcagcgauuuuaacgggaagcauuuggacauuuccggcaucccuucaaaugucagauggcugccaagguacaguggaaucggcacgaaagaucgcugcaagcucuauugucagguggcugggacaaacuacuucuaccugcuuaaagacaugguugaggauggaacccccugcgguacugaaacccacgacauuugugugcagggccaaugcauggccgcugggugugaucacguacugaacucuagcgccaagaucgacaagugcggagucuguggcggugauaauuccucaugcaaaacaauuaccgggguguuuaacagcucucauuauggcuacaauguuguggucaagauaccugcaggagccacuaacguggacauccggcaguauuccuacaguggccagccagaugacagcuauuuggcucucucugaugcggaggggaauuuccuguuuaacggaaauuucuuacuguccacaucaaaaaaggaaauuaacguacagggcacgagaaccgugaucgaguacagugguagcaauaacgcaguugaaaggaucaauucgacuaaccgccaagagaaagagcuaauucuccagguccuguguguggggaaucuuuauaaccccgacgugcacuacuccuucaauauaccguuggaagagcgaucugacauguuuacaugggauccuuacggaccaugggaaggcugcaccaagaugugucagggucugcagcggcguaacaucacaugcauucauaagagcgaccacucagucguuagugauaaagagugcgaccaucucccccugccuuccuucgugacucaaucuuguaacaccgauugcgaauuaagauggcacgugaucggcaagagcgaguguuccucacagugcgggcagggauauaggacgcuggacauucacuguaugaaauacagcauccaugagggccaaaccguacaggucgaugaccacuauugcggggaucagcuuaagcccccaacacaggaauugugucauggaaauugcguguuuacucgcuggcacuacagugaguggucucaauguucccggagcugcggcgguggggaaagaucgagggagucauauuguaugaacaauuucggacaccgacucgccgacaacgagugccaggaacugucucgcguuacccgggagaauugcaacgaauuuaguuguccuuccugggcugccagcgaguggucugaaugccuagugacauguggcaaagguacuaagcagagacaggucuggugccaacugaauguggaucaucucagcgacggcuucuguaacuccucaaccaaacccgagagucugagcccaugcgagcuucacacgugugcaucuuggcagguugggccguggggaccuugcacaaccacuuguggccauggguaccagaugagggaugugaagugcguaaaugaauuggccuccgcuguccuggaggacacagaaugucacgaggccucacgucccagugaccgccagagcugcguguuaaccccaugcuccuuuauaucuaagcucgaaacugcacugcuucccaccgugcugaucaaaaagauggcgcaauggcggcauggaucguggacaccuuguagcgucucaugcggcagagguacgcaggcuagguauguuuccugucgagaugccuuggaccggauugcagaugagaguuacugcgcccaccucccacgccccgcugagaucugggacuguuucaccccuugcggggaauggcaggccggagauuggucuccguguagcgcauccugcggccacgguaaaacuacaagacaagugcuguguaugaacuaccaucagccaauugacgagaauuauugcgaucccgaaguaaggccucuaauggagcaggaauguucacuggcugccugcccacccgcgcacucucauuuuccuagcaguccggugcagcccuccuacuaucucagcaccaaccugccacuuacacaaaaguuggaggacaaugagaaccaggucgugcacccuucuguucggggcaaucaguggcgaacugggcccuggggaucaugcuccaguagcuguucgggcgggcugcagcacagagccguggucugccaagaugaaaacggacagucugcuuccuacugugacgcagccagcaaaccaccugaguuacagcagugcggccccgguccauguccgcaauggaacuaugggaauuggggagaaugcucacagaccuguggcggcgggaucaagagucgccucgugauaugccaguucccuaacggacagauucuggaggaucauaauugugagaucguuaacaagcccccaucugugauucaaugccacaugcaugcuugucccgccgacgucuccuggcaccaggaaccuuggacgagcugcucagcaaguugugguaaaggcaggaaguaccgugagguauuuugcaucgaccaguuccaacggaaacuugaagauacaaauugcagccaggugcagaagccacccacccauaaagcguguagauccguuaggugcccuucuuggaaggccaacagcuggaaugaguguuccgugacuugcgggucaggaguccagcaacgcgacguguauugucgacugaagggcguaggucagguggucgaagagaugugcgaucagucuaccagaccguguagucagcggaggugcuggucgcaagacuguguucagcacaaagggauggagcgcggacgucuaaacugcagcacauccugugaaagaaaggauucucaccagcggauggagugcacugacaaucagauaaggcaagugaacgaaaucguguacaauucaagcaccauuucccucacaaguaaaaacugccgcaauccacccuguaacuacaucgucgugacggcugauucuagccagugcgccaauaacuguggcuuuucauaucgacagagaauuaccuacugcacugagaucccuuccacaaagaaacauaagcugcaccgguugaggcccauaguuuaucaagaauguccaguagugccuaguagccaggucuaccagugcauuaauucuugucugcauuuagcaaccuggaaggugggcaaaugguccaagugcucaguuacuugugggaucggaaucaugaaacgccaggugaagugcauuacaaaacacggucucagcucggaccugugucuuaaccaccugaagcccggcgcucaaaaaaagugcuaugccaacgauugcaagucuuucaccacguguaaagagauccaggucaagaaucauauuagaaaagacggggauuacuauuugaacauaaagggaaggaucauuaaaaucuacugcgcagacauguaccucgagaauccaaaggaauaucugacucuagugcagggcgaggaaaacuucagugagguauacgguuuucggcugaagaauccuuaucaguguccguucaacgggucccgucgcgaagauugcgagugugacaauggacaccuugccgcuggcuacaccgucuuuagcaaaauucgaaucgaccucacaucaaugcaaauaaagaccacugaucuguuguucuccaaaacaaucuuuggcaacgcggugcccuucgccaccgcaggggacugcuauucugcuuuuagauguccacagggacaguucagcauuaaucugagugguacaggcaugaagaucuccagcacugccaaaugguuaacccaggggucuuacacgucaguuaguauuaggcgguccgaggauggaacacgcuuuuucggcaagugcgguggguauuguggaaagugccucccucauaugaccacuggccugcccauccaagugauauga

SEQ ID NO: 52446 - RNA, 3636 nt, Artificial Sequence
  derived and/or modified sequence opt3 from ADAMTS2__Homo_sapiens__NP_055059
auggacccgccugccggcgcugcaagaaggcugcucugcccagcccuucuguuguuacugcuacuccugccgcccccucuucugccacccccuccacccccugcgaacgcucgguuggccgcagccgcugauccacccgggggaccccucggucacggcgcagagcgcauccuggccgugccuguccgaaccgacgcucaggggcgucugguuagccaugugguauccgccgcgacaucuagagcaggagugagggcccggcgcgcugccccagucagaacucccucauucccuggcgguaaugaagaggaaccagggagucaccucuuuuacaacgugacgguuuucggaagggauuuacaucugcggcuucgccccaaugcacgauugguggcuccgggcgccaccauggaguggcaaggcgaaaaggggacaacuagagucgagccucugcuaggaagcugucucuaugugggugacguagcgggccuggccgaggcauccucuguugcucuuucgaacugcgaugggcuggccggauugauuaggauggaagaggaagaguuuuucauagagccccucgaaaaaggccuggcugcccaggaggcagaacagggucgggugcacgucguguaccgucgcccaccuaccucacccccauuagggggaccccaggcccuggacacaggcgcuagccucgauagucuugacucccugucuagagcguugggcgugcuagaggaacaugcaaauagcuccaggcggcgagcccgcagacacgcugccgaugacgauuauaacaucgagguccugcucgggguugacgauucagugguacaauuucacggaaaggagcaugugcagaaauaccugcuuacccugaugaauauugucaacgaaaucuaucacgacgagaguuugggugcacauauuaaugugguucucgugaggaucauacuguuaagcuacggcaagucuaugucccugaucgaaauugggaacccuucacagagccuagagaaugucugucggugggccuaucuccagcaaaaaccagacacuggacacgaugaauaccacgaccaugcuaucuuccugacacgccaggauuuuggcccgagugguaugcagggguacgcccccgugaccggcaugugccacccuguaagaucuuguacgcuuaaccaugaggacggauucuccagcgcauuuguuguggcgcacgagacuggccaugucuuggggauggaacacgauggacaggguaauaggugcggcgacgaggugcgucuggggucgauuauggcuccacucguccaagccgcauuccaccgguuucauuggucucgauguucccagcaggaacugucaagauaucuucacaguuacgauugccuguuggacgaucccuucgcccaugacuggccugcucucccacaacugcccggauuacacuauagcaugaacgagcaguguagguuugauuucggccuggguuacaugaugugcaccgccuuccgcacauuugacccguguaagcagcuauggugcucccacccugacaauccauauuucugcaagacuaaaaaggggcccccucucgauggcaccaugugugcacccggaaaacauugcuuuaagggccacuguaucuggcugacaccagacauacuuaaacgggaugggucuuggggagcuuggagcccuuucgguucaugcaguagaaccuguggcacgggggugaaguuuaggacucgccagugcgacaacccccauccagccaacggaggccgaacauguuccgguuuggcguacgauuuccaacugugcagccggcaggacuguccggauucucucgccgacuuucgugaggaacagugcagacagugggaucuguauuucgagcacggggacgcucaacaucacugguuaccucacgaacauagggaugcaaaggagcgcugucaccuguacugcgaaucacgggagaccggcgagguugugaguaugaaaagaaugguacaugacggaacuaggugcagcuacaaggaugccuuuucccuuuguguccgaggcgacugccgcaaaguggggugugacggaguuauugguucuucgaagcaggaagauaaaugcggcgugugugggggagacaauagccacugcaaggucgugaaaggcacauucacccggucccccaagaagcaugguuauaucaaaauguuugagauuccagcuggcgccagacacuugcucauccaggaaguagaugcaacgucacaccaucuggcggugaagaaccuagagaccgggaaauucauccugaaugaagagaacgacguugaugccaguucuaagacauuuauugcuaugggagucgagugggaauacagggacgaggauggccgugaaacucuccagaccauggggccccugcacggaacaauaacugugcuugugaucccugucggcgacacccgcguuagcuugacauauaaauacaugauucaugaggauucccugaauguggacgauaacaauguguuagaagaggacucaguagucuaugagugggcccucaagaaguggagcccauguucuaaacccugcggugggggaucccaauucaccaaguacggcugucggagaaggcuggaucacaaaauggugcaccgagguuucugcgcagcucuuaguaagccuaaagccauccggcgcgcauguaacccgcaggaaugcagccagccaguuugggugacuggcgagugggaacccugcucucagacgugugggagaacaggaaugcaagucagguccgugcggugcauacagccucugcaugacaauaccacucgaucaguucacgccaagcauuguaacgacgcuagaccagagagucgcagggcgugcagccgugaauugugucccggccgguggagagccgggccuuggucgcagugcuccgugaccuguggaaauggcacacaagagaggccgguacucugccgcaccgcagaugacucuuuugguauuugucaggaggaacgacccgagacugcuagaacaugccggcuggggccauguccuaggaacaucagcgaucccucaaagaaaaguuaugucgugcaguggcuaucccgcccagacccugauucucccauccguaagauuagcuccaaaggacacugccagggcgacaagucaaucuucugcagaauggaagugcugagccgguacuguaguauuccagguuacaauaaacucugcuguaagucuugcaaccuguauaauaaccuuacgaacgucgagggcaggauagagccgccucccgggaagcauaaugauaucgacguuuuuaugccaaccuugcccgugccuacuguagccauggaagugcgcccaucccccagcacaccucuggaggucccguuaaacgccucgucaaccaaugcuacagaagaucacccagagacuaacgcaguggacgaacccuacaaaauucacggacucgaggaugagguucaaccucccaaucugaucccacgaagaccuucucccuaugaaaagacccggaaccagaggauccaggagcuuauugacgaaaugcgcaaaaaggagaugcugggcaaauucuga

SEQ ID NO: 52447 - RNA, 3618 nt, Artificial Sequence
  derived and/or modified sequence opt3 from ADAMTS3__Homo_sapiens__NP_055058
auggugcugcucagccuuuggcugaucgccgcugcauuggucgagguuagaaccuccgccgacggccaggcggggaacgaagagauggugcaaauugauuuacccauaaagagguaccgggaauaugagcugguaacaccugugucuacuaaucuagaaggacgcuaccucucacacacgcugagugcuagccauaaaaagcgauccgcccgugacgucucuucgaacccagagcagcuuuucuuuaauaucaccgcauucgguaaagauuuucaccugagauugaagccgaacacacagcucguggcccccggcgcuguuguggaguggcaugaaacuucacuggucccugggaauauuaccgacccaaucaacaaucaccagcccggaagcgcaacauauaggauucggcgcaccgagccucugcaaacuaacugcgccuacgugggcgauaucguagacauaccagguacaaguguugcuaucuccaauugugaugggcucgccggaaugauuaaaucugacaacgaagaguauuucaucgagcccuuagaaagaggcaagcagauggaggaagagaagggcaggauucauguggucuacaaacggagcgcgguggaacaggcaccuaucgauauguccaaggacuuucacuaucgcgagucagaucuggaggggcuugacgauuugggaaccguguacgguaauauacaccagcaacugaacgaaacgaugcgaagaaggcggcaugccggcgagaaugacuacaacauugaaguccuacucgggguugacgauagugugguacguuuccacggaaaagagcaugugcagaauuaucugcuuacucugaugaacaucgucaacgaaauuuaccacgacgagagcuugggcgugcacaucaauguugugcucguccgcaugaucaugcuggguuaugcuaagucuauuuccuuaauagagagagggaacccaucaaggagccuggaaaaugugugccggugggccagucagcagcaacgaucugaucucaaccauuccgagcaccaugaccacgcaaucuuucuuacccgccaggauuucggaccggcuggcaugcagggcuacgcccccguaacagggaugugucauccuguuagaagcugcacucugaaucacgaagacggauuuucgucugcguucguggucgcccacgagaccggucauguguugggcauggaacacgaugggcaaggaaacagguguggcgacgagacagcaauggguuccgucauggcuccacuugugcaggccgcuuuucaucgguaucacuggucacgcugcagugggcaggagcugaaaagauacauucacagcuaugauugucuccuggacgaucccuucgaccaugacuggccuaagcuaccagaacugcccggcaucaauuacuccauggaugagcagugcagguuugacuucggaguuggcuacaagauguguaccgccuuccguacguuugauccgugcaaacaauugugguguucucacccugacaaccccuauuucugcaagacuaaaaaggggccaccucucgauggaacagaaugcgcagccgguaaaugguguuacaagggccauugcauguggaaaaaugcuaaccagcagaagcaggacgggaauuggggaagcuggaccaaguuuggcucauguagucggacuugcgguacaggggugcgauucagaaccaggcaauguaacaaucccaugccaauaaacggcggacaggauugccccggcguaaauuuugaguaucagcuguguaacacggaggaaugccagaaacacuucgaggacuuucgcgcgcaacagugucagcagcggaacucccauuucgaauaccaaaauaccaagcaccacugguuaccuuaugagcauccagauccgaaaaagagaugccaccuguacugucagagcaaagaaacaggggacgucgcauauaugaagcagcuagugcaugauggaacucacugcucuuacaaggaccccuacucaauuugcguuaggggugagugugugaaagucggcugcgauaaggagaucgggaguaacaaaguggaagacaaguguggaguaugcggcggugacaauagccauugucgcaccgugaaagggacauuuacucgaaccccucggaagcucggcuaucugaagauguucgauaucccacccggagcccgucacguucuuauucaagaggacgaagcuagcccucacaucuuggccauuaaaaaccaggcaacaggccauuacauacugaaugggaagggagaggaagccaaaucuagaaccuuuaucgaucucggcgucgagugggacuauaacauugaggaugacaucgaaucgcugcacacugaugguccacuucaugaccccgugaucgugcugauuauaccgcaggagaaugauacgaggagcuccuugacauacaaguauaucauucacgaagacucagucccuaccaucaacaguaauaacguuauucaggaggaacucgauacuuucgagugggcucugaaaucuuggagccaaugcuccaagccaugugggggaggcuuucaguacaccaaguaugguugccgccggaaaucagacaauaagauggugcacagauccuucugugaggccaacaaaaagcccaaaccuaucaggcgaaugugcaauauacaggaauguacacaucccuuauggguggcagaggaaugggagcacugcaccaagacuugcgggucuuccggcuaccagcugcgcacaguacggugucuacaaccacuccuggauggaacgaacagaaguguccauagcaaauacugcaugggcgacaggccugagucucgucgccccuguaaucgggugccaugcccggcgcaguggaagaccgggccuugguccgaauguucaguuacuugcggagagggcacagaagugagacagguccuuuguagggcuggugaccacugcgauggggagaagcccgaaagugugcgagccugucaguugccacccugcaacgacgagccuugucugggagauaaaagcaucuucugccaaauggagguucucgcacgguauugcucgauuccaggcuacaacaagcuguguugcgaauccuguucuaaacgcagcucaaccuuacccccuccguaucugcuugaggccgcugaaacacaugacgaugugaucaguaauccauccgacuugcccagaucucucguaaugccuacuagccuggucccauaccacuccgagacccccgccaagaaaaugucacuaagcaguauuucuuccguggguggcccuaacgcauaugcugccuuuaggccgaauagcaagcccgauggggcgaaccugcggcagcgaucggcccagcaagcuggaucaaagacggugagacucgucaccguuccaucuaguccucccacaaaacgcgugcaccuguccagcgcaucucagauggccgcugccagcuucuuugcagcguccgacucaaucggcgccaguagccaggcuaggacuucuaagaaagaugggaagauaauugacaaucgucggccaaccagauccucaacacuugaaagguga

SEQ ID NO: 52448 - RNA, 2514 nt, Artificial Sequence
  derived and/or modified sequence opt3 from ADAMTS4__Homo_sapiens__NP_005090
augagccagaccggcucccaccccgggagaggacuggccgguagguggcucuggggcgcucaaccuugccuucuguugccaaucgugccguuaucuuggcuggucuggcuacuccugcuucuguuggcaucacuccugcccagugcccggcuggcgagcccucucccacgcgaggaagagauuguuuuccccgaaaaguuaaacggguccgugcugccuggaucuggcgcuccagcccgacuuuugugucgucugcaggcauuuggugagacacuacuccuggaacuugagcaggacucggggguacagguggagggacugacuguccaauacuugggccaggcccccgaacuccugggcggggcugagccuggaacguauuuaaccgguacaauaaauggcgauccagaaucaguggcaagccugcauugggacgggggagcccuccuuggcguucugcaguacagaggugcugaguugcaccuacagccgcuggaagggggaacucccaacagugccggcggcccuggggcgcauauccucaggcggaaauccccagcaucuggacaaggucccaugugcaaugugaaggccccucugggcagcccaaguccccgcccgagaagggcuaaacgguucgccucacuuagucgcuuugucgaaacccuggugguagcagaugacaagauggcugccuuccacggggcgggauugaaacgauaucuccugacaguuauggccgcagcugccaaggcuuuuaagcauccuagcauuagaaaccccgugucuuuagucgugaccaggcuggugauccuaggcuccggugaggaagggccacaggucggcccuucagccgcacagacucuccggagcuucugugccuggcagcguggacugaauacacccgaggauagugacccagaucacuuugacaccgcuauucuuuucacgcgccaagauuugugcggcguuucuacuugugacacccuggggauggcggaugugggaacaguaugcgaccccgcaagauccugugccaucguggaagaugacggucuccagagcgcuuuuacugccgcacacgagcugggccaugucuucaacaugcuucacgacaauucgaaaccuugcauaucucugaacgggccauuguccaccucaaggcaugugauggccccgguuauggcucacguggaucccgaggaaccuuggaguccauguagcgcccgguuuaucacagacuuccucgauaauggauacggccacugccuguuagacaagcccgaggcaccucugcaucuaccagucaccuuucccgguaaagauuaugacgcggaucgacagugucaacucacguucgggccggacucccgccacugcccucagcugccacccccuugcgcugcccuuugguguucuggccauuugaacggacacgcaaugugccagacuaagcauagccccugggccgauggcacaccaugugggccugcucaggccugcaugggagguagaugucugcacauggaccaacuccaggauuucaauauuccccaggcaggcggguggggaccauggggcccguggggugacugcucaaggaccugugggggcggagugcaguuuaguucccgggacugcacucgcccuguacccagaaacggcgggaaauacugugaaggaaggcguacacgguuccgaagcugcaauaccgaggauuguccaacgggcucugcucugaccuuuagagaggagcaaugcgccgcguauaaccacaggacagacuuauucaagucauuucccgguccuauggauuggguuccacgcuacacugggguggcuccccaggaccagugcaagcugaccugucaggcccaagcacuuggauacuauuacgucuuggagccucggguggucgauggcacaccgugcaguccagacagcuccucuguguguguucaggguagaugcauccaugccggcugugauaggauuaucgggucgaaaaagaaauucgacaagugcaugguguguggaggcgaugggagcggaugcuccaaacagucaggcaguuuucgcaaguuccgauaugguuacaauaacguagucacuauacccgcuggggccacccacauucucgugcggcagcaaggaaacccuggccaucguucuaucuaucuggcacuaaaacugccagacgguagcuacgcgcucaauggcgaauauacacugaugcccuccccuaccgauguugugcuuccgggggccgucucauugagauacagcggagcuacugccgcaucugagacgcuguccggccacgggcccuuagcucagccacucacacuucaggugcugguagccggaaacccucaagacaccaggcugcgcuacuccuuuuucgugccccggccaacuccuagcacccccagaccaacaccgcaggauugguugcacaggcgagcacagauucucgaaauccugcgccggagaccuugggccggcaggaaguga

SEQ ID NO: 52449 - RNA, 2793 nt, Artificial Sequence
  derived and/or modified sequence opt3 from ADAMTS5__Homo_sapiens__NP_008969
augcugcucggcugggccagccuucuguugugcgcuuucagauuaccccuggcagccguggggccugcggcuaccccagcccaggacaaggcaggacaaccgcccacagccgcugcagccgcucagccuaggcggcgccagggugaggaaguccaggagcgagccgaaccacccggccacccucauccacuagcgcaacguagaagguccaaagggcucguucagaacaucgaucagcuguacucuggaggcgguaaggugggguaucuuguauacgcaggaggccggcgcuuucuguuggaccucgagagagauggcucaguggggauugccggauucguccccgcugguggcgggacgagugccccuuggaggcaccggagccauuguuuuuaucgcggaacuguggacggcuccccacgaucucuggcaguuuucgaucugugcggugggcucgacggauuuuucgcugugaaacacgccagauacaccuuaaagccgcugcuuaggggccccugggcggaagaggagaaaggccgggucuauggggauggaucggcccguauauugcauguguacacacgcgaagguuuuucauucgaggcacugccuccaagagcuagcugugaaacucccgccaguaccccugaggcucacgagcacgccccagcacauuccaaucccucuggcagggccgcucuagcgagccagcuccuggaccaauccgcacuuucaccggccgggggaaguggcccucagacaugguggcggcgacgcagaaggagcaucucucgggcucgccagguagaacuguugcucguugccgaugcauccauggccagacuguaugguaggggguuacagcacuaccugcucacccuugcuucaauugccaaccgucuguacagccaugcaaguaucgagaaucacauucgguuggcgguggucaagguggugguccuaggcgacaaggauaaaucucuggaaguuuccaagaacgcugccacuacacucaaaaauuuuugcaaguggcaacaccagcauaaccagcugggagacgaucacgaggaacauuaugacgcagccauccuuuucacccgagaggaccuguguggccaccauagcugcgauacguuggggauggcugacgugggaacuauauguucgcccgagagaucuugcgccguaaucgaagaugacggucuccacgcagcuuuuaccguggcccacgagauuggccaucuguuagggcugucccacgaugacucaaaauucugugaagagacauuuggaaguacugaagauaagaggcuaaugagcuccauccucaccucuauugacgcgagcaagccauggucaaaaugcacaagugccaccaucacggaguuccuggaugacggccaugguaauugucuuuuggaucugccucgcaagcaaauacucgggcccgaggaacugccaggccagacuuacgacgcuacacagcagugcaaccuuaccuucggacccgaguauuccgucugcccuggcauggacgugugugcacggcuguggugcgccguugugagacaagggcagauggucuguuugacuaaaaagcucccagcuguggaaggaacaccgugcgguaaaggcaggauuugucugcaggggaagugcguagauaaaaccaagaagaaauacuauagcacgucuucacacggaaauuggggcaguugggguagcugggggcaguguucccgcucuugcggcggaggcguucaauuugccuaccgacacuguaacaaucccgcaccucggaacaaugggcguuauugcaccggaaagagagcgaucuacaggucguguagcuuaaugccaugucccccuaacggcaaauccuuccgccaugagcagugcgaagccaagaaugguuaccagucagacgcuaaaggggugaagacauuugucgagugggugccaaaguaugccggaguccugcccgcagaugugugcaaacuaacuugccgggcuaagggcaccgguuacuauguuguguucaguccgaaaguaacagacggcacugaguguagacucuacucuaacagcgucugcgugagggggaaguguguucgaaccggaugcgauggcauuaucggguccaaacugcaguaugacaaguguggagugugcggcggugauaacucaagcuguacaaagaucgucgggaccuuuaauaaaaagucuaaaggauacacugacgugguacgcauuccugaaggcgccacgcacauaaaggugcggcaauucaaagcaaaggaucagacaagauuuaccgccuaucuugcuuugaagaaaaagaacggugaguaccugaucaauggcaaauacaugauuuccaccagugaaacuaucauagacauuaacgggacaguuaugaauuauagcggauggucucauagggaugacuuccuccacggcaugggguacuccgcgaccaaggagauccugaucguccagauuuuagccacugauccaacaaaaccccuggacgugcguuauucauuuuucgugccuaagaaaaguacgcccaaggucaacagcguuaccucgcauggauccaauaaggugggcucucacacuagccagccacaaugggugacagguccuuggcuugcaugcucacgcaccugugacacaggguggcacacucggaccguacagugccaggauggaaacagaaaauuggcuaagggcugcccccucagucaaaggccauccgccuuuaaacagugucugcuaaagaaaugcuga

SEQ ID NO: 52450 - RNA, 3354 nt, Artificial Sequence
  derived and/or modified sequence opt3 from ADAMTS6__Homo_sapiens__NP_922932
auggagauccuguggaagacccucacauggauucuuagccugauaauggccuccucugaguuccacucagaccauagauugaguuacagcucccaggaagaauuuuuaacuuaucuggagcacuaccaacuaacgauccccauuaggguggaucagaacggcgcuuuccucucuuuuaccgucaaaaaugacaagcauucgcggcgccgacguucaauggauccuaucgacccacagcaggcaguuagcaaacuguucuuuaaacuuagugccuaugggaagcacuuccaucugaacuugacacucaauacugauuuuguguccaagcacuucaccguagaauacuggggaaaggacgguccgcaauggaaacacgauuuucuggacaacugccauuauacaggcuaccugcaggaucagagaucuaccacuaagguggcgcucagcaauugugucggguuacacggagugauugcuacagaggacgaggaauauuucaucgagccccugaaaaacaccacggaagauuccaagcauuuuucauacgagaauggccacccucacguuauauacaaaaagagugcccuucagcaaaggcauuuguaugaccacagccauugcggugugucugauuucacucgguccgggaagccaugguggcugaacgacaccucaacagucagcuacagucuacccaucaauaacacucacauucaucaccgccagaaaagaucuguguccaucgagagguuuguagaaacccucguuguggcagacaagaugauggucggauaucacggccggaaagauauugagcauuacauccugagcgugaugaauauaguggccaaacuuuaucgcgacucgucucugggcaacgucguuaauauuaucguggcucgauugauuguacucacagaagaucagccuaaccuggagaucaaucaccaugcagacaaguccuuagauucauucuguaaguggcagaaaaguauccugagccaccaauccgacgggaacaccauuccagaaaacggaauagcccaccaugauaaugcugugcucaucacgagauacgacauuugcacuuauaagaacaagcccugugguacacuuggccuggccucugucgcggggaugugcgagccugagaggagcuguucaaucaaugaagauauaggauugggcagugcauucaccauugcccacgagaucggucauaacuuugggaugaaucacgacggaaucggcaacuccugcggcacuaaagggcaugaagcugccaagcuaauggcagcucacauuacagccaauaccaacccauucagcuggucugcguguucacgggauuacaucacgaguuuucuggacagcggacgugguaccugccucgacaaugagccgcccaaacgcgauuuccuguacccugccguggcaccaggccagguuuaugacgcugaugaacaguguagauuucaauacggggccacauccaggcagugcaaguauggagaggugugccgggagcuuuggugucugucuaaaucgaaccgaugcgucacuaauagcauucccgcugccgaaggcaccuugugucagacagguaacauagagaagggguggugcuaccagggcgacugugugccuuucggaacuuggccacaauccaucgauggcggguggggacccuggucacucuggggugaaugcagucgcaccuguggcgggggaguaucuagcucccugagacacugcgacucaccggcaccuagcggcggugggaaguauuguuuaggcgagaggaaacgguaccgcucuugcaauacagaucccuguccacugggauccagagacuuuagggaaaagcagugcgccgauuucgacaacaugccuuuucguggcaaauauuacaauuggaagcccuacaccgggggagguguuaaaccaugcgcucuaaacugucucgcggagggcuauaacuucuacacugagcgggcacccgccgugauugaugggacgcagugcaaugcugacagucuggauaucuguaucaacggagaaugcaagcaugucggcugugacaauauucuugguagcgacgcccgagaggauagaugcagggugugugggggcgacggaucuacaugcgaugcaauagaaggcuuuuucaacgacuccuugccucgcgggggauauauggaggucgugcagaucccacggggcucaguucacauugaggugagagaaguagccaugaguaagaauuacaucgcucugaaaagcgagggugaugacuauuacauuaacggggccuggaccaucgauuggccgaggaaguuugacgucgcaggaacugcguuccauuauaaacgccccaccgaugaaccugagucgcucgaagcucugggcccaacauccgagaaucuuauagugaugguucuguugcaagagcagaaccucgguauccgauacaaguucaaugugcccauuacccggacuggcucuggggacaacgaagucggauuuacauggaaucaccagccuuggagcgaguguucagccacgugcgcaggcggggugcagcgucaagaaguaguguguaaaagacuggaugacaacaguaucguucagaauaacuacugcgauccagacuccaagcccccggagaaucagagggccugcaacaccgaaccuuguccacccgagugguucauuggagacugguuagagugcucuaagacuugugauggcgguaugcgcacacgggcuguccugugcaucagaaaaauagggccuagcgaagaggaaacccuagacuauuccggaugucucacacauaggcccguggagaaggaaccaugcaacaaucagucauguccuccccaauggguggcccuggauuggagcgagugcacuccaaaauguggcccggguuuuaagcaccgaauuguccuuugcaaaaguucugacuuguccaagaccuucccugcagcucagugucccgaggaaagcaaaccacccguucgcauccggugcucgcugggcagaugcccuccacccaggugggugacgggggauuggggacaguguucagcccaaugcggccucgggcagcagaugcguaccgugcagugucugucuuacacaggacaagcgaguuccgacugcuuagagacuguacgcccuccgagcaugcagcagugugaaucuaagugcgauagcaccccaauuuccaacacagaggaguguaaggacgucaauaaaguggccuauugcccccugguucuuaaguuuaaauucuguucacgggcuuacuuuagacagaugugcuguaagacuugccaaggccacuga

SEQ ID NO: 52451 - RNA, 5061 nt, Artificial Sequence
  derived and/or modified sequence opt3 from ADAMTS7__Homo_sapiens__NP_055087
augcccggcgggccuagcccaagauccccggcaccacugcucaggccucuucuguuguuacugugcgcucuagcaccaggagcccccgguccugcgccaggccgggcuaccgaggggcgcgccgcccucgacaucgugcaccccguccgaguugacgccggcggcucuuuccugucauacgaacuuuggccucgugcucugagaaagagggacgugaguguacggcgcgaugcaccagccuuuuaugaguugcaguacagagguagggaacuccgguucaaccugacagcuaaucaacaccuccuggccccgggguuugugagcgagacucgccgaagaggaggcuuaggcagggcgcacauucgggcacacacgcccgccugucaucugcuuggggaaguccaggacccugaguuggagggaggucuggcugccauauccgcaugcgauggccuaaaggggguguuccagcucucuaacgaagacuauuuuaucgagccacuggauucggcucccgcccguccuggacaugcgcagccacacguuguguacaagcgccaagcccccgaaagacuugcacagaggggcgacucaagcgcuccgaguaccugugguguccagguguauccugagcuggagucccggcgagaacgcugggagcagagacaacaguggaggcggccccgcuugagaaggcuccaccagcguucuguaagcaaagaaaaguggguugagacccugguggucgccgaugcuaaaaugguggaauaccaugggcagccacaaguggaguccuaugucuuaacuauuaugaauaugguugccggacuguuccacgacccuucaaucggcaaccccauucauaucaccauagugcggcucguacuucuggaggaugaagaggaagacuugaagaucacacaccacgcagauaauacccuaaagaguuuuugcaaauggcaaaagagcauuaacaugaaaggcgacgcccauccacugcaccaugacacugcuauccuccugacacgaaaggaucuuugugcggcaaugaauagacccugcgagacccugggguugucucacguggccggaaugugucagccucauagguccugcucaauuaacgaagacacgggucucccacuggcuuucacugucgcccacgaguuaggccacagcuuugggauccaacaugauggaaguggcaaugacugugagccgguggguaaacgccccuucauaaugucuccucagcugcuauacgaugcagccccacucaccuggucccggugcagcagacaguacauuacaagguuucuggaccgcggguggggccuuuguuuggaugaucccccugcuaaggauaucauugacuucccaucgguucccccgggagugcuguaugaugucucucaccagugccgacuccaauacggcgccuauuccgcauuuugcgaagacauggacaacgugugucauacucuguggugcucaguagggaccacaugucacaguaaacuugaugcggcuguugacggaacccggugcggugagaauaaauggugucugagcggcgaaugcgugccugucggguuccguccagaggccguggauggaggcugguccgguuggucugcauggagcaucuguucaagaaguugcgggaugggcguccaguccgccgaaaggcaguguacgcagcccacuccuaaguacaaaggacgcuauugcgugggcgagcggaagagauucagguuguguaaccuccaggcuugccccgccgggcgacccagcuuucgccacguucagugcucucauuucgacgcaaugcuguacaaaggacaguuacacacaugggugccuguagucaaugaugugaaccccugugagcugcauugccggccagcuaaugaauauuuugccgagaagcuaagagacgcgguuguggaugguaccccguguuaccaggucagggccucacgugaccucugcaucaacggcauuuguaaaaacguggggugcgauuucgaaauagacaguggagcuauggaggaucgcuguggcguaugccacgguaaugggagcacuugucauacaguguccggcaccuuugaggaagcagagggacugggcuacguugacgucgggcuuaucccugccggagcucgggaaauuagaauccaagagguggccgaagcagcgaacuucuuggcccugaggucugaggaucccgagaaguauuuucucaauggcgguuggacgauacaguggaacggggacuaccagguggcuggaaccacauucacuuaugcccgacggggcaauugggaaaaccugaccucgccaggucccacaaaggagccugucuggauucaguuacuguuucaagaaagcaauccaggcguucacuacgaguauacuauccaccgcgaagcagggggacaugacgaggugcccccuccgguguucuccuggcacuacggcccauggaccaaaugcacaguaaccugugggagaggaguccagaggcagaacguguauugccuugagcggcaagcuggccccguugaugaggaacacugcgacccuuugggucgaccagaugaccagcagagaaaguguucagaacagcccugcccugcccgcuggugggcaggggaguggcaacucuguaguucuagcugcggaccgggcggucuguccaggcgugccgugcuauguauccggucagucggccuggaugaacagagcgcucucgagcccccagcgugcgagcaucugccuagacccccaacugaaacgccuuguaauaggcaugugcccugcccagccacaugggcaguugggaacuggucucaguguuccgugaccugcggagagggcacucagcgccgaaauguacuuuguaccaacgacacaggggucccgugcgaugaagcucaacagccugccagugaggugaccugcagcuugccccuguguagauggccauuaggaacucucggccccgaggguucuggguccggaucaaguagccacgaacuguuuaaugaggccgacuucauuccucaccaucuugcuccacggcccucgccugcauccucuccgaaaccaggcacaauggguaacgccaucgaagaggaagcgcccgagcuggauuugccuggccccguguuugucgacgauuucuacuacgacuauaauuucauuaacuuucacgaggaucucagcuacgggccaucagaggaaccugaccuggaccuagcuggaacgggcgauaggacacccccaccucauagucacccggccgcacccuccacugggucuccaguuccugccacagaacccccagcugcaaaggaggaaggagugcugggcccuuggagccccuccccguggccaucacaggccggucgcagcccucccccacccagugagcagaccccugggaacccgcucauaaauuuccugcccgaggaagacacaccaaucggagcgccugaucuuggcuugcccucucuguccuggccucguguaagcacugacggcuuacaaaccccagcuacgcccgagucgcagaacgauuuuccuguggggaaagacucacagucucaacucccacccccguggagagaucggaccaaugaagucuucaaggacgaugaggaaccuaagggaaggggugccccacaucugcccccucgcccaaguuccacacuucccccgcugagcccugugggcucuacucauagcucccccucaccagacguugcagagcuauggaccgggggaacaguggccugggagccugcucucgaaggcggucuggggcccgucgauagugaguuguggccaacugugggaguugccagccuguuacccccuccaauugcaccgcuccccgaaaugaaagugcgagacucuucccuggagccuggcaccccaucauuucccacgccuggcccagggaguugggaccuucagacagucgcuguauggggaaccuuccugcccacuacauugaccggucucggccacaugccugagccggcccugaacccagggcccaagggacagccugaaagccuaucccccgaggugccacugucuucgagacuucucagcacuccugcgugggauucacccgccaauucccaucggguuccagaaacccagccgcuggcaccuaguuuggcugaggccggacccccagcugacccccugguggucaggaacgcagguuggcaagccgggaauuggucugaaugcagcacaacguguggauuaggcgccguguggcgcccuguaagaugcuccucaggcagggaugaggacugugcuccagcggggcggccccagccugcacgucgcugccaccuccgaccgugugccaccuggcauucuggaaacuggagcaaaugcaguagauccugugguggcgggagcucugugagggauguccagugcguugacacucgggaucugcgcccacuuagacccuuucacugucagccuggaccagcuaagcccccugcccacaggcccugcggcgcacaaccaugccugucaugguauacauccaguuggcgggaguguagcgaagccugcggugggggagagcagcagcgauuggugaccuguccggaaccuggccucugcgaggaagcucugagacccaauacaacucgcccauguaacacccauccuugcacgcaguggguggucggccccugggggcaauguucgggaccaugcgguggcggggugcagaggcggcuaguuaaauguguaaauacacagaccggacugccugaggaggacucugaucagugcggccacgaagcguggcccgaguccagccguccgugugguacugaagacugcgagccaguggaaccucccagaugcgagagggaucgccuuucauucggguuuugugagacccuccggcuguugggacgaugccaauuaccaacaaucagaacucaguguugcaggaguuguucucccccuucccauggcgccccgagccgcggccaccagcgggucgcaagacguuga

SEQ ID NO: 52452 - RNA, 2670 nt, Artificial Sequence
  derived and/or modified sequence opt3 from ADAMTS8__Homo_sapiens__NP_008968
augcugcccgccccugcugcaccaagauggccgccccuccuucuguuguuacugcuacuccugccucuugccaggggcgcgccagcucggcccgccgcagggggacaggccagcgagcugguggucccuacccgcuugccagguuccgcuggcgaacucgcacugcaccugucugccuucgggaagggauuuguucuccgauuagcucccgacgauucauuccuggccccugaguuuaaaaucgaacgucuuggcgguagugggagagcgacaggaggcgagaggggcuugcgggggugcuucuuuagcggaacugugaacggugaaccagagucccuggcagccguaucucuaugucgcggccucucggggucauuccugcuugacggagaggaauuuacgauucaaccgcagggcgcuggugggagccuggcccagccccauagauugcagagguggggaccugcaggcgcucggccacucccccgcggcccugagugggaaguggagaccggggagggacaacgacaggaaagaggugaucaccaggaggacagugaagaggaaucccaggaggaggaagccgagggcgcgucugaaccacccccgccucugggggccacaagcaggacuaagcgguucgucuccgaggcacguuuuguggaaaccuuacugguugcugaugccucaauggcugccuucuacggagcagaccuccaaaaucauauacuuacacugaugaguguggccgcucgcaucuauaaacaccccagcauuaagaacucuaucaauuugauggucgugaaaguacuaauuguugaggaugagaaguggggcccagaaguguccgacaacggugggcugacccucagaaauuuuugcaacuggcagaggcgguucaaucagccuucagaucgacaucccgagcacuacgacacugcgauccugcuuacacgccagaacuuuuguggccaagaaggacugugcgauaccuugggcgucgcagacauagggacgaucugugauccaaauaagagcugcagugugauugaggacgaaggacuccaggccgcucacacucuggcccaugaguuaggucacgugcugucuaugccccaugacgauuccaaaccuuguaccagacuauucggcccaauggggaagcaccacgucauggcaccccucuucguucaucugaaccagacacuucccuggagcccuugcucggccauguauuugacugagcugcucgacggaggccacggugauugucugcuugacgcuccagccgcagcgcugcccuugccuaccgggcucccaggcaggauggcucuguaccaauuagaucagcagugccggcagaucuuuggacccgacuuccgccauuguccgaauacaucugcccaagaugugugcgcacagcuguggugccacaccgacggcgccgaaccucuaugucauacgaaaaacgggucccucccaugggcugauggaacucccugcgguccuggccaccuguguucagaggggaguugccuucccgaagaggagguagaaagaccaaagccuguggccgacggaggcugggcacccugggguccauggggcgaguguagcaggacaugcgggggaggcguccaguuuucccaccgugaauguaaagauccggagccucagaaugggggacgguauugcuugggccgacgggcuaaguaccaaucuugucauaccgaagagugcccgccagacgguaagagcuucagggagcagcagugugaaaaauauaacgccuacaauuacacugacauggaugggaaccugcuccagugggugcccaaguaugcgggaguuucaccucgcgaccggugcaaacuguuuugcagagccaggggccgcagugaguucaagguguuugaagcuaaagucauugaugguacauuauguggcccagagacccuggcaaucugcgugcgagggcaauguguaaaggccggaugcgaccacguuguggauucccccagaaaacuugacaaguguggcgucugcgggggaaagggcaacagcugucguaaagugucugguucauugacgccuaccaauuacggguauaacgauauagucacaauuccggcuggagccacuaauaucgacgugaagcagagaagucauccaggcguucagaacgaugguaauuaccucgcacugaaaaccgcggacggccaguaucuacugaacgggaaucucgccauuagcgcuaucgaacaagauauccuggugaagggaacaauucuuaaauacuccggcucuauagccacuuuggagaggcugcagucguuccgccccuuaccugagccacucaccguacagcugcuuacaguccccggggaaguguuuccuccgaagguuaaguauaccuucuuugugcccaacgacgucgauuucagcaugcaauccucaaaagagcgggcaacuacgaauaucauucagccacuguugcacgcucagugggugcucggagacuggagugaaugcucuagcacauguggcgccgguuggcagagaaggaccguagagugccgagacccuuccgggcaagcaucagccacuuguaacaaggcucugaaacccgaagaugcgaagccaugcgagagccagcuaugcccucuguga

SEQ ID NO: 52453 - RNA, 5808 nt, Artificial Sequence
  derived and/or modified sequence opt3 from ADAMTS9__Homo_sapiens__NP_891550
augcaguucgugaguugggccacccugcucacacuucuggucagggacuuggcugaaaugggcucccccgaugcagccgcggcuguuaggaaggaccgguuacacccucgccaagugaaacuguuagaaacucucucugaguacgaaaucguaucaccaauucgagugaacgcccugggggagccguuucccacgaauguccauuucaagcguaccagaaggaguauaaacagcgcaacagauccuuggccagccuuugcuuccucuucgucaagcaguacuuccucucaggcacacuaucggcuuagcgccuucggacagcaguuucuguucaauuugaccgcuaacgccgguuuuaucgcgccccucuucacagugacccugcugggcacuccugggguuaaucaaacaaaauuuuacuccgaagaggaggcagaacucaagcauugcuucuauaaaggauacgugaacaccaauucagagcacacggccgucauuaguuuauguagcggcaugcuggguacuuuucgcucucaugacggggauuauuucaucgaaccacuucaguccauggacgagcaggaggaugaagaggaacagaacaagccccacauuaucuacagaaggucagcuccucaacgggagccaagcaccggacgccacgccugcgacacaagugaacauaagaaucgacacucuaaagauaagaaaaagacuagagcaaggaaauggggcgagcggauaaacuuggcuggcgacguggccgcgcuaaauuccgggcuggccaccgaggcauuuagcgcuuauggaaacaagacagauaauacccgugaaaagcgcacgcauagaaggacuaaacgguuccucucguacccgcgauucguagagguucugguggucgccgacaaccgcauggugucuuaccacggugaaaaucuucagcacuauauccugacauugauguccauuguggcuucaaucuacaaggaucccaguauuggcaaccucaucaacauagucauuguuaaucugaucgugauucauaacgagcaggacgggccuagcaucuccuuuaaugcccagaccacucugaaaaauuucugucaauggcagcacucuaagaauagcccaggaggcauccaucacgacacagcaguacuacucaccagacaggauauuugcagggcccaugacaaaugugauacgcuuggucuggcugaauuggggaccauaugcgaccccuaucggucauguaguaucuccgaggauagcggacugucuacagcguuuacuauugcacacgagcugggccacguguucaacaugccucaugacgauaauaacaagugcaaagaagagggcgucaagucaccacaacacgugauggcccccacccucaauuuuuacacaaacccguggauguggaguaaguguagccgcaaauauaucacugaguuccuggacaccggguacggagagugccuucugaaugaaccugaguccagacccuauccauugccuguucagcuccccgguauacuguacaacgugaauaagcagugugaguuaauuuuuggcccagggucucaggucugccccuacaugaugcaaugcaggcgucugugguguaacaaugugaacggaguacauaaaggcugccggacacagcacaccccuugggcugaugguacugaaugugagccagggaagcacugcaaauauggcuucuguguuccgaaggaaauggacgugcccgucacggauggaucguggggcagcugguccccuuuugggacaugcucacgaaccuguggagguggcaucaagacugccaucagagagugcaacaggccagagcccaaaaaugggggaaaguacugugugggccgccggaugaaauucaagaguugcaacaccgaaccuugucuaaaacagaagagagacuuuagggacgagcagugcgcacauuucgaugguaagcacuuuaauauuaacgggcuccugccaaauguccgcugggugcccaaauauucuggcauccuuaugaaggaccgaugcaaauuguucugucggguugccggaaacacagcuuacuaucaacugcgugauagagugauugacggcaccccgugcgggcaggauacuaaugacauauguguacagggacucugcaggcaggccgguugugaucauguccugaacagcaaggcacgccgggacaaaugcggcgugugugggggagauaauuccucaugcaagacaguugcgggcacguucaacaccgugcacuacgguuauaauacugucgugagaaucccugcuggggccacaaacauugacguaaggcaacauagcuuuucuggcgaaaccgaugacgauaauuaccuugcacuguccaguagcaagggagaguucuugcucaacggcaauuuugugguuacaauggccaaacgagaaauccgcaucgggaacgcugucguggaguacucuggauccgagacugccguggaacggauuaacucaaccgacagaauagagcaggaacuguuacugcagguccuaaguguuggcaagcucuauaauccagacgugagguacagcuucaacauccccauugaggauaaaccucagcaauuuuauuggaacucgcacggucccuggcaggcauguuccaagccaugccagggggaacguaaacgcaagcugguguguacgcgggagucugaccaacuuaccguaagcgaucagagaugcgacagguugccucagcccggacacaucacagagccaugcggcacugauugugaccugcgauggcaugucgcuucacggagugaaugcuccgcccaguguggucucggcuaccgcacccuggauauuuauugcgcgaaauacucuagauuagacgggaagacagagaagguggaugacggauucuguagcucccacccgaaaccuucaaacagggaaaagugcagcggcgaguguaauacugggggauggcgguauagugccuggaccgaaugcucuaaauccugugauggcgguacgcaacgaagacgcgcuaucugcguuaacacaaggaaugacgugcuggaugacagcaaguguacccaucaggagaaagucacuauacagcguugcucggaguuucccugcccacaguggaagucaggggacuggucugaaugucuugugacaugcggaaagggccacaaacaucggcaaguuuggugucaguucggugaggauagauugaacgacaggaugugcgaucccgaaaccaagccuacuagcaugcagaccugucagcaaccagagugcgcauccuggcaggccggccccugggggcaguguagcgugacaugcggacaaggcuaccagcuccgcgcuguaaaauguaucauugggacguacaugucugucguggacgauaaugacugcaacgccgcaacccgaccuacugauacacaggacugugagcugccgagcugccacccacccccugcggccccagaaaccagacgguccacauauucagcucccaggacucaguggcgcuuuggaaguuggaccccuugcagcgccacguguggcaaggguacacguaugagauacgugucuugccgggaugagaauggguccgucgcagacgaaucagcuugugccacccuaccgaggcccguugcaaaagaggaaugcagugugacuccauguggacaauggaaggcccuggauuggagcuccugcucuguaaccuguggccagggucgcgcuacacgacaggugaugugcgucaacuauucggaccacgugaucgacagaagcgagugugaucaggacuacauuccugagacugaucaagacugcucaaugucccccuguccacagcggaccccugauaguggccucgcgcagcaucccuuccagaaugaagacuauaggccacgcucugccagcccguccagaacacacguucuaggcgggaaccaauggaggacggggccuuggggagcaugcucaucuaccugcgcuggaggcagccagcggcguguggucgugugucaggaugagaaugguuacacugccaacgacugcguugaacgcaucaagcccgaugagcagcgagccugugaaagugggccaugcccccaaugggcuuauggaaacuggggcgaguguacaaaacuuugcggcgggggaauaagaaccagguugguggucugucagcgguccaauggugagcgcuuuccugaccugagcugcgaaauuuuagauaagccacccgacagagagcaguguaacacucaugcaugcccucacgaugccgcguggucuacaggcccguggucauccuguaguguaagcugcgggaggggacacaaacaacggaauguguacuguauggcuaaggacggcucgcaucucgaaucugacuacugcaaacaccuggccaagccacauggucaccgaaagugcagagggggacgcugucccaaauggaaggcaggcgccuggucccagugcagcguuucauguggcagaggggugcagcagcggcaugucggaugccaaaucgguacccacaaaauugcucgugagacggaauguaacccuuauacuagacccgagagugagagggauugccagggcccacgcuguccucuuuacaccuggcgggcagaagaguggcaggaaugcacaaagaccuguggggagggaucucgauauagaaaagugguaugcguggacgauaauaagaacgagguccacggcgccaggugugacguuuccaaacgccccguggaucgggaaagcugcucacugcagccaugcgaguacguguggaucacuggugaauggagugaguguagcgucacaugcgggaagggauauaagcaaagauugguguccuguucugaaauauacaccggcaaagagaauuaugaguacagcuaccagacaacuaucaacugcccuggcacccagccgcccuccguucauccauguuaucuccgugacugcccuguaucagcgacguggaggguggggaauuggggaucuuguagugucucgugcggugugggcguuaugcagcggagcgugcaaugucugacaaacgaagaucagcccucccaccuaugccauaccgaccugaagccagaggaacgcaaaacuugucgaaaugucuacaacugcgagcucccucagaauugcaaggaagugaaaagacugaagggggcuucugaggauggagaguauuuccuuaugauuaggggcaaguugcugaaaaucuuuugugccgguaugcacucagaccaccccaaggaauacguaaccuuaguccauggggauagcgagaacuucuccgaaguguauggacaccggcuccauaauccgacagagugcccauacaacggcagucgcagagacgauugucaaugcaggaaagacuauacugcagccggcuucucuagcuuucagaagauucgaaucgaccugaccucaaugcagauaauuacgacagaucuucaguucgcucggaccuccgaagggcacccuguucccuuugccacugcaggagacuguuacagugcugccaaaugcccacaaggucguuucagcaucaaucuguacggcacagggcuaucucucaccgaguccgcgagauggaucucacagggaaacuaugccgugagcgauauuaagaagucgcccgacggcacucgcgucguggguaaaugugggggauacugcggcaaguguacaccuucuaguggcaccgggcuggagguuaggguguuguga

SEQ ID NO: 52454 - RNA, 5289 nt, Artificial Sequence
  derived and/or modified sequence opt3 from ADAMTSL1__Homo_sapiens__NP_001035362
auggagugcuguagaagggccacccccggcacacugcuccuuuuccuggcuuuuuuguuacugagcucccggacugcacgcucugaagaggaccgagaugggcuaugggacgccuggggaccuuggucagaaugcagucguacgugugguggcggggcgagcuacucccucagaaggugccugucuucgaagucaugugagggacggaacauccgcuauagaaccugcagcaauguggauuguccaccggaagcuggcgacuucagggcccagcaaugcagugcacacaacgaugucaaacaucacggucaguuuuacgaguggcuucccguuuccaaugacccugauaacccauguucucugaagugccaggccaaagggacaacuuuggugguagagcucgcucccaaggugcuggacggaacccgguguuauacagaaagccuggauaugugcauuuccggccucugccagauagucggcugugaccaucaauuagggucaaccgugaaagaggauaauugcggaguuuguaacggugacggcaguacuugccgccuggugcgagggcaguacaagagccagcuuucugcaacaaaguccgaugacaccgucguggccaucccuuauggaucaagacacauuagguugguacugaaaggcccagaccaucuauaccucgaaacgaagacucugcaggguaccaaaggggagaauagccuuaguucuacaggaacuuuccugguugauaacuccagcguggacuuucaaaaguuccccgauaaagagaucuugcggauggcuggcccucucaccgccgacuuuauugucaagauccguaauucgggcucugcggauuccacagugcaguucauauuuuaucagccaaucauucaccgcuggagagaaaccgacuucuuuccguguucagcaacgugcgggggagguuaccagcugacuagugccgaguguuacgauuuaaggagcaaccggguggucgcugaccaauauugccacuacuaucccgaaaauaucaagccuaaaccaaagcugcaggaguguaaccucgaucccugcccugccuccgacggcuacaaacagauuaugccauaugaucuuuaccauccccugccgcgaugggaagcaacaccuuggaccgcuuguucuagcucaugcgggggaggcauccaaagucgcgccguuuccugcguggaggaggacauacagggucacguaacuagcguggaagaguggaaguguauguauacacccaaaaugccaauugcgcagccuugcaauaucuucgacugucccaagugguuggcccaggaauggucuccaugcaccgucacgugugggcaaggccuaagauacagggugguucugugcauugaucaucggggaaugcacaccggcggguguucacccaaaacaaagccucacaucaaggaggaaugcaucgugccaacuccguguuacaaacccaaggagaaacucccugucgaggcaaagcugccaugguuuaaacaggcucaggaacuugaggaaggagccgcugugagugaggaacccagcuucauuccugaggccugguccgcaugcaccguaacaugugguguuggcacucaggugcgcauagucagaugccaagugcuguugucuuucucgcagagcgucgccgaccucccaaucgaugagugcgaagggcccaagccggcuucccagagggcguguuaugcaggaccuugcucaggcgagauuccagaauuuaaccccgacgagaccgauggucuguucgggggcuuacaggacuuugaugagcuguacgacugggaauaugagggauucacaaaguguagugaaucuugcggcgggggagugcaagaggccguugugagcugucuaaauaaacagacccgugaaccugcugaggagaaccucugcguaacuucccggcgacccccacagcugcuuaagucauguaacuuggauccuugccccgccagaugggaaaucgguaaauggagcccauguucucugacgugcggcgucgggcuccagacaagggacguguuuuguucccaucugcuuagucgcgagaugaaugaaaccguuauacuggcagaugaguugugccggcaaccgaagccuagcacugugcaggccugcaacagauucaauugucccccagcuugguaccccgcccaguggcaaccuugcucuaggaccuguggaggcgguguccagaaacgcgaagugcucugcaagcagcgaauggcagacggguccuuucuggaguuaccagagacauucuguucagcgaguaagcccgcuugccagcaagccuguaaaaaggaugacugcccuagcgaauggcugcuaucggacuggaccgaguguuccacuucuugcggcgaaggaacacagacgcggagcgcaauuugucguaaaaugcucaagaccggccugucaacuguagugaacaguacacuuugcccgccauugcccuuuuccucuagcaucagaccuugcaugcuggccaccugugcuaggccagggcgccccuccacaaaacacucaccucauaucgccgcagcucggaagguuuauauucagacuagaaggcagcgaaagcuccacuucgucgugggaggcuuugccuaccuguuaccgaaaaccgcggugguccugcgcugccccgcccggagaguuaggaagccacuuaucacgugggagaaagauggucaacauuugauuagcaguacccacgugacaguggcuccuuucggguaucucaagauacaccgucugaaacccucugacgcaggaguauacacuuguuccgccggcccagcucgcgaacauuuugucaucaagcuaauugguggcaaucggaaacugguggccagaccucucagccccaggucggaggaggaaguucuggcagggcgaaagggaggcccaaaggaggcgcuucagacccacaaacaucagaacgggaucuucucaaauggaucuaaggccgaaaaacggggcuuggcugccaacccggguagucgcuacgaugaccugguguccagauuacucgagcaggggggauggccuggcgagcugcuugcaagcugggaagcucaagauucugccgagaggaauacaacuagcgaagaggaccccggugcagaacagguccuguugcaccucccauucaccauggugacggagcagcggcgacuggaugacauccuaggcaaccugucccaacagcccgaggaacucagagaucuguauucaaagcaccuuguugcccaguuggcucaggagauuuuucgcagucaucuggaacaccaagacacauuacucaaaccuagcgagaggcguaccucuccagugacucuguccccccauaagcacguaucaggguucaguagcucccuucggacaucuucgaccggagaugcgggcgggggaagcagaaggccucaucgcaagccgacuauacugcgaaaaaucucagccgcacagcagcuauccgcuagugaagucgugacccaccucggccagacaguggcccuggccucugguacguugagcguccuguuacacugcgaggcuauugggcauccaagacccaccaucuccugggcacggaauggagaggaaguucaauuuucagacaggauucuccugcagccugaugacucucuucagauccuggcccccguggaggcggacguaggcuucuacacuuguaacgcuacaaaugccuuggguuaugauagcgugaguauagcagucacccucgccggcaagccacuggugaaaacaucccgcaugacuguuaucaacaccgaaaagccugcugugacggucgacauugggagcacaaucaaaaccgugcagggaguuaaugugacuauuaacugccaagucgcaggcguacccgaggccgaagugaccugguuucguaacaagucuaagcuagggucaccacaccaucugcacgagggaucccuucuccugacaaauguuaguagcucggaucagggcuuguacucuuguagagcggcuaaccugcauggugaguuaacugaauccacccagcuccugauccuugacccuccgcaggugcccacacaacuggaggauauacgggccuugcucgcagccacggggccaaaucugccuagcguccuaaccucaccccugggaacucagcuugugcucgacccaggcaacagugcucuguugggcugcccuauuaaagggcaccccguaccgaauaucacaugguuccacggaggucagccaauugugaccgccacuggcuuaacacaucacauccuggcagcugggcaaauacuccaggucgccaaccugucuggaggcucccagggugaauuuagcugucuugcgcagaaugaggccgggguucugaugcaaaaggcaucauuggugauccaggauuauugguggaguguggacaggcuagcuaccugcagcgccuccuguggaaaccgcggcguccagcagccucgacugagaugccuccugaauucuacggaggugaaccccgcucauugcgcaggcaaaguucggccagccguacaacccauugccuguaauaggcgcgauugcccuagcagauggauggugacuuccuggucagcuuguaccaggucuugcgggggagguguccagacacggcgugugaccugucagaagcuuaaagcgaguggcaucucgacuccgguuagcaacgacaugugcacacagguggcaaagcgccccgucgauacccaagccuguaaucagcaguuaugcguggaaugggcuuucuccucuugggggcaauguaacggaccaugcauuggcccucaccuggccguacagcaccgacaggucuuuugucagacaagagacgguaucacucuccccucagagcaaugcagcgcauugccuaggccaguguccacccagaauuguuggagugaagccugcucuguucauuggcgggugagccuguggacgcucugcacagcuaccugugggaacuacggauuccagucacgcagagucgagugcgugcacgcgaggacuaacaaggccguucccgaacaucuguguuccuggggcccucggccagcaaauuggcagcgaugcaacauaacccccugugagaauauggagugcagagacacaacucgcuauugugaaaaagugaagcaacuuaaacugugccaguugagucaguuuaagagcagguguugcggcaccugugggaaagcuuga

SEQ ID NO: 52455 - RNA, 2856 nt, Artificial Sequence
  derived and/or modified sequence opt3 from ADAMTSL2__Homo_sapiens__NP_001138792
auggacggcagauggcagugcagcuguugggccugguuccugcucgugcuugcugucguugcaggggauaccguguccacaggaucuacugacaacucacccacgaguaauagccuggaggguggcaccgaugccacagcguuuugguggggagaauggacuaaguggaccgcuugcuccaggucuugugggggcgguguaacaucgcaagagcggcacugcuugcagcagcgccgaaaaucagugccugggccaggaaaccguaccuguacuggcacaagcaagagauaccaguuaugcaggguccaagaauguccgcccgacggccggaguuuccgcgaggaacagugcguguccuuuaauucucauguuuauaacgggagaacccaccaguggaaaccucuguacccagaugacuaugugcauaucagcuccaagcccugugaucuacacugcacgacugucgacggacagaggcaacucauggugccugcccgggaugguaccucauguaaacugacagaccuucgcggcguaugcguuagugggaagugcgagccaauuggaugugauggcgugcuguucagcacucauaccuuggacaagugcgguauaugucagggggauggaucuuccugcacacacgucaccggcaauuaccgaaaaggcaacgcacaccucggguauucacuggugacgcauauccccgccggagcuagagacauucagaucguggagaggaagaaaagcgcagacguccuggcccucgcugaugaagccgguuacuauuucuucaauggcaacuacaagguugacaguccuaaaaauuuuaacauugcggggacugugguaaaguaccggcguccaauggauguguaugagacaggaaucgaauacauagucgcacagggcccgaccaaucaagguuuaaacgugaugguuuggaaucagaacgggaagucucccuccaucacuuucgaguauacacugcuucagccuccacacgagagccgcccccaaccuauuuacuauggcuuuucggaaucugccgagucccagggauuggacggcgcugggcugaugggauucgugccacauaaugguucacuauacggccaggccaguagcgaaagacucgggcuggauaacaggcuuuuuggacaccccggccuggacauggaguuggguccgucccaggggcaagaaaccaacgaggucugugagcaggcaggcggaggcgcuugcgaagggccuccccggggaaaagguuuccgagaucgcaaugugacgggcaccccacucacaggggacaaggaugacgaggaaguagauacucacuuugccucucaggaguucuucagcgcgaacgccaucucagaccagcuguuaggagcaggcagugaccugaaagauuuuacccucaaugaaacaguuaacuccauuuucgcucaaggugccccuagaagcucucuugcugagucauuuuucguggacuaugaggaaaaugagggggccggccccuaccuguugaacggaaguuaccuagaacugagcuccgauagggucgcaaauucuucgagcgaggccccauuucccaacguguccacuucacuccugaccagugcuggcaaucggacacauaaggcgcgcaccagaccuaaagcaaggaagcagggggucucuccagccgacauguaucguuggaaacuuagcucccacgaaccguguucagcuacuugcacgacaggagugaugagcgccuacgcaauguguguucgguaugauggcguggagguagacgauucuuacugcgacgcccugacccgacccgagccuguccaugaauuuugugcugguagagagugccagccaaggugggaaacuuccaguuggagcgagugcucucgcaccuguggggagggauaucaguuucgggugguuagaugcuggaagauguugucccccggcuucgauucaaguguguacagcgaccucugugaagccgcagaggcggucaggccugaggaacgcaagacaugccgaaacccagcuugugguccccaaugggaaaugucggagugguccgagugcaccgccaaauguggcgaacggucugugguaacucgugauaucagaugcagcgaggacgaaaagcugugugauccgaauacaaggccugugggggagaaaaacugcacgggaccacccugugaccgccaguggaccguuucagacuggggcccuugcaguggguccugcggacagggccggacuauaagacacgucuauuguaagacaucugaugguaggguggugcccgaaagccagugccaaauggagaccaaaccauuagcaauucauccuuguggggacaagaauugccccgcccacuggcuggcucaggauugggagcgauguaacacaacuugcggacgcggcgucaagaaacggcuaguucucuguauggaacuggccaaugguaagccacagaccagauccggcccggagugcgggcuugcuaaaaagccucccgaagagucaacguguuuugaaaggccaugcuucaaaugguacaccagccccuggagugaguguacaaagacuugcggagugggcgugcguaugcgcgacguaaagugcuaccaagggaccgauaucguccggggaugugacccuuuggugaaaccaguuggcagacaggcaugcgaucugcagcccuguccuacagagccgccagacgauucuugccaggaccaacccgguacuaacugugcccucgcgauuaaggugaaccugugcgggcacugguauuacuccaaagccuguugcaggagcugucgaccuccacauucguga

SEQ ID NO: 52456 - RNA, 5076 nt, Artificial Sequence
  derived and/or modified sequence opt3 from ADAMTSL3__Homo_sapiens__NP_997400
auggccagcuggaccucccccuggugggugcugaucggcauggucuucaugcacucuccucucccacagacaacugcugagaagucaccgggggcauacuuucuucccgaauucgcccugaguccucaaggaagcuuuuuggaggacacgaccggugaacaguucuuaacauauagauacgaugaccagacuuccaggaacacccggucugaugaggacaaagauggcaauugggacgcguggggggauuggucggacugcucacgcacauguggaggcggugcuagcuauagucugcgacguugccuaaccgggagaaacugugaaggacagaauauuagguacaagacuugcuccaaccaugauuguccacccgacgccgaggauuuucgggcacaacagugcucugccuauaaugacguucaguaccagggccacuauuacgaguggcucccucgcuacaacgauccagcugcacccugugcccugaaaugccaugcucaaggccagaaucuugugguagaacuggccccuaagguguuggacgggacaagauguaacaccgacagccucgauaugugcauauccggaaucugucaggcggucgguugcgacaggcagcugggcucaaaugcaaaagaggauaacugcggggugugugccggagacggcaguacgugccggcugguucgcggucaaagcaagucucacguguccccagaaaagcgagaggagaaugucauugcugugccgcucgggucaagaagcguaaggaucacuguuaaaggacccgcccauuuauucauugaaaguaagacccugcagggcucuaaaggcgagcacuccuuuaacagcccugggguguuccuugucgaaaauacaacuguggaguuucagcggggaucggaacgucaaaccuucaagaucccaggucccuugauggcagauuuuauauucaaaacacgcuauaccgcugccaaggacucugugguccaguuuuucuucuaccagccuaucucccaccaguggagacaaacggauuuuuucccauguacuguuacaugcggcgggggauaucagcugaacucagcggaguguguggacauuaggcuaaagcggguagugcccgaucauuacugccacuauuacccggagaaugucaaaccuaagcccaaacucaaggaauguaguauggacccaugcccuagcuccgauggcuuuaaagagaucaugcccuaugaccauuuccagccacugccccgaugggaacacaacccuuggaccgccuguucugugagcugcggugggggcauucagcgcagaucauuuguuuguguggaggaaaguaugcacggagagauccuucaagucgaggaauggaagugcauguacgcaccaaaaccgaaggugaugcagacuugcaaccuguucgacugucccaaguggauagcuauggaguggucccagugcacaguaaccuguggcaggggguugcgguaccgcguugugcucugcauuaaucauagaggagaacacgucgguggcuguaacccucagcugaaauuacauaucaaggaggaaugcgugauuccaauccccuguuauaaaccuaaggagaaaagcccagucgaggccaagcugcccuggcucaagcaagcucaggaacuugaggaaacgaggaucgccaccgaggagccgacauuuauuccugaaccauggucugcaugcucaacuaccugugggcccggagugcagguucgugaggugaaaugccggguacuguugacauucacucagaccgaaacagagcuaccugaagaggagugugaaggccccaagcugccaaccgagcgaccuugccuccuggaagccugcgaugagagucccgcuagcagagaacuugacauaccacugccggaggauuccgagacuacguacgacugggaauaugcggguuuuacaccuuguaccgcaacuugcgucgggggccaccaagaggccaucgcuguguguuugcauauucagacccagcaaacaguuaaugauucucucugcgacauggugcacaggcccccagccaugucgcaggcauguaacaccgaacccugcccuccacgcuggcacgucggaagcuggggccccuguuccgccacuugcggggugggaauccagacacgggauguauacugucugcauccuggugagacgccggcuccacccgaagagugcagagacgagaaaccucacgccuuacaggcauguaaucaauucgauugcccacccggcuggcauauagaagaguggcagcagugcucaaggaccugugggggaggcacucagaaccgccgagugacaugccggcaacugcuaaccgacgguaguuuucucaaucugucugaugaacuuugucaggggccuaaggcgagcucccacaaaucaugcgcucguacagacuguccgccccacuuggccguuggcgauuggagcaagugcucugucuccuguggagugggcauucagagaaggaagcaggugugccaacgccuggcagccaaagggcggagaaucccacucagugagaugauguguagggaccugccuggacuuccccugguccgaagcugccagaugccagaguguucuaagaucaaauccgaaaugaagacuaaauugggcgagcaggguccucaaauucucucaguucagcgcguguauauccagacccgggaagagaagagaauuaaccugacgauagggaguagggcuuacuuacugcccaauaccagcgugaucauuaagugcccaguacgucgcuuccagaaaucgcuaauccaaugggaaaaggacggacggugccuccagaacuccaaaagacugggcaucacaaagucugguagccuuaaaauucauggcuuggccgcaccggauauaggggucuauagguguaucgcuggaucagcccaggagacugugguucugaagcucauuggcaccgacaaucgacugaucgcgcggccugccuuacgcgagcccaugagagaauacccagggauggaucacagugaggcuaacucccugggagugacauggcauaaaaugaggcagauguggaauaacaagaaugaccuuuacuuggaugacgaucacauuucuaaccaacccuuucuccgggcacugcuaggccauugcagcaacuccgccgguucaacuaauagcugggaacugaagaacaaacaguucgaggcugccgucaagcagggggcauauaguauggacaccgcgcaguucgaugaacucauccgaaauaugucucaacugauggagacgggagagguguccgacgaucuugccagccaguugauauaccagcugguugcugaauuagccaaagcacagccuacacacaugcaauggagaggcauccaggaggaaaccccacccgcugcccagcuccgcggugagacuggcucggugucacaaucuagucacgcaaagaacuccgggaaacugacauuuaagccuaagggaccgguacuuaugaggcagagccagccacccucuauuagcuucaauaaaaccaucaacucccguauuggcaauacugucuauaucaccaagcggacagaagugauaaacauucugugugacuugaucacgccuucagaggccaccuacacuuggacaaaagaugggacccuccugcagcccagugugaagauuauccuagacggaacaggcaaaauacaaauccagaauccaacuagaaaggagcaggguauuuaugaaugcagcgucgcuaaccaucuggggucugacguugaguccucaagugugcucuacgcggaagccccuguaauccugagcguggagaggaauauuaccaagcccgagcacaaccaucuuuccgucgugguuggaggcaucguggaagcagcuuugggugccaaugucacgauacgcuguccagugaaaggcguuccucagccgaacauuacauggcugaagcgagggggaucuuuaucgggcaaugugagccuccuguuuaacgggucacuucugcuacaaaacgucucccucgagaaugaaggaaccuauguaugcaucgccacuaacgcucugggcaaagcaguggccaccaguguuuugcaccuguuagagagacgguggcccgaaucuaggaucguguuccuccagggucauaagaaauacauucugcaggcgacaaauacucgcaccaacagcaaugauccaacaggggagccucccccacaggagccuuuuugggaacccggaaacuggucccacuguucagcuacgugcggccaccuuggcgcccguauccaaagaccgcagugugucauggcaaaugggcaggaggugucugaagcccugugcgaccauuugcaaaagccacucgcuggauucgagccuuguaacauucgggauugccccgcaaggugguuuaccagcguauggagucagugcuccgugagcuguggugaaggcuaccacucucgccaggucacuugcaagcgaacaaaagccaaugggaccguucagguggugucaccaagagcgugugcucccaaggaccggccucugggaaggaaaccgugcuucggccaucccuguguccaaugggagccagguaaccgcugcccugggagauguaugggaagggccgugcggaugcagcagcgucacacugcaugccagcacaauuccagugauagcaacugugacgaucgcaagcgacccacacuaagaaggaauugcaccucgggcgccugugacguuugcuggcauacgggcccuuggaaaccauguacugcugccugcgggcggggauuucaaucucgcaagguagauugcauacacaccagauccuguaaacccguggcaaagaggcauugcguccagaagaaaaagccuaucagcuggcggcacugucuggguccaucaugcgaccgagauuguacagacaccacucauuauugcauguucgugaaacaccuuaaccucuguagucuggacagauacaagcagcgcugcugucagucuugccaagagggcuga

SEQ ID NO: 52457 - RNA, 3393 nt, Artificial Sequence
  derived and/or modified sequence opt3 from ADAMTSL4__Homo_sapiens__XP_011507946
augcuggcccccagaagggcuccuagcaccccacggugccuccgcuccuucugugaccagucugcaccggccucacccuggggcagucgagggggagcgauggagaacuggacaggucguccuuggcuuuaccuguuguuacugcuaagccucccacaacugugccuugaucaggaagugcuguccggccacucuuugcagacucccacggaggaagggcagggaccugagggcgucugggguccauggguucaaugggcuucguguucacagcccugcggggugggaguacagagaaggagccggaccugucagcucccuacagugcaacugcauccaagucugccguuacccccucgcccacccagacacccugaagcccuccugccaaggggccagggcccccggccgcagacuuccccugagacccuucccuuguaucgcacacagucucgagggagaggagguccacugaggggcccugcaagccaucuagggcgggaggaaacccaagagauccgugccgcucgcagauccaggcuccgggaccccauuaagccaggaauguuuggcuacggucgaguccccuucgcacugccucuucaccgcaauagaaggcauccacggucaccgccccgcagugaacugagcuugauaucuuccagaggggaggaggccaucccuucaccaacucccagggcugaaccuuuuagcgccaacggaaguccacagacagagcugcccccgaccgaacucucugugcacacgccuuccccacaggcggagcccuuaagcccugaaacugcacaaaccgagguugcaccccguacacggccagcuccucugcgacaccaucccagagcccaggcaucgggcacugagccaccgucuccuacccacucccucggcgaagggggauucuuuagggcuucaccccagccacgccggcccaguagccaggguugggccuccccucaaguggcgggcagaaggccagaucccuucccuucugucccgcgcgggcgaggacagcagggccaggguccaugggggacaggcggaacgccccauggcccucggcuugagccagacccccaacacccuggggccuggcugccguugcuaagcaauggaccccacgcaucaagucuguggucccucuuugcuccaagcucuccuauuccccguugcucaggugaaagugagcagcugagagccuguagccaggcuccaugcccucccgaacagccagauccgagggcccuucaaugugcagccuucaacucccaggaguuuaugggccagcuguaucagugggagccuuucaccgaagcucccuugcucccacugcgccaugcguuuuucuuacugcccggggcaggaucuggcgacucgacuggugugcaagggagccagcggugcgagcuaaauuguagaccuaggggcuuucgauucuacguacgccacacagaaaaaguucaggauggaacccucugccaaccaggcgcccccgacaucugcguggcugggcggugucuguccccuggaugcgaugguauucuuggcucagggagaaggccggacggauguggcgucugcgguggggaugacaguacuugucguuuggugucuggcaaccugacagaucgcggaggcccacucggguaucagaagauccuguggauacccgccggagcacuucggcugcagaucgcccaguugagaccuagcuccaauuaccucgcucugaggggccccggugggcgaucaauuaucaacggaaauugggccguggacccaccuggcagcuaucgggccgguggcaccgucuuccgcuacaacagacccccaagggaggaagggaaaggagagucuuuauccgcggagggcccuacgacccaaccgguugacguguacaugauuuuucaggaagagaaucccgggguauucuaucaguacgugaucaguagcccaccucccauacuggaaaacccaacaccugagcccccggucccacagcuacaaccugagauucuccggguggaacccccacuggcucccgccccucgaccggcaagaacucccggaacccuucagcgccagguuaggaucccacagaugccugcucccccucauccacguacacccuugggcucuccugccgccuauuggaagcgggugggucacuccgcaugcucagcuaguugugggaaaggagucuggagaccaauuuuucugugcaucagcagggagucgggcgaggaacucgaugaacgcuccugugccgcgggugcccgacccccggcuucuccugagccaugccauggcacucccuguccuccauacugggaggcaggggaauggaccagcugcucaagaaguugcggacccggcacacaacaccggcagcugcaguguaggcaagaguucgggggaggcgguuccucugugccgccugaacgcugcgggcacuuaccccguccaaauaucacccagagcugucagcugagacuuugcggacauugggagguaggcuccccuuggucacaguguagcguucggugcgguaggggccaacgcagucgacaggugagaugugucgggaacaauggagacgaagugucugagcaggagugcgccuccgggcccccacagcccccuagccgggaggcuugugauaugggcccaugcacuacggccugguuucacucggacuggucaucuaaguguagugcagaaugcggaacaggcauucaaaggcgcuccgucgugugcuuggguagcggggcggcccucggaccgggccagggcgaagcuggggccggaaccggucagucuugucccacuggcagcagaccuccagauaugagggcaugcucccuggggcccugugagcggaccuggcguugguauacaggaccuuggggcgaaugcucaagugagugugguagcgggacccagcgccgagacauaaucugcguuucuaagcuaggaacugaguucaacgugacauccccaucaaacuguagucaucugcccagaccuccggcucuccaaccaugccagggccaggccugucaggauaggugguuuagcacgcccugguccccuugcucucggucgugucaaggcgggacccagacucgcgaaguacagugccugagcacaaaucaaacccuuucaacaagaugucccccacaguugaggccuucccggaaacgacccugcaacagucagccaugcucucagagaccggacgaucaauguaaggacagcuccccucacugcccccuggucgugcaggcacgcuuauguguuuacccauauuacacugcuaccugcuguaggucaugcgcccacgugcucgagcggucuccccaggauccuagcuga

SEQ ID NO: 52458 - RNA, 1416 nt, Artificial Sequence
  derived and/or modified sequence opt3 from ADAMTSL5__Homo_sapiens__NP_998769
auggacagcgccccucuguucccuagaccacaccucuuucagaaccuucuguuguucuuaugggcucugcuaaauugcggccucgggguguccgcacaaggaccgggugaguggacccccugggucucuuggacaagguguucaaguagcugcggccgcgggguuuccgugcggucucgacguugucugagacuuccuggagaggaaccaugcuggggcgauucgcaugaauacaggcugugucaguugcccgacugcccuccaggugccguacccuuucgggaucuccagugugcgcuguauaacgggcgcccugugcugggaacucagaagacguaccaaugggucccauuccacggcgcuccgaaucagugcgaccucaacuguuuagccgagggccaugcauuuuaucacucauucgggagagugcuggauggaaccgccugcagccccggugcucagggcguuuguguggcagggaggugccuuagugccggaugcgacggcuugcuggguuccggggcucuagaagaucgguguggacgcugcggcggcgccaaugacucuugucucuuuguccagcgaguguucagagaugcgggggcauuugccggauacuggaacguaacacugaucccugagggugcuaggcauauucggguugagcaccguagccgcaaucaccuugcccugaugggcggggacggaagauauguguugaacggccauugggucguguccccacccgguacuuacgaagcagcugggacccacguggucuauacaagggauaccggcccucaagagacucuccaggccgcgggaccaacaucacaugaccuguuacugcagguucuccuucaggaacccaauccgggcauagaguucgaguuuuggcugccucgggaacgauacagucccuuccaagcccgcgugcaggcauugggguggccacuaagacagccucaacccaggggaguagagccacagcccccugcugccccagcugugaccccggcccagacgcccacucuggcaccugauccaugucccccuugcccagacacccggggucgcgcccacagacuccugcacuacugcggcagcgacuuugucuuccaggcuagggugcuugggcaucaccaucaagcgcaggaaacacguuaugagguucggauccagcugguguacaaaaaccgaucucccuugagagcaagggaauaugucugggccccgggacacuguccuugcccaaugcucgcuccccaucgcgauuaccugauggccgugcagcgguuaguauccccugacggcacucaagaucagcugcuacucccccacgcagguuaugccagaccauggucacccgcugaggacagcaggauucgccugaccgcccgacggugucccggguga

SEQ ID NO: 52459 - RNA, 1158 nt, Artificial Sequence
  derived and/or modified sequence opt3 from ADAP1__Homo_sapiens__NP_001271237
auguuccaguuuguguucagcagagucuacugcaucaaccccgccaggcggaaguggaaagaguuugaaaagaugcugggcugugcugaggaagggcacgcaucccucggacgcgacccugauugggccucuuauacccuugguguuuucauuugccugucauguaguggcauacaucgaaauaucccacaagugagcaaaguaaaguccgugcguuuggacgcgugggaggaagcucaggucgaguuuauggccucucacgggaacgaugcagccagagcuagguucgagucgaaagugccgucauuuuacuaucggcccacaccuagcgacugccaguuacugcgcgaacaguggauuagagcaaaguacgagaggcaagaguucaucuauccagaaaagcaggagcccuacagugccggauaucgggaaggcuuucuauggaaacgcggucgagauaaugggcaguuccucuccagaaaguuuguucugacugagagggaaggagcucuuaaauacuucaaccggaaugacgccaaggagccuaaagcggugaugaagauugaacaucugaacgcaacguuucagccagccaagaucggccacccccauggcuugcaagucaccuaccucaaagauaauucuacacguaacauauucaucuaucacgaggacgggaaggagauuguggauugguucaaugcucugcgcgccgcaagauuucacuaccugcagguagcuuucccuggagccagcgacgcggaucucguuccaaaauuauccaggaacuaucugaaggaagguuacauggagaaaacuggcccgaagcagaccgaaggguuucggaaacgaugguucacaauggacgaucgcagacuuauguauuuuaaggaccccuuggacgccuucgcaaggggagagguguuuaucggcucaaaggaaagugguuacaccguccugcauggguucccuccaagcacucagggacaccauuggccccacggcauuacaaucgugaccccugaucggaaauuucuauucgcuugugagacggagucugaccaacgcgaauggguggccgcuuuucagaaggccgucgauagaccaaugcucccccaggaguaugcaguugaagcccacuucaaacauaagccguga

SEQ ID NO: 52460 - RNA, 1146 nt, Artificial Sequence
  derived and/or modified sequence opt3 from ADAP2__Homo_sapiens__NP_060874
augggcgacagagagaggaacaagaaacggcugcucgaacuucugcgcgcccccgauaccgggaaugcucacugcgcagacuguggagccgcggauccugacugggcuagcuacaaguuggguaucuucauuugcuuaaacuguugcggcgugcaucgaaauuuuccagauauaucccgugucaaaucuguuagacuggacuucugggaugacucaaucguggaguuuaugauucacaacgggaaucuaaggguaaaggccaaauucgaagcacgggugccggccuuuuauuacaucccccaggcuaacgauugucucguccugaaggagcaauggauucgcgcaaaguaugaaagaagggaguucauggccgacggagagacaaucagucuuccuggcaaucgggaagguuuucuguggaaacgcgggcgagauaacagccaguucuugagaaggaaguuugugcuccuggcucgggagggacugcucaaauacuucacuaaggaacagggcaaauccccaaaggccguuauaucuaucaaggacuuaaaugcgacguuucagaccgagaaaauuggccauccccacgggcugcaaaucacauaucgucgcgauggacauacuagaaaccuuuucguguaccacgagucggguaaggaaauugucgacugguuuaaugcauugagggccgcucggcugcaguaucuaaaaauggccuucccugagcucccagaaucagagcuggugcccuuccuuacccgaaacuaccugaagcagggcuuuauggagaaaacagggccuaagcagaaagaaccauucaagaagcgcugguuugcauuggacugccacgagagaaggcuccuguacuauaaaaauccguuagaugcuuucgaacaaggacagguauuucugggcaacaaggagcaggguuacgaagccuaugaggaccuccccaaagggauccggggaaaucgcuggaaggcgggccuuaccauaguuacuccugaaagaagguucgugcugacauguccaagcgagaaagagcagcaagaaugguuggagagucuacguggcguccuguccucuccccucaccccucugaaccggcuuacggccagcacugaauccgggcgaucaaguagauga

SEQ ID NO: 52461 - RNA, 2145 nt, Artificial Sequence
  derived and/or modified sequence opt3 from ADARB1__Homo_sapiens__NP_056649
auggacaucgaggaugaagagaacaugagcuccucuucaaccgacgugaaggaaaauagaaaccuggauaaugucagucccaaagacggcagcacaccugggccaggagaggguucccagcucucuaacggcgggggaggcgguccggggaggaagcggccccuugaagagggaucgaauggccacucaaaauaccgccugaagaaacgacguaagacuccuggcccaguuuugcccaagaacgccuuaaugcaacugaaugagauuaaaccugggcuacaguauacgcuccugagccagaccggaccagugcaugcuccccuuuucguaaugaguguggaagucaacggucagguguuugagggcuccgggccuacaaagaaaaaggcaaaacugcacgccgcggaaaaggcuuugagaucuuucguucaauuuccaaaugccagcgaggcacaucucgccaugggaaggacucuguccgugaacaccgauuucacaucagaccaggcugauuuuccggacacccuguucaauggcuuugagacucccgauaaggcagaaccuccauucuacgucgguaguaacggggacgauagcuuuucuuccucaggagaccucagcuuaagugccucucccgugccugcuucccuggcccagccaccccuuccgguauugccucccuucccaccucccagcggcaaaaauccaguuaugauacugaacgagcuacggcccggccucaaguaugauuuucugucggaaucuggggagucccacgcgaaaucauucgugaugagugucgugguggacggacaguuuuucgaagguagcggccgcaauaagaaacuugcaaaggccagagcugcccaauccgcacuggcugccaucuucaacuugcaucucgaccagacaccuucuaggcagccaauuccgagcgaggggcugcaguuacaucugccccaaguccucgcggaugccguuucacggcuugugcugggaaaauuuggcgacuugaccgauaacuucaguuccccucacgcacgccgaaagguacuagcugguguggucaugacgacugggaccgacgugaaggaugccaaaguuaucagcgugucuacaggcacuaagugcauuaauggagaguacaugucagacagaggccuggcucucaacgauugucacgccgaaaucauaaguaggcggagccugcuucguuuucuguauacccaguuggagcucuaccugaauaacaaagacgaucagaagcgcuccaucuuccaaaaaucugaaagagggggauuuagguuaaaggagaauguccaguuccaccuguauauuucgacaagcccaugcggugacgcacggaucuuuucaccccaugaaccuauucuagagggcucccgaaguuacacccaggccggggugcagugguguaaccacggaucucuccaaccaagacccccgggccugcuuagcgauccuuccacgucaacuuuccagggugcugggacaaccgagccagcggaccgccaccccaauaggaaggcacggggccaguugcgcacuaaaaucgaaagcggagagggcacaauaccuguaagaucuaacgccuccauucagaccugggacgggguucugcaaggagaaaggcuccugacgaugaguugcagcgauaagaucgcucguuggaauguggucgguauucagggcucucuucuguccaucuuuguggagcccaucuacuucucaaguauuauauuggggagccucuaucauggagaccaccugucgcgggccauguaccagcgaaucuccaacauugaagauuuaccaccucuguauacccuaaauaaaccccuccugucuggcaucagcaacgcagaggccagacagccagguaaggcuccgaauuuuucagucaacuggacagugggggacagugccauagagguuauuaaugcaacuaccggcaaagaugaacuuggaagggcgucccgcuuguguaagcaugcucuguacugccgguggaugagagugcacggcaagguaccuucucaucuccugaggagcaaaaucacaaagcccaacgucuaucacgaguccaaauuagccgcaaaggaauaccaagccgcuaaagugcacuga

SEQ ID NO: 52462 - RNA, 2220 nt, Artificial Sequence
  derived and/or modified sequence opt3 from ADARB2__Homo_sapiens__NP_061172
auggccagcgugcugggcuccgggagaggaucugguggccucucaagucagcuuaagugcaaaagcaagaggcggcgccgacguagauccaaaaggaaggacaaagucucuauccugucgaccuucuuggcucccuuuaagcacuuaucaccugggauuacaaacacugaggaugacgauacgcugagcaccaguuccgcagaaguuaaggagaaucggaacgugggaaaucuagccgcgcgcccaccgcccucuggcgacagagcuagggguggggccccuggagcaaaacggaagcgcccacucgaagagggcaacggcgggcaucuguguaaacuucaacugguauggaagaaauugagcugguccguggcccccaagaaugcucucguccagcugcacgaacugcgaccuggacuccaguacagaacagugucacagacugguccaguucaugcacccguguucgccgucgcuguggagguaaacggcuuaaccuuugaggggacaggaccuaccaagaaaaaggccaaaaugagggcggcagaacuggcccuucggaguuucguucaauuuccaaaugcuugccaggcccacuuggcaaugggcggugggccgggacccggcacugauuucacaagcgaccaggcugauuuuccugacacccuguuccaggaguuugaaccacccgccccucguccaggccuagccgggggacgccccggugaugcggcacuccugucugcugccuauggcagaaggcggcuucugugucgagcuuuggaccucguggggccgacgccugccacucccgcagccccaggagagcgcaacccugucgugcuguuaaauagacugagggcuggccuccgguacgugugccuugcggagcccgcagaacgcagagccagguccuucgucauggcuguuucaguggauggucguaccuuugaggggagcggccggaguaagaaacuggcccgaggacaagcagcccaggcugccuugcaggaacuauucgacauacagaugccaggccaugcacccgggagagcgaggcgcacaccuaugccacaagaguuugcugauucuaucucccagcugguaacucagaaguuccgggaagugaccacagaccucaccccgaugcacgccagacacaaagcacuggccggaauugucaugacgaagggucuugacgcuaggcaagcccaggugguugcacugagcucgggcacuaaguguaucucuggggagcauuuguccgaucagggacucguggucaacgacugccacgcugaggugguagcccgccgagcguuccugcacuuuuuauauacacagcuggaacuacaccucucaaaacggcgugaggauagugaaagaagcauuuucguuaggcugaaggagggcgguuaccgccuucgggaaaauaucuuguuucaccuguauguguccaccucucccuguggggacgccagacuccauagcccuuacgagauaacuacagaucugcacucaaguaaacaucuugucaggaaguuccgaggccaucugcgcaccaaaaucgaguccggagaaggcacggugccaguccgggggcccagcgcugugcaaaccugggacggaguuuugcucggugagcagcugauuacaaugucuugcacugauaagaucgcaagauggaacguguuaggccugcagggggcccuacucucacauuuuguagaaccugucuaucugcagaguauugugguuggaagccuucaccacaccggccauuuggcuagggugaugucccaccguauggagggugucgggcaacugccagccucuuaccgccauaaucggccccuccugucgggcgugagcgacgcagaagcgagacagccgggaaaguccccuccauucucaaugaacuggguagugggcagugccgauuuagagaucauaaaugcuacaacugggaggcgaucuuguggaggccccagccggcugugcaaacacguucuuuccgcccgcugggcaagauuguacgguaggcucucaacccggacaccuagccccggggacaccccaucuauguauugugaggcuaagcugggagcccacacuuaccaguccgucaaacagcaacuauuuaaggcauuccagaaagccggccuggguacgugggugcgaaagccucccgaacagcagcaauuucuccugacacuuuga

SEQ ID NO: 52463 - RNA, 2796 nt, Artificial Sequence
  derived and/or modified sequence opt3 from ADAR__Homo_sapiens__NP_001020278
auggccgagaucaaggagaaaauuugcgacuaccuguucaacgugagcgauuccucugcucucaaucuugcaaagaacauaggccugaccaaagccagagacaucaaugcggucuugauugauauggaaaggcagggggacguuuaucggcaaggaacaacucccccuaucuggcacuuaacggauaagaaacgcgaacgaaugcagauuaagcguaacaccaauucagugccagagacagcuccggccgcaauccccgaaacuaagagaaacgccgaguuucugaccuguaauauaccuacaaguaacgcuagcaauaacaugguaaccacugagaaaguggaaaauggucaggagccagucaucaagcuagaaaacaggcaggaggcacggcccgagccugcccgccucaaaccacccgugcauuacaauggcccuuccaaggcuggguauguugacuucgaaaacggacaaugggccacagaugacauuccagaugaccuuaauucuaucagagcggcaccgggcgaguuuagggccauuauggaaaugcccucguucuacucacacggucugccucggugcagcccauauaaaaagcugaccgagugucaguugaagaaccccaucagugggcuccuggaauacgcucaguuugccucccagacgugcgaguucaacaugauagagcaaucuggaccuccacaugaaccccgcuuuaaauuccagguggucauuaauggccgagaguuuccgccugcagaagcuggcagcaagaaaguggccaagcaggaugcggccaugaaagcaaugacuauccugcucgaggaagcuaaggccaaagacuccgggaagucagaggagaguagccacuauucuaccgaaaaggaguccgagaaaacagcugaaucacagacucccaccccaagcgccacaaguuucuuuucuggaaaguccccuguaaccacguuacuggaauguaugcauaaacuugguaacagcugcgaguucagauugcugucgaaggagggccccgcacacgaaccaaaauuucaauacuguguugccgugggggcucagacuuuccccucugucuccgcgccuucaaagaagguggcaaaacagauggccgcugaggaagccaugaaggcacuacacggagaggccacaaauaguauggcuagcgauaaccaaccagagggcaugauuuccgaaucucucgacaaucuggagagcaugaugccgaacaaagugaggaagaucggugaacuuguccgguaccugaauaccaaccccguugggggauugcucgaguaugcccguucacauggcuucgcagcggaauuuaaacugguggaccagaguggcccuccacacgagcccaaguucguauaccaggcuaaggucgggggacgcugguuuccugccgugugcgcacauuccaaaaagcaggguaaacaagaggccgcugaugccgcauuaagagugcugaucggcgaaaaugagaaggcugaaaggaugggguucacugagguuacaccagugaccggagccagccuccggcgaacgaugcuucuguugucucgcucacccgaagcgcagccgaaaacccuaccucugacaggcaguacuuuucacgaccagauugccaugcucagccacagauguuucaacacccugacaaauuccuuucagccaucucuucuggguaggaagauauuggcugcaaucauuaugaagaaagauucggaggacaugggggucgugguaagccucggcacuggaaaccggugcguuaagggcgauucccugucauuaaaaggggagaccgugaaugacugucaugccgaaaucauaagucgcagaggauucauuagguuucuguauucugagcuaaugaaguacaacagccaaacagcuaaagauuccaucuucgaacccgccaaggguggcgagaaacuccagaucaagaagaccgucucauuucaccuguauauuagcacugcaccuugcggggacggagcgcuuuucgauaaaucuugcuccgaccgugccauggaaaguacggagagccggcauuaccccguguuugagaauccaaagcagggcaaauugcgaacaaaggucgaaaacggugaggggaccaucccuguggaaucuuccgauauuguucccacuugggacggcauaagacugggagagaggcuccgcaccaugucauguagugacaaaauccugcgguggaacgugcuuggccugcagggggcuuugcucacacacuuccugcaaccaauuuauuuaaagagcguaacccugggauaccuauucucgcagggucaucucacuagagccaucugcuguagggucacacgcgauggcuccgcauuugaggacgggcugcgacacccguucaucgugaaucacccuaagguuggacgggugucuauuuacgauagcaaacgucagucaggcaagacgaaagaaaccagugucaacuggugccuugcugacgguuaugauuuggagauacuggacgggacuagaggcacaguggauggacccaggaaugaacucucccgcguaucuaagaaaaacaucuuucuguuauucaagaagcuguguagcuuucgguacagaagggaccuuuugcgacucuccuauggcgaggccaaaaaggcagcccgcgauuacgaaaccgcuaaaaauuauuucaagaaagggcugaaggacaugggauacggcaacuggauuucaaagccacaggaggagaaaaauuuuuaucuaugccccguguga

SEQ ID NO: 52464 - RNA, 435 nt, Artificial Sequence
  derived and/or modified sequence opt3 from ADAT2__Homo_sapiens__NP_001273188
augguguacaacaaugaggucguuggcaaggggagaaacgaagugaaucagaccaaaaacgccacaaggcacgcugagaugguagcaaucgaccaagugcuggauuggugccggcagagcggaaagucccccucugaagucuucgagcauacugugcucuauguuacgguggaaccuuguauuaugugcgccgcggcccuucgccugaugaaaauaccauuggucguguacgguugucagaaugagcgauuuggcgggugcggaucaguauuaaacaucgcuagugcagaccugccgaauaccggccgucccuuccaguguauuccugguuauagagccgaggaagcuguugagaugcuaaagacauuuuacaaacaagaaaacccaaaugcacccaagagcaaggugaggaaaaaggagugccagaaauccuga

SEQ ID NO: 52465 - RNA, 1104 nt, Artificial Sequence
  derived and/or modified sequence opt3 from ADAT3__Homo_sapiens__NP_612431
augauccugugcagcagacucugucuuccccaguccgccucucugaggauggagccugcuccaggcuugguggaacaaccgaagugcuuagaggcagggucacccgaaccugagccagcccccuggcaggcgcugccuguccuaagugaaaagcagagcggagacguugagcucgugcuggcuuacgccgcaccaguacuugauaagcggcagaccucccgccuguugaaagaggugucugcccuccacccccugccugcucaaccacaucugaagcgaguccguccgucgagagacgcagguucaccccacgcccucgaaauguuacugugucuugcuggcccugccagcgggccaaggaguuuggcggagcugcuaccccggccugcaguggauccacgcggacucggccagcccuuccugguuccggugccugccagacccccacuuacaaggggucaguuugaagaggcucgggcccauuggccuacuuccuuccacgaggacaaacaggucacgucugcacuggcugggcgcuuguuuagcacccaagaacgagccgcgaugcagucccauauggagagagccgugugggcagcuaggcgggccgcugcccguggacuccgcgcaguaggcgccguuguggucgaucccgcuucagacagagugcuggcgacaggccacgauugcaguugugcagacaacccauuacugcacgccgugauggucugcguugaucucguggcuagggggcagggacgggguacuuaugacuuccgacccuuuccugccuguagcuucgcaccagccgcugccccgcaggcaguacgcgcgggcgcugugagaaaacuugaugccgacgaagaugggcugcccuacuugugcaccggauaugaccuauacgucacaagggagccuugugcaaugugcgccauggcucuggugcaugcccggauucuccgcguguuuuauggcgcaccaucucccgacggugcucuggggaccagauucaggauacacgcccguccugaucuuaaucaucgguuucaaguuuuccgaggaguccuggaggaacaguguagaugguuggacccagauacuuga

SEQ ID NO: 52466 - RNA, 1944 nt, Artificial Sequence
  derived and/or modified sequence opt3 from ADCK3__Homo_sapiens__NP_064632
auggccgcuauccugggcgacaccauuaugguggcaaaggggcucgucaaacuuacacaggccgcgguugagacucaucugcaacacuugggaauagguggcgaauuaaucauggcugccagagcacugcagagcacggccguggagcagauugggauguuccuaggaaagguacagggccaagauaaacacgaagaguacuuugcugaaaacuucggugggcccgagggagaguuucauuucuccgugccucacgcagccggcgcuucuaccgacuuuucaagugccagcgcgccagaucaguccgcaccgcccucucucggccaugcccacucggaagggccugcuccagccuaugucgcaucaggacccuucagggaggcugguuuuccuggccaggccagcaguccacuggggcgggcgaauggacgccuuuucgccaacccccgagacuccuuuucugcaaugggcuuccagcguagauuuuuccaccaagaucagagcccugugggugggcugacagcugaagacaucgagaaggccaggcaggcuaaagcccggccagagaauaagcagcauaagcaaacuuuguccgaacacgcacgcgagagaaaaguuccggugaccaggauuggacggcucgccaacuuuggcggccuggcugucgggcugggauucggugcgcucgcagaaguggccaagaaaucauuacgcagugaggaucccagcggcaagaaagcuguacuggggucuuccccuuuccuuucagaagccaaugcagagcgaaucguuagaacauugugcaaggugaggggagccgcucugaagcuaggccagaugcucagcauacaggacgaugccuuuaucaacccacaucuggcaaaaauuuucgagcggguccgucaaagugcggacuuuaugccccuuaagcagaugaugaaaacccugaauaacgauuuggguccuaauuggcgcgacaagcucgaauacuucgaggaaagaccauuugcugccgcaucuaucggccaggugcaccuggccaggaugaaagggggacgggagguggcuaugaagauucaguaucccggcgucgcccaauccaucaacagcgauguuaauaacuuaauggcagugcugaauaugucgaacaugcucccggaagggcuuuucccugagcaccugauagacguauugcgacgcgagcuagcucuggaaugugacuaccagagagaggccgcgugcgccaggaaauuucgggaucuccugaagggacaucccuucuuuuaugugccagaaauugucgacgagcuuuguucuccucacgugcugacuacagaauugguuuccgguuucccccucgaucaggcugagggccugucacaggagauccgcaaugaaauuugcuacaacaucuuagugcugugucuaagagagcucuuugaauuucauuuuaugcaaaccgacccaaacuggaguaauuucuucuaugauccccagcagcacaaggucgcacugcuugacuuuggggccacgagggaguacgaucguagcuucacugacuuguacauccagauuauacgggcugccgcagaucgagacagagagaccgugagggcgaaauccaucgaaaugaaguuucugacaggauaugagguaaaaguuauggaagaugcccaucucgacgcuauucugauccuuggcgaggccuucgcaucugacgaaccuuuugauuucgguacucaaagcaccacagagaagauacacaaccugauuccagugauguugcgccaccggcucgucccgcccccugaggaaaccuacucacugcauagaaaaaugggcgggaguuucuuaaucugcuccaagcugaaggcuagguucccauguaaagccauguuugaggaagcauauagcaauuacugcaagcgccaggcccagcaguga

SEQ ID NO: 52467 - RNA, 1512 nt, Artificial Sequence
  derived and/or modified sequence opt3 from ADCK4__Homo_sapiens__NP_001136027
auguggcugaaggugggcgggcuccuuagaggaaccgguggccagcuggggcaaacagucggauggcccugcggcgccuuggguccugggccacacagguggggaccguguggcggcagcugggcucagaaauucuaccaggacgggcccggacgggguuuaggcgaggaagauauccgccgagcacgugaggccagaccuaggaagacuccacggccccagcuguccgaccgcucuagagaaaggaaaguuccugcgucacggauuagucgccuagcuaacuuugggggacucgccgugggccugggucuugggguacuggcagagauggccaagaaaagcaugccaggaggccgauugcaauccgauaauucuuucauaucgccccagcuccagcauaucuuugaaagagugaggcagucagcugacuucaugccucgguggcaaaugcugcguguccuggaggaggaacucggccgcgauuggcaggcaaagguggccagcuuagaggaaguuccauuugcugccgcgaguauuggacaggugcaccaggggcugcuuagagacgguacggaggucgcagugaagauccaauauccgggcauugcccaguccauccagucugauguacaaaacuugcuggcuguucuaaaaaugagcgccgcacuccccgcugggcuguucgccgagcagucccuucaggcgcugcagcaagaauuggccugggagugcgacuacaggcgggaagcagcuugugcccagaauuuucgacagcuccuggcuaacgauccuuucuuucgcgugccagccgucgugaaggaguuaugcaccacaagagugcugggaauggaacucgcaggcggugucccccuugaccagugucaagggcugucacaggauuugaggaaucagauaugcuuccagcuacugacucucugucugcgggagcuuuuugaguuccgcuuuaugcaaaccgacccuaacugggccaauuuccuguaugaugcuaguagccaucagguuacauugcucgacuucggcgcgucuagagaauuuggaaccgaguucacugaccacuacaucgaagugguaaaagcagccgcugauggcgacagggauugcgugcugcagaagucccgugacuuaaaauuucugacaggguucgagaccaaggccuuuucagaugcacaugucgaagccgugaugauucuaggagagccauucgcuacgcagggucccuaugacuuuggcagcggggagacugcccggcgaauccaagaucucauuccgguucugcuuagacacagguuguguccucccccagaagagaccuacgcacugcaccgcaagcucgcgggagcuuuccuggccugcgcacaucuucgggcccacaucgcuuguagagaccuguuucaggauacauaucauagguacugggccagucgccagccugacgcagcuacugccggcucuuugcccaccaaaggugauuccuggguggacccaagcuga

SEQ ID NO: 52468 - RNA, 4374 nt, Artificial Sequence
  derived and/or modified sequence opt3 from ADCY10__Homo_sapiens__NP_001161221
augcugguguucggcgacgaaacccacagccauuuucucgucaucgggcaggccguugaugacgugagacuugcucaaaacauggcacagaugaaugauguaauucugucccccaacugcuggcaguugugugacaggucuaugauagaaaucgagucagugccugaucagcgggccgucaaggugaauuucuuaaaaccaccgcccaacuuuaauuucgacgaauuuuucacaaagugcacuacguuuaugcacuacuauccuaguggagagcauaaaaaccugcuacgccucgcguguacccugaagccagaucccgaacuugagaugagccugcaaaaauacguuauggaguccauuuugaagcagaucgacaauaagcagcuccaggguuaucugucugaacugcgaccugugacaauugucuucgugaaccucauguuugaggaucaagacaaagcugaagagaucggcccagccauacaggaugcauacaugcacaucacuucgguauuaaagauuuuccaggggcagaucaauaaaguuuuuauguucgacaagggaugcucauuucuguguguguucggcuuccccggugagaaagucccugaugaacuuacccaugccuuggagugcgcuauggacauuuuugacuucuguagccaagugcacaagauccagacagugaguauaggggucgcauccggaauuguuuucugcggcaucgugggccacaccguacgucaugaauauacugugauugggcagaaggucaaccuggccgcuagaaugaugauguacuauccaggaaucgugacaugugauucuguuaccuacaaugguagcaaccuaccggccuacuucuuuaaagagcuccccaagaaagugaugaagggcgucgcggacuccgggccucuguaucaauacuggggaaggacggaaaaagugauguucggcauggcaugccuuaucuguaaucggaaggaggauuauccacuguugggucgcaacaaagagauuaauuacuuuauguauacuaugaagaaguuccucauaucaaacaguagccagguacugauguacgaaggguuacccggauauggcaaaucucagauccugaugaagauugaguaccucgcccagggcaaaaaccacagaaucauagcuauuucccuuaauaagaucucauuucaucaaaccuucuacacaauccagauguuuauggccaacguucugggguuggacacuugcaaacacuauaaggaaaggcagaccaaucuacggaacaaggugaugacacugcucgaugagaaauucuacugccugcuuaaugacauuuuucacguccaguucccuaucagccgcgaaauuagucgaaugucuacccugaagaaacaaaagcaguuggagauacucuucaugaaaauccugaaguuaauugugaaggaggaaagaaucaucuuuauuauagaugaggcacaguucgucgacuccacgagcuggagguuuauggaaaaacugauccggacucuaccaauuuucaucauuaugucgcucugucccuuugugaacaucccgugcgcugccgcgcgugccguuauaaagaaucgcaacacaaccuauaucgugauuggagcaguacagccuaaugauaucucuaacaaaauuugucuggaccuuaaugucuccugcaucucaaaggaguuggauaguuaccugggugaaggcagcugugggauacccuucuauugcgaggagcuccugaaaaaccuugaacaucacgaggugcugguuuuucaacagacugaauccgaggagaagacaaauagaaccuggaacaauuuguucaaguacucuauuaaacucacggaaaagcugaacauggugaccuuacauagcgacaaagagucagaagaggucugucaccugacaaguggagugaggcuaaagaaccucuccccaccuacuagccugaaagaaaucucucuuauucaguuggacucaaugcggcugagucaucagaugcucguacgaugcgcugccaucauaggccugaccuuuacaacugaguuacuguucgagauccuucccuguuggaauaugaagaugaugauuaaaaccuuggcuacacucguggaaagcaacaucuuuuauugcuuccgcaaugguaaggagcugcaaaaggcccuaaaacagaacgauccauccuuugaaguucacuacagaucucugucgcucaagcccagcgaggggauggaccacggcgaagaggagcagcugagggaacuugagaaugaagucauugagugucaucggauccgcuucugcaacccuaugaugcagaaaaccgcauacgaauuguggcugaaggaucaaagaaaagccaugcacuuaaagugcgcuagguuccucgaggaggacgcgcaucguugugaucacugccggggacgagacuuuauaccauaucaccauuucacugugaauauuagacugaacgcacuugauauggacgccaucaagaaaauggcuaugucccacggcuuuaagacggaagagaaacugaucuugucaaauagugaaauuccggagacaucugccuucuuucccgagaacaggagcccugaagagauccgcgaaaagauucucaauuucuuugaucaugugcugaccaaaaugaagacuuccgacgaggauauaaucccacuagaaucaugucagugcgaggagauucuggaaaucgucauucucccccuggcacaccauuuccuugccuugggggagaacgacaaggcucuguacuacuuuuuagaaaucgccagcgcauaucucauauucugugauaauuauauggcguacauguaucugaacgagggacagaaacuucugaagacccugaaaaaggacaaaucuuggucccaaacauuugaaagugcuaccuucuacagccucaagggugagguuugcuucaauaugggccagaucgugcuggccaagaaaauguugcggaaggcacugaaauuacucaacagaauuuuuccuuacaaccugaucucucuuuuccugcacauucacguggagaagaauaggcauuuucacuauguaaaccgccaggcccaggaauccccacccccggggaaaaagcgauuggcucaacucuaccggcagacugucugucugucacuacuguggcguaucuauaguuacagcuaucuuuuccauugcaaauacuaugcccaccucgcagugaugaugcagaugaauacagcucuggagacgcagaacuguuuucaaauaauuaaggccuacuuggacuacucgcuguaucaucacuuagcgggauacaagggcguuugguucaaauaugaagugauggccauggagcacaucuuuaaucucccucugaagggugaagggaucgagauugucgcuuacguggcagagacccuuguuuucaacaaacugauaaugggccauuuggaucucgccaucgaacugggauccagagcucuacagaugugggcccugcuucagaauccaaacaggcacuaucaaucucucugccgccugagccgguguuuguuacuaaauucaagauacccccagcucauucaggugcugggcaggcuuugggagcugaguguaacucaggaacauaucuuuuccaaggcauucuuuuauuucgucugcuuggacauucuacuguacucuggguuuguguaccgaacauucgaggagugccucgaauuuauccaccaauaugagaacaaucgcauacugaaauuucacagcggacuuuuacugggucucuacuccucaguggcgaucugguaugcccgguugcaggaaugggauaacuucuacaaguuuagcaauagagcuaagaaccugcucccuaggcguaccaugacacugacuuauuacgacggcauuagucgcuauauggaggggcagguccuucaucugcagaaacaaaucaaggaacagucugagaaugcccaggcauccggagaggaauugcugaaaaaccuagagaaccucguugcucagaauaccacgggccccguguucuguccacgguuauaccaccugauggccuacguaugcauucuuaugggugaugggcaaaaguguggccuguuucucaacaccgcauugagacugagcgaaacacagggaaauauccucgagaaaugcuggcugaacaugaauaaggaaucgugguauucaacuucugagcuuaaggaggaccaguggcuacagaccauacugaguuugccuuccugggagaaaauuguggccggcagggucaacauccaagauuuacagaagaauaaauuccugaugcgagcuaacacaguggacaaucauuuuuga

SEQ ID NO: 52469 - RNA, 3360 nt, Artificial Sequence
  derived and/or modified sequence opt3 from ADCY1__Homo_sapiens__NP_066939
auggccggcgcucccagagggggagguggcgggggaggcggugcaggggagccuggaggcgccgaaagggcggcuggcaccagccggcgccgagggcugcgugccugcgacgaggaauuugcauguccagagcucgaagcccuuuuuagaggauacacacugagguuggagcaggcugcaacuuuaaaggcccuggcugugcuaucccuccuggccggugcgcuugcacuggccgaguugcucggcgcuccggggcccgccccuggacuggcaaaaggcucucacccaguccauugcguucuguuccucgcuuuacuggugguaacgaacgugcggucacuucaagucccccaguugcaacaggugggucagcuggcccuacucuuuagucugaccuucgcgcuucuguguugcccuuuugcccucgggggaccagcacgcggcagcgcuggcgccgcugggggacccgccacagcagaacaggguguuuggcagcuccuguuagugacuuucgucuccuaugcccugcucccugugagaucucuucuggcuaucggcuuuggguugguaguugcggcaucgcaccuacuggugaccgccacacucgucccagcuaagaggccgcggcuguggcgcacccuuggagccaaugcacuguuguucgugggcgugaacauguacggugucuuuguucgaauuuugacugagagaucacagaggaaagccuuccugcaagcucggagcuguauagaagaucguuuacgccuggaggacgagaaugaaaagcaggagagacuacucaugagucugcuucccaggaacguggccauggaaaugaaagaggauuucuugaagccuccagaacggaucuuccauaagauuuauauccagcgacacgacaauguauccauucuguuugcagauaucgugggguucacaggccucgcgucucagugcaccgcucaagagcuggucaaacuucugaacgaguuguucggaaaguuugacgaacucgccacggagaaucauugucgcagaauaaaaauccugggcgauugcuacuauugugugagcggguuaacucagcccaagaccgaccacgcacacugcuguguugaaaugggacuggauaugauugacacaaucacuuccguggccgaggcuaccgaagucgaucuaaacaugagggugggucuccauacaggccggguacugugcgggguucuuggauugcgcaaauggcaguacgacguguggucaaaugaugucacccuggccaacgugauggaggcagcuggccucccugguaagguccacauuacgaagacuacacuggccugcuuaaauggggacuaugagguggaaccaggcuacggacaugagagaaacaguuuccugaaaacccacaauaucgaaacauuuuucauaguucccagccacaggcguaagauuuuuccgggccuuaucuugucugacauuaaaccugcgaagcggaugaaauucaagacuguguguuaccuccugguacaacuaaugcauugccgaaaaauguuuaaggccgagauccccuucuccaacgucaugaccugugaagaugacgauaagagaagggcucugcgcacggcaucagagaaacuccggaauagaagcaguuuuucuaccaacgugguuuauacaacuccagggaccagggugaaccgcuacaucucccgacugcuugaggcccggcagacagaauuggagauggcugaccugaauuucuuuacuuuaaaguauaaacacgucgaacgugagcagaaguaccaucagcuccaagaugaguauuucaccagcgccgugguacugacacuuauucuggcagcguuguuuggacucguguaccugcuaauauucccucagucgguugucgugcugcuccugcuuguguucugcaucugcuuuuuggucgccuguguucuguauuuacacauuaccagagugcaguguuuccccgguugccucacuauccagauaaggacggugcuguguauuuuuaucguaguccuuaucuacucuguggcucaaggcugcguuguggggugucugccaugggccugguccucaaaacccaacaguagccuagucgugcucuccucuggaggccagcgcacagcacugccuaccuugccaugcgaaagcacucaucacgcucuguuaugcugucucguugguacccugccgcuugccauuuucuuucgggugucaagucugcccaagaugaucuugcucuccgggcugacaaccagcuacauucuaguacuggagcuuucuggcuauacuagaacaggaggcggggcagucucaggaaggaguuacgaaccuauaguggccauccuccuguucagcugcgcuuuggcgcugcacgcccgacagguggacauucgcuuacggcucgauuaucugugggcagcucaggccgaggaagagagagaggacauggaaaaggucaaacuugauaauaggcguauccuguuuaacuugcucccagcccauguugcucaacacuuccugauguccaauccccgcaacauggaccuauacuaucagucuuacagccaggugggcguaauguuugcaucgaucccuaauuucaacgauuuuuauauugagcuggacgguaauaacauggggguggaaugucuucggcuccugaaugagauaaucgccgacuucgaugaauugauggagaaggacuuuuacaaagauauugagaagaucaaaacgauuggauccaccuacauggcggcugucggcuuagccccaacuucagguacaaaggcaaagaaaaguaucucuagccaucuguccacccucgccgacuucgcuauagaaauguucgaugugcuggacgagaucaacuaucagucauacaaugauuuuguucuuagagugggcauuaacgucgggcccgugguugcaggagugaucggcgccaggcgaccgcaauaugacauuugggggaauacagucaacguagcgagccggauggauucuacuggagugcagggccgcauccagguuaccgaagaggugcacagacuguugaggcggugcccuuaccacuucgucugucgagguaagguguccguaaaagggaagggagaaaugcuaacguauuuucuggagggcagaaccgacgguaacggcagucaaauacgcagccucgggcuggauaggaaaaugugcccauucggacgugcuggccuucaggggcggagacccccugugugucccaugccaggagucucuguuagggccggcuuaccuccccauuccccaggucaguaccugccgucagcagccgcugggaaggaggccuga

SEQ ID NO: 52470 - RNA, 3276 nt, Artificial Sequence
  derived and/or modified sequence opt3 from ADCY2__Homo_sapiens__NP_065433
auguggcaggaggccaugagaaggcggcgcuaccugcgagaccguagcgaagaggcugcaggcgggggagauggucuccccagauccagggacuggcuuuaugaaucuuacuauugcaugucacaacagcacccucugaucguguucuuguuacugauugucaugggcaguugucuagcccuccuggcgguguuuuucgcucuugggcuggagguugaagaucauguagccuuuuugauaaccgugccaacagcacucgccaucuucuuugcuauuuucauccuggucugcauugagagcguguuuaagaaacugcuccgguuauucucccugguuaucuggauaugucuuguggcaaugggauacuuguuuaugugcuucggcgguacugucucuccgugggaccaggugucguuuuuccuguuuaucauuuucguaguuuauacgaugcuacccuucaacaugcgcgaugccaucauugcuucagugcucaccagcaguucccacacaaucguccugucugugugucuuagcgccacuccugggggaaaggagcaucugguguggcagauauuggcgaaugucauuaucuuuauuugcggcaaccucgcaggcgccuaccacaaacaucugauggaauuagcucugcaacagaccuaucaggacacauguaauugcaucaaguccagaaucaaacucgaguucgaaaagaggcagcaagagcggcuucuguugucacuacugccagcccacauugcaauggagaugaaggcugaaauaauccagcgccuccaggggcccaaagccggacagauggagaacaccaauaacuuucacaaucuguacguuaagcgacauacuaacgugaguauucuuuacgcggauaucguagguuucacaagacuggccagcgacuguucuccuggcgaauuggugcacaugcucaaugagcuguuugggaaauucgaucaaauagcaaaggaaaacgagugcaugaggauuaaaaucuuaggagacuguuauuacugcgucuccggccugccaaucucacuacccaaucaugcuaagaacugcgugaagaugggucucgauaugugugaggccauuaaaaagguucgggacgcuaccgggguggauaucaauaugcgugucggagugcacagcggcaacguacugugcggcguuauugggcuucagaaauggcaguaugacguguggagucacgacgucacguuggccaaucauauggaagcaggaggugugccuggccgcguccacauaucuuccgugacucuggagcaucucaacggggccuacaagguugaagagggagauggcgacaucagagauccauaucugaaacaacaccuugugaagaccuacuuuguaauuaacccgaaaggugaaaggcggagcccccagcaucuguuccgaccucgccacacauuggacggggcuaagaugagagcgucggucaggaugacucgguaucucgagucuuggggcgcagccaagccauuugcucaucugcaucaccgcgauuccaugaccacagagaauggaaaaaucucaaccacggacgugcccaugggccagcauaacuuccagaauagaacuuuaaggacaaagagucagaaaaagcguuuugaagaggaacugaacgagcggaugauccaagccauugaugggauaaaugcacagaaacaguggcuaaagagcgaagacauccaacgaauuucccuccuguucuacaacaagguucuugagaaagaguacagagccaccgcuuugccugccuuuaaguauuacgugacuugugcaugccugaucuucuucuguauuuuuaucguccagauacucgugcugccaaaaacaucuguauuaggaaucagcuucggugcggcuuuucugcuuuuggccuucauucucuuugugugcuucgcaggccagcugcuacaguguucaaagaaagccaguccccugcucauguggcugcuuaaguccagcgggaucauugcuaauaggccguggccucgcaucucuuugaccauaauuacgaccgccaucauucugaugauggcaguuuuuaacauguucuuuuuaucagauagugaagagacaauucccccaacugcuaauaccacaaacacuagcuucuccgccucuaauaaccaagucgcgauacuccgggcccagaaucuguuuuuccuuccuuauuuuaucuacucgugcauucugggauugaucagcuguuccguguuccucagagugaacuaugaacugaagaugcuaauuaugauggucgcucugguuggcuacaauaccauccuccugcacacacacgcacaugugcuuggugacuauucacagguguuguucgagaggcccgggauauggaaagaucugaagaccaugggcaguguaucuuuaagcaucuuuuucaucacucuccugguccuuggacgccagaacgaguacuacugccgacuggacuuucuauggaaaaacaaguucaaaaaggaacgggaggaaaucgagacgauggaaaaucucaaccgugugcuguuggagaauguucugccagcccacguggcugagcacuuuuuagccagaucccucaagaacgaggaacuguaucaccaaucauacgacugugucugcgugauguucgcaagcauucccgauuuuaaagaguucuauacagaaucugacguuaauaaggaaggccuugagugccugagguugcucaacgagaucauugcggauuuugacgaucugcuauccaaaccuaaguucagugggguggagaaaauaaagaccaucggaagcacuuacauggccgcuaccggucugucugccguaccaucccaggaacauucacaggaaccggagcgccaauauaugcacauuggcacaauggucgaauuugcauucgcucuuguggggaaacucgacgccaucaauaagcacaguuucaacgauuuuaagcugcgggugggaauuaaucauggccccgucaucgccgguguuauaggggcacagaaaccucaguacgacaucuggggcaacaccgugaauguagcuagcagaauggauucgacuggaguguuggacaagauucaggucacagaggagacgucccugguguuacaaacccucggcuauacuuguacaugcagggggaucauuaacguuaaaggaaagggcgaucugaaaaccuacuucgugaauacagaaaugucucgaagccuuucacagaguaacgucgcguccuga

SEQ ID NO: 52471 - RNA, 3435 nt, Artificial Sequence
  derived and/or modified sequence opt3 from ADCY3__Homo_sapiens__NP_004027
augcccagaaaccagggcuucagcgagccugaauacuccgccgaguauucugcugaauacucagugagucugccaagcgacccggauaggggagucgggcggacccacgagaucuccguucgcaauucugguucgugccucugucuuccccgauuuaugcgucugacauucgugccugaaucauuggagaacuuauaucaaacuuacuuuaagagacagaggcaugagacgcugcuaguacucguggucuucgcagcccuguuugacugcuaugugguugugaugugugcggucguguucagcagugauaaacuugcuucccuggccguagcaggcauuggguugguucucgacauaauccuguuugugcugugcaagaaaggacucuuaccagaucgggucacccgcagagugcugcccuacgugcuuugguugcugauuacagcccagaucuucucuuaucuaggccucaauuuugcuagggcacacgccgcuagcgacacugucgguuggcagguuuucuuuguguucuccuuuuucauuacccugccucuuucacugaguccaaucguaauaaucagcguggucucuugugugguucauacauuggugcucggggucaccguggcccaacagcagcaggaagaacugaagggaaugcaauuacugcgggaaauucucgcgaacguauuccuuuaccugugcgcaaucgccguuggcauuauguccuacuauauggcugaucgcaaacaccgaaaggccuuuuuggaggcaagacagucacuagaggugaagaugaaucuggaagaacagagccagcaacaggaaaaccucaugcugaguauccuucccaaacaugucgcugacgagaugcugaaggauaugaaaaaggacgaaucucagaaagaucaacagcaguucaauacuauguacauguauaggcacgagaacguguccauauuguuugccgacauugucggcuucacacagcucagcucggcguguucugcccaagagcuggugaaguuacugaaugaacuauuugcacgguucgauaagcucgcugccaaauaccaccagcugcguaucaagauucuuggggacugcuauuacuguaucugcggauugccugacuaucgcgaggaucaugcuguuuguuccauccugaugggucucgccaugguggaagcaauuucauacguaagagagaaaaccaagacgggcgucgacaugaggguggggguucacacuggaaccgugcugggcgguguccuugggcagaaacgguggcaguacgauguguggaguacagacguaacuguggccaacaagauggaagcuggaggcauaccaggccgaguucauaucagccaauccaccauggauugccugaaaggggaguuugacgucgagccgggagaugguggcucucgcugcgacuauuuggaagagaaggggauugaaacauaccucaucauagcgagcaagcccgaggugaaaaagaccgcaacgcagaauggacugaacggcucagccuuaccuaauggugcuccagccaguuccaaaucuagcucacccgcacugauugaaacuaaggagccuaacgggagugcccacagcuccggcucuacaucggagaaaccagaggagcaggaugcucaggccgacaaucccagcuucccgaacccuagaaggcggcuacgccuccaagaucuggcagacagaguggucgacgcguccgaagaugagcacgagcuuaaccaguugcugaaugaagcucuccuggagagggaaucagcccagguugugaagaagcguaacaccuuuuuacugaguaugcgguucauggaccccgagauggaaacucgauauucuguggagaaagagaagcagagcggagcagccuuuuccuguucaugcguaguccuuuuguguacagcucucguggaaauccugaucgauccauggcuaaugaccaauuacguuacguucauggugggcgagauucugcuccugauccuuaccauuugcagcuuggccgcaauauuuccuagagcuuuccccaaaaagcuggucgccuucucuacauggaucgacaggacucgcugggcgcggaacaccugggccauguuagcuauuuuuauccucgugauggcaaauguuguggauaugcuguccugucuucaauauuacacagggccaaguaacgccacugcuggaauggaaaccgaggguagcugccuggaaaaucccaaauauuacaacuacguagccgucuugucucucaucgcaacaauuaugcugguccaggugucccauauggugaagcuaacccugaugcuccugguugcgggcgccguggcuacuauaaaucuuuaugccuggagaccuguauucgacgaguacgaucacaagagguuucgcgagcaugacuugccaaugguggcacuggaacagaugcaaggguucaacccgggauuaaauggcacggaucgacucccccuggucccuucaaaauauaguaugacagugaugguuuuucuuaugaugcugagcuucuacuauuuuucgcggcacguggagaagcuagcucguacccucuuccuguggaaaaucgaaguccaugaccagaaggagagaguguacgaaaugaggcgcuggaacgaggccuugguuacuaauaugcugccagagcacguggcacggcacuuuuuagguuccaaaaagagagaugaggagcucuauucucagaccuacgacgaaauuggggucauguucgccagccugcccaacuuugcugauuucuacacagaggagucaaucaauaacggcggaauugaaugucuuagguuucugaacgagaucauaagugacuucgacuccuugcucgauaauccuaaguuccgaguaaucaccaaaauuaagacuaucggcucuacauauauggcggccagcggggugacgccagacguuaacaccaauggauuugcauccucaaacaaagaagauaagagcgagcgcgaacgguggcagcaucuggcugaccuagccgauuucgcccuggcuaugaaagacacucuuacaaauauuaacaaucaaaguuuuaacaauuucaugcucagaaucgguaugaacaagggcggggugcuggcaggagucauaggcgccaggaaaccccacuacgauauuugggguaauaccgugaacguagcgucucguauggaguccacaggggugaugggcaauauccaggucguugaggaaacucaggugauuuugcgcgaguauggauuucgguucgugagaaggggcccgaucuuugucaaggggaagggagaacuguuaaccuucuuucucaaaggccgagacaagcuggcuacguucccuaacgguccaagcgugacccuuccccaucagguuguagauaauucguga

SEQ ID NO: 52472 - RNA, 2736 nt, Artificial Sequence
  derived and/or modified sequence opt3 from ADCY5__Homo_sapiens__NP_001186571
augaagucacagaaagagggcugcuguuccagaggggaccugucuauccaaaccggacccgguggcgaaugggccccuaggcggcucgugucaaacguccuuauuuucaguugcacaaauauaguugggguguguacucacuacccagcugagguaagccagcgccaggcauuucaggaaacgcgagagugcauccaagcccgucugcauucccagagagaaaaccagcagcaagagagguuguuacugucugugcuaccgcggcacgucgcgauggagaugaaggcugauauuaaugccaaacaggaagacaugauguuccauaagaucuauauucagaaacacgauaacgugucgauccucuuugcagacauagagggauucaccucacuggccagccaguguacagcucaagaacuuguuaugacucugaaugaguuguuugcacgcuucgauaagcucgccgcugagaaccauugccugagaaucaagauucugggcgacuguuacuauugcgugaguggucuccccgaagccagggcggaucacgcacacuguugcgucgagauggggauggacaugaucgaagccauuuccuuagugcgggagguaaccggaguuaaugugaacaugcgcgucggcauccauucuggccgagugcacuguggggugcugggacuuagaaaauggcaguuugaugucuggagcaaugacguuacauuggcuaaccauauggaagccgguggcaaggcagggaggauacacauuaccaaagcuacucugaauuaccuaaacggagauuaugagguggagccuggcugcgguggggaacggaaugccuaccucaaggagcacuccaucgaaacauuccugauucuucguugcacccagaaacgcaaggaggaaaaggcgaugaucgccaaaaugaacagacaaaggacgaauagcaucggacauaacccaccccacuggggcgcagagcggccuuuuuauaaccaucugggcgggaaucagguaaguaaggagaugaaacgaaugggauucgaagacccaaaggauaaaaacgcucaggagagcgccaaucccgaagacgagguggacgaauuuuugggucgcgcuauugaugccagaucuauagacaggcuccgguccgagcacguccgcaaguuccuguuaacuuuuagagagccugaucuggaaaagaaguacucaaaacagguggacgauagguucggcgcauacguugccugugcuagccucguguuccuuuuuaucugcuucguccaaauuaccaucgugccacauaguauauuuaugcugucuuucuauuugacauguucccuacugcucacucugguaguuuuugugagcgucauuuacucgugcgugaaacuuuucccgucuccccugcagaccuugucccguaagaucguccggucaaaaaugaacaguacacucguggggguuuuuaccaucacgcugguguucuuagcggcauuuguaaauauguucacuuguaacagccgagaccugcuaggaugccucgcccaggagcacaauauuuccgcuucucaggucaacgccugucacguggcagaaagcgccguuaauuauucacugggcgaugagcaagguuuuugcgggaguccuuggccaaacuguaauuuccccgaguacuuuacauauuccgugcuuuugagccugcucgcuugcucugucuuccugcagaucucauguauuggcaaacuugugcugauguuggccauagaacucaucuacguacugauuguggagguuccuggagucaccuuauucgacaacgcagaucugcuagugacugcgaaugcuaucgacuuuuucaacaauggcacaagucagugcccagaacaugccaccaaaguggcacucaaggucguuacgcccaucauuauaagcguguuugugcuggcccuuuauuugcacgcucagcaaguagaguccaccgccagacuggauuuccucuggaagcugcaggcaacagaagagaaagaggaaauggaggaauuacaggcuuacaacaggcgccugcuucauaacaucuugccgaaggacgucgccgcgcacuuucucgcccgggagagaaggaaugacgaacuguacuaucagucuugcgaguguguggcuguuauguucgcaucgauugccaacuuuagcgaguucuacguggaacuagaggcuaauaacgaaggggucgagugccugcgccuccugaaugaaaucauugccgauuuugacgagaucauauccgaggaucgauuccggcaacuugaaaagaucaagacuauuggaucaaccuauauggcagcgagugguuugaacgacucuacauacgauaaagugggcaagacucacaucaaggcccuggcugacuuugccaugaaauuaauggaucagaugaaguauauuaaugagcauagcuucaacaauuuucagaugaaaaucgggcucaacauaggaccuguuguggcaggcguaauuggugcucguaagccccaauacgacaucugggggaauaccgucaacguggccuccagaauggauucaacaggcgugccagacaggauucaggucaccacugauauguaucagguucuggcagccaauacguaccagcuugaaugucgcggagugguaaaagugaagggcaagggggagaugaugacauacuuccugaacggagguccucccuugagcuga

SEQ ID NO: 52473 - RNA, 3507 nt, Artificial Sequence
  derived and/or modified sequence opt3 from ADCY6__Homo_sapiens__NP_056085
augagcugguucuccggccugcucgugcccaaggucgacgagagaaaaaccgccuggggagaaaggaacgggcagaagcggucucgccgacgugguacaagagcuggcggguuuugcacuccuagguacaugucaugucuucgggaugcagagccaccgagucccacgccugccggaccaccccgcugcccuuggcaagacgaugcguucaucagaaggggcgguccagggaaaggaaaggaacugggcuugcgggcuguugccuuaggcuuugaggacaccgaagugacaacuaccgcagggggaacagccgagguagcucccgaugcagugccucgcagcggucgauccuguuggagaaggcugguccagguguuccagucuaaacaguuucggucggccaagcuagagcgucucuaucaacgcuacuucuuucagaugaaucagucaagccugacccuucugauggcuguuuuggugcuccugacugccguccugcucgcguuccacgcagccccagcuagaccgcagcccgccuauguggcauuacuggcuugcgccgcggcccuuuuuguaggcuugaugguuguguguaacaggcauaguuuccggcaagacuccaugugggucgugucuuacgugguccuggggauucuagcagcuguucaggugggaggcgcccucgcugccgauccucgaagcccauccgcaggucuguggugccccguauuuuucguguauauagccuacacacuucugccuauccgcaugagagcugcggucuugucagggcucggacugaguaccuuacaccugauucucgcauggcagcuuaauaggggcgacgccuuucuguggaagcaguugggcgcuaacgugcuacuguuccucuguacgaauguuaucgggauuugcacucauuauccagccgaagugagccaacggcaggcauuccaggagacccgcggauacauccaagccagacugcaccuucagcaugaaaacaggcagcaggagcgucuguugcucucuguccugccccaacacguggcuauggagaugaaagaagauauaaauacaaagaaagaggacaugauguuucacaagaucuacauucagaaacaugauaacguauccaucuuauucgccgacauugaagguuuuacuucacuggcaagccaguguaccgcgcaggagcuaguuaugacacucaaugaacuguucgcucgguuugauaagcuggccgcagagaaccacugcuugcgaaucaagauacugggcgacuguuauuacugcgugagugggcucccggaggccagagcugaccaugcccacugcugugucgaaaugggaguggauaugauugaggcaaucucucuggucagggaagugaccggcguuaaugugaacaugcgcguagguauucacuccgggcggguccauugcggcgugcuuggacugagaaaauggcaauucgacguuuggagcaaugaugugacguuggcuaaccacauggaggccggcgggagggcgggacgcauccauaucacucgagccacacuccaguaucugaauggugacuacgaagucgagccuggccgugggggagagcggaacgcuuauuuaaaggaacagcacauugagaccuuucugauacuaggcgcaucgcagaaaagaaaggaagagaaagccaugcucgcuaagcugcaaaggacucgcgccaacucuauggaaggucuuaugccccggugggugccagauagagcauucuccaggacaaaagacucaaaggcguuucgacagauggggaucgaugacaguagcaaggauaaucgcggcacccaggacgccuugaacccugaggaugagguagacgaguuccugucccgggcuauugacgccagaucuaucgaucagcucaggaaagaccaugugcgucgcuuucuguuaacguuccaacgggaagaucuggaaaagaaauacagcagaaagguugaccccagguuuggagcauaugucgcuugugcccuuuugguguucugcuucauauguuuuauucagcuccugaucuucccacacucaacccuaaugcugggcaucuacgcaaguauuuuucuccugcuuuugaucacagugcugauuugcgccgucuacuccugugggagcuuauuccccaaagcucuccagcgacugucucggucaauaguucgcaguagagcgcacagcacugccgugggaaucuuuuccgugcuucugguauucaccucugcaauugcuaauauguuuacaugcaaccauacuccuaucaggucgugugccgcccggauguugaaucucaccccagcugauaucacagcaugccaccuucaacagcuaaacuauagccugggucucgacgccccgcugugugagggcaccaugcccacuugcuccuucccugaguacuuuauugggaauaugcuuuugucacuguuagcgaguucugucuuccuccauauaagcuccaucggaaagcuggcuaugauuuuugugcuuggccugaucuaucuaguucuccuguugcuggguccacccgccacgauuuucgauaacuacgacuuacuccugggggugcacggccuugcaucaagcaaugaaacauuugauggacuggacugcccugccgcuggccgagucgcauugaaguauaugaccccagugauccuccugguuuucgcccuagcgcuguaccuucacgcucaacagguggagucuacugccagacucgauuuccuguggaaauugcaggcaaccggggaaaaggaggaaauggaggagcugcaggccuauaaccgcagguuacuccauaauauacugcccaaagacguagcugcccacuuucuugcacgugaacggagaaacgaugagcuguacuaccaguccugugaaugcgucgcugugauguucgccaguaucgcgaauuuuagcgaguucuauguggaauuggaggccaacaaugagggagucgaaugucucaggcugcuaaacgagauuaucgcagacuuugacgaaauuaucucugaggaacgcuuccgacagcuggagaagauaaaaacaauuggcuccaccuacauggcugccucaggucuuaacgcuaguacuuaugaucaaguugggagaagccauaucacagcacucgccgacuacgccaugcggcugauggagcagaugaagcacauuaaugaacauucguuuaacaauuuccagaugaagaucggauugaacaugggcccggugguagcuggugugauaggcgcgaggaaaccucaguaugauaucugggggaauacggucaacguguccucucgcauggacagcaccggaguuccagaucguauucaagugacuacagacuuauaccagguccuggcagccaagggcuaucagcucgagugcagaggggugguuaaagugaagggaaaaggcgaaaugaccacauacuuucugaauggugggcccucaaguuga

SEQ ID NO: 52474 - RNA, 3243 nt, Artificial Sequence
  derived and/or modified sequence opt3 from ADCY7__Homo_sapiens__NP_001105
augcccgccaagggcagauacuuccugaacgagggggaagagggaccugaccaggaugcucucuaugaaaaauaccaacuuaccagccagcacgguccacuguuguuaacacugcuacucguggcagccacugcgugcgucgcucugaucauuauagccuuuucccagggcgacccgucuaggcaucaggcaauccuugggauggccuuccugguuuuggcuguguuugcagcccucucaguacugauguauguggagugucugcuccggcgcugguuacgagcucuggcccuuuugacgugggcgugccuggucgcacuaggauacgugcucguuuucgaugccuggaccaaggcugccugugcaugggaacaagugcccuuuuuccuguuuauugucuucgugguauauacacuucugccuuuuaguaugcguggcgcuguugccgugggugcggucagcacugccucccacuugcucgugcuggggucuuuaaugggaggcuucaccacaccaucggugagagucggccugcagcuccuugcaaaugcuguuaucuuucugugcgggaacuugaccggagccuuccauaaacaccagaugcaggacgcuucaagggaucuauuuacuuacacagugaaguguauucaaauccggcgcaaacugagaauagagaagaggcagcaggagaaucuccugcuuagcguacugcccgcccauaucaguauggguaugaaguuggcaauuaucgaacggcucaaagagcacggcgaccgccgaugcaugccugauaacaauuuccacucccuguaugugaagagacaucagaacgucucuauuuuauacgccgacaucgugggguucacccaacuggcuagcgauuguuccccaaaagagcuaguugugguccucaaugaacuguuuggaaaguucgaccagauagcgaaagcaaacgagugcaugaggauuaagauccuuggcgauuguuacuauugcgugucagguuugcccguaagucugccuacgcacgcccggaauuguguuaagauggggcucgacaugugccaggcuauuaaacaagugcgugaagccacuggagucgauaucaacaugcgcgugggcauccauagcggcaauguccugugcggggugauuggacuuagaaaguggcaguacgacguuuggucucacgacgugucccuggcaaacaggauggaggccgcugguguaccaggccggguccacauaaccgaagccacauugaaacaucucgauaaggcauaugagguggaagacgggcacggacagcagcgagauccguaccugaaagagaugaauauccgcacuuauuuaguuauugaccccagaucacaacagccuccacccccuagccagcaucugccaaggcccaagggcgaugcggcucuaaaaaugcgggccagugugcgcaugaccagauaccucgagucuuggggugcagccaggccguuugcucaccugaaccaucgugaauccgucagcucgggggagacacacgugccuaauggccggcgacccaagucuguaccacagagacacaggcgcaccccugaccgguccaugucacccaagggaagaagugaagaugacagcuaugaugacgagaugcuuuccgccaucgaaggcuugucuagcacgaggccauguugcucaaaaagugaugacuucuacacuuuuggguccauauuccuggagaagggauuugagcgcgaauaccgacucgcacccauuccucgggcucgucaugacuucgccugugcgagccugaucuuugugugcaucuuacugguucacguccuuuugaugccaagaacagccgcucucggugugucuuucggccugguggcauguguccuagggcugguucucggacugugcuuugccaccaaauucucaagguguugcccggcucgcggcacucuuuguacaauuagugagcggguggaaacccaacccuugcugagauuaacgcucgccgugcugaccaucgguagccuucugacaguagcaauuauaaacuugccucucaugccauuucagguccccgagcugccuguggggaacgaaacuggccuacuggcggccuccucuaagaccagggcucucugcgagccacugcccuauuacacauguucgugcguucuuggauucaucgccugcagcguguucuugcgaaugucccuggagccgaaagucguguuacucacuguugcacugguggcuuaucuuguacuguuuaaucuaucaccuuguuggcagugggauugcuguggccaggggcucggaaaccugaccaagccaaaugguacaaccaguggcacucccucuugcagcuggaaggacuugaaaacgaugacaaacuucuaccuggucuuauuuuauauuacccuccugacucuuucccgccaaaucgauuacuauugucggcuggacugcuuguggaagaaaaaguucaaaaaggaacaugaggaauuugagaccauggagaaugugaacagacuccugcuagaaaaugugcugccugcccacgucgcagcccacuucaucggggauaaacuuaacgaggacugguaccaucagucauacgauuguguuugcgugauguuugcuagcguacccgacuucaaaguguuuuauacagaaugugaugucaauaaggagggacucgaaugccugagguugcugaacgagauuauagcggacuucgaugaguuacuccugaaaccaaaguuuucuggcguggaaaagaucaagaccauugguuccacuuacauggccgcagcugggcuuaguguugccagcggccacgagaaucaggaacuggagcgucagcaugcccacaucggagugauggucgaguucucuauugcuuugauguccaagcucgacggcaucaaccgccauucauuuaauaguuuccggcugagaguggggauaaaccacggaccuguuaucgcaggcgugauuggugccaggaaaccccaauaugauaucugggggaauacagucaacguagcgagccgaauggaaucgacgggagagcuaggcaagauucaggugaccgaagagacuuguacaauccugcagggucuuggcuacuccugcgaaugccgggggcucauaaacguuaaaggaaagggcgagcugcgcaccuauuucguguguacagacacugcuaaauuucaaggguugggauuaaauuga

SEQ ID NO: 52475 - RNA, 3756 nt, Artificial Sequence
  derived and/or modified sequence opt3 from ADCY8__Homo_sapiens__NP_001106
auggagcugagcgacgugagaugccucaccggcuccgaggaacuuuacacaauccaccccacuccuccagccggggauggaaggucugcuucacggccgcagcgccuguuguggcaaacggcaguccgacauauuaccgaacagcguuucauacacggucauagaggcgggaguggaagcggcuccggugggucuggaaaggccucggaccccgcgggcggcgggccuaaccaccaugcuccacaguuaucaggagauagcgcccugccccuauauagucucgguccuggcgagagggcacacuccacaugugggacuaaaguuuuuccagaacggucuggaagcggcuccgccucagguagugggggaggcggcgaccugggguuccuucaccuggauugcgcucccagcaauucugacuuuuucuugaacggagguuacuccuaucgcggcgugaucuuuccuacccucagaaauucauucaagagcagggaucuggagcggcuguaccagcgcuauuuucucgggcaacgaagaaaaagugagguagugaugaacgucuuagacgugcugacaaaacuuaccuugcugguucuacaucucucucuggcauccgccccaauggauccgcuuaagggcauucuguugggauucuuuacugguaucgaaguggucauuugugcucucgugguaguuaggaaggacacaaccagccacacguaccugcaguauucggggguggucacuuggguggccaugaccacacagaucuuagcggcaggccugggauacggccuccuuggggauggaauagguuacgugcuguucacuuuguuugccaccuauucuaugcuaccccugccucucacaugggcuauccuggccggccuugggaccucccuguugcaggucauucuccaaguugugaucccacggcuggcaguaauuucaaucaaucagguggucgcucaggccguguuauucaugugcaugaacacggcgggaauauuuauuaguuaccugagcgaccgugcccagcgccaagcauuccuagagacuagaagguguguugaagcucggcuccgacuggagacagagaaucagcgccaggaaagacuuguguuguccguccugcccagguucgugguacucgagaugaucaacgauaugaccaauguugaagacgagcaucugcaacaccaguuucaccggauuuauauccaucgcuacgaaaacgugucuauccuuuucgccgacgucaagggcuuuacuaaucugagcacaaccuugucagcucaggagcucgugagaaugcugaacgaguuauucgccagguuugaucgucuggcacacgaacaucacugccuacggauuaaaauacucggugacuguuauuacugcgucagugggcugccugagccacgacaggaucaugcccacuguugcguggaaaugggccuuuccaugaucaagacgauuagauauguuaggagccgcaccaaacacgacguggauaugcggaucggaauacauucuggcucaguauugugugggguccugggacucagaaaguggcaauucgacguguggaguugggauguugacauugcuaauaaacuggagagcgguggcauccccgggaggauccacauuuccaaggcgacauuagauugccugaacggagacuacaauguggaagagggccaugguaaggagcgcaacgaauuucuucgaaaacacaacaucgagacuuacuugauuaagcagccggaagauucucuccugucgcuaccugaggacauagucaaagaaagcguguccucaagugaccggcguaauucuggggcaaccuucacagagggcagcuggucccccgagcugccauuugauaacaucguaggaaagcagaauacucucgccgcucugaccagaaacucaauuaaucuuuugccuaaccaccuggcccaggcauuacaugugcaaagcggccccgaagagaucaauaaaaggaucgaacacacaauugaccuccgcucuggggauaagcugcggagagagcauauaaaaccauucucccuuauguuuaaggacaguagccuggagcacaaguauucucagaugagggaugaaguuuucaaauccaacuuggucugcgccuuuaucgugcuccuguucauuaccgcuauccagucacuacugcccaguagccgagugaugccuaugacuauucaguucucgauccucauaaugcugcauuccgcccuugucuugaucacgacagcagaggacuacaagugucugccauuaauucuccgcaaaaccugcuguuggaucaaugaaacuuaucuggcgcggaacguuauuaucuuugcuucuauacuuauuaauuuccugggagccauccuaaacauucucuggugcgauuuugacaagagcaucccgcugaaaaauuugaccuucaacucaagugcaguguuuacagauauauguuccuaccccgaguauuucguguuuaccggcguacuggccauggucacuugcgcuguguucuuaagacucaauucuguucugaaacuugccgugcuguugaucaugauugcaaucuacgcucuccugacagaaacggucuaugccggucuauuucugagguacgacaaccuuaaccacagcggggaggauuuccucggaaccaaggaggugucccuguugcugauggcgauguuuuuacucgccguuuucuaccacggccaacagcuggaauauacugcucgucuugacuuucuguggcgcgugcaggcaaaggaggaaauuaaugagaugaaggaauugcgggagcauaacgagaauaugcucagaaacauccugccuucacacguagccaggcauuuccuagaaaaagaucgagacaaugaggaacuguacagccagaguuaugacgcugucggugugauguucgccucuauaccaggcuuugcagauuucuacucccaaacagagaugaacaaucaggggguggaaugucuucggcuccugaacgagauuaucgcggacuuugaugaguuguuaggagaagaccgcuuccaggauaucgagaagauuaaaaccaucggcagcacauauauggccgucucggggcugucacccgaaaagcaacagugcgaggacaaguggggacaccucugugcucuggccgauuuuucucuugcacugacugagaguauucaggaaauaaauaaacauuccuucaacaauuuugaguugagaaucggcauuagccacgguucuguuguggcugggguaaucggagccaagaaaccucaguacgacauuuggggcaagaccgugaaccuagcaagcaggauggauuccacgggugucucaggccggauccaagugccagaagagaccuaucugauacucaaagaccagggguucgccuuugauuaccgaggagaaaucuacguuaagggcauuagugagcaggaggggaagaucaaaacauauuuccugcuuggaagagugcagcccaauccguuuauuuuaccuccacgcaggcugcccggccaauacagccucgcugcggucguguugggucugguucagucucucaaccgucagcggcagaagcaacugcuuaaugaaaacaacaauacugggaucauaaaaggacacuauaacagaaggacccuguuguccccuucaggcacagagcccggugcccaggcagaaggcacugacaagagugaucuaccauga

SEQ ID NO: 52476 - RNA, 4062 nt, Artificial Sequence
  derived and/or modified sequence opt3 from ADCY9__Homo_sapiens__NP_001107
auggccucucccccucaccagcaacugcuccaucaccauuccaccgaggugucuugcgacucaaguggcgauagcaacuccgucagaguuaagaucaauccaaaacagcuuucuucgaacucacacccgaagcauuguaaauacagcauuaguuccucuugcagcuccucaggggacaguggaggugugcccaggcggguaggcgggggaggccgccugcgacgucagaagaaauugccucaguuauucgaaagagcuagcucuagguggugggauccaaaguuugacuccgugaaucuggaggaagcaugucuagagcggugcuucccccaaacacagcgcagauuuagguaugcccucuucuacauagguuuugcgugucugcuuuggucaaucuauuucgcuguccacaugcggagccgccugauugugaugguugccccugcauugugcuuucuccuggugugugucggguucuuucuguucacuuuuacgaagcucuacgcccgacacuaugcuuggaccaguuuagcacugacacuuuugguguucgcccugacucuagcugcccaguuucagguacucaccccaguuucuggaagaggcgauuccagcaaccugacagcgaccgcaaggcccacugacacaugccuuucgcaagugggcucuuucuccauguguaucgaaguccuguucuugcucuacaccgugaugcaucugccuuuauaucugucacucugccuugggguggccuacaguguccuguuugagacguucggauaccacuuucgggaugaggcuuguuucccaagcccgggugccggcgcauugcauugggaacuacugucccgugggcuccugcacggaugcauucacgcuaucggcguucaucuuuuugugaugucucagguacgcagcagaucaacuuuccugaaagugggucagaguauaaugcacgggaaggacuuggaggucgaaaaagcccucaaggagaggaugauccauuccgugaugccccggauuaucgcggaugaccugaugaaacagggagaugaggaaagcgagaauagcguuaagcgacacgccaccucaaguccuaagaaccgcaaaaagaaaagcuccauucaaaaggcaccaaucgcuuuuagacccuucaaaaugcagcagauagaagaggugucuauuuuauuugccgacaucgucggcuucacaaagaugucggcuaauaaaagcgcccaugcacuggugggccuacucaacgaucuguuugggagguucgaccggcuuugcgaagagacuaagugugagaagauuuccaccuugggagacugcuauuacuguguagccgguugcccugaaccacgcgcugaucacgcguauuguugcaucgagaugggccuggggaugaucaaagcaauugaacaauuuugucaggagaagaaagaaaugguuaauaugagagugggaguccacacaggcaccgugcucugcgguauacuggggaugaggcguuucaaguucgacgucuggucaaacgaugugaaucuugccaaccugauggagcaguugggcguugcuggaaaagugcauaucagugaggccacggcaaaguaccucgacgaucgguaugaaauggaggacggcaagguaauugaacgacuggggcagucugucguggccgaucaauuaaaaggacugaagacuuaccuaaucagcggucagagagcuaaagaguccagguguucaugcgccgaagcacuccugagcggcuuugagguuauagacgggucucagguguccaguggaccccgcggccaggguacagcgagcucugggaaugucuccgaucuugcucaaaccgugaagacuuucgacaacuugaaaacauguccgucaugcggcauuaccuuugccccuaagagugaggcaggagccgaaggcggggcuccccagaauggaugccaggaugagcacaagaacagcacgaaagccucggguggcccaaacccuaagacccagaaugggcugcucuccccaccccaagaagagaaacugacaaacucucagacuagcuuaugugagauccugcaggaaaagggacggugggcaggcguaucacuugaccagagugcuuugcucccccugagauucaaaaauaucagggagaagaccgacgcccauuuuguggauguuauuaaggaagacucccuaaugaaagauuauuucuuuaagccuccaaucaaccaauucucucugaauuuucucgaccaggagcuggaacgcagcuaccgaacauccuaccaggaggaggucauuaaaaacucaccggugaagacuuucgcgagccccaccuuuaguucucuuuuggauguguuccuguccacaaccgucuuuuuaacucucagcacgacaugcuuccugaaauaugaagccgcuaccguuccuccacccccugcagcccuugcuguguucucggccgcacuguugcucgaggugcugucacuagcgguaucuauacggauggucuuuuuccuggaagacgugauggccuguacuaagcgucuccuggaguggaucgcugguuggcuuccaagacacugcauuggggccaucuugguuagucugcccgcauuagcuguguacucccacgucaccagcgaauaugagacaaauauccauuuuccgguguucaccggcucugccgcacucauugccguugugcacuacuguaacuuuugccaacugagcuccuggaugaggucaagucuugcuacuguagucggagcgggcccucugcuacuccuguaugugagcuuguguccagauucuuccgugcugacaucacccuuagacgccguccagaauuucaguagcgagcgcaacccuugcaauuccucuguuccccgggaucucagaaggccagcaucgcugauagggcaggaagugguacuuguguuuuuccuguugcuccugcuagucugguuucugaaccgagaguucgaagugagcuaccgccuucauuaucacggagacguugaggcugaucuccaucggacgaaaauccagucaaugagagaccaagccgauuggcuguugaggaauauuaucccuuaccacguggccgaacagcugaaggucucccagaccuacaguaagaaccacgacucuggcggugugauuuuugcuagcaucguuaauuucuccgaguucuaugaggaaaacuacgaagggggaaaagaauguuaucguguguuaaacgagcucauaggcgacuuugaugagcugcuuucaaagcccgacuacucuagcaucgaaaagauuaagacuaucggugcaacauauauggccgcgaguggccugaauaccgcucaggcccaagaugggucccauccacaggagcacuugcagauucucuucgaauuugcaaaagagaugaugcgcgucguagacgauuucaacaauaacaugcugugguuuaauuucaagcuacgggugggauuuaaccauggcccgcugacagccgggguuaucggaacuaccaaacuucucuacgacauauggggcgauacggugaauauugcuagcagaauggacaccacaggugucgaaugcaggauccaggugucugaggagucauaucgaguacuguccaaaaugggguacgauuucgacuaccggggaacugugaacgucaagggcaaaggucaaaugaagaccuauuuguacccuaaauguacagaucaccgcguuauuccccagcaucaguuaaguaucagcccagacauaagagugcaaguggauggcucgaucgggaggucucccacugacgaaauugcaaaucuggucccuuccgugcaguauguugacaagaccagccucggaucagauaguucuacgcaggccaaggacgcgcaccuguccccaaaacggcccuggaaggagccuguaaaagcugaggagcgaggcagauuugggaaggccaucgaaaaagaugacugcgaugagacaggaauugaggaagcaaacgagcuuaccaagcugaaugugagcaagucagucuga

SEQ ID NO: 52477 - RNA, 531 nt, Artificial Sequence
  derived and/or modified sequence opt3 from ADCYAP1__Homo_sapiens__NP_001093203
augaccaugugcagcggcgccagacuggcucuccuuguguacgggaucauuaugcacuccucugucuauucaagucccgcagccgcgggacugagguucccugguauacggccagaggaagaggcuuacggcgaagacgggaacccguugcccgauuuugacggaagcgagccuccaggcgccgguucccccgcaucugccccucgcgcugcagccgcuugguaucgaccagccgggcguagagauguugcgcauggaaucuuaaaugaagcauacaggaaggugcuggaccagcuaucggccggcaaacaccuccaaucacugguagcucggggcgucgggggaagccuugguggcggggccggagaugacgcagagccccugaguaagcgccauuccgauggcauuuucacagacucuuauagcagauacaggaaacagauggcugugaagaaauauuuggccgcggugcucgguaagcgguacaagcagcgcguuaaaaacaaggggcgaagaaucgccuaccuguga

SEQ ID NO: 52478 - RNA, 1407 nt, Artificial Sequence
  derived and/or modified sequence opt3 from ADCYAP1R1__Homo_sapiens__NP_001109
auggccggcgugguccacguuagccuggcugcacuccuucuguugcccauggccccugcgaugcauuccgacugcaucuucaagaaagagcaggcuauguguuuagaaaagauucaaagagccaacgagcugaugggguuuaaugauucuucaccaggaugcccggguaugugggacaacauaaccuguuggaaacccgcacacgugggcgaaaugguacucgugaguugcccugagcuauucaggaucuuuaauccagaucaggucugggaaacagagacuauuggggagagcgacuucggagauuccaacucucuggaccuuucggauaugggcgugguuucacggaauuguacggaagacgguuggagcgagcccuuuccucauuacuucgaugccugcggguuugacgaauaugagagugagaccggagaucaggacuacuauuaccuguccgugaaggcuuuguauacagucggcuacucuacuagccucgugacccugacaaccgcaaugguaauccugugucgcuuccgaaaacuccacugcacucguaacuuuauucauaugaauuuauucguuuccuuuaugcugagagccaucucaguguucauaaaggauuggauccuuuaugcugaacaggacaguaaccacuguuuuauuagcacagucgagugcaaggccgugaugguguucuuccacuacugugucguuucuaauuacuuuugguuguucaucgaaggccuguaucuauuuacccuccugguggagacguucuuuccagaaaggcgguacuucuauugguacacuauuaucggguggggaacccccacaguaugcgugacugucugggcgacccuucgccuguauuuugacgauacagguugcugggacaugaacgauuccaccgcauuguggugggugauaaaaggcccuguuguggggucaauuauggucaauuucgugcucuuuaucggaauuaucguaauccugguucaaaaguuacagagcccagacaugggcgguaacgagaguucuauuuaccugagacucgccagguccacgcuucuguugauaccgcuauucgggauccauuauacuguguuugcuuucagccccgagaaugucucgaaacgggaacgccugguguuugagcucggacugggcucuuuccagggcuucgucguggccguucuuuacuguuuucugaacggggaagugcaggcagagauuaagcgaaaauggagauccuggaagguaaauagguacuucgcugucgauuuuaagcaccggcauccuucauuggccaguagcggagugaacgguggcacacaacucuccauccugucuaaaagcucaagucagauacguauguccggguuaccagcggacaaccuggccaccuga

SEQ ID NO: 52479 - RNA, 2214 nt, Artificial Sequence
  derived and/or modified sequence opt3 from ADD1__Homo_sapiens__NP_001110
augaacggcgacagcagagccgcuguggucaccucucccccuccaacaacugcaccgcacaaggagagguacuucgaucggguugacgaaaauaaccccgaguaucugcgcgaacgaaauauggccccugaucuccgucaggacuuuaacaugauggagcaaaagaagagaguguccaugauccuucagucaccagcguucugcgaagaacuggagaguaugauucaggaacaguuuaaaaaggggaaaaaucccacgggauuguuagcucugcaacagauagccgauuucaugaccacaaacguaccuaauguguacccagcagcuccccaggguggcauggccgcacuaaacaugagccucgggauggucacuccugugaaugaccugaggggauccgauucuaucgccuaugacaagggcgagaaacuucugcgguguaaauuggcugccuuuuaccgccucgcggaucuguucgguuggucgcagcugauuuauaaccauaucaccacaagaguuaauucagaacaagagcacuuucucauugugccauucggguuacuguacagcgaggucaccgcaaguucccuugugaagaucaacuugcagggagacauaguagauaggggcucuacuaaucugggcguuaaccaggccggguuuacacuacauagcgcuaucuaugccgcacggccggacgugaaaugcgucgugcacauucauacccccgcuggagccgcgguguccgccaugaaguguggucuccugccuaucucaccagaagcacuuagucugggcgaggucgcuuaccacgauuaccacgggauuuugguugacgaagaggaaaaagugcucauccagaagaaucugggacccaagagcaaaguauuaauacugcgcaaccauggccucgugucugucggugaguccguggaggaagccuucuauuacauucacaaccuuguuguggcuugcgagauccaaguccgaacgcuggccucagcagggggaccugacaauuuggugcuacugaacccagaaaaguauaaagccaagagcagaagucccggcucuccgguaggcgaggggacuggauccccucccaaauggcagauuggugaacaggaguuugaggcucucaugaggaugcuggauaaucuuggcuaccggaccggguauccauaccguuauccugcgcugcgcgaaaagagcaaaaaguacucggacguugaggugcccgcaucugucacaggauacuccuucgccucagauggcgacagugguacuuguagcccauugagacauuccuuucaaaagcagcagagggagaaaacccgguggcucaacucugggcgaggcgaugaggcuagcgaagagggacagaauggcucaagucccaaguccaaaacaaaguggaccaaagaggacgggcaccgcacgagcacuucugccgugccuaaccuguucgucccauuaaauacaaacccgaaggaagugcaagagaugagaaauaagaucagggaacagaaccugcaggauaucaaaaccgcaggaccccagucacaaguucuaugcggugugguaauggaccggagucucguccagggcgagcuggugacugccagcaaggcuauuauagagaaagaauaucagccucacguuaucguguccacaaccgggccaaaucccuucacgacccuuacagaucgcgaguuggaagaguacagaagggaagucgagcguaagcagaaaggaucugaggaaaaccuggacgaggcccgggaacaaaaggagaagucgccuccagaucagcccgcagugccgcauccuccacccagcacuccuauuaaacucgaagaggaccugguacccgagccaaccacaggcgacgauuccgacgcggcuacuuuuaagccuacccuucccgaucugucaccagacgaaccgagugaggccuuggguuucccuaugcucgaaaaagaggaagaggcacaccgacccccaucucccacagaggccccuaccgaagcuagcccagagcccgccccugauccggcaccaguggcugaagaggccgcgcccuccgccguugaggaaggggcugcagccgacccuggcucagauggaagcccaggcaagucucccuccaaaaagaagaaaaaguuuagaacuccuaguuuccugaaaaagagcaaaaagaaaucugacuccuga

SEQ ID NO: 52480 - RNA, 1728 nt, Artificial Sequence
  derived and/or modified sequence opt3 from ADD2__Homo_sapiens__NP_001171984
augcccagaaggcgggugccuggcgccaacugcaagccaaccgggaaaaugagcgaggaaacagucccggaggcugcaucucccccuccaccccagggacaaccuuacuucgaccgcuuuuccgaagaugacccagaguauaugcgacugcguaauagagccgcggaucucaggcaggacuucaaccuuauggaacagaagaaacggguuacuaugauccugcagucacccaguuuucgcgaggaguuggaagguuuaauucaagagcagaugaagaaaggcaauaacagcuccaauauaugggcucugagacagaucgccgauuucauggcaucuacgucgcacgccguguuuccuaccucaagcaugaacguaaguaugaugacaccaauuaaugaccuacauacugcugauucccucaaccuggcaaagggggaaaggcuuaugcgguguaagaucucuagcguguaccgccuguuggaccucuauggaugggcccagcuguccgauaccuacgucacacugcgagugucaaaagagcaagaccacuuccucauuaguccgaagggcguuagcugcucugaggugaccgcuuccucauuaaucaaagucaauauacugggugaagugguagagaaggggagcaguuguuuucccguugauacuacaggauucugccuucauucugccaucuaugcggcaagaccugacgugagguguauuauccacuugcauaccccagccacggcugccgucuccgcaaugaaauggggccugcuacccgugagccacaacgcucuccuggugggcgauauggccuacuaugacuuuaauggggaaauggagcaggaagcggaccggauuaaccuucagaagugccugggaccuacuuguaagaucuugguccuccguaaucacgguguuguggcccugggcgauaccguagaggaggcauucuacaaaauauuucauuuacaggcugccugcgaaauucaagugucggcucugucuuccgccgggggagucgagaaccucauccuucuggaacaggagaagcaccgcccacaugaagugggcucaguucagugggcagguaguacauucgggcccaugcagaaaagcagauugggagagcacgaguuugaagcccuaaugaggaugcuggacaaucucggcuaccggacuggcuauaccuaccgacacccguucgugcaagagaagacaaaacauaaguccgaagucgagauuccugcuaccgugacggcguucguauuugaagaggauggggcacccguuccagcccugcgccagcacgcucagaaacaacagaaggagaagacuagauggcuuaacacaccuaacaccuaucugagggugaaugucgccgacgaagugcagcggucuaugggaagcccccgcccaaaaacuacauggaugaaggcagaugaggucgaaaaaucaaguuccgguaugcccaucagaaucgagaacccuaaucaguucgugccauuguacaccgacccgcaagagguucucgaaaugaggaacaagauucgugagcagaaucggcaggaugugaaaagcgccggcccccagucucaacuguuagcuucaguaauagccgaaaagagucgaagcccugucgagcagagacugccacuaacgggcggagaaaccugucuccccuccgggucuucggugccuggugcagggcugcaggacccauga

SEQ ID NO: 52481 - RNA, 2121 nt, Artificial Sequence
  derived and/or modified sequence opt3 from ADD3__Homo_sapiens__NP_058432
augagcuccgacgccucucagggcgugaucaccacacccccuccaccgucaaugccccacaaggagagauacuucgauaggauuaacgaaaaugacccugaguauauacgggaacgcaacaugaguccagaucugcgacaagacuuuaauaugauggagcagcguaaaagagucacucagauccuccagagccccgcuuucagggaagaucuugagugccugauucaagagcagaugaagaaagggcauaacccuacgggauuguuagcacugcagcagaucgccgacuacauuauggcuaauuccuuuucugguuucucgucaccaccccuaagccucggcaugguuaccccuaucaacgaucugccaggggcggacacaaguuccuaugugaagggagaaaaacuuacucgguguaagcuggccucuuuguaccgccucguagaucuguuuggcugggcacaccuggccaauaccuauauaagcgugagaaucuccaaggagcaagaccauauuaucauuaucccgaggggucucucauucagugaagcuacagcaagcaacuuagucaaagugaauauaauuggggagguuguggaucagggaucuaccaaccugaagaucgaccacacuggcuuuucaccccaugccgcuauuuacuccacacggccugaugucaaaugcgugauccacauccacacccuugccacggcggcaguaagcaguaugaaguguggcauuuugccaauaucucaggagucccugcuacucggggacguugccuauuacgacuaccagggaagccuggaagaacaagaagaacgcauccagcuucagaaagugcugggucccucgugcaaggucuuggugcuccgaaaucauggcguggucgcucugggggaaacuuuagaggaggccuuccacuauauuuuuaacguucaacuggcaugugaaauccaggugcaggcucucgccggagcgggcgguguagauaaucuucaugugcuggacuuccagaaguacaaagccuuuaccuauacagucgcagcuucugggggaggcggcgugaacauggggucccaccaaaaguggaaaguuggagagauagaguucgaggguuugaugagaacucuagauaaucugggcuacaggaccggguaugccuaccggcacccucucauucgugaaaagccacgccauaaaucagacguggagauccccgcuacagucaccgccuuuaguuucgaggaugacacggugccgcugagcccucuuaaguauauggcacagagacagcagagggagaaaacucgguggcugaacucccccaacacauacaugaagguaaauguuccagaggaaucucgaaacggagagaccagcccucgcacuaagaucacauggaugaaagccgaagauucaaguaagguguccggcgguacccccauuaaaaucgaggacccaaaucaauucguccccuugaacacgaauccuaacgaggugcucgaaaagagaaauaaaauuagggagcagaaccgguacgaucugaagaccgcugggccacagagccaguuacuggcgggcauagucguggacaagccgcccucuacaaugcaauuugaagaugacgaccacggaccuccagcacccccuaauccauucucacaucuaacugagggcgagcucgaagaguauaaacgcaccaucgaaagaaagcagcaggggcuggaggaugccgaacaggagcuuuugagugacgaugcuagcuccguuucucaaauucagucgcagacacaaagcccccagaacgugccggagaaacuggaagagaaucacgaacucuuuuccaagucauucaucaguauggagguaccugucauggugguuaacggaaaagacgauaugcaugacguggaagaugagcuggccaagagggucucucgucuuagcacuuccaccacaaucgagaauauugaaauaaccaucaagucaccagagaaaauugaagaggugcugagccccgaagguucuccuuccaagagucccagcaaaaagaaaaagaaguuucggacuccaucuuucuugaaaaagaacaaaaagaaagagaagguagaggcauga

SEQ ID NO: 52482 - RNA, 5004 nt, Artificial Sequence
  derived and/or modified sequence opt3 from ADGB__Homo_sapiens__NP_078970
auggcaagcaagcaaaccaaaaagaaagaggugcacagaauaaacuccgcucauggcucugacaagucaaaagauuucuaccccuuugggagcaauguccaaagcggauccacugaacagaagaaggguaaauucccucuguggccagaguggucugaagcagacauuaacucggagaagugggaugccggcaaaggggcgaaggaaaaagacaagacuggaaagucaccgguuuuucacuucuuugaggaucccgagggcaaaauagaacucccuccaagccuuaagaucuauaguuggaaaaggccccaggacauucuguucucccagacgccugugguagugaagaaugagaucaccuuugauuuguucucugcuaacgaacauuuacugugcagcgagcuaaugcgguggauuaucuccgagauauacgccgucuggaaaaucuuuaauggugggauucucucaaacuauuucaagggaaccaguggcgaaccaccccugcuuccuuggaaaccaugggagcacaucuacagccuguguaaggcagugaagggccauaugccguuguuuaauucuuaugggaaauacguugugaagcucuauuggaugggaugcuggcgcaaaauuacuaucgacgauuuccugcccuuugacgaagauaacaaucugcucuuaccugccacuacauacgaguucgaacuguggccaaugcuuuuguccaaggcuauaauuaaacuggcaaacaucgacauucacgucgccgaucgacgugagcuaggugaguucaccgugauccacgcucucacuggcuggcugcccgaaguaaucucacuucauccuggguacauggacaagguuugggagcuguugaaggaaauucucccagaguuuaaacugagcgacgaagccaguucugaguccaagauagcgguguuagauagcaaacugaaggagcccggaaaagaaggcaaggaggguaaggaaaucaaagacgggaaggaggucaaagaugugaaggaguucaaaccggagucgucucucacaacccuuaaggcaccugagaaguccgacaaagugcccaaggaaaaagccgaugcuagagacauuggaaagaaaaggucaaaggauggcgagaaagaaaaguuuaaguucagucugcacggcagccggccauccucugagguccaauauagcguucagucauugagugacuguuccagcgccauccagacgucucauauggugguauacgcaacuuuuaccccucuauaucuguucgagaauaaaauauuuucacucgaaaagauggcugauagugccgagaaacugcgcgaauacgggcuuagccacauuugcucccaccccgugcuggucacaagaucuaggucguguccauugguggcgcccccuaagccaccgccccucccuccauggaaacugauccggcagaagaaggagacuguuaucaccgacgaagcccaagaguuaauugugaaaaagcccgagcgcuuccuggaaaucagcuccccuuuucuaaacuaucgaaugacaccauucaccauucccacggagaugcauuuugucagaucacucaucaagaagggaaucccgccugguagugaucugccaucugugagcgaaacugacgagacagcaacccacucccagacugaccuuucacagauuacaaaagcuaccagccagggcaauacggccucucaaguaaucuuggggaagggaaccgaugaacagacagacuucggccugggugaugcucaucaguccgacgggcucaaccuggagagggagaucguuagucaaacuaccgccacacaggaaaagagccaggaggaacuucccacuaccaauaacucuguguccaaagagauuuggcuggauuuugaagacuucugcgucuguuuccagaacauauacaucuuucacaagccuucaaguuauugcuugaauuuccagaaaagcgaguuuaaguucucggaggaacggguguccuacuaccucuuugucgauucucugaaacccauugaguuacugguguguuucagcgcccugguucguuggggcgaauauggagcccucacaaaggacucaccaccuaucgagcccggccugcuuaccgcugagacuuuuaguuggaaguccuugaaaccagggucucuggugcucaagauucauacguacgcgacaaaagcaaccguaguccgccugccggugggaagacacauguuacuguucaacgccuauagcccuguuggucacuccauccauauaugcucaauggugagcuuugucaucggcgaugaacacgugguacuucccaauuucgagccagaaaguuguagguuuacugagcagucuuugcucauuaugaaggcuaucgggaacgugauugccaauuucaaagacaagggaaaacuguccgcagcccuaaaggaucugcagaccgcucauuaccccguuccuuuucacgacaaggaacucacagcccagcacuuccgggucuuccaucugagccuuuggcgauugaugaaaaaggugcaaaucaccaaaccacccccuaacuuuaaguucgcauuucgcgcgauggugcuggauuuagagcuccuaaauucgucacuugaggaagucucucugguugagugguuggacgugaaauauugcaugccgacaagcgacaaggaauacuccgcugaggaaguggccgcagccauaaagauucaggcuauguggagaggcacauauguaaggcuccugaugaaagcccggaucccagauacgaaggagaacauuagcgucgcagacacccuacagaaagugugggcuguucuggagaugaaucucgaacaguacgccgugucucugcuucgcuugauguucaagagcaaaugcaagucccuggagucauaccccuguuaucaagaugaagagacuaagaucgcguuugccgacuacacagucaccuaucaggaacagccuccaaacaguugguucauaguguuuagagagacauucuuaguucaccaggauaugauccucgugcccaaaguauacacuacccugccuauuugcauccuucauauugucaauaacgacacgauggagcaagugccgaagguguuucagaaagucguucccuaucuguacaccaagaauaaaaaggguuauacauucguggcugaagcauuuacuggggauaccuacguagccgcuaguagguggaagcuacgucucaucggaucuuccgccccacugccuuguuugucacgggacagucccugcaacagcuucgcaauaaaagagauucgagauuacuauaucccaaaugacaagaaaauccuguucagauacuccgugaaggucuuaacaccucagcccgcgacuauucaagugaggaccucuaaaccagaugccuuuaucaagcuccagguucuggaaaacgaggagacgauggugucgagcacaggaaagggccaggcuauuauaccggccuuccacuuucuuaaaucagaaaaggggcuguccagucagucuagcaaacauaucuuguccuuccacucagcaucuaagaaagagcaagaagucuaugugaagaaaaaggcugcccagggcauucaaaagagcccuaaaggucgcgcaguuagugccauccaggacauuggccucccccugguggaggaagagaccacuuccacaccaacccgggaggauaguucuucaacuccccuacaaaacuacaaguauaucauacaguguuccguccuguacaauaguuggccucuuaccgaaagccagcucacauuuguacaggcucugaaagacuugaagaaaucgaacacgaaggcguauggggagagacacgaagaacugaucaauuuaggaucuccagacucccauaccauuagcgaaggccaaaagucaagugugacuucuaaaacaaccaggaaggguaaagagaaguccagcgagaaagaaaagacagccaaggagaaacaggcaccccgcuucgaaccucagaucucaacuguucacccgcaacaggaggauccaaacaagcccuacuggauucuccgacuggugaccgaacauaaugagagugagcuuuuugaagucaaaaaggacacggagcgggcugaugaaauccgugccaugaaacaggccugggagacaaccgagccugggagagcuauaaaggcaagccaggccaggcugcacuacuuguccggcuucauuaagaaaacuucugacgcggaaagucccccaaucuccgagucacaaaccaagccuaaagaagagguggaaacagcugcccgcggaguaaaggagcccaacucuaaaaauagugcaggcucggagagcaaggaaaugacucagaccggguccggaucugccguguggaaaaaguggcagcucacaaagggccugcgggaugucgcuaaaucaacgagcuccgagaguggugggguuucuagcccaggaaaggaagagagagaacagucaaccaggaaagagaacauccaaacuggcccucgaacacgcuccccgaccauucuagagacaagcccccggcugauaagaaaggcacuugaauuuauggaccucagccaguaugugaggaaaacagauaccgacccacuguugcagacggaugaguuaaaucagcaacaggccaugcagaaggcggaagagauccaucaguuccgucaacaccgcacucgggugcugucuauuagaaacaucgaccaggaagagaggcucaagcugaaagaugagguccuugacauguacaaggaaaugcaggacucccuggaugaggcucgacagaaaauuuuugacauccgggaagaguaucgcaauaaguugcuagaggccgaacaccugaaacucgagacccuggcagcccaggaagcugccaugaaacuugagacagaaaagaugaccccugcacccgauacucagaaaaagaaaaaggguaaaaagaaguga

SEQ ID NO: 52483 - RNA, 1683 nt, Artificial Sequence
  derived and/or modified sequence opt3 from ADGRA1__Homo_sapiens__NP_001077378
auggaccugaagaccgugcucagccuucccagauacccuggcgaguuccugcacccagucguuuaugccugcacagcugugauguuguuaugucugcuagcauccuuuguaacuuacaucgugcaucagucugccauuaggauaucacggaaagggcgccacacgcuccugaacuucugcuuucaugcggcucuuaccuucacagucuuugccggagguaucaaucgaacuaaguauccgauucugugucaagcagugggcaucguuuugcacuacaguacccucagcacaaugcuguggauuggggugaccgcccguaacaucuauaaacaggucacuaagaaagcuccccugugccucgauacagaccagccuccauaccccagacagccuuuacugagguucuaucuuguguccggaggcguaccauuuauaaucugugguguuaccgcagccacgaauauucggaacuacgggacugaagaugaggacaccgcuuacugcuggauggccugggaacccucuuugggagcguucuauggcccugcagccaucauuacacuggugacuugugucuacuuucuaggcaccuaugugcaacuccgcagacauccagggaggcgguacgagcugcgcacacagccggaggaacagcgaagacuugcuacccccgagggagguaggggcauccggccugggacgccacccgcccacgaugcaccuggagcuucggugcugcagaaugaacacucauuccaagcccaguugcgugcggccgcauuuacucucuuccuguuuacagcuaccugggccuucggcgcuuuagccgucagccagggucauuuccuggacaugguuuuuaguugccucuauggggcauucugugugacucuuggacuguuuguauugauacaccauugcgccaagcgcgaggauguguggcaguguuggugggcuugcugcccacccagaaaggacgcgcacccggcacuagaugccaacggcgcugcccugggcagggcagccugucuccacuccccugggcugggacaaccccgggguuucgcucauccaccuggccccugcaaaaugacaaaucuucaggccgcacaggggcacgcgucuugucugagcccagcuacccccugcugugccaagaugcauugcgaaccuuugacggcagacgaggcccacguccaucuccaagaggaaggagcuuuuggccacgauccacaucugcacgguuguuuacaggggcgaaccaaaccgcccuacuucucccgccacccugccgaggaaccagaguaugcauaccauauucccucaagucuggacggcagcccuagaucuuccaggacagauucaccacccagcagucuagacggaccggcuggcacucacacccucgccugcuguacacagggggacccuuuuccaauggugacucagcccgaaggaucugaugguuccccugcgcuguacagcugccccacccaaccaggccgggaggccgcucuugggccuggacacuuggagaugcugcgcagaacacagucgcuccccuucggcgguccaucucagaacgggcugccgaagggcaaacuucuggaaggauugccuuuuggcaccgacgggacuggaaauaucaggacgggucccuggaagaacgagacaaccguuuga

SEQ ID NO: 52484 - RNA, 4017 nt, Artificial Sequence
  derived and/or modified sequence opt3 from ADGRA2__Homo_sapiens__NP_116166
augggcgccgggggaagaaggaugcggggugcucccgcacgccugcuccuuccucuguugccaugguuacugcuacuccuggccccggaggcgcgaggcgcucccgggugcccucuuagcauccguuccuguaagugcucuggagaaagaccaaaaggccugucagguggggugcccggaccugccaggcggcgcgucguuuguaguggcggcgacuugccagagcccccugaaccagggcuccugccgaacggaaccgugacacugcucuuaagcaauaacaagauuacuggucugagaaauggcuccuuccuuggguugucucugcuagagaaacucgaucugaggaacaauauaaucucgacgguacagcccggagcauuucuuggccugggugaauugaagcggcucgaccugucaaacaaucgcauugggugcuuaaccagcgagacauuccaaggacugccucgacuccuuagacugaacaucaguggcaauaucuuuuccucuuugcagccaggcguguucgaugagcuacccgcccugaaagucguggaccucgggacugaauuucugaccugugauugccaccuuagguggcuguugccuugggcucagaaccggagccuccagcuguccgagcauacauuaugugcauacccaucagcccugcacgcucaagcccuaggaagucuccaggaagcgcagcugugcugugagggugcacuugaguugcauacccaccaucugauucccagccuccgucagguuguguuccaaggcgaccgccugccguuucagugcucugccuccuaucuugggaaugauacuagaauaaggugguaccacaaccgggcuccugucgaaggagacgagcaggccggcauccuguuggcagaaucacucauucacgauuguacauucaucaccagcgagcugacguuaagucauauuggugugugggcuucuggggaaugggagugcacuguauccauggcccagggcaaugcgagcaagaagguugagaucgugguccuggaaaccucggccucuuauugccccgcagagcgaguggcuaacaaucgcggagacuuuagauggccaaggacacuagccggcauaacugcuuaccaauccugucuccaguauccuuucaccucagugccccucgggggaggugccccaggcacacgggcaagucgcagaugcgauagggccgggcguugggaacccggagacuacagccacugucuuuauaccaacgauauuacgcgggucuuguacacuuuuguucugaugccuaucaacgcuuccaaugcgcucacacuggcacaucaguuacgaguguacaccgccgaggcugccucuuucagcgacaugauggacguaguguaugucgcacaaaugauucagaaauuucugggcuacguggaucagaucaaggaacuuguugaggugauggucgacauggccucaaacuugaugcucguggaugagcaucugcuauggcuggcucagagagaagacaaagccugcaguaggaucguaggugcacucgagcgcauugggggcgcggcucuguccccacacgcccaacacauaagcguuaaugcacggaacguggcccuugaagcauauuugaucaagccgcacucuuacgucggacugacuuguacagccuuccagagaagggagggcggggugcccggaacccgcccugguucaccaggccagaaucccccuccagaacccgagccgccugcagaucagcaauuacgauuccggugcacgaccgggcguccaaacgucagucucagcuccuuucauauuaaaaauucuguggcucuggccucgauccagcuucccccuagccuguucuccucauugcccgcggcccucgcuccaccuguucccccagacuguacacugcagcuacugguguuuagaaacggaaggcuguuccacagucauucuaauacuagccgcccgggcgcagccgguccugggaagcggagaggcguagcuacccccgucauauuugccggaacauccggcugcggggugggaaaccugacugagccaguugcagugucacuuaggcacugggcggaaggcgccgagcccgucgcugccugguggagccaggaagguccuggggaggcaggaggcuggaccucugaggguugucaauugcgauccagucagccaaaugugagcgcucugcacugccagcauuuaggcaacguagccgugcucauggaacugucugcauucccccgcgagguugggggagccggcgcugggcuucacccugucguguauccguguacagcgcugcuacuccugugcuuguuugccaccauuaucacuuacauccugaaucauuccucaauucgggugaguagaaagggauggcacauguuacucaaccugugcuuccacaucgcaaugacgagcgcugucuuugccggcgguauuacacuuaccaauuaucagaugguuugucaagccguggggauaacucugcauuacucguccuugucuacccuccuguggaugggagugaaagcuaggguacuacacaaggaacugacauggcgugcaccacccccucaggagggcgauccagcccuucccaccccuagcccgaugcuccgcuucuaccugaucgcggguggcauucccuugaucaucugcgggauuacugcugccgucaacauacauaacuaucgggaccacucaccauacuguuggcugguguggagaccuaguuuaggagcauuuuauauccccguugcccucauucugcuuaucacauggauuuacuuccugugcgcuggcuugaggcuccgagggccacuggcacagaauccuaaagccggaaacucccgggcgucucuagaagcuggcgaggagcugcgcgguagcacgagacuuaggggguccggaccccuccugucagauagcggcaguuuguuagccaccgguucugcacgggugggcacuccagggccgccugaagacggagauucccuguauagccccggcguccaacucggggcccuggugacaacccauuuucuuuaccuggcuaugugggccuguggagcauuggcuguuucgcagcgauggcuaccaagagugguaugcucaugucuguauggcgucgccgcgucugcccucggucuguucguguucacacaccacugcgcacgcaggcgugacgugcgggcuaguuggagagccuguugucccccugcuuccccagcagcuccccaugccccuccgagggcccuuccagcggcagccgaggacgggagccccgucuuuggagaaggcccucccucuuuaaagagcuccccaucaggcaguagcgggcacccucuggcucucggacccugcaaauugacuaaucugcagcucgcccagucucaaguuugcgaggcuggugccgcugcgggcggggaaggagagccagagccugccggcacccgcgguaaccuggcacaucgacacccgaauaacgugcaucacgggagacgggcucacaaguccagggccaaaggacaucgcgcaggcgaagccugcggcaagaaucgucuuaaggcucugagagggggagccgcgggugcauuggagcuacugucaagugaaagcggcucccuccacaacucucccacggauucguacuuagggagcucacggaacuccccaggagccggccugcagcuugagggugaaccuaugcugacccccagugaggggucugacacaagcgcugccccacucuccgaggcuggaagggcaggccagcgccgaucagccucuagagauagcuugaaaggcgggggagcucuggaaaaggagagucaucggagguccuacccucucaaugccgcaagccugaauggugcgcccaaaggcgggaaguaugacgauguaacucuuaugggagccgaaguggcuucuggcgguuguaugaaaaccgggcuauggaagucagagacaacugucuga

SEQ ID NO: 52485 - RNA, 3966 nt, Artificial Sequence
  derived and/or modified sequence opt3 from ADGRA3__Homo_sapiens__NP_660333
auggagcccccuggcagaaggcgggggcgcgcccagccaccgcugcuccuuccccugagcuuguuagcucugcuagcacuccugggagguggcgggggaggcggugccgcggcacuuccugccgggugcaagcacgacggacgaccacguggcgcaggcagagccgcuggggcagccgaaggaaaaguggucuguuccucucuggaguuggcucaaguucuucccccugauacccugccaaacaggacagugacucugauccucucaaauaacaagauuagugaacugaaaaaugguagcuucuccggcuuaucucuuuuggagcggcuggaccuacgcaacaaucucauaucgucaaucgaucccggggccuuuuggggacugagcagucuuaagagacuggacuugacgaacaauaggauuggcugccucaacgcggauaucuuccggggucugaccaauuuaguacgccugaaccucuccgggaaucucuuuucuagccugucccagggaacauucgacuacuuggcaucacuacgaagucuggaauuucagacugaguaucuccugugugauugcaacauucuuuggaugcauagaugggugaaagagaagaauaucaccgucagggacacacgguguguguacccuaagagccugcaggcccaaccaguuaccggcgugaaacaggaauugcucacuugcgauccgccccuggaguuaccuucuuucuauaugacaccaucccaccgucaggucguguuugaaggcgacucacugcccuuccaguguauggcuagcuacauagaucaagacaugcagguacuaugguaucaggaugggcgcaucguugagaccgacgagagucagggaauuuuuguggaaaagaacaugauccauaauugcucucucauugccuccgcacugacgaucagcaacauacaagcugguucgacuggcaacugggggugucacguccagaccaaaagaggaaauaacacaaggacuguggacauugugguccuugagucuuccgcccaguacugcccuccagaacggguugugaauaacaagggcgauuuccgauggccccgcaccuuggcggguaucacagccuaucugcaauguaccagaaauacgcaugggucaggcauuuacccgggaaacccucaggacgagaggaaagcauggcggcgcugcgauagaggcggguuuugggcugacgaugacuacaguaggugccaguaugccaaugauguaacucgugugcucuacauguucaaccagaugccccugaaucuuacaaacgcugucgccaccgcacggcaacuguuggccuauacuguggaagcugcgaauuuuagcgacaagauggauguuaucuucguggcagagaugaucgagaaguucggacgauuuacaaaagaagagaaguccaaagaacucggugacgucaugguggauauugccucuaacauaaugcuggcugacgagagaguauuauggcuggcccagagggaagcaaaggccuguagccgcaucguucagugccuacagcggauugcuaccuacagacucgccggcggggcacacguguauucaacguacaguccaaauaucgcgcuggaggcuuaugucauaaaauccaccggauucacaggcaugacuuguaccguguuucaaaaggucgccgcaagcgacaggacaggucuuucugauuacgggcgccgagacccugagggcaacuuggauaaacagcugucauucaagugcaaugugaguaacacuuuuagcucccucgcccugaagaacaccauuguugaggcuucuauccaguuacccccaucgcuguucagccccaaacagaagcgggaacuucguccuacagacgauuccuuguacaaacuccaacugaucgccuuuagaaauggaaagcuauucccagcaaccggcaacucaacuaaucuggcugacgaugggaaaaggcgcacggugguaacaccggucauucucaccaagaucgacggagugaacguugauacucaccauauucccgugaaugucacccugcggagaauagcccacggugcggacgccguggcugcaaggugggauuuugaccuuuugaacggccaagggggauggaagagugauggcugucauauccuguauucugacgaaaauauuacaaccauccagugcuacagcuuauccaacuaugccguacucauggaccugacugguucagagcuuuacacacaggcugccagccuguugcacccugugguuuauacgaccgcaaucauucuccugcuaugucugcucgcggucauagugucuuacaucuaucaccauucccugauucgaaucagucuuaaaagcuggcacauguuggugaaucugugcuuccauaucuuuuuaacuugugucguuuucguagggggcauuacacagacccgcaacgccucuauaugccaggcugugggaaucauucuccacuacuccacacuggccacugugcuuugggucggcgugaccgcacggaauaucuacaagcagguuacgaaaaaggcuaaaagaugucaagauccagacgaacccccuccacccccgaggccuaugcugcguuuuuaucuaauugggggaggcaucccaauaauugugugcgguaucaccgccgcagccaacauuaagaauuacgggucacgccccaacgcuccuuauugcuggauggcgugggagcccagucucggagccuucuacggcccagcuagcuucaucacauuugucaauuguauguauuuccugucgauauuuauccaguugaagcggcauccugagagaaaauacgaacugaaggagcccacugaggaacagcagagguuagcugccaacgagaacggugaaauuaaucaccaagauuccaugucucucagccugaucucaaccagugcccuugagaacgaacacacauuccauucccagcuguugggcgcuucucucacucugcuacuguauguggcacuuuggauguuuggggcccucgcgguuagccuguacuacccauuggaccugguguucuccuuuguauucggagcuaccucacucagcuuuagugccuucuuugucgugcaccauugcgugaaucgagaggauguccgguuagcauggauuaugacguguugcccgggcagaucuuccuauagcguucaggugaacguacagccucccaauucgaacgggacaaauggagaagccccaaaaugucccaacucaucugcugagaguuccugcaccaauaagagcgcaucuagcuucaaaaacuccucacaaggcuguaagcugacuaaucuucaggccgcggcugcccagugccacgcaaacagucugccuuugaauagcacaccacagcucgacaacucucugaccgagcacuccauggauaaugacaucaagaugcauguggcuccccuagaaguccaauuucgcacuaacgugcacucaaguaggcaucacaaaaaccggagcaagggucaucgagccuccagacugaccguucuucgcgaguacgccuaugaugugccuacaucugucgaagggucggugcagaauggacucccgaaaagcaggcugggcaacaaugagggucacucacguucccggagagcauacuuggcuuauagggaacgccaguacaacccaccccaacaggacaguucugaugccuguagcacguuaccuaaguccucacgaaauuucgagaaaccaguuucuaccacuagcaagaaagacgcgcugagaaagcccgccguggucgagcucgaaaaccagcagaagaguuauggccugaaucuugcaauacaaaacgggccuauuaaauccaauggacaggagggcccgcuguuggggacagauagcaccggaaacguacggacaggccuauggaagcacgaaacuaccguguga

SEQ ID NO: 52486 - RNA, 4755 nt, Artificial Sequence
  derived and/or modified sequence opt3 from ADGRB1__Homo_sapiens__XP_011515501
augagaggccaggccgcugcacccgggccuguguggauccuggccccacuccuucuguuguuacugcuacucggaaggcgggcgcgcgcugccgcuggugccgacgcuggcccggggcccgagccuugcgcaacccugguccaaggaaaguucuuuggcuacuucagcgccgcugccguuuuuccagcgaacgcaucccgauguucuuggacacuucguaaucccgauccuagaagguauacucuguacaugaaaguggccaaggcuccaguacccugcucagguccugggcgggugcgcacguaucaguucgacagcuuuuuggaaagcaccagaacauaccucggagucgaguccuucgaugaagugcugaggcugugugacccaucugccccgcucgcauuuuuacaggcuucgaaacaguuccugcaaaugcggcgccagcagcccccucagcacgauggccuucgaccaagagccgggcccccugggccaacugacgauuuuucaguugaguauuugguggucggaaacaggaaucccagccgggcggccugccaaaugcugugucguuggcuagacgcaugccucgcugguagucgcuccucucauccguguggcauuaugcagaccccuugcgccugucuagggggagaagcuggcggucccgccgcagggccacuugccccuagaggagaugugugccugagggacgcuguagcgggcggccccgagaacuguuugacaagccucacccaggaucggggcggacacggugcaacuggcggguggaagcugugguccuuauggggagagugcacacgagacugcggcggugggcugcagacccgcacgagaacuugucucccagcccccggcguugaaggaggcgggugcgagggagugcuugaagaggguaggcaauguaaucgggaggcuugcggcccugccgggcgcaccucaaguagaagccagucucugagguccacagaugcacgucggcgagaagaguugggagacgaacuacagcaauucggcuuuccagccccgcagacuggugaccccgcugccgaggaauggucaccuuggagcgucuguaguucuaccugcggggagggcuggcagacaagaaccagguucuguguguccagcucguacucuacgcagugcuccggaccacugcgcgagcaacggcucuguaacaauucagcagugugccccguccauggcgcgugggaugaauggaguccuuggagccuguguuccucuacuugcgggagaggauuuagggaccgcacacgaaccugccggccaccccaguucgguggcaacccgugugaggggccugaaaaacagacuaaguucugcaauauagcucuuuguccaggacgugccguugauggcaacuggaaugaguggagcucauggagugcaugcuccgccagcuguucucaggguagacaacagaggacacgcgaaugcaacgggcccucauauggcggagcugagugucagggccacuggguggagacccgggacugcuuucugcagcaauguccuguagaugggaaguggcaggccugggcaaguuggggaagcugcuccgugacguguggcgcugguucucagagaagggaacgagucugcucggggcccuucuuuggaggcgccgcgugccaggguccacaagacgaguaccgccaguguggcacccagcggugcccugaaccccaugagaucugugaugaagacaauuucggggccgugauuuggaaagagacaccagcuggagagguugcagccgugagaugcccgaggaacgcuacuggcuugauccuccgucgcugugaacuggaugaggaagggauugccuacugggagccucccaccuauauccggugcgucagcauagacuacagaaauauccaaaugaugacaagggagcacuuagcaaaggcgcagcgaggacugccaggcgaagguguguccgagguaauucagacucuaguugaaaucucacaggaugggaccaguuauucuggagaccuccugagcacaauugacgugcuucggaacaugaccgagaucuuucgcagagccuacuauucccccacuccuggcgauguccaaaacuucgugcagauauugucaaaucugcucgcugaagagaacagggacaaaugggaggaagcccagcuggcagguccaaaugcuaaggagcuuuuucggcuggucgaagauuucguggacguuauuggcuuucgaaugaaagauuugagagacgccuaccaggugacggauaaccucguacugagcauccacaaguuacccgcaucuggggccacagacauuuccuucccuaugaagggauggcgcgcuaccggcgauugggcgaaagucccggaggacagggugacuguuaguaagagcguguuuucuaccgggcugacagaagccgaugaggcauccgucuucgugguaggaaccgugcuauaucguaaucucggcucauuucuggcacuucaacggaacacuacaguuuugaauaguaaagucaucagcgugacggugaagccacccccuagaucgcugaggaccccacucgagaucgaguucgcccauauguacaacgguacuacaaaucagaccuguauucugugggacgaaacagauguccccuccucuagcgccccuccgcaguuagggcccuggucauggcgcggaugccgaacuguuccacuggacgcucuuagaacccgguguuugugcgacaggcucaguacguucgcaauacuggcccagcuauccgcggaugcuaacauggaaaaagccacccugccuucugugacacucaucgugggcugugguguaagcucccugacucuuuugaugcuggucauuaucuacgugucaguuuggcgcuauauacguagcgagagaagugugauuuuaaucaauuuuugccucucuaucauuuccagcaacgcacugauccuuauuggccaaacccagacacggaauaaggucgugugcacucugguugccgcuuucuugcacuuuuucuuucucucgucauucuguugggugcugaccgaagcauggcagucuuacauggccguaacggggcaucuaaggaaccgccugauacgaaaaagauuucucugccugggauggggccuucccgcguuggucguggcuaucagugugggguucacaaaggccaagggauauuccaccaugaauuacuguuggcugagcuuagagggcggucuccuguaugcauuugucgggccagccgcugccguugugcuuguaaacauggugauuggaauccuggucuucaacaaacuggugucuaaggacggcaucacugauaaaaagcucaaagagcgggcaggcgcuagccugugguccucaugcguuguguugccucuguuagcccucacauggaugagugcgguccuggccgugaccgacaggcgcagcgcacuuuuucaaauucuguucgcuguuuuugauucuuuggaaggguucgugauagucaugguacacuguauccucagaagggaggugcaggacgccguuaagugccggguggucgaucgucaggaagagggaaauggugacuccggcgggucauuccagaacggacacgcucaacugaugacugauuuugagaaggacguggaucuagcaugucgcaguguacugaauaaagacauugccgccugccgaaccgcuacaaucacgggcacccuuaagagacccagccucccagaagaggaaaaacugaaguuggcgcaugcaaaagguccgccuacuaacuucaauucccugcccgccaacgugucuaaguuacaccuccaugggucgccaagguaccccggaggcccucugccagauuuucccaaucacagccuuacacugaagcgggacaaagcuccuaagucauccuucgucggcgacggggauauuuuuaaaaaguuggacagugagcucucucgcgcccaggaaaaagcacuggauaccagcuauguuauccuaccgacagccacugcuacccugagaccaaagcccaaggaggagccuaaauacuccauacauaucgaccagaugccccagacgaggcuuauucaccucucaacagcgccagaagccucucugccugcacggagucccccaagucgacaaccuccguccggaggucccccagaggcuccucccgcccagccaccucccccgccaccucccccacccccuccgccccagcagccauugccucccccuccaaacuuagaacccgcaccuccaagccugggcgaucccggggagccggccgcucacccuggaccaucuaccggccccucaacuaagaaugaaaacguggccacccucuccgugaguagccuggagagacgcaaaucgagguacgcggagcuugacuucgaaaagaucaugcauacacggaaacgucaccaagauauguuucaggaccugaauagaaaguugcagcaugcagccgagaaagauaaggaaguccuagguccugacucuaagccagagaaacagcaaacucccaacaagaggccgugggaaucccugcgcaaagcucacgggaccccuacaugggugaagaaagagcucgagccccugcagccaagcccucuugaauuacggucaguugagugggaacgaaguggagccacgauuccccugguaggccaggauaucauagaccuccaaaccgagguguga

SEQ ID NO: 52487 - RNA, 4755 nt, Artificial Sequence
  derived and/or modified sequence opt3 from ADGRB2__Homo_sapiens__NP_001281264
auggagaacaccggcuggauggggaagggacacagaaugacacccgccugcccucugcuccuuagcgugauccuguccuugagguuagcuacugcauucgacccagccccgucugcguguucagcucuggccagugguguccuauacggcgcauuuagccuccaggaucuguuccccacgauugccuccgggugcucuuggacccuugaaaauccugacccaacaaaauauucgcuguacuugcgguuuaaccgccaagagcagguuugugcucauuucgcaccccgacuccugccucuggaucacuaucucgugaauuuuacuugcuuacguccaucacccgaagaggccguagcucaggccgaaagcgaggugggaagaccugaggaagaggaagcggaggcagccgcuggccuggagcuuuguagugguuccgggccauucaccuuuuugcauuucgacaagaacuuuguccagcugugccuaucugccgaaccgagcgaggcacccaggcuccuggcuccugccgcgcuugccuuccgguuuguggaaguucuguugauaaauaacaauaacuccucacaauucacauguggagugcucugccgcuggagugaggaauguggcagagcagcuggcagggccugcggguuugcucagccaggauguagcugccccggugaggccggcgcagggucuaccacuacaaccuccccuggaccacccgccgcucacacgcugucaaaugcguuagucccgggcgguccugcacccccagccgaggcugaucugcauagcgggaguucuaacgaccucuucacuaccgaaaugcgguacggagaggaaccugaggaggaacccaaagugaagacacaguggccacgcuccgccgaugagcccggccuuuauauggcacagacuggcgacccugccgcugaagaguggagcccauggucgguaugcucucugaccugugggcaaggauugcagguucgaacaagauccugcgugucaaguccguacgguacccuauguagcggcccccugagggaaacgcggccuugcaauaacuccgccacuuguccaguccacggggugugggaggaauggggaucuuggagccucugcucacguaguuguggccgcgguuccagaagcaggaugcggacaugcgugcccccucagcacgggggcaaagcaugugagggaccagagcugcagaccaaacuuugcucuauggcggcuugucccgucgaaggccaauggcuggagugggggccguggggaccuugcucaacuagcugcgccaaugguacacagcagcgaagccgcaaguguuccguugcaggcccagccugggcuaccugcacgggggccuugaccgauacaagagaauguucuaaccucgagugccccgcaacugacucgaaauggggaccuuggaaugcuuggagccuguguuccaagaccugcgauacaggcuggcaaaggcgguuccgcaugugucaggccacugguacccagggguaucccugcgagggcacaggagaagaggugaaaccauguucagaaaagagaugcccugcguuucaugagauguguagggacgaauacguaauguuaaugaccuggaaaaaggccgcugcaggcgagaucauuuacaacaagugucccccaaacgccagugggucugcuagccgucggugccugcuauccgcccagggaguggcauauuggggucucccgucauucgcgcgaugcaucagccacgaguacagauaucuguaccuuucuuugagggaacaucuggccaaaggccaacgcaugcucgcuggggagggaaugucccaggucgugcggagucugcaggaacuucuggccagaaggacuuauuacagcggcgauuugcucuuuucuguugacauucugcgcaaugugacggacacauucaagcgagcaaccuaugucccuuccgcugaugacgugcagcgguuuuuccaaguaguuucauuuaugguggaugccgagaacaaagaaaagugggacgaugcacagcaggucagucccgguagcgugcacuuacugcgugucguggaggacuucauccaccuaguuggggaugcccucaaggcuuuucagucgucccugauagugacugacaaucuuguaaucucuauucaaagagagccagucagcgcggugucaagugauaucaccuuccccaugaggggccgccggggaaugaaggacuggguuagacauuccgaagauagguuguuucugccuaaagaggugcucucucugagcuccccaggcaagcccgccacaucaggggcagcuggaagcccuggccgaggucgcgggccgggaaccgucccacccggcccuggucacagucaucagcgguuacugccagccgaccccgacgaaucuuccuacuucgugauuggcgccguacuuuacagaacuuuggggcucauccugccuccgcccaggccaccucuagcugugacaagccguguuaugacggucaccgugcggcccccaacucagccucccgcagagccacugauaacaguggaacucucguauauuaucaacggaaccacagauccgcacugcgccucaugggacuacucucgcgcggaugcuaguuccggcgacugggauacugagaauugucagacccuggagacgcaagccgcacauaccagaugccagugucagcaccuuagcacauuugccgucuuggcucaaccucccaaggaccugacuuuagaacucgcagggucuccaagcguuccccuggugauuggaugcgccguguccuguauggcgcuucugaccuugcucgcuaucuaugccgcauucuggagguucaucaaaucagagcgaaguauuauacugcuaaacuuuugccugagcauccucgccucuaauauucugauccuuguaggccagucccgggucuugucaaaggguguguguacaaugacugcugccuuccugcacuuuuucuuuuuaaguagcuucugcuggguucucaccgaagcauggcaguccuaccuggcugugauagggcgcaugagaacgaggcuuguccggaaacgauuucugugucuaggauggggccucccugcccuggugguugcggugucuguagguuucacaagaaccaagggcuaugggacuucgagcuacugcugguugucacuggagggaggcuuacucuaugccuuugucgggccagcagcugugauugugcuggucaacaugcuuaucggaaucauuguuuucaauaaacugauggcccgcgauggcaucuccgacaagaguaagaaacagagggcugguucugagcguugccccugggcaaguuugcuccugccuuguuccgccugcggggccgugccgucaccacuacugucuagcgcuagugcgcggaacgcaauggccucccuuuggagcucuuguguagugcucccccuguuggcucugacauggaugucagccgucuuagcaaugaccgauagaagguccgugcucuuucaagcccuguucgcuguuuuuaauagugcgcagggauucgugauuacugccguccauugcuuccuucgccgagaagugcaggacguugugaagugucagaugggcgucugcagagcagaugagagcgaagacucgccugauucuuguaaaaacggucaacugcagauauuguccgacuuugagaaggacguagaucucgcuugccagaccgugcuguucaaagaaguuaauacauguaaccccagcacgaucaccggcacucuaucacggcugagucuugacgaggaugaggaaccaaagucuugccucguggggccugagggaucccugagcuuuucacccuugccaggcaauauuuuagucccuauggccgcaaguccggggcugggagaacccccaccuccccaggaggccaacccaguguacauguguggcgaaggugggcucaggcaacuggaccuuacauggcugcgcccuaccgagcccggaagcgagggcgauuacaugguauugccgcguagaacacuaucccugcagccaggcgggggagguggcgggggagaagacgcuccucgggccaggcccgagggcacuccacgccgagcggcaaagaccguggcccacacggaagguuaucccucuuuccucagcgucgaucauuccgggcugggacuuggcccugcuuacggcucauuacagaacccguaugggaugacauuucaacccccaccucccaccccuucugccagacagguuccagagcccggagaacggaguaggacuaugccucgcaccgugccagguucgacaaugaaaaugggcagccuggagagaaagaaacucagguacuccgacuuggauuucgaggugaugcacacucggaagcgucacucugaacuguaucaugagcucaaucagaaauuucacaccuucgaccgcuaccgaucacagagcacagcuaagagagaaaagaggugguccgucaguucugggggagcagccgagcggagcgugugcacggauaaacccucaccgggcgagcgcccuucccugagucaacauagaaggcaccagagcuggucuaccuuuaaguccaugacucuugguucacugccacccaaaccucgggaacgauugacacuacauagagcugccgcaugggagccaaccgaacccccggacggggauuuccagacugagguuuga

SEQ ID NO: 52488 - RNA, 4569 nt, Artificial Sequence
  derived and/or modified sequence opt3 from ADGRB3__Homo_sapiens__NP_001695
augaaggccgugagaaaccugcucaucuacauuuucagcaccuaucuucuggucauguuuggcuucaaugcugcacaggacuuuuggugcuccacauugguuaaaggggugauauacggaucuuauucaguaagugagauguuccccaagaacuuuacuaauuguacguggaccuuagaaaacccugauccaacaaaauacagcaucuaucugaaguucuccaaaaaggaccuaucuugcucgaauuuuucacuccuggccuaccaauucgaucacuuuagccaugagaagauuaaagaccuucugaggaagaaccacaguaucaugcaguuguguaauuccaaaaacgcguucguguuucuccaguaugauaagaauuucauucagauccggcgcgucuuuccgacuaacuuccccggucugcagaaaaagggcgaagaggaccagaagucuuucuuugaguuccuggugcucaauaaaguuagcccuucccaguuugggugccauguguuauguaccuggcuggagucaugccuuaagagugagaacggacgaacagaaagcuguggcauaauguacaccaaaugcacuuguccacagcacuugggugagugggggaucgaugaccaaucucugauucuacucaauaacgucgugcugccccuuaaugaacagacagagggaugccugacccaggaguugcagacgacucaaguauguaaccucacccgugaagcuaagagaccuccaaaagaggaguucggcaugaugggcgaucauacaaucaagucccagaggccccggucaguucacgaaaaacgcgugccucaggaacaagccgacgcagccaaguuuauggcucagacuggggagagcggagucgaggaauggagucaguggucuaccugcuccgugacaugcggucagggcagccaagugagaaccaggacgugugucucgccauacgggacucacugcucuggaccgcugcgggagucccgcguuuguaacaauacagcauuaugccccgugcauggcguaugggaagaguggucaccuuggagucuguguagcuuuaccugcggucgagggcagagaacuaggacacgguccuguaccccaccccaguauggaggccguccuugcgaaggcccagagacgcaccauaagcccuguaacauugcccucugcccgguggaugggcaguggcaagaguggucuagcuggucacaguguagugugaccugcuccaauggaacacagcagcgcagcagacaaugcacugcugccgcgcacgguggcucugaauguagggggccuugggcagagucacgggaaugcuacaaccccgaguguaccgccaauggacaguggaaccaguggggccacuggagugguugcagcaaauccugugacgggggcugggaacgacgcaucagaacaugccagggagcugucauaacuggccaacagugugaggggaccggagaggaaguuaggcggugcucugagcagcgcuguccagccccuuaugaaauuugccccgaggauuaccuuaugucgaugguguggaagagaacaccagcuggugaccuggcauucaaucaaugucccuugaacgccaccggcacuacgagcaggcguugcucccuaucacugcauggggucgcguucugggagcagccuaguuuugcccggugcaucucuaaugaauaucgacaccuccagcauagcauuaaagagcaccuggcaaagggacagagaaugcuugcuggcgacgguaugucccaagugacaaaaacccuguuggaucucacucagaggaagaacuucuacgccggggaccuguuaaugucaguagaaauccugcgcaauguuaccgauacauuuaagcgggcuagcuauaucccagccucugacggcgugcagaacuucuuucagauugucuccaaucuacucgaugaggaaaacaaagagaagugggaggacgcacaacagauauacccgggaaguaucgaacugaugcaagugauugaggauuucauccauauagucggcauggggaugauggacuuccagaauagcuaccuuaugaccggaaacgugguugccucuauucaaaaauugcccgcugcguccgugcugacugauaucaacuuuccuaugaaggguagaaaaggcaugguagacugggcacgcaauucagaagauagggucgugaucccaaagaguauuuucacacccguuagcucgaaggagcucgacgaauccucuguguuuguccugggggccgugcuuuauaaaaaccuggacuugauccucccuacgcugcgaaauuacaccguaauuaacagcaagauaaucgugguuacuauucggccagagcccaaaacaaccgauucauucuuagagaucgaacuggcucaccuagccaauggaacacucaacccguauuguguccugugggacgauaguaagacuaaugagucccuuggcaccuggucuacgcaggguugcaaaaccguguugacagacgcaagccacacuaagugucugugcgaucgucucuccaccuuugccauccuggcucagcaaccuagagaaauuauaauggagucaagcgggacaccaagugugacuuuaaucgucggcucuggacuguccugucuugccuugauuacccucgcaguuguguacgcggcucuguggagguauauccgcagcgaacggucgauuauccuaauaaacuucugccugucaaucauuucuaguaauauccucauucuggugggccagacgcagacacauaacaaguccaucuguaccacuacaaccgccuuucuucacuucuuuuucuuggcaaguuuuugcuggguacugacugaggccuggcagucuuacauggcugucaccgggaaaauaagaacaagguuaauucgaaagcgcuuccucugucugggauggggccuucccgcccuggugguugcaacgagcguggguuuuacccggacuaaaggguauggaacagaccauuacugcugguugucccucgagggcggucugcuauacgcuuucgucggcccugccgcggccgugguucuggugaauaugguaaucgggauucucgucuucaacaagcuggugucaagagauggaauccuugacaaaaaguugaaacacagggcuggccaaaugagugaaccccacagcgggcugaccuuaaagugugcaaagugcggaguggucucuacaacugcccucuccgcuaccacggccucaaaugcaauggcgagucuguggagcuccugcguugugcuuccacugcuagcccucacauggaugucugcuguacuggccaugaccgauaaacguucgauauuguuucagauccuguucgcaguguuugacagcuuacagggcuucgucauugugaugguucauuguauccuccgccgggaggugcaggaugcuuuuagaugcaggcugcgaaacugucaagacccuauuaaugccgauucauccaguucuuuccccaacggucacgcacagaucaugacugacuuugaaaaggacgucgauauagccugccggagcgugcuucauaaagacauugggccaugucgcgcugcgaccaucacaggaacucuguccagaaucucauugaacgaugacgaggaggaaaagggcaccaauccggagggucucucuuauagcacacugccuggcaacguuauuaguaaagugaucauucagcagcccacggggcuacacaugccaauguccaugaaugaacugagcaaccccugccuuaagaaggaaaauucugaacucaggcggaccgucuaccuguguacugaugacaacuugcgaggagccgauauggacauaguacauccucaagagagaaugauggagucagauuauaucgugaugccacgcuccaguguuaauaaccagcccagcaugaaagaagagucgaagaugaauauuggcauggaaacacugccucacgagagguuacuccacuacaaagugaacccggaguucaauaugaacccacccgucauggaccaguuuaauaugaaccuggaacagcaucuugcaccucaagagcacaugcagaaucugccauucgaaccccguaccgcugugaagaacuuuauggccucugaguuggaugacaacgccgggcucucccggagcgaaacuggaucaacaaucaguaugucuucccuggagagaaggaaaagccgcuauucagaucuagacuucgaaaagguaaugcauacccgaaagagacacauggagcuguuccaggagcuuaaucaaaaauuucagacgcucgaccgguucagggauauuccuaacacuagcagcauggaaaauccggcucccaacaagaauccaugggacaccuuuaaaaacccuuccgaguacccccauuauacaaccaucaaugugcuggauacugaagcaaaggacgccuuggaguuacgcccagcggagugggaaaaaugccugaaccucccucuggauguccaggagggcgacuuccagacagaaguuuga

SEQ ID NO: 52489 - RNA, 2625 nt, Artificial Sequence
  derived and/or modified sequence opt3 from ADGRD1__Homo_sapiens__NP_942122
auggagaagcugcucagacuuugcuguugguacagcuggcuguuguuauucuauuacaacuuucaggugaggggcgucuauucccggucucaagaccaccccggguuccagguucuggccucagcuagucauuacuggccucuagaaaauguggauggaauccacgagcuccaggacaccacaggugauauuguagaaggcaaagugaacaaggggauauaucugaaagaggaaaagggagucacucuucuguacuauggccgcuacaauagcuccugcaucucuaaaccagagcagugugguccggagggggugacguuuucguucuuuuggaagacccaaggagaacagucacgacccauuccuagcgcauacggcggccagguuaucaguaacggguucaaggugugcuccucuggaggucguggcagcgucgaguuguauacaagagacaauuccaugacuugggaagccucauuuaguccacccgggccuuacuggacccauguguuguucacauggaaaagcaaggagggacugaaaguauauguuaacggcacccugucuacuuccgauccaucagguaaggugagcagggacuacggggagaguaaugucaaccucgugauuggaucugaacaggaucaagcgaaauguuaugagaauggcgcuuuugacgaguucaucauaugggaacgggccuuaacacccgaugaaaucgcaauguacuuuaccgccgcuauuggcaagcacgcacugcuuuccagcacguugccuucgcuguucaugacuucuaccgccuccccagugaugccgacagacgcuuaucaucccaucauuacuaaccuaaccgaggagcgcaagacauuucagucaccuggggucauccucaguuaccugcagaauguuagccuuucccugccaucuaagagcuugucagaacagaccgcccucaaccugacgaaaacuuucuuaaaagcggugggagagauacugcuccuucccgguuggauugcacugagugaagauuccgccguaguguugagccuaaucgacacaauugauaccgucaugggccacgugucuucaaaucugcacgggaguacuccucaaguuacaguggagggaagcuccgcuauggccgaguucucugucgcaaagauccucccaaaaaccgugaacucgagccauuacagauuucccgcucacggccaguccuucauccagauuccgcaugaagccuuucacaggcacgcguggucaacgguaguuggucugcuuuaucauaguaugcacuacuaucugaauaacauauggccugcccauaccaagaucgcagaggcuaugcaccaucaagacugccuccucuucgccacaucucaccugauuagcuuagaagugagucccccaccuacucugucacagaaccuaagcgggucuccccucaucaccguccaccugaaacaucggcuuacacgcaagcagcacuccgaggcuacuaauaguagcaaccgaguguuugucuacugugccuucuuggacuuuucuuccggcgaaggaguguggucaaaucauggcugcgcacugaccagagggaaccucacauauaguguuuguaggugcacccaccugacuaauuucgccauacuuaugcaagugguaccacuggaguuggcucggggacaccaggucgcgcucagcucgauuuccuacguggguuguucucugagcguuuuaugccugguggcaacgcuagucacauuugccgugcucucaaguguauccaccauccguaaccagcgcuaucauauccacgcuaaucugucuuucgccgugcuuguugcacaggucuugcugcucauuagcuuuagacuggaacccggcacuaccccuugccaggugauggccguguuacugcauuacuucuuucuuuccgcuuucgccuggauguuggucgaggggcuccaccuguacucaaugguuaucaagguguucggaagcgaggauaguaaacauagguauuacuauggcauggguuggggguuuccacuacugauuuguauaaucucucucuccuucgcaauggacagcuacggcacaucgaacaauugcuggcugucacuugcgucuggagcuauuugggccuuuguggcaccggccuuguucguaaucgucgugaacaucggcauucugauagcuguuacccgggugaucagucaaauuuccgccgauaauuauaagauccacggggaccccagcgcauuuaaauuaacugcuaaggccgucgcggugcuccugccuauucuuggaacaucuuggguuuucggugugcuggccguaaacggcugugcugucguguuucaguacauguucgcaacguugaauagccuccaggggcuguuuaucuuccuauuucacugccugcucaacuccgaagugcgagccgcuuucaaacauaagaccaaggucuggucacugacuuccagcucugcccgcacauccaaugcaaaaccauuucacucagaucuuaugaacggaaccagacccggcauggcgaguacaaaguugagcccuugggacaaauccucucauucggcccacaggguugaucugagcgcuguguga

SEQ ID NO: 52490 - RNA, 2925 nt, Artificial Sequence
  derived and/or modified sequence opt3 from ADGRD2__Homo_sapiens__XP_006717411
auggugaccggccccgaggaagggaacagcgagauggacgccccuuggggagcuggugaaagauggcugcacggcgcagccgucgauagguccgggguuucucucggaccaccgcccacaccucaggugaaucaaggcacucuugguccacagguagcgcccguggcugccggggaggucgugaagacggcaggaggcguuugcaaauucucaggccagcggcugaguugguggcaggcccaagaaagcugugagcagcaguuugggcauuuggcuuuacagccuccagacggagugcuggcaucccgccuacgagaucccgucugggugggucaacgugaggccccucucagaaggccaccgcagcggcgcgcuagaaccacagccguacugguuuucgacgaaaggacugcggaucgggcagcccgccuucgaucuccccugccugaguuggcugcccucaccgcaugcacacacgugcagugggacugugcuucgccagaucccgccgcgcuguuuucagucgccgcacccgcucugccaaacgcccuccaguuaagagcuuucgccgaacccggcgggguggugagggcagcccuggucguucggggacaacaugcuccguuucuugcggcauuccgugccgacggccgcuggcaccaugugugcgcuaccugggagcagagaggugggaggugggccuuguuuagcgauggacggcgacgcgcaggcgccagaggccugggggcuggacacccuguacccagugguggcauccuagugcucgggcaggaccaagauucccugggaggcgguuucucugucaggcacgcccuuagcgggaaucugacugacuuucauuugugggcacgggcgcucuccccagcucagcugcaccgcgccagagcaugugccccucccucagagggcuuacuguucaggugggauccaggagcucucgacgugacacccagucuucugccuaccguuugggugcguuugcuaugcccagucccgagcgaagagugucccacguggaacccuggcccacggucugaaggguccgagcugugccucgaaccccagccuuuucuguguugcuaccgaacugagccauauagaaggcuucaggacgcccaaucauggcccggacaggaugugauuagccgcguaaaugcacuggcuaacgacauaguuuugcucccggauccucugagugaggugcauggugccuuaucuccagcggaagccuccagcuuccugggccuacucgagcacguccuggcuauggaaauggcaccccuugggccugccgcuuugcuggccgugguccgguuucucaagagagugguugcacugggagcgggcgaccccgagcuucuguugaccgguccaugggaacagcucucgcagggggugguaucugucgccucccugguguuagaggagcaaguugcugauacauggcugucacuaagggaagugaucggcggaccuauggcccucgucgcaagugugcagcgccuggcuccccuuuugagcacuuccaugaccucugagcgaccacggaugcguauucagcacagacaugccggccugagcgggguaacagugauccacucaugguucaccaguaggguuuuccagcauacgcucgaaggaccggaccuggagccucaagcacccgccuccagcgaagaggcuaaucgcguccagcgguuuuuaucuacucagguggguucagcgauuaucaguagcgaggugugggaugucacaggcgaaguuaacguggccaugaccuuccaucugcagcacagagcacaauccccacuuuuucccccucacccacccucuccuuacacugggggagcuugggccacaaccggcuguucgguggccgcuuuguaucucgacagcacggcaugcuucugcaaucacuccaccucauuugccauacugcuacagaucuacgagguacagagggguccggaagaggagagucugcuccgaacacugucuuucgucggguguggcgugagcuuuugcgcgcuuacuaccacauucuugcuguuuuuaguugcuggagugccaaaauccgaacgcacuaccguccauaagaaccucacauucucacuggccagcgcagagggcuuucuuaugaccucugaaugggccaaagcuaaugagguggcauguguugccgugacuguagcgaugcacuuccuguuuuuggucgcuuucuccuggaugcucguggaagggcugcuacuguggcggaagguggucgccguuaguaugcaucccggaccuggcaugagacucuaucacgcaacggguuggggagugccaguagggauuguggccgucacacuggcuaugcuuccccacgauuacguggccccuggccauugcugguugaacguucacaccaaugcaaucugggcuuucguggguccgguccuguuuguguuaacugccaacaccuguauucucgcgaggguugugaugaucacagucagcucugcccgucgccgggcaagaaugcuguccccucaaccaugccuucagcagcagauauggacccaaauuugggcuacuguaaagccugugcugguucuacuccccgugcugggcuugacauggcuggccgggaucuuaguccaucucucaccagcuugggcauaugccgccgugggacugaauaguauucagggccuuuacaucuuccugguauacgcugcguguaacgaggaggugaggagcgcauugcagcgaauggccgagaaaaaggucgcugaaguucuccgggcccuggggguguggggaggcgcagccaaagaacacucgcuaccuuuuuccgugcugccccuuuuccucccaccgaagccuucuacgccccgccauccacugaaagcucccgcguga

SEQ ID NO: 52491 - RNA, 2604 nt, Artificial Sequence
  derived and/or modified sequence opt3 from ADGRE1__Homo_sapiens__NP_001243181
augagaggcuucaaccugcuccuguuuugggggugcugugugaugcacagcugggagggacauaucaggcccacccggaagccuaauacaaaagguaacaauugccgcgacuccacucuguguccagccuacgcuacgugcaccaacacagucgauucuuauuacugugcaugcaagcagggcuucuugucaaguaaugggcaaaaccacuuuaaagacccgggaguucgauguaaggauauuaaugaaugcuuaacuagcuccgugugucccgagcauucugacugcguaaacucgaugggcucauauagcuguaguugccagguggguuucauaucccguaauucuaccugcgaagaugucgacgagugugccgauccuagagcgugcccagaacacgcuacauguaacaauaccguggggaacuacagcugcuuuuguaaucccggauucgaguccucaaguggccaucugagcuuucagggccuaaaagccucuugcgaggacaucgaugaauguacugagaugugcccuauuaacuccacauguaccaauacgccagggucauauuucugcacuugucaccccggauuugcaccuagcaacggucagcucaacuucaccgaccaaggcguugaaugcagggauaucgacgagugccggcaggauccaaguacaugugggcccaauucuauuugcacuaacgcccugggauccuacagcuguggcugcaucgcugguuuucacccgaauccugaggggucgcagaaggacggaaacuucucuugucagcgcgugcuuuuuaagugcaaagaagacgucauaccagauaauaagcaaauccagcagugucaggagggcaccgcagugaaacccgccuauguauccuucugcgcucaaauuaacaauaucuucucaguucuggacaaggugugugaaaacaaaacaaccgucgugaguuugaagaauacgacugagagcuuugugccuguccucaagcagauuuccacauggaccaaauucacuaaggaagagacaucuagccuggccaccguuuuucuggagucaguggaaaguaugacgcucgcguccuucuggaaaccaagcgcaaacaucacccccgccguaagaacagaguacuuagauauagaaucuaaggugauuaauaaagagugcucagaagagaacgucacucuggaccuuguggcuaagggcgauaaaaugaagaucggguguaguaccauugaggaaagcgaguccacagaaacuaccggaguugccuuugugucuuucgucgguauggagucgguguugaaugaaagguuuuucaaggaccaucaggcaccgcugacaaccagcgagaucaaacuaaagaugaacucccggguaguuggcgggaucaugacuggagagaaaaaggauggcuuuucagacccuauuauauacacgcucgaaaauauccaacccaaacagaaguucgagcgcccaauuugcgugaguuggucuacagaugucaagggugggcgauggaccagcuuuggcugcgugauccuggaggcuuccgagacuuauaccauauguucaugcaaccagauggccaaccuugcggucauuauggccagcggagagcugacaauggacuucucuuuguacaucaucucccacgugggcauuaucauuagucucguuugucugguguuagcaauagcuaccuuucugcucugcagaagcaucaggaaucauaacacuuaucuucaccuucacuuguguguaugccuacugcucgccaaaacacuguuccuugcugggauucauaagacggauaauaaaaugggaugugccaucaucgcagguuuccugcacuacuuguuucucgccugcuucuuuuggaugcuggucgaagcugugauuuuauuccugaugguucggaaccuaaagguggucaauuauuuuucuucccguaacauaaaaaugcuccauaucugugcguucggcuacgggcugccuaugcuugugguagugauuucagcaaguguucagccccaaggauauggcaugcacaaucgcugcugguugaacaccgagacugguuuuaucuggagcuuccuggggccagucuguacagugauuguggucucgaaguacuacaauucccucgccaagugcguucugaaagaagaacagggcgaccuuagagaccuggaauuucccggaaccugcgcugccgagaggaucaacucuuugcuccugacauggacuuuauggauacugcggcagcgacuaagcucagugaaugcagaggugaguacccucaaggauacgcgccugcuuaccuucaaagccuuugcucaguuguucauccugggcuguuccuggguacucgggauuuuucaaaucggaccugucgccggugugauggcauaucuguucacaauuaucaacucuuuacagggcgcguucauauuucugauucauugccuuuugaaugggcagguuagagaagaguacaagagguggaucacuggaaaaaccaagccaagcucccagucacaaacaagccggauucuccugaguucuaugccguccgcuagcaagacuggcuga

SEQ ID NO: 52492 - RNA, 2298 nt, Artificial Sequence
  derived and/or modified sequence opt3 from ADGRE2__Homo_sapiens__NP_001257981
augggcgggagaguguuccuggucuuucucgccuucugcguuuggcuuacccugcccggagcugagacacaggacagcagggguugugcacgguggugcccucaggauuccucuugugugaacgccacugcgugccgcuguaauccaggcuuuucaaguuucagcgaaaucauuacgaccccgauggagacaugcgacgauauaaacgaaugugcuacuuuguccaagguaucuugcgggaaauuuucggacuguuggaauaccgagggaucauacgauugcguguguagccccggcuaugaaccugucaguggugccaagacauucaaaaacgaguccgagaauaccugccaggacguggaugaaugccagcagaacccacgauuauguaagucuuacgggacuugcguuaauacacugggaagcuauaccugucaaugccuacccggcuuuaaacucaagccugaggacccaaagcuguguacggaugugaacgaaugcacuuccggccagaaucccugucacucaaguacccauugccuuaacaaugucgggagcuaccagugucguugcagaccuggauggcagccaaucccggguucucccaacggcccuaauaacacagugugugaggacguagaugagugcuccucagggcaacaccagugcgacagcaguacuguuuguuucaauaccgugggaucuuauuccuguaggugccggccaggcuggaaaccccgccaugguauuccuaacaaccagaaggauacagucugcgaagacaugaccuuuagcacguggacuccacccccgggggugcacucgcagacacugucuagauucuuugacaaagugcaagauuugggaagggacuacaagccuggccucgcaaauaacaccauccaguccauucugcaggcccuggaugagcucuuagaagcucccggcgaccuggagacucuuccacgguugcaacagcauugugucgcaucacaucugcuagaugggcucgaagacguucugcgcggacuuaguaaaaaucugagcaacgguuugcucaauuucuccuauccugccggcacagagcugucuuuagaggugcagaagcagguagaucgaagcgugacccugagacaaaaccaggcugucaugcagcucgacuggaaucaggcccaaaagucaggggaucccggaccaagugugguuggccuuguguccauccccgguauggggaaacuguuggcggaagcaccucuaguccuggagccagaaaagcagaugcuccugcacgagacgcaccagggccuucugcaggacggaagcccgauauugcucucugaugugaucucagccuuucugaguaacaaugacacccaaaacuuaagcucccccguaacauucacuuucucucacagggaagaggacccuguucugaccgugauuacauacaugggccuaucggucagccuccugugccuuuugcuggcugcccucacuuuucugcuuuguaaagcaauccagaauaccuccacaucacugcauuugcagcucagucugugcuuauuccuggcucaccuacucuuucugguggccauugaucagaccgggcacaagguccuuuguucuaucauagcgggaacuuugcauuaccuguaucucgccacgcugacauggauguuacuggaggcacuuuacuuguuccucaccgcucggaaccugacugugguuaauuauagcuccauuaaccguuuuaugaaaaagcuaauguucccaguggguuacggcguacccgccgucaccguggcuaucucagccgcaagccgcccucaccuguaugggacaccaucuagaugcuggcuccaacccgaaaaaggauuuauuuggggcuuccuggguccgguuugugccaucuuuuccgugaaucuugucuuguuccuggugaccuuauggauccucaagaacaggcugaguagccuuaacucugagguauccacucugcggaauacacgaauguuggcuuuuaaggcgacggcacagcuguucauucuggggugcaccuggugccuaggcauacuccaggugggaccugccgcucgcguuauggccuaccucuuuacuaucauuaacucacugcaaggcgucuucaucuuccuuguguauuguuugcugagucaacaggugagagaacaguacgggaaauggagcaagggaauaaggaaauuaaagacagagucggaaaugcauacccucuccucuagcgcaaaagccgacacaucaaagccaaguacugucaauuga

SEQ ID NO: 52493 - RNA, 2361 nt, Artificial Sequence
  derived and/or modified sequence opt3 from ADGRE5__Homo_sapiens__NP_001020331
augggcgggagaguguuccuggccuuuugcgucuggcucacccuucccggagcugagacacaggacagcagggguugugcacgguggugcccucaaaacuccucuuguguuaaugccacugcgugccgcuguaacccaggcuucucaaguuuuagcgaaaucauuacgaccccgacagagacuugcgaugacauaaaugaaugugcuacccccuccaaggugucuugcgggaaauucucggauuguuggaacacagagggaucauacgacugcguauguagcccuggcuaugaaccagugaguggugccaagaccuuuaaaaaugaguccgagaacacuugccaggaugucgacgaaugccagcagaauccccgacuguguaagucuuacgggacaugcgugaacaccuugggaagcuauacgugucaaugcuuaccuggcuucaaauuuaucccagaggaucccaagguuuguacugacguggaugaaugcuccucaggccagcaccagugugacaguagcaccgucugcuucaauacaguggggucuuacuccugucguugcagaccuggauggaagccaaggcaugguauuccgaacaaucagaaagauacuguaugugaggacaugaccuuuucaacauggacgcccccuccaggcguucacagccaaacccugagucgguucuuugauaaggugcaggaccuagggcgcgacucuaaaacuuccagcgcagaggucacaauccagaacgugauuaagcucguggaugaacugauggaggcccccggagacgucgaagcucuugcaccuccaguuagacaucugaucgccacccaguugcucucgaaucuggaggauauaaugaggauccuggcuaaaucucuccccaagggcccguucacuuauauuuccccuucaaacacagaauuaacccugaugauccaagagcggggugacaagaaugugacgauggggcagaguagcgcccgcaugaaacuuaacugggcgguagcagccggagcugaggaucccggcccagccguggcaggcauuuuguccauccagaacaugaccacacugcuagcuaaugccucucucaaccugcacagcaagaaacaagcggaacuugaggaaauauacgagucaaguauucgagggguccagcugagaagguuguccgccgugaauagcaucuuucucucucauaacaauacuaaggaacugaacucaccuauuuuauucgcauucagucaccuggagagcuccgacggagaggcuggucgggaucccccagccaaagacguuaugcccggcccucgucaggaacuccuuugcgcuuuuuggaagucugauucggaccgcgggggacacugggccaccgagggcugccaggugcuggguagcaaaaauggguccacaacuugucaaugcucacauuugaguucuuucgcaauccuaauggcccacuaugaugucgaagacuggaagcugacccucaucacaagagugggccuggcucuuagccuguuuuguuugcuccugugcauuuuaaccuuccugcuaguaaggccaauacagggaucccggacuacgauccaucuccaccuguguauuugccuuuuuguuggcucaacaaucuucuuggcggggauagagaacgaaggaggucaggugggccugcgaugucgccucgucgcagggcugcuucacuacugcuuucuggccgcuuucuguuggaugagcuuggagggacucgagcuguacuuuuuaguggucagaguguuccagggccaaggucugucuaccagguggcuaugccucauuggguauggcguuccgcugcuuaucgugggaguauccgccgcaaucuacaguaagggcuaugggcggccccgcuacuguugguuggacuuugaacagggauuccuguggagcuuucucgguccugucacuuucauuauccugugcaaugccgugauuuucguuaccacaguguggaaauuaacccagaaguuuucugagauaaacccagauaugaaaaagcugaaaaaggcuagagcccuuacuaucacagcaauugcgcaguuguuccuccugggcugcacgugggucuuugggcuauucaucuuugacgauaggucccuggugcucaccuauguauucacuauccugaauugucuucaaggagccuuuuuguaccuguuacauugccuccugaacaagaaagugcgugaagaguaucggaagugggcuugucuuguugcaggcgguucaaaauacagugaguucacaagcaccacaucggggacuggccacaaucagacccgagcccugagagcuuccgaaucuggaauuuga

SEQ ID NO: 52494 - RNA, 4041 nt, Artificial Sequence
  derived and/or modified sequence opt3 from ADGRF5__Homo_sapiens__NP_056049
augaagucucccagaaggaccacacugugccucauguucaucgugauuuacuccucuaaagccgcucuuaacuggaauuaugagucaacuauacacccucugaguuugcaugaacacgagccagcaggcgaagaggccuuacggcagaagcgcgcggucgcuacgaaaagcccgaccgccgaagaguacacaguuaacaucgagauuuccuuugaaaaugcaucuuuccuggaccccaucaaggccuaucuaaacucgcucucauuuccuauucaugggaauaacacugaucaaaucaccgacauacugagcaucaaugugacaaccguaugucgaccagcuggaaacgagauuuggugcaguugugaaacugguuacggcuggccccgugagagaugccuucacaaucugaucugucaggagagggauguguucuugccugggcaucacugcuccugucucaaagaacugccacccaacggaccuuuuugccugcuccaggaggacgucacauuaaauaugcgggugcgccugaacguuggcuuccaggaagaucuuaugaauaccucuagcgcauuguauagauccuacaagacggaccuggagacugccuuuaggaaggguuaugggauucuaccaggauucaaaggcgugaccgucacaggcuuuaagucagggagugugguaguuacuuacgaagugaaaaccacaccgcccagccucgagcugauccacaaggcuaacgagcaagucgugcagucucuuaaucagaccuacaaaauggauuauaacuccuuccaggccgugacgauaaacgaaucaaauuucuucgucacuccugagauuaucuuugaaggagacacaguuagccuggugugugagaaggaaguauugaguucuaacguguccuggcgguacgaggagcaacagcucgaaauucagaauagcucgcgcuucucuaucuauaccgcgcuguucaacaauaugacuuccgucucaaaguuaacaauccauaacauuaccccaggugaugcaggcgaguacgugugcaaacugauacucgacaucuuugaauaugaguguaagaaaaagauugauguuaugcccauccagauacuugccaaugaagagaugaaagugaugugcgacaacaauccugucagucugaacugcuguagccaagggaaugugaacugguccaagguagaguggaaacaggaaggaaagauuaauaucccaggcacgcccgagaccgauaucgacucuagcugcucacgauacacauugaaggcugacgguacucaguguccgaguggguccagcggaaccacaguuauuuauacuugcgaauuuaucucugccuacggcgcaagaggcucagcuaacauuaaagugaccuuuauaagugucgccaaucuaacaaucaccccugaucccauuagcguguccgaggggcaaaacuucucuaucaaguguaucucggacgucagcaacuacgaugagguguauuggaauacuuccgcgggaauuaaaauauaccagagguuuuauacgacacggcguuaccuggacggugccgaaucaguucucaccgugaagaccaguacccgcgaguggaacggcacauaucacugcaucuucagauacaaaaauucuuauagcauugcaaccaaggauguaaucguccauccacugccucuuaagcugaacauuaugguggaccccuuggaagcuacuguuuccuguucagggagccaccacaucaaaugcuguauagaggaagauggagacuacaaggugacauuucauacgggcagcuccagucucccagccgcuaaagaggucaauaagaaacaggugugcuacaagcacaacuucaaugccagcucuguauccugguguucaaagaccguggauguuugcugccauuuuacuaacgcagccaauaacagugucuggagccccucgaugaaacugaauuuagugccuggugagaacaucacaugucaggacccagugauuggggucggcgaaccgggaaagguuauccaaaaacugugcagguucuccaaugugcccucuagcccugagucaccaauuggcgggaccaucacauauaagugugugggaagucagugggaagagaaacggaacgauugcauauccgcucccauuaauucucuacuccagauggcgaaggcacugaucaagagcccuucccaggacgaaaugcuuccaacuuacuugaaagaccugucaauuagcaucgauaaggccgagcacgagauaaguucuucccccgguagccucggcgcuaucauuaacauccuggaccuucugucgaccguaccgacgcaagucaacucagaaaugaugacccauguguugucuacaguuaaugugauucucgggaaaccuguccugaacacuuggaagguguuacagcagcaguggaccaaucaaaguucccagcugcuacacagcguugagcgauuuucucaggcccuccagagcggagauuccccaccccugucauucagucaaacaaacgugcagaugagcucuaugguaaucaaauccucacacccugaaacuuaucagcaacgcuuugucuuccccuacuucgaccuuuggggcaauguggugauagauaagaguuauuuggagaaccugcagagcgacuccucuauugucaccauggcauuuccaacgcuccaggccauccuggcucaggauauccaagaaaauaacuucgccgagucguuaguuaugacaaccacugugagccauaauacaaccaugccuuuuagaauuucaaugacuuucaaaaacaauucccccagugguggggagaccaaguguguauuuuggaacuucaggcuggcaaauaacacaggcggaugggacucuagcggcugcuacguggaagagggggauggagacaaugucacguguaucugcgaucaccuuaccuccuuuucaauuuugaugucuccagacagcccggauccuaguucccuccuggguauacuacuggacaucauuagcuaugugggcguuggguucucuauccucucacuggcggcuugucuuguggucgaagccgugguuuggaaguccgugacuaaaaaccggacaaguuacaugcgccauaccugcauugucaacaucgcagccagcuugcugguagcuaauacaugguuuauagugguugccgcaauccaggacaacagauacauuuuauguaagacugcuugcguggccgcgaccuucuuuauccacuucuuuuaucucucggucuucuucuggaugcugacgcuuggacugauguuguuuuacaggcucguguucauucugcacgagacaucucguuccacccagaaagccaucgcuuuuugccuaggcuaugguuguccccuggcaauaagcguaauuacucucggggccacccagccacgggagguguacacacgaaagaaugucugcuggcugaacugggaagauacuaaagcucuuuuggccuucgcaauccccgcgcugaucauuguuguggugaauauaaccaucacaauugucgugaucacgaagauuuuaagaccuucaaucggcgacaagccauguaaacaagagaagaguucucucuuucagauauccaaaagcaucggaguucugacuccccuucugggccuaacuuggggguucggacucacaaccguauuuccuggcacuaaccugguguuccauauuaucuuugccauuuugaaugucuuccagggucuguuuaucuuacucuucgggugccugugggaucuuaaggugcaggaagcucuguugaacaaauucucacucaguagguggagcucccaacacucuaagagcacaucccugggaucaucuaccccgguuuuuaguaugucgagcccaauaucccgccgguucaauaaccuauuuggcaagacggguacuuauaaugugucuacccccgaggccacaucaagcucccuggaaaacaguucuagcgcaucaucccuucucaauuga

SEQ ID NO: 52495 - RNA, 1572 nt, Artificial Sequence
  derived and/or modified sequence opt3 from ADGRG1__Homo_sapiens__NP_001277071
augacaccccagagccugcuccaaacaacucuuuuccuguuguccuuacuguuucuagugcagggcgcccacgggagaggacauagggaggacuuccgguuuugcucucagcagcuccaaucacuggaaaguaagcuaacgagcguccgcuucaugggugauaugguuuccuuugaggaagaccgaaucaacgcuaccguguggaaacugcagccuacagcaggcuugcaggaucuccacauucauucucgucaggaggaggaacaaucggagauaauggaauacucaguacugcugccaagaacucucuuccagaggaccaaggggcggagcggagaggccgaaaaacgcuuacugcuuguggacuuuaguucccaggcguuguuccaggauaaaaauucuagccaaguccugggcgagaaggugcuagguaucguugugcagaacacaaaggucgcuaaucucaccgagccggugguacugacuuuucagcaccaacuucagcccaagaacguuacacugcaguguguguucugggucgaagacccuaccuuguccucaccagggcauuggaguagcgccggaugcgagacggugagaagggaaacucagaccucuuguuuuugcaaucaccucacauauuucgcagugcugauggucuccucaguugagguggaugccguacacaaacauuacuuaagccugcucaguuaugugggcugugucgugucugcucuugcaugccugguuacuauugccgcuuacuuguguucccgggugccccuaccuugccgccgaaagccaagagacuauaccaucaaaguccacaugaaccugcuccuggccguguuucuucuggauaccagcuucuugcucucggaacccguagcgcugaccggcucugaggcaggguguagggccuccgcuauuuucuuacauuuuucacugcuaacgugccucaguuggaugggacuggaggguuacaaucuuuaucgguugguuguggaagucuucggcacuuacgugccuggguaccugcucaagcugagcgccaugggauggggcuuuccaaucuuccuugucacacugguggcauugguugacguggauaacuaugguccgauaauccucgcuguacaccguacccccgagggggucauuuacccuuccauguguuggauccgcgacucucuggugagcuauauuacuaauuuaggacuguuuucacuuguuuuccucuuuaacauggccaugcuggcgacaauggugguccaaauccuuagauugaggccacacacccagaaauggagucaugugcugacgcuccugggcuuaucccugguacuuggcuugcccugggcccucauauucuuuagcuucgcaucugggaccuuucagcuggugguucuauaccuguucucaauuaucacaaguuuucagggauuccucauuuucaucugguauuggagcaugcggcugcaagcucgagguggcccuuccccacuuaagucuaauucggauagcgcccgcuugcccaucuccucagggaguacuucuagcuccagaauuuga

SEQ ID NO: 52496 - RNA, 3054 nt, Artificial Sequence
  derived and/or modified sequence opt3 from ADGRG2__Homo_sapiens__NP_001073327
augguguucagcgucagacagugcggccacguugggaggaccgaggaagugcugcucacauuuaagaucuuccuuguaauuauaugucugcauguggucuuggugacuuccuuagaggaagacacggauaacucuucacugagucccccuccagccaaacuaagcguuguguccuuugcuccgucuucgaauggaacccccgaggucgaaacaacuucacucaacgacgugacccugagccuucugccuaguaaugagacagagaagaccaaaaucacuauuguaaagacauucaacgcauccgguguuaaaccacaacggaauaucugcaacuugucuagcauuuguaaugauuccgccuuuuuccgcggcgaaaucauguuucaguacgacaaggagucaaccgugccccagaaccagcacauaacgaaugggacucucaccggaguccugagucugagcgaacucaagcgaucugaguuaaacaaaacacugcaaacucuuuccgagaccuauuucaucaugugcgcgacagcugaagcccagucaaccuugaauuguacguuuacuauuaagcugaacaauacaaugaacgcaugcgccgugaucgcugcacuagagcgugugaaaauuagaccuauggaacauuguugcuguagcgucaggaucccaugccccaguucuccugaggaacucgagaagcugcagugugaucuucaggacccaauaguuugccuggccgaucacccgcggggucccccuuucuccagcucgcaaucuauuccagugguaccccgcgcuaccguguugucccaggucccuaaagccacuucauuugcggagccacccgacuacaguccggugacacauaauguuccuagccccaucggcgaaauucagccacucuccccucagcccucugcaccaaucgccagcucacccgcuaucgauaugccuccacaaagugagaccauuuccagcccgaugccccagacgcacgugucugggaccccuccacccgucaaggccucauucaguagcccuacaguguccgcaccagcuaacguaaacacuaccucugcucccccgguucagacagacauagugaauacuucgagcaucuccgaucuggaaaaccaagucuuacagauggagaaggcgcugucacucggaagucuugaaccuaaucuggccggcgagaugauuaaccaggugucuagauugcuacacagcccacccgacaugcuggcaccucucgcucagaggcugcuuaaagucguggaugacaucggccugcaauugaauuuuuccaacaccacaauaucacucaccagccccucucuggccuuagcuguuauucgggugaaugccuccaguuucaacacuacgacauucguagcacaggacccagccaaucugcaggucagccuagagacccaggcuccugaaaacucuaucgggacuaucacccuccccuccucacugaugaauaaccuuccagcgcaugauauggaguuggcaagucgcgugcaauuuaauuucuuugaaacaccggcccuguuccaggacccuagccucgagaaccugucgcuuauuuccuauguuaucucuagcucaguggcuaaucugaccguccgaaacuugacuagaaacgugacaguaacgcucaagcacauuaaucccagucaggaugaacugaccgugaggugcgucuuuugggacuuaggacggaacgguggccgugggggaugguccgauaauggcuguucuguuaaagaccgcagacugaacgagacuauaugcacauguagccaucuaaccuccuucggugugcuccuggaucuuucaaggacaagcguguugccagcccagaugauggcacugacuuuuaucaccuacauugggugcggacucaguucuaucuuccuguccgucacguuaguuaccuauaucgccuuugagaagauucggcgagacuaccccagcaaaauacugauccaacuuugugcugccuugcuccugcuaaaucugguguuccuccuggauucguggauugcacuuuauaagaugcagggcuugugcaucucaguggcgguauuucugcacuacuucuuacucgucucuuuuacauggaugggccuggaagccuuccacauguaccuugcccuggugaaaguuuucaacacuuauauucgcaaguacaucuugaaguuuuguauagugggguggggagucccugcagugguugugaccaucauucucacaaucaguccagacaauuauggucugggcuccuacgggaaauuccccaacggaagcccugaugacuuuugcuggauuaauaacaaugccguauucuauaucacugucgugggcuacuuuugugugauauuccuacugaacgucucuauguuuauuguugugcucguacagcugugcagaaucaagaaaaagaaacagcuuggugcucaaaggaagaccagcauucaggacuugcgguccaucgccgggcugacguucuuacucggcauaacauggggauuugcauucuuugcuuggggcccggugaaugucaccuucauguaucuguuugccaucuucaacacucuucagggguucuuuauuuucaucuuuuacuguguggcgaaggagaauguucgcaaacaauggagaagguaccugugcugcggaaagcuacgucucgccgaaaacucagauuggaguaaaacagcuaccaacggucugaagaaacagacugugaaucagggcgucucuagcuccucaaacaguuugcagagcuccucuaauucgaccaacagcacaacgcuguuagugaauaacgacuguucaguucaugcauccgggaauggaaacgccaguaccgagcggaauggcgugucuuucagcguccaaaacggugauguaugccuccacgacuuuacugggaagcagcauauguucaaugagaaggaagauuccuguaacggcaaaggacgaauggcucugagaaggacaucaaagcgcggcucucuucacuuuauugagcagauguga

SEQ ID NO: 52497 - RNA, 1650 nt, Artificial Sequence
  derived and/or modified sequence opt3 from ADGRG3__Homo_sapiens__NP_740746
auggccacccccagaggccugggggcucuccuucuguuguuacugcuaccuacaagcggacaggagaagccaacugaagguccgaggaacacgugccucggcuccaauaacauguacgacaucuucaaucugaacgauaaagcacuuuguuuuaccaagugccggcaaucugggucagacaguuguaauguggagaaccugcagcgcuauugguugaauuacgaagcccaccucaugaaagagggacugacacagaaggucaacacucccuuccugaaagcgcucguucagaauuuaagcaccaacacagcugaagauuuuuauuucucccuggagccuucucaagugccacgacagguaaugaaggacgaggauaagcccccugaccgugugagacuuccaaaaucguuguuuaggucacugcccggcaaucggagcgucgugcgccuagccguuaccauucucgauauagguccugggacucuguucaagggaccaagacuuggccugggcgacgggaguggaguguugaacaauaggcucgucggucuguccgugggccagaugcauguaacaaaauuagcagaaccgcuggagaucguguuuucucaccagcggcccccuccaaacaugacccucacgugcguuuucugggaugucacuaaggggaccacaggagacuggagcuccgaaggcuguucaacugaggugcgccccgaggguaccgugugcuguugcgaucaucuuacauuuuucgcccuguugcuacgaccuacccuggaccaaaguacgguccacauucucacuagaaucagccaggcuggguguggaguuucuaugauuuuucuggcauucacaaucauacuuuacgccuuucugagguugucccgggaacguuucaaaucagaggaugcuccaaagauccauguggcccucggcggcagccuguucuuacugaaucuagcguuucucguaaacguggggaguggaucuaaggguuccgacgcagccugcugggcucgcggcgccgucuuccacuauuuucugcuuugugcauucaccuggaugggguuggaggcuuuucaccuguaccuccuggccgugagaguuuucaacacuuauuuuggacauuacuuccuuaaacugagcuuggugggcuggggucuccccgcgcugauggucauugggacaggcucggccaauucuuacggauuauauaccaucagggaccgggaaaaccgaacgucccuggaacuaugcugguuucgcgagggcaccacaauguacgcacucuauauuacugugcacggguacuuccugaucaccuuucuuuucggaaugguaguuuuggcucugguggucuggaagauauuuacacucucaagagccacugcugugaaagagagggguaagaaucggaaaaagguccugaccuuacugggccuuaguagcuugguggggguuacauggggacucgccauuuucaccccgcugggccuauccacuguguauaucuucgcacuguuuaacucucuccaggguguauucauuugcuguugguuuacgauccuguaccuuccuagccagucaacaaccgucaguuccagcacugcccgcuuggaucaagcucauucugcgucacaggaauga

SEQ ID NO: 52498 - RNA, 3582 nt, Artificial Sequence
  derived and/or modified sequence opt3 from ADGRG6__Homo_sapiens__NP_001027566
augauguucagaagcgacaggaugugguccugccacuggaaguggaaacccucuccucugcucuuucuuuucgcccuguacaucaugugugugccacauucagucuggggcugcgcuaacugucggguuguguugaguaauccgagcgggaccuuuacaucccccugcuauccuaacgauuacccaaauucucaggcauguauguggacuuuacgcgcccccacgggauauauuauacaaaucaccuucaacgacuuugauauugaggaagcgccuaauugcaucuacgacucgcugucacuagauaacggugagagccagacaaaguucuguggcgcuacugccaaagggcucaguuuuaauuccucugcaaacgaaaugcacgugagcuucuccucagacuuuaguauucagaagaaaggauucaaugccagcuauauccgaguagcugucucucugcguaaccagaaggugauacuuccacaaaccuccgaugcauaccagguuucaguggccaagagcaucaguauucccgagcugucugcuuuuacauugugcuucgaagccaccaaagucggccaugaggacuccgauuggacugcguuuagcuauucgaaugcaucuuucacacagcuccuguccuucgguaaggccaaaucaggguacuuucugaguaucagcgacuccaagugucucuuaaacaaugcucugccugugaaagagaaggaagauauuuucgccgagucuuuugaacagcuuugcuugguauggaacaauagccugggaucaaucggcguuaacuucaagagaaacuacgagaccgugccaugugacaguacgauauccaaagucauuccgggcaaugggaagcuacuccugggaagcaaccaaaaugagaucgugucucuuaaaggugauauuuauaacuuuaggcuguggaauuucacuaugaacgcaaagaucuugucaaaucucaguugcaacgugaaaggcaaugucguugacuggcagaacgacuuuuggaauauccccaaccuggcuuuaaaggccgaaagcaaucuguccugcgggucuuaccucauuccucuuccagcggccgagcuggcaucgugugcugauuugggaacccuaugccaggacggcauaaucuaucggauuagcgugguaauccagaacauacugcgccaccccgaagugaaaguccaauccaagguggccgaguggcucaauucaacauuccagaacuggaacuacacuguuuauguggucaauauuaguuuucaucugucugcuggugaagauaagaucaaagugaagagaagccuugaggacgagccuaggcugguauugugggcccuccugguuuacaacgcaaccaauaacacaaauuuagaagggaaaaucauucagcaaaagcuguugaaaaacaaugagucccucgaugaaggacugcggcuucacaccgugaacguccgccaguugggccacugucuggccauggaggaaccaaagggcuauuacuggcccucaauccagccgagcgaguacgugcucccuugccccgacaagccaggguucucugcuucccgaauuuguuuuuauaaugcgacgaacccucuggucacuuacuggggacccguggauauaaguaauugccuuaaagaggcaaacgaaguugccaaucagauccugaacuugacagcugacggucaaaaucucaccagcgccaacauuacuaacaucguggagcagguaaagagaaucgucaauaaagaagagaacauugauauaacacugggcucuaccuuaaugaauaucuucuccaacauucugucaaguagcgacucggaucuacucgaauccucuagcgaggcacugaagacgaucgacgagcuugccuuuaaaauugaccuaaauucaaccagucaugugaacaucacaacuaggaaucuggcucucuccguuucuagccuguuaccagggaccaacgccauauccaauuucucaaucggacugcccagcaacaaugaaaguuauuuccagauggauuuugagucuggccagguggacccucuugcauccgucauuuugccaccgaaccuccuggaaaaucuaagccccgaggauucggugcugguacggcgugcgcaauucacauuuuucaacaagacuggucucuuucaggacguggggccucagcgcaagacccugguuucauacgucauggcuuguucuaucggcaauauuacaauccagaaccuuaaagauccagugcaaauaaagauuaaacacaccagaacucaggaggugcaucaccccaucugcgccuucugggacuugaacaagaauaaaaguuuuggaggcuggaacacguccgggugugucgcacacagggauagcgacgccucugaaacaguuugccuguguaaucauuucacccacuuuggaguguuaauggaucucccucggagcgcuucccagcuggacgcccgaaacacuaaggugcuuaccuucauuucauauaucgguugcggcauaagugcaaucuuuagcgcugccacacuguugaccuacguagcguucgagaagcuccgcagagauuauccaucuaaaauucugaugaaucuauccacugcccugcucuuucugaaccuuuuguuccuguuagacggguggaucacaucauucaaugucgauggacucugcauugcuguggcaguucugcuucacuuuuuccugcuagccacguuuaccuggaugggccucgaagcuauccauauguacauagcccuggugaaggucuucaacacuuacauuaggcgguauaucuugaaauuuuguaucauugguugggggcugcccgcauuagugguuagugugguacucgcgagccgcaauaacaaugaggucuacggcaaggaauccuauggaaaagagaagggcgacgaguucugcuggauccaggacccggugauauuuuacgugacaugugccggguauuucggagucauguuuuuccugaacauugcuauguuuaucguugugaugguacaaauuugcgguagaaauggcaaaaggucuaaccguacccuucgggaagaggugcugcgaaauuugagaucggucgugagccucacauuccugcuagggaugacuuggggauucgccuuuuucgcauggggcccucugaacaucccauuuauguaccuuuucucaauuuuuaauucccuccagggucuguucaucuuuauauuccauugugcuaugaaggaaaacguucagaagcaauggaggcgccacuugugcugugggcgguuuagacuggccgauaacagugacuggucuaaaaccgcaacgaauaucauuaagaaaagcuccgauaacuuaggcaagucacucucuagcaguuccaucggaagcaauucuaccuaucugacaucaaaauccaagaguagcucgacuaccuacuucaagaggaacucucacacagacaauguguccuacgagcauagcuuuaacaaaucaggcagucuucgccagugcuuccacgggcagguccuggugaagacuggacccuguuga

SEQ ID NO: 52499 - RNA, 2394 nt, Artificial Sequence
  derived and/or modified sequence opt3 from ADGRG7__Homo_sapiens__NP_116176
auggccagcugcagagcuuggaaccugagggugcucgucgcaguuguguguggccuucugaccgggaucauuuugggauuagguauauggcggaucguaauucgcauccagcgaggcaaguccacaucuucaaguagcacucccacggaguucugccguaaugggggaaccugggaaaacggcagauguauuugcacagaggaauggaaaggucugagguguacuaucgccaauuuuugcgagaacuccaccuacaugggguucacauuugcgcggauaccugugggacgcuauggcccaucucuacaaaccuguggcaaggacacuccgaaugcugggaaccccauggccgucagacucugcucgcugucacuuuacggagaaaucgagcugcagaaagugacaauugguaauuguaacgagaauuuggaaacccucgagaagcagguuaaagaugugacggcaccucugaacaauaucagcagugaaguccagauucugacuuccgacgccaacaagcucaccgcugagaauaucacaucugcaacuagggugguaggccaaauauucaacaccagccggaaugccuccccagaggcuaagaaaguugccauugugacagucucacaguuacuggaugcgagugaagacgcauuucagcgcguggccgcuaccgccaacgaugacgcacuuacgacuuugaucgagcagauggaaacauauagccugucucuagggaaccaauccguggucgagcccaauauugcuauccagucagccaacuucagcagugaaaaugcgguuggaccuucuaacgugcgauuuuccguacagaagggcgccagcucgucucucguguccucaaguaccuucauccacacuaaugucgauggucugaacccagacgcacagacagagcuucaagugcuguugaauaugaccaaaaacuacacgaagaccugcggguuuguuguguaucagaaugauaaacucuuccagagcaagacauuuacugcuaaguccgacuucucucagaaaauuauaagcucaaagaccgaugagaacgaacaagaccagagugccuccgucgauaugguguuuagccccaaauacaaucagaaggaguuccaacuguauucuuacgcuuguguauacuggaacuuaucagccaaagacugggacacauauggaugccagaaggauaaaggcacugacggcuuccugagauguaggugcaaucauaccacaaacuuugcaguucucaugaccuucaagaaggauuaccaguauccuaaaagucuugacauccugagcaauguggggugcgccuuguccgucacuggacuagcucugacggugauuuuucagaucgucacacggaaggugcguaaaaccucuguuacuugggugcucguaaaccuguguauaucgaugcuuauuuucaaccuguuguuugucuucgguaucgaaaauagcaacaagaaucuccaaaccuccgauggcgacaucaacaauauugauuuugacaacaaugauaucccacgcacagacaccauuaacauaccgaaucccaugugcacugcgaucgcagcccuguuacacuacuuccugcuagugacauuuacguggaacgcucucucagccgcacagcuguauuaccuuuugauuagaaccaugaaaccucugccaaggcauuucauccucuuuaucagucugauuggguggggaguucccgccauaguggucgcuaucacugugggcguaauuuauucucagaaugguaacaauccucagugggagcuugauuaccggcaagaaaagaucuguuggcuggccauuccagagcccaacggggugaucaagagcccguugcucugguccuucauaguuccugucacaaucauucugaucucaaauguggugauguuuauuaccaucagcauaaaagucuuauggaagaacaaccagaaucugacaucuacuaaaaagguuuccaguaugaaaaagauugugagcacccuaucuguggcaguagucuucggcaucacguggauucucgcguaccugaugcuugugaacgacgacuccauccgaauaguuuucucauauaucuuuugcuuguucaauaccacacagggacugcagauuuuuauccucuacacugugcgcaccaaggucuuccaaagugaggcuagcaaagugcugauguuacugucguccauuggcagaaggaagucucuucccagcguuacacggccacgcuugagagugaaaauguauaacuuucucaggucacugccuacucuacacgaacguuuccggcugcucgagaccagucccuccacggaagagaucacacugucugaaagcgauaaugccaaggaguccauauga

SEQ ID NO: 52500 - RNA, 4425 nt, Artificial Sequence
  derived and/or modified sequence opt3 from ADGRL1__Homo_sapiens__NP_001008701
auggccagacuggcugcagugcucuggaaccuuugcgucaccgccguucuggugacaagcgcgacucagggcuuguccagggcuggguuacccuucggacugaugcggcgcgagcuagccugugaagguuacccuaucgagcuccgaugcccaggcucugacguaauuaugguggaaaaugcaaacuaugggcguacggaugacaagauaugugaugccgacccguuucaaauggagaauguccagugcuaccugcccgaugcuuucaaaaucaugucacagagauguaacaauaggacccagugcgugguuguggcaggaagugacgccuuuccugauccaugucccggcacauauaaguaccuugaaguccaauaugacugcgugccuuacaaaguagagcagaagguuuucguguguccagguacucugcagaaagucuuggagcccaccagcacacacgaauccgagcaucagucuggggcuuggugcaaggauccucuccaagccggagaccggauuuaugugaugccauggaucccguaccgcaccgauacucugacagaauacgcgucgugggaggacuauguggcagccagacacaccacgacuuacaggcugcccaaccgggucgauggcaccggcuuuguuguguaugacggggcuguauucuacaauaaggagcgcacacgaaacauugugaaauaugaccucagaacuaggaucaagucaggagaaaccgucauaaauacagccaacuaccaugauaccagcccuuaucggugggguggcaaaacggacaucgauuuagcaguggacgagaaugggcuguggguuauuuacgcuacugaaggaaacaauggccgucuuguggucagucaguugaacccauacacacugcgcuuugaggguaccugggaaacuggguaugauaagagauccgccucuaaugcguucaugguguguggaguacuauacguucucaggagcguguaugucgacgaugacuccgaggccgcaggcaaccggguggauuacgcuuuuaacacaaaugccaaccgagaggaacccgucucacugaccuucccuaauccauaucaguuuaucaguagcguggacuacaacccccgcgauaaucagcuuuauguuuggaacaauuacuucgugguaagauacucucuggaguuuggcccgccugaccccuccgcugggccagccacgucaccucccuugagcaccacaacuaccgcaaggccaacaccccucaccaguacugccucuccugcugcgacaaccccacugcggcgcgcaccguuaacuacgcaccccgucggagccauuaaccaacuggguccugaccucccacccgcuacagccccugugccauccaccagaaggcccccggcaccuaaucuucauguuagcccagaacuguucugcgagccccgugaagugcggcgaguccaguggccugccacucagcaaggcauguugguggagagacccugcccaaaagggaccaggggaaucgcuucguuccagugucuaccugcccugggccucuggaacccccgcgguccagaucugucuaauugcacauccccguggguaaaccagguggcacagaagauaaagucaggggagaaugcggcuaacauugccagugaacuugcacggcacaccagaggcagcaucuaugccggagacguuuccucuagcgucaaacugauggagcaauugcucgauauucuggacgcucaguuacaggcccugaggccuaucgaacgcgagucagcaggcaagaauuacaacaaaaugcacaagcgagaacggacuuguaaagauuauaucaaggcugugguggagacagucgacaaccuacuccgucccgaggcccuggaaaguuggaaagauaugaaugcgacggagcagguucauaccgccacuaugcuuuuggacgugcuggaagagggggcuuuucuccuggcagauaacgugagagagccagccagguuccuugcugccaaggaaaauguaguccuggaggugacaguuuugaacaccgaaggacaagugcaggagcucgucuuuccccaggaagaguacccucgcaaaaauuccauucagcugagcgcaaagacaauaaagcaaaacucucggaauggugugguuaaagugguauucaucuuauauaacaaucugggccuauuucucucaacugagaacgcgaccgucaagcuggccggggaagcuggaccaggcggucccgggggcgccagucuuguggugaauagccaggucauugcagcuuccaucaacaaagagucuucgagaguuuucuugauggacccugugauauuuacgguagcccaccuggaagauaagaaucauuucaacgcaaauugcagcuuuuggaacuacuccgagaggucaaugcucggauauuggaguacccagggcugucgacugguggaaucuaacaagacacacacuaccugcgccuguagccacuuaacaaauuucgcuguccugauggcgcaucgcgagauuuaccaggggcggaucaacgagcuuuugcucuccgugaucacuuggguuggaauugugaucucacuggucugccuagccauuuguauaagcaccuuuugcuuccugagaggucuccaaacggacaggaauacaauccacaaaaaccuguguauuaauuuguuucuugcagaacuguuauuccucgugggcaucgauaagacccaguacgagaucgcuugcccgauuuucgccgggcugcuucauuacuuuuuccuggccgcuuuuucuugguugugccucgaaggaguucaccuguaucuacugcucguggaggucuucgaauccgaguauagucguacuaaauacuauuaccugggcgguuauuguuuuccagcacuuguaguggggauagccgcggcuaucgacuaccgcagcuacggcacagagaaggccugcugguugcggguugacaacuauuucauuuggucuuuuaucggacccguguccuucgucauugugguaaaucugguguuuuuaauggucacccuccauaaaaugaucagaucaaguagcguucugaagccugauucguccaggcuugacaacauaaagucuugggcacugggcgccaucgcucuacucuuccuguuggggcugacuugggcauuuggauuacucuucauuaauaaagaaagcguggugauggccuaccuguuuaccacauucaacgcguuccagggcgucuuuaucuucguguuucacugugcacuucaaaagaaaguucacaaggaguauucaaaaugccugcgacauaguuacuguugcauucgguccccacccggugggacgcacggaucuuugaagaccagcgccaugcgcuccaauacuagauauuacacaggcacccagucaaggauccggcgaauguggaacgauacaguaagaaagcagacugaaagcaguuucauggcuggugacauaaauucuaccccuacgcucaaccgcggcacaauggggaaucaucugcuaaccaacccggugcugcagcccaggggaggcacuuccccauauaacacccuuauugccgagagcgucggguuuaauccuucgucacccccaguguucaacucuccuggaaguuaccgugagcccaaacacccacucggcggucgggaggcuugugggauggauacacugccguugaauggaaacuuuaauaacuccuacagccugagaucuggcgacuucccucccggugauggcgggccagaacccccuaggggacgcaauuuagccgacgcagcugccuuugaaaagaugaucauuagcgagcucguucacaacaaucugcgaggcuccucaagugcggccaaagggccacccccuccggaaccacccgugccucccgucccaggaggcgguggggaggaggaagcaggaggcccugguggcgcugauagagccgagaucgaacuucuguauaaggcuuuggaggaaccccuccugcuaccacgggcacaaagcgugcuguaccagucugaccuugaugaguccgagucaugcacugccgaagacggggccaccaguaggccucucagcuccccgcccggacgcgauucucuguaugcuucgggcgcgaacuugcgugacagcccaucauacccugacuccagucccgaggggccaucugaagcauuaccucccccgcccccugccccaccaggacccccugagauauauuacacaagcagaccgcccgcucugguagcccggaauccacuccagggcuauuaccaggucaggcgcccuucccaugaagguuaccuggcagcccccgggcuugagggaccuggcccagauggcgacgggcaaaugcagcuggugacgucauuguga

SEQ ID NO: 52501 - RNA, 4410 nt, Artificial Sequence
  derived and/or modified sequence opt3 from ADGRL3__Homo_sapiens__NP_056051
auguggcccagccagcugcucaucuucaugaugcuucuggccccuauuauacacgcuuuuuccagagcaccaaucccgauggccguggucaggcgggaguugucuugcgaaucauaccccauugaguuacgcuguccuggcaccgacguuaucaugauugaaagugcgaacuaugggcgaacagaugacaagaucugcgauagcgacccagcucaaauggagaauauacguuguuaccugcccgaugccuauaaaaucaugucccagagaugcaacaauaggacucagugugcagugguagccggaccugacguguucccagaucccugcccugguacguacaaguaucuagaaguccaguacgagugugugccauauaaaguugagcaaaagguguuucucugcccgggccugcuuaaaggggucuaccagucugaacaucuguucgagucggaccaccagucaggagcuugguguaaggaucccuugcaggcaagcgacaagauuuacuauaugccuuggaccccauaccggacagauacucucaccgaauauaguuccaaagacgauuuuaucgccggccgccccacaaccacuuacaagcugccucauagaguggacgguacaggguucguaguuuaugacggagcucuguuuuucaacaaagagaggacccggaauauugugaaguuugaucuccgcacgcgaaucaaaucuggcgaggccauaauugcgaacgcaaauuaccacgacacuagcccauauagauggggcgggaaguccgauaucgacuuagccgucgaugaaaacggacugugggugauuuacgcuaccgagcaaaauaacgguaagaucgugaucucacagcuuaaucccuacacauugaggauugaaggcacuugggacaccgccuaugauaaacggagugcaagcaacgcuuucaugauaugcgggauccuguacgucguuaagucuguguaugaggacgaugacaaugaagccacaggaaacaaaauugauuacaucuauaauaccgaccaguccaaggacagccuaguagaugugccguuuccuaacagcuaccaguauauagcggccgucgacuacaacccccgugauaaucuccuguacguguggaacaauuaucauguugugaaauacagucuugacuucggcccacuggauucucgcuccggucaagcacaccacgggcaggucagcuauauuucgccucccauccauuuggacucugagcucgagagaccauccgugaaggauaucucaacgacuggaccccugggcaugggcaguacaaccacuagcacaaccuuaaggacgaccacacuguccccugggcggucuacuaccccaagcguaucaggacgacgcaacagaaguacauccacuccgagccccgcuguugaagugcucgacgauaugaccacacaccuuccuucugccucaagucagauuccagcucuggaggaaagcugugaggccgucgaagcaagggagaucaugugguuuaaaacccggcaaggucagauugccaagcagcccugcccugcuggcacuauagggguguccacguacuugugccuagcgccagacggaaucugggauccccagggcccggaccugucuaauuguucgagcccuugggucaaccauauuacacaaaagcucaaauccggugagaccgcagccaauaucgcucgcgaacuggccgagcagacuagaaaccaccuuaaugcaggggauaucaccuauucagugagggccauggaccagcugguuggcuugcucgacgugcagcugcguaacuuaacaccaggaggcaaggauagugcugcccggucucugaauaaacuacaaaagcgagaaagaagcugcagggcauacguacaggcgauggucgagaccgugaacaaucuccugcagccccaggcucuuaacgccuggcgcgacuugacuacauccgaucaacugcgggcagccacgaugcuccugcacaccguugaagagucagcuuucgugcuugccgacaaucuguugaaaacugauauugucagagagaacacagacaacauaaagcucgaaguggcaaggcugagcaccgaggggaauuuagaagaucugaaguucccugagaacaugggacaugguucuacaauccagcuauccgcuaauacucucaaacagaacggccgcaauggggagauucgaguagccuuugugcuguauaacaaucuuggacccuacuugaguaccgaaaacgcgagcaugaagcugggcacggaggcccucucuaccaaucacuccguuaucgucaacucaccagugauuacagcugcaaucaauaaagaauuuaguaacaagguguaccuggccgacccugucguuuuuacugugaaacauauaaagcagagcgaggaaaauuucaaccccaauuguucguuuugguccuauucuaagcggaccaugacagguuacuggagcacucaagggugccguuuacugaccacgaacaaaacacacaccacuuguucaugcaaccaucuuacaaauuucgcuguguugauggcccacguagaggucaagcacagugaugcagugcaugaccuccugcuagauguuaucaccugggugggcauucugcucucccuggucugucuuuugaucugcauuuuuacuuucuguuucuucagaggacugcagucugacaggaacaccauccacaaaaauuuaugcauaagccucuuuguggcggagcugcuuuuccugauuggcaucaaccgcacagaucagccaauugccugugcuguuuuugccgcauugcuccauuucuucuuucuggcugccuucacguggauguuucuagaaggggugcaacuguauaucaugcucguagaggucuucgaauccgagcacucacggagaaaguacuuuuaucuggugggauacgguaugccggcacuuauaguggccgucagcgcugcgguugacuauaggaguuacggcaccgacaaagugugcugguugcgacuggauacuuacuucaucuggucuuuuauugggccugccacauuaaucauuaugcucaauguaaucuuccugggaauagcacuuuauaagauguuucaccauaccgcuauucugaagcccgaauccggcugccuagacaacaucaauuacgaggauaaccgcccauucaucaaaagcugggugauuggugccaucgcccuccuguguuugcugggguuaacaugggcuuuuggccucauguauauuaaugagucgacugucauaauggcauaccuguucaccaucuuuaacucacuucagggaauguucauuuucaucuuucacugcgugcugcagaagaaaguucggaaggaauauggcaaauguuugagaacgcauugcuguucugggaagaguacagaguccagcauuggaucuggcaaaaccagcgguuccaggacucccgggcguuacucaaccggaagucagagccgcauccggagaauguggaaugacacagugaggaagcaaucugaauccucauucauaacuggcgauaucaacaguagcgccucccucaaucgagagggucugcuaaacaaugcgcgggacaccucugucauggauacacugccucuuaacggcaaccacgguaauucguauagcauugcuucaggagaauaccucuccaacugcgugcagaucauugaccgcggcuacaaucauaacgagacggcccuggagaagaaaaucuugaaggaacugaccaguaauuauauaccaucuuacuuaaacaaucacgagagaagcuccgaacagaacaggaaucucaugaacaaacugguuaauaaccuugggucaggacgggaggaugacgcaauugugcuggaugacgccacuucuuuuaaucacgaggaaucauugggccucgagcugauccaugaagagagugacgcuccccuacugccuccgcgagucuauuccacagaaaaccaccagccacaucacuacaccagacgcaggaucccccaagaucauagcgagucuuucuuuccucuucucacuaaugagcacacagaagaccugcagucaccacaccgugauuccuuguauaccaguaugcccacguuagcagggguagccgcgacugagagcgugaccacaucgacccagacugaaccuccgcccgcuaaguguggggacgccgaggauguuuacuauaaaucuaugccaaaccugggaucccggaaucaugugcaccagcuccauacauacuaccaacugggcagagguagcucagacggcuucauugucccucccaacaaggaugggaccccaccugaaggaaguucuaagggccccgcacaccuugugacaucccuguga

SEQ ID NO: 52502 - RNA, 18921 nt, Artificial Sequence
  derived and/or modified sequence opt3 from ADGRV1__Homo_sapiens__NP_115495
augagcguguuccugggacccgggaugccuuccgccucucuccuugucaaccuguugucagcuuuacugauccuauuuguuuucggagaaaccgaaauuagguuuacuggucagacugaguucgugguaaaugaaacgaguaccacugugauaaggcucaucauugaacggaucggcgaaccagcuaacgucacugccauugugagccuguacggggaagaugcgggagacuuuuucgauaccuaugcugccgcauuuaucccggccggcgaaacgaaucgcaccguuuacauagcugugugcgaugacgaucuucccgaaccugacgagacuuucaucuuucaccugacauugcagaagccauccgcaaacgucaaacucgguuggccccgaaccgugacgguuacuauucugucuaaugauaacgccuucgggaucauuucguuuaauaugcugccuucaaucgcuguuagcgaaccaaagggacguaacgagaguaugccccucaccuuaauaagagagaaaggcacauauggcauggugauggucacuuucgaaguggaaggugggccuaauccaccggacgaagaucugucccccgugaaggggaacauuaccuuuccuccaggcagggccacagucaucuacaaucuuaccguuuuggacgaugaggugcccgaaaacgacgagauuuuccugauccagcuaaaaucuguagaagggggagcggaaaucaauacgagccggaacuccauugagauaaucauuaagaagaaugauucaccugugcgcuuccuccagaguaucuaucuggucccagaagaggaccacauacuuauuauccccgugguuagaggcaaagacaacaacgguaaucugaucgggagcgaugaauacgaggugucuauuuccuaugcagucacuacaggaaacucaaccgcccacgcucagcaaaauuuggacuuuaucgaucuccagccgaacacuacagugguauucccucccuuuauucaugagagccaccugaaguuccagauaguugacgauaccaucccagaaauugccgagaguuuucauaucauguuacugaaagacacgcuccagggcgaugcagugcuuaucucuccuuccgucgugcaagucaccauuaagcccaaugacaaaccauacggcgugcugagcuucaacucgguuuuguuugaaaggacagugauaaucgaugaggaccggauuucucgcuacgaagagaucacuguaguccgaaaugggggaacccacgguaacguguccgcuaauuggguucuaacaagaaacucaacugaucccaguccugugaccgccgacauuaggccaagcuccggcguccugcacuucgcgcaggggcagaugcucgccacaaucccgcugaccgugguagacgaugaccuucccgaggaagcagaggcuuaucuguugcagauacucccucauacuauccggggaggcgccgaagugucugagccagcugagcuguuauuuuacauucaagauagcgacgauguuuauggucugaucacguucuuucccauggaaaaucagaagauugagucaaguccuggggaacguuaccuaucccucagcuucacacgccugggcggaaccaagggcgacgucagacuuuuguauucugugcuguacaucccagccggggcaguggauccccuccaggccaaagagggaauacugaacauuucaaggcggaaugaccuuaucuuuccggaacaaaagacucaggucaccacaaaacugccuauucgaaacgaugcuuucuugcagaauggugcgcacuuccucguucagcuggagaccguggaguuacugaacaucauaccacuaauacccccuauuaguccccgcuuuggcgaaaucuguaacauuagccuccuggugacuccagcaaucgccaauggggagauaggauuccuuuccaacuugccuauuauccugcaugaacccgaggacuuugcugccgaaguagucuauaucccacuccacagagauggcacagacggucaagcaacgguguacuggucucugaagccgucgggguucaauagcaaagccguuaccccugaugacauuggccccuuuaacggauccguguuauuccugucaggccagagugacacuacaaucaauauuaccauaaagggggaugacaucccagagaugaacgagacagucacucuuucuuuggauagggugaauguugaaaaccaggugcucaaaagcggauacaccucccgggaccugauuauccuagagaaugaugaccccgguggcguauuugaguucagcccugcuagccgcgggccauaugucauuaaggagggagaaucuguggagcugcacaucauaagauccaggggcagucucgugaagcaguuucugcauuaccgugucgagccccgggauagcaacgaguucuaugguaauacggggguucuugaguuuaaaccuggcgaacgagagaucgugauuaccuugcuggccagauuagacggaaucccggagcucgaugaacacuacuggguagugcugucuucccauggcgagagggaaucaaaacuugggagugcaacaauugucaacaucacuauacugaaaaaugacgauccacacggaauuaucgaguucgugagcgacggcuugaucguuaugauuaacgaaucgaagggugaugcgauauauuccgcuguguacgacgucgugcgcaaucgggggaacuuuggagacguuucugugagcugggucguaucacccgauuucacccaagacguguucccuguucagggcacaguggucuuuggugaucaggaguucaguaaaaacaucacuauuuauucccucccagacgagauccccgaagagauggaagaguuuaccgugauucugcuaaauggcacagggggagccaagguaggcaacagaacaaccgcaacucugaggauccgccgaaaugaugacccuauauacuucgccgaaccgcgggugguccguguucaggagggggagacagcuaacuuuaccgugcucagaaauggaucuguggaugucacuugcauggugcaauacgccaccaaggacggcaaagcaacagcuagggaacgcgauuucauccccguugagaagggugaaacgcugauuuuugagguagggagccggcagcaguccaucucaauuuucgugaacgaagacggaaucccagagaccgaugagccuuuuuauauaauucuuuugaauagcacuggcgacacagucguguaccaguaugguguugccaccgugaucaucgaagcgaacgacgaucccaauggcauuuucagucuggagccaaucgacaaagccgucgaagaggggaagacaaacgcuuuuuggauauuaagacauaggggauacuucggcucuguguccguaagcuggcaacucuuccagaaugauucggcacugcagccugggcaagaguuuuaugaaacuucaggaaccgucaacuucauggacggcgaggaagccaaacccauuauccuucacgcuuuuccagauaagauuccggaguucaaugaauuuuacuuccugaagcuagugaacaucucuggugggaguccuggacccggcggucagcucgccgagacgaaucugcagguuacagugauggucccauuuaacgacgaucccuucggcguguuuauauuggacccugagugucuggaacgagagguugcagaagauguguuauccgaggacgauaugagcuauauuaccaacuucacuauccuccgccagcaaggggucuuuggagacgugcagcugggcugggaaauccuuucuagcgaguucccagcggggcugcccccuaugauugacuuuuugcucguaggaaucuucccgaccacagugcaucugcagcagcauaugcggagacaccauuccggcacugacgcccuauacuucaccggucuggagggggcuuuuggaacaguuaauccaaaauaccaccccucaaggaacaauacgauugccaacuucaccuuuagugcaugggucaugccuaaugcuaacacuaauggcuucauaaucgccaaggacgauggcaacgggagcauuuauuacggagugaaaauccaaacaaaugaaucucacgugacccuuucccuccauuauaagacucuggguucaaacgcaacauacaucgccaaaaccacggucaugaaguauuuggaggaaaguguauggcugcacuuacucauuauacuggaggacggcaucauugaauuuuaccuugaugggaaugcuaugccccguggaaucaagagccugaaaggcgaggcgauuacugacgguccagggaucuugcgcauaggagccggcaucaacggcaaugaucgguucaccgggcucaugcaggacgugagauccuaugagaggaagcugacacuagaagagauuuacgaacugcaugcaaugccugcuaaaucugaucuucaccccaucucgggauaccucgaguuucgacagggugagaccaacaagagcuucauuaucucagcccgggacgauaaugacgaagagggcgaggaacuguuuauauugaaauuaguuuccguguaugggggagcccgcauuagugaagagaacacuacagcuagacugaccauccagaagucugauaaugcaaacggccucuucgguuuuacaggggccugcauuccagagaucgcggaagagggaagcacuauauccugugucguggaaaggacccggggcgcucuggacuacguucauguguucuauacgaucucacaaauugagacagauggcaucaacuaccuugucgacgacuuugccaaugcaucugggaccauuacuuuccugccuuggcagcgaagcgaaguguugaacaucuauguacuagaugacgauauaccggagcugaaugaguacuucagagugacccucguuagugccauucccggagacgguaaacugggcuccacaccaacuagcggggcuucuaucgauccugaaaaggagaccacggacaucacaauuaaggcaucagaucaccccuauggacuuuuacaguuuuccaccggccugccaccucaacccaaagacgccaugacucucccggcgaguagcgucccacacaucacaguggaagaggaagauggugagauacgcuugcuggugauuagggcucaggggcuccugggacgugucaccgccgaguuccggacuguuucgcuuacagcauuuucuccugaagacuaccagaacguggccggcacccuggaguuccagcccggcgaaagauacaaguauaucuuuauuaauaucacggauaacuccauaccagaguuggagaagucauucaagguagaacuacugaaucucgaagggggaguggcugaauuauuuagggucgacgguucaggcaguggggacggagauauggaguucuuucugcccacuauccauaaacgcgccucucuuggcguggcaucccaaauucugguuaccaucgcugccagcgaccacgcgcaugguguguucgaauuuucaccugagagucucuucgucagcgggacagagccggaagauggauacuccaccguaacauugaacgugauucgacaccauggcacucugucucccguuacccuccacuggaauaucgacagcgauccagacggcgaucuggccuuuacguccgggaacauuacauucgagaucggacagacuucagcaaauauaaccguggaaauucuuccugacgaggaucccgaacuagacaaggcuuucucugucagugugcugucggucagcuccgguucuuugggcgcccacaucaacgcuacauuaaccgugcuggcaucagaugacccuuaugggaucuuuauuuucagcgagaagaauagaccaguuaaaguggaggaagccacucagaacauaacccucuccaucauucggcugaagggacuuaugggcaaaguacuggugaguuacgccacacucgaugacauggagaagcccccuuauuuuccacccaauuuggcuagggcgacgcagggucgcgacuacaucccggcaucuggguucgcccuguuuggcgcuaaccaaagcgaagccacuauugcaaucucaauacuagaugacgaugagccugaacguuccgagagugucuucaucgagcugcucaacagcacccuuguugccaaagugcagucuagauccauuccaaauucaccccggcugggaccuaaggucgaaacaaucgcucaguuaauuaucauagcgaacgacgaugccuuuggcaccuugcagcugagcgcaccaauugugaggguagcugagaaucauguggggcccaucaucaacguuacucgcacaggaggugccuucgcagacgugucggucaaguuuaaagccgugccgauuaccgcuauagccggcgaagauuauucuaucgcgaguuccgacgucgugcuccuggagggggagacgagcaaggcaguuccuauuuacguaaucaaugauauuuaccccgaacuugaggaaucauuccuggugcaacucaugaacgagacuacaggaggcgcccgauugggugcucugaccgaagccgucaucauaaucgaggcuuccgacgauccauauggguuauuuggcuuccagauuaccaaacuaaucguggaggaaccugaguuuaauucuguuaaggugaaccugcccauuaucagaaauagcggaacucucggcaacgucacagugcaguggguagcaaccauuaaugggcagcuugccacaggagaccugcgggugguuagugguaacgucacuuucgcuccaggcgaaacgauacaaaccuugcugcucgaggugcuggccgacgaugugcccgaaaucgaggaggucauucagguucagcuuacagacgcauccgggggaggcacuaucggucucgauaggaucgcgaauauuauaaucccugccaacgacgauccauacgggaccguggcuuucgcccaaaugguauaucgcgugcaggaaccgcuggagagaagcucuugcgcaaauauuacagucaggcggucaggcggacacuuuggccguuugcuguuauucuacaguaccuccgacaucgaugugguugcucuagccauggaagaggggcaggaccugcucagcuauuacgaaucucccauucagggagugccugauccacuuuggcgcacuuggaugaacgucucggcagugggcgagccccuguauacgugugccaccuugugccugaaagagcaggcuuguucagcguuuagcuucuuuuccgccagugaagguccucagugcuucuggaugacaucuuggaucagcccagcaguaaacaauuccgacuuuuggacuuaccgaaagaacaugaccagaguugcuucacucuucagugggcaggccguggccggaucugauuacgagcccgucacaaggcagugggcaauaaugcaagaaggcgacgaguuugcuaaucugaccgugagcauccuuccugaugacuucccggagauggacgaauccuuuuuaauuucacugcucgaggugcauuugaugaacaucagcgccucucugaagaaucagccaacuauuggucagcccaacaucuccacagucguuauagcgcuaaauggcgaugcuuucgggguguuuguaauuuauaacaucaguccuaauacgagcgaagacggacuguucguggagguccaggaacaaccccagacccucguggagcuuaugauucaccggacuggcgggucgcugggacagguugccguggaguggcgcgucgugggcgguacagcaaccgaaggguuggauuucaucggagccggcgagauacugaccuuugcugaaggugagacuaagaagacuguaauccucacgauucuggacgauuccgaaccagaggacgaugagucuaucauuguuucauuaguguacaccgaaggcgggagcagaauccuuccuaguuccgacacagucagggugaacauacuggcaaaugauaacguugccggaauugugucuuuccaaacugcgagccggucagucaucggccacgagggggaaauccuccaguuucaugugauucgaaccuuccccggaagaggcaauguaacagugaacuggaaaaucauaggucagaaucuagagcugaacuuugcuaacuucuccgggcaguuguuuuucccagaaggaagucugaauaccacucucuuuguccaccuucuggacgauaacauuccggaggagaaggaaguuuaucaagugaucuuguacgacguccgcacgcagggcgugccucccgccggcauugcacugcucgaugcccagggguaugcugccguauuaacaguggaggcaagcgacgaaccacauggaguucugaauuucgcucuuucuucaagguuugugcugcuacaggaggccaacaucaccauacaacucuucaucaaucgggaguuugguucccugggcgcgauuaacgucacuuacaccacagugcccgggauguugagccugaaaaaucagacuguuggaaaccucgccgaaccugaggucgacuucgugccaaucauuggcuuccuuauccuggaagagggugaaaccgcagcugccauuaauaucacaauauuagaggaugacgugcccgagcuggaagaguacuuuuugguaaaccucacguacgucgggcugaccauggcagcuucuaccagcuucccuccgcgucuagauucggaaggacuuacagcccaggugaucauugacgccaaugauggcgcgagaggcguuaucgaguggcagcaauccagguuugaagugaacgagacacacgggagccugacucucgucgcucagcgcucacgggagccacugggacaugugucuuuguucguuuacgcacagaaucuggaagcccaggugggucucgacuauauuuuuacacccaugauacuucacuucgcugauggcgagcgauacaagaacguaaauaucaugauucuggacgaugacaucccugaaggggaugagaaauuucaauuaauucugaccaacccaagccccggauuggaacucggcaagaacacgaucgcccugauaaucguccuagcaaaugacgacgguccuggggugcuuuccuucaacaauagugagcacuuuuuccugagagagcccaccgcccucuaugugcaggaaucaguugcuguccuguacauugugagggagccagcgcagggauuguuuggcacaguaacugugcaauucaucgucaccgaagugaacucuagcaaugaguccaaggauuuaacaccgaguaaaggcuauauuguucuggaggaaggggugcgcuucaaggcccuccagaucagcgcaauacuugacacugagccugaaauggaugaguacuuugucuguacccuguucaaccccacaggaggugcucggcuaggcgugcauguucagacccugauuacugugcuccagaaucaagccccauuggggcuguuuuccaucucugcaguagaaaacagagccacgucaaucgacauugaggaggcuaaucguacagucuaucuuaacgugagcaggaccaauggaauagaucuggccguuucggugcagugggaaacugucuccgagaccgcguucggcaugcgggguauggacgugguauuuaguguguuccagucuuuucucgaugaaagcgcaucaggguggugcuucuuuacauuagagaaccugaucuacggaauuauguugcgcaaauccucugucacgguuuaccgauggcagggcaucuucauuccuguggaagaccugaauaucgagaaccccaagaccugcgaggccuuuaauauaggcuucaguccauauuuugugaucacucacgaagagagaaacgaagagaaaccuagccucaacuccgucuucacauucaccucaggguuuaaacuuuuccuggugcaaacuauuaucauucuagaaagcucucagguuagguacuuuacaagugauucccaggacuaucugaucauagcuagccagcgggaugacucagagcucacccaaguauuccgcuggaauggagguucuuuuguguugcaucagaagcugcccgucagaggcgugcuuacaguugcccuguucaacaaagggggauccguguuuuuagcaauuucgcaggcuaaugccaggcucaacagccuguuguuccgauggaguggcucugguuuuaucaauuuccaagaggucccgguguccgggacuaccgaaguagaggcucugagcucagccaacgauauuuaccucaucuuugcagaaaauguguuccuuggagaccagaacaguaucgacauuuuuauaugggagaugggccaguccagcuuccgguauuuccagucugucgauuuugcggccguuaaucguauccacucauucacgccagcuagcggcauugcccacauccugcuaauugggcaagacauguccgcacuguacuguuggaacucugagagaaaucaguuuaguuucgugcucgaagucccuucggcuuaugauguggccagcguuaccgugaaguccuugaacucaucuaaaaaucugaucgcauuaguaggagcccauagccacauauacgagcuugcguacaucaguucccauucagacuuuauucccucuagcggugaacugaucuucgagccaggcgaacgcgaggcuacaauugccgugaacauacucgaugacacuguccccgagaaggaagaguccuuuaaagugcagcugaagaauccuaaagggggagcagaaaucggcauuaacgauaguguuaccaucacaaucuugagcaacgacgaugccuaugguauugucgcuuucgcccaaaauucucuguacaaacaaguggaggaaauggagcaggacucacucgugacucuuaacguagagaggcugaaggggaccuauggacggauaacgaucgcaugggaagcugauggcuccauuagcgacaucuuuccgacaaguggcgucauucuauucaccgagggacaggugcugucuacuaucacauuaaccauacucgccgauaauaucccagaacuguccgagguugugauugucacuuugaccagaaucacaacggaaggaguggaggacucguacaaaggugcgaccauugaccaggaucgcagcaagucaguuaucacuacacuucccaacgacuccccuuuuggccuggugggguggagggcugccucugucuucauacgaguggcagagcccaaagaaaauaccacuacacuccaacugcagauugcccgggauaagggauugcugggcgacaucgcuauucaccuaagagcacagccaaacuuucuccuucauguagauaaucaagccaccgagaacgaagacuaugugcugcaggagacgaucauaaucaugaaggagaauauuaaagaagcgcacgccgagguuaguaucuuaccugaugaccugcccgaacucgaggaagguuucauugucacaaucaccgaggugaaccuggugaauagcgauuucucaacugggcagccauccgucaggcgcccuggcauggagauagcugaaauuaugaucgaggaaaacgacgauccgcguggaaucuuuauguuccacguuacccggggcgcaggggaggugauuacagccuacgaaguacccccaccuuugaaugugcuucagguccccgugguuagacuggcuggcagcuuuggugccgugaacgucuauuggaaggcaucuccagacagugcuggccucgaggacuucaaaccuucccaugggauccuggaguuugccgauaagcaaguaacugcgaugauugaaauaaccaucauugacgaugccgaguucgaacuaacagagacguuuaauaucagcuugauuucaguggcaggaggcgguaggcugggggacgauguuguggucacuguggugaucccccagaacgacucuccguucggcgucuuuggauucgaagagaaaaccguuaugauagaugagucgcucagcuccgacgauccagacaguuacgugacacuuaccguagugcgcucuccuggcgggaagggaacuguccgacuggaauggacaaucgaugagaaggcuaaacacaacuuaucaccccugaaugguacccuccauuuugacgaaacggagagccagaagacuauuguucugcacaccuugcaggauacagugcuugaggaagaccggagauucaccauccaacugauuuccaucgacgagguggaaauaaguccagucaaaggcucugccagcauuaucaucagaggggauaagcgcgcauccggagagguaggcauugcccccucaagcagacacauacucaucggugaaccuucugcuaaauacaacggcacugccauuaucucccuggugcgggggcccggcauuuugggcgagguuacaguguuuuggaggaucuucccaccuagugucggggaguucgcggaaaccucaggaaaguuaacaaugcgugacgagcagagcgcugugauaguugugauccaggcacugaaugaugacauuccggaagagaaaucguuuuaugaguuccaguugacugccgucuccgagggcgguguacucucugagaguagcucaaccgcuaacaucacgguggucgccuccgauucucccuacgggcgauuugcauucagccaugaacaacugcgcgugagugaggcccagagaguuaauauuacaaucauacgguccagcggagacuuuggccacgugaggcuuugguauaagaccaugucugguacugcugaagcgggccuggauuucgucccagccgcaggggagcuccuguuugaagccggagagaugcgcaagucauugcauguggagauucuugacgaugacuacccugaaggccccgaggaguucucccugaccaucacaaaaguagagcuacaggggagaggauaugauuuuacuauccaggagaacggccuccaaauugaccagccaccugaaaucgguaauauuagcauagugcggaucauuaucaugaagaacgauaaugcugaggggauuaucgaguucgaccccaaauacacggcauuugagguugaagaggacgugggacugauaaugaucccggucgugagguuacacggcaccuaugguuacguuacagccgauuucauuagucagucuucauccgcuagcccuggcggggucgacuacauccugcauggaucgaccgugacuuuucaacacggccagaacuugucuuucauuaauauaaguaucauugaugacaacgaguccgaguucgaggaaccaaucgagauccuccugacaggggccaccggaggcgcgguacuuggucgacaccuggugagccguauuauaaucgcaaagucagauucucccuuuggggucauuagauuccucaaucagagcaaaaucuccauugccaacccuaauaguacuaugaucuugucacuggugcuugaacgcacaggaggccuguuaggcgagauacagguuaacugggagaccguggggccaaauagccaagaagcucuacucccccagaaccgggacaucgccgauccugucuccggacuguuuuauuucggugagggcgaagggggagugaggacgauuauccugacuauuuacccacaugaggaaaucgagguagaggaaaccuuuauaauuaaguugcaccucguuaagggcgaggcaaaacuggacucuagagcuaaggaugugacacuuaccauccaggaguucggugaccccaacggggucgugcaguuugccccggagacucugaguaaaaagacauauagcgagccuuuagcgcucgaaggaccccuguugauuaccuucuuugugcgccggguuaaaggcacguucggcgagaucauggucuacugggaacuuuccucagaguuugauauaacagaagacuuccugucuacuucgggguuuuucaccaucgccgacggagagagcgaggcuuccuucgaugugcaucuacucccagacgaaguacccgagauugaagaggauuaugugauccaacuggucaguguggaagguggcgcagagcuggacuuggagaagucuauuacaugguuuagcguuuacgccaaugaugacccucacgggguguucgcucucuauucagauaggcaguccauccugauaggacagaaccuuauucgaagcauccagaucaauauuaccagacuggcaggcacuuuuggugacgucgccgugggguuacggaucucuagugaucauaaggaacaaccaauuguaacggagaacgcugaaaggcagcucguugugaaagacggagccaccuacaaggucgaugugguucccaucaagaaucagguguuccugucccuaggcucaaacuuuacauugcaacuggucacugugaugcuuguaggcgggcgcuucuacggaaugccuaccauccuccaggaggcaaagagcgccgugcugccagucucugaaaaagcggcuaauucgcagguugguuuugaguccacagccuuccagcugaugaacauuaccgcaggcacaagucacgugaugaucagccguagagggacauauggagccuugucaguggcuuggaccacgggcuacgccccgggucuugagauucccgaauuuaucgucguggggaauaugacuccuacacucggaucucuguccuucagccacggcgagcaacgaaagggcguauuuuuauggaccuucccaagucccggguggccugaagcauucguacugcaucuaucaggagugcaguccagcgcuccagguggcgcccagcucaggucuggguuuauagucgcggagaucgagcccaugggaguguuccaguuuaguacuagcucccggaacauuaucguuucugaagacacccaaaugauucgccugcacgugcagagauuguucggcuuucauucagaucugaucaaggucagcuaucagacaaccgcagguuccgccaaaccgcuugaggacuucgaaccugugcagaauggggagcucuuuuuccaaaaguuucagacggaaguagacuucgagauaacaauuaucaacgaucagcugucggagaucgaagaguuuuucuacauuaauuuaacuucugucgaaauaaggggacugcagaaauuugacgugaacuggaguccacgguugaaucucgauuucagcguugcugugaucaccauucuggacaacgaugaccuugccggcauggauaucucauuccccgagacaacugucgcuguggcaguugacaccacacugauuccuguggaaaccgaguccacuacguaucuaucuaccagcaagacaacuaccauccuccaacccacaaacguaguggccauagucaccgaggcgacuggcguguccgccaucccagaaaaacugguuacauugcacgggacgccggcugucagugagaagccugauguggcaaccgugacugccaauguaucaauucacggaacauuuagccugggucccucuaucgucuacauugaagaggaaaugaaaaacggcaccuucaauaccgcugaggugcuuauccgcagaacugggggauuuacaggcaacguuuccauaacggugaagaccuucggugagcgaugcgcccagauggaaccaaaugcacuccccuuuagggggauuuacggcaucaguaaccugacaugggccgucgaggaagaggacuucgaggaacagacuuuaacccugaucuuuuuggauggagagcgggaacguaaggugagcguucaaauucucgacgaugacgagccugaaggccaggaguucuuuuauguguuccugacaaauccacaagggggagcucagaucguagaggaaaaagacgauacugguuuugcggccuucgcaauggucauaauuaccggcucagaccuucauaacgggaucauuggauuuucugaggaaucccaaucgggccuggagcuacgcgaaggugcugugaugagaaggcuccaccugaucgugacgcggcagcccaauagagccuucgaggauguuaaggucuucuggcgcgugacauugaacaaaaccguagugguccugcagaaggacgggguuaaucuuguggaggaauuacagagcgugaguggcacuaccacauguacuaugggacaaaccaaaugcuuuauauccaucgagcugaagccugaaaaggucccacagguggagguuuacuucuuuguggaacucuaugaggcaacagccggcgcugcgauuaacaauucugcccgauucgcacagaucaaaauucuggagucagaugaaagccagucccuaguauacuuuucugucgggagcagguuggcuguggcccauaagaaagccacgcugaucagucuccaaguugcucgggacucaggaaccggucuuaugauguccgugaacuucagcacucaggagcugagaucugcagaaacaauuggccguaccauaaucaguccggccauuuccgggaaggauuuugucaucacugagggaacacucguguucgagcccggccagcgcagcaccguacuggacgugaucuuaacgccugaaaccgguucacuaaauucguuuccaaaaagguuccaaauuguccuguuugaucccaaagggggagcucggauagacaagguuuauggaacagcgaacaucacucuugugucugaugccgacagccaggcaauuuggggccuggccgaccagcuccaccagccugugaacgaugacauccugaauagaguccuacauaccauuuccaugaaaguugcuacagagaacacugaugaacaacuuagugcaaugaugcaccugaucgagaagauaaccacagaagggaaaauccaggccuucucaguggcuucucgaacgcucuuuuacgagauuuuguguagccugaucaauccaaagaggaaagacacccgcggauucucccacuucgccgagguaacugaaaacuuugcauucaguuuacugacaaaugugaccugcgguagccccggcgagaagucuaagacuauucucgauuccuguccuuaucuuucaauccuggcguugcauugguacccgcagcagauaaacgggcacaaauuugaaggaaaggagggcgacuacauucggauccccgaaagacugcucgauguccaagacgccgagauuauggcugguaaaaguaccugcaagcuagugcaguucacagaguauucgucccagcagugguuuaucucuggcaauaaccugccaacgcuuaaaaauaagguucugagucucucagugaaagggcaaagcucccaguugcugaccaacgauaaugaagucuuauacaggauauaugccgcagagccucgcaucauuccccagacuucucugugucuccuuuggaaccaagcugccgcgagcuggcugagugacucacaguucugcaaggugguagaagagacagccgauuacguugaaugugcuugcucccauaugagcguguaugcagucuacgcccguaccgacaauuugucuuccuauaacgaggcauuuuucacaaguggauuuaucugcauuagcggccugugucucgcagugcuaucacacaucuucugcgcccgguacucuauguuugccgcuaagcuguuaacacacaugauggcagccucccuggggacccagauacucuuccuugcgagcgcuuacgccucgccacaguuggcagaggaaaguuguucugccauggcugccgucacucauuaucuguaccugugccaauuuucauggaugcucauucaguccgugaauuucugguauguucuugugaugaacgaugagcacacagaaagacgauaccuguuguucuuucugcucagcuggggacuaccugcauucguagugauccuguuaaucgucauucuuaaaggcaucuaucaucagucuaugagccagauuuacggucugauacacggggaccucuguuuuauccccaacguguaugcugccuuguucaccgcggcacugguuccacugacgugccucgucgugguguuuguugucuucauucaugccuaccaagugaagccgcaguggaaggcuuaugacgauguauuuaggggacgcaccaaugccgcugagaucccucuuauccuguauuuguucgcacuaauuuccgugacauggcuguggggcggucuccacauggccuaccggcacuuuuggauguuaguccuguucgugauauuuaacagucuucagggccuguauguuuucaugguguacuuuauccuccauaaucagauguguugccccaugaaggcgucauauacugucgagaugaacgggcacccaggacccagcaccgccuucuucacaccuggcuccgggaugccacccgcuggaggcgaaauuucuaaaaguacucaaaauuugaucggugcaauggaggaaguaccuccggacugggagagagccucauuucagcaggggagccaggcuucccccgaucugaagccaucuccucaaaacggagccaccuuccccucgagcggcgguuacggccaggggucccugauugcagacgaagagagucaggaguuugaugaccucaucuucgcccuaaagacgggagcuggccugucagugucugauaaugaaagcgggcaaggaucccaggagggcgguacacuuaccgacagucagauaguugaauugaggcgcaucccaauugcggauacucaucuguga

SEQ ID NO: 52503 - RNA, 1128 nt, Artificial Sequence
  derived and/or modified sequence opt3 from ADH1A__Homo_sapiens__NP_000658
augagcaccgccggcaaggugaucaaaugcaaggcugcaguccugugggagcucaaaaagcccuucuccauugaagagguugaaguggccccuccaaaagcgcacgagguaagaauaaagaugguggcugucgggaucuguggaacagacgaucaugugguuucugguacuauggugacgccgcuucccgucauucugggccacgaagccgcagggaucguggagucaguaggagagggcguuaccacagugaagccuggugacaaagucauuccauuggccaucccccagugcgggaaguguaggauaugcaaaaacccugaaaguaauuacuguuuaaagaacgaugugagcaauccacaaggaacucugcaggacggcaccucccgguuuacaugccgccgaaaacccauccaucacuuccuaggcauuucuaccuuuucgcaguauacuguggucgaugagaacgcuguugcaaagaucgacgccgcuucaccucucgaaaaggugugucugauugggugcggauucagcacagguuacggcagugccguaaauguggcgaaagucaccccaggguccacgugugcaguguuuggacuuggcgguguugggcugucugccaucaugggaugcaaggcugccggcgcagcucguauaauugccguggauaucaacaaagacaaguucgcgaaagccaaggaguugggcgcaacugaguguauuaauccgcaggauuauaaaaagcccauccaagaaguccucaaggagaugaccgacgggggaguggauuuuagcuucgaaguaaucgguagacuggacacaaugauggcuucccugcucugcugccaugaggccuguggcacuucaguuauugugggggucccuccagauagucagaacuuaagcaugaaucccaugcugcuuuugaccggaaggacauggaaaggcgcuauacuggguggguuuaagucuaaagaaugcgugccuaagcuagucgccgacuucauggccaaaaaguuuucccucgacgcacugaucacccacgugcuuccauucgagaagauuaacgagggcuuugaucuguugcacucaggaaaaagcauccggacgauacucauguucuga

SEQ ID NO: 52504 - RNA, 1128 nt, Artificial Sequence
  derived and/or modified sequence opt3 from ADH1B__Homo_sapiens__NP_000659
augagcaccgccggcaaggugaucaaaugcaaggcugcaguccugugggagguuaaaaagcccuucuccauugaagacguggagguagccccuccaaaagcguacgaagugagaauaaagauggucgcuguggggaucugucacacagaugaccauguugugucuggaaaccucgucacuccgcuucccgugauucugggucacgaggccgcaggcaucguagaaucaguuggggagggagugacgaccgucaagccuggcgauaaagugauuccauuguuuacaccccagugcgguaaguguagggugugcaaaaauccugagaguaacuauuguuuaaagaaugaccuggggaacccacggggaacucuacaagauggcacccgccgauucacaugccguggcaaacccauccaucacuuucucgggaccagcacuuucucccaguacacagucguugacgaaaaugccguggcuaagauagaugcagccucuccucuggagaagguaugucuuaucggaugcgguuuuucgaccggcuaugggucagcugugaacgucgccaaagugacgccaggaagcacuugugcgguuuucggccuggguggggugggauugagugcagucaugggcugcaaggccgcuggcgccgcaagaauuaucgcuguggacauuaauaaagauaaguuugccaaagcgaaggaacucggggccaccgaguguaucaacccgcaggacuacaaaaagcccauacaggagguacugaaggaaaugacagauggagguguugacuucuccuuugaggugauuggcaggcuggauacuaugauggcaucucucuuaugcugccaugaagcaugugggaccagcgucaucgugggagucccuccagccucccaaaaucugucaauuaaccccaugcuuuugcugacaggccggaccuggaaaggugcuguguaugggggcuucaagaguaaagagggaaucccuaagcuaguugccgacuuuauggcuaaaaaguucagccucgacgcccugaucacgcacgugcuuccauuugaaaagauuaaugagggcuucgaucuguugcacucugggaaauccauacgcacuguacucacauucuga

SEQ ID NO: 52505 - RNA, 1143 nt, Artificial Sequence
  derived and/or modified sequence opt3 from ADH4__Homo_sapiens__NP_000661
augggcaccaaggggaaagugaucaagugcaaagccgcuauugcaugggaggccggaaagccccuguguauagaagaggucgaaguugcgccuccaaaagcucacgaggugagaauccagauuaucgccacaagccucugccauacugacgcaacgguaauugauuccaaguucgaaggucuugccuuuccggugaucgucggccacgaggcugcagggauaguggagucuaucggacccggcguuaccaacgugaagccuggugacaaagucauuccacuguacgcccccuuguguaggaagugcaaauucuguuuaucaccucugacaaaucuaugcgggaagaucaguaaccucaaaagcccagcuuccgaucaacagcugauggaagacaagacuucucgguuuaccuguaagggaaaacccguguaucauuucuuuggcacaucgaccuucucacaguacacuguaguuagcgauauuaaucuugccaagaucgacgaugacgcgaaccuggagcgcgugugcuugcucggcuguggguuuaguacaggauauggugcagccauaaauaacgcuaaagucaccccuggcuccacgugcgccguguucgggcugggaggcgugggucugucugcagucaugggguguaaggcugccggagcgagccgaauuaucggcauugauaucaauuccgaaaaauuuguuaaggccaaagcacucggcgcuacugacugcuuaaacccacgugaucugcacaagccgauccaggaggugauuauagagcuuaccaaagggggaguagacuucgccuuggauugcgcugguggcucagaaacaaugaaggccgcacuggacuguacuaccgccggguggggaaguugcacauuuaucggcguggcugcggguagcaaggggcuaaccauuuuccccgaggaacucaucauaggcagaacgauuaauggaacauuuuucggcggguggaaaucugucgacuccaucccuaagcuggugacugauuacaaaaacaagaaguucaaucuugacgcacugguuacccauacuuugccauuugauaaaaucucagaggccuucgaccucaugaaccaaggaaagagcgugaggacaauucugaucuuuuga

SEQ ID NO: 52506 - RNA, 1125 nt, Artificial Sequence
  derived and/or modified sequence opt3 from ADH5__Homo_sapiens__NP_000662
auggccaacgaggugaucaagugcaaagcugcagucgccugggaagcgggcaagccccugagcauugaggaaauagagguugcuccuccaaaagcccacgaagugagaaucaagauuaucgcaaccgccguaugucauacagacgcuuacacucucuccggggcagauccggagggaugcuuccccgugauucuuggucacgagggcgccgggaucgucgaaucugugggagagggcguuacgaaacugaaggcuggugacaccgugauaccuuuguauaucccacaguguggggaaugcaaguuuuguuuaaaucccaaaacaaaccugugccaaaagauuagggucacucagggaaaaggccuaaugccugauggcaccucacgguucacauguaaggggaaaaccauccuccauuacaugggaacaaguacuuuuagcgaguauaccgugguagccgacauuuccguugcgaagaucgauccacuggcaccccuugacaaggugugccuguuggguuguggcauaucuacgggguacggagccgcugucaauacugccaaacucgagccuggcucggugugcgcaguguucggucuugggggagucggccuggcuguuauuaugggcuguaagguggccggggcgucacgcaucauuggaguagauaucaacaaagacaaguuugcccgagcaaaagaguucggugcuaccgaaugcaucaauccacaggauuuuagcaagccgauucaggaagugcucauagagaugacagacggcggggucgauuauaguuucgaaugcaucggaaacgugaaaguuaugcgugccgcuuuagaggccugucacaagggcugggguguguccgucgugguagggguugcagccucuggcgaggaaauugcuacuagacccuuucaacuggugaccggaaggacauggaagggcaccgcguucgggggauggaaaagcgucgaguccgugccuaagcuggucucagaauacaugaguaaaaagaucaaaguggacgaguuuguuacgcauaauuugagcuucgaugaaauaaacaaggcauuugagcugaugcacucugguaaguccauucggacugugguaaaaaucuga

SEQ ID NO: 52507 - RNA, 1107 nt, Artificial Sequence
  derived and/or modified sequence opt3 from ADH6__Homo_sapiens__NP_000663
augagcaccacaggccaggugaucagaugcaaggccgcuauucuguggaaacccggggcaccuuucuccauagaggaagucgagguugccccaccgaaggcgaaagaagugaggaucaagguaguggcuacuggacucugugguacggagaugaaaguccuuggcucuaagcaccuggacuuguuauaccccaccauucuggggcaugaaggagccggcaucguggagucaauuggugaggggguuaguacagugaagccuggagauaaagucaucacucuauuucucccacaaugcggcgaauguaccagcugccugaacuccgagggcaauuucuguauacaguuuaagcagucuaaaacacagcuuaugucggacgggaccucacgguucacuugcaagggaaaaagcaucuaucacuuugguaacacaaguaccuucugugaauacacggugauuaaggagaucuccguagcaaagauugaugccguugcuccccuggagaaagugugcuugaucucuuguggcuuuagcacuggguucggagcagccauaaauaccgcuaaggucacaccuggcuccacuugcgccguguuuggucucgggggagugggccugucagucguuaugggcuguaaagcggcaggggccgcucgcauuaucggaguggacguaaacaaggaaaaauucaagaaagcccaagagcugggugcaaccgaaugccucaauccacaggauuuaaagaagcccauucaggaggugcuguuugacaugacagaugcuggcaucgacuucugcuuugaagccaucgggaaccuugaugucuuggcggccgcacuggcuaguuguaaugagagcuauggagugugcguuguggucggcgugcuaccugccucuguacagcucaaaauuuccggucaacuguucuucucagggcgaagccuuaagggcaguguuuuuggaggcuggaaaucucgucagcauauaccaaagcugguggcugacuacauggccgagaaauugaaccucgauccgcugaucacccacacguuaaaucuggacaagauuaacgaagcagucgagcucaugaagacugggaaaugguga

SEQ ID NO: 52508 - RNA, 1161 nt, Artificial Sequence
  derived and/or modified sequence opt3 from ADH7__Homo_sapiens__NP_000664
auguucgccgagauccagauucaagacaaggauagaaugggcaccgcugggaaagugauaaagugcaaagcagccguccugugggaacagaagcagcccuuuagcaucgaggaaauugagguugcgccuccaaaaacaaaggaagugaggaucaagauucucgcuacuggaaucugucggacggacgaucacguaauaaaagguaccaugguguccaaguucccggucaucgugggccaugaggccacagggauuguugagucuaucggagaaggcgugacuaccgucaaacccggugacaaggugauuccucuuuuucugccacagugccgcgaguguaacgcaugccgaaaucccgaugggaacuuguguauccguucagacauaacaggaagaggcguauuagccgauggcaccacuagguucacaugcaaagggaagccuguucaccauuuuaugaauaccaguacguucacugaauacaccguggucgacgagagcuccguggcuaagauugaugacgcagccccacccgagaaagugugucugaucggaugcgguuuuucuacaggcuauggggcugccgucaagacuggaaaaguuaagccuggcucgaccugugugguauucggucuagggggagugggccucucagucauuaugggcugcaaaagcgcgggggcaagucggaucaucggaauugaucugaacaaggacaaauuugaaaaggccauggcugugggugccacagaguguauauccccaaaggauucuaccaaaccgaucagcgaaguucuuuccgagaugacgggcaauaacgugggguacacuuucgaagucauuggacaccuggagacaaugaucgacgcauuggcuucaugccauaugaauuauggcaccagugugguaguuggugugcccccuagcgccaagaugcucacuuacgacccaaugcugcuguuuacagggcgcaccuggaaaggcugcgucuucggaggccucaagucuagagaugacgugcccaaauuagucacggaguuucuggcgaagaaguucgaucuugaccaauugauaacccacgugcugccuuucaaaaagauuuccgaaggguuugagcuacucaacucaggacagagcaucaggacaguucugacuuucuga

SEQ ID NO: 52509 - RNA, 1404 nt, Artificial Sequence
  derived and/or modified sequence opt3 from ADHFE1__Homo_sapiens__NP_653251
auggccgcugcagccagagcgaggguggcuuaccugcuccggcagcuucaacgcgccgcaugccagugucccacccacagccauacauauucccaggccccuggccugucuccaucagggaagacuacggacuacgcuuucgagauggcagucaguaacauccgauauggagccgcuguuaccaaagaaguggguauggauuugaagaauaugggcgccaaaaacguaugcuuaaugacagacaagaaucugagcaaacuaccgcccgugcaggucgcgauggauucccucgugaagaacgggauuccuuuuacuguuuacgacaaugugcgugucgagccaaccgauucuucguucauggaagcaauagaguuugcccaaaagggagcuuucgacgccuauguggcaguaggcggugggucaacaauggauaccuguaaagcugccaaccuguacgcgagcaguccccacuccgacuuucuugauuauguuucugccccuaucggaaagggcaaaccagugagcgucccccugaagccuuugauugcagugccaacuacauccggcaccgggucagaaacgacuggaguggcuaucuucgacuacgagcaucucaaagucaagauugguaucaccaguagagccauaaagccgacacugggccugaucgauccccuccacacuuuacauaugccugcuaggguuguggccaauagcggguuugacguacugugccacgcacuugagucuuacaccacauugccauaucaucugcggucccccuguccuucaaacccaauuacccgccccgccuaccagggaagcaauccgaucagugauauuugggcuauccacgcgcuaagaauaguggcaaaauaucucaagagggccguccggaacccugacgaccuggaagcucgcucucacaugcaucuugccuccgcauucgccggcauugguuuugggaaugcuggagugcaccugugccacggcaugagcuaccccaucucgggcuugguuaaaauguauaaggccaaagauuacaacguggaccauccacucgucccucacgggcugucugugguauuaacgucccccgcaguuuucacuuuuacagcgcagauguucccagagcgacaucuggaaauggcugagauucucggagccgauaccagaacugcaaggauccaggacgccggucuugugcuggcugauacauugcggaaguuucuauucgaccuggaugucgacgauggccucgccgcagugggguauucaaaagcugacauccccgcccuggucaagggaacccuuccucaagagcgugugacgaagcuggcgccauguccgcagagugaagaggauuuggccgcucucuucgaagcaagcaugaaacuguacuga

SEQ ID NO: 52510 - RNA, 540 nt, Artificial Sequence
  derived and/or modified sequence opt3 from ADI1__Homo_sapiens__NP_060739
auggugcaggccugguacauggacgaugcucccggcgacccuagacaaccacacaggccggaucccgggcggccugucggacuggagcagcuccgccgacuugguguucuguauuggaaguuggacgcagauaaauacgaaaacgacccagaguuagaaaagauccguagagagaggaauuauagcuggauggauauuauaaccaucugcaaagacaagcugcccaacuacgaagagaaaauuaagauguucuaugaggaacaucuacaccucgaugacgagauccgguacauucuggauggcuccggguauuuugacgugcgcgauaaggaagaccaguggaucagaauauucauggagaaaggagacaugguaacacuuccugccggcaucuaccauagguuuacuguggaugagaagaauuacacgaaagcgaugcggcuguucgucggugaaccaguguggaccgcuuauaaccgccccgccgaccacuuugaggcacgagggcaguacguuaaguucuuggcccaaacagcuuga

SEQ ID NO: 52511 - RNA, 243 nt, Artificial Sequence
  derived and/or modified sequence opt3 from ADIG__Homo_sapiens__NP_001018092
augaaguacccccugaugccucucgugaacgaccuuaccuucagcuuucuggucuucugguuuugcuugccaguuggcuuacugcuacuccugaucauuuggcuuagauuccuguugucccaggauucugaggaaaaugacucaagugugugucucgauugggagccguggagcaaagggcccgccgaauuuugcuggaagggaacacugcacggucaagagaaagaaaggccuuguugguga

SEQ ID NO: 52512 - RNA, 735 nt, Artificial Sequence
  derived and/or modified sequence opt3 from ADIPOQ__Homo_sapiens__NP_001171271
augcugcuccuuggcgccgugcuguuguuacuggcucuacccgggcacgaccaggagaccacaacucaaggaccugguguccuccugccacuuccgaagggcgcaugcacgggguggauggccggaauccccggccauccuggucacaacggggcgccaggaagagauggcagggacggcacccccggggaaaaaggagagaagggugauccuggccugauugggccaaaaggagacauaggcgaaacagguguucccggggcugagggaccucggggcuucccaggcauccaggggcgcaagggagaaccgggugagggcgccuacguguaucgaagcgcauuuuccguaggguuggagacuuacgugaccauucccaauaugccuauccguuucacaaaaaucuuuuauaaccagcagaaucauuacgauggaucuaccggcaaguuccacuguaacauuccaggucucuauuacuuugccuaucauauaacugucuacaugaaggacgugaaaguuucacuguucaagaaagauaaggcuaugcuguuuacauacgaccaauaucaggaaaauaacguggaucaggcaagugggagcguccucuuacaccuggaggugggcgaccagguauggcuucaaguuuacggagaaggcgagagaaauggguuguaugccgauaacgacaaugauuccaccuucacgggauuucugcuauaccacgacacuaacuga

SEQ ID NO: 52513 - RNA, 1128 nt, Artificial Sequence
  derived and/or modified sequence opt3 from ADIPOR1__Homo_sapiens__NP_001277558
augagcucccacaagggcucuguggucgcccaggggaacggagcucccgcaucaaauagagaggccgacaccguugaacuggcggagcucgguccucuucuggaagagaaaggcaagagggugaucgcuaacccaccgaaagccgaagaggagcaaacaugccccguaccucaggaagaggaagaggaggugcgggucuugacuuuaccacugcaggcacaucacgccauggaaaagauggaggaguucguguacaaaguuugggaagggcgcuggcgagugauucccuaugauguccuaccugacuggcucaaggauaaugacuaccugcuucauggacaccguccacccaugccuaguuuuagagcuuguuucaagagcauauuuaggauccauacggaaaccggcaacauuuggacacaccuguuggguuucgugcucuuucuguuccuggggauccucacuauguuacggccaaauauguauuuuauggcaccgcugcaggagaaaguaguuuucggaauguuuuuccuuggcgccguguugugccuguccuuuucuuggcuauuccacaccgucuacugucauucggagaaggugucacgcacauuuagcaaacucgauuauaguggcauugcucugcuuaucaugggguccuucgugcccuggcuguacuauucuuucuacugcagcccucaaccaagauugauauaccucuccaucgucuguguucugggaauuucagccaucauuguggcgcagugggacagguuugcaacccccaagcaccggcagacucgcgccgguguauucuuaggccuggggcucaguggaguggucccuacaaugcauuuuaccaucgcugaaggcuucgugaaagccacgacuguuggucagauggggugguuuuuccuuauggcagugauguauauaaccggagcuggccuguacgccgcgcgaaucccagagagauuuuuccccggcaaguuugauauuugguuccaaagccaccagauuuuucacgucuuggugguagccgcagcuuucguucauuuuuauggggugucuaaccuacaggaguucagguacggacuggaagguggcugcacagacgauacucuccuguga

SEQ ID NO: 52514 - RNA, 1161 nt, Artificial Sequence
  derived and/or modified sequence opt3 from ADIPOR2__Homo_sapiens__XP_006719081
augaacgagcccaccgaaaauagacugggcugcagcaggacaccugagccagacauccggcuccgcaaggggcaccagcuugauggaacucgacguggugacaacgauucccaucaaggcgaccuggaaccgauuuuggaggccucuguguuaucaagucaccauaaaaagagcuccgaagaacacgaguacucugaugaagcuccccaggaggacgaaggguucaugggaaugucgccucugcuacaggcacaucacgccauggagaaaauggaggaauuugucuguaagguuugggagggcagauggagggugauaccacacgauguacuccccgacuggcugaaagauaaugacuuccuucugcauggucaccggccuccaaugcccucauuucgcgcgugcuucaagagcaucuuuaggauucauacggaaaccgggaacaucuggacacacuugcucggauguguguucuuucugugccugggcauuuucuauauguuuagaccuaauaucaguuucgucgcuccacuccaggagaaggugguuuuuggcuuauucuuucugggggccauacuuuguuuguccuucucuuggcuguuccacacuguguacugccauagcgaaggagucucccggcuauuuucaaaacucgauuauagugguaucgcacugcuuauuaugggcagcuucgugccguggcuguacuauucuuuuuacuguaacccccaaccuugcuucaucuauuugauuguaaucuguguucucgggauagccgcuauuaucgugucccagugggacauguuugcaaccccacaguaccgcggaguccgagccggcguguuccuggguuuagggcugucaggaauuauccccacacuccacuacgugaucagcgagggcuuucuuaaggcugccaccauuggccagauaggguggcugauguugauggcgagucuauauaucacuggagcagcccuguacgcugccaggauuccugagagauucuuuccagguaaaugcgauaucugguuccauucucaccaacucuuucauauauucgucguugcaggcgcuuuugugcacuuccacgggguauccaaucugcaggaguuccgguuuaugauuggaggcgguuguagcgaggaagacgcccuuuga

SEQ ID NO: 52515 - RNA, 231 nt, Artificial Sequence
  derived and/or modified sequence opt3 from ADIRF__Homo_sapiens__NP_006820
auggccagcaagggccugcaggaccucaaacaacagguggaggggaccgcucaggaagcagucuccgccgcgggagcugccgcacagcaaguuguggaucaggccacagaggcuggucagaaggcaauggaccagcuugccaaaacuacgcaagaaaccaucgauaagacagcuaaccaggccucugacacuuucucaggcauugggaaaaaguuuggacuguugaaguga

SEQ ID NO: 52516 - RNA, 1038 nt, Artificial Sequence
  derived and/or modified sequence opt3 from ADK__Homo_sapiens__NP_001114
augaccagcgugagagagaacauccuguucggcauggggaauccccuccuugacauuuccgccgucguugauaaggacuuucuggauaaauacucuuugaagccuaacgaccagauauuagcugaagauaaacacaaggagcuguucgacgaauuggugaaaaaguuuaagguagaguaucaugcaggagguucaacacaaaauaguaucaaaguggcccaguggaugauucagcagccacacaaggcggcuacuuucuuuggcugcaucgggauugauaaauucggagaaauccucaagaggaaagccgcagaggcccaugucgacgcucacuacuaugagcaaaacgaacagccgacgggcaccugugcagccugcauaacaggugauaaucggagccugaucgcuaaccuugccgcggcaaauuguuacaagaaggagaaacaucuggacuuggaaaagaacuggaugcucguggagaaagcccgcguuugcuauauugcuggguuuuuccugacugugucccccgagucuguccugaagguggcccaccacgcaucggaaaauaaccgaaucuuuacccucaauuuaucagcuccuuucauuagccaguuuuacaaagagagucugaugaagguaaugccauauguugauauccuuuucggaaacgaaacagaggccgcgaccuuugcccgugaacagggcuucgagacuaaagacauaaaggagauugcaaagaaaacacaagcucuacccaagaugaacuccaaaagacagaggaucgugauuuucacccagggccgggaugacacgaucauggccacugaaucugaggucaccgcuuuugccgugcuggaccaggaucaaaaggaaaucauugacacaaauggggcaggagaugccuucguggguggcuuucuaagccagcucgucuccgacaaaccucugacugaguguauacgcgcugggcauuacgcggcaucaaucauuaucagaaggaccggaugcacauucccagaaaagcccgauuuucacuga

SEQ ID NO: 52517 - RNA, 447 nt, Artificial Sequence
  derived and/or modified sequence opt3 from ADM2__Homo_sapiens__NP_001240774
auggccagaauccccaccgcugcacugggcugcauuagccuccuuugucugcaguugccuggguccuuaucuaggucacugggaggugacccacggccggugaagccccgcgagccuccagcccgaagucccagcuccucucuacaaccucgucacccagcgcccagaccugucguuuggaaacuccauagggcucugcaggcccagcggggcgcagggcuugccccagugaugggacagccgcugcgcgauggcgguagacaacacucggggcccaggcggcauucaggaccucgccgaacacaggcucaguugcucagaguaggcugcgugcugggcacuugucagguccaaaaccugagccacaggcucuggcaguuaauggggccagcaggacggcaggacagugcccccguggauccuuccucuccacauagcuacgguuga

SEQ ID NO: 52518 - RNA, 558 nt, Artificial Sequence
  derived and/or modified sequence opt3 from ADM__Homo_sapiens__NP_001115
augaagcuggugagcgucgcccucauguaccuuggcucccuggcuuucuugggggcagacaccgccagauuagauguugcgucugaguuuaggaaaaaguggaacaaaugggcucugucacggggaaagcgcgaacuacgaaugaguagcuccuaucccacaggucucgccgacgugaaagcaggcccugcccagacucugauccguccacaagauaugaagggggcuucuagaucgccggaggacucaagccccgaugcagccaggauucggguaaagcgcuacagacagaguaugaauaacuuccagggacuuagguccuuuggcugccgguucgguacguguaccgugcagaaacuggcucaccaaauauaucaguuuacagacaaggauaaagacaaugucgccccucgcucuaagaucagcccacagggguacggacgaagaaggcggcguuccuugcccgaagcgggcccuggccgcacucucgugucaaguaaaccacaggcacauggggcccccgcuccuccaagcggaucugccccgcacuuccuguga

SEQ ID NO: 52519 - RNA, 3309 nt, Artificial Sequence
  derived and/or modified sequence opt3 from ADNP__Homo_sapiens__XP_011527049
auguuccagcugcccgugaacaaucucggcagccuuagaaaggccaggaaaaccgucaagaaaauccuguccgacauuggguuggaguacugcaaggaacacauagaggauuuuaaacaauucgaaccuaacgacuuuuauuuaaagaauacaacuugggaggauguuggacugugggacccaucucuaacgaagaaccaggauuaccggaccaaaccguucuguugcucagcuugucccuuuaguagcaaguucuuuuccgcauauaaaucucauuuccgcaaugugcacucggaagacuuugagaaccgaauccuccugaauugcccuuacuguacauucaacgccgauaagaaaacucuugagacccauauuaagaucuuucacgcgccaaaugcuucagcccccagcaguucccugucuacauucaaggacaaaaacaagaaugaugguuugaaaccuaagcaggcagacagcguagaacaggccguguauuacugcaaaaaguguaccuaucgugauccacucuacgagauugucagaaaacauaucuacagggaacacuuucaacacguggcugcacccuauauagccaaggcuggcgagaagucccugaacggggccguuccucugggaucaaaugcgcgggaggaaaguagcauccauugcaaacgcugucucuucaugccaaagucuuacgaggcauuagugcagcacgucauugaagaccaugagagaaucggcuaucaggugacugccaugauuggucacacaaacguaguugugccgagguccaaaccccugaugcuuaucgcuccuaagccacaggauaaaaagucaaugggguugcccccucggauaggaagccuggccaguggcaauguccgcucucuaccaucccaacagauggugaaccgacucagcauucccaagccgaaccugaacucgaccggcgugaacaugaugucuuccguccaccuucagcagaauaacuacgggguuaaaucagugggacaagguuauaguguaggccagagcaugagacugggguugggaggcaaugcaccuguguccaucccccagcaaucucagagcgucaagcagcuccugccaucagguaacgggaggaguuacggauuaggcuccgaacagcggagccaagcuccugcccguuauucucugcagucagcgaaugccaguagccucuccucuggccagcuuaaaucgcccagccugucccagucacaagcaagucgcguguuggggcagucuagcuccaagccagcugccgcugccacgggacccccuccagguaacacuucaagcacccagaaauggaagauuugcacaaucuguaaugagcuauucccggagaacguuuacucugugcauuuugaaaaggagcacaaagcagaaaagguccccgccguggcuaauuacaucaugaaaauucauaacuucacuuccaagugccuguauugcaauagauaccucccuaccgacacacugcuuaaccacaugcugauacauggcuugaguuguccauauugcaggagcaccuuuaaugacguagagaaaauggcggcacacaugcggaugguucacaucgaugaagagauggggcccaagacggacucuacucucuccuucgaucugacauuacagcaaggaucacauaccaacauucaucugcuagugacuacauacaaccuccgagacgccccugcugagagugucgccuaucacgcacagaauaacccacccgugccgccuaagccacagcccaaaguccaggaaaaggccgauaucccugugaaaagcucgccccaagcugccguuccauacaagaaagacgugggcaagacccuguguccucuuugcuuuuccauauugaaaggucccauuucugaugcacuggcgcaccaccuccgcgagagacaucagguaauccagacgguccacccaguggaaaagaagcugaccuauaaauguauccauugccuugggguuuacacaagcaauaugacugcuucaaccauuacacugcacuuggugcauuguaggggcgucggaaagacucaaaacggccaggacaaaaccaaugccccgagucggcucaaccaguccccuucucuggcacccgugaagcgcacauacgagcagauggaguucccauuacugaaaaagagaaagcuagaugacgauagcgacucccccucauuuuucgaggagaaaccugaagaaccaguagugcucgcccuggaccccaaggggcacgaagaugacagcuaugaggcuaggaaaaguuuucuuaccaaguacuucaauaaacaaccuuauccgacucgucgggagaucgaaaaguuggccgcaucucuguggcucuggaaguccgauauugcuagccacuuuucgaacaaacgaaagaaaugcguuagagacugugagaaguacaaaccaggaguccuguuagguuucaauaugaaggaacugaacaaggugaaacaugagauggauuuugacgccgaauggcuuuucgagaaucacgaugagaaggacucaagggugaacgcgucuaaaacggccgauaagaaauugaaucucggcaaggaagacgauaguuccagcgacucuuucgagaaccuggaagaggaaagcaaugaguccgggucacccuuugauccugucuucgagguugaaccaaaaauaaguaacgacaaccccgaggaacaugugcuaaaggugaucccugaggacgcuagcgaaucugaggagaagcuggaucagaaagaagacggauccaaguaugagacaauucaccucaccgaggaaccgacuaaacugaugcauaaugcaucagauagugagguagaccaggaugacgucguggaauggaaggauggcgccagccccuccgagucugguccagggucgcagcaaguuagcgacuuugaagauaauaccugcgagaugaaaccuggcacauggucagacgaauccagucagucugaggaugcucgcagcuccaagcccgccgcaaagaaaaaggcgaccaugcagggagaccgggagcagcuuaaauggaaaaauucaucuuacggcaagguggaaggguucuggagcaaggaucaaagucaguggaagaacgccuccgagaaugacgaaagauugagcaacccacagaucgaguggcaaaauucuacuaucgacucagaagauggagagcaguuugacaacaugacagauggugucgcugagccuaugcacggcucccuggccggggugaaauuaaguagccagcaggcauga

SEQ ID NO: 52520 - RNA, 813 nt, Artificial Sequence
  derived and/or modified sequence opt3 from ADO__Homo_sapiens__NP_116193
augcccagagacaacauggccagccugauccagaggauugcucggcaagcaugccucaccuuccgcggcuccgggggaggucgaggcgccucugaucgugacgcggcuucagggccugaggccccaaugcagccgggauuucccgaaaaucuuaguaagcugaaauccuuguuaacacagcugagagcagaggaucuaaacauagccccuaggaaggcuacucuccagccacugcccccuaaucuuccacccgugacguacaugcacaucuaugaaaccgacggcuucagccugggugucuuuuugcucaaaucugggacaucgauuccucugcaugaucacccaggaaugcauggcaugcugaagguucucuacggcacugugcggaucucauguauggacaaauuagaugcagggggaggucaacgcccgagagcccugcccccugagcagcaguucgaaccaccccuucagccuagggagcgggaggcuguacgcccaggcguguugcgaagcagagccgaauauaccgaggcgagugggcccugcauucugacaccgcacagggacaaccuacaucaaaucgaugcagucgaaggaccugccgcuuuucucgacauacuggcacccccauacgauccugacgauggccgggacugucacuauuaccgugugcuugagcccguucgcccaaaggaggccuccucuagcgcuugcgaccugcccagagaagugugguugcucgagaccccucaggccgaugacuucuggugugaaggugagccauauccggggcccaaggucuuuccuuga

SEQ ID NO: 52521 - RNA, 981 nt, Artificial Sequence
  derived and/or modified sequence opt3 from ADORA1__Homo_sapiens__NP_000665
augcccccuagcaucuccgccuuccaggcugcauacauuggcauagaggugcugaucgcccucgucucuguuccagggaacgugcuuguaauuugggcggugaaggucaaucaagcucugagagacgccaccuuuugcuucaucgugucauuggcaguugccgauguggcugucggagcauuagugauuccgcuggccauccuaauaaacaucgguccccagacauauuuucacacuugucucaugguagcuugcccuguucugauucuuacgcagaguagcauccuggccuugcucgcgauugcaguggacagguaccugcgggucaaaaucccacugcgcuauaagaugguggugacaccccgacgugccgcugucgccauagcaggcuguuggauucucuccuucguugugggguuaaccccuauguuuggauggaauaaccugucugcuguagaaagagccugggcggccaauggcucgaugggugagccagugaucaaaugcgaguucgaaaaggucauuucaauggaauacaugguguauuuuaacuucuuuguuugggugcuucccccuuugcugcuaaugguccucaucuaccuggagguguucuaucuuaucaggaaacagcugaauaagaagguaagcgcaaguuccggggauccacaaaaauacuacggaaaggaguugaaaauugcuaagucucucgcccugauauuauuucuguucgcucucagcuggcuuccgcugcauaucuugaacuguauuacucuauuuugccccuccugucacaaaccuucaauccugaccuauauagccauuuuccucacacauggcaauagugcaaugaacccaaucguuuacgccuuccggauccagaaguuucgcgugaccuuccugaagauuuggaaugaccacuuuagaugccagcccgcuccuccaaucgaugaagaccuucccgaggaaaggccggaugacuga

SEQ ID NO: 52522 - RNA, 1239 nt, Artificial Sequence
  derived and/or modified sequence opt3 from ADORA2A__Homo_sapiens__NP_001265429
augcccaucaugggcagcuccguguacauuaccgucgagcuggccauagcuguucucgcaauccuugggaacgugcugguaugcugggccgugugguuaaauucuaacuugcagaaugucacaaacuauuucgugguuucacuggcggcugccgacauugcagugggaguccuagccaucccuuuugcuauuacuaucaguacggguuucugugcagccugccacggcugucucuuuauagcuugcuucgugcugguacuuacccaaagcuccaucuuuucucuguuggccauugcgaucgauagauacauugcaaucaggauaccacuccgguauaaugggcugguuacaggaacucgcgccaagggcauuaucgcuauuuguugggugcugucguucgccaucggucucaccccgauguuaggguggaacaauugcggacagcccaaagaaggcaagaaccauucacagggcuguggggagggacaggucgcaugccuguuugaagacguggugccuaugaauuacauggucuauuucaacuuuuucgcuuguguucuugugccauugcugcuaaugcucgguguauaccugcgaaucuuucuugccgcgcguagacaacugaaacagauggagagccagcccuugccuggcgaaagggcccggaguacacuccagaaggaggugcacgcagcuaaaucccuggccauuauagucggguuauucgcucugugcuggcucccacuucauaucauuaauuguuuuaccuucuucugccccgauugcucucacgccccucugugguugauguaucuagcaaucgugcugagccauacuaacuccguugugaauccauuuauauacgccuaccgcauuagagaguucaggcaaacauuucggaagaucauccgcucacacguccuccgacagcaggaaccguucaaggcugcgggaaccagugcaagagugcuggccgcucacggcagcgacggugagcagguaucucuuaggcugaacgggcaucccccuggaguuugggccaauggcuccgcaccacaccccgaacggcguccuaacggcuaugccuuggggcucgugucaggagguagcgcucaagagagucagggcaacacggggcugccagaugucgaguuacugucucaugaacuaaaaggagugugucccgagccgccuggccucgacgauccccuggcccaggacggugcaggggucuccuga

SEQ ID NO: 52523 - RNA, 999 nt, Artificial Sequence
  derived and/or modified sequence opt3 from ADORA2B__Homo_sapiens__NP_000667
augcugcucgagacccaggacgcccuuuacguggcucuggaauuggucaucgcagccuuaagcguugcgggcaacgugcugguaugcgcugccguggggacagcaaauacucuacaaacgcccaccaacuauuuccucgucucccuggccgcugcagauguggccguuggacuuuuugcuauuccuuucgccauaacaaucucucuggguuuuuguacugacuucuacggcugcuuguuucucgcguguuucgugcugguccugacccagucaaguauuuuuagccucuuagcaguggccguagauagauaucuggcuaucugcguuccacuuagguacaaguccuuggugacagggacccgggcccgcggagucauugcagugcugugggugcuagcuuucggcaucggucucacuccguuucugggguggaacucuaaagacucggccacaaauaauuguaccgagcccugggauggaacgacuaacgaaucaugcugucuugucaagugccuguucgagaauguugugccuaugagcuauaugguauacuuuaacuucuuuggcuguguguugccaccccuccugauaauguuagucaucuauauuaaaaucuuccugguggcgugccgacagcuccagcguaccgaacuuauggaccacaguagaacaacucugcaaagggagauucaugccgcaaaguccuuggcuaugaucguuggcauauucgcccuauguuggcugccugugcacgcugucaauugcgugacccucuuucagccagcccaggggaaaaacaagcccaagugggcaaugaauauggccauucugcuuucucaugcuaacagcguaguuaauccuaucguguacgcguaccggaaccgcgauuucagauauacauuucacaaaauuaucuccagguaccuguugugccaggcagacgucaagucaggaaauggucaagccggcgugcagccagcucucggggucggacuguga

SEQ ID NO: 52524 - RNA, 1491 nt, Artificial Sequence
  derived and/or modified sequence opt3 from ADPGK__Homo_sapiens__NP_112574
auggcccuguggagaggcagcgcuuacgcaggguuccucgcccuugcggugggaugcgucuuucuguuggagcccgaauuaccugguuccgcucugaggucucuauggucaagucucugucugggcccagccccggcacccccugggccaguuagccccgagggacggcuugccgcugcaugggacgcccugaucgugcgcccuguacgacguuggagaaggguggcugucggcgugaacgccugcguugauguggucuuguccggugugaagcuccugcaggcgcuggggcucucuccaggaaauggcaaagaccacucgauuuuacauucacggaacgaucuggaagaggcauucauacacuuuaugggcaagggggccgcugccgaacgcuucuuuagcgacaaagagaccuuccaugauaucgcacaaguagcuagugaguuucccggagcccagcacuauguugguggcaaugcggcccuuauugggcagaaguucgcagcuaacuccgacuugaaagugcugcuauguggaccugucggcccaaagcuccaugaacugcuugaugacaauguguuugugccgcccgagucucugcaggaagucgaugaguuccacuugauccucgaguaccaagccggugaagagugggggcagcugaaggcuccucacgccaacagauuuauuuucagccaugacuuauccaauggagcaaugaacaugcuggaaguuuuugugucaagucucgaggaguuccagccagaucuuguagugcugagcggcuugcacaugauggaaggccagucuaaagagcuacaaaggaagcggcugcucgaagucgugacauccaucucagacauacccacugggaucccuguucaucuggagcuugccagcaugacgaaucgcgaacugaugaguucuauugugcaccaggucuucccagcugugaccuccuugggacucaacgagcaggaacuguuauuucugacacagagcgcgucggguccccacucuucccuaucaaguuggaauggcguaccggauguugggauggugagcgacauccucuucuggauucugaaagagcauggacgauccaagucuagagcaagcgaccuuacuaggauccacuuucauaccuuggucuaucacauacuggccacaguggauggccauugggcuaaccaacucgccgcagucgccgcuggugcccggguggcagggacccaggcgugcgcuacugagacaauugacaccucacguguuagucugcgcgccccucaggaguucaugacgucccacagcgaagcaggcucuagaaucgugcuuaaucccaacaaaccaguagucgaauggcacagggagggaauuucauuucauuucacuccugugcugguuuguaaggaucccauccggaccgugggcuugggggacgccaucagugcugaaggacucuuuuacagcgagguccacccacauuauuga

SEQ ID NO: 52525 - RNA, 1074 nt, Artificial Sequence
  derived and/or modified sequence opt3 from ADPRH__Homo_sapiens__NP_001278878
auggagaaguacguggccgcuaugguccugagcgcagccggcgacgcgcucggguauuacaacggaaaaugggaguuccuucaggauggugagaagauccacagacaacuggcucaguugggcggguuagacgcccuggauguuggaagguggcggguguccgacgauaccguaaugcaucuagcaacagccgaagcucucguggaggcaggcaaagcccccaagcugacucagcuuuauuaccuguuggcuaaacacuaucaggacugcauggaagauauggacggucgcgccccugggggagcgucuguccauaaugcaaugcaacucaagccaggcaagccgaacggcuggcguauucccuuuaauucacacgaagggggauguggugccgcuaugcgagccaugugcauaggccugagauucccucaucacagucagcuggauacgcucauccaggugagcauugaguccgggaggaugacccaccaucacccaacaggauacuuaggcgcacuggcuucugcccuuuuuacugcguaugccguuaacucgcggcccccuuugcagugggguaaagggcugauggaacuacucccagaggcaaagaaauacaucgugcaaucaggauacuucgucgaagagaaucugcagcauuggagcuauuuucagaccaagugggagaacuaccuuaaacugcgcggcauuuuggacggcgaaagugcucccacauucccugaguccuuuggggugaaggaaagagaucaguucuauaccucucucagcuacuccggaugggguggcucaagugggcacgacgccccaaugaucgcuuaugaugccguacuggcagccggagacagcuggaaggaguuagcucacagggcguuuuuccauggcggugacucugauuccacugcagccauagcuggguguugguggggcguuauguacggauuuaaaggcgugucaccgagcaauuaugaaaagcuggaguaccggaaccgccucgaggaaacagcccgagcacuuuacagucuggggucuaaagaggacaccgucaucuccuuguga

SEQ ID NO: 52526 - RNA, 1065 nt, Artificial Sequence
  derived and/or modified sequence opt3 from ADPRHL1__Homo_sapiens__NP_612439
auggagaaguucaaagccgcuaugcugcucggcagcgugggggacgcacuuggauacagaaacgucugcaaggaaaauuccaccguugguaugaaaauccaggaggaacugcaaaggucuggcggguuggaucacuuagugcugucacccggagaguggccuguaagugacaacacaauuaugcauauagccacugcggaagcucuaacgaccgauuauuggugucucgacgaucuguaccgggagauggugcgcugcuaugucgagaucguggaaaaacuuccagagcgacguccggaccccgccacaauugaaggcugugcacagcugaagccuaauaacuacuugcucgccuggcacacuccauuuaaugagaaggguagcggguucggagcugcaaccaaggccaugugcaucggccugagauauuggaaacccgagaggcuggaaacacucauugagguuuccguggaauguggccggaugacccauaaccacccuacuggguuuuuaggaucucugugcacagcucuuuucgucucguuugccgcgcaggguaagccauuggugcaguggggccgcgauaugcugagagcaguaccccuagccgaggaauacuguaggaaaaccauccggcauacggcugaguaucaagagcacugguucuacuuugaagccaaguggcaguucuaccucgaggaacgcaaaauaucaaaggacagcgagaauaaggcaaucuuuccugauaacuaugacgcugaggaacgagagaaaacuuacagaaaguggaguuccgaagggaggggaggccggcguggucacgaugccccaaugauugcguaugacgcccugcuugcagcuggaaauucuuggaccgagcugugccaucgcgccauguuccacgggggcgaaagcgcugccacaggcacuaucgcaggguguuuguuuggacuccuguacgguuuagaucugguuccgaaaggccucuaucaggaccuugaggacaaggaaaaacuggaggauuugggggccgcucuauacagacuguccaccgaggaaaaguga

SEQ ID NO: 52527 - RNA, 630 nt, Artificial Sequence
  derived and/or modified sequence opt3 from ADPRHL2__Homo_sapiens__XP_011539938
augagaguggccggcaucagccuggcuuacuccucuguccaggacguucaaaaguucgcaaggcucucagcccagcuuacccacgcgaguagccugggguauaacggagcuauuuugcaggccuuagcagugcaucuggcccuacagggugaguccucuucggaacacuuucucaaacaacugcuuggccauauggaggaucuggaaggggacgcucagucaguauuggaugcacgggagcucggaauggaggaacgccccuacagcagucgacugaagaaaauaggcgagcugcucgaccaggccuccgugacacgugaagaggucgugucugaauuagguaaugggaucgcugccuucgagagcguuccuacugcgauuuauugcuuucugagauguauggagccagauccggaaauccccuccgcauucaacucacuucagaggacguugauuuacaguaucagccugggaggcgacaccgauacaauagccacuauggcuggcgccaucgcaggggcuuauuacggaauggaccaagugccugagucuuggcagcaguccugcgaagguuaugaggaaaccgauauucuagcccagucacuccaccgggucuuucaaaagagcuga

SEQ ID NO: 52528 - RNA, 1401 nt, Artificial Sequence
  derived and/or modified sequence opt3 from ADRA1A__Homo_sapiens__NP_000671
augguguuccugagcggcaacgccuccgacucuucaaauugcacccagcccccugcuccagucaacaucaguaaggcaauucuccuugggguuauacugggagguuugaucuuauuuggcgugcuggggaauauucuaguaauccucagcguggccugucacagacaucugcacuccgucacacauuacuauauugugaaccuugcgguugcugaucuguugcucacuucuacggugcugccguucucggccaucuuugagguccugggauacugggcauucggcaggguguuuugcaauauaugggccgcuguagacguucucuguugcaccgcaucaaucauggguuuauguauuaucagcauugaucgguauaucggggugaguuacccccugcgcuauccuacaauagucacucaacgacguggacuuauggccuugcugugcgugugggcucuaucccucgugauuucuaucggcccacuguucggcuggagacagcccgccccugaagacgagaccauuugucagaucaacgaggaaccaggguacguccuuuuuagcgcgcugggauccuucuauuugccccucgcaaucauucugguuauguacugcaggguguacguaguggccaaacgggaaucacgcgguuuaaagaguggccugaaaacagauaagagcgacucugagcaggucacccucagaauacacaggaaaaaugcuccugccgggggauccggcauggcaucagcuaagacuaagacacauuuuagcgugcggcuucugaaauucagucgcgagaagaaagccgcgaagaccuuggguaucguugugggguguuuuguccuaugcuggcugccauucuuucucgugaugccgauuggaucuuucuuccccgauuuuaaaccuuccgaaacgguauucaagaucguguuuuggcugggcuaucuuaacagcuguauaaauccaauuaucuaccccugcucgucucaagaguucaagaaagccuuucagaacguucugcgaauccagugcuuguguagaaagcaguccucaaaacacgcacucggcuauacucugcacccuccaagucaagcugucgaagggcagcauaaggacauggugaggauucccgucggaagccgggagaccuucuaccguaucuccaaaacagauggugugugcgaguggaaguuuuucucuagcaugccgcgcggcucagccagaauuacuguuaguaaagaccaguccagcuguaccacagcuagggugcggucuaagucauuuuuacagguaugcuguugcgucgggccuaguacccccagccuggauaagaaucaccaagugccaacgauaaaaguucauacuaucucccuaucugaaaacggagaggaaguguga

SEQ ID NO: 52529 - RNA, 1563 nt, Artificial Sequence
  derived and/or modified sequence opt3 from ADRA1B__Homo_sapiens__NP_000670
augaaccccgaccuggauaccggccacaauacaagcgccccugcucauuggggagagcucaagaacgcaaauuucacugggccaaaccagacguccucuaauucaacccuuccgcaacuggacauuacaagagccauuaguguggguuuggucuuaggcgcguuuauacuguucgcuaucguugggaacauucuagugauccucagcguagccugcaauaggcaucugcggacucccaccaacuacuuuauugugaaucuugcaauggccgaucuguugcucuccuucacaguccugccuuuuucugcugcacuggaagugcucggauauuggguuuuaggccgcaucuucugugacauaugggccgcuguggauguccugugcuguaccgccucgauccuuucauugugcgcgauuagcaucgaccgauacauuggugugcguuauagucugcaguacccaacucuaguaacaagaaggaaagcaauccucgcccugcuuuccguuugggugcugucuaccgucauaagcauugggcccuugcucggauggaaggagccugcuccaaacgaugacaaagaauguggcgugacggaggaacccuuuuaugcccuguucuccucauuaggcaguuuuuacaucccucuggcagugauucucgucauguauugccggguuuacaucguggcuaagcgcacuaccaaaaaucuugaggccgggguaaugaaggagaugagcaacucuaaggaacugacauugagaauccacuccaaaaauuuccacgaggauacucuaucaagcaccaaggcgaaaggacauaacccaaggaguucuauugccgugaagcuguuuaaauucucccgggaaaagaaggcagcuaaaacacucgguauagucgugggcauguuuauccuguguuggcuuccguucuucauugcccugcccuuggggagccucuuuucgacccugaagccuccagacgcuguuuucaaaguggucuuuugguuaggauacuucaauucuugccugaaccccaucauauauccuuguuccucaaaggaguuuaaacgcgccuucgugcgaauccuaggcugccaguguagagguagggggcggcgucgcagaaggcggcgacgcagacucggaggcugcgcauacacguauaggccauggacucggggcgggagucuggagcgcagccaguccagaaaggauucucuugacgauagcggaucaugcuugagugguucccaaaggacacugcccagcgccucuccgucaccuggcuaccucgggcguggagcucccccaccuguagaacugugugcguuucccgaguggaaagcaccaggcgcccuucugaguuugcccgcuccugaaccaccgggucggcgagggagacacgacagcggcccccucuucaccuuuaagcuguuaacugagccugaauccccaggaacagacggcggggccucuaacggagguugcgaggcagccgcugauguugccaauggccagcccggguucaagucgaacaugccucuggcaccaggacaguuuuga

SEQ ID NO: 52530 - RNA, 1719 nt, Artificial Sequence
  derived and/or modified sequence opt3 from ADRA1D__Homo_sapiens__NP_000669
augaccuucagagaccugcucagcguguccuuugagggccccaggccugauucuucagccgggggaaguagcgcugguggcgggggaggcuccgccgguggggcagcgccaucugaaggaccggcugucggcggcguucccgggggagccgguggcgggggaggcgugguaggugcagggucgggagaggacaaccggucaagcgccggcgaaccuggcagugcuggggcaggaggugaugugaauggcacagccgcugucgggggacuugugguuuccgcccagggcgugggugucgggguguuccuggcggcauuuaucuugauggccguagcuggcaacuuacugguuauucuaucuguggccugcaaucgccaccuccaaacugucacgaacuacuucauagugaaucuggcaguggcugaccuucuguugagcgccaccguccucccauuuuccgcgacaauggagguucugggauucugggccuuuggccgagcauucugugaugugugggcugccguagacgugcugugcuguacugcuucaauccucaguuuaugcaccauuagcgucgaucguuauguggggguuagacauucucugaaguaccccgccaucaugacagaaaggaaagcagccgcuauucuugcguugcuguggguggucgcauuggugguauccguuggaccucuccuggguuggaaggagccagugcccccugacgagcgguuuuguggcaucaccgaagaggccggguaugcugucuucucaagcgugugcaguuuuuaccuuccaauggccgucauagugguuauguauugucgcguguacguagucgcaagaucuacuacaaggucccuggaagccggagugaaacgggagcgcggcaaggcuagcgagguuguguugcgaauccacugcagaggugccgcaaccggggcggauggcgcucauggaaugaggucggccaaaggccacacguuccggucuucccucucaguccgucuguuaaaguuuagucgcgaaaagaaagcagccaagacucuggcuauugugguagggguguucguucucuguugguucccguuuuucuuuguccuuccccugggaagccuauucccucagcuaaaaccauccgaggguguguuuaaggugaucuucuggcugggcuauuuuaacucuugcgucaauccccucauuuacccuuguagcucaagagaguucaaaagggccuuucugcggcuucugcgaugccagugccgcagaaggcggcgcagaaggccauuguggcguguuuacgggcaucacuggcgggcaaguaccuccggacuccgacaggacugugcucccagcucuggcgaugccccgccuggugcgccccuggccuuaacagcucugccagacccugaucccgaaccacccgggacuccugaaaugcaagcaccaguggccucaagaaggaagccgcccagugcuuuccgcgaguggcggcuacucggcccuuuuagaaggccaaccacacagcugcgcgccaaggugagcucccuuucucacaaaauccgagcaggaggcgcgcagcgggccgaggcugccugcgcacagcguucggaaguagaggcugucagcuugggggugccccaugaaguugccgagggagcaaccugucaagccuaugaacuggcugacuacuccaaccucagagagacggacauauga

SEQ ID NO: 52531 - RNA, 1398 nt, Artificial Sequence
  derived and/or modified sequence opt3 from ADRA2A__Homo_sapiens__NP_000672
auguucagacaggagcaaccccuggccgaaggcagcuuugcuccuauggggucccuccagccagacgcaggaaacgccucuuggaaugguaccgaggcgccgggcgggggagcuagggccacacccuacucacuucaggugacucugacguuggucugcuuagcaggccugcuaaugcuccugaccguuuucgguaacgugcuuguaaucauugccguguuuacaagucgggcucugaaggcaccucagaauuuguuccucgucagccuggccuccgcugauauacugguggccacucucguuaucccauuuucuuuagcgaacgaagugaugggguauugguacuucggaaaagcauggugugagauuuaucuggcccuugacgucuuguuuugcaccucgucaaucgugcaccugugugcuauuagccuagaucgcuacuggaguaucacacaagccauagaauauaaucucaagcgaacccccagaagaaucaaagcaauuaucauuacuguauggguuaucuccgcugugauaucuuucccuccacugauuagcaucgagaagaaaggcggcgggggagguccccagccugccgagccaaggugcgaaauuaacgaccagaagugguacgucaucuccucauguaucggcagcuuuuucgcgccgugccuuauuaugauacugguguaugugcggaucuaccagauugccaagcgcagaacaagggucccuccuagucggcgcgggccagaugcaguugcugcucccccuggaggcaccgagcgaagaccaaaugguuuggggcccgaaaggucugccggaccgggcggcgccgaggcagagccucuccccacgcaacugaacggggccccaggagaaccugcucccgcggguccacgggacacugaugcauuagaccuggaggaauccucaagcagugaucaugccgagcgucccccuggcccacgcagaccggaaagggggccccggggaaaaggcaaggcucgagccucucaggugaaaccuggugacucccucccacgcagagggcccggcgcaaccggaaucggcacacccgccgcugggccaggagaggagaggguaggugccgcaaaggcgagccgguggcgcggcagacagaauagggaaaaacguuuuacuuucgugcuugcugucgugauagggguuuuuguggucuguugguuccccuucuuuuucaccuacacacugaccgccgugggaugcucgguaccgcggacguuguuuaaguucuuuuucugguuuggcuauuguaacucuucccuaaauccuguuauuuacacuaucuucaaccacgauuuucgacgugcauucaagaaaauccugugcaggggugaccgcaagcggauuguguga

SEQ ID NO: 52532 - RNA, 1353 nt, Artificial Sequence
  derived and/or modified sequence opt3 from ADRA2B__Homo_sapiens__NP_000673
auggaccaccaggaucccuacagcgugcaagccaccgcugcaaucgccgcggcuauuacauuccugauacucuuuacuaucuucggcaacgcccuugucauucuggcaguuuugacguccagaucuuuaagggccccucagaaucuguuucuagugucacucgcugcagccgacauccugguagcuacccuuauuaucccauucagucuggccaacgaguugcucggguauugguacuuucggcgcacauggugcgaaguguaucuggcgcuggauguccucuucuguacuagcuccauagugcauuuaugcgcaaucucucuggaccgauacugggccguuucgcgugcucuugaguauaauucaaagagaaccccgaggcggauuaaauguaucauuuugacaguguggcugaucgccgcagucauaagccuacccccucucauuuacaagggagaucaggguccacagccccgcggcagaccucaaugcaaacugaaccaggaggcuugguauauccuugccaguuccauugggagcuuuuucgcgccaugucugaucaugaucuugguguaccucaggauuuaccugauagccaagcggagcaaucgccgaggacccagagcaaaaggcgguccugggcagggagaauccaagcagccaaggccggaccacggcggcgcuuuagccucagcuaagcugcccgcccucgcaaguguagccagcgcucgggaaguuaacgggcauucuaaauccaccggagagaaggaggaaggugagacuccugaagauacaggcacccgugcgcuuccacccucaugggcagcccugccuaauagcgggcaaggacagaaagagggcgugugcggugcuaguccagaggacgaagccgaggaagaggaagaggaggaagaggaagaggaagagugugagccccaggcagucccggugucuccugccuccgcuugcucucccccauugcagcaaccucaggggucgcgcgugcuagccacgcugagaggacagguccuccugggcaggggcguuggggcaaucggaggucaaugguggcggcgacgcgcgcagcuuacuagagaaaagagguuuaccuucgugcuggcuguagugauuggcgucuuuguguuguguugguuccccuuuuucuucucuuauucccucggggccaucugcccaaaacacuguaagguuccccauggacuguuucaguucuuuuucuggauaggcuacugcaacucaaguuuaaauccugugauuuauacaaucuuuaaccaggauuuccggcgcgcauuuagaaggauccugugccguccauggacucaaaccgccugguga

SEQ ID NO: 52533 - RNA, 1389 nt, Artificial Sequence
  derived and/or modified sequence opt3 from ADRA2C__Homo_sapiens__NP_000674
auggccagccccgcucuggcagccgcgcucgcuguggccgcagccgcuggcccuaacgcauccggggccggagagagagguucuggcggggucgcuaaugccucaggagcgaguuggggcccaccgaggggucaguacagcgcaggggccguugcuggacuugccgcagugguaggcuuccugaucguguuuaccgucgugggcaacguuuugguggucauugcuguguuaacaucccgggcccugcgcgcgccccaaaaucuauuccucguaucucuggccucggcagacauacuuguugcuacucuggugaugccuuuuucauuggccaacgaacucauggcuuauugguacuucgggcaggucuggugcggaguguaucuggcccuggaugugcucuuuuguacgagcaguaucguccacuuaugcgcaauuucccuggaccgauacuggucuguuacccaggccguggaguauaaucuuaagcguacaccaagaaggguaaaagcuacuaucguggcggucugguugauuagcgcagugaucuccuuucccccucugguuucacuauaccggcagccagauggugccgcuuauccccaauguggccucaacgacgaaaccugguacauacugaguagcugcaucgggucuuucuucgccccuugucuuauuaugggacugguguacgcacgcaucuauagagucgccaaguugaggacacggacccucuccgagaaacgcgcuccagugggcccggauggugccucacccacuacagaaaaugggcugggagcagcggcuggcgccggcgagaacgggcauugcgcaccuccacccgccgacguagagccugaugaaagcagugcugccgcagagcgaagaaggcggcguggagcuuuacgcagagguggcaggcggcgagccggggcggaaggaggcgccgguggggcugacggccagggagcaggcccaggggccgcugagucuggagcccugaccgcaucccgcagccccgguccgggcgggagacucucgagggcgucuucccggucaguugaguuuuuccuuagucgcagaaggcgugcccggagcuccgugugucgaagaaaggucgcucaggccagggaaaaacgcuuuacguucgugcuggcagucgugaugggaguuuuuguguugugcugguucccuuucuuuuucucuuacagccuauauggcauuugucgggaggcuugccagguacccgguccacuguuuaaguucuuuuucuggaucggguacuguaauucaagucucaacccugucauauauacuguguuuaaucaagauuucagaagguccuuuaagcacauucuguuccgccgacggcguagaggcuuuaggcaguga

SEQ ID NO: 52534 - RNA, 1434 nt, Artificial Sequence
  derived and/or modified sequence opt3 from ADRB1__Homo_sapiens__NP_000675
augggcgccggggugcugguccucggagcuagcgagcccgguaaccuuuccucugcagccccucugccagacggcgcggcuaccgccgcaagauuguuaguuccggccucacccccugcuagucugcuaccacccgcaagcgaauccccugagccacucucucagcaauggacagccgggaugggacugcuuauggcucugaucguguugcucauuguagccggcaaugugcuggucauaguggcgaucgcaaagacucccaggcugcagacgcucaccaacuuauucauuaugucgcuggccucagcugaucuuguuauggguuugcugguggucccuuuuggggccacaaucgugguauggggacggugggaauacggcagcuucuuuugcgagcuauggaccaguguugacgugcucugugucacugcauccauugaaacacugugcgugaucgcucuugaucgcuaucuggccauaaccucuccauuccgauaccagagcuugcucacucgugcgagagccaggggccugguguguacagucugggcaaucuccgcuuuaguuucauuucugccgauucucaugcacugguggcgggccgagagugacgaggcucgcagaugcuauaaugaucccaaauguugcgacuucgugaccaacagggccuacgcaaucgccagcucuguaguguccuuuuaugucccucuuuguauuauggcuuucguguaccugcggguuuuucgcgaagcgcagaagcaagugaaaaagaucgauucaugcgagcgaagauucuugggcggaccagcaaggcccccuagcccaagucccucuccggucccugcccccgcuccaccucccgguccaccccggccugccgcagccgcugccacggcaccacuagcgaauggccgugcugggaaacgcagaccguccaggcugguggcccuccgggaacagaaggcacugaagacucuuggaauaauuaugggcguauuuacccuguguugguugcccuucuuucucgccaacguugugaaagccuuccaucgagagcuggucccugaccgcuuauucguguuuuucaauuggcuggguuaugcuaacagcgcauuuaauccaaucauuuacugcagaucgcccgauuucaggaaggcuuuucaggggcuacucuguugcgcccggcgcgcggccagaaggcgucacgcuacacauggagaccggccucgagcaucuggcugccuggccagaccagggcccccgccuuccccaggggcugccucagaugacgaugacgacgaugucgugggagcaacucccccugcgaggcuuuuggagcccugggccgguuguaacggcggggcugccgcagacagugauagcucccuggacgaaccaugccgcccuggauucgcuucugagagcaaaguuuga

SEQ ID NO: 52535 - RNA, 1242 nt, Artificial Sequence
  derived and/or modified sequence opt3 from ADRB2__Homo_sapiens__NP_000015
augggccagcccgggaacggaagcgccuuccugcucgcuccuaauagaucccacgcaccagaccaugaugugacccaacagagggacgaggucuggguuguggguaugggcaucguaaugucucuuauugugcuggccauagucuuugggaacguguugguuaucacagcgauugcuaaguucgaacgguuacagacugugacgaauuacuuuaucaccucacuggccugcgcagaucuagucaugggacucgccgugguaccguucggcgcugcacacauucugaugaaaauguggacauuugguaacuucuggugugaguuuuggaccaguaucgacguucuuugcgugacugccagcauagaaacacugugugucaucgcuguggaucgcuauuucgccauuaccucccccuuuaaguaccagucuuugcucacuaaaaauaaggcgcgagugaucauucugauggucuggaucguuucggggcugacaucauuccucccuauacaaaugcauugguaucgugcaacccaccaggaggccauuaacugcuacgcuaaugaaacguguugcgacuuuuucacuaaccaggccuaugcaaucgcuagcaguauuguguccuuuuacguaccauuagugaucauggucuucguguauucuagaguuuuccaggaggccaaaaggcaacugcagaagaucgauaagagcgagggacgguuucaugugcagaaucuuucccaggucgaacaagacggccgcaccggccacggguugagaaggucaaguaaauucugucugaaggagcacaaagcgcuaaagacacucggaauuauaauggguacuuuuacccugugcuggcuucccuucuuuaucgugaacauuguacauguuauccaggauaaucugauacggaaagaaguguacauuuugcucaacuggaucggcuacgucaauagcggguucaacccucugaucuauugucgcucuccagacuuucgaauugccuuccaggaguuacugugccucagaagguccucacuuaaggcauacggaaauggcuauagcaguaacgguaacacaggggagcaaucuggauaccacguggaacaggagaaggaaaauaaacuguugugugaggaucuacccggcaccgaagacuuugucggccaucaggggacggugccuuccgauaacaucgacagccagggacggaauugcucgacuaacgacucucugcucuga

SEQ ID NO: 52536 - RNA, 1227 nt, Artificial Sequence
  derived and/or modified sequence opt3 from ADRB3__Homo_sapiens__NP_000016
auggcccccuggccucacgagaacagcucccuggcuccauggccggaccuccccacccuugcaccuaauacagccaacacuucugggcugccaggggugcccugggaagcggcuuuggccggagcauuacuggcccuagcuguccucgcaacgguugguggcaaucugcuugugaucguagccauugcuuggaccccuagacugcagacaaugacuaacguguucgucaccucauuggccgcggcagaucucgugauggggcugcugguugugccacccgccgcuacacucgccuuaaccggacauuggccucugggcgcaacugguugcgagcuuuggacaagugucgacguguuguguguaaccgcuagcauagaaacgcugugcgcccuagcgguugauagguaccucgccgugacuaauccacugcgguauggggcacuugucaccaagcgcugugcucgaacagccguggugcuggucuggguuguguccgcugccguaucuuuugcaccgaucaugucgcaaugguggcgugugggagccgacgcugaggcgcagagaugccacucaaaccccagguguugcgcauucgccagcaauaugccuuacgucuugcucaguuccucugugagcuuuuaucugccauuacugguuaugcuuuucguguacgcucgggucuuugugguagccacucgccagcucagacuguugaggggcgaacuaggccgguuucccccugaggaguccccacccgcaccgucacgcagucuggccccugcucccguugggaccugugccccaccugaaggagugcccgcaugcggucgaagaccagcgaggcuccugccccuucgggagcaucgugcucuguguacauugggccucauuauggggaccuucacgcugugcugguuaccuuucuuucuggccaacguccuacgcgcacucggaggcccaagccuggugccgggucccgccuuccuugcuuugaauuggcugggguaugccaacucugcauuuaauccucucaucuacuguagauccccagauuucaggucagcuuuucggcgacugcuuugccgcugcggaagaaggcugcccccugaaccaugugccgcggcccggcccgcuuuguucccgagcggcgucccugcagcccgcaguucuccagcucagcccagacucugccaaaggcuggacggcgccuccuggggcgugagcuga

SEQ ID NO: 52537 - RNA, 2070 nt, Artificial Sequence
  derived and/or modified sequence opt3 from ADRBK1__Homo_sapiens__NP_001610
auggccgaccuggaggcugugcucgcagaugucagcuaccuuauggccauggaaaaguccaaagcgacccccgcugccagagcaucuaagaaaauccuguugccugagccaucaauuaggaguguuaugcagaaguauuuagaagaccggggcgaggugacauucgaaaagauauuuagccaaaagcugggguaccuacucuuccgcgauuuuugccugaaccaccuugaggaggcccgaccgcugguagaguucuaugaagaaaucaagaaauacgagaaguuggagacugaagaggaacguguggcuagauccagggagauuuuugacucuuauaucaugaaagaacuccuggcauguucgcaucccuucucaaagagcgccacggagcacguccagggacaucuggguaaaaagcaagugccuccagaucucuuucagcccuacauugaggaaaucugccagaauuuacggggcgacguuuuccagaaguuuauagagagugauaaauucacccgcuuuugucaguggaagaacguggaacugaauauccaccuuacaaugaacgacuucuccguccauagaauuaucgggaggggaggcuuuggugagguguaugggugccggaaagcugauacuggaaagauguacgccaugaaauguuuggacaagaaacgcauuaagaugaagcagggcgaaacccuggcgcuaaaugagcgaaucaugcucucucugguaagcacaggcgauugcccuuucauaguuuguauguccuacgcauuccacaccccagacaaacuuucauuuauucuggauuugaugaacgggggagaccuccacuaucaucugagucaacacgguguguucagcgaggccgacaugagauuuuacgcugccgaaaucauuuuaggccuggagcauaugcacaauagguucgucguguaucgggaucucaagcccgcaaacauccuucuggacgaacacgggcaugugcguaucucugauuugggacuagcuugcgacuuuuccaaaaagaaaccucacgccucagucggcacucaugguuacauggcgccagagguucugcagaaggggguggccuaugauagcagugcagacugguucucucucggauguaugcuguuuaaacuucugcgcggccacuccccguucagacagcauaaaacaaaggauaaacacgaaauugacaggaugaccuugacgauggcuguagagcuccccgauagcuuuucgccugagcugcggucuuuacuggaaggccuacuccagcgagacgugaaucgcagacuggggugccuuggaaggggugcccaagaggucaaggaauccccauucuuucggucauuggauuggcagaugguguuccugcagaaauaucccccuccacucauacccccgcgcggcgagguuaacgcugccgacgcauuugacaucgggaguuucgaugaggaagacacuaagggaauuaagcugcuugauagcgaccaagagcuguacagaaauuucccuuugaccaucuccgaaagguggcagcaggagguggccgaaacagucuuugauacuauaaacgcugagaccgaccgucucgaggcgcggaaaaaggccaaaaauaagcagcugggccacgaagaggauuacgcauuagguaaagacuguauuaugcauggguacaugucuaagaugggcaaccccuuccugacacaauggcagcgaagauauuuuuaccuauucccaaauaggcucgaauggcgcggagagggcgaagcuccucagagccugcuuaccauggaggagauccagucaguggaagagacgcaaaucaaggaacggaaaugcuugcugcucaagauuagagggggaaaacaguuuauccugcagugcgauagugaccccgaguuaguacaguggaagaaagaacugagggaugccuaucgcgaggcacaacagcuuguucagcgagugccaaagaugaaaaacaagccccgguccccugucguggaguugagcaaggucccacucgugcagcgugguucugccaacggccuguga

SEQ ID NO: 52538 - RNA, 2067 nt, Artificial Sequence
  derived and/or modified sequence opt3 from ADRBK2__Homo_sapiens__NP_005151
auggccgaccuggaggcugugcucgcagaugucagcuaccuuauggccauggaaaaguccaaagcgacccccgcugccagagcaucuaagaggaucguucugccugagccaucaauucggagugugaugcagaaauauuuggccgaacgcaacgagauaacauucgacaagaucuuuaaucagaaaauuggcuucuuacuguuuaaggauuucugccuaaacgaaaucaaugaggcuguaccccaagugaaguuuuacgaggaaauuaaagaguaugaaaagcucgacaacgaggaggaucgacugugucguagcagacagaucuacgacgcauauauaaugaaagaacuucuguccugcucucaccccuucucgaagcaggccgucgagcaugugcaaucacacuugagcaaaaagcagguuacuuccacgcucuuucagccuuacaucgaagagauuugugaaucccugaggggagauaucuuccagaaguuuauggagucugacaaauucacccgguuuugccaauggaagaauguggagcugaacauucaucucacaaugaaugaguucagcguccaccgcaucauagggagagguggcuuuggggaaguguauggauguaggaaagcugauacuggcaagauguacgccaugaaaugcuuagacaagaaacggauuaagaugaagcagggugaaacccuggcgcuuaacgagcgcaucauguugucccugguaucaacaggggauuguccauucauuguuugcaugaccuacgcauuccauacucccgacaaacuauguuuuauccucgaucugaugaauggaggcgaccuucacuaucaccugagucagcauggcguguucagcgaaaaggagaugcgauuuuacgccacagagaucauuuuggggcucgaacacaugcauaacagauucgucguguauagggaccugaaaccugcuaauauauuacuggaugagcacggacacgcccggaucucugaccucggucuugcaugcgauuuuuccaagaaaaagccacaugcuucagugggcacccacggguacauggcccccgaaguccugcagaagggaacggcguaugacagcagugccgauugguucucuuugggcuguaugcuauuuaaacugcuccguggucauuccccuuuccgccaacacaagacuaaagacaagcaugagauugauagaaugacccugacaguuaacguggaacuuccagacacuuuuagcccggagcugaaaucguugcucgaggggcuguuacagagggauguaucuaagcggcugggaugccacggcggcgggucccaggaagugaaggagcacucauucuuuaaaggagucgacuggcaacauguguaccuacagaaguaucccccuccacucaucccgccucgaggugaaguuaaugcagcugaugccuucgacauaggcaguuuugacgaggaggauaccaaagggauuaagcugcuugacugcgaucaggaauuguacaaaaacuucccacuggugaucagcgagcgcuggcagcaagaagucacagagaccguguacgaagcuguaaaugccgacacggauaagaucgaggcaagaaagagggccaaaaacaagcagcucggacacgaggaagacuaugcucugggcaaagauuguauuaugcaugguuacaugcuuaagcuggggaaccccuucuugacucaguggcagcggcgcuauuuuuaccucuucccgaauagacuggaguggaggggcgaaggagagucccgucaaaacuuacugacaauggaacagauccuaucuguugaggagacccagauuaaagacaagaaaugcauacucuuucggaucaagggcgggaagcaguucgugcugcaaugugaaagcgauccugaguuuguccaguggaaaaaggaacuuaaugagacuuucaaagaagcgcagcgauugcugagaagggcacccaaguuucucaacaaaccacgcucaggaacaguggagcugccuaagcccaguuuaugccaccggaauaguaacggucuguga

SEQ ID NO: 52539 - RNA, 1224 nt, Artificial Sequence
  derived and/or modified sequence opt3 from ADRM1__Homo_sapiens__XP_011526804
augaccacaagcggcgcccuguuccccucccucgugccugggucuagaggagcuucaaacaaguaccuugucgaguuuagggcagguaaaaugagucugaagggcacuacgguuaccccagacaaacggaagggguugguguauauccagcaaacagaugacagcuuaauucacuucugcuggaaagaucgcacuuccggaaauguagaagacgaucugauaaucuuuccggacgauugugaguucaagcgagugccccagugcccuucuggccgugucuacgugcuaaaguuuaaagccgguucgaagagacucuucuuuuggaugcaggaaccaaaaaccgaccaggaugaggaacauuguaggaagguuaacgaguaucugaauaaucccccuaugccaggggcgcuuggagcuucaggcagcaguggccacgagcuguccgcccucgggggagaagguggcuugcaaucucugcuggggaacaugagccauucccagcucaugcaguuaauuggacccgcaggccugggugggcuuggaggcuugggcgcccugacagggccuggacuagcuucacuccuggguaguagcggcccaccggggucuuccucaagcaguucuucccggagccagucggcagccgugacccccucuuccacuacaucaaguacccgcgcuacgccugccccaagcgcgcccgcagccgcuuccgccacuucuccuagcccagcacccucaaguggaaacggcgcuuccaccgccgcgagcccgacacaaccuauccagcuuucugaccugcagucaauuuuggccacuaugaauguccccgcagguccagcugggggccagcaaguggaucucgccaguguacugaccccugagaucauggcucccauauuagccaacgcagacguucaggaaagacugcucccauaccuucccagcggagagucccugccucagacagccgaugagauccaaaauaccuugacgucuccacaguuccagcaggcucuaggcauguuuucggcggcacuggccagcgggcaacucggaccgcugaugugccaguucggucuucccgcugaagccguggaggcagccaacaaaggcgacgucgaggcuuuugccaaggcaaugcagaauaacgcgaagccugaacagaaagaaggggacacuaaggauaaaaaggacgaggaggaagauaugucccuggacuga

SEQ ID NO: 52540 - RNA, 1455 nt, Artificial Sequence
  derived and/or modified sequence opt3 from ADSL__Homo_sapiens__NP_000017
auggccgcuggcggggaccacggaagccccgauuccuacagaucuccucuggcaucaagguaugccaguccagagaugugcuucguguuuagcgaccgguacaaguuccgcaccuggcgacagcucuggcuuuggcuggcggaagcugagcaaacauuggguuuaccgaucacugaugaacagauucaggagaugaaauccaaccuggaaaauauagacuuuaagauggccgcagaggaggaaaaacgucuaagacaugaugucauggcccacguucauacguucggccacuguugccccaaggcugcagggaucauucaucucggagccaccucuuguuaugugggcgacaacacagaucugaucauucuuaggaaugcucuggacuugcuccugccuaaacuggcccggguaaucucgcgccucgcggauuuugcaaaggagagagccucauuaccaacucuggguuucacccacuuucagcccgcucaacuuacaaccguggggaagaggugcuguuuguggauacaggaccugugcauggaucuacagaaccucaaacggguccgcgacgaucugcgauucagaggagugaagggcacuacaggcacccaggccagcuuucuucaacuguucgaaggggacgaccacaaaguugagcaguuggauaagauggugacggagaaagcaggauuuaagagggcuuucaucauuacuggucagaccuacacacggaaggucgacaucgaagugcucaguguacuggccuccuuaggcgcgucuguucauaaaauuuguacugauauccgucugcucgccaaucuuaaggagauggaggagccuuuugaaaaacagcaaauagggagcuccgcaaugccauauaagcgcaaccccaugagaucagagaggugcuguagucuggcucggcacuugaugacccuagugauggacccucugcagacagccagcguccagugguucgagcgaacccucgaugacucugcuaaucgcagaauuugccuggccgaagcauuccuuacggccgauacuauccugaacacauugcaaaauauuuccgagggacucgugguguacccaaaagucaucgaaaggcggauccgccaggagcugccguuuauggcuaccgaaaacauuauaauggcgaugguuaaggcaggcgguucaagacaggacugucaugagaaaaucaggguguuaagccagcaagccgcuaguguagugaagcaggaagggggagauaaugaccugauugaacguauccaggucgaugccuauuucucucccauacacucccagcuagaccaccuccuggacccuagcucguuuacuggccgggcaucucaacaggugcagcgauuccuugaggaagagguuuacccauugcugaagcccuacgaauccgugaugaaagucaaggccgagcucugccuguga

SEQ ID NO: 52541 - RNA, 1371 nt, Artificial Sequence
  derived and/or modified sequence opt3 from ADSS__Homo_sapiens__NP_001117
auggccuucgcugagaccuaccccgcagccagcucccugccuaacggcgacugcgggagaccaagggcgcggccgggagguaaucgcgugacagucguucucggcgcucaguggggcgaugaaggaaagggcaaagugguagaccuucuggcccaagaugcagacaucgugugucgaugccagggugggaacaaugccggacacacugucgugguugauucuguggaguaugacuuucauuuguuacccucaggcauuauaaacccuaaugucacggcuuucaucggcaacggggugguaauucaccuuccaggacuauuugaagaggcagaaaagaauguucagaaagguaagggccucgaggggugggagaaacgucugaucauuagugauagagcccauaucguguucgacuuucaccaggcugccgauggaauacaagaacagcagaggcaggagcaagcgggcaagaaccuugguaccacaaagaaagggaucggacccgucuacagcuccaaggcagcccggucuggccugcgcaugugugacuuggugucggauuucgacggcuuuucagaaagauucaaagugcucgcuaaucaguauaagagcauuuacccuacucuggagaucgauauugagggggaacugcagaaacucaagggauauauggagaagaucaaaccaauggucagggacgguguuuacuuuuuauaugaagcccugcaugggcccccuaagaaaauacuuguggagggggcaaacgcugccuugcuggacauugauuucggaaccuacccauuuguaacaaguuccaauugcaccgugggcggugucuguacugggcuaggcaugccgccccagaacgugggagaaguuuacggcguggucaaggcguauacaacccggguggggaucggagccuucccuacggagcaagacaaugagauuggugaacuccugcagacucgcggccgagaguuugggguaaccacaggaagaaaaaggcggugcggcuggcuugaucugguuuugcucaaguacgcacacaugaucaacgguuucacugcucuggccuuaaccaaacuggacauccucgauauguucacagaaauuaaggugggggucgcuuauaagcuggacggcgagauaaucccacacauucccgccaaucaggaagugcugaacaaagucgaggugcaauacaagaccuugccuggauggaacacggauaucucuaaugcacgugccuuuaaagagcuaccaguuaacgcucagaauuaugugcgcuucauagaagacgagcugcagauucccguaaaguggaucggcgucgggaaaagcagagaauccaugauccagcucuuuuga

SEQ ID NO: 52542 - RNA, 1374 nt, Artificial Sequence
  derived and/or modified sequence opt3 from ADSSL1__Homo_sapiens__NP_689541
augagcggcaccagagccuccaacgacaggcccccuggggcuggaggugugaagcggggccgccugcagcaagaggcagccgcgacagggucucgagucacuguugugcucggagcucaguggggcgaugaagguaaagggaagguaguggaccuucuggccacggaugcagacaucauuucacguugccagggaggcaauaacgccggccacaccgucgugguugaugggaaagaguacgacuuccauuuguuaccaaguggaauaaucaauacaaaggcugugagcuuuauugguaacggcgucgugauccaccucccggggcuauucgaagaggcagagaaaaaugaaaagaagggacucaaagauugggagaagagacugauuaucuccgacagggcccaucuuguauuugauuuccaccaggcuguugacggccugcaagaagugcagcggcaggcccaggaggguaaaaacauagggacuaccaagaaaggaaucggccccacauauucuucgaaggcggcacgcaccggcuugagaauuugugaucuccugucagacuuugaugaguucagcaguagguuuaagaaucuggcccaucaacaccaguccauguucccuacucucgaaaucgacauugaggggcaguuaaaacggcugaagggauuugcugaacgcauccgaccaauggucagagacgguguguacuucauguaugaggcccuucacgggcccccuaaaaagauauugguggaaggcgcaaacgcugcccugcuagauauugacuuuggaacauacccauucgucaccucuagcaauugcacgguuggcgguguguguacugggcucggcauucccccucagaacaucggagauguauauggcguggucaaagcguacaccacaaggguggggaucggagccuuuccaacugagcaaaucaaugaaauugguggccugcuucagacccgggggcaugaguggggaguuacaaccggccguaagcgcagaugcgguuggcuggacuugaugauacucagguaugcacacauggugaacggguucacggcucuggccuuaacuaaacuggauauccucgacguccuuggcgaggugaagguaggaguuuccuacaagcugaauggcaaacggauuccguacuuccccgcuaaccaggaaauguugcaaaagguggaggucgaauaugagacacuaccuggguggaaagccgauaccacuggagcacgacgcugggaagaccugccaccccaggcccagaauuacaucagauuuguggagaaccaugucgguguggcuguuaagugggugggcguagggaaaucaagggagaguaugauacagcuguucuga

SEQ ID NO: 52543 - RNA, 747 nt, Artificial Sequence
  derived and/or modified sequence opt3 from ADTRP__Homo_sapiens__NP_001137420
augaccaagacaagcacuugcaucuaccacuuccuggugcucuccugguauacguuucuuaacuacuauauuucucaggagggcaaagacgaagucaagcccaaaauacuggccaauggggcuagauggaaguacaugaccuuguuaaaccugcuaaagaauaggacagcaggauucgauaucuaucaaccugguucauuucggcagcuccugcagacuauuuucuacggcguuaccugucuugacgaugugcugaagcgcacaaaagggggaaaagacaucaaguuuuugaccgccuuccgagaucuccuguuuacuacacuggcguucccaguaaguaccuuuguguuccucgcuuuuuggauuuuauuccuguauaaccgugaccuuaucuacccgaaagucuuggauacggugauacccguuuggcugaaucaugccaugcacacuuuuaucuucccuauuacccuagcagaggugguccucagaccacauagcuaccccuccaagaaaacaggccugacucuucuggccgcugcaucuaucgccuauauuucgaggaucuuguggcucuacuucgaaaccgguacauggguguauccuguauuugcuaagcugucauuacuggggcucgccgcguucuuuagccuuaguuacguuuucauagcauccauuuaucuguugggagagaagcuaaaccacuggaaauggggcgacaugcggcagccacgcaagaaaagaaaguga

SEQ ID NO: 52544 - RNA, 1554 nt, Artificial Sequence
  derived and/or modified sequence opt3 from AEBP2__Homo_sapiens__NP_001107648
auggccgcugcaaucaccgacauggccgaucuggaggaacucagcagacuuagcccccugccuccaggcucuccggggucagcggcuaggggacgggccgagcccccugaagaggaagaggaggaagaggaagaggaggaagaggcagaagccgaggcuguggcagccuuguuacugaacgguggcagugggggaggcggugggggaggcggcgggggagucgguggcggggaagcugagacaaugagcgagccaucccccgaaucugccucgcaggcgggagaggacgaagaugaggaagaggacgaugaggaagaggaagacgagucaagcaguuccggcgguggggaagaggagucuagcgcagaaucccuaguuggaucaaguggcggcuccucuuccgaugagacucgcucacucagcccuggggccgcuaguucuuccagcggagacggugauggcaaggaagggcuggaggagccaaaaggaccccgaggcucgcaaggugggggcggaggcgggucuuccucaaguagcgugguauccucuggaggugacgaaggcuacgggacgggaggcggugggagcucagccaccaguggcggacguagaggcucccuugagaugagcucugauggggaaccucugucaaggauggacagugaggauagcauuuccucuacaauaauggacguggacucgacuaucagcuccggacggucaaccccagcaaugaugaauggucagggcaguacaaccucuagcuccaagaacauugcuuauaauugcuguugggaucagugccaggccuguuucaacucaagcccggacuuggcggaucacauccgcucuauucaugucgacgggcaaagaggaggcguguuuguuugccucuggaaagguuguaagguguacaauacucccuccacaagucagagcuggcugcagaggcacaugcugacccauucuggggauaaaccuuucaagugcgucgugggcggauguaacgccuccuuugcaucacagggcgggcucgcucggcacguaccaacgcauuucagucaacagaauagcucgaagguuuccucucagcccaaagccaaggaagagagcccuucaaaagcuggaaugaacaagcgccgaaaauuaaagaauaagagaaggcggagucugccacguccccacgacuuuuucgaugcccagacucuugacgcaauccgccacagagccauaugcuuuaacuuguccgcucauaucgagucucugggcaaaggucacagcguggucuuccauuccaccgugauugcgaagaggaaagaagauucagggaagaucaaacuacuccugcacuggaugccggaggacauucuuccugaugugugggucaaugaaagcgagcggcaccaacugaagacaaaaguugugcauuugaguaagcuccccaaggacacugcacuguuacuggacccaaacaucuaucgaaccaugccucagaaacgccucaagagaacacuuauaaggaaaguauuuaaucuguacuugucuaagcaguga

SEQ ID NO: 52545 - RNA, 978 nt, Artificial Sequence
  derived and/or modified sequence opt3 from AEN__Homo_sapiens__NP_073604
auggugcccagagaggccccugaaagcgcucagugccuguguccaucccucaccaucccgaacgcaaaggacguccuuaggaaacggcacaagcgccgaucucgucaacaucagagauucauggccaggaaagcgcuguugcaggagcagggcuuacugucaaugcccccugaaccagggaguagcccccuaccuacaccauuuggagcugccacugcaacggaggccgcuuccucugguaagcaaugccuccgggcaggcucggggucagcccccuguagccgcagaccugcuccaggaaaagccaguggcccgcugcccuccaagugcguugcgauugauugugaaaugguggguaccgggccuaggggacggguaucugagcuugcacgcugcagcauaguguccuaccacggcaauguccuguaugacaaguacauccgaccagagaugcccauugccgauuauagaacaagguggucaggcaucacucggcagcauaugcguaaagcugugccuuuccagguugcccagaaggaaauuuugaaacuccugaaggggaaaguggucgugggacacgcacugcauaacgacuuucaagcucucaaguacguacacccacgcagucagaccagagauacaaccuauguucccaauuucuuaagcgagccgggucugcacacuagggcccgggugucucuuaaggacuuggcgcugcagcuacuccauaaaaagauccaggucggccaacacgggcauuccucaguggaagaugccacaaccgcaauggagcuguaccgacuuguggagguccagugggaacagcaagaggcucgcagccuguggacguguccugaagacagagagcccgauaguucuacugacauggaacaguauauggaggaucaguacuggccagacgauuuggcccacggauccaggggcggugcucgggaggcccaggaccgcagaaacuga

SEQ ID NO: 52546 - RNA, 795 nt, Artificial Sequence
  derived and/or modified sequence opt3 from AES__Homo_sapiens__NP_945320
augugccacaagaacggcuucccccaggaagggggaaucaccgccgcuuuucugcagaaaagaaagcucaggcuuagcaaaaaucaucggccugcacgcgccaaggugacagagcacguccgagguacucguccaggcagagcgacggcugggccggccgcauccaccagggccgcuggaucucuguucuuugaccgguggggcaaccgcggucccgcaggguguagaggaucaagucauuugccucaacaguuaaaauucacaacuagcgauuccugcgacaggauuaaggaugaguuucagcugcuacaagcccaguaccacucucucaagcuggaaugugacaaacuugcuucggagaagucagaaaugcagcggcauuauguuauguacuaugagaugagcuacggccugaauauagagaugcacaaacaggccgaaaucgugaagcgcuugaacggcauuugcgcgcaaguacucccauaucugagucaggagcaccagcagcaagugcugggggcaaucgaacgagccaaacaggucaccgcucccgagcucaauuccauuaucagacagcaauuacaggcccaucagcugucucagcuucaagcauuggcucugccucuaacaccacuccccgugggacugcagccuccaagccuuccggccguuuccgcggguaccggccuguugucacucagugcccuggggagccaggcacacuuaucuaaggaggauaagaacggacaugacggcgauacucaccaggaagacgauggugagaaauccgacuga

SEQ ID NO: 52547 - RNA, 2445 nt, Artificial Sequence
  derived and/or modified sequence opt3 from AFAP1__Homo_sapiens__NP_001128119
auggaggaacugaucguggagcucagacuuuuccuggaauuguuagaccacgaguaccugaccagcacagucagggaaaagaaagccguuauuacuaacauacuacuccggauccaguccucuaagggcuuugaugugaaagaccaugcucaaaagcaggagacggcaaauucacugcccgccccuccacagaugccgcuucccgagauuccucagccauggcugcccccugauagugggccacccccuuugccaaccagcucccucccggaaggauauuacgaggaagcgguaccccugucuccugguaaagcuccagaguauaucacaucgaacuacgacucagaugccaugagcaguuccuaugagucuuacgacgaagaggaagaggauggcaaggggaagaaaacucgccaccaauggcccagcgaagaggcauccauggaccuggugaaggaugccaaaauuugcgcuuuccucuuacgaaagaaacguuuuggacaguggaccaagcugcuuugugucaucaaggacacaaaauugcugugcuauaagucaaguaaagaucagcagccucaaauggagcuaccacuccagggcuguaauauaaccuacauccccaaggacagcaaaaagaaaaagcaugaacugaagauuacucagcaggguacagauccgcuugugcuggcaguucaaucuaaagagcaggccgaacagugguugaaggugaucaaagaggcuuacuccgggugcucaggaccugucgacagcgaaugucccccaccucccaguucuccagugcacaaggccgagcucgagaaaaagcuguccagcgaaagacccucgucugacggcgagggcguaguugaaaacgggauuaccacgugcaauggaaaggagcaagugaaaaggaagaaauccucaaagagugaagcgaaagguacugucagcaaggugaccggcaagaaaaucacaaagauaauuuccuuagggaaaaagaaaccuucuacugaugagcagaccagcucagcagaggaagacgugccaacauguggauaucugaacguccucaguaauucccgguggcgcgagagauggugcaggguuaaggauaacaagcugaucuuccauaaagaccggaccgaucugaagacgcacauugugagcaucccguugcgcggcugugaaguaauccccggucuagacucuaaacacccucugacuuuucgacuccugagaaaugggcaggagguggccguccuugaggcuucaaguagcgaagauaugggaagguggauuggcauacuguuggccgagacaggcuccucuaccgacccagaagcacuccauuacgauuauaucgacguggagaugucggcuagcguuauucagacugccaagcaaacauucugcuuuaugaaccggcgugugaucuccgcgaaucccuaccuugggggaaccucaaacgguuaugcccacccuaguggcacggcauuacauuacgaugacgucccauguauaaaugggucuugggaacccgaggacggauucccggcuagcugcucccgcggccugggugaggaagugcuauaugauaacgccgggcucuacgacaaucugccuccaccccacauuuuugcuagauacagcccugccgauaggaaagcaucacggcuuucugccgacaaguuguccaguaaccacuauaaauaccccgcuagcgcgcagucuguaaccaacacauccucaguuggccgagcaagucugggacucaauagccagcugaagggcaagaaaccaccuguggccucgaacggggucacuggaaaggguaaaacccuuuccucucagcccaagaaagcugauccagccgcaguggucaagcgcacaggcagcaaugccgcucaauauaaguacgggaaaaacagaguggaggccgacgcaaagaggcugcagacuaaagaagaggaauugcucaagcggaaagaggcgcugcgcaauagauuagcucagcugaggaaggagcguaaggaucuacgggccgcaaucgaaguuaacgccggacgaaaaccgcaggcuauccucgaggaaaagcugaaacaacuugaggaagagugcagacagaaggaggccgaaagggugucauuggagcuggaacucaccgagguaaaagagagucugaagaaggcauuagcuggcggugucacacuggggcuugccauugaaccuaaauccggcaccucuagcccccaguccccaguguuccgccaucggacuuuggaaaauucacccaucagcaguugugacacgucugauacagagggaccuguuccagugaacuccgcggccguccucaagaaaagccaggcugcacccggcucgucaccuugcagagggcacgugcugaggaaggccaaagagugggaacuaaagaauggaaccuga

SEQ ID NO: 52548 - RNA, 2178 nt, Artificial Sequence
  derived and/or modified sequence opt3 from AFAP1L1__Homo_sapiens__NP_001139809
auggacagaggccaggugcuggagcaacuccuucccgaacugaccggguuguuaagccugcuagaucacgaguaccucuccgacacaacucuggaaaagaaaauggccgucgcuucuauccuucagucacugcagccuuugccagcaaaggagguuaguuaucucuacgugaacacggccgaucugcauagcggaccguccuucguagaaucucuguuugaggaguucgacugcgaucucucggacuuaagggauaugcccgaagacgauggugagccuucaaaaggcgcgagcccagaacuggcuaagaguccccggcuucgcaaugccgcagacuugccuccaccccugccuaacaaaccaccgcccgaggauuauuacgaggaagcccuaccucucgggccaggaaagucccccgaguauauuucuagccacaauggcuguuccccuucacauaguauaguggacgguuacuaugaagaugcugacagcucuuacccagcaacccgagucaacggggagcugaaguccucauacaaugacagcgaugccaugaguucuuccuaugaaagcuacgacgaggaggaagaggaaggaaaaucgccccagccgcgucaccaauggccuucugaggaggcuuccaugcaucuugugagagagugcaggaucugugccuuucuguugcggaagaaacgcuucggccagugggcgaagcagcucacaguuauuagagaggaucagcuguuaugcuauaaaucaaguaaggacaggcaaccccaccugagacucgcacuugauacuuguagcaucauuuacgugccaaaggacucccgccacaaacgacaugaacugagauuuacccagggcgccacagaggucuuggugcuagcucugcagucuagggaacaggccgaggaauggcucaagguaauccgggagguuagcaaaccugucgggggagcagaggguguggaagugccccguucaccagugcugcuuugcaagcuggauuuggacaaacgccucagucaagagaagcagaccuccgauagcgacucugucggcguuggggauaacuguucaacucugggaagaagggaaacaugcgaccacggcaaagguaagaagaguagcuuagcugagcugaaaggguccaugucucgggccgcgggacgaaagauaacccgcaucauuggcuucucgaaaaagaaaacgcuagccgacgaucuccagacuagcuccaccgaggaagaggugcccuguugcggcuaucugaauguacuugugaaccaaggguggaaggaaagaugguguagguugaagugcaauacacuguacuuucauaaagaccacauggaucuccggacucacgucaacgcaaucgcucugcagggaugcgagguggccccugguuucggcccacgccauccguuugcuuuccggauucuuaggaaucgucaggaaguugccauccuggaggcaucauguagugaggacauggggcggugguugggacuccuguuaguggaaaugggcucucgagucacccccgaggcccugcacuaugauuacguggacguagaaacacuaaccagcauaguuuccgcugguagaaacucauuucucuacgcgaggagcugccagaaucaauggccugagccacgcguguaugaugacguccccuacgaaaagaugcaggaugaggagccugaacggccaacgggggcacaggugaaaagacaugccucuuccuguagugaaaagagccacagggucgacccccaggugaaaguuaagcgccaugcuucuuccgccaaccaauauaaguacggcaaaaaucgagcagaagaggaugcccggcguuaucugguggaaaaggagaaacuugagaaggaaaaagagacuauuagaacagaauugaucgcucugaggcaggagaagcgcgagcucaaggaagccauucggucaaguccgggagcaaaacugaaggcguuagaggaagcuguagccacccuggaggcacagugcagagccaaagaagagaggcgaaucgaccuugaguugaagcucgucgcugugaaagaacgccugcagcaaagccuagccggcgggccugcacugggacucucgguuuccucuaagccaaaaagcggugagugggaaaugaagaagacuuga

SEQ ID NO: 52549 - RNA, 2457 nt, Artificial Sequence
  derived and/or modified sequence opt3 from AFAP1L2__Homo_sapiens__NP_001001936
auggagagauacaaggcccuggaacagcuccuuaccgagcuggacgauuucuugaaaaucuuagaccaagaaaaccugagcuccacagcucuagugaagaaaucuugccucgcagagcugcuuaggcuguauacuaagucaaguagcuccgaugaagaguacauuuauaugaauaaagucacgauaaacaagcagcagaaugccgagucucagggcaaggcgcccgaggaacaaggguugcucccuaacggagaaccaucgcagcacucaagcgcuccgcagaaaagucugcccgaccugccuccacccaagaugaucccugagcggaaacagcucgccauuccaaagaccgagucccccgaagguuacuaugaggaagcagagccuuacgauacaucuuuaaaugaagacggcgaggccguuagcuccucauaugagaguuacgaugaagaggacgggagcaaaggaaagucugcuccauaccaauggccgucccccgaagcaggcaucgagcugaugcgcgaugcccgaauuugugcuuuccuuuggcguaagaaaugguugggucagugggccaagcagcugugcgugaucaaagacaacagacuacucuguuauaagucaagcaaagaucauaguccucagcuggacguaaaucuucuggggucuuccgugauacacaaggaaaaacaagucaggaagaaggagcauaaauugaagaucacuccaaugaacgcggaugugauuguucucggacugcagagcaaagaccaggcagagcaaugguuacgggugauccaggaagucucgggccugcccucugagggcgccuccgaagggaaucaguacaccccugacgcucagcgcuucaacugccaaaagccagauauugccgagaaauaucucucagcaagugaauacggaagcuccguggacggucaccccgagguaccggagacaaaggauguuaagaaaaaguguucugcuggccuuaaacugagcaauuugaugaaccuagggagaaagaaaucaaccagucuggaaccuguggagaggucccucgaaacuagcucuuaucugaauguccuugugaacucacaguggaagagucgguggugcagcgugcgcgacaaucaucugcacuuuuaccaggaucgaaacagauccaaggucgcccagcaacccuugucucucguuggaugugaggugguaccagacccuucgcccgaucaccuguauagcuucaggaucuuacauaaaggcgaggaacuggcgaagcuagaggccaaauccucagaagagaugggucacuggcucgggcugcuuuugagugaaucuggaagcaagacagacccagaggaguuuaccuacgauuacguggacgcagaucgggucuccugcauagugucagcugccaaaaacagccugcuccugaugcagcguaaguucucugaacccaauacguauauugacggccuuccuucccaggaccgccaggaggaacuguacgaugacguugauuugagugagcucacugcugccguggaaccaaccgaggaggcaacaccggucgccgacgaucccaacgaaagagagagcgacaggguguaucuggauuuaacuccuguaaagucuuuucugcauggcccauccucagcucaagcgcaggcaaguagccccacccuaucgugucucgacaaugccacagaagcucugccugccgauuccgggccaggacccaccccggacgagccuugcaucaaauguccagaaaaccuuggugagcagcaguuggagucucuggaacccgaggauccuagccuccggauuacgacuguuaagauccaaacagaacagcagcgaaucucauuucccccaaguugcccugacgcaguggucgccacucccccaggcgcuuccccgccugugaaagaucgccugagagucaccucugccgagauuaaguuagggaaaaauaggacagaggcagaagugaagcgguacaccgaggaaaaagagcgccuggaaaagaagaaagaggagauaagaggacaccuugcgcaauugaggaaggaaaaacgugagcucaaggaaacgcugcuaaaaugcaccgacaaggagguucuggcuagccucgaacagaagcugaaagagaucgacgaggaaugucggggcgaggaaucccgaagaguggaucuugaguugucaauuauggaaguaaaggacaaccugaaaaaggccgaggcaggucccgucacauuagggacuaccguggauacaacucaccucgagaauguuagcccaaggcccaaagccgugaccccugcuagugccccagacugcacacccgucaacucugcaaccacucugaagaaucgcccucuuuccgugguagugacgggcaagggaacaguucugcagaaagcuaaggaaugggagaaaaagggcgccagcuga

SEQ ID NO: 52550 - RNA, 3657 nt, Artificial Sequence
  derived and/or modified sequence opt3 from AFF1__Homo_sapiens__NP_001160165
auggccuucaccgagagagugaacagcuccggcaauucucuguacaacgacgauaggaaucuccuucggauccgcgaaaaggagcgacguaaccaggaagcucaccaagagaaagaagcauuucccgagaagauuccucuguucggggagccauauaaaacagccaagggagacgaauugucaaguagaauacagaauauguuagguaacuacgaggaagucaaagaguuucugagcacuaagucccauacgcacaggcuagaugcgucugagaaucggcucggcaagccgaaauauccccugaucccugacaaggggucgucaauuccaagcaguuccuuccauaccucuguucaccaucagagcauccacacacccgcuuccggaccucuuucagugggcaacauuagucacaauccaaaaauggcccagccccgcacugaaccuaugccaagccugcaugcaaagucuugcgguccgcccgauucccaacacuugacccaggacagacucgggcaggagggauuuggcucaagccaucacaaaaagggcgauaggcgggccgacggggaucacugugcuaguguaacagacucugcaccugaacgcgagcuguccccacugaucagccuccccucgccugugccacccuuaucuccgauacauuccaaccagcaaacccugccucgaacucagggaucaaguaagguccacgguagcuccaauaacucuaaaggcuacugccccgccaagagcccaaaagaucuugcugugaagguucaugacaaagaaacaccucaggauucauugguggcccccgcgcagccacccagucaaaccuucccuccaccgucccugcccagcaagucugucgcaaugcagcagaaaccuacggccuaugugagaccaauggacgggcaagaccaggcucccucagagaguccugagcuaaagccacuccccgaagauuacaggcagcagacuuuugagaagaccgaccugaaaguaccggccaaggcaaaacuuacaaagcugaaaaugccuagccaauccguugaacagacuuauucuaaugaggugcacugugucgaagagaucuugaaggagaugacccauucguggccacccccucucacagcuauucacacccccagcacggccgaaccauccaaguucccuuuucccacuaaagauucacagcacgugaguucugugacacagaaccaaaagcaguacgacaccagcuccaaaacucauucaaauagccagcagggaacaucuuccaugcuggaggaugacuuacaacugagugauagcgaagacucugauuccgagcagaccccagaaaagccgccuucaaguagcgcgcccccaucggcaccccagucccucccugagccagucgccucugcucacagcucaagugccgaguccgaaucuacgagcgacuccgauucaagcagugacucugaguccgaaagcucgucaucugacagugaggagaacgaaccccuugagaccccugcuccggaaccagagcccccuacaacuaacaaauggcagcuggauaauugguugaccaagguuucccaaccagccgcacccccugaaggcccgcggagcacagagcccccacgucgccauccugagucuaaggguagcuccgacucagccacuucacaggaacacagcgagucuaaagaucccccaccuaaguccucaaguaaagcucccagagcgccaccggaagcaccucaccccgggaagaggagcugccagaaauccccagcccaacaggagcccccucagcggcagaccgugggaacaaagcaaccaaagaaacccguaaaggcuucugcccgagcaggcucgcgcaccagccuacagggcgaaagagagccugggcugcucccguacggaucaagggaccagacuuccaaagauaagccaaaagugaagacgaaaggucggccccgcgccgcugccaguaacgagccuaagcccgcagucccaccuucuagcgaaaagaaaaagcauaaauccucacugcccgcgccaucuaaggcucuuagcggcccugagccggccaaagacaauguggaagauagaacacccgagcacuucgcacugguuccauugaccgaaagucaggggccuccccauuccggaagcggcucuaggacuucagguugucgucaagccguggucgugcaggaggacucccggaaggaucgacucccacugccuuuaagagacaccaagcugcuaaguccccucagggauacaccgccaccucagagccugaugguaaaaaucacccuugacuugcugucgcgcauuccccagccacccgggaagggcucucggcaaagaaaagcugaggauaagcagccuccggccggaaagaagcacuccagcgaaaagaggucaagugacucuuccagcaaacucgcaaagaaacgcaagggcgaggcugaacgagacugcgauaacaaaaagauccggcuggagaaggagauaaaaucacagaguagcuccucuagcuccucacauaaggaaucuaguaaaacuaagcccucgcguccaagcucccaaucuaguaaaaaggagaugcuuccucccccuccaguuagcuccaguucucagaaacccgccaagccugcgcugaagagaagcaggcgcgaagccgacacaugugggcaggauccacccaaaucagcuuccaguacgaaaagcaaucacaaagacucuuccauuccgaagcagcggagaguggagggaaaagguucaaggagcucgucugaacacaagggcaguuccggggauaccgcaaacccuuuuccaguccccagcuugccuaauggaaacucaaagccaggcaaaccccaagugaaguucgacaaacagcaggccgaucuccauaugcgagaggcuaagaaaaugaagcagaaggccgagcugaugacugaccgcgucgguaaagcauuuaaguauuuagaagcggugcuguccuucaucgagugcgggauugccacagaaucugagagccaaaguuccaaaagcgcuuacucuguuuauucagaaaccguggaucuaaucaaguucaucaugagucucaaauccuuuagcgacgccacagcaccgacucaggagaagauuuucgcuguacuguguaugcggugccagucuauacuuaauauggccauguuuagauguaagaaagauaucgcaauuaaguacucgaggaccuugaacaaacacuucgagucaagcuccaaggucgcccaggcuccuagucccugcaucgcgcguucuacgggcaccccaagcccucugucccccaugccaucacccgccaguucugugggaagccaauccucagcaggcagcguugggucuuccggaguggcugccacaauaaguacuccugucaccauucagaauaugacaagcucguaugugacuaucaccucccauguacucacggccuuugaccugugggaacaggcugaggcauuaacacgcaaaaacaaggaguucuuugcccggcugucuaccaaugugugcacucuugcguugaacucaagccucguugaucugguccacuacacaagacaggguuuccaacagcuacaggaacugaccaagacuccauga

SEQ ID NO: 52551 - RNA, 3831 nt, Artificial Sequence
  derived and/or modified sequence opt3 from AFF2__Homo_sapiens__NP_001162593
auggaccuguucgacuuuuucagagacugggaucucgagcagcaaugccacuacgaacaggacaggagcgcccuuaagaaacgggagugggaacgccgaaaccaggaggugcagcaagaagaugaccuguuuuccucuggcuucgauuuguuuggggagcccuauaagaccaauaaaggagacgcuuuagcaaaccguguccagaauacacuggguaacuacgaugagaugaagaaucuacucacuaaccauucaaaucagaaccaccugguuggcaucccuaaaaauagugugccacagaacccgaauaacaagaaugaacccagcuucuuuccugagcaaaagaacagaauuauaccaccccaucaggacaauacgcacccuuccgccccaaugcccccuccaucuguagugauccuuaacucgacccugauucauucaaacaggaaaagcaagccggaauggagucgggauucccacaaucccucuacagucuuggcgagccaggcuuccgggcagccuaacaaaaugcaaacucucacccaggaccagucacaagccaagcuggaggauuucuuuguguauccagcagagcagccccagaucggagaaguugaggaaaguaauccuagcgccaaagaggacucuaacccaaauuccucaggcgaagacgcuuucaaggagauuuuucagagcaacagucccgaggaaucugaguucgcagugcaagccccggguuccccucuggucgcuagcucgcucuuagcccccucuuccgggcugucagugcagaauuuuccaccuggacuuuacuguaagacaaguaugggccagcagaaacccaccgcguauguacgcccaauggauggccaagaccaggcacccgauaucagcccuacuuugaagccauccauagaguucgaaaacucuuucgggaaucugagcuuuggaacacuacucgacgguaaaccgucagccgcuaguuccaagaccaaacugcccaaguucacgauccuucagacuagcgaaguuucucugccuucagauccaaguugcguggaggagauuuugagagaaagccagcaccucacccccggcuuuacacugcaaaaauggaacgacccuacuaccagggccuccacaaagucugucucguucaagagcauguuagaggaugaccugaaacucuccucagaugaagacgaucuugagccagugaagacccugacgacucaguguacagcaaccgaauuguaccaggcuguggagaaagccaagccccggaauaacccggucaauccuccacuagcgacuccccagccucccccagccguucaagcaagugggggaucuggcagcuccucagagagcgaaucuuccagugagagcgacucugacacagaauccucaaccacggauagugagagcaacgaggcuccucgcguggccacccccgaaccagagccgccuucgacaaauaaauggcagcuggacaaguggcucaacaagguaacuucccagaacaaaucuuuuaucugcggucaaaaugaaacccccauggagacaauuagccugccacccccuaucauacagccaauggaagugcagaugaaggucaaaacuaacgcuucacaggugcccgccgagccuaaggagcgaccgcuucugaguuugauuagagaaaaagcaaggccacggcccacccaaaagaucccugagacaaaggcccucaaacauaagcuguccaccacuucugaaacgguuagccagcguacaauugggaaaaagcagcccaaaaagguggagaagaauaccuccacugaugaguucaccuggcccaaaccuaacaucacaucaagcaccccgaaggaaaaagagagugucgaauuacacgaucccccacgcggaagaaauaaggcuacugcgcauaaaccugcacccaggaaggagccacggccuaacaucccccuggccccagaaaagaagaaguaucgaggcccgggcaaaauugugccuaagucucgcgaguuuauagaaacagauuccagcacgucggacucaaauaccgaucaggaggagacucuacaaaucaaaguacucccaccauguauuaucucugggggaaacacagcuaagaguaaagaaauaugcggugccucccugacccuuagcacauugaugucuagcuccggcucaaauaacaaucugaguauuagcaacgaggaacccacuuucucuccuaucccaguuaugcagaccgagauccucagcccccugagagaccacgagaaucuuaagaaccugugggugaagauugauuuggaccuccugucaagggucccugggcacaguagcuuacaugcagccccggcuaaaccagaucacaaggaaacggccaccaaacccaagcggcagacagcagugacugcggucgagaaaccugcucccaagggaaagcgcaaacauaagccaaucgaaguggccgagaaaauuccugaaaagaaacagagacuggaggaggcaaccacaauaugucuacugcccccaugcaucuccccugccccgccccacaagccaccuaauacuagggaaaacaacucuucgcgucgggcuaaucgaagaaaggaggaaaaacucuuucccccaccucuuagccccuugccggaggacccaccuaggcgccggaacguuucaggcaauaacggucccuucgggcaagauaagaauauugccaugaccggccagaucacguccacaaaaccaaagagaaccgaaggaaaauuuugugcaacuuucaagggcaucagugagggggacacacccaaaaaggcuucuagcgccaccauuacugugaccaacacagcgauagccacggcuaccguaacugcaacagccaucgucaccacaacugugaccgcuacggccacagcaaccgcgacuaccacaacuaccacaacgaccauuuccacuaucacaucaaccauuacuacaggacugauggacucuagccaucucgagaugaccaguugggccgcucugccuuuacuguccuccucuucaacgaauguuaggcgcccgaaacuuacuuuugaugacuccgugcacaacgccgauuacuacaugcaggaagcuaaaaaguugaaacacaaggcagacgcccucuucgagaaauucgguaaggcagucaauuaugccgaugcugcgcugaguuuuaccgaaugcggcaacgccauggagcgagacccccuagaagcaaagagcccauacacaauguauucggagaccguggagcugcuccgguacgcuaugcgucugaaaaauuucgccucuccucuugccuccgauggggacaagaaauuggcuguacuguguuauagaugcuuaagccuccuguaccuuaggauguuuaagcugaaaaaggaucaugcaaugaaguauucacgcaguuugauggaauacuucaaacaaaacgccucuaagguggcgcagauccccuccccuuggguuagcaauggcaaaaacacuccaucacccgucagucucaauaacgugagcccuauaaacgcuaugggaaauugcaacaaugguccagugacaaucccccagcggauucaccauauggccgcaucccacgucaacaucaccucuaauguucugagaggguacgagcacugggacauggccgauaagcuaacaagggaaaacaaagaguuuuucggcgaccuggauacucucaugggaccgcugacccagcauagcuccaugacgaaucuugugcgauaugugcgccaaggcuuguguuggcugcggauugacgcucacuuacucuga

SEQ ID NO: 52552 - RNA, 3756 nt, Artificial Sequence
  derived and/or modified sequence opt3 from AFF3__Homo_sapiens__NP_001020279
auggacagcuucgaucuggcccuccuucaggagugggaccuggaauccuuguggggcgaggauaucuuaaaccaaagaaaugacucucugguggucgaauuucagucaagugcuaguaggugccgguccguuuacgagcccgaucgcaacgcacuacgacguaaggaaagagagaggcggaaucaggagacccagcaagacgaugggacauucaacucuucguauucacucuuuagcgaaccuuacaaaacuaauaagggagacgagcugaguaaccgcauucagaauacgcuugguaacuaugaugaaaugaaagacuuccugaccgauagauccaaucagucucacuuggugggcguaccaaagccgggggugccccagacaccugucaacaaaauagacgagcauuuuguggccgauagcagggcgcaaaaucagccauccucaaucuguaguacuaccacaagcacccccgcugccguuccugugcagcagucuaagcggggaacuaugggcuggcaaaaggcaggucacccacccuccgacgggcagcagcgcgccacacaacagggaucacuccgaacccugcugggcgacggcgucgggagacagcagccuagggcuaaacaagugugcaacguagagguuggacuccagacgcaggaacggccaccggcaauggccgcuaagcauagcaguucuggucacugugugcagaauuuucccccuuccuuagccagcaaaccaucgcugguccaacagaagcccacugcguacgugcguccuauggauggccaggaccaggcaccagaugagucucccaaacuuaaguccucaagugaaaccagcgugcauugcacauccuaucgcggggucccggccucuaagccugagcccgcuagagccaaagcaaaguugagcaaauucucaauuccaaagcaaggagaagagaguagguccggcgagacuaacagcuguguugaagagaucauucgggaaaugaccuggcugccuccccuaucugcuauccaggccccagguaaaguggagcccacaaaguucccuuuuccaaauaaagacucacagcucguaaguagcgggcacaacaacccgaagaagggagaugcggaacccgaguccccugacaauggcaccucuaacacgucgaugcuggaggaugaccuuaaacugagcuccgaugaagaggaaaaugagcagcaagccgcacagcgaacugcuuugcgcgcccucucagacagugcugugguccagcaaccaaacugcagaacaucugugcccagcuccaagggcucauccucuuccaguagcucuggguccucaaguagcucguccgauucugaaagcucaaguggauccgacucugagaccgagagcuccucaagcgaaagugaggguucuaaaccuccacacuucuccagccccgaagccgagccggcaucgucaaauaaguggcagcuggacaaaugguuaaacaagguuaauccucauaagccacccauacugauccagaacgagucucacggcagugaauccaaucaguacuauaacccugugaaagaggauguccaagacugugggaaggugcccgauguaugccagccaagccucagggaaaaagagauuaagucuacuuguaaagaagaacagcggccucgcacagccaauaaggcucccggaagcaagggcguuaaacagaaguccccaccggcggcaguggccgucgcugugucagccgcagccccucccccagcuguccccugcgccccugcagagaacgcgccagcucccgccagaaggagugcagguaaaaagccuacccgucggacggaacgaaccagcgccggggacggcgcuaauugucauagaccggaggaaccagccgcagcugaugcccuuggaacaucugugguugugcccccugagccaacuaaaaccaggcccugcggcaacaaucgcgcgucccaccggaaggaacugagaucaaguguaacaugcgagaagaggcgcacucgaggguugagccggaucgucccuaaauccaaggaguuuauugaaaccgagucuucgagcucauccaguucuagcgacuccgaucuagaaucagagcaagaagaguacccgcugucuaaagcccagacaguggcugcaagcgccaguuccggaaacgaccagcgucucaaggaggcugccgcaaacgguggcagcgggcccagagcgccaguuggaucuaucaaugccaggaccacuucagauauagcuaaagaacuggaggaacaguucuacacgcuugugccuuuuggccgcaacgagcuguugagcccccucaaggacagugaugagauucggagccugugggucaaaaucgacuuaacacugcuaucgaggauuccagaacaccucccucaagagcccggugugcugucugccccagcaaccaaggauuccgaaagcgcuccgccuucacauacuagcgacacccccgccgagaaggcacuuccaaaaucuaagagaaaacgaaagugugacaaugaagaugacuaucgcgagaucaaaaagucccagggggagaaggauagcucaagucgguuggccacaagcaccuccaacacucugucugcuaaucacugcaacaugaauaucaacagcguagcgauucccauaaauaaaaacgaaaagaugcucagauccccuaucucaccacugucugacgccaguaaacauaaguacacaucggaggaucuuacgagcuccucuaggcccaauggcaacucacuguucaccagcgcauccaguucuaaaaagccuaaggcugacagccaguugcaaccgcacggaggcgaucucacuaaagccgcccauaauaacucagaaaauauuccacugcacaagucccguccccagacaaaaccuuggagucccgggagcaacggacaccgcgacuguaagcggcagaaauuaguguucgaugacaugccaagaucugcugauuauuuuaugcaggaggcaaagaggaugaagcauaaagccgacgcgaugguugaaaaguucgguaaagcucugaacuacgccgaggcagcccuauccuuuaucgagugcggcaaugcuauggaacaagggccuauggagucaaagagccccuauaccauguacucggaaacagucgagcucauacgauaugcaaugcggcugaaaacucacucuggaccaaacgccaccccugaagauaagcagcuugcggcuuuguguuaccgcugccuggcccuccuguacuggagaauguucagguuaaaacgggaccaugcagugaaguauaguaaggcccugauugacuacuuuaaaaauuccagcaaggcugcccaggcaccgucacccuggggcgcuuccgguaaaucuacggggaccccaagcccuaugagucccaacccauccccugccagcucugugggcucacagggaagucuuuccaaugcgagcgccuugucucccucgacaaucgucucaaucccgcaacgaauccaccagauggcagcuaaccacguuagcauuacuaauuccauucuccauaguuaugauuacugggagauggccgacaaccuggcuaaggagaauagagaguucuuuaacgaucuagaccugcucaugggcccagugacccugcacucuagcauggagcaucuugugcaguauucccagcaaggguugcacuggcugcgcaauucagcacauuuaaguuga

SEQ ID NO: 52553 - RNA, 3492 nt, Artificial Sequence
  derived and/or modified sequence opt3 from AFF4__Homo_sapiens__NP_055238
augaacagagaggacaggaaugugcugcggaugaaggaacgcgagcgacguaaccaggaaauccaacagggcgaggaugccuuucccccuagcuccccacucuuugcugaaccguacaaagucaccucuaaggaggacaaacuuucaaguaggauucagagcaugcuggggaauuaugaugagaugaaggacuucauaggagauagauccauccccaaauugguugcaauuccuaagccaacagugcccccuucugccgacgaaaagucgaacccaaauuucuucgagcagcggcacgguggcucacaucaaagcaguaaauggacucccguagggccugcgccauccacgucucagagccagaagcgcuccucaggauuacagaguggccacagcucucaaagaaccuccgcugguucaagcagugggacaaacucuuccggacagaggcaugaucgggaaagcuacaauaacucggggucuuccucacgcaaaaagggccagcacggcagugagcauagcaaaucccgaucuagcucaccgggaaagccccaggccgugaguucccugaauagcucucacucaagaagucacgguaacgaccaucacagcaaggagcaucaaagguccaaaucuccucgggauccagacgcaaauugggauucgcccagccgugucccuuuuuccucaggccagcacaguacucagucuuucccacccagccuaauguccaagucaaacagcaugcuccaaaaaccgaccgccuaugugcgcccuauggacgggcaggaaucuauggagcccaagcuguccagugaacacuacagcucucagucccauggaaauucaaugacagagcuuaaaccaaguagcaaggcucaccugaccaaauugaagaucccuucgcagccccucgaugcauccgccucuggcgacguuagcugcguggacgaaauucugaaggagaugacucauucauggccacccccucugacagcuauccacaccccauguaaaacggagccgaguaaguuucccuucccuacuaaagaaucccaacagucuaacuuugguaccggggagcagaagagauauaauccaagcaaaacauccaacggacaucagucaaagagcaugcucaaggaugacuuaaaacugaguucuuccgaagauagcgacggcgagcaagauugcgacaagacuaugcccaggucgaccccuggcucaaacucugaaccaagucaccacaauuccgagggggccgauaacagccgggacgauucuagcucccauucaggaagugagucaucuuccgguucagacagugaaagcgaguccucuucgagcgauucagaagcgaaugagcccucccagagugcaucuccggaaccugagccacccccuacaaacaaauggcagcuugacaauugguugaacaaggucaauccccacaaagugagcccagccuccucaguagacucuaacauaccuagcagucagggcuacaagaaggaggggcgagaacaaggaaccggcaauuccuauacggauacuagcggucccaaagagacaucuucagcuaccccagggcgcgacuccaagacuauccagaaaggcagugaaagcggaagaggcaggcagaagucgccggcccagucugauuccacaacccaacggcgcacgguugggaaaaagcagccuaagaaagcagagaaggcugccgcggaggaacccagaggaggucugaaaauugagagcgaaaccccaguggaccuagccucaaguaugcccucuuccaggcauaaggcagcuacaaaaggcagccguaagccuaacaucaaaaaggagucaaagaguagcccacggcccacugccgagaaaaagaaauacaaguccaccucuaaaagcucccagaagucacgagaaauuaucgagacagauacuucuaguucggacagcgaugaauccgagucucucccuccgucaagccaaaccccaaaguaccccgaauccaauagaacaccugucaaaccaaguucuguggaggaagaggacagcuucuuuaggcagcgcauguucucacccauggaggaaaaggagcugcuuuccccucugagugaaccggaugaccgguaucccuugauagugaaaauugaucucaaccuguuaaccagaaucccagggaagccuuacaaagagacugaacccccaaagggagagaagaaaaaugucccugagaagcacacgagggaagcucagaaacaggccagcgagaagguuucuaacaaaggcaagcgcaagcacaaaaaugaagacgauaaccgagcauccgagucaaagaaacccaagacagaggacaaaaacagcgccggucauaagccaucgucuaaucgggaaaguuccaaacaaagcgcugcgaaggagaaggaccugcucccgagcccugcagggcccgugccauccaaagaucccaagaccgaacacggcucucguaaaagaacuauuagccagaguuccagccuuaagucuucaaguaacuccaauaaagagaccagcggaucuucgaagaacucaagcuccacaaguaagcagaaaaagaccgaaggcaaaacuucuagcuccucaaaggagguaaaagagaaggccccuaguucuagcuccaauuguccacccucagcuccuacacuggacagcucuaagccgaggcgcacgaaauugguguuugaugaccggaacuauuccgccgaucauuaccuacaggaagcaaagaaacugaagcacaaugccgacgcucucagugauagauucgagaaagccgucuauuaccuggacgcagugguuagcuucaucgaaugcgggaacgcgcuugagaagaaugcucaagaaucgaaguccccauuucccauguauucugagaccguggaucugaucaaauacacuaugaaguugaaaaacuaccucgccccugacgcaacagccgcugauaagaggcugaccgucuuaugucugcgaugcgagucacuacucuaucugcgccuuuucaaauugaagaaggaaaaugcccugaaauacagcaagacacucacugagcaucugaaaaacaguuauaauaacucccaggcacccucuccaggacuugguagcaaggcugugggcaugccuucacccguauccccaaaacugaguccugggaauagcggaaacuacucuucaggcgccuccagcgcgucugccagugguucguccguuaccauuccgcagaagauacaccagauggcugcaagcuaugugcaagucacgucaaacuuuuuguacgccaccgaaaucugggaccaggcugagcagcucucuaaagaacaaaaggaguucuuugccgagcuggauaaggugauggggcccuuaauuuucaaugcaagcaucaugacagaccugguccgguauacuagacagggccuacacuggcucaggcaggacgcgaaacugauauccuga

SEQ ID NO: 52554 - RNA, 2394 nt, Artificial Sequence
  derived and/or modified sequence opt3 from AFG3L2__Homo_sapiens__NP_006787
auggcccacagaugccugaggcucuggggccgcgggggauguuggccccgcggucuucagcaacuguuggugccuggcggggucggaccaggcgagcagccgugcuuacgaacccuguaccguuucguuacaacucaggcuagagcaagcaggaacucccuacucacggacaucauugccgcguaucagcgguuuuguucucggcccccuaaggguuucgaaaaauacuuuccaaaugggaagaacggcaaaaaggcuucagagcccaaagaagugaugggagagaagaaggaaaguaaaccugccgcaaccacaagaagcuccggcgggggagguggcgggggaggcaagaggggugggaaaaaggaugacucucauugguggucgcgguuccaaaaaggagauauaccaugggacgauaaggacuuucgcauguucuuucuguggacugcccuuuucuggggcggcguaauguuuuaucuguugcucaagcgaucagggagagagaucaccuggaaagauuucgugaauaacuaccugagcaagggagucguggacaggcuggagguugugaauaaacgguuuguccgugugacauucacccccgguaagacuccuguagauggccaguauguuugguuuaacauugggaguguggacacauucgaacgcaaucucgagaccuuacagcaggaacugggaaucgagggcgagaacagagucccagugguguacauugcugaauccgaugguucuuuccuuuugagcaugcugccgacgguccuaaucauagcauuucuccuguauacuaucaggcgggggcccgccggcauuggacgaaccggccgcgggaugggaggucuuuucuccguuggcgagacaacugcuaaagugcugaaggacgaaaucgauguaaaauuuaaggacguggccgggugcgaggaagcgaaguuggagauuauggaguucgucaauuuucucaaaaacccuaagcaauaccaggaccugggagcaaaaaucccaaagggcgccauauuaaccggucccccugggacaggcaaaacccugcucgcuaaggccacggcaggagaagcuaaugugccauucauuacuguuucaggcagugaguuucuugaaauguucgugggggucggacccgccagagugagggaucuguuugcguuggcccggaagaacgcaccguguauccuauucauugacgagaucgaugcuguaggucgcaaaagaggcagggggaauuuuggaggccagagcgaacaggagaacacacugaaucaacuccugguugagauggacgguuucaacaccacuacaaacguggucauccuugccgggaccaaucguccugauauucuggaccccgcuuugcuccggccaggccgauuugauagacagauauucaucggaccucccgacauuaagggcagggccucuaucuucaaagugcaucugcgcccauuaaagcuggauuccacgcuagaaaaagacaagcucgcacggaagcuggccucacuuacccccggguuuagcggagcugaugucgcgaacgugugcaaugaggcagccuugauagcugccagacaccugagugacucuauuaaccagaaacacuucgaacaagcaaucgagaggguuaucggcggucucgaaaagaaaacacaggugcugcagccugaggagaagaaaacuguagccuaccaugaagcugggcacgccgucgcaggaugguaucuugagcacgcggacccacuguugaagguguccauuaucccgcgcggcaagggucucggcuacgcucaguaucugcccaaagaacaauacuuauauaccaaggagcagcugcuagaucgaauguguaugacacucgggggacggguuagcgaggaaauauuuuucggccguauuacuaccggggcccaggacgaucugagaaaagugacacagucggcauacgcccaaaucguccaguuuggaaugaaugagaaggugggccagauuucuuucgaccuuccuaggcagggugauaugguauuggaaaaaccauauuccgaggcuaccgcccgccugaucgacgaugaagugcggauccucauuaacgacgcauacaagagaacuguugcucuguuaacggagaaaaaggccgaugucgagaagguggcgcugcuuuugcucgaaaaagaggugcuggacaagaaugauauggucgaacuacuggggcccaggccuuuugccgagaaaucaacauacgaagaguucguugagggaaccggcagucucgacgaagauacuagccugccagagggucuuaaggacuggaacaaagaacgagagaaggaaaaggaggagcccccgggcgaaaaaguggcuaauuga

SEQ ID NO: 52555 - RNA, 1800 nt, Artificial Sequence
  derived and/or modified sequence opt3 from AFM__Homo_sapiens__NP_001124
augaagcugcucaaacuuaccggcuucaucuuuuuccuguuuuucuugacagagagcuuaacucugcccacgcagccuagagacauugaaaacuuuaauuccacccaaaaguucauagaggauaacaucgaauacauuacaaucauugccuuugcucaguaugugcaggaggcaacuuucgaagagauggagaagcuagucaaagacaugguugaauacaaagauaggugcauggccgacaagacccucccagaguguucuaagcugccgaauaacgugcuucaggagaaaaucugcgcgauggaggggcugccccaaaagcacaauuuuucacauuguugcaguaaaguagaugcucagcggcgcuuguguuucuuuuauaacaagaaaagcgacgugggauuccucccuccauuucccacacuggauccugaggaaaagugccaggccuacgaguccaaucgagaaucucugcucaaccacuucuuauaugaggucgcacguagaaauccauucguguuugcccccacccugcuuacuguugcugugcauuucgaagaggucgcaaagucguguugcgaggaacagaacaaagugaauuguuugcaaacaagggccauaccuguaacccaguaccugaaggcuuuuucaagcuaucagaaacacguuugcggugcccuacucaaguucggcacgaaagugguccauuuuaucuacauugcgauccugagucagaaguucccaaaaauugaguuuaaggaacuuaucucccugguggaggacgugucuagcaacuacgauggguguugcgaaggagacgucguucaaugcauacgggauacuuccaaggugaugaaucacauuuguucaaaacaggacaguaucagcucuaagauuaaagagugcugugagaagaaaaucccggaacgcggccagugcaucauuaacuccaauaaggaugacagacccaaggacuugucacucagggaggguaaauucaccgauagcgaaaacguaugucaagagcgggacgcagauccugacacauuuuucgccaaguuuacuuucgaauauagucgccgacacccagaucugucuauacccgaguuacugagaaucgugcagauuuacaaagaccuccuuaggaacugcuguaauaccgagaacccuccagggugcuaucgguacgcugaagauaaguuuaaugagacaaccgaaaaaucccugaagaugguccagcaggaguguaagcauuuccaaaacuugggaaaagacggccuaaaguaucacuaccugauccgucucacgaaaauagcaccccagcugagcacugaggaacuugugucgcugggcgagaagaugguuacagccuucaccacuugcuguacauugucugaagaguuugcuugcguggauaaucucgccgaccuggucuucggggaauuaugcggagugaacgagaaucgcaccauuaacccggcgguagaucauuguugcaaaacgaauuuugccuucagaaggccuuguuuugagucccugaaggcagacaagaccuauguucccccaccuuucucacaggaccuauuuacauuccacgcugauaugugccagagucaaaacgaagaacuccagcggaaaacugaccgauuucuggugaaucuugucaaguugaaacacgaacugaccgaugaggaacuccagagccuguucacaaacuuugccaauguggucgacaaguguugcaaagcugagucccccgagguguguuucaacgaagagucuccaaagaucgguaauuga

SEQ ID NO: 52556 - RNA, 1830 nt, Artificial Sequence
  derived and/or modified sequence opt3 from AFP__Homo_sapiens__NP_001125
augaaguggguggagagcaucuuccugauuuuucuccuuaacuucaccgaauccagaacacugcacaggaaugaguacggcauagccucuaucuuggacucauaucagugcacugcugaaauuaguuuagcagaucuggccacgaucuuuuucgcgcaauuuguccaggaggcuaccuacaaagaaguuagcaagauggugaaagacgcccuaacagcaauugagaagcccacuggggaugagcaguccucuggaugucucgaaaaccagcugccugccuuccuugaggaacugugccaugagaaagagaucuuggaaaaguauggucacucggacuguugcucacaaagcgaggaaggccggcauaauuguuuucucgcucacaagaaaccaaccccggcaaguauaccccuguuccagguaccugagccagugacauccugcgaagccuacgaggaggaucgcgaaaccuuuaugaacaaguucaucuaugagauugcucgacgucaucccuuucuguacgccccuacuauccucuuaugggcggcaagauaugacaaaauuaucccaucuuguugcaaggccgaaaaugcugucgaguguuuccagacaaaagccgcaaccgugacgaaggaacugagggagagcucccuuuugaaccagcacgcuugcgccguuaugaagaauuuugggacucggaccuuccaagcgauaacagugacuaaacugucacagaaguucaccaaagucaacuuuacagagauucagaagcuagugcucgauguagcccacguucaugaacacuguugccgcggagacgugcuggauugccuucaggacggcgagaaaaucaugaguuacauuuguagccaacaggauacccugucuaauaagaucacggaaugcuguaaauugacuacacucgagagaggucagugcaucauucaugcagaaaacgacgagaagcccgaggggcuguccccuaauuuaaacagguuccugggagaucgggacuuuaaucaauucucaagcggcgaaaagaacauauuucucgcuaguuucguccacgaguacucucgccgacacccacagcuugccguguccgugauccugagagucgcuaaaggcuaucaggaauugcuagagaaguguuuucagaccgagaauccgcuggaaugccaagacaaaggggaggaagaacuccagaaguacauucaggaaagccaggcccuggcaaaaaggucguguggacuuuuccaaaagcugggugaguauuacuugcagaacgccuuucucguugcuuauacuaagaaagcgccccagcugacaucuuccgaguuaauggcaaucacccggaagauggccgcuacggccgcaaccugcugucagcugucagaagauaaacuacucgccugcggcgagggggcugccgacauaauuaucggacaucuguguauccgucacgaaaugacaccugugaacccaggcguaggucaaugcugcaccaguagcuacgcaaaucgcagacccuguuucuccucucuuguggucgaugagacuuaugugccuccagcguuuagcgacgauaaguucauuuuucauaaagacuugugccaggcucaggggguugcccugcagacaaugaagcaagaguuccucaucaaccuggugaagcagaaaccccagauuacugaggagcaacuugaagcagucauagccgauuucucaggacuguuggagaaguguugccagggccaggaacaggagguguguuuugcugaagagggccaaaaacucaucaguaagaccagggccgcacuggggguauga

SEQ ID NO: 52557 - RNA, 1041 nt, Artificial Sequence
  derived and/or modified sequence opt3 from AGA__Homo_sapiens__NP_000018
auggccagaaagagcaaccugcccgugcuccuugucccuuuccuguugugccaggcuuuaguuagguguuccucuccacugccgcuagugguaaauaccuggcccuuuaaaaacgcaacagaggccgcguggcgggcucucgccucaggcgggagugcacuggacgccguggaaagcggaugcgcuaugugugagcgcgaacaaugcgaugguuccgucggcuucgggggaucuccugacgagcuuggcgaaacuacgcuggaugcaaugaucauggacgguaccacaauggaugugggggccguuggagacuugcgacguauuaagaaugcuauaggcguggccagaaaaguccucgagcacacuacccauacacugcuggugggcgagucggcgaccacuuuugcacagucaaugggguucaucaacgaagaucucagcacaaccgccagucaggcuuuacacuccgacuggcuggccaggaauugucagccaaacuacuggcggaauguaauucccgauccuucuaaguauugcggaccauacaaacccccugguauccuuaagcaagacauuccaauccauaaggagacggaagaugaccgcggccacgauacuauagggaugguugugauccauaaaaccggacacauugcagcuggcacaagcacuaacgguaucaaguuuaaaauucacgggagagucggagacuccccgauccccggcgccggcgcguaugccgacgauaccgcaggggcugccgcugccacaggaaauggugacauauugaugagguuccugccuucauaccaggcaguggaguauaugcggcgcggcgaggauccaaccauugccugucagaaggugaucagucgaauccagaaacauuuucccgaguucuuuggggcugucauuugcgcgaacguuacgggaagcuacggcgcagccuguaauaagcuaucuacuuucacacaauuuuccuucaugguguauaacucagaaaagaaucagccuaccgaagagaaaguagacugcaucuga

SEQ ID NO: 52558 - RNA, 2574 nt, Artificial Sequence
  derived and/or modified sequence opt3 from AGAP1__Homo_sapiens__NP_001032208
augaacuaccagcaacagcuggccaauagcgcugcaaucagagccgagauucagagguucgaauccgugcaccccaacauauauucuaucuacgagcuccuugaacgggucgaggaaccuguucugcagaaucaaauucgcgagcaugugaucgcgauugaggacgcuuuuguaaacucacaggaauggaccuugagucgaagcgugccagaguuaaaggucggcaucguggggaaucuggccuccggaaaaucugcccuaguucaccguuaucucacagguacuuacgugcaggaagagucgccggagggcgggagauucaagaaagaaauagucguggauggacagucauaucugcuucugaucagggacgagggcggucccccugaagcacaauuugcuauguggguagaugcaguuauuuucguguuuagcuuggaggacgaaaucaguuuccagacggucuaccauuauuacucccggauggccaacuaccgcaauaccucugagauuccacucgugcugguggggacacaggaugcuaucagcuccgccaaccccagagucauagacgaugcgagggcacggaagcugucaaaugaccucaaacgcugcacuuauuacgagaccugugccacauauggauuaaacguugaacgaguguuucaggauguagcucaaaagauuguggccaccagaaagaaacagcagcugaguaucggcccuugcaagagccuuccaaauucucccucccacucaagcgucuguagugcacaagugucugcuguucauauuucccagacuagcaacggcgggggaucguugucugacuacuccucaagugugccuagcacaccauccaccucucagaaagagcugaggaucgaugucccgcccacggccaauacuccuaccccagugcggaagcagagcaaacgucgcucaaaccuauucacaaguagaaaggguuccgaccccgauaaggagaaaaagggccucgagagcagggcggacucuaucgggucaggacgggccauuccuauaaaacaaggcaugcugcuuaagcgaagugguaaaagccugaauaaggaauggaaaaagaaguauguaacuuugugcgacaacgggguucucaccuaccacccaucccugcacgauuauaugcagaacgugcauggaaaagagaucgacuuacugcgcacaaccgucaaggugcccggcaaaagaccgccuagggcaacgucugcuugugcccccauuucgagcccaaagacuaauggccucuccaaagauaugucaagucuucacaucucuccuaacagcgggaaugucacauccgcuucaggaagccagauggccucugguauaucccuggugaguuuuaacagccggcccgacggcaugcaucagcgcucuuacuccguuucaagugcagaucaauggagcgaggccaccgugauugcuaauucggcgaucuccucugacacuggguugggagauagcguaugcucaaguccauccaucucuagcacaaccucccccaagcuagacccuccaccgucaccccacgcaaacagaaagaaacacaggcguaagaaaagcacgaguaauuucaaggccgauggccugucugguaccgcugaagaacaggaagagaacuuugaguucauuaucgucucccucacagggcagacuuggcauuuugaagccaccacauacgaggaacgggacgcaugggugcaggccauugagagccaaauacuggcuucgcuucagucaugugaaucuaguaaaaauaagucccgacugacuagccagucugaggccauggcauugcagagcaucagaaacaugaggggcaauucccacugcguugauugugagacccaaaacccuaauugggcgucacucaaccugggagcuuuaaugugcauugaauguaguggcauccaucgcaaucuggggacacaccuaagccgggugagaucucucgaccuggacgauuggccagucgagcuuaucaaggugauguccucaauuggaaacgaauuggccaacaguguaugggaggaaagcucccaggguaggaccaaacccucuguggacucgacucgcgaggagaaggaacgauggauacgggcaaaauaugagcagaagcuguuccucgccccucugccaugcacggaacuuagccugggccaacauuugcuccgugcuacagccgaugaggaccugagaaccgcaaucuuacugcuagcucacgggucaagggaugaaguuaaugagacuugcggagagggcgacggucgcaccgcccuccaccuggcgugucggaaagggaacgucgugcuugcccaguugcugauuugguacggcguggaugucacagcuagagacgcacauggaaauaccgcccucgcuuaugccaggcaggcauccagucaggaaugcaucgauguucuguuacaauacggcugucccgacgagcgauucgugcugauggcgacuccgaaccuuucucgccggaauaacaauagaaacaauagcuccgggagggugccuacaauuaucuga

SEQ ID NO: 52559 - RNA, 3579 nt, Artificial Sequence
  derived and/or modified sequence opt3 from AGAP2__Homo_sapiens__NP_001116244
augagcagaggcgccggggcucugcagaggcggaccacaacuuaccucaucucccuuacgcuggugaaguuggagucuguucccccuccaccgcccucaccuagugcagccgcggcuggagccgccggugcccgcggcagcgaaaccggggacccaggaucaccccgaggcgcugaggaaccugguaaaaagcgucacgagagauuauuccauaggcaagaugcacuguggauuucuacaucgucagccgggacuggaggcgcugaaccacccgcccuaagcccugcgccagcaaguccggcccggcccgucuccccugcuccaggccgcagacucucucugugggccgugcccccugggccaccccuuagcggaggucuguccccggacccuaaacccggcggggcaccaaccucaaguaggcggccuuugcucagcucucccuccuggggaggcccagagcccgagggucgcgcugggggaggcauaccuggcucaagcaguccacacccggggacaggaucucgaagacugaagguagcacccccuccacccgcgccuaaaccaugcaagaccgugacuacauccggugccaaggcaggcgggggaaaaggcgcugguagcaggcugucguggcccgaaucugaggggaagccgcgggucaaaggcuccaagucaagugccggaaccggcgcuagcguguccgccgcagccacggcugcggcagccgggggagguggcucuacugcuagcaccucagggggaguuggcgccggugcaggggcccguggcaaacucaguccucgcaagggaaaguccaaaacauuagauaacagcgaccugcauccaggacccccugcugggucucccccaccucuuacuuugcccccaaccccguccccugccacagcagugaccgcggcuagugcccagcccccaggacccgcaccuccaaucacgcuggaacccccugccccgggucuaaagagaggcagggaagggggacgggcuagcacucgagaucgcaaaaugcucaaguuuauuuccggcaucuucacaaaaucuaccggugggccacccggcucgggaccucugccagggcccccuagccuuuccucagggaguggaucuagagagcuguugggcgccgaacucagggcaagcccgaaggcugucauuaauucccaggaguggacucugucacggagcauccccgaauuacgccugggugugcucggggacgccagaucuggaaaauccagucuuauacacagguuucugacaggcagcuaucagguauuggagaagaccgaaucugagcaauacaagaaagagaugcuaguugauggucagacgcaucuggugcucauccgugaagaggcgggcgccccagacgcuaaguucuccgggugggcagaugccgucauuuuuguguucucacuggaagacgagaacaguuuucaggcugugagccggcuucacggacagcugucguccuugcgaggcgaagggagaggaggccucgcccuggcauuagucgguacccaagauaggaucucugcgagcucaccucgcguugugggggacgcccgggcuagagcccugugugcagauaugaaaaggugcaguuauuacgagacaugugcuacuuauggacuaaauguagaccgcguguuccaggaggucgcccagaaggugguuacccuccgaaaacagcaacagcugcuugcagccugcaaguccuugcccucuagcccaucccacucagcugcgagcacaccuguggccggccaggcaaguaacgguggccauacuucugacuacuccagcucgcugcccucaucuccaaaugucgggcaccgggaacuccgugcugaggccgccgcuguggcaggacugaguaccccgggcucccuucauagagccgcgaagaggcgcacaagccuguuugcuaaccggagagggucugauagcgagaaaagguccuuggacucacgaggagagaccacuggcaguggucgcgccauuccuaucaagcagagcuuccuccugaaacggucuggcaauuccuuaaacaaggaauggaaaaagaaguauguaacgcugucaaguaauggauuucuacucuaccaccccagcauaaacgauuacauucacuccacacauggcaaagagauggaccugcuuagaaccacuguuaaggugccagguaaaaggcccccucgugcaaucucugccuucggcccaucggcuagcauuaauggguuggucaaggauaugucaaccgugcaaaugggagagggccuggaagcaacaacccccaugccuuccccgaguccaucucccagcucccuccagccucccccagaccagacuucaaaacaccuguuaaagccugaucgcaaccuggcccgggcgcuuucuacagacuguacgcccagcggggauuugaguccacucuccagagagccuccgcccagcccaauggucaagaaacaaaggcgaaagaaacugaccacuccuucuaagacagaaggaucagcuggccaggccgaggcaaaacggaagauguggaaacuaaaguccuuugguagucugcgcaauaucuauaaggccgaggaaaacuucgaguuccucaucgugagcucgaccgggcagacauggcauuuugaagcugccucuuucgaggaaagagacgcauggguucaggcuauugagucccaaauacuggccagccuucagugcugugagucaaguaaagugaaguugaggacugauucucaguccgaagcgguagccauccaggcaauucggaaugcuaaaggaaacagcaucugcgucgacuguggcgcccccaacccaaccugggcuucacugaauuuaggcgcacucauaugcauugaguguagugggauccaccgaaaccugggaacgcaucuuagcagagugcgcucccuggacuuggaugacuggccuagggaacucacccugguucuaacagccaucgguaaugauacugccaaccgugugugggagucugacacccggggcagagcuaagcccagcagggauuccucacgcgaggaacgagagucuuggauuagagcgaaauacgaacaacugcucuuucuggcaccgcuuaguacaucggaggaaccauuggggcggcagcugugggccgcuguccaggcccaggacguggcaacuguauuacuccugcuugcccacgcuaggcacggaccucuggauaccagcguggaggacccccaacuacgcuccccacuccaucuggcggccgaauuggcacacguugucaucacgcagcuguuacucugguauggcgcugauguggccgcacgugacgcccaggguagaacagcucuguucuacgcccggcaagcggggucucagcuuugcgcagauauucuguugcagcauggaugccccggcgagggcgggucagccgcuaccacuccuagcgccgcuacaaccccguccauaacugcaacccccaguccaaggcgccgaucuagcgccgcuucagugggcagagccgacgcaccugucgcgcucguuuga

SEQ ID NO: 52560 - RNA, 1191 nt, Artificial Sequence
  derived and/or modified sequence opt3 from AGAP3__Homo_sapiens__NP_001036000
augaacuuccaggccggcgggggacaaagcccccagcagcagcaaucccuggcugcaccugguggcgggggagccgcggcucagcagcucgugugcggcggucaguuugggggagccggcccaggcgcagggggagguggcgggccgucucaacagcuugccggaggucccccucagcaguucgcucugucaaauagugcagccaucagagcugagauucaaagguuugaaagcguccacccaaacauauacgccaucuaugacuugauugagcggaucgaagauuuagcgcugcagaaucagauucgcgagcauguuaucuccauagaagacucuuucgugaacucgcaagaguggacccuaucacgaagcguacccgagcucaaggugggcaucgucgggaaucugaguuccggaaaaucugcacuugugcaccguuaccugacaggcacuuauguucaggaagagagcccugaaggcgggagauuuaagaaagagauuguggucgauggacaguccuacuugcuccugaucagggacgaggguggcccacccgaacugcaguucgccgcuuggguggaugccguaguuuuuguguucucacucgaggacgaaauuaguuuucaaacggucuauaacuacuucuuacggcuguguagcuuucgcaaugcaucugaggugccuauggugcuugucgggacccaggaugcuaucuccgccgcgaacccaagaguuauagacgauucaagggcccggaaguugagcacagaccugaaacgcugcacuuauuacgaaaccugugcaacauacggacuaaauguggagcgaguauuccaggauguggcucagaaggucguggcccucagaaagaaacaacagcuggcuauuggcccgugcaagagucuucccaacucuccuucccauagcgccguuucggcagccucuaucccagcugugcacauuaaucaggcgaccaacggugggggcuccgcauuuucagacuauaguagcuccguccccucuacuccuagcaucucacagagggagcugcggaucgaaacaauugccgcuaguuccaccccaacgcccauacguaaacaaagcaagcgcagaucuaauaucuucacuauuugugccaccgugucaaacuucaguagcacaaaaaggccguuucaguugcucccuaauuga

SEQ ID NO: 52561 - RNA, 1992 nt, Artificial Sequence
  derived and/or modified sequence opt3 from AGAP4__Homo_sapiens__NP_597703
augggcaacauccugaccugcagagugcaccccagcgucucccucgaguucgaccagcaacaggggucuguuuguccuucagaaagugagauuuacgaagccggagcuggugauaggauggcaggcgccccaauggcggcugccgugcagccggcagagguaacaguggaagucggggaggaccuucauaugcaccaugugcgggaucgcgagaugcccgaagcccuggaguuuaauccuagcgcuaacccagaagcauccacuauauuccagcgaaauucucaaacggacguuguggagauccguagaucgaacugcaccaaucacgucucaacagugagguuuagccagcaguauaguuuguguuccacuauuuucuuagaugacucuaccgccauccagcauuaccugacaaugaccauuaucagcguaacucuagagauaccccaccacaucacacaacgggaugcugaccgcucccucucaauuccugaugaacagcugcauaguuuugccguuagcaccgugcacaucaugaagaaaagaaacggaggcgguucucuuaauaacuauuccucaagcauuccaaguacgcccucuacuucccaggaggacccucaguucagcgucccaccgaccgcgaauacacccacuccugugugcaagaggucgaugcgguggucuaaccuguuuaccuccgaaaaagggucagauccagacaaggagcgcaaagcacccgaaaaucaugccgauacaaucggaaguggccgagcuauaccuauuaagcaaggcauguugcucaagagaagcgggaaauggcugaagaccuggaaaaagaaauacgugacgcuguguuccaacggaguccucacuuauuacucuagcuuaggugacuauaugaagaauauccacaagaaagagauugaccugcagacaucaaccaucaagguuccaggcaaauggcccagucuugccacuuccgcaugcacaccgaucagcaccucuaagucaaacggguugaguaaagauauggacacgggacugggcgauagcauuuguuucuccccuucuauaucgagcaccacaucccccaagcuaaauccaccucccucaccacacgcuaacaaaaagaagcaucucaaaaagaaaaguacuaacaauuuuaugaucgugucugccaccggucagacauggcacuucgaggcgacuaccuacgaagagagggacgccuggguacaagcaauucagagccagauccuggcuucccuucagucaugcgaaagcucuaaguccaaaagucaacugacaagccagucuaaggccauggcuuugcaguccauacagaacaugcgggggaaugcccauuguguggauugcgagacccaaaaccccaagugggcaucacucaaucugggagucuuaauguguauugaaugcaguggcauccaccguagccugggcacucgccucucgagagugaggucccuugagcuggacgauuggccuguugaguugcggaaagugaugucuagcaucgggaacgaccuagccaauucaauuugggaaggaaguucccagggucagacgaagccaucugagaaaagcacacgagaagagaaggaacgcuggaucagauccaaauacgaggagaagcuguuucucgcuccgcugcccugcaccgaacuuucacugggccagcaauugcucagggcgacugcagaugaggaccugcagaccgccauuuuacugcuagcucaugggagccgggaagaggucaacgagacauguggagaaggcgaugguugcaccgcccuccaccuggcaugucgcaaggggaaugugguacuugcccaguugcugauaugguauggcguugacgugauggcuagagacgcccacggaaacacugcacucacauacgcgaggcaggcuaguucucaagagugcaucaauguccugcuucaguauggcuguccugauaaaugcguguga

SEQ ID NO: 52562 - RNA, 3201 nt, Artificial Sequence
  derived and/or modified sequence opt3 from AGBL1__Homo_sapiens__NP_689549
augaucagcaagggcggguccgaggcccugcuccagacccuuguggacacagcuagaacugcacccccugauuacgacauucuguugccauuauucaggcugcuagccaaagucggacuccgggauaagaaaauaggucgcaaggcgcuggaacuugaggcucuggacguuacguugauccucgcccguaaaaaccugucucacggccaaaaucugcuccauugcuuaugggcacugcgaguguuugccucaaguguaagcaugggggcuaugcuuggaauuaacggcgcaauggaauugcuguucaaggugaucaccccguauacaagaaagaggacucaggccauucgggcugccaccgagguccuagcggcacuccugaaauccaagucuaauggucgcagagccgugaacaggggguacguuacaucgcuucugggauugcaccaggauuggcauucacacgacaccgcuaaugccuaugugcagauccggcgcggccuccuguuaugucugcgacauauagcagcucucagaagcggcagggaagccuuucuugcggcccaagggauggagauccuguucaguacuacacagaacugcuuggaugacaaauccauggagcccgucauuucugugguacuacagauccugcggcaguguuacccuaccagcccacucccccugguuacggcauccucagcuuaugccuuuccugugccaggaugcauuacuaccgaacccccucacgaucuuccagaggaagacuucgaggaugacggugaugacgaggucgacaaggauagugacacagaagauggcaaaguggaggacgaugaccuggaaacugaugugaauaaguugagcucuaagccggggcucgaccgucccgaggaggagcugaugcaauacgaggucauguguuuagaacuguccuauucauuugaggaacuacagagcaaacucggagaugaccugaacagugagaagacccaguacgcuaaucaccaucacaucccugccgcagccucuuccaaacagcauugcuacagcaaggaucaaucgucuuguggccaggaacgcgaguaugcuguucagacaucccuuuugugcagagugaaaaccgguaggucaacgguacaccuggggaguaagaaaaacccaggagugaaucucuaccaaaacguccagagcaauucccugcggcgagacucuagcgagucagaaauacccgacauucaggcgaguccuaaggcagaugccugggacguggaugcuaucuucuguccacgcauguccgccagcuuuucuaacucaacuagaacaagggagguugugaaggucauugacaaacuucugcagacccacuugaagcgggugcccuuccaugauccguaucucuacauggcaaaagcccgcagaacaaguagcguaguugacuuuaagaugauggcuuucccugauguguggggccacugucccccaccuacuacccaacccaugcuggaaaggaaaugcggcguccagcguauccggaucuuugaggacauucgaagauuaauacagccauccgaugugaucaauaaggucguguucucucuggacgaacccuggccucuacaggauaacgccucgaacugccucagguucuuuagcaaguucgaguccgggaaucugcgcaaagcaauucaaguucgggaguuugaauaugaccuuuuggugaacgcggauguaaauucaacgcagcaucagcagugguucuacuuuaaggucaguggaaugcaagcugccaucccauaucacuucaacauaauuaauugcgagaaaccgaacucucaguuuaauuacgguaugcagcccacccuguacagcgugaaggaagcacuccugggcaaaccuacauggaucagaacugggcaugagaucuguuauuacaagaaccacuauaggcaguccaccgccguugcuggaggcgccucagguaagugcuacuauacauuaacuuucgcagugaccuuuccacacagcgaggacgucuguuaccuggcuuaucauuaccccuacacauauaccgcccuuaugacucacuuggacauucucgaaaaaucugugaaucugaaggagguauacuuccgccaagaugugcuaugccagacgcucgggggcaacccuuguccacugguuacaaucaccgcgaugcccgaauccaauagugacgagcaucuggaacaguuucgacaccggccguaucaagucauuacugcccgugugcacccuggagagagcaacgcuucuugggugaugaaaggcacccuugaguucuuggucuccucagauccaguugcaagacuguuaagggaaaauuuuauauucaagaucauucccaugcucaacccugacggggugaucaauggaaaccaucgcugcagucugagcggugaggaucuuaaccggcaguggcugucgcccuccgcccacuugcagccaacaaucuaccaugcuaaaggccuccuguaucaccuaucuagcauugggagaucaccugugguauucugugacuuucauggacacagucagaagaagaaugucuuccuguacggcugcuccauaaaagaaacccucuggcaagccgcauguacuguggguacaucuacgauccuggaggaaguuaacuauaggacccuucccaagauuuuggauaaacuggcgccagccuuuacuaugagcuccugcucauucuuaguggaaaagagccgagcuaguacagcccgcgucgugguuuggcgggagaugggggugucuagauccuacaccauggaaagcucguacuguggcugcaaucagggaccguaucagugcacacagaggcuccuggagcguacuaaaaacgaacgcgcacacccuguagacggccuucaagggcugcaguuuggaacccgggagcuagaagagaugggugcuauguucugucucggccuguugauccuggaguuaaagucagccucuugcagucaucagcuccuggcacaggccgcuacgcuucuguccgcggaagaggaugccuuggaccaacaccuccagagacugaaaagcucuaauuuucuacccaagcauauuugguucgcauaccacuuuuucgcuaucaccaacuuuuucaagaugaaucugcuucuccaugucagcccagugugugauacauga

SEQ ID NO: 52563 - RNA, 2709 nt, Artificial Sequence
  derived and/or modified sequence opt3 from AGBL2__Homo_sapiens__NP_079059
auguuccccgcccuggagacccaccucaagcagacaaucccugacccauacgaagauuuuauguauagacaucuucaauacuauggcuacuucaaagcucagagggggagccugccgaacuccgcaacucaccagcaugugcggaagaauaacccccagugcuuguuaaauggaucucugggugagaaagacgaucuaauuccugacacgcuccaaaaggaaaaacugcuuuggccaauaucacugaguagcgccguccaccgccagaucgaggcgauuaaccgagauuuucauuccuguuugggcuggaugcaguggcgugggcucucuucgcugcagcccccuccacccagauucaaggacagcccugcuucagccuuuaggguugcaggaaucaccgauagucacaugcugucccucccacacuuacggucucgccaacugcuuuaugacgaauuggaugaggugaauccgagacugagggagccccaggaacuauucagcauucucuccacaaagcggccucugcaggccccacgcuggcccaucgagugcgaaguaauaaaagagaacauccaucacauugagugggcuccuccacagcccgaauacuuuuaucaaccgaagggcaaugagaaagugccugaaaucgucggugagaagaaagggacugugguuuaccagcuugacucagugcccauugaaggaaguuacuucaccagcucucgagucggcggcaagagagggaucgugaaggagcuggcaguaacauugcagggaccagaggauaacacccuccuguuugaauccagguucgagucagguaauuuacaaaaagccguucggguggacacuuaugaauacgagcugacacuccguaccgaucuuuauacgaacaagcauacucagugguuuuacuuccgcguccagaauaccagaaaagacgcuacauauagguuuacuauagugaaccuguugaagccuaaaagccuauacaccgugggcaugaagccccugcucuauagucagcuggacgccaauacacggaacauuggguggcgacgcgaaggaaaugagaucaaauacuacaagaacaacaccgaugacggccaacagccauucuauugucuuacguggacuauucaguuccccuacgaucaggacacaugcuuuuucgcgcacuuuuauccuuacaccuauacugaucugcaauguuacuugcucucugucgcaaauaacccaauccagucccaguucugcaagcugcagacauuauguagaagccuggccgguaauaccguuuaucuacucacgaucaccaacccgucgcaaacaccccaggaggcugccgcaaagaaggcugugguacugucugccagggugcacccuggggaauccaauggaucaugggucaugaaaggcuuucuugacuucauuuugaguaacagcccagaugcgcagcugcuccgggacauauuuguguucaagguucugcccaugcuuaauccugauggcgugaucgucgggaacuaccgcugcucccuggccggaagagacuugaauaggcauuacaaaacuauucucaaggagucuuuuccauguaucugguauacccguaacaugauaaagcggcuguuagaggaacgagaagugcugcuauacugcgauuuccacggucauagcaggaaaaauaacauuuuucucuauggcuguaauaacaauaacagaaaguacuggcugcacgagcgcguauucccccuuauguugugcaaaaacgcaccggacaaguuuucauuccauaguugcaauuucaaaguucagaaguguaaggaggggacaggacggguggucauguggagaaugggcauccugaacuccuauacuauggaaagcaccuuuggugggucuacacucggcaauaaaagggacacccacuucacuaucgaggaucugaagucauuaggauaccacgugugcgacacgcugcuugauuuuugugacccugaucaaaugaaauucacacagugcuuggcugaacucaaggagcugcuacgccaggagauucauaaaaaguuucacgaacugggccaagacgucgaucucgaggggaguuggagcgacaucucccugucugauauugaaucgagcaccuccggaucagacaguucucuuagcgaugguuugccagugcaucuggccaacauagcugacgaguuaacucagaagaaaaagauguucaaaaagaaaaagaaaaagucccuccagacccgaaagcagcggaaugaacaauaucagaaaaagaaccugaugcagaaacuuaagcugacagaggauaccucagagaaagccggcuuugcaagcacuuugcagaagcaacccacauucuuuaaaaauucugaaaacuccaguuuccucccuaugaaaaaugagaacccccgucugaaugaaacgaaccuaaauagaagggacaaggacaccccacuggauccuagcauggccacucucauccugcccaaaaacaaggggcgcaugcagaauaaaaagccaggauuuacaguuucuuguuccccgaagcggaccauuaacucaagucaggagccugcucccggcaugaaaccaaacuggcccagaagcagguacccugcgacaaagcgagguugcgcagccauggcugccuacccaucgcuucacaucuauacuuaccccuga

SEQ ID NO: 52564 - RNA, 2763 nt, Artificial Sequence
  derived and/or modified sequence opt3 from AGBL3__Homo_sapiens__NP_848658
augagcgaggacuccgaaaaggaggauuacucugacagaaccaucucagaugaagacgagagugaugaagacauguucaugaaauuugugagcgaggaucugcacaggugcgcccuccuuacagcugacuccuucggcgaucccuuuuucccucggacuacgcagauucuguuggaguaucaauuagggcgcugggucccacgacugcgugaaccgagagaccuauacggaguuucuucgucagguccccucagcccuaccagguggccauaucauugugaggugauagaugaaaagguacagcacaucgacuggacacccaguugcccugagccaguguacauucccacuggccuggagaccgaaccucuuuauccagauuccaaagaggcaacagucguguaccuggccgaagacgcguauaaggagccguguuuuguuuacucucgggucgggggaaaccgcacccccuugaaacagccuguggacuacagagauaauacucucauguucgaagcuagguuugagagcggcaaccugcagaaggugguaaagguugccgaguaugaauaccaacugacagugcggccagaccucuucaccaauaaacauacgcagugguauuacuuucaggucacuaacaugcgcgcagguaucguguaucgauucaccauugugaauuuuacaaagcccgccuccuuauacucaagagggaugaggccucuguucuauagugagaaagaagcuaaggcacaccauaucggauggcagcggauaggcgaucaaaucaaauacuaccguaacaauccaggccaggacgggcgccacuauuuuagccuuacuuggaccuuccaguucccccacaacaaggauacaugcuacuuugcccauuguuauccguacaccuauacgaauuugcaggaguaccugucuggaauuaacaaugacccugucagauccaaguucugcaaaaucaggguucuaugucacacucucgcucggaacaugguguauauucugacaaucaccacuccccuuaaaaauucagauagccgaaaacgcaaggccguaauacugacagcgagagugcauccaggugaaaccaacaguucuuggauuaugaaaggcuuuuuggacuacauccucgggaauaguagcgaugcacaacuguuaagggacacguucgucuuuaaggugguuccuaugcugaaccccgauggagugauugucggcaacuaccggugcucgcucgccggucgcgaccuuaauagaaacuauaccucucuguugaaagaguccuucccaucagugugguacacaaggaauaugguacaccgucuaauggagaagcgggaaguuauccuguauugugaccuccacgggcauagucgaaaggagaacaucuuuauguacggaugcgauggcagcgacagauccaaaacucuguaucuucagcagaggauuuucccccugauguugucuaagaauuguccugauaaauuuagcuucucagcuugcaaguuuaacgugcaaaaauccaaggaaggcaccgggcgcgucgugauguggaagaugggaauaagaaauuccuucacaauggaggccacuuuuugcgguagcacccucggcaacaaacgggggacacacuucucuaccaaggaccuggaaucaaugggauaccauuucugugauaguuuacuggacuauugcgauccagacaggacuaaauacuaccgcugucuaaaggagcucgaggaaauggagcgacacaucacgcuggaaaaagucuuugaggauagcgacacaccggugauugauaucacccuugacguugaguccucuucgcggggcagcgauuccucagaaaguauagacucuuugacuuaucugcucaagcugaccagccagaagaaacaucuuaagacaaagaaggagcguaauuccaccauugcaucacaccagaacgcuagaggucaggaaguguacgacagggggcaccuguugcaacgccauacucagagcaauucugauguaaaagacacacggcccaacgagccugaugacuauauggucgauuacuucagaaggcagcucccaaaucagggccuggacuuacaccauaaccugaaguccaagaucaaagaaugcaucaguuuucaaagcaagaaaacgggaauuaauuggaccgaugacgagaagcgaucuuauaaagauaagggcaucgugcagacucaggagauucuacaguaccuccugcccauaguucacuccaccaaaaacaugcaaacaacacagaucaagcagcuuuucaacccucgcacuaauuuucagauucaacaccaguugaacccagccaccugucggaauaucaagaaauauucaacgaguuggaccgcgcccagaaaccauccguucgugauccagggggacgucauggccaauagcucggaaugggugcaauccaagccucacaggucucuggagagccucucaccacugaaaggacccaagaaaaacaagcauagucagauuugggcaauaaagaaugaagauaucaaaccuuuauccucuaagugggagacagcuagcuccucauuugguauggacgccaacguacugaaauacaagagccuucaggcugaagagacuaaucagcaaaguucuaaacacaccgccuugcaucucacaaagaacaaggaugagcaggcaaauaaaaacgacggccagcccacucuguaccuaaaguuccagcgugaauccuga

SEQ ID NO: 52565 - RNA, 1521 nt, Artificial Sequence
  derived and/or modified sequence opt3 from AGBL4__Homo_sapiens__XP_011540611
auggccgagggcagccaguccgcucccgaagcagggaacgacaugggaaaugaugacgccaucgguggcaacgugucuaaguacauuguccugccuaccggguauugcggacaaccaaagaagggccaccucauauucgaugcguguuuugagucagguaaucuugggagaguugaccaggugagugaguucgaguacgaucuguuuaucaggccggacacaugcaacccccgguuccgcguaugguuuaauuucacuguggaaaacgucaaagagagccaggugcgagagauuguugauacguuucguguggucuugagagugaucuucaauauuguaaacuuuuccaagaccaaaucuuuauauagggacggaauggcuccuaugguuaagucgacaucacggccaaaguggcagcgccugcccccuaaaaauguguacuauuacagauguccagaucauaggaagaacuaugucaugagcuucgccuuuugcuucgaccgggaagaggauaucuaccaauuugcauacuguuaucccuacacuuauacccgcuuccagcacuaccuagacagucuccagaaacgaaauauggauuauuucuuuagagaacagcugggccaauccgugcagcagaggaaacuugaccuguugacaauaaccucuccugacaaccuccgggagggcgccgagcagaaaguggucuucaucacugggcguguucauccaggagaaacaccgagcuccuuugugugccaagguauuaucgauuuccugguaucacagcaccccauugcuugugugcugcgcgaguaccucgucuuuaagaucgcaccuauguuaaauccagacggcguguaucuggggaacuacagaugcagucuuaugggauucgauuugaauaggcauuggcuggaccccagcccuuggguucacccaacccuacacggcgugaagcagcucauaguccaaauguacaacgaucccaaaacgucucuggaauuuuauauugacauccaugcccacuccacuaugaugaacgguuucauguacgggaauauuuuugaggaugaagaacgguuccagcgacaggcuaucuuuccgaaacuucugugucagaacgccgaggacuucucauauagcaguaccucuuuuaaucgcgaugcggugaaggcaggaacaggcagaagguucuugggcgggcuccuggaccauacuuccuacugcuauaccuuagaaguuagcuucuacucguauaucauuucuggaacaaccgccgcuguaccuuacacggaggaagccuacaugaagcugggucggaacguggcacgcacuuuucucgauuauuacagacuuaaucccgucguggagaaagucgcuauaccaaugccuaggcugcguaaggaaaaaucacccccauauaagcaccccuugcuacggggcccugccuccaacuacccaaauaguaagggggacaaaaagagcuccgugaaccacaaagacccgucuacacccuucuga

SEQ ID NO: 52566 - RNA, 1215 nt, Artificial Sequence
  derived and/or modified sequence opt3 from AGER__Homo_sapiens__NP_001127
auggccgcuggcaccgcagugggggccuggguccugguucucagccuuuggggagcggugguaggugcucagaacaucacagccagaauuggcgagccccugguguugaagugcaaaggggcaccuaagaaaccaccgcaaagguuagaauggaagcugaauacuggacggacggaggccuggaaaguccuauccccucagggcggugggccuugggacucuguggcucgcguucucccaaacggaucacuguuccuucccgcagugggcauacaggaugaaggcaucuuucgaugucaggccaugaaucguaacgggaaggagaccaagaguaauuacagagucaggguguaucaaauuccuggaaaaccagaaaucguagacagcgcuuccgagcugacagccgguguucccaacaaggugggcacuugcgucucugaggggucguacccugcgggaaccuugucauggcaccucgauggcaaaccacuggugccgaaugaaaagggugugagcgucaaagagcagacacggcgccaucccgaaaccgggcuguucacucuccagagugaguuaaugguuacacccgcaagaggaggcgacccaaggcccaccuuuuccuguucuuucagcccuggccugccacggcaccgcgcccuucgaacggcucccauucagccgagagugugggagccuguacccuuggaagaggugcaacuggucguggaaccagaagggggagccguugcaccugguggcacugugacccuaacaugcgaaguccccgcucagccaucaccccagauccauuggaugaaggauggggugccucucccacugccgcccuccccuguacuuauacugccagagaucggaccccaggaccaaggcacuuauaguuguguugccacccacagcucucaugguccucaggaguccagggcggugucaauuagcaucauugaaccaggggaggaaggccccacagccggaagugucggcgggucuggauuggguacccucgcacuggcuuuaggcauccuugggggacucggcacggccgcucugcugauaggugugauuuuguggcagcggcgucaacgcagaggggaggaaaggaaggccccggagaaccaggaggaagaggaggagcgggcagaacuaaaucaguccgaggagccugaagccggcgagagcucgacuggaggcccauga

SEQ ID NO: 52567 - RNA, 1755 nt, Artificial Sequence
  derived and/or modified sequence opt3 from AGFG1__Homo_sapiens__NP_001128659
auggccgcuagcgcaaagagaaaacaggaggaaaagcaccugaaaaugcucagggacaugaccggccuuccccauaaccggaagugcuucgauugugaccaacgcgggccuacauacgugaauaugacugucggauccuuuguuugcacgucuuguucagguagucugcgaggcuugaacccaccgcaccgugugaaaagcaucuccaugaccacauucacucagcaggagauugaauuuuuacagaagcaugggaaugagguaugcaagcaaauauggcugggacuauucgaugacagaucuucggccauccccgauuuuagggacccucagaaagugaaggaguuccuccaggaaaaauaugagaagaaacggugguacgucccacccgaacaggcgaaggugguugcuucagugcacgccagcauuaguggcuccucugcaagcuccaccucaaguacaccugaggucaagccacugaaaagccuucugggugauucugcccccaccuugcaucucaacaaggggacuccuucccaaucaccagugguaggacgcagccagggccagcagcaagagaaaaagcaguuugaccugcugagugaucucggcucugacaucuucgcugcaccggcuccccaguccacagccaccgccaauuuugcgaacuucgcacacuuuaauagccacgccgcucaaaacucggccaaugcagauuucgcuaacuuugacgccuucgggcagucuuccggaucaaguaauuucgguggcuuuccuacggcgagccauuccccauuccagccccagacuaccgccuuuagaauguuaucuagcucauguaguuucggggaauuuacauccgcauucccucugcaagcuacucacagcggaucugccgcuucaguuaacgccaauuuugcacauuucgauaacuuuccaaaaaguagcuccgccgacuucggcaccuuuaauacaucucagucgcaccagaccgcuagcgcgguguccaaggucucaacgaacaaagcaggucuucagacugccgacaaguaugcugccuuggcaaaccuggauaauauuuucagugccgggcaaggaggcgaccagggcucuggguuuggaacaaccgguaaggcucccgugggcagcguggucuccguuccgucacagagcucugccuccagugauaaauacgcagcgcuagcugagcucgacagcguguucucuuccgccgcaacuucaaguaacgccuauacaagcaccucgaaugcuuccucuaacguauucgggacggugccugucguggccagcgcacagacccaacccgcuucaaguuccguuccagccccuuuuggagcgacacccucuacuaauccauucguggccgcugcaggccccagcgucgccuccucaaccaacccuuuucagacaaaugcuaggggugccacugcagcgaccuucgggacagccagcaugaguaugccaaccggcuuuggaacuccggcucccuacucucugccuacguccuucagcggcucguuucagcagccagccuuccccgcacaagcugccuuuccucagcagacagcauucucacaacagccaaacggguuugccgcuuucggacagaccaagcccgugguaacuccguuuggucagguugcggccgcaggcgugucuaguaauccuuucaugaccggggcuccaacaggacaauuccccaccggcuccagcucuacuaacccuuuucuuuga

SEQ ID NO: 52568 - RNA, 1446 nt, Artificial Sequence
  derived and/or modified sequence opt3 from AGFG2__Homo_sapiens__NP_006067
auggugauggccgcuaagaaaggccccgggccuggagguggcgucagcgggggaaaggcagaggccgaagcggcuuccgagguuuggugcagaagggugcgggaacugggcgguuguucucaggccgggaaccgccacugcuucgagugugcacaacgaggaguaaccuacguggacaucacagucggcucauuugugugcacuacguguaguggccuccuucgugggcugaauccaccgcauagaguuaaaagcauuuccaugaccacauucacugaacccgagguggucuuuuugcagucuaggggaaacgaggugugccggaagauaugguuaggucuguucgaugcccgcaccucgcuaguaccugacucaagagauccacagaaaguuaaggaauuucuccaggagaaguaugagaaaaagaggugguacgugcccccugaccaagucaaaggcccaacauauaccaaggggagcgcuaguacucccgugcagggauccaucccugaaggcaaaccacugcggacacuucugggugauccggcacccucuuugagcguggccgcuuccaccucaagucagccugucagccagucucacgcccgcacgucccaagcgcgaucaacucagccacccccucauagcaguguuaagaaggcaucuaccgaccuccuggccgauauugggggagacccauucgcugcaccccagauggccccggcuuuugccgcguucccugccuuuggcggccagacacccucccaagggggauucgcaaauuuugaugcuuucagcucggguccaucuuccucaguguuuggcagucugccucccgccgggcaggcuagcuuccaggcccaaccaacucccgcaggauccucucagggcaccccuuucggugccacaccacucgcuccggcgagccagcccaacucauuagcagacguagggaguuuucugggcccuggagugccagccgcuggcguccccuccagccuuuucgggauggccggacaggugccuccauugcaaucuguuaccauggguggcgggggaggcucaaguacgggucuggcauuuggggccuucacuaaucccuuuacagcuccggccgcacagagcccucuaccauccaccaaccccuuccagccuaauggccucgcgcccggaccaggcuuugggaugucuucggcuggaccugguuucccccaggccgugccaccgacuggcgcauuugccagcuccuucccugcuccccuguuuccaccccaaacaccucuuguccagcagcagaacgggucaaguuucggagaucugggcucugccaaauugggucaaagaccacucagccagcccgcagggaucuccaccaauccuuuuaugacgggcccgucaagcucuccauucgcuuccaagcccccuaccacaaacccauuccuguga

SEQ ID NO: 52569 - RNA, 2145 nt, Artificial Sequence
  derived and/or modified sequence opt3 from AGGF1__Homo_sapiens__NP_060516
auggccagcgaggcucccuccccuccaagaucuccgcccccuccaaccucacccgaaccugagcuggcacagcucaggcggaagguggaaaaacuugagcgcgaacugcgaaguugcaagcgucaagucagagagaucgagaaauuguuacaccauacagaaaggcuguaccagaacgccgagagcaauaaccaggaacuacggacucagguugaggagcucuccaagauucugcaacgcggcagaaaugaagacaacaaaaagucugauguggagguacagacggaaaaucacgcgccauggucgauaucagacuauuucuaccagaccuauuacaacgaugugagccuucccaauaaggucacagagcugagugaccagcaagaucaggcuaucgaaacuuccauuuugaacucuaaagaccaucuccagguggagaaugaugccuauccugggaccgacaggacagagaacguuaaguaccgccagguggaucacuuugcaagcaauucccaagaaccagccucagcucuggcaaccgaggacacuucccuggaaggaagcucucucgccgaguccuuacgggcugccgcggaagcagccgucucacagacagguuucagcuaugaugagaacaccggccuguacuuugaccauaguacgggguucuacuaugauucugagaaucagcuuuacuaugacccguccacuggaaucuacuauuacugugacguggaaagcggccgauaucaauuucacucgagaguagauuugcagcccuacccuaccucuuccacaaaacagucaaaggacaaaaagcugaagaaaaagaggaaagauccagacaguagcgcuacuaacgaggaaaaggaucuaaauuccgaggaccagaaagccuucucuguugaacacaccagcugcaacgaggaggaaaacuuugcaaauaugaagaaaaaggcuaagauugguauccaucacaaaaacucacccccuaaggugacagucccaaccagugggaauacgauagagaguccccuccaugaaaacaucagcaauucuacuucauucaaagaugagaagauuauggagacagacagugaaccggaggaaggagagaucaccgauagccaaacugaagacuccuacgaugaggccauuacaucugagggcaacgugaccgcggaagacucggaggacgaagaugaggacaaaaucuggccucccuguauacgggugauugucauccguagcccaguucugcagauuggcucccuuuuuaucaucacggccgugaauccugcaaccauugggcgcgaaaaggauauggagcacacacugagaauacccgagguaggagugucaaaguuccacgcugaaaucuauuuugaccaugauuugcagaguuacguccucguggaccaggguucucaaaacggcacuauuguuaaugggaaacagauccugcagccaaagaccaaaugcgaucccuauguguuagagcacggagacgaagucaagauaggcgagacagugcugagcuuccauauucacccugguuccgauacuugugacgggugcgaaccaggacagguaagggcccaucuccggcuugauaaaaaggacgagucauuuguuggcccgacccugagcaaggaggaaaaagaguuggaacgacgcaaggagcugaaaaagaucagagugaaauacggccuacaaaacacagaguaugaagaugagaagacccucaagaaucccaaauacaaggacagggcugggaaacggcgcgaacaggucggaucugaggguacuuuccagagagacgaugccccugcauccgugcacagugaaaucacggacagcaacaagggcaggaaaaugcuggagaagaugggguggaaaaagggagagggccuugguaaggaugggggcggaaugaaaacaccaauucagcugcaauugcgucggacccacgccggccucgggacuggaaagcccucuuccuucgaagacguccaucuguuacagaauaaaaacaagaaaaauugggauaaggcucgagagagauuuaccgaaaacuucccugagacaaagccacagaaagacgaucccgguaccaugccgugggugaagggcacucuggaauga

SEQ ID NO: 52570 - RNA, 1053 nt, Artificial Sequence
  derived and/or modified sequence opt3 from AGK__Homo_sapiens__XP_005250080
augaccguguucuuuaagacacugagaaaccacuggaaaaagacuacggccggccucugccuucugaccuggggagggcauugguuguacgguaaacacugugacaauuuacugaggcgggcugcaugccaggaggcccaagucuucggcaaccagcuaauucccccuaaugcgcagguuaagaaagcuacaguguuucucaacccagccgcauguaaggggaaggcccgcacucuguucgagaaaaaugcugcaccgauccuucaucugagcggaauggauguaaccauagugaagacagacuaugaaggccaggccaaaaaguugcucgaacugauggagaacaccgaugucaucauuguggcugguggggacggaacucugcaagaaguugugacaggcguccuccgacguaccgaugaggccacguuuuccaaaauccccauuggcuucaucccuuuaggggagacuucuucacugagucacacccuuuuugcggaaagcggaaauaaggugcagcauauaacagacgcaacuuuggccaucguaaagggugagaccguuccacuggaugugcuacagauuaaaggcgaaaaggagcagcccgucuucgcuaugacagggcucagauggggauccuuuagggacgccggcgugaaagugucuaaguacugguaucuggguccucuuaaaaucaaggcagcucacuucuuuucgacccugaaagaguggccacaaacgcaccaggccucaauuagcuacacugggcccacagaacggccuccaaacgagccggaagagacccccguccagcgcccuaguuuguauagaaggauccuccggcgccuggcguccuacugggcccagccacaagaugcauuaucucaggaaguuagccccgagguguggaaggacguacagcuguccacuauagagcucucaauuacaacccgaaauaaccaacuugauccuacgaguaaggaagacuuccugaauaucugcauugagccagauaccaucagcaaaggagacuuuaucacaauuggcaaguga

SEQ ID NO: 52571 - RNA, 1338 nt, Artificial Sequence
  derived and/or modified sequence opt3 from AGMO__Homo_sapiens__NP_001004320
augaagaaccccgaggcccagcaagacgugagcgucucccagggguucagaaugcuguuuuacaccaugaaaccuucugaaacaucauuccagacucucgaggaaguuccagauuaugugaagaaagcuacgccguuuuucaucagucuuaugcuguuggaguuaguagugagcuggauucugaaggggaaacccccuggaaggcuagacgaugcacucaccuccauaucugccgguguccugucgcggcuuccaucacuguuuuuccgcagcaucgaauugacaaguuacauuuauaucugggagaauuaccgacucuuuaaccugcccugggacuccccuuggacuugguauucugcguuccugggcguggauuuuggguacuauugguuccaccguauggcucaugagguuaauauuaugugggccggacaccagacccaucacagcuccgaagacuacaaccucucaacagcauuaagacaaagugugcugcagaucuacaccagcuggauauuuuauucuccacuugccuuguucaucccaccuuccgucuacgcugugcaucugcaguuuaaucuacucuaucaguucuggauucacacugagguaaucaacaaucugggcccacuugaacugauuuugaacacaccgucacaccauaggguucaccauggucggaaucgcuacugcaucgauaagaacuaugcaggggugcucauaauuugggacaagaucuucggaaccuuugaggccgagaaugaaaaagucguguacggccugacgcaccccauuaacacuuucgagccuaucaaggugcaauuucaccauuuauucagcaucuggaccacauuuugggcuacuccaggcuucuuuaauaaauucagugucauuuuuaaggggcccggaugggguccuggcaaaccaagacuggggcucucugaagagauacccgaaguuaccggaaaggaggugccguucuccagcucgucuucccagcuucugaagaucuauacaguagugcaguuugccuugaugcuagcguucuacgaggaaaccuuugcagauacggccgcucugucacaggucacucuccugcuuaggguguguuucauuauccugacauugaccaguauaggcuuccuccuggaccaacggccuaaagccgcaauuauggagacuuuacgcugccugauguuucuaaugcucuaccgauucggucaccugaagccccuuguucccagcuuguccucugcuuuugaaaucguguucagcaucuguauugccuuuuggggcgucagaucaaugaaacagcugacaagucauccuuggaaguga

SEQ ID NO: 52572 - RNA, 2478 nt, Artificial Sequence
  derived and/or modified sequence opt3 from AGO2__Homo_sapiens__NP_001158095
auguacagcggcgccgggcccgcucuggcaccuccagccccgcccccuccaauccagggauaugcguucaagcccccuccaagacccgacuuugguaccuccggcaggacaauuaaacuccaagcuaacuucuuugagauggauauaccuaagaucgacauuuaccacuaugaacuugauaucaaaccagagaagugcccgcggcgcgugaaucgagaaauugucgagcauaugguucagcacuucaaaacucagaucuuuggggaccguaagcccguguucgauggaagaaagaaccuguacacggccaugccuuugccaauaggcagggacaaaguagaauuagaggugacccugcccggugaggggaaggaucggaucuuuaaagucucuauuaagugggugucauguguuagucuacaggcacuccaugacgcccugagcggacgccuuccuuccgugccauucgaaacaauccaagcucuggaugucgugaugagacacuugcccucuaugagguauacuccgguaggccggucguuuuucaccgcaucagagggcugcagcaauccucucgggggaggucgcgaaguuugguuuggcuuccaucagagugugcgacccucccuguggaaaaugaugcugaacauugacgucucugccacagcuuuuuacaaggcccagccagugaucgaguucgugugugagguccucgauuucaagagcauagaggaacagcaaaaaccuuuaaccgacucccagagaguuaaguuuacuaaagaaauuaaggggcugaaaguggagaucacacacugcggacagaugaagaggaaauaucggguauguaaugugacccgucgccccgcgucacaccagacguucccacuucaacaggaaaguggccagacugucgagugcaccguggcacaauacuuuaaggauagacauaaguugguucugagguacccccaccuaccuugucuccaggugggucaggagcagaaacauacauaucugccacuugaagucugcaacauuguggccgggcaacgguguaucaagaaacugacugacaaucagaccagcacaaugauccgagcuaccgcccgcucugcaccggacagacaggaggaaauuuccaaguugaugaggucagcuagcuucaacacggaucccuacguacgggaguuuggaauaaugguuaaagacgaaaugacugaugugacaggccgcguccuccagccuccaaguauccuguauggcgggagaaauaaggccauugcgacccccgugcaaggagucugggacaugaggaacaagcaguuccacacugguaucgagauaaaagugugggccauugcaugcuuugcuccucagcgucaguguacagagguucacuuaaagucuuucaccgaacaacugcggaaaaucucccgagaugccggcaugccaauccaggggcagcccugcuuuugcaaguacgcucagggagccgacagcguggagccgauguucagacaucucaaaaauacguaugcaggccuucaacugguagucgugauuuugccugguaagaccccaguuuacgccgaagugaagagggucggggauacagugcuaggcauggcuacucaguguguacagaugaaaaacgugcaacgcaccacaccccagacucugucgaaucucugccugaagaucaacguuaaacuuggaggcgucaauaacauucuguugccucaggggcggcccccaguguuucagcaaccugugauauuccucggagcggacgucacccaucccccagccggugauggcaagaaaccgucuaucgcagcuguugugggguccauggacgcccacccuaacagauauugugcaacagugaggguacagcagcaccgccaggagauuauccaagaucuggccgcuaugguccgagaauuacugauccaguuuuacaagucaacccgguucaagcccacucguauuauauucuacagagacggagugagugagggccaguuucagcaaguucuacaucacgagcuccuggccaucagggaagcaugcauuaaacuugagaaggacuaucagccagguaucacguucauugugguccagaaacgccaccauacacgguuguuuuguaccgauaagaaugaaagagggacuagcaggcccucccacuaccaugugcugugggacgauaaccgauucucuagcgacgagcuccaaauccugaccuaucagcuuugccacacauacguucgcuguacccggucagugaguauaccugcgccagcuuauuacgcccaccugguagcauuuagagccagguaucauuuggucgauaaagagcacgacuccgcugaaggcagccauacuucuggacagucaaauggccgugaucaccaggcccucgcaaaggcugugcaagugcaucaggacacacugcgcacgauguacuucgccuga

SEQ ID NO: 52573 - RNA, 864 nt, Artificial Sequence
  derived and/or modified sequence opt3 from AGPAT1__Homo_sapiens__XP_005248862
augguggccagaauggaccuguggcccggcgcuuggaugcuccuucuguuguuauuccugcuacuccuguuucuucugccuaccuugugguucugcagcccauccgcaaaguacuuuuucaaaauggccuuuuauaacggguggauccucuuccuggcgguccuggcuauuccgguuugugccgugaggggacggaauguagagaacaugaagauacuccgcuuaaugcugcuucacaucaaauacuuguaugguauucgaguggaaguccguggcgcacaucacuuucccccuucucagccauacgugguugugucaaaucaucaaaguagccuggaucuacucgggaugauggagguccugcccggaagaugcgugccuaucgccaagagggaacuucugugggcuggcuccgcagguuuggccuguuggcucgcugggguaauuuucaucgaccggaaacgcacaggagaugccauaucuguuaugucggagguggcgcagacucuguuaacgcaggacgucagaguguggguguuuccagaaggcaccaggaaccacaauggcucaaugcugcccuucaagcgcggggcauuucaucucgccguccaggcucaaguuccuaucgugccaauuguaaugagcaguuaucaggauuucuacugcaagaaagagcggcgauuuacauccggacagugucaggugagaguccuuccgcccgugccuacugagggucugaccccagacgauguucccgccuuggcagacagggugcggcacucuaugcuaacagucuuccgugaaaucagcaccgauggccgcgggggaggcgacuaucugaagaaaccuggugggggaggcuga

SEQ ID NO: 52574 - RNA, 741 nt, Artificial Sequence
  derived and/or modified sequence opt3 from AGPAT2__Homo_sapiens__NP_001012745
auggagcuguggcccugccucgccgcugcacuucuguuguuacugcuacucgugcagcugagcagagccgcggaauuuuacgcuaaggucgcccuuuauugugcacugugcuuuaccguuuccgccguggcuucuuugguaugucuccugaggcacggcgggcggacaguggagaacaugucaaucauuggaugguucguccgcaguuuuaaauacuucuauggucugcgauuugaagugcgugacccuagaaggcuccaagaggcacggccaugcguuauagugagcaaucaucaguccaucuuagauaugaugggccugauggaaguccuuccggagcgcugugugcagauugccaagagagaguugcuguuccuagggcccguaggacucaucauguaccugggcgguguuuucuucauuaacaggcagcggucuucgacugcuaugacggugauggccgaccuuggggaacgcaugguccgagagaaugugccuaucgugccagucguuuauagcucauuuaguuccuucuacaacaccaaaaagaaauuuuucacaucuggaacugugaccguacaagugcuggaagcgauacccacaagcggcuugaccgcagccgaugucccugcucucguggacacuugccacagagccaugaggacaaccuuucugcauaucuccaagacgccacaggagaauggcgcaacugcugggucaggaguucagcccgcccaguga

SEQ ID NO: 52575 - RNA, 1131 nt, Artificial Sequence
  derived and/or modified sequence opt3 from AGPAT3__Homo_sapiens__XP_006724093
augggccugcucgccuuccuuaagacccaguuugugcugcacuuguuagucggguucguuuuugugguaagcggacuggugaucaacuucguccaacuaugcacacucgcucuguggcccguguccaaacagcuuuacagaaggcugaauugucgguuggcauauucucucuggucacagcugguuaugcugcucgagugguggaguugcacugaauguacguuauuuaccgaccaggccacaguggagcgcuucgguaaggaacaugcggucauuauacugaaccacaauuuugagaucgauuuccuuugcggcuggacuaugugugaacgauuugggguguugggaagcuccaaaguacuggcuaagaaagagcuacucuacguuccucugauuggcuggaccugguauuuccuugagaucguguuuugcaagcguaagugggaagaggacagagauacagucguggaaggucugaggcgguugucugacuacccagaguauaugugguuccuccuguacugugaggggacccgcuuuacugaaacaaaacauagagugucgauggaggucgccgcagccaagggauuaccgguucugaaauaucaccuccuucccaggaccaagggcuucacgacugcugugaaaugccugcggggcaccguagcagccguguacgaugucacauugaacuuccgcgggaauaagaacccuucacuacuggguauucucuacggaaagaaauaugaagcugacaugugugugcgaagauuuccacuggaggauaucccccuugacgaaaaggaggccgcgcaauggcugcauaaauuguaccaggagaaggaugcacuccaggaaauauauaaucagaaaggcauguucccuggggagcaauuuaagccagccaggcggcccuggacucuguuaaacuuccugagcugggcuaccauccuacucaguccucuguuuuccuucguucuuggaguguuugccucuggcagcccauugcugauucucacauuccuggguuuugucggggcagcuuccuucggagugcgucgccuuaucggcguaaccgaaauugagaaaggcucaaguuacgggaaucaggaauuuaagaagaaagaguga

SEQ ID NO: 52576 - RNA, 1137 nt, Artificial Sequence
  derived and/or modified sequence opt3 from AGPAT4__Homo_sapiens__NP_064518
auggaccuggccggccuccuuaagagccaguuccugugccacuugguguuuuguuacgucuucaucgcuuccggguuaauuauaaacaccauccaacuguuuacacuacuccuguggcccauuaauaaacagcuuuucagaaagaucaacugcaggcugucuuauuguauuucaagucaguugguuaugcuccuggagugguggagcggaacugaaugcacgaucuuuaccgauccucgggcauaccugaaauaugguaaggagaaugccauagugguacucaaccauaaauucgaaaucgacuuuuuauguggcuggucccugucugagcgcuucgggcuuuugggaggcucgaaggugcuggcgaagaaagaacuagcuuacgucccaauuaucgguuggaugugguauuuuacagagaugguguucugcucacgaaagugggagcaggaucguaaaacuguugccaccagccuccaacaccugagagacuacccggaaaaguacuuuuuccuuauucauugugaggggacaagguuuaccgagaaaaagcacgaaaucaguaugcaaguggcacgggccaagggacugccccgcuugaaacaucaccuccugccuagaacuaagggcuucgcuauaacagucagguccuuacggaaugugguaucugcaguuuaugauugcacccugaacuuccgcaauaacgagaauccaacgcuccuuggcgugcugaacgggaaaaaguaccacgccgacuuguauguccgaaggauuccccuagaagauaucccugaggacgaugacgaauguagcgcuuggcugcauaaacucuaccaggagaaggaugccuuucaggaagaguauuacagaacuggaaccuucccagagacacccauggugccuccacggcguccguggacucuggugaauuggcuguuuugggcgucccuugucuuguaucccuucuuucaguuccucguuucaaugauucgcagugguagcucucugaccuuagcauccuuuauccugguguucuuuguagccucagugggcgucagauggaugaucggggugacagaaauugacaaaggaagcgcuuacggcaacagugauucuaagcagaagcuaaaugacuga

SEQ ID NO: 52577 - RNA, 1305 nt, Artificial Sequence
  derived and/or modified sequence opt3 from AGPAT9__Homo_sapiens__NP_001243350
auggagggcgccgaacuggcugggaagauccucagcaccuggcuuacacugguguugggauucauuuuacugcccuccgucuuugguguuucucuaggcauaucagagaucuacaugaaaauucucgugaagacucuggaaugggcaacgaucagaauugagaaagggaccccuaaggaaaguauccuuaaaaacagcgccuccguaggaauaauccagagggacgagucuccaauggagaagggccugucggguuugcgggggcgcgauuucgaacucucagacguguuuuauuucagcaagaaaggacuggaggcgauugucgaagaugaggugacacagcgauuuaguuccgaggaacugguuucuuggaaucucuuaacucguaccaacgugaauuuccaguacaucagccugagacuuacaauggucuggguguugggcguaauuguuagguauugcgugcugcuaccgcuccgggucacccuggcuuuuaucggcauaucccuucuggugauugggacuacauuggugggacagcuccccgacucaagucugaagaacugguuaagcgagcugguccaccucaccuguugccgcaucuguguuagagcccuuucugguacgauucauuaccacaauaaacaguauaggccucaaaagggcgggaucugcguggcaaaccauacuuccccaaucgauguacugauuuugaccacagacggauguuacgccauggugggccagguccacggugggcuaaugggaauaauccagcgggcuauggugaaagcaugcccccauguuugguucgaacgcucagagaugaaggaucgacaccuggugacuaagagacucaaagaacacauugccgacaagaaaaagcugccuauccuuauauuuccagagggcaccuguauuaauaacacaagcgucaugauguucaaaaagggcaguuuugagaucgggggaaccauccaucccguggcuauuaaauauaauccucaguucggugaugccuuuuggaacucuuccaaguacaauaugguaagcuaccuguugaggaugaugacgucgugggcgaucguuugcgacgugugguauaugccaccgaugacucgggaagagggcgaagaugcaguccaauucgccaaccgugugaagucugcuauugccauacaagggggacucacagagcugcccugggacggcgguuuaaaacgcgcaaaggucaaagauaucuucaaggaggaacagcagaaaaauuacuccaagaugauuguggggaacggcucacugaguuga

SEQ ID NO: 52578 - RNA, 1977 nt, Artificial Sequence
  derived and/or modified sequence opt3 from AGPS__Homo_sapiens__NP_003650
auggccgaggcugcagccgcggcuggcgggaccggacugggugccggcgcaagcuacggguccgccgcugacagagauagggaccccgauccugaccgggcaggacgccgacuccgugugcuuucuggccaccuguuggguagaccaagggaagccuuaucaacaaacgagugcaaggcucggcgcgccgcgagugcagccacugcugccccgacggcaacccccgcugcccaggaaagcgggacaaucccuaaaaagagacaagaggucaugaaauggaauggauggggcuauaacgauuccaaguucauuuuuaauaaaaagggccagauagaacugacugggaagagguacccacuaucuggaaugggucuccccaccuucaaagaguggauccagaacacacugggcguuaauguggagcauaagaccacuucgaaagcgucacuuaacccuagcgacacaccacccaguguagugaaugaagauuuucugcacgacuugaaggagaccaacauuuccuauucucaggaagccgaugaccgggucuuccgcgcacaugggcacugucuccaugagaucuuucugcugcgagagggaauguucgaaaggauuccugauaucgugcucuggccaacgugccacgacgauguugugaaaauagucaauuuagcuuguaaguacaaccugugcaucauuccgaucggcggugggacuagcguguccuauggacuuaugugucccgccgacgagaccagaacaauuaucucauuggacacuagccaaaugaaucggauacuguggguagaugaaaacaaucuaaccgcucacguugaggccggcauuacaggccaggaacucgagcgucagcugaaggagagcggguacugcaccggacaugaaccugacucucuugaguuuuccacgguggguggcugggucucaacucgcgcaagcgggaugaaaaagaacaucuauggaaauauugaagaucugguggugcacaucaaaauggucacaccaagaggcaucauugagaagaguugucagggucccaggaugucuaccgggccugacauacaucacuucaucaugggcuccgaaggaacuuugggcguuauuacagaggccaccaucaaaauacggccagugcccgaguaccaaaaguacgggagcguagcuuuuccgaacuucgaacagggaguggcgugccuccgagagauugcaaaacagcgcugugccccugcuucgaucagacugauggauaacaagcaguuucaauucggucacgccuuaaagccccaggucucuuccaucuuuacgucauuccuggacggccucaaaaaguucuauauuaccaaauuuaagggguucgauccaaaucagcuuaguguggcaacacuguuguuugaaggagacagggagaaaguucuacaacaugaaaaacagguguacgauaucgccgcuaaguucggcggucuggccgcaggggaggacaacggccagcggggauaucuccugacuuacgucauugcguauauacgcgaucuugcucuggaguacuauguguugggcgaaaguuuugagaccuccgccccuugggacagaguaguugaccucugcaggaaugugaaggaacguaucacacgggaguguaaggagaaagggguccaguucgcacccuuuucuacuugccgagugacccaaacauacgaugccggagcuugcauuuacuucuauuuugccuucaacuacagagguaucagcgacccacugaccgucuuugaacagacugaggcagcugccagggaagagaucuuagcgaauggcgggucacugagucaccaucacggagugggcaagcuacgcaaacaguggcucaaggaauccauuagcgauguugguuucgggaugcugaagucugugaaagaguauguagaccccaacaauauauuuggcaaccggaaucuuuuguga

SEQ ID NO: 52579 - RNA, 528 nt, Artificial Sequence
  derived and/or modified sequence opt3 from AGR2__Homo_sapiens__NP_006399
auggagaagauccccgugagcgccuuccugcuccuugucgcucuguccuacaccuuggcaagagacacaacuguuaaaccuggcgccaagaaagauacgaaggacucuaggccaaaauuaccgcagacccugucacggggguggggagaucaacuaauuuggacacagacuuaugaagaggcgcucuacaagaguaagaccagcaacaaaccccugaugauaauccaccaucuugacgaaugcccucacucccaggcucugaagaaaguguuugccgagaauaaggaaauucagaaauuggcagagcaauucguacuccugaaccugguguaugagacaaccgauaagcaucucucuccagacggucaguacgucccccgcaucauguuuguggauccuucguuaacuguucgagccgacauuacaggccguuauucaaauagacuguacgcuuaugaaccagcagauaccgcccuuuugcuggacaacaugaagaaagcucuaaagcuccugaaaacggagcuuuga

SEQ ID NO: 52580 - RNA, 501 nt, Artificial Sequence
  derived and/or modified sequence opt3 from AGR3__Homo_sapiens__NP_789783
augaugcugcacagcgcccucggccuuugccuguuguuagugaccgucuccucuaaccuggcuaucgcaauuaagaaagagaagagacccccucagacacuaucaaggggguggggagacgauauaacuuggguucaaacguacgaagagggucucuucuaugcccagaaaaguaagaaaccacugauggugauccaucaccuugaagacugucaguacagccaggcgcugaagaagguauuugcucaaaaugaggaaauucaggagauggcccagaacaaauucaucauguugaaucucaugcaugagaccacagauaagaaccuguccccggacggccaguaugugccccggauuauguuugucgauccuucucugacugugcgcgcagacaucgccgggcgauacucgaaucgucucuauaccuacgaaccaagagauuuaccccugcuuauagagaacaugaaaaaggcuuugaggcugauccaaucagaacuauga

SEQ ID NO: 52581 - RNA, 4416 nt, Artificial Sequence
  derived and/or modified sequence opt3 from AGRN__Homo_sapiens__XP_011539733
augcugcacgugcacgccugcacccaccagaucagccuccaugucgcuuccgcaggccccugugagacaugcggggacgccguuugugcguucggagcugugugcucugccggucaauguguaugcccuagaugugaacacccaccgcccggcccugugugcgggucagauggagucacuuacggcagugcaugugagcuuagggaagccgcuugccugcagcagacgcagauugaggaagcacgggccgguccaugugagcaagcugagugcgggagcggaggcuccggcucuggggaagacggagauugcgagcaggaauugugucgccagcgagguggcauaugggacgaggauucggaggacgggcccugcgugugugauuuuucaugccagagcguuccuggaaguccaguguguggcuccgacggugucaccuauucuacagaaugcgaguuaaagaaagcccguugugaaagccaaagagggcuguacguggcggcacagggagccugcaggggccccacuuucgcuccucuaccaccgguagcaccccuccauugugcccagaccccuuauggcugcugucaggauaacaucacagcugcccgcgggguuggacuggcggguugcccauccgccugccaauguaauccccacggcucauacgggggaaccugcgacccugcaacuggccaguguaguugccggccaggugucgggggccuuagaugugauaggugcgagcccggauuuuggaacuuccggggcauugugacagacgggcgcagcggauguaccccgugcucuugugauccucagggugcugugcgagacgacugcgaacaaaugacgggccuguguuccugcaagcccgggguggccggaccaaaaugcggccaguguccugaugguagagcuuuggggcccgccggcugcgaggcagacgccucagcuccagcgacuugugcagagaugaggugcgaauuuggagcccggugugucgaggaaagcggcagugcucacugcguuugucccaugcugaccugcccugaggccaaugcaacaaaggugugugggucugauggaguaacuuaugguaacgaaugccagcugaaaaccaucgccugucgucagggccugcaaauuuccauccagagccucgggccaugccaggaggcuguggccccgucgacacaucccaccucugcauccgucacggugacuacaccuggauuacugcuuucacaggcguugccagcucccccuggcgcccugccacuagcacccaguagcaccgcccacucccaaacuacaccgccuccaucuagccgccccagaaccacggcuucaguuccuaggaccacaguguggcccguccucacugugccaccuaccgcccccaguccagcaccgucccugguagcuagcgccuucggugagucugggucaacagacggcaguagcgaugaggagcuuuccggagaccaggaagcgucuggcgggggaucgggcggucuggagccuuuggaagggagcuccguugccacucccggaccacccguggagcgggcuucaugcuacaauagugcacucggcuguugcucugaugguaagaccccuagccuggacgccgagggcuccaacuguccagcuacaaaggucuuucaggggguguuagaacuggagggagucgaaggccaggaacucuucuauacccccgagauggccgauccuaaaucagaacuuuuuggggagacugcacgaagcauagaaucuacgcuggacgauuuguuccgcaauuccgacgugaagaaagacuuuagaaguguuaggcuacgggaucugggaccgggcaagagcgugcgcgcgaucguagacguccauuucgauccaacaaccgccuuuagagcucccgacguggccagggcacuccugcgucaaauucagguuucucggcgaagaucccuuggugugaggcgcccucugcaggagcacguccgguucauggauuucgacugguuuccagcuuucaucacuggggccaccucaggagcaauugccgcuggcgcgacagccagagcaaccacugcuaguagguugcccagcucggccgugacaccucgcgccccgcaccccucccauacgucucagccaguagcuaaaaccacugcagccccuacaacccgacggcccccaacaacugcgccuagccgugugcccgguagaaggccaccggcuccucaacagcccccaaagcccugcgauucacagccuuguuuucacggcgggaccugccaagacugggcccucggaggcggguucacguguaguugcccagcaggacgcggcggugccguuugugaaaagguccugggggcucccgugccugcauuugagggacgguccuucuuagccuuuccgacccugagagcguaccauacacuaaggcucgcucuggaguuccgagcccuugaaccacagggcuugcugcucuacaacgguaaugcacgcggcaaagauuuucuggcccuugcucuguuggacgggcgggugcagcucagauucgauacuggaucuggccccgccguccugaccagcgcaguuccuguggagcccgggcaguggcacagguuagaacugucccgucauuggcgccggggaacacuaucaguggacggcgagacuccaguacucggugaaagcccuagugggaccgauggacugaaccuugacacggacuuguuugucggcggcgugcccgaggaucaagcugccguugcgcuggagagaacauucgugggggccggacucagggguugcauccgacuguuagacgucaauaaccagcggcuggaacuuggcauagggccaggagcagcuacccgcggcucuggugugggggaguguggagaucacccuugcuugccgaaucccugccacggcggcgccccaugucagaaccucgaagcugggagauuucauugccaguguccucccggaaggguugguccaacuugcgcagacgagaaguccccuugucaacccaauccgugccacggcgccgccccaugucgggugcugccugaagggggagcucagugcgaguguccccuaggccgagaggguacauucugccagaccgcgagcgggcaggauggaucgggcccauuccuggcagacuuuaacggcuucucacaucucgaacugagagggcuucacacuuuugcccgcgauuugggagagaaaauggcucuggaaguagucuucuuagccaggggucccucuggccuccugcuuuauaacgggcaaaagaccgacggaaaaggcgauuuugugagucuggcauugcgugaccggagacucgaguucagguacgaucuggguaagggggccgcugugauucgcucccgagagccugucacacuaggagcguggacgagaguuagccuggaacggaauggcaggaaaggcgcccuccgcgugggggacggaccgcguguacugggugagucucccaagagcagaaaggugccacacaccguccuuaacuugaaagaaccucuguaugugggcggggcacccgauuuuuccaaguuagcucgggccgcagccguuucaaguggauucgacggcgcuauccagcucgugagccugggugggaggcagcuucugacuccugagcauguccuacgccaaguggacguuacaucuuuugccggacacccauguacccgagcguccggccaucccugccucaauggcgcaucaugcgugccuagagaagccgcuuacgucugucugugcccagggggauucagugguccccacugugagaaaggcuugguagaaaagagcgccggggauguggacacacuggcuuuugauggacggacuuucguugaguauuuaaacgcagugaccgaguccgaaaaagcccuccagucuaaucauuuugagcugucgcuuaggacggaagcuacacagggccuggucuuguggagcgguaaggccaccgagcgcgcagacuacguggcgcucgccauuguagaugggcaucugcagcuaucauauaaccugggcucccaaccggugguccuuagaaguacuguuccugugaauaccaacagguggcuccggguggucgcucaccgugagcagcgcgaaggaucucuccaggugggcaaugaggccccaguuacagggagcucccccuugggagcaacucagcuggacaccgauggugcuuuauggcucggcgggcugccugaacuuccaguaggacccgcccugccgaaggcauacggcacagguuucguggggugcuugcgagacgucgugguuggcagacacccucuccaucugcuagaggaugccgugacgaaacccgaacugaggccauguccuacccccuga

SEQ ID NO: 52582 - RNA, 399 nt, Artificial Sequence
  derived and/or modified sequence opt3 from AGRP__Homo_sapiens__XP_011521229
augcugaccgccgcugugcucagcugcgcacuucuguuggccuuacccgcgacaagaggcgcucagauggggcuggccccuauggagggaaucaggcggccagaccaggcacuacucccggaacugcccggucuuggccugcgcgccccuuugaagaaaacuacggcugagcaggcagaagaggaucuccugcaggaagcccaggcucuggccgagguccucgacuuacaagaucgagagccacguuccucuagaagguguguucggcugcacgaaucaugccuugggcaacaggugcccuguugcgacccuugugcgaccugcuacugucgcuucuuuaacgcauucugcuauuguagaaaguugggaacagccaugaauccaugcaguaggacuuga

SEQ ID NO: 52583 - RNA, 1458 nt, Artificial Sequence
  derived and/or modified sequence opt3 from AGT__Homo_sapiens__NP_000020
augagaaagagggcuccccagagcgagauggccccugcaggcgugucccugcgggccaccauccucugccuucuggcgugggcuggguuggccgcaggagaccgcgucuacauucacccauuccauuuaguuauacacaacgaaucuacaugugagcaacuggccaaagcuaaugcagguaagccgaaagaucccacuuuuaucccugccccaauucaggcuaagacgucacccguggacgaaaaagcccuacaggaucagcucguacugguggcggcaaaacuugacaccgaggauaagcugcgagccgcuauggucggcauguuggccaacuuccucggguuucguaucuauggaaugcauagugaacuguggggcgugguucacggugcaacagugcugagcccuacugcugucuucgggacccucgccuccuuauaccugggagcgcuugaccauacagccgauagauugcaagcaauucugggcgugccauggaaggacaagaauugcaccucuaggcuagaugcucacaaaguacucucggcccugcaggcuguucagggccuucugguggcccaggggcgggcagacucacaagcccaguugcuccugagcacugucgugggaguguuuacagcucccgguuuacaccugaagcagccuuucguccagggccucgcgcuuuauaccccaguugugcugccgcgcaguuuggauuuuacggagcuagacguagcagccgagaaaaucgauagauucaugcaagcugugacuggguggaagaccggauguucccugaugggcgccucugucgacagcacacucgcauuuaacacuuacgugcauuuccaggguaagaugaaaggguuuucccugcuugccgaaccccaggaguucuggguugacaauucaaccagugugagcgucccuaugcugucuggaaugggcacauuucaacacugguccgauauacaggacaacuucucagugacccagguaccauucacggaaagcgcuugcuugcuccugauccagccccauuaugccagugauuuagacaagguugagggccugacuuuucaacaaaauucucuaaacuggaugaaaaagcucuccccuaggacaauucaccugaccaugccacagcuuguguugcaggggagcuacgaucugcaggaccuccuggcacaggcggagcuucccgcuauccugcacacugaauugaaucuccagaaacugucgaacgaucggauucgcgucggagagguguuaaauucuaucuucuuugaacuggaggccgacgaacgagagccgacagaguccacccagcaacuaaacaagccugaaguccucgaggugacgcugaauagacccuuccuuuuugcaguuuaugaucagucagccaccgcuuugcauuuccuggguaggguggccaacccacucaguacagcauga

SEQ ID NO: 52584 - RNA, 3837 nt, Artificial Sequence
  derived and/or modified sequence opt3 from AGTPBP1__Homo_sapiens__NP_001273644
augagaaccggcagcgccgcuuccucugcagccgcggcugccgcagccgcugcagccucagcuagucccgccacaggggugugcaugaagacuccuggagguggcaggcgggggauccgccgagacccaggagcggagccgggcgcagccgcucugcguggucccagacagaggccuauucucagccggcuuacgaacaauucccgcauagucgggcuguuggcccaauuagagaaaaucaacgcagaaccaucugaaucggauaccgcuagauacguuacaucaaagauucugcaccuagcccagagccaggagaaaacuaggcgggaaaugaccgcgaagggaaguacaggcauggagauccuccuguccacccuugagaauacuaaagaccugcagacaaccuugaacauucucucuauccugguggaacugguaagcgccggcgggggacgccgaguguccuuccucgucacgaaggguggcucacaaauauuacugcagcuuuugaugaaugcaaguaaggagucucccccucaugaagaucugauggugcagauccacucuauucuagcuaaaaucgggccaaaggacaaaaaguuuggaguuaaagccagaauuaacggcgcucucaauaucacucugaaccuugugaagcagaaucugcaaaaccauagguugguccuccccugucugcaguuacugcggguguauuccgccaauucaguaaacagcguuagucucgguaagaaugggguggucgagcuuauguucaaaauaauuggaccuuuuucuaagaaaaacuccagccugaucaagguggcauuggauacccuagccgcucugcucaaaucgaagacaaaugcgcgucgcgcaguggacagaggcuacguccagguucugcuuacuauuuauguggauuggcacaggcaugacaaccggcaccgaaacaugcugauccgcaaaggcaucuugcagucucucaaguccguaaccaauauuaagcuggggagaaaagccuucauagaugcuaacggaaugaagaucuuauacaauacaucacaagagugccuggccgugaggacccuagacccacucgucaacacgaguagccugauuaugcggaaauguuuuccgaagaaucgccuucccuugccuacuaucaaauccucuuuccacuuucagcugccagugauacccguuacagguccuguggcacagcucuauagccugccacccgaagucgaugacgugguagaugagucagacgacaacgaugacauugauguugaagccgagaaugaaaccgagaacgaggacgaucuugaccaaaauuucaagaacgaugacaucgaaacugauaucaauaagcugaaaccgcagcaggagccuggcagaacaauugaagacuugaagauguacgagcaucucuuucccgaacugguggaugacuuccaggacuaugauuuaaucaguaaagagccaaagccuuuugucuucgaggggaaagugaggggacccauugucgugccaaccgcuggcgaagagacguccgguaacagcgggaaucugcguaagguugugaugaaggaaaacauaucuucaaaaggcgacgagggagaaaagaaaaguaccuuuauggaucuagccaaggaggacaucaaagauaaugaccggacacuccaacagcagcccggcgaucagaaccgaacuauuagcuccguacacgggcugaacaaugacaucgucaaggcacuugauagaaucaccuugcaaaacauuccuucucagacagcgccaggauucacugcugagaugaagaaagacugcucgcugccgcucaccgugcugacaugugccaaggcaugcccccauauggccaccugugguaauguuuuauucgaaggcaggacugugcagcuggggaaacuuugcuguacgggagucgagacagaagaugacgaggauaccgagagcaacuccucaguggaacaggcuaguguagaggugccugacggcccaacuuugcacgaccccgaucucuacauagaaaucguuaagaauaccaaaucugucccugaguacagcgaaguggccuauccagacuacuuuggucacauucccccgccuuucaaggagccaauccuggagcgccccuauggggugcaacggacaaaaauugcacaggauaucgaaagacuaauacaucaguccgacaucauugauagggucguuuacgaccuggauaacccuaauuauaccauccccgaggaaggcgacauucucaaguuuaacucaaaguucgagagcggaaaucugcgcaaagugauccagauacgaaagaacgaauacgaucuuauuuugaauagcgacaucaacuccaaucacuaucaucaaugguuuuacuucgaggugaguggcaugcggccagggguagcuuaccguuuuaacauuaucaauugcgagaaaagcaacucucaguucaacuauggaaugcagccucugauguacuccguccaagaagccuuaaaugcgagacccugguggauaaggauggguacugauaucuguuauuacaagaaccacuuuucacgcaguagcguggccgcuggcgggcagaaaggaaagucguauuacacaauuacguucaccguuaauuuuccacauaaggacgaugugugcuauuucgcauaccacuacccguauacuuacuccacacuccagaugcaucugcagaaacuugagucugcccacaacccucaacagaucuauuuucggaaggacguccugugcgaaaccuugagcggcaauucauguccccucgugacaauuacugcuaugccagagaguaacuacuaugaacacaucugccauuucagaaauaggcccuacguuuuccuguccgcccgagugcacccuggugagaccaacgcaucuuggguaaugaaagggacgcuagaguaucugaugagcaauaacccaaccgcgcagucccuccgcgaaucauacauauuuaagauuguccccaugcugaauccugacggcgugaucaacggaaaucaccgguguagccuuaguggcgaggauuugaacagacaguggcaaucuccguccccagaccugcaucccacaaucuaccacgccaaaggguuacuccaguaucuggcugccgugaagaggcuuccucuggucuacugcgauuaucauggacacagccguaagaaaaauguuuucauguacggcuguucgauuaaggaaacuguguggcauaccaacgacaacgcaacaucaugcgauguaguggaggacacugguuaucgcacccuaccaaaaauccucucucacauugcucccgccuuuuguaugaguuccugcagcuucgucguggagaagucuaaagaaagcacggcacggguuguggucuggagagagauaggggugcagagguccuacacaauggaaucaacccuguguggaugcgaucagggcaaguauaaggguuugcaaaucggcacucgagagcuggaagagaugggggccaaauuuuguguuggauuacuccggcugaagcgccuuacaaguccucuggaguacaauuugccgagcucucuccuggacuucgaaaacgaucuaauugaguccucaugcaaagugaccagucccacuaccuacguccuggacgaagaugagccaagauuucuugaagagguagacuauagcgcugaguccaaugacgaacucgauaucgagcuggcggaaaacgugggcgacuacgagccuucugcccaggaagagguuuugucggauagcgagcugucaaggacauauuuacccuga

SEQ ID NO: 52585 - RNA, 1185 nt, Artificial Sequence
  derived and/or modified sequence opt3 from AGTR1__Homo_sapiens__NP_004826
augaagaaaaugaaccacaagagcaccgacucccccaaagccccucagcugagaggcgggguguucgauaucgucuuugcuacaaauucuacucaaguuauuaagaugauacucaacucaaguacggaggacggaaucaaaaggauucaggaugacugcccaaaggcaggucggcauaauuacaucuucgugaugauuccgacccuuuauagcaucauauuuguagugggcaucuucgggaacucccuggucgugauuguuaucuacuuuuauaugaaguugaaaacaguggccucugucuucuuacugaaucuagcgcucgcugaucuguguuuucuucugacuuugccccucugggccguguacaccgcaauggaauaucgcuggccuuucggaaacuaccugugcaagauugccucggcuucaguaucauuuaaucuguaugcaaguguuuuccucuuaacaugucuguccaucgaccgauaccuugccauagugcacccaaugaaaucucguuugagaaggaccaugcuggucgcuaaggugacuugcauuaucauuuggcuacucgccggccuggcgagccuucccgcaaucauccaucggaacguguuuuucauugagaauacaaacauaaccgucugugccuuucacuacgaaucccagaauagcacgcugccuaucgguuuggggcucacuaaaaacauucugggauucuuauucccauuucugaucauacucaccaguuauacacuuauuuggaaggcucugaagaaagccuacgagauccagaagaauaaaccccgcaacgaugacaucuucaagauuaucauggcaauuguuuuguuuuucuuuuucagcuggauaccucaucaaaucuuuacuuuccuagaugugcugauucagcucggcaucaucagagacugcaggauugcugauauaguagacaccgccaugccaaucacaauuuguaucgcguauuuuaauaacugccugaacccgcuuuucuacggcuuucuggggaaaaaguucaaacgguacuuuuugcagcuccugaaguauauucccccuaaggccaaaucucacuccaauuuaucaaccaagaugagcacgcugaguuaucgcccaucugauaacguguccagcucgacuaaaaagcccgcaccuuguuucgaagucgaguga

SEQ ID NO: 52586 - RNA, 1092 nt, Artificial Sequence
  derived and/or modified sequence opt3 from AGTR2__Homo_sapiens__XP_011535835
augaagggcaacagcacccuggccacaacuuccaaaaauaucacgucugggcuccacuucggacuugugaacauuucagguaauaacgagaguacccugaauugcagccagaagcccuccgacaaacauuuggaugcuauaccuaucuuauacuauauuaucuuugucauuggcuuccugguuaacaucgugguagugacacuauuuuguugccaaaaggggccgaaaaaggucucuucgauauacaucuucaaucucgcaguggccgaccugcuucuguuggcgacucucccacugugggcuaccuauuacucauauagauacgauuggcuguuuggacccguuauguguaagguguucggcagcuuucucacauuaaacauguucgccaguaucuuuuucauuaccugcauguccgucgacagguaucagucugugauuuacccuuuucugagccagcggcgcaauccauggcaggcauccuacaucguaccccuuguuugguguauggccugcuugucaagucugccuacuuucuauuuucgagaugugcguacaauagaauaccuaggugucaacgcuuguauuauggcauucccacccgagaaauaugcccaauggagcgcugggaucgcccucaugaagaauauucugggauucaucaucccucuuauuuuuauagcgaccugcuacuucggcaucagaaaacaccuguugaagacgaacucuuauggcaaaaauaggauuacucgggaccaggugcucaagauggcagccgcugugguccuggccuuuaucauauguugguuaccauuccauguucugaccuuucucgaugcacuugcuuggaugggggugauuaacuccugcgaaguaaucgccgugaucgaccuggcguugccguucgccauucuacugggauuuacaaauucaugugucaaccccuuccucuacugcuuuguggguaaccgcuuccagcagaagcugagaagcguuuuuagggugccuaucacuuggcuucaaggcaaacgggagaguaugucuugccgcaaguccagcucgcugcgagaaauggagaccuucgucucuuga

SEQ ID NO: 52587 - RNA, 1545 nt, Artificial Sequence
  derived and/or modified sequence opt3 from AGXT2__Homo_sapiens__NP_114106
augacccugaucuggagacaccuccuuaggccccugugcuuggugacaagcgccccucggauuuuagagaugcauccauuccugucccuaggcacuucucgcacgucagucaccaagcucagucugcacacaaaaccgcgaaugcccccuugugacuuuaugccagaacguuaccagagccuuggguauaacagaguucuggagauacauaaggaacacuugucccccgugguaacugcuuacuuccaaaaaccucuccugcugcaucagggacacauggaguggcucuuugaugcagaagguucuagguauuuagacuucuuuucgggcaucgugaccgucucaguggggcacugccauccaaagguuaaugccguggcgcagaaacagcugggacggcuuuggcacacaagcaccgucuucuuucaucccccuaugcacgaguacgcugagaaguuggccgcacugcuaccagaaccgcucaaggugauuuuccugguaaacaguggcuccgaggccaaugaacuugcuaugcugauggcacgcgcccacucuaacaauaucgauauuaucagcuuuagaggugcuuaucauggguguucccccuacacuuugggacucacaaacguuggcaccuauaaaauggagcugccuggcgggacgggaugccaaccaacuaugugucccgacguguucagggguccuuggggcgggucacacugccgggauaguccaguccagaccauacgcaaguguagcugcgcccccgacuguugccaggcgaaagaucaguacaucgagcaauuuaaggacacauuaucuacuuccguggcaaaaucaauugccggauucuuugcugaaccgauccagggcgugaauggugucguucaguacccuaagggguuccugaaggaggccuucgaacucgugcgagcaagaggaggcguauguauugcugaugaggugcagaccggcuuugggaggcuuggaagccauuucugggguuuucaaacacacgacguccugcccgauaucgugaccauggccaaaggcauagggaacggauucccaauggcggccguuauuacgacuccugaaaucgcaaagaguuuggcuaaaugccuacagcauuuuaauacauucggcgguaaccccauggccugcgcuauugggucugccgugcuggaggucaucaaggaggaaaaucuccaggagaacucccaagaagugggcaccuauaugcugcuuaaauuugcaaagcugcgggacgaguucgaaaucguaggagauguucguggcaaaggguugaugauuggaauagagauggugcaggacaagaucagcugucgcccacuccccagagaggaagucaaucagauucacgaggacugcaagcacaugggucuguuagugggcagggggucgaucuuuucucagacuuuccggauagccccuuccauguguauuacaaaaccagaagucgauuuugcuguggagguuuuccgaucagcgcugacccaacauauggaacgcagagcaaaguga

SEQ ID NO: 52588 - RNA, 1179 nt, Artificial Sequence
  derived and/or modified sequence opt3 from AGXT__Homo_sapiens__NP_000021
auggccagccacaagcugcucgugacacccccuaaagcacuucugaagccauuguccaucccgaaccaguuacugcuaggccccgggccuucuaaucucccacccagaauuauggcugccggaggucugcaaaugauaggcucaaugaguaaagacauguaccagaucauggaugagauuaaggaagggauccaguaugucuuccagaccaggaacccucuuacucugguuauuagcggauccggccauugcgcguuggaggcugcccucgugaauguacuggaaccaggugacucuuuucuggugggggcaaacggaaucuggggccaacgggccgucgauauaggcgagcgcaucggggcucgagugcaccccaugacgaaagacccuggaggucauuacacccuccaggaaguugaggagggcuuagcacagcacaagccagugcugcuuuucuugacacauggggaaucgucaacuggaguccugcagccgcuagauggcuuuggugagcucugucaccguuauaagugccugcuucugguggacagcguagccagucucgggggaacccccuuguacauggauagacaaggcauugacauccuguauuccggcucucagaaagcucucaaugccccuccagggacaagccugauuuccuucucagauaaggcgaaaaagaaaauguacaguaggaagaccaagcccuuuagcuucuaucucgacaucaaauggcuugcaaacuuuuggggaugugaugaccagccucggauguaccaccauacuauaccaguuauuucucuguacuccuugcgcgaaucacuagcccugaucgcugagcagggucucgagaauagcuggagacaacacagggaagccgcagcuuaucugcauggccggcuucaggcccugggguugcaguuauucgugaaggaucccgcgcugcgcuuaccgacagucaccacgguggccgugccugcaggauacgacuggcgagacauugucaguuauguuaucgaucacuuugacaucgagauuaugggcggucuggggcccucuacuggcaaagugcuaagaauaggacuccugggcugcaacgcuaccagggaaaauguagaucgggugacagaggcccuucgugcugccuugcaacacuguccaaagaaaaagcuguga

SEQ ID NO: 52589 - RNA, 1299 nt, Artificial Sequence
  derived and/or modified sequence opt3 from AHCY__Homo_sapiens__NP_000678
augagcgacaagcugcccuacaaaguggccgauaucggccucgcugcaugggggagaaaggcccuugacauugcggagaacgaaaugccuggacugaugaggaugcgggagcgcuauuccgcuucuaaaccauugaagggugcccgaauagcaggcugcuuacacaugaccgucgaaacagccguucugaucgagacucuagugacgcucggggcugaaguacaguggucaaguuguaauauuuucagcacccaagaucaugcagccgcugccaucgcgaaagcaggcauuccgguguacgccuggaagggagagacagacgaggaauaucuguggugcaucgagcagacucuuuacuuuaaggaugguccccugaacaugauauuggacgaugggggagaccucaccaaucugauccacacaaaauauccucagcugcucccaggcauucguggcaucuccgaagagaccacuacagggguccauaacuuauacaagaugauggcuaaugguauucugaaagugcccgccaucaacguuaaugauucugugaccaagucgaaauucgacaaccuuuauggauguagagagucauugauagauggcauuaagagggcaacggacgucaugaucgcugggaagguggccguaguugcgggauacggcgauguggguaaagggugcgcccaggcacugcggggauuuggcgcucgcgucauuaucacugaaaucgacccuauuaaugcccuacaagcugccauggagggcuacgaagugaccacaauggacgaggcaugucaggaagggaacauauucgugacuaccacaggaugcaucgauauuauccucgguagacacuuugagcagaugaaggacgaugccauagucuguaauauuggccauuucgacguugagaucgaugugaaauggcugaacgaaaaugcuguagagaaggugaacaucaaaccacaggucgacagguaucggcuuaagaaugggcgccgaauuauccuguuggcggaaggaagacucgugaaccugggcugcgcaaugggucaccccagcuuuguuaugaguaacuccuucaccaaucaagugauggcccagauugaguuauggacgcacccugauaaauacccagucggggugcauuuucugccgaagaagcucgacgaagcuguagccgaggcacaccuuggcaaacugaacguuaaguugacuaaacuaacagagaagcaggcccaguaucugggaaugucuugugauggccccuucaaaccugaccauuacagguauuga

SEQ ID NO: 52590 - RNA, 1833 nt, Artificial Sequence
  derived and/or modified sequence opt3 from AHCYL2__Homo_sapiens__NP_001124192
augagcgugcaggucguuuccgccgcugcagccgcgaaggugcccgagguagaacugaaagaccucucuccuucagaggcugaaagucaacuuggccugagcaccgccgcagugggggccauggcuccaccggcaggagguggcgaucccgaggccccugcuccagccgcggaaagacccccugucccagggcccggauccggcccugcagccgcuuugucuccagccgcagguaaggugccgcaggcuucggccaugaaaaggucagacccccaccaucagcaccagcggcaucgcgaugggggagaggcguuaguuagcccugacggcacagugacugaggccccacgaacggucaagaaaauccaauucgcagaucagaagcaggaauuuaacaagcgucccaccaaaauuggcagaaggagucugucccggucuauaagccaguccucaacagacaguuacagcucugcugccuccuauacugauucaagcgacgaugagaccaguccucgcgacaagcaacagaaaaauucuaagggguccagcgauuucugcgugaaaaacaucaagcaggcugaauuuggaagaagggagauugagaucgccgaacaggagaugccagcacuaauggcccuccggaagcgcgcucaaggugaaaaaccccuggcgggcgcaaagauuguaggguguacacacaucaccgcccagacugcuguucuuauggagacacugggagccuugggcgcacagugccgaugggccgcuuguaauauauacucgacccucaacgaaguggccgcagcgcuggcugagucugguuucccggucuuugccuggaaaggggaguccgaagacgauuucugguggugcaucgacagaugugugaauguggagggauggcaaccuaacaugauucuggacgauggcggcgaccucacgcauuggaucuauaagaaauaccccaauauguuuaagaaaauuaaggggaucgucgaagagucaguuacuggagugcacagguuauaucagcugaguaaggcagguaaacuuugcguaccagccaugaacgugaaugauagcgucaccaagcagaaauucgacaacuuguacuguugccgggaauccauacuggauggccuaaagcguacaacugacaugauguuugggggaaaacaggugguuguguguggcuauggugaggucgggaagggcugcugugcugcccucaaggcaaugggaucuauuguguacguaaccgagaucgauccuauuugcgcucugcaagccugcauggacggcuuccgccuuguuaaacugaaugaagugaucagacaggucgauaucgugauuacauguaccgggaacaagaaugucgugacgagggagcacuuggaccggaugaaaaacagcugcauaguuuguaauaugggacauucaaacacugaaaucgauguggcgagucuccgaacacccgagcugaccugggaacgcguaagaucccaggucgaccacgugauuuggccagacgguaagaggaucguuuuacuggccgagggccggcuccuuaaccugagcugcucuacugugcccacauuugucuugucaauaaccgcuacgacccaggcacuagcccugauugagcucuacaaugcuccugaagggcgcuauaaacaagauguguaccugcuuccaaagaagauggacgaguauguagccagucugcauuugccgacauucgaugcacaccucacugaacugaccgacgagcaggcgaaauacuuaggacugaacaagaauggccccuuuaaaccuaacuauuacagauauuga

SEQ ID NO: 52591 - RNA, 3162 nt, Artificial Sequence
  derived and/or modified sequence opt3 from AHI1__Homo_sapiens__NP_001128304
augcccaccgccgagagcgaagcuaaggugaaaacaaaggucagauucgaggaacugcucaaaacucacuccgaccuuaugagggagaagaaaaagcugaagaaaaaguugguucggucugaagagaacaucucaccugauacgauucgcaguaauuuacauuacaugaaagagaccacaagcgacgauccagacacuauacgauccaaccugccgcacaucaaggaaaccacaucugaugacgugucggcagccaauaccaacaaucucaaaaagucaacucguguaacaaagaacaaacuaagaaauacccagcuggcgacggagaaccccaauggcgaugcuagcguggaagaggacaagcaagggaaaccuaacaagaaagucauuaagacugugccacagcuuaccacacaggaucugaaacccgagacuccugaaaauaagguugacaguacccaucagaagacacacaccaaaccacaacccggaguggaucaucagaaguccgagaaagccaacgaagguagggaggaaacggacuuggaggaggaugaagaacucaugcaggcauaucagugccacgucacugaagagauggccaaggaaaucaaacggaagauucgcaagaaacugaaggagcaacugacauacuuuccuucugacacccucuuccacgacgauaaauuaagcuccgagaagaggaaaaagaagaaagaagugccaguauuuucaaaggcugagacuagcacacugaccaucagcggcgacacgguugaaggggagcagaaaaaggaaucuuccgugagaucagucagcagugauucucaucaggacgaugagauauccagcauggagcagucgaccgaagacucuaugcaagaugacacaaaaccgaagcccaagaaaacuaagaaaaagaccaaagcaguggccgauaauaacgaggacguggauggagacggcguccacgaaaucacaucccgggacucaccuguuuauccaaagugucuuuuggaugacgaucuggugcuagguguauacauucaucgcacugaccgacucaaaagugauuucaugaucagccaccccauggugaagauucacgucguggacgagcauaccgggcaguauguuaagaaagaugacuccggaagaccugugucuagcuacuaugagaaggaaaaugucgauuacauccugccaauaaugacacagcccuacgacuuuaaacaacuuaagucaaggcugccggagugggaggagcagauuguguucaacgaaaacuuuccuuauuugcuccggggcagugaugagucccccaaaguaauccuguucuuugagauuuuagacuuccugagcguugaugaaaucaagaauaacucugaggugcagaaucaggaaugcggcuuucguaagaucgcuugggccuuccucaaacuucugggggcgaacggaaaugcaaacauuaauucaaaguugcgccuacaacuguacuauccaccuaccaaacccagaaguccacucagcgucguggaggccuuugaauggugguccaagugucccaggaaccacuacccuucuacucuguaugucacggugcggggucuuaaaguuccagacugcauaaagccgucguaccgaagcaugauggcucugcaggaggagaagggcaaacccgugcauugugaacgccaccaugaguccucaaguguagacacagaaccuggguuggaggaaucuaaggaggucaucaaauggaagagacucccaggacaggccugcaggauucccaauaaacaccuguucagcuuaaacgcaggcgagcgggguuguuucugccuggauuuuucccacaaugggcgcauccuagcugccgcgugugccucaagagacggauauccuauaauucucuacgaaaucccaagcggcagguucaugcgugagcugugcggccaucuuaacaucauuuacgauuugucuugguccaaggacgaucacuauauccugaccaguagcucugacgggacugcacggauuuggaagaaugaaauaaacaauaccaacacauuucgagugcucccccauccguccuucguuuacaccgcuaaauuucacccugccgugagagagcuggucgugacuggauguuaugauucaaugaucaggauuuggaagguagagaugcgcgaagacagugcuauccuugugcggcaguucgauguucacaaaaguuuuaucaacucgcugugcuucgacacagagggucaucacauguacuccggcgauugcacgggggucauugugguguggaauaccuaugucaagauaaacgacuuggaacauucuguucaccauuggacuaucaauaaagagauuaaggaaacagaguuuaaaggaaucccaauuagcuaccucgagauccaccccaacggcaagagacuguuaauacacaccaaggauucaacacugaggaucauggaccuacgcauucucguggcccgaaaauucgugggugcagccaauuaucgggaaaagauccauaguacucugaccccuugugggacguuucuuuucgcuggcuccgaggacggaauuguauacgucuggaaccccgaaaccggcgagcaaguggcgauguacucugauuugccauuuaaaagcccuauccgugacauauccuaucaccccuucgaaaauaugguugcauucugcgccuuugggcagaacgagccaauucugcucuacaucuaugauuuccauguggcucagcaggaggccgaaauguuuaagagauacaauggaacauucccgcugccugguauucaccaaucacaggacgcauuauguacuugccccaaacugccacaucagggcagcuuucagaucgaugaguucguccacaccgaaaguucuuccacaaagaugcaacuugugaagcagagguuggagacuguuaccgaagugauacgcagcugugccgcuaaaguaaacaagaaucucucguuuacgucacccccugccgucucuagucagcaauccaaacugaagcagagcaacaugcuaacagcacaggagauccugcaccaguucggguuuacccaaacugacucucauuucgcggaguuuaauacaugcauucucugguggaaaaagcacuga

SEQ ID NO: 52592 - RNA, 450 nt, Artificial Sequence
  derived and/or modified sequence opt3 from AHNAK__Homo_sapiens__NP_076965
auggagaaggaagagaccacaagagaacugcuccuucccaacuggcagggcagcgggucccacggacugacuaucgcccaaagggacgaugguguguucguccaggagguuacgcaaaauucuccugcugcacggaccggcgugguaaaagaaggggaccagauugugggagccacaauauacuuugauaacuugcagucaggcgaggucacucaguuacugaauaccaugggucaucacacaguggggcuaaagcuccaucgcaaaggagaccgaaguccagagccgggccagaccuggacucgugaaguuuucagcuccuguucuucggaggugguccugaacacaccccagccuucagcgcuugaaugcaaggaucaaaauaaacagaaggaggcuagcagucaggccggcgcaguguccguaucuaccccaaacgccgggcuguga

SEQ ID NO: 52593 - RNA, 2547 nt, Artificial Sequence
  derived and/or modified sequence opt3 from AHR__Homo_sapiens__NP_001612
augaacagcuccucugccaauaucaccuacgcuucaagaaagaggcggaaacccgugcagaagacagucaaaccuauuccagcagagggcauaaagaguaacccgagcaaacgccaccgagaccgucugaauacugaacucgauagacuugccucccuguugcccuucccucaagacguuaucaacaaguuagauaagcugucugugcuaaggcucucgguaucauaucugcgggcgaaauccuuuuucgacguggcucuuaagaguuccccaacggagcgcaaugggggacaggauaacugcagagccgcaaauuuuagggaaggucugaacuugcaggagggcgaguuccuccugcaggcccugaauggguuuguccucgugguuaccacagacgcuuuaguguucuacgcaucuagcacuauucaagauuaucugggauuucagcaguccgacgucauccaucagucaguguacgaacuuauucacaccgaggaucgggccgaguuccaacgccaguugcauugggcucugaaccccagucaguguacagaaagcggccaggguaucgaagaggccaccgggcuaccucaaacuguaguuugcuauaauccagaccagauacccccugagaacucuccacucauggaacgauguuuuaucugcagacugaggugucuucuggauaauuccucaggauucuuggcgaugaacuuucagggcaaacucaaguaccugcacggccagaaaaagaaggggaaagacggaagcauuuuaccgccccagcuggcacucuucgccaucgcuacaccucuucagccacccaguauucuggagauccggaccaagaauuuuauauuccguacgaaacauaaguuggauuucacuccuauugguugcgacgccaaaggccgcaucgugcuaggguauaccgaagcagagcuguguacaagaggaucuggcuaccaguuuauucacgcugccgacaugcucuacugcgcggaaucccacaucaggaugaucaagacuggugagagcgggaugauugucuuccggcugcuuaccaaaaacaaccgauggacaugggugcaaucgaaugcccgccuguuguauaagaacggaagaccagauuacauaaucgugacccagaggccccucacggacgaggaaggcacugagcaucugcggaagcgcaauacaaaauuaccguuuauguucaccacuggcgaagcaguccuguaugaggcuacaaacccuuuucccgccauuauggauccacuaccucucagaaccaagaaugggacgucuggaaaagacuccgcuaccacaucaacucugaguaaggauagccuuaaccccuccucuuugcuggccgcaaugaugcagcaggacgaaagcaucuaccucuauccagccucaaguaccuccagcacagcucccuucgagaauaacuuuuucaaugagucuaugaacgaauguaggaauuggcaagauaacacugcgccuauggguaaugacaccauacugaaacacgagcagauugaucagccacaggacguuaacucauuugcaggcgggcauccgggacuuuuccaagauaguaagaauagcgaccuguacuccaucaugaagaacuugggcaucgacuuugaagauauucgucacaugcagaacgagaaauucuuucggaaugacuucucuggugaaguggauuuccgagacaucgaucucacagacgagauucugaccuauguacaggauucguuaagcaagucccccuuuauaccuucagacuaccagcaacagcagagucuggcccuaaacucuagcugcauggugcaagagcaccuccaucuggaacagcagcagcaacaccaucagaaacaggucgugguugagccacagcaacagcuuugucagaagaugaaacacaugcaagugaaugggauguucgaaaacuggaauagcaaccaauuuguccccuucaauugcccucagcaggauccacaacaguacaacguguuuacugacuugcauggcaucucacaggaguuccccuauaagagcgagauggauucuaugccguacacgcagaauuuuauuuccugcaaccaaccuguacugccacagcacaguaaguguacagaacucgacuaucccaugggcagcuucgagccuucucccuacccaaccacuuccucacuggaagauuuuguuaccugcuuacagcugccugagaaucagaaacacggacuuaacccccaaagugcuaucaucacaccacagaccuguuaugccggggcagugagcauguaccagugccagccggaaccucaacauacucacgucggacagaugcaguauaaucccguguugccaggucagcaagccuuccucaacaaguuucagaauggcguccugaacgagacauaccccgcugagcuaaacaauauuaacaauacgcagaccacuacacaucugcaaccucuccaccacccaucggaagccagacccuucccugaccugaccuccucuggguuucuuuga

SEQ ID NO: 52594 - RNA, 2106 nt, Artificial Sequence
  derived and/or modified sequence opt3 from AHRR__Homo_sapiens__NP_001229341
augcccagaaccaugaucccuccaggcgagugcacauacgccgggaggaagcggcgccgaccgcugcagaaacaacgucccgcugugggagcagaaaagagcaacccuuccaaaagacacagggaccggcucaaugccgagcuugaucaucuggcgucuuuguuaccauuucccccugacauuauaucaaagcuggauaaacuaaguguccuccgccugagcguuuccuaucuuagagugaagucuuucuuccagguagugcaggaacagucgucaaggcaaccagcugccggugcacccagcccuggcgacaguuguccacuggccggguccgcugucuuggagggacggcuccugcuggaaucucucaacggcuuugcauuagugguuagcgccgaggguacuaucuucuacgcuuccgccacgauuguggauuaucugggguuucaccagaccgacgucaugcaucagaauaucuacgauuauauucacguggacgaucgccaggacuucugccgacaacuucauugggcgauggauccgccccagguaguuuuuggacagccuccacccuuggagacaggcgacgaugcaauccugggcagacuacucagggcccaggaaugggggacuggaaccccuacagaguacucagcuuuccugacccgguguuuuauaugccgugugcgcugucuucuggacaguacuagcgguuucuugacaaugcaauuucagggcaagcucaaauuccuguuugggcagaagaaaaaggccccaucuggagcaauguuacccccgagacugucccucuucugcaucgcugccccuguccuucugcccucagcggccgaaaugaaaaugaggagcgcauugcuacgggcuaagccacgagccgacaccgcugccacggcagaugccaaggugaaagcuacuaccagucugugugagucugagcuccacggcaagccuaacuauuccgcgggucgcagcucgagagaaucuggggugcugguccuuagggagcaaacagacgcaggacggugggcccagguucccgcucgcgccccaugccuguguuugagaggcggccccgaucucgugcuggacccuaaagggggauccggugauagggaagaggaacagcaccguauguuaucacgggcaaguggcguaacugggcgaagagagaccccaggaccgacaaagccccugccuuggaccgccggcaaacauagcgaggacggugcuaggccacgccuacagcccuccaagaaugauccuccaucucuccggcccaugccgagagggagcugccugccuuguccaugcgugcaaggcacguucaggaacucacccauuagucacccucccuccccaagcccuucugccuacucaagucgcacuagccgacccaugcgggacgucggagaagaucaggugcauccaccgcuuugccacuuuccucagcguuccuugcagcaccaacugccccagccaggcgcacagagauucgcgacaaggggguaccccauggaggacaugaaacuccagggaguuccuaugccacccggugaucuguguggcccuacccuucuguuggacgugucuaucaagauggaaaaggacucggggugcgagggagcugccgauggcugugucccgagccaaguguggcucggugcauccgaccgcucacauccagccacuuuucccacacggaugcaccugaaaaccgaaccugauaguagacagcagguauauauuucucauuuagggcacggcguuaggggagcucagccacauggccgagccacggcagggcgcagccgggagcugacccccuuccacccugcucacugcgccugucuagagccgacagacggacucccccaauccgaaccaccucaucagcugugcgcgagagguaggggcgagcagucauguacuugccgugccgcugaagcagcccccguggucaagcgcgagccacuugauagcccucaaugggcuacccacucucaggggauggugcccggaauguugccaaaauccgcccuggcaacacucgucccgccucaggcgaguggcuguacuuuucugcccuga

SEQ ID NO: 52595 - RNA, 1017 nt, Artificial Sequence
  derived and/or modified sequence opt3 from AHSA1__Homo_sapiens__NP_036243
auggccaaguggggcgagggggaccccagauggaucguggaagagagggcugaugcaaccaacgucaauaacuggcacuggacagaacgggacgccagcaauugguccacugauaaacugaagacccucuuccuugcgguucaggugcaaaacgaggaaggaaaaugcgagguaacggaggugucuaagcuggacggugaggcuucaauuaauaaccgcaaaggcaaguugauauuuuucuacgaguggagugucaaguuaaauuggacagggacuagcaaauccggagugcaguauaagggccauguugaaaucccuaaccugucugaugaaaauucgguggacgaggucgaaauuucagugagccuagccaaagaugagccagacaccaaccucguagcacugaugaaggaagaggguguuaaacuucugcgagaagccauggggaucuacauuaguacauugaagaccgaguuuacucagggaaugauccucccgacaaugaauggcgaguccguggaucccgucggccagccugcucugaagaccgaagaacguaaagcaaagccagcccccucuaaaacgcaagcuagaccugugggggugaagauaccaacuuguaaaaucacccugaaggaaacauuccucacuagccccgaggaauuauauagggucuuuaccacacaggagcugguucaggccuucacccacgcgccugcaacgcuugaggccgaccggggagguaaauuucauaugguggauggcaacguauccggggaguucacugacuuggugccagagaagcacauugucaugaaguggcgcuuuaaaucauggccggaaggacauuucgcuacaaucacccugacuuuuauugauaagaauggcgagacagaacuaugcauggaggguagagggauccccgccccugaggaagagaggacccggcagggauggcaacgcuacuauuucgaaggcauaaaacagacguuuggcuacggggcacgacucuucuga

SEQ ID NO: 52596 - RNA, 414 nt, Artificial Sequence
  derived and/or modified sequence opt3 from AHSA2__Homo_sapiens__NP_689605
augauccugcccaccaaggccauggcuacacaggagcucacugugaaaagaaaacuuagcggcaacacgcugcaaguccaggcauccucuccuguugccuugggggugaggauuccaaccguagcguuacacaugauggaacuguucgacacaacuguggagcagcuauacucaauauuuaccgucaaggaacucacaaauaagaaaaucauuaugaaguggcggugcggaaacuggccggaggaacauuaugcuaugguggcccugaauuucguucccacccuuggucagacugagcugcaauugaaggaguuucucaguaucuguaaagaagagaacaugaaguucugcuggcagaaacagcacuuugaagagauuaagggcagccugcagcugacaccucucaauggguga

SEQ ID NO: 52597 - RNA, 1104 nt, Artificial Sequence
  derived and/or modified sequence opt3 from AHSG__Homo_sapiens__NP_001613
augaaaagccuggugcuccuucugugcuuggcccaguuauggggcugucacuccgcuccccaugggccuggacugaucuacagacaaccaaacugcgacgauccggagaccgaagaggcagcccuagucgcgauugacuauauaaaucagaaccuccccugggguuacaagcacacacugaaucagaucgaugaaguuaagguguggccucagcaaccaucuggcgagcuuuucgaaauugagaucgacacucuggagacgaccugucauguauuggaucccacaccuguggcuaggugcucaguccggcagcucaaagaacacgccguggagggggacugugauuuucagcugcugaagcucgacggaaaauucaguguuguguaugcaaagugcgauagcuccccagacucugccgaagauguccgcaaggugugucaggacugccccuuacuggcuccucuuaacgauacucgaguaguucaugcagccaaagcugccuuggcggcauuuaaugcccaaaacaauggcucgaacuuccagcuggaggagauuucacgugcucagcuagugccacucccgcccagcaccuacgucgaauuuacagugagugguaccgacuguguggccaaggaggcaacugaagcugccaaaugcaaucugcuugcggagaagcaguauggguucuguaaagccacacuguccgaaaaguugggaggcgcagaggucgcuguuaccugcaugguguuucaaacgcagccuguaucuagccagccacaacccgagggcgccaacgaagcugugccuacuccagucguggaccccgaugccccgccuuccccaccccucggggcaccuggacugcccccagccgguucacccccugacagucacguuuuacuggcugcgccaccgggccaccagcuccauagagcacacuacgaucuuaggcauaccuucauggggguggucagccugggaucucccuccggcgaggugucacacccucggaagacacgcacuguaguucagccaagcgugggugccgcugccgggcccgucgugccuccaugccccggaagaaucaggcacuuuaaagucuga

SEQ ID NO: 52598 - RNA, 597 nt, Artificial Sequence
  derived and/or modified sequence opt3 from AICDA__Homo_sapiens__NP_065712
auggacagccugcucaugaacagaaggaaguuccuuuaccaguuuaaaaaugugcggugggccaagggccgccgagagaccuaucugugcuacgucguuaaacguagagauuccgcuacaucuuucucauuggacuuuggguauuuaaggaacaagaauggaugucacguggaacugcuauuccuccgguacaucagugauugggaccuggaucccggucgcugcuauagaguaacuugguuuacgagcugguccccuuguuacgacugcgcaaggcauguggccgauuuccuucggggcaacccaaaucugucuuugcgcauuuuuaccgcgcgacucuauuucugugaggacagaaaagcugaaccggaggggcugaggcggcugcaccgugccggaguccaaauagcaaucaugacauuuaaggauuacuucuacugcuggaacacuuuuguggaaaaucaugagcgcaccuucaaggccugggagggccuccacgaaaacucgguuagauuaucaaggcagcugcggcgcauucuuuugccccuguaugagguggacgaucuacgagacgcuuuuagaacacucggucuguga

SEQ ID NO: 52599 - RNA, 921 nt, Artificial Sequence
  derived and/or modified sequence opt3 from AIDA__Homo_sapiens__NP_073742
augagcgaggugaccagaucccugcuccagagguggggcgccucuuuccggcgcggggcugacuuugauucauggggacaacuugucgaagcaaucgacgaguaccagauucuggcccgacacuugcagaaggaagcgcaggcucaacauaacaauagugaguucacagaggagcagaaaaagacuauagguaaaaucgccacgugcuuagagcugcguagcgcagcccuacaguccacccagucucaagaagaguuuaagcucgaagaucugaaaaagcuggagcccauucuuaagaacaucuugacauauaauaaagaguucccuuuugacguucagccagugccgcucagaaggauucuggcucccggcgaagaggaaaaccuggaguucgaagaggaugaggaagaagggggagcaggcgccgguucgccugacucauuuccagcucggguacccgggacucucuuaccucgccugccaagcgaacccggaaugacccuuuugacaaucagaauagagaagaucggccugaaagaugccggccaguguauugacccuuacaucaccgugagugucaaggaucuaaaugggauugaccucacuccagugcaggauacaccgguugcguccaggaaagaagacaccuaugugcacuucaacgucgauaucgagcugcaaaagcauguggagaaacuuacgaagggagcagccauauuuuucgaauuuaagcacuacaaacccaagaaacgguucacuucuaccaagugcuuugcuuucauggagauggacgaaauuaaaccugguccaaucguaauugagcuguauaagaagcccacagacuucaaacgcaagaaauugcagcuccugacuaagaaaccuuuauaccugcaucuccaccagacccuucacaaggaauga

SEQ ID NO: 52600 - RNA, 444 nt, Artificial Sequence
  derived and/or modified sequence opt3 from AIF1__Homo_sapiens__NP_001614
augagccagaccagagaccugcaaggcgggaaggccuucggacuccuuaaagcucagcaggaggaaaggcuggaugagaucaacaagcaguuuuuggacgaucccaaauacuccucugacgaagauuuaccuucaaagcuggaggguuucaaagaaaaguauauggaguuugaccuaaauggcaacggggauauugacauaaugagucucaagcggaugcuggagaaacuuggagugccaaagacacaccuggaauugaaaaagcucaucggcgaggucagcuccgguucuggggaaacuuucucguacccggauuuucugcgcaugaugcugggaaaacgaucagcaauucucaagaugaucuuaauguaugaggagaaggcccgugaaaaagagaagcccacgggcccuccagcgaaaaaggcuauuagcgaacugcccuga

SEQ ID NO: 52601 - RNA, 825 nt, Artificial Sequence
  derived and/or modified sequence opt3 from AIFM1__Homo_sapiens__NP_001124318
augggcaagauccugcccgaguaccucagcaacuggaccauggaaaaagugagaagggagggggucaagguuaugccuaaugccauugugcaguccguaggagugucuucagguaaacuucugauaaaguugaaagacggccggaaggucgaaacagaucacaucguggcugcaguuggguuagagccaaacguggaacuggccaagacuggaggccuagagauugacagugauuucgguggguuucgcgucaaugcggagcuccaagcucgaagcaacaucuggguggccggagacgcagccugcuucuaugauauuaaacugggccguagaaggguagaacaucacgaccaugcuguuguguccggccggcuugcaggggagaauaugacgggagccgcuaagccguacuggcaccagucuauguuuuggucggaucugggucccgacgucggcuaugaagccaucggguugguggauucaagccucccuaccgugggagucuucgcgaaagcaacagcccaggacaacccaaagagugcuacugagcaguccggcaccgguauacgcucugagagcgaaacagaguccgaagccucagagaucaccauucccccuaguacuccagcaguuccccaagcuccugugcagggggaagauuacggaaaaggcguaaucuuuuaucugagagacaagguggucgugggcauuguucuguggaauaucuucaacaggaugccaauagcccggaagauuaucaaagauggggagcagcaugaggaccucaaugaaguggcgaaguuauuuaacauucacgaggacuga

SEQ ID NO: 52602 - RNA, 1122 nt, Artificial Sequence
  derived and/or modified sequence opt3 from AIFM2__Homo_sapiens__NP_001185625
augggcagccagguguccgucgagucuggggcccugcacguugugaucguaggagguggcuucgggggaauugcugcagccucacaacuccaggcgcuuaacgugcccuuuaugcuggucgacaugaaggauaguuuccaucacaauguggcugccuugagagcaagcguugaaaccggcuuugccaaaaagacauucauauccuacucugugacuuuuaaagacaacuucaggcaggguuuagucguggggaucgaucugaagaaucagaugguacuacuccaaggaggcgaggcucugccuuuuucgcaucuuauucuggcaacgggcucaaccgggccauucccgggaaaauuuaacgaaguuagcagucagcaggccgcuauccaggccuaugaggacauggugcggcaaguccagcgcucccgauucauugugguggucgguggcgggucugcgggaguugaaauggcagccgagaucaagacagaguaccccgaaaaggaggugacuuugauacacagccagguagcucucgccgauaaagaacugcugccuuccgugcgucaggaggucaaggagauccucuuaagaaaaggcgugcaacugcuuuugucagaaaggguuaguaaucuggaggaacuaccacucaacgaguaucgggaauacauuaaggugcagaccgacaaagguacagaggucgcaaccaaucuggugauccuuugcacugggauuaagaucaacagcucugcuuaucgcaaggccuuugaguccagacuggcgucaagcggagccuugaggguaaaugaacaucuccagguugagggccacaguaacguguacgcaauaggcgauugugcugacguccggacacccaaaauggccuaucuggcuggguuacacgccaauauugcaguggccaacaucgucaauucugugaagcaacgcccucugcaggcuuacaaaccaggagcgcucaccuuccuucuguccaugggucgaaacgauggcguugggcagauuagcggauuuuacgugggcagauugaugguaaggcuaacgaagucgcgggaccuguucgucucuacuuccuggaaaaccaugcgucagucacccccuuga

SEQ ID NO: 52603 - RNA, 1797 nt, Artificial Sequence
  derived and/or modified sequence opt3 from AIFM3__Homo_sapiens__NP_001018070
augggcgggugcuucagcaagcccaaaccuguggagcugaagaucgaagucguucucccagagaaagaaagaggaaaggaggaacuuuccgccucugguaaaggcucaccgagggcuuaccaggggaacggaaccgcacggcacuuucauacagaggagcgccugaguacuccccacccuuauccaagcccccaagacuguguggaagccgcgguaugccaugugaaggauuuggagaauggccagaugcgagaagucgaguuagguugggggaaggugcugcuaguuaaagacaacggagaguuccacgcucucggccauaaguguccucacuacggcgccccacuggugaaagggguccuuucccguggaagagugaggugccccuggcacggugcauguuuuaauauuucuacgggcgaucuggaagacuucccuggguuggauucgcuccauaaguuucagguaaaaauagagaaggaaaagguuuaugugcgggccucaaaacaggcucugcaacugcagcgcagaaccaaggucauggcaaaaugcaucagcccaagugccggauacuccucuagcacaaacgugcucauugugggcgcuggugccgcgggguuagucugugcagagacucugaggcaggaaggauucuccgaccggaucguucuuugcaccuuggaucgccaucugccguaugaccgacccaagcuaucaaaaagucucgauacacagccugagcaacuggcccuuagaccaaaggaguuuuucagggcuuacggcauugaagugcugaccgaggcccagguagugacugucgacgugcggaccaaaaagguuguguuuaaggauggcuucaaauuggaauauagcaagcuccuguuagcacccgggucuuccccuaaaacacugucauguaagggaaaagaggucgaaaauguguuuacgauccguacuccagaggacgcuaaccgcguaguuagacucgccaggggucggaauguggucguggucggcgcgggguuccuuggaauggagguggccgcauaccugaccgaaaaggcucacagcguuagugugguagaguuggaagagacacccuuucgacgcuuccuaggcgaaagagucgguagggcccugaugaagauguucgagaacaaucgggugaaauuuuacaugcagacugagguuucugaacuccgcgggcaggagggcaagcugaaagaagugguccuuaaguccagcaaagugguaagagcugaugugugcguugucggaauaggcgccgugccggcaaccggguuccugaggcaaucgggaaucgguuuggacucucguggcuuuauuccugugaacaagaugaugcagacaaauguccccgggguuuucgccgcuggagacgcggugaccuuuccacucgcauggcggaacaaucgaaaggugaacaucccucacuggcagauggcccacgcucaaggcagaguagccgcacagaauaugcuggcccaggaggcugagauguccacgguccccuauuuauggacugccauguucgguaaaucacugagguacgcaggguauggcgaaggauuugaugacgugauuauccagggcgaucuagaggaacucaaguucguugcguuuuacacaaaaggggacgaggugauagcugucgccaguaugaacuaugauccaauugugagcaagguugcagaagugcuggccuccggacgcgcuauccggaaaagagagguagagaccggugacaugucuuggcuuacuggcaaggggagcuga

SEQ ID NO: 52604 - RNA, 687 nt, Artificial Sequence
  derived and/or modified sequence opt3 from AIG1__Homo_sapiens__NP_001273516
auggccauccugcucagcuacugcuccauucuuuguaacuauaaggcuauagagaugcccucucaccagaccuacggcgggucauggaaauuccugacauuuaucgacuuggugauucaagcagucuucuuuggaaucugcguuuuaacugaucugaguagccuacucacgagagguuccggcaaucaggaacaggagaggcagcugaagaaacuuauuucucugcgggacuggauguuggccgugcucgcguucccuguagggguguuugucguggcuguuuucuggaucauauaugccuacgaucgcgaaaugaucuauccaaagcugcuggacaacuuuauuccgggauggcucaaucauggcaugcacaccacaguguuacccuucauccugauugagaugcgaacuucgcaucaccaauacccuucacguagcaguggucuuaccgcaaucuguacauuuuccgucggguauauauugugggugugcuggguacaucacguuaccggaauguggguguacccauuccuggaacacauuggccccggcgccagaaucaucuuuuucgggucuacuacaauucuaaugaacuuucucuaccugcuuggagagguccugaauaacuauaucugggauacccagaaaagcauggaggaagagaaggaaaagccuaaauuggaguga

SEQ ID NO: 52605 - RNA, 5172 nt, Artificial Sequence
  derived and/or modified sequence opt3 from AIM1__Homo_sapiens__NP_001615
auggaaaagagaucguccggcaggcggucugggcgccgacguggaucacagaaaaguaccgacagccccggugccgaugcugaacugccugaauccgccgccagagacgaugcgguguucgacgaugaagucgcuccaaacgccgcaucugacaaugccucggcugagaagaaaguuaagucaccgagggcagcccucgauggcgggguggcuagcgccgcgagucccgaauccaaaccuucuccaggaacaaagggccaacuucggggugagagcgaccgcuccaagcagcccccuccagcaucaagucccacuaaaagaaaggggaggagccgggcccuggaggcuguaccugccccaccggcaucuggaccccgcgcuccugccaaagaauccccacccaagcgagugccugauccaucacccgucacgaaaggcaccgcggccgagagcggcgaagaggcagcuagagccaucccgagggaguugccugugaagaguucuuccuuacugcccgaaauuaagccagagcacaaacgggggccucuacccaaccacuuuaauggacgugcugaagguggccgcagcagagagcucgggagggccgcaggagccccaggcgcuucggacgcggauggucugaagccccggaaccacuucgggguuggacgaucuacagugacuaccaaagucacacuuccugcaaagccaaaacauguggaacugaauuugaagaccccgaaaaaccucgacucccugggcaaugagcacaaccccuuuucacagccuguacauaagggcaauacugccacaaagauaagucuguucgagaacaaacgcaccaauagcuccccaagacacacggauaucagggggcagcggaacacucccgcuucuagcaagaccuuuguuggacgcgccaaacucaauuuagcaaagaaagccaaggaaauggagcaaccugaaaagaaagugaugccaaacucaccccagaaugguguccuggugaaggagacagcuauugaaacuaaagugaccgucagugaggaggaaauccuuccggccacaagaggcaugaacggggacuccagcgagaaccaggcauugggaccucagccaaaucaagacgauaaggcggacguucagaccgaugcuggcugccugucugaacccguggccucagcacuaauuccuguaaaagaccacaagcuccuggagaaggaagauagugaggccgcugacagcaaaucccuugugcuggagaacgucacggauacugcccaggacauccccacaaccguggauacuaaggacuugccaccuacagcaaugcccaaaccacagcauaccuucucugauucgcaaagcccggcugaauccucaccuggucccagucucucucugagcgccccagcgcccggggacguuccuaaggacacgugugugcaguccccaauaagcucauuucccugcaccgauuuaaaagucucugagaaucacaagggcugugugcugccuguauccaggcagaacaaugaaaagaugccgcuccuugagcugggaggcgagacaacuccacccuugaguaccgaacguagcccugaggccguugggucugaaugcccaucccgggugcuaguccaagugcgaucauucguccugcccguggagaguacacaggacguuagcagccaggugaucccugaauccucugagguaagagagguccagcucccgacuugucauagcaacgaacccgaggugguuucaguggcuaguugcgcaccaccucaagaagagguccugggaaaugaacacucccacuguaccgccgagcuugcugccaaaucugguccccaggugauuccuccagcaagcgagaagacacugcccauccaggcgcagucccaaggcucaaggaccccauugauggccgaaagcaguccgacuaacucuccuuccagcgggaaucaucucgcuacgccccagcgcccagaucagacaguaaccaacggacaggacucgcccgccucacuguuaaauauuucugcaggcagugaugacuccguguuugauagcucuagcgacauggagaaauucacugaaaucauaaagcaaauggauuccgcuguuugcaugccuaugaaacggaagaaagccagaaugccaaacucacccgcaccucacuuugccaugccgccaauucaugaggaccaccuggaaaaggucuucgaucccaagguguuuaccuucggucuagggaaaaagaaagagagucagccugagaugagccccgcucuccaucugaugcagaaucuugacacaaagucuaaauugaggccaaagcgcgcguccgccgaacagucagugcuguucaagagucuccacaccaacacuaauggcaacagcgagccucuggucaugcccgaaaucaacgauaaagagaaucgagacguuacaaacggaggcauuaagcggucccgucuugagaaaucugcacuguuuucgagcuugcucucaucccugccacaagacaagaucuucaguccuucugugacgagcgugaauaccaugacuacagcuuuuuccaccucacagaacgggucuuuaagccagaguuccguaagccaaccgacaacugaaggagcacccccauguggucugaauaaagagcagucuaaccuacucccugauaauucacugaaggucuucaacuuuaauuccaguagcaccucgcacucuucccuuaagagccccucacauauggaaaaauacccacagaaggagaaaacgaaggaagacuuggauaguagaucuaaccugcaccucccugagaccaaauucuccgagcugagcaaguuaaagaaugacgauauggaaaaagccaaccauaucgagucagugauuaagaguaaucugcccaacugcgcuaauagcgacacagauuuuaugggccuuuucaaauccucuagguaugacccgagcauauccuuuucagggaugucuuugagugauacuaugacccuccgcggaucgguucagaacaagcugaacccacggccuggcaaaguggucaucuacagcgaacccgacguguccgagaaguguauugaaguuuucucugauauccaagacugcucaagcuggucccuaaguccagugauacugauuaaaguagucagagguugcuggauccucuaugagcagcccaauuuugaggggcacucuaucccucuggaagagggcgaacuugaguugagcggacuguggggcauugaagauaucuuagagaggcacgaggaagcagagucagacaagccgguggugauuggguccauacgacaugucguucaggacuaccgcgugagucacaucgaucucuucacagaacccgagggacugggcauucuuagcucuuauuuugacgauacugaggaaaugcaggguuucgggguaaugcaaaagaccuguuccaugaaagugcauuggggaacguggcugaucuacgaggaaccaggcuuccagggugucccuuuuaucuuggagcccggcgaauauccugaccucucauucugggauacagaggaggccuacauugggagcaugcggccacugaagaugggaggcagaaaaguggaauuucccaccgacccuaagguuguggucuacgagaaaccauucuuugaagggaagugcguggagcuagaaacuggaauguguucguucguuauggagggcggugagacagaagaggcgaccggggaugaccaucugcccuuuacuucugugggaaguaugaagguccucaggggcauauggguagcuuaugaaaaaccggguuucaccggccaucaguaccugcuugaggaaggggaguaucgugauuggaaggccuggggaggcuacaacggggaguugcagucccugcgcccuaucuuaggagacuuuagcaaugcacacaugauuauguauucagagaaaaacuucggcuccaaggguucuagcaucgaugugcucgggauuguugccaaucugaaagagacaggauacggcgugaagacgcaaaguaucaacguccuuuccgguguguggguagcuuaugaaaauccagacuuuaccggcgagcaguacauacuggacaagggguucuacacuagcuuugaggauuggggaggcaaaaacugcaagaucucuucagugcagcccauuugucuagacaguuucacagggccucggagaaggaaucaaauccaccucuucuccgaaccacaguuucagggacauagccagucuuucgaggaaaccacaucgcaaauugaugacucauuuagcacuaaauccugccgagucaguggcgguucuuggguuguguaugauggggagaacuucaccggaaaucaguacgugcuggaagagggccacuaucccuguuugagcgcaaugggcugcccgccuggggccacguuuaagucccugcgguucaucgacgucgaguuuucagaacccacaauaauuuuauucgagcgcgaagauuuuaaaggaaagaagaucgagcucaacgcggaaaccgugaaucugagaagucuugguuucaacacucagauuaggucuguucagguaaucggcgggauaugggugaccuacgaguauggaagcuaccggggccgacaauuucuguuguccccagcugaggucccuaauugguaugaguucucagguuguagacagaucgggagccuccgccccuucgugcagaaaaggauuuacuuucgucugcggaacaaggccacaggacuauucaugucuacuaacggcaaucuggaggaccuuaaacuccugagaauccagguuauggaagaugugggcgcagacgaucaaauuuggaucuaccaggaggggugcauaaaguguaggauugccgaagacugcugcuugaccaucgucggaucccuggugacaagugguagcaaauuaggccucgcucuggaucagaacgccgacucgcaguuuuggucccuuaagucugacgggcgcaucuauucaaagcugaaaccaaauuugguacucgauauuaagggaggcacgcaauacgaccagaaccauaucauucugaauaccgucagcaaagagaaguucacucaggugugggaggcaaugguucuauauacauga

SEQ ID NO: 52606 - RNA, 1032 nt, Artificial Sequence
  derived and/or modified sequence opt3 from AIM2__Homo_sapiens__NP_004824
auggagagcaaguacaaagaaauccugcuccuuaccggccuggacaacauuacagaugaggaauuggacagauucaaguuuuucuuauccgaugaguuuaauauagccacugggaaacugcacacggcuaacaggauccagguggcaacccuaaugauucaaaaugccggagcggucucugcuguuaugaagacaauccggauuuuccagaaacucaacuauaugcugcuugccaagcgccugcaggaagagaaggagaaaguggacaagcaguacaaaucaguaacuaagcccaaaccuuugagucaagcagaaaugagcccagccgcuuccgcagccauccgaaaugauguggcuaagcagcgugccgcgccgaaggucucuccccaugugaaaccugagcagaagcagaugguugcacaacaggaaucgauaagagaggguuuucagaaaaggugccucccagugaugguccugaaggccaaaaagcccuucaccuuugagacacaggaaggcaaacaagagauguuccacgcuaccguggccacugaaaaggaguuuuucuuuguaaagguuuucaacacacugcucaaagacaaguuuaucccuaaacggauuaucauuaucgcacgcuauuacagacauucaggguucuuagaagugaauagcgcuaguaggguccuggaugccgaguccgaccagaaggugaacgugccacuuaauauaauucggaaagcgggagagacccccaagaucaacacguugcagacucaaccucugggcaccauugucaauggucuauucguugugcagaagguaacagagaaaaagaaaaacauccucuuugaucugucugacaauacugggaagauggaagugcuuggaguccgcaacgaagauaccaugaaauguaaggagggcgacaaggugcgacugacauucuuuaccuugagcaaaaauggcgaaaagcuccagcugacguccgggguucacucaacuaucaaagugauuaaggccaaaaagaagacauga

SEQ ID NO: 52607 - RNA, 939 nt, Artificial Sequence
  derived and/or modified sequence opt3 from AIMP1__Homo_sapiens__NP_001135887
auggccaacaaugacgcugugcugaagagacucgagcagaaaggcgcagaagccgaucaaaucauugaguaccuuaagcagcaggucagccuguugaaagaaaaggcgauauuacaggcuacccugagggaggagaaaaagcuacggguugagaacgccaagcucaaaaaggagaucgaagaacugaaacaagaacuuauucaggcagagauccagaauggggugaagcagauucccuucccuuccggaacaccacugcacgccaacucuaugguaucagagaaugugauccaaaguacugcugucacgaccgugagcuccgguacaaaagaacagauaaagggcgggacuggagacgagaagaaagcaaaggagaaaaucgaaaagaaaggcgaaaagaaagagaagaagcagcagucuauugccgguucggcugauucaaaaccgaucgacguuagccgcuuggaucuccgaauugggugcaucauaaccgcccguaagcaucccgacgcggauagucuguauguggaggaagucgacgugggagagauugcaccuagaacaguaguuuccggccuggugaaccacgucccacucgaacaaaugcagaauaggauggugaucuuacuguguaaccuuaaacccgccaagaugcggggcguguugucucaggcuauggucaugugcgccagcuccccugagaaaauugaaauccuggcaccacccaaugggucaguuccuggagaucgcaucaccuuugacgcuuucccaggugagccggauaaggagcuaaaccccaagaaaaagauuugggaacaaauacagccugaccuccauacuaaugaugaguguguggccacauacaaaggcguaccauuugaagugaaggggaaaggagucugcagagcgcagaccaugaguaacagcggcaucaaguga

SEQ ID NO: 52608 - RNA, 963 nt, Artificial Sequence
  derived and/or modified sequence opt3 from AIMP2__Homo_sapiens__NP_006294
augcccauguaccaggugaagccuuaucacggcgggggagccccacugagagucgagcucccgaccugcauguacaggcuucccaacguucauggucggagcuauggcccugcuccaggggcaggacacgugcaagaagaguccaaucugucuuugcaggccuuagaaucacgccaggacgauauccugaaacgacuauacgagcucaaggcggcuguagacggccugaguaaaaugauucagacacccgaugccgaccuugaugugacuaacauaauccaagcagacgaaccuacgacccugacaacuaaugccuuggaucucaacagcguccuggguaaggacuauggggcucugaaagauauugugaucaaugcaaacccagccucucccccucucuccuuacugguucuucaucguuugcugugugagcacuucagagugcuaucgaccguccauacacacucaagcgugaagaguguaccagagaaucuccugaagugcuuuggagaacagaacaaaaagcagccgaggcaggacuaccaacuuggcuucacccugauuuggaaaaauguucccaagacucagaugaaauuuuccauccagacaauguguccuauagagggcgaagggaacaucgcucgguucuuguuuucucucuucggacagaagcacaaugccgugaacgcgacccugauugauagcugggucgacaucgcaauuuuucaauuaaaggaggguuccucaaaagagaaggccgcuguguuccgcaguaugaauagcgcccugggcaaaucuccauggcucgcagggaacgaacuuacgguggcugaugucguucugugguccguguugcagcagaucggaggcugcucaguaacugugcccgccaauguccaaagauggaugaggagcugugagaaccuagcgccuuuuaacaccgcccugaagcuccugaaauga

SEQ ID NO: 52609 - RNA, 993 nt, Artificial Sequence
  derived and/or modified sequence opt3 from AIP__Homo_sapiens__NP_003968
auggccgacaucauugcuagacugagggaggauggcauacagaagcgggugauccaagaagggcgcggagagcuccccgacuuccaggaugguaccaaagcaacauuucacuaccgaacucuucauagcgacgaugaaggcacgguccuggacgauucccgugccagagggaagccuauggaguugauuaucggcaaaaaguucaaauuaccaguuugggaaaccauugugugcacaaugagggagggagagaucgcgcaguuucugugugacauaaagcacguagugcuauauccgcucgucgcuaagucucugcggaacaucgccguggguaaagauccccuugaagggcagcgccauugcuguggaguugcacaaaugagagagcacucaagucugggccaugccgacuuggaugcucuccagcagaauccucagccacugauuuuccacauggaaaugcugaagguggagagccccggcacuuaccaacaggacccuugggcaaugaccgaugaggaaaaagccaaggcugucccacucauccaccaggaggggaacagguuauaucgggaaggacaugugaaagaggccgcggcaaaguacuaugacgccauugcuugccugaagaaucuucagaugaaagaacaacccgguuccccugaguggauccaguuggaccagcaaauaacaccacugcuacucaacuacugucagugcaagcugguaguugaggaauauuacgaggugcuugaucacuguucuucgauucugaauaaauacgacgauaacgucaaggccuauuuuaaacgcggcaaggcacaugcugccguguggaaugcgcaggaagcccaggcagacuucgcuaaaguguuggagcucgauccggcccuggcucccgucguuucacgagaauuaagagcccuggaggcaaggauccggcaaaaggacgaggaagauaaggcccguuuucgcgggauuuucagccacuga

SEQ ID NO: 52610 - RNA, 966 nt, Artificial Sequence
  derived and/or modified sequence opt3 from AIPL1__Homo_sapiens__NP_001028226
auggacgccgcucugcuccuuaacguggagggcgucaagaaaaccauccugcacgggggaacaggugaauugcccaauuucauuacuggcagcagaguuauauuucauuucaggacgaugaagugcgaugaggaacggaccgugaucgacgauucccgccagguagggcaaccuaugcacauuaucauuggaaacauguuuaaauuagaggugugggaaauccugcuaacaucuaugcgaguccaugagguggcagaguucuggugugacacuauaguugaugccccaucagacuaccagcgugaaaccuggaaucucaguaaccacgagaagaugaaagcggugccgguccugcauggcgaagguaauagacuuuuuaagcuggggagguaugaggaggcuagcuccaaguaccaggaagccaucauuugcuugcggaaccuccagacaaaagagaagcccugggaagugcaauggcugaaacuggagaagaugaucaauacccucauuuuaaacuauugucagugccugcuuaaaaaggaagaguacuaugagguauuggaacacacuucugauauccugcgccaccauccuggaauaguuaaggcauacuaugugagagccagggcucacgcagaggucuggaaugaagccgaggcuaaagccgaccuacagaaggugcucgaacuggagccaucgaugcagaaagcggugcggcgcgagcuucgacuguuggaaaacagaauggcagagaagcaagaagaggaaaggcuccggugucguaauaugcugucacagggcgccacacagcccccugcugagccacccaccgagccuccagcccagagcaguacggaaccgcccgcagagccuccaacugcucccuccgccgaauuaucugcgggcccuccagccgagcccgcaaccgagccgccucccagcccagggcauucccugcaacacuga

SEQ ID NO: 52611 - RNA, 1638 nt, Artificial Sequence
  derived and/or modified sequence opt3 from AIRE__Homo_sapiens__NP_000374
auggccaccgacgcugcacugagaaggcuccuucggcugcaccgcacagagaucgccguggcggucgauagcgcuuuccccuuguuacaugcccuggcagaccacgauguugugccugaagacaaguuucaggagacucuacaucucaaagaaaaggagggcugcccacaagccuuccacgcucugcuuuccuggcuguugacgcaggauucuaccgcaauucucgacuuuuggcgaguacuguucaaagauuacaaccuggaacguuaugggagacuccagccgauauuagacucauuucccaaggauguggaccugagucagccuaggaaaggacggaagccacccgccgucccuaaggcucuugugccacccccucgcuugccaacaaaaagaaaggccagcgaggaggcgagggcagccgcuccggccgcacugacuccccgggguaccgcuuccccuggcucucaacuaaaagccaagccacccaaaaagccugaaucgucagcggagcagcagcgccucccacuggggaauggaauccagacaaugagcgccaguguucaacgagcaguggcuauguccucuggcgauguccccggugccagaggggcuguggaaggcauucuuauccagcagguauucgagagcggaggcuccaagaaauguauucagguugggggagaguuuuacaccccgucaaaguucgaagacagugguagcggcaaaaacaaggccaggucuuccucagggccuaaaccccuggugcgggcaaagggagcccaaggcgcugcgccaggugggggagaggcacguuugggccagcagggcagcgucccugcuccccucgcccugccaagugauccccaauuacaucagaaaaaugaagacgagugcgccgugugucgcgacgggggagaacugaucugcugugaugguugcccuagagcauuucaccucgccugucuuucuccaccgcugagggagauacccuccggcacuuggcggugcagcucguguuugcaggcuacagugcaggagguccaaccucgagccgaggaaccacgcccccaggaaccuccaguugagacaccccuaccgccugggcugagaucugcaggagaagaggugaggggcccacccggugagccucucgcggggauggacacgacucugguauauaagcaccuucccgcuccaccuuccgccgcaccccugccaggcuuggauucaagugcccuccauccgcuguuaugcgugggaccugaaggccagcagaaccuggcucccggggcccgguguggagucugcggugacggcaccgaugugcuacgcugcacacacugugcagcugccuuccauuggagaugccacuuuccagcggggacuagcaggcccggaaccggccuccguugucgguccugcucuggugacguuaccccugccccaguggaggggguccuggcucccagcccugcacgacuugccccgggcccagcuaaggaugacaccgccucacacgaacccgcauugcauagagaugaccuggagagucuccuguccgaacacacguucgauggaauccuucaaugggcgauucagagcauggccaggccugcugccccauuucccucuuga

SEQ ID NO: 52612 - RNA, 1236 nt, Artificial Sequence
  derived and/or modified sequence opt3 from AJAP1__Homo_sapiens__XP_011540088
auguggauccagcaacugcucggccuuagcuccaugucuauuagauggcccgggaggccucugggaucacacgccuggauauugaucgcuauguuccaguuagcaguggaccugccagccugcgaggcgcuagguccgggccccgaauuuuggcuccugccucggaguccaccccgcccuccacgacuuuggagcuuccguuccgggcagcccgcuagagucccugccccaguuuggucuccgaggcccccucggguggagcgcauucauggacagaugcaaaugccaagagcaaggcgggcccaccgcccccgagaucaggcugcagcccugguaccuaaggcuggcuuggccaaaccacccgcggcagccaagucgucaccgagccucgcuaguuccucuagcuccucaaguagcgccguggcugguggggcaccugaacagcaggcccugcugagaaggggaaaacggcaucuccaaggcgacggcuuaucuuccuuugauucacgugggagccgccccaccacagagacugaguucaucgcguggggaccaacgggugacgaagaggcccuggaaaguaacaccuuuccuggcgucuacgggcccacaacugugucuauucuucagaccagaaagacaaccguugcagcuacuacaaccacgacuaccacagccacuccaaugaccuugcagacaaaaggauucaccgagucccuggaucccaggcggcgaaucccuggcggugugagcacgacugaaccaucgacaucuccguccaauaacggggaggucacccagcccccucgcauacuaggagaggcuucaggccucgccgugcaccaaaucauuacuaucacaguaagucugauuaugguuaucgcagcccuuauaaccacgcugguguugaagaauuguugcgcucagagcggcaacaccagaaggaacucccaucagcggaagacaaaucaacaggaagagucuugucagaaucucacugacuuuccaagcgcgcgcguccccucaagucuggauauuuucaccgcauauaacgaaacauuacagugcucccacgagugugugagagccagcgugccugucuacacugacgaaacccugcacucuacaaccggggaguauaaaucaacuuuuaauggaaacaggccaaguagcuccgaucgucaucucauccccguugcuuucgugucugagaagugguuugaaauuucgugcuga

SEQ ID NO: 52613 - RNA, 1617 nt, Artificial Sequence
  derived and/or modified sequence opt3 from AJUBA__Homo_sapiens__NP_116265
auggagagacugggcgaaaaggccagcaggcuccuugagaaauucgggcggcgcaagggagaauccucucgaucagguagugacggcacccccgggccuggaaaaggccgucugagcgguuuagggggaccaagaaaguccggcccgaggggcgcuacagggggacccggugaugagccuuuggaaccagcacgggagcagggcucucuggacgccgagcgcaaccaaagagggucguuugaagcgcccagguacgagggaucauucccugcuggcccacccccuacucgggcccuaccacucccgcagagccugcccccugauuuucgccuugaaccaacggcacccgcccugaguccucgauccucuuucgcuagcuccucagcaagugacgccagcaaaccaucuucccccagagguucauugcuccuggauggggcuggagccggcggcgcagggggaagcaggccgugcaguaaucggaccucugguaucuccaugggcuaugaccagcgucacgggagcccucugcccgcgggaccaugucucuuuggcccucccuuagccggugcuccagccggguacucgcccggcggagugccuucugcauauccagagcugcaugcugcccuugaucgcuuguacgcgcagagaccggccggcuucgggugccaagaguccaggcacucauaucccccugcacugggaaguccaggugcucuagccggcgcuggggucggagccgcaggcccccucgaacggcgaggugcccagccugggcgccauagcguuacaggcuacggagacugugcugugggcgcgagauaucaggaugagcugacugcacuucugagguugaccguagggacaggaggucgggaagccggcgcucgcggggagccauccggaauugaacccucuggccucgaggagccgccugguccauuugugcccgaagccgcaagagccaggaugcgugagccugaagcucgggaggacuacuucgggaccugcauaaaguguaacaagggcaucuacggacagagcaaugccugccaagcacuggauucauuauaucacacucaguguuuugucugcuguaguugcggccgaacacugagauguaaagcguucuacuccgugaacgggagcguuuauugcgaagaggacuaccucuuuucuggauuccaggaggcugccgaaaagugcugugugugcggccaucuuauucuggagaaaaucuugcaggcaauggguaagucauaucaccccggguguuuuaggugcauugucuguaauaaaugccuagauggaaucccauucaccguggacuucaguaaccaaguauacuguguuacggacuaucacaagaauuacgccccuaagugcgcugccuguggccagcccauacugccaagcgaagguugcgaggauaucgugcgcgucauuuccauggaccgggauuaccauuuugaauguuaucacugcgaggacugcagaaugcagcucucugaugaggaaggcuguugcuguuucccgcuggacgggcaucuucugugccacggaugucacaugcaaagguugaacgcacgccagccucccgcuaauuacaucuga

SEQ ID NO: 52614 - RNA, 585 nt, Artificial Sequence
  derived and/or modified sequence opt3 from AK1__Homo_sapiens__NP_000467
auggaggaaaagcugaaaaagaccaaaaucauuuucguggucggcgggcccggaagcgguaagggcacacagugcgagaaaauaguucaaaaguacggguauacucaccucuccacgggagaccuucugagaucugaagugucaaguggcagcgccagggguaagaaauuguccgagaucauggaaaaggggcaguuaguaccucuggagaccgugcuagauaugcuccgggacgcuauggucgcaaaagugaacacaucuaagggauuucugauugauggcuacccacgcgagguucagcagggcgaagaguucgaacgacguaucgggcaaccgacucuucuguuguauguggacgccggacccgagaccaugacacagagacuccugaaaaggggugagaccucgggccgggucgaugacaaugaagagacuauuaagaagcgccuggaaacauacuauaaagcgaccgagccugugaucgcuuuuuacgaaaagagagggauaguaaggaaaguuaacgccgagggaucaguggauagcgucuucagucagguguguacgcaucucgacgcauuaaaguga

SEQ ID NO: 52615 - RNA, 564 nt, Artificial Sequence
  derived and/or modified sequence opt3 from AK3__Homo_sapiens__NP_001186781
augggcgccagcgcuagacugcucagggcagugaucaugggggcccccggauccgguaagggcaccgucucuucacggauuacaacucacuucgagcuuaaacaucugaguagcggggacuuguuacgcgauaacaugcugcgaggaacgggcuuuccucguacccuaccacaggcggaagcucucgacagagccuaccaaauagauacaguuaucaaucugaacgugccguucgagguaauuaagcagaggcuuacugcacgguggauccaccccgccuccggucgcguguauaauauugaauuuaacccuccaaaaaccgucgggaucgacgaucugacaggagagcccuugauacagagagaagacgauaagccugagaccgugaucaaaaggcucaaggcuuacgaggaccagacuaagccaguucuggaauauuaccagaaaaagggcgugcuggagacauucucuggcaccgaaacgaauaaaauuuggcccuaugucuacgcauuucuccaaacuaaggugccucagcggucgcagaaagccucaguaaccccauga

SEQ ID NO: 52616 - RNA, 510 nt, Artificial Sequence
  derived and/or modified sequence opt3 from AK6__Homo_sapiens__NP_001015891
augugccacagaaagcccggcaccccuggggugggaaaaacaacucuggguaaggagcucgccagcaaauccggccuuaaguacaucaacgucggggaccuggcuagggaagaacaguuguaugauggauacgacgaagaguaugauuguccaauuuuagacgaagaucggguuguggacgagcuggauaaucaaaugcgcgagggcgguguaauaguggacuaccaugggugcgauuucuuuccggaacgaugguuccacaucgucuuugugcuacguacggacaccaacguucucuaugagagacuggaaacaaggggauacaaugagaaaaagcugacugauaacauucagugugagaucuuccaggugcuuuaugaagaggcaaccgccucuuacaaggaagagauuguccaucaguugcccucaaauaaaccugaggagcucgagaacaauguggaccaaauccugaaguggauagaacaguggaucaaagaucacaacaguuga

SEQ ID NO: 52617 - RNA, 2172 nt, Artificial Sequence
  derived and/or modified sequence opt3 from AK7__Homo_sapiens__NP_689540
auggccgaggaagaggaaaccgcugcacugacagagaaggugaucagaacucagagggucuucauuaaccuccuugacagcuacuccucuggcaauauagggaaauuucugucaaacugcguugugggagccaguuuggaagagaucacggaggaagaggaagaggaggaugaaaauaagagcgcgauguuagaggcuuccucuaccaaaguaaaggaagguacauuccaaauugugggcacucugucgaaacccgacucaccucggccagauuuugccgucgagaccuauagcgcaaucagucgcgaagaccuacucaugcgacugcuugagugugaugugauuaucuacaacauaacagaguccucucagcagauggaagaggccaucugggcuguuagcgcacuguccgaagaggugucacacuucgaaaagcguaaguuguuuauucuccugaguaccgucaugacuugggccagaagcaaagcucuggacccggaggauucugaggugcccuucacagaagaggacuauaggcggcgcaagucccauccuaauuuucucgaucacaucaacgccgagaaaaugguauuaaaguucgggaaaaaggcgagaaaguuugcagccuacguuguggcugccggacugcaguauggcgcagaaggugggaugcuucauaccuucuuuaaaauggcuugguugggagaaauuccagcccugcccgucuucggcgacggcacgaaugugaucccuacuauacacgugcuagaucucgcgggggucauucaaaacguuaucgaccaugugccaaagccccacuaccugguagccguggaugagucaguccacacccuugaggacauugugaaaugcaucagcaagaauacaggaccugguaaaauccagaagauuccaagggaaaacgcauaucugacuaaagacuugacccaggauugucucgaccaucuguuaguuaaucugcggauggaggcucucuuugugaaggaaaacuucaauauacgcugggccgcucagacaggcuucgucgagaacaucaauaccauucuuaaggaguacaaacaaagucgagggcugaugccgaucaagauaugcauuuugggacccccugccgugggcaaaucuuccaucgcaaaggaacuagccaacuacuauaaacugcaccauauccagcucaaggauguaauuagcgaggcuaucgcgaagcuggaagcaauuguugccccaaacgacgugggugagggggaagaggaggucgaagaggaagaggaagaggagaauguggaagaugcucaggagcuucuggacggaauaaaagaaucgauggagcagaacgccggccaauuggaugaccaguacaucauuagauuuaugaaggaaaaacucaagucuaugcccuguaggaaucagggcuauauccuggauggguucccuaaaacguacgaccaagcaaaggauuuauuuaaccaggaggacgaggaagaggaagacgauguccggggacguauguucccauuugacaagcugaucauucccgaguucgugugcgcccuagaugcuuccgacgaguuucucaaagaacgcguuauaaaucugccggagucaaucguggccgguacucacuauagucaggauagauuccuuagggcauugagcaacuaccgggacauuaauaucgaugacgaaacaguauuuaacuauuucgaugagcuggaaauucacccuauccauauagacgucggcaagcucgaggaugcgcagaaucgacuggcuaucaaacaacuuauuaaggagaucggggaaccccgcaacuacggacugaccgacgaggaaaaagccgaggaagagagaaaggcagccgaggaaagguuggcucgggaggccgcagaagaggcugaacgcgagcaccaggaggccguggaaauggcggagaagauugccagaugggaagaguggaauaaaaggcucgaggaaguuaagcgugaggaacgggagcuguuagaagcucaguccaucccacugcgaaacuaccuaaugacuuaugugaugccuacacucauacagggccugaaugaguguugcaacgucagacccgaggauccaguggacuuucuugcagaauacuuguucaaaaauaaccccgaggcccaauga

SEQ ID NO: 52618 - RNA, 1440 nt, Artificial Sequence
  derived and/or modified sequence opt3 from AK8__Homo_sapiens__NP_689785
auggacgccaccaucgcuccccacaggauuccuccagagaugccgcaguacggcgaagagaaccauauauucgaacugaugcaaaauaugcucgagcagcuucugauccaccagcccgaagauccuauuccauuuaugauccagcauuugcacagagacaacgauaaugugccccggauugucaucuuagggccuccagcaagcggaaagacaacuauagccauguggcugugcaaacaucuaaacuccucucuccugacgcuugagaaucugaucuugaacgaguucucauauaccgcgacagaagcucgccgacucuaccugcaacguaagacuguucccagugcccugcucgugcaguuaauucaggagagacuggcagaagaggacuguaucaaacaggguuggauucuugauggcaucccugagaccagggaacaagccuugcggauacagacacuggggauuaccccacgccacguaaucgugcuaagcgcuccggacacuguccucauugagagaaaucugggaaagaggaucgauccccagacaggcgaaaucuaucacaccacguuugacuggccuccagaguccgaaauucagaaccggcuuauggugcccgaggauauaucugagcuggaaacugcacaaaaauugcucgaguaccaucgcaauaucguucgagugauuccuucguauccaaagauccugaaggucauaucagccgaccagcccugcguggauguauucuaccaggcuuuaaccuauguucaaagcaaccacagaacaaaugccccguuuacuccuagggugcugcuccuuggucccgucgggaguggaaaaucccugcaggcggcauugcuagcccagaaguaccggcuggugaacguguguugcggccagcuccugaaagaagcugucgccgaccguaccacauucggcgagcuuauucaaccauuuuucgaaaaggagauggcaguuccugauucucuguugaugaaagugcucagccagcgccuggaccagcaggacuguauccaaaagggguggguauuacauggagugcccagagaucuggaccaggcucaccuacucaauaggcuggguuacaacccaaaucgggucuuuuuccuuaacgugcccuuugauuccaucauggagcgauugacccugcgcagaauugacccuguuacgggcgaaagguaucaccucauguacaagccaccgcccacuauggagauccaggcccggcugcuucagaacccuaaagaugcggaggaacaagugaagcugaaaauggacuuguucuaucgcaauucagccgaucucgaacagcuguacgggagugcaauuacauuaaacggagaccaggauccauauaccgucuuugaguacauagagagcggcaucauuaauccccugccuaagaaaaucccauga

SEQ ID NO: 52619 - RNA, 1266 nt, Artificial Sequence
  derived and/or modified sequence opt3 from AK9__Homo_sapiens__NP_659462
augaccagccaggagaagacagaagaguaccccuucgccgacaucuuugaugaagacgagacugaaagaaacuuccugcucuccaaaccugugugcuuugucguuuucggcaagccaggggugggaaaaacgacccuugcuagguauauuacacaagcauggaaguguauacggguagaggcccugccgaucuuggaggaacagauugcggcugagacugaaucuggugugauguuacagucaaugcugaucaguggccagagcauucccgaugagcuagucaucaaacucaugcuggagaaacuuaauuccccugaagugugccacuuuggguacauaaucaccgagauuccaucucugucgcaagacgccaugacaaccuugcagcagaucgaacucauuaagaaccugaaucugaaacccgauguuaucauaaacauuaaguguccugacuaugaucucugccagcgcaucucaggacaacgacagcauaauaacacuggcuacauuuauagccgugaccagugggauccagaggugaucgaaaaucacagaaagaagaaaaaggaggcacagaaggacgguaaaggggaggaagaggaagaggaagaggagcaagaagaggaagaggccuucaucgcugaaaugcagauggucgcagagauuuuacaucaccuggugcagaggcccgaggauuaccuugaaaacguagagaauauaguuaaguuguauaaagaaacaauccugcaaacccuagaggaggugauggccgaacauaacccucaguaccucauugagcugaauggaaacaagccagcugaggaacuuuuuaugaucgucauggaccggcugaaauacuugaaucucaagcgcgccgcgauacugacgaaauuacagggcgcagaagaggagauuaacgauacuauggaaaaugacgagcuguucagaacccucgccaguuauaaacuuaucgcuccgagguaccgguggcagcgcuccaaguggggccgaacaugucccgugaaccugaaggacgggaacaucuauucuggauugccugauuacagcguguccuuucuagguaagauuuauugccugucaagugaagaggcccucaaaccauuccugcuuaaucccagaccuuaccuguugccacccaugccgggcccucccuguaaggucuuuauccucgggccacaauauagcggaaaaacuacccugugcaacauguuagcagaaaauuacaagggcaagguuacaaacuga

SEQ ID NO: 52620 - RNA, 1989 nt, Artificial Sequence
  derived and/or modified sequence opt3 from AKAP10__Homo_sapiens__NP_009133
augagaggcgccgggcccagcccuaggcaguccccacggacccugcgcccggaccccggaccugcuaugucuuucuuucgacguaaggugaaagguaaggagcaagagaaaacaucagaugucaagaguaucaaagcaagcauuuccguucacucuccacagaagucgacuaagaaccaugcccuccuugaggcggcuggccccucacacguggccauaaaugcaaucagcgccaacauggacaguuucuccucuagcagaacggcuacccugaaaaagcagccuucccauauggaagcagcccacuuuggggauuugggaaggucaugcuuagacuaccagacacaagagacuaaaaguagccugucuaagacccuagaacagguacuccaugauacaauugugcugccauauuucauccaguuuauggagcuucggcgcauggagcaccuggucaaauucugguuggaagcugaguccuuucacucaaccacuuggagcagaauuagggcccauagucucaauacagugaagcagucuucccuggcggaacccguuagcccuucgaagaaacacgagaccacggcaucuuuccugacugacucccucgauaagcgguuagaggacucaggcagugcccaacuguuuaugacccauagcgaagguaucgaucuuaacaaucgcacaaacuccacucagaaucacuugcugcuaucucaggagugugacagcgcucacucacuccgacuggaaauggccagagcagggacccaucaggugaguauggagacacaagaauccagcucuacccuuacggucgcuucaaggaacaguccagccagcccgcugaaagaguuguccggaaagcucaugaaaucuauagagcaggaugcggugaauacuuucacaaaguacaucucgcccgacgccgcaaaaccuauuccaaucaccgaagcuaugcggaacgauauuaucgcccguauaugcggcgaggacggccagguagaccccaauuguuuuguucuggcucaaagcauuguguucuccgccauggaacaggagcacuuuucagaguucuuacgcagucaucacuucugcaaguaucagaucgagguccugacuucugggacaguguaccucgcagauauucuguuuugugagagcgcccuguucuauuuuuccgaauacauggagaaggaagacgcugugaacaucuugcaguucuggcuagcggcagauaauuuucaaucacagcuggccgcuaaaaagggacaguaugacggucaggaggcccaaaacgaugcaaugauccucuacgacaaauacuucagccugcaggccacccauccucuuggcuuugaugacgucguuagacuggaaauugagucuaauauaugcagggaagggggaccauugcccaacuguuucacgaccccgcuccggcaggcuuggacaacuauggaaaagguguuucugccuggcuucuuauccaguaaccuguauuacaaauaucuaaaugaucucauccacagcguacgaggugacgaguuucuugggggaaacgugucucuuaccgcccccggcuccgucggcccaccugaugaaucacaccccgggaguagcgacucguccgcaucucagagcucagugaagaaggcgaguauuaaaaucuugaagaauuucgacgaggcuauaauuguugaugccgcaucccuggacccagagucucucuaccaacgcacauaugccggaaaaaugacuuuugguagagugagcgaucugggccaguucaucagggaauccgagcccgaaccugacguccggaagucaaaagggagcauguucagucaggcuaugaagaagugggugcagggaaacaccgaugaggcccaagaagaacuugcauggaaaaucgcuaagaugauuguaucugacaucaugcagcaggcccaauacgaucagccacuggagaaauccacaaaguuguga

SEQ ID NO: 52621 - RNA, 5349 nt, Artificial Sequence
  derived and/or modified sequence opt3 from AKAP12__Homo_sapiens__NP_005091
augggcgccgggagcuccacagagcagagaucucccgaacaaccuccagagggaucaaguacaccggcugaacccgagccuagcgguggcgggccauccgcagaagccgcgcccgacacuacggcugauccugccaucgcagccucugacccagcuacaaagcugcuccagaaaaacggacagcuuucgacaauuaauggcguggcagagcaggaugagcugucauugcaagaaggugacuuaaacgggcagaagggagcccugaauggccagggcgcucuaaacagccaggaggaagaggaggucaucguuacugaaguggggcaaagggauagugaggacguauccaaacgggauucugacaaggaaauggccaccaaaagcgcggugguccacgauaucacagacgauggacaggaggaaacccccgagauuaucgagcagauuccuuccucagaaaguaaucucgaggaacugacucagccaacagagagccaagcaaacgacaucgguuucaagaagguguuuaaauucguuggcuuuaaguucaccgugaaaaaggauaaaacggaaaagccggacacuguccagcuucugaccgugaagaaagacgagggggagggagccgcuggcgccggugaucauaaggaccccucuuugggggcaggagaagcugccuccaaagagucagaaccuaagcagagcacagagaaaccagaagagacucucaagcgcgagcaaagucacgcggaaauaucucccccugccgaguccggccaggcaguagaagagugcaaagaggaaggcgaggaaaagcaggagaaggaaccaagcaaaucggcugagucucccaccuccccgguuacaucagagaccgggaguacguuuaagaaauucuuuacucagggaugggccgguuggcgaaagaaaaccagcuuccguaagccuaaggaagaugagguggaggcuuccgagaaaaagaaagaacaagagcccgagaaggucgacaccgaagaggauggcaaagccgaaguggcaucugagaagcugacugccagcgaacaggcucauccacaggagccugcggagucagcacacgaacccagacugagugccgaguacgaaaagguggagcucccauccgaggaacaggucagcgggucucaaggacccucagaggaaaaaccugcuccauuagccacagagguuuuugacgaaaagaucgaggugcaucaggaggaaguaguggcagagguccacgugaguaccguugaagagaggacggaagaacagaaaaccgagguggaagagacagccggcagcgucccggcugaagaacugguggaaauggaugccgagccccaggaggcagaaccugcgaaggagcuuguaaaauugaaggaaacuuguguuuccggugaggacccaacccaaggggcugaucugucucccgacgagaaggugcuaucgaaaccuccagaaggcgucgugagcgaggucgaaaugcucuccucacaggagcggaugaaggugcagggaaguccccugaagaaacuuuucacaucuacuggccugaaaaaguugagcgggaaaaagcagaagggaaaacgcgguggcggggaugaagaguccggagagcacacccaaguuccggccgacucaccugacagccaggaagaacagaagggcgaaucuuccgcaaguagcccagaggaacccgaggagauuacaugccucgaaaaaggucuggccgaggugcaacaggauggggaagcugaggaaggcgccaccucugacggagagaagaaaagagagggcguaacuccuugggcauccuuuaagaagauggucacgcccaaaaagagggugcggcgcccaucagaaagugauaaagaggacgaauuagauaagguuaaaagcgcuacacugucguccaccgagucuacugccagcgagaugcaggaagagaugaaggggucaguggaagaaccuaagcccgaggaaccaaaacgaaaggucgacaccaguguguccugggaggcgcucaucuguguaggaucuagcaaaaagagagccaggcgggguuccucaagcgaugaagagggcgggccgaaagcuaugggaggcgaccaucagaaggcagaugaagccgguaaggacaaagagacagggaccgauggcauucuugcuggaagucaagaacacgacccuggccaggggucuuccagccccgagcaggccggaucgccaacugagggcgaaggugugucaacaugggagucuuucaagcgucugguuacgccccgcaaaaagaguaaauccaaguuggaagagaaaagcgaagauucuaucgcagggagcggagucgagcauuccaccccugacacugagccaggcaaggaagagucaugggugaguauaaagaaauuuauucccgguagaaggaagaaacggccugacggcaagcaggaacaagcgccgguggaggaugccgggccaacaggagcuaaugaggacgauagcgacguccccgccguugugccucuaucugaauaugaugcaguggagcgagagaagauggaggcucagcaggcccagaaguccgcagaacaaccagagcagaaggccgcuaccgagguaucaaaagaacugagugagagccagguccacaugauggcggccgcaguggcugacggcacacgcgccgccacuaucauugaagagagaucccccucuuggaucucggcuagcguuaccgaaccucucgagcaaguggaggcagaagccgcgcugcuuacggaggaaguccuggagagggaagugaucgcugaggaggaaccgcccaccguuacagagccauugccugaaaaccgggaggcccgcggggauacugugguaucagaggcagaacucacccccgaggccgucacagcugcagaaacugccggaccacugggcgcggaggaagguaccgaggcuuccgccgcagaggaaacgacagagauggugagugccgugucucaguuaaccgacagcccugauacuacagaagaggcuacccccguccaggaaguugaagggggagugccagacauugaggaacaggagagaaggacucaagaaguacugcaggccguggcagagaaggucaaagaagagucccagcuaccgggcaccgguggcccugaggaugugcuccagcccguucaacgugcugaagccgagcggccagaggaacaggcggaggccucagggcugaagaaagaaacagacgugguccuuaagguggaugcacaggaggcuaagacggaacccuucacccagggaaaaguugugggccaaacuacaccugagucuuucgaaaaggccccacaggucaccgagagcauagagaguuccgaauugguaacaacuugccaggcugagacccuggcaggggugaaaagccaggaaaugguuauggagcaagccauacccccugacucuguggaaacgccgacagacucagagaccgauggauccacuccagucgccgacuuugaugcucccggcaccacacagaaggacgagauuguggaaauccacgaggaaaaugagguagcgagugguacucagagcgggggaaccgaagcagaggccgugccugcucaaaaagagcgacccccagccccuucgucuuucgucuuucaggaagagacaaaggaacaguccaagauggaggauacgcucgagcauaccgacaaagaaguuagcguggagacugugucaauacugaguaagacagaaggcacccaggaggcagaucaauacgccgacgagaaaacuaaggauguccccuucuuugagggucuugagggcucuauugacacagggaucaccguguccagagaaaaaguuacggagguagcucugaagggagaaggcacugaggaagcggaguguaagaaagaugacgccuuggagcuccagagccacgcaaagucaccaccuaguccgguggaaagggagauggucgugcagguugaacgcgagaaaaccgaagcugagcccacacaugugaacgaggaaaagcuggagcacgaaaccgccgucacugugagcgaggagguauccaaacaguuacugcaaacagucaaugugccaaucauugacggggcaaaggaaguuucuagccuagagggauccccucccccaugccucggccaggaagaggccguguguaccaaaauccagguccagucaucugaagcuaguuucacacugacugccgcggcagaggaggaaaaggugcuuggugagaccgccaacauuuuggaaacgggggagacacuggaaccugcuggagcccaucucguucuggaggagaagucgagcgagaaaaaugaggauuuugcugcacaccccggcgaagacgccgugccgaccggcccagauugccaagcuaaguccacuccugucauagugucugccaccaccaaaaagggguuaucaagcgaccuggagggagagaaaacuaccucccuuaaguggaagagugaugagguagacgaacagguggcaugucaggaaguuaaagucucuguggcgaucgaggauuuggaacccgagaacgguauucucgagcuggaaacgaaaagcucaaagcuagugcaaaauaucauccagacagccgucgaccaguucguacggaccgaggaaacugcuacagagaugcugaccuccgaacuccagacucaagcccacgugauuaaagcagauagucaggacgcuggccaggagacagagaaagaaggggaggaaccacaggccagcgcacaagaugagacccccauaacgucugccaaggaagaguccgagucaacugcuguuggacaggcgcauagcgacaucucgaaggauaugucugaagccagugagaaaaccaugacaguggaagucgagggcuccaccgugaacgaccagcagcuggaagagguugugcuuccuagcgaggaagagggugggggagcaggcacaaagucagucccggaagacgauggccacgcuuugcuggccgagagaauugagaaauccuuaguggaacccaaggaggacgaaaaaggggaugacguagaugacccagagaaccaaaauucugcccucgcagauacugacgcuagcggaggucugaccaaggaaaguccugauacgaacggccccaagcagaaagagaaggaggacgcccaggaaguggagcuucaggaagggaaaguucauuccgagagcgauaaggcgaucacaccucaagcucaggaggagcugcagaaacaagagagggaaucugccaagucagaguugacugaaaguuga

SEQ ID NO: 52622 - RNA, 4305 nt, Artificial Sequence
  derived and/or modified sequence opt3 from AKAP13__Homo_sapiens__NP_001257475
auguacgagagacacaagaggcgguauagccugugcgacaucuccaaaguggaucgcaccgucgacguugugcuccuuaagauuaaccgagaaaauugguguacaauagagcccugcccugaugccgcuucucuguuggcaucaaaacagaguccagaaugugagaacuucuuagacguaggccuggggcgugaaugcacuagcaagcaaggagugcuaaaaagagaguccgguucugauucggaccucuuucauucaccgagcgaugacauggauaguaucauuuuccccaagccugaggaagaacaccuggccugugacaucacgggcuccucuagcuccaccgaugacacagcgucacuugauaggcauaguagccacgggucugacgucucccugucacagauuuugaagccaaaucggagccgcgacagacagagucucgauggauuuuacucucauggcaugggugcugaagggagggaguccgagagcgaacccgccgacccuggagauguggaggaagaggaaauggacucgaucacugagguuccagcaaacugcucugugcugcgguccucaaugcgcagucugagccccuuccgaagacacuccuggggcccuggcaaaaaugccgcuucugaugcagagaugaaccacaggagcuuuucacucgaaggguuaaccggaggugccggcgucgggaauaagccaaguuccagccuggaggugucuucagcuaacgccgaggagcuucggcauccguucaguggagaggaacguguagacagcuugguuucccugucugaggaagaucuagagucggaccagcgcgaacacagaauguuugaucaacagauaugucauaggagcaaacagcagggcuucaauuauugcacauccgcgaucucaaguccccucaccaagucuauuagccugaugacuaucucccacccuggucuugacaacucacggccauuucacagcacauuccauaauaccucugcaaaccugacggaguccauuacugaagagaauuacaacuuuuugccccacaguccuagcaaaaaggauucugaguggaaguccgggaccaaagugucacgaacauucaguuauaucaagaauaaaaugagcucguccaagaaaucuaaggaaaaagagaaggaaaaggacaaaauaaaggagaaagagaaggacagcaaagauaaggaaaaggacaaaaagacugucaacggacauaccuuuucaaguauuccaguggugggccccaucuccuguucucaaugcaugaaaccguucacaaacaaggaugccuacaccugugcuaauugcagcgccuucguccacaaaggcugccgcgagucccucgcaucaugugcuaagguuaagaugaaaccuaaggggagccugcaggcccaugacacgaguucuuuacccacugugauuaugagaaacaaaccaucccagccuaaggaaaggccccggagcgcgguacugcucguggaugagacagccaccacuccaaucuuugcaaaucgcagaucgcagcaaucagucucucuuaguaaauccgugagcauccagaacauuacaggaguugguaaugacgaaaacaugucuaauaccuggaaguuccugagccacuccacggauucauugaacaagauaaguaaagugaaugagagcaccgagucucuaacagacgaaggcgucgggacugauaugaacgagggacagcugcucggcgacuuugaaaucgaguccaagcaacuggaagcugagucauggaguaggauuaucgauagcaaauuccuuaagcagcagaaaaaggacgugguaaaacgucaggagguuauauaugaacugaugcaaaccgaguuucaccaugugcggacauugaagauuauguccggugucuacucucaggggaugauggccgaucuccuguucgaacagcagaugguggagaaguuauuucccugccuggacgaacuaaucucgauccacagccaauucuuucagcgaauccucgagaggaaaaaggagucacuggucgacaaauccgaaaagaauuuccuuauuaaaagaauuggcgauguguugguuaaccaguuuaguggagagaaugcugaacgccugaagaagacuuacggcaaauucugugggcagcauaaccaaucugugaauuauuuuaaggaccucuacgccaaagauaagcgguuccaggcauucgucaaaaagaagaugagcuccucaguagugagaaggcugggaauaccugagugcauccuucugguuacccagcgcauuacaaaauauccaguguuguuucagcgaauccuccaauguaccaaggacaacgaggucgaacaggaggaucuggcccagucuuuaagccuggugaaagacguaaucggugcuguggauaguaagguugcguccuacgagaaaaagguccggcuaaacgaaauuuauacuaagacggacagcaaaucuauaaugcguaugaagucaggccaaauguucgcaaaagaagaucucaagaggaaaaagcuggugagagacggguccguguuucuuaaaaaugccgcuggacgcuugaaggagguccaggccguucugcucacagauauccugguguucuuacaggagaaggaccagaaauacauuuuugcaagucuggaucaaaagagcaccgugaucucgcuuaaaaaguugauuguacgggaagucgcccacgaggaaaaaggccucuuccugaucucuauggguaugacugacccggagaugguggaaguucacgcuuccagcaaggaggagagaaacucauggauacagaucauucaggacaccaucaauacacuaaacagggaugaagacgaggggauucccagugaaaaugaggaagagaagaaaaugcuggauacccgagcccgcgagcucaaggaacagcugcaucaaaaagaccagaagauccuuuugcuguuagaggaaaaagagaugauauuucgggauauggcagagugcucuacuccucucccagaagacuguucccccacacacagcccuagagugcuguucaggucaaacacggaggaagcgcuuaagggcggaccacugaugaagagugcuauuaaugaggucgaaaucuugcagggccucgugagcgggaaccugggagguacccuaggccccacuguuuccucuccgauugagcaggaugugguagggccugucagccugccacgucgcgccgagacauuuggaggcuucgacucccaucaaaugaaugcaucaaaagguggggaaaaggaggaaggcgaugacggacaggaucuccggagaaccgagucugacaguggccugaaaaagggagggaacgccaaucuuguguuuauguugaaaaggaacucggaacaggugguccaaagcguugugcaccuguaugaguuacucuccgcucugcagggcguagugcuucagcaggacucuuacaucgaggaucaaaagcugguccuaucagaacgagcccucacacggagccugucccgccccaguucuuugauagagcaggaaaagcagagaagccuggagaaacagaggcaagacuuagcaaaucuccagaagcagcaggcucaauaccuggaagagaaacggcgaagagagcgcgaaugggaggccagggaacgugagcuucgggagagagaagcgcuguuggcccagagggaggaagaggugcagcagggucaacaggaucucgaaaaggagcgcgaggaacugcagcagaaaaaggggacuuaucaauacgaccuagagcgacugagagcugcacagaagcagcuugaacgggagcaagaacagcucaggcgcgaggccgagcgucugucacagagacagaccgaacgggauuugugccaaguuucccauccucacacgaaacugaugaggauccccaguuucuuuccaagcccugaggaacccccaucuccguccgcuccuucaauugccaagagcggaucguuagacucugagcucagugugucccccaaacgcaacagcaucucacgaacccacaaggauaaaggcccauuccauauucuguccucuacaagccagacuaauaagggucccgaaggccagagucaggcgccugcauccaccagcgccucuacaagacuuuucgggcugacuaaaccaaaggagaagaaagagaagaaaaagaaaaacaagaccucacggagucaacccggagacggcccugcuuccgaagucagcgccgagggggaagagaucuuuuguuga

SEQ ID NO: 52623 - RNA, 2088 nt, Artificial Sequence
  derived and/or modified sequence opt3 from AKAP17A__Homo_sapiens__NP_005079
auggccgcugcaaccaucgugcacgacacaagcgaggccgucgaacugugccccgcguacggccucuaucuuaagccuauuacuaaaaugacgauauccguugcucugccacaguugaagcaaccggggaaaucuaucucaaacugggaggugauggaaagauuaaagggaaugguacagaaucaucaguucaguacccugaggauuagcaaauccacaauggauuuuauccgguucgagggugaaguggagaacaagucucuagucaagucguuucucgccugucuggacggcaaaacuauuaaacuuucaggguucagcgauauccugaaggugcgcgcagccgaguuuaagauagacuuccccacccgacacgauugggacuccuuuuuccgugaugcuaaagacaugaaugaaacauugccuggagagagaccagauaccauccaucucgaaggccugcccugcaagugguuugcacugaaggagagugguucugagaaaccuagcgaagacguucucgugaaggucuucgagaaauuuggggaaauuaggaacguggauaucccaauguuagaccccuaccgggaggaaaugacuggacgcaauuuccacacauuuuccuucggcggccaucugaacuucgaggccuauguacaguacagagaguauaugggguuuauucaagcuaugucagcccuuaggggaaugaaguugauguacaaaggugaagauggcaaggcgguugcauguaauaucaaagugaguuucgacagcaccaagcaccugucugacgccuccauaaagaaacggcagcuagagcgccagaagcuccaggaacuggagcaacagcgagaggaacagaaaagaagggagaaggaagcugaggaacggcagcgugccgaggaacgcaaacaaaaggagcuugaggaacuggagagagaaaggaagcgggaggagaaauugcgaaagcgcgaacagaaacagagagauagggagcuccggcgcaaccaaaagaaacuggaaaaguuacaggcagaggaacagaagcagcugcaagagaaaauuaagcucgaggaaagaaaacuucuguuggcucagaggaaucuacagucaauccgucugauugccgagcuccugagccgggcgaaggccgucaaacuucgagaacaggagcaaaaggaagagaagcugagauugcagcagcaggaggaaaggcgccggcuccaagaggcagaacugagaaggguggaggaagagaaagagcgcgcuuuagggcugcagcgaaaggaacgggagcuacgugaaagacuccugaguauccuuuugucuaaaaagccugacgauucccacacgcaugacgagcugggaguggcccacgcugaucuccugcagccaguccuugacauccugcagacuguuagcucgggcugcgugucugccaccacauugcauccgcucggugggcaacccccugcaggagccccaaaagagucccccgcucacccugaagcggauggcgcaccaaagucaguaaacggcaguguggccgaggaagcucccuguaaagagguccagagcuccugcagggugguuccggaagacgggucuccugagaagcgcugucccggaggugugcugagcugcauuccagauaauaaccagcaaccuaagggcauacccgccugugagcagaaugucucacggaaagacacuagaagugaacaggauaagugcaacagggagccauccaaagggcgaggacgcgcaaccggcgacgguuuagccgaccggcacaagagagaaaggagccgugcucgccgggccucuucaagagaggaugggaggccccgaaaagaacggcgcccucauaagaagcacgcauauaaagacgauaguccaagaaggcggagcacauccccggaccauacccgaucuagacgcucgcacagcaaggauaggcaucgucgggagagauccagggagcgccgaggcucagcgaguagaaaacacucucggcacaggcgccguagcgaaagaucccggucaaggagccccucucgccaucgauccacguggaauagauga

SEQ ID NO: 52624 - RNA, 2712 nt, Artificial Sequence
  derived and/or modified sequence opt3 from AKAP1__Homo_sapiens__NP_003479
auggccauccaguucagaagccuguuuccccucgcuuuaccuggcaugcuggcauuguuagggugguggugguucuuuuccaggaagaaaggacacgugucuucacaugacgagcaacaggucgaagccggugcgguucagcugcgggcugauccagccauuaaggagccgcuacccguggaagacguaugcccuaaaguggucaguaccccacccagcgugacagagccuccagaaaaggagcucuccacuguuucuaaacugcccgcagagccuccagcccuucugcagacgcacccgcccugucgccgaucggaaucaagcggcauauugccuaacaccacagauaugcgucucagaccagggacuaggcgggacgauaguaccaagcuggagcuggcucucacaggaggcgaagcaaaguccauccccuuagagugcccucugucuagcccaaaaggugugcuuuucuccucaaagagugccgaggucuguaaacaagacagccccuuuucucgcgugccgagaaagguacagccuggguaccccguugugccagcugagaaaagguccucaggagagcgggcccgcgaaaccggcggcgcggaggggacuggagaugcagucuugggugaaaaggugcuggaggaggcccuacucagccgagaacaugugcuggagcuugaaaauaguaagggcccuucucuggcuuccuuggagggggaagaggacaaaggaaagagcucgucuucccaggucguuggccccgugcaggaggaagaguauguagccgaaaaacucccaucaagauucauugagagugcacacacagaacuggcuaaggaugacgccgcgcccgccccuccaguggcagaugcuaaagcccaagacaggggugucgagggggaguuaggaaacgaagagagccuggaucggaaugaagagggccucgaccguaacgaggaaggccuugaccgcaaugaggaaucccuggauagaaacgaggaaggguuggacaggaaugaggagaucaagcgggcugccuuucagauuaucucucaggugauaagcgaagcaaccgagcagguucuagccacgacugugggaaaagucgcuggucgagugugccaagcgucacagcugcagggccaaaaggaagagaguuguguaccgguucaucagaagaccgugcucgggcccgauacagcagaaccugccacugcugaggccgcagucgccccacccgacgcuggacugccucuuccaggccugcccgccgaggguuccccgccuccaaaaaccuacgugagcugcuugaagucucuccugucaagucccacaaaagauagcaagccuaacaucuccgcacaccacauuucuuuagcgucgugucuggcucuaaccacgcccagcgaagaacucccagaccgcgccgggauccuggucgaagaugcaacuugcgugacauguauguccgacucaagucagucuguuccucuuguggccagccccggccauugcuccgauucauucagcaccucuggauuggaggacuccuguacugaaacaaguagcucuccaagagauaaagcuauuaccccgccucugcccgaguccacgguaccauuuucaaauggcguccucaagggggagcugagugaccuuggagccgaagacgguuggaccauggaugcagaggcugaccacagcggcgggucggauaggaacuccauggacucuguggauagcugcugcucacugaagaaaacagaaaguuuccagaaugcccaagcgggauccaaccccaagaaaguugacuugaucauaugggagauugaggugccuaagcaucucgucggccggcugaucgguaaacaggggcgcuaugugucuuuucuuaagcagacuagcggcgccaagauuuacaucuccacccugccauauacacagucaguacaaaucugucacauugaaggaagccagcaccauguggauaaagcucuaaaucucauaggcaagaaauucaaggagcugaaccuuacuaauaucuacgcacccccuuugccgagucuggcccucccaucucugcccaugaccuccugguuaaugcugccugacgggauuacaguugaagucaucguggugaaccaggucaacgcuggacaccuuuuuguucagcaacauacccacccaacuuuccaugccuugagaagccucgaucagcagauguaucugugcuacucgcagcccgguauaccuacgcuaccgacacccguggagauuaccgugaucugugcagcgccaggcgccgacggggcuugguggagggcccaaguagucgcaucauacgaagagacuaaugagguggaaauccguuauguugauuacggaggcuauaaacgggugaaggucgacgugcugcgacagauuagaucugauuucguuacccucccuuuucagggugcugaggugcugcuugacaguguaaugcccuuguccgacgaugaccaauucagcccagaagccgaugcagccaugucugagaugacagggaacaccgcucuguuagcgcaggucacuagcuacuccccuacaggccucccccugauccagcuuuggucaguggugggagacgaagucguucugauuaauaggaguuugguggagcgcggccucgcccaguggguagauagcuauuacacgucucuguga

SEQ ID NO: 52625 - RNA, 2847 nt, Artificial Sequence
  derived and/or modified sequence opt3 from AKAP2__Homo_sapiens__NP_001004065
augagauggccccagccuggcgccgcugcaaggcugccaccggagagccccgggccuccagaaucccccggaccuccagagcgggaagccgcggcugcccgccgauggaccggugcagagccccaagacugcgccccuggcucugggcguccagaaaagccgccccagcucucagaggaugacaucuggcuuaaaagugagggagauaacuacagcgcuacacuguuggaaccugcagccuccucuuuaucgccagaccacaagaauauggagauugaagugucagucgcugaguguaaaagcguucccggcauaacuucgacgccucauccaauggaucaccccuccgccuucuauucuccgccucauaacggucugcuaaccgaccaccaugagagccucgauaaugacguggcgagagaaaucagguaccuggaugagguacuugaagcaaacugcugugacuccgccguggaugggacauauaauggaacuucaagucccgagccaggcgcugucgugcugguuggcggguugagcccucccgugcacgaagccacccagccagagcccacagagcggaccgcaucucgccaggcuccuccacacauugaacucuccaacucaagcccggaccccauggccgaggcggaaagaacuaauggacauaguccuucucaaccaagggaugcccugggugacucccugcagguccccgugagcccuucgucuacaaccuccucacggugcaguagccgcgacggcgaguuuacgcucacuaccuuaaagaaagaagcaaaguucgagcugcgagcuuuucacgaggauaagaaaccauccaaacuuuucgaagacgaugagcaugaaaaagagcaguacuguaucagaaagguaaggcccucugaagagauguuggagcuggaaaaagagcggcgugaacuaauucgcagccaggccguuaagaagaacccggggaucgcugccaaaugguggaauccuccacaagagaagacaauagaggaacagcucgacgaggaacaccuggagucacacaaaaaguauaaagaaagaaaggagaggcgggcacagcaggagcaacuucuguugcagaaacagcuccaacagcagcagcaacagcccccuagucagcugugcacugcccccgcuuccagccaugaacgagcgucuaugaucgauaaggcaaaggaggacauugugaccgaacagaucgauuuuucagccgcucgcaaacaauuccaguuaauggagaacaguagacaggccgucgcaaagggacagagcacaccaaggcuguuuuccauuaaaccuuucuaccggccccucggcucugugaauagugacaagccacuuaccaacccgcgcccucccagcgugggugggccacccgaagauuccggagccucagcugccaaaggccaaaagaguccuggcgcacuggagacgccaucugcggcugggagccagggaaauacugccucccaggguaaggagggccccuauucagaaccuagcaaaagagggccguugucuaagcuaugggcagaggacggagaauuuacauccgccagggcuguccugaccguugugaaagaugacgaccacggcauccucgaucaguucagucguagcguaaacgugucucugacucaagaggaacuugacuccggucuggaugaguugucaguccggagucaggacacaaccgugcucgagacgcugagcaaugauuuuucgauggacaacauauccgauucuggggccagcaacgaaaccacaaaugcauuacaggagaacucacuggcugacuucagucuaccacaaacuccccagaccgauaauccuuccgaaggccgaggagagggcguuucuaagagcuuuuccgaccauggguucuacucaccaagcaguacacucggagauucuccccugguggacgauccucuugaguaccaggccgguuugcugguccagaacgcgauucaacaggccaucgcugaacagguggacaaagcaguauccaagacuagcagagacggcgccgagcagcaagggccggaagcuaccguugaggaagccgaggcagcggccuucggaucggagaagccccagucaauguuugaaccaccucaggugucuagucccguccaggagaaaagggaugugcucccaaagauucugccugcugaagaccgcgcccuucgggagagaggucccccacaaccgcugccugcaguccagcccuccggcccaaucaauauggaagagacaaggcccgaggggagcuauuucucuaaauacagcgaagcugccgaguugcgcuccaccgcaucacuccuggccacucaggaaagugaugugaugguuggcccuuuuaaguuacgaagccggaaacaacguacgcugucuaugaucgaggaagagauuagagcugcgcaggagagggaagaggaacuaaagcgccagagacaggugcuccaauccacacagucaccacggaccaagaacgcccccagucugccuagcaggacuuguuauaaaaccgcaccgggaaagauagagaaaguaaagccacccccuucccccacaaccgagggcccaucucuucagccugacuuggcucccgaagaggccgccgggacucagcgaccaaagaaucugaugcaaacacucauggaagauuacgagacgcacaagucgaaacgccgggaaagaauggacgauagcucaguccuggaggcuaccagggugaaccgucgcaaguccgcauuagcccugcggugggaggcgggaaucuaugcuaaucaggaagaggaagacaacgaguga

SEQ ID NO: 52626 - RNA, 2562 nt, Artificial Sequence
  derived and/or modified sequence opt3 from AKAP3__Homo_sapiens__NP_001265238
augagcgagaagguggacuggcugcagucccaaaacggcgucugcaaaguugauguguacucucccggggacaaucaggcccaggauuggaagauggacaccucaacagauccuguaagagugcucaguuggcuuaggcgggaccuggaaaagagcacugcugaguuccaggauguccgcuuuaagccaggagaauccuucgguggcgagacgucuaacucgggggacccgcacaaaggauuuucaguggauuauuacaauaccacaacuaagggcacccccgaacgauugcauuucgagaugacacacaaggagaucccuugucaagguccacgugcacaguuagggaacggaagcaguguugacgaaguguccuuuuaugccaauagacugaccaaccuagucauugcgauggcuaggaaagagauaaaugaaaagaucgauggcucugagaacaaaugcguguaccagagccucuauaugggcaaugagcccacuccuacaaagucccugucaaaaauugccagugaacuuguaaacgagaccguuagcgcauguucucggaaugccgcuccagacaaggcacccggguccggagaucgcgugucagguagcagucagucuccuccaaaccugaaguacaaauccacguugaagaucaaagaaagcacuaaggagagacaaggcccggacgacaaacccccuucgaagaaaucuuucuuuuauaaggaagucuucgaguccaggaauggggauuacgcccgggagggaggccgcuuuuucccacgagaaagaaagagguuucggggucaggagcgucccgacgauuucaccgcuucagugagugaagggauuaugacauacgccaacagcguggucuccgacaugaugguuucuaucaugaaaacucucaagauacaggugaaagauaccacaaucgcgaccauucugcugaagaaaguacucuuaaagcaugcaaaggagguggucagcgaccugaucgauucauuucuucgcaauuugcacagugugacgggaacucugaugacagacacccaguucguuuccgccgugaaaagaacugucuucagccauggcucucaaaaggcuacagauauuauggacgccaugcuaaggaaacucuauaacgugauguuugcaaagaaaguaccugaacacguucggaaggcucaggauaaggccgagucauacagucugaucagcaugaaaggcaugggggacccaaagaaccgaaaugugaacuucgcgaugaaauccgagaccaaacuucgcgagaaaauguauucugaacccaagucggaagaggaaacgugcgccaagacccugggagagcacauaauuaaagaggguuugacacucuggcauaagagccagcaaaaagaauguaagucccugggcuuucagcacgcagcuuucgaggccccgaauacucagagaaaaccugcuucagacaucaguuuugaauaccccgaggauauugggaacuuaucucugccaccuuaucccccagagaagcccgaaaauuucauguacgacagcgauuccugggccaaagaccucaucgucucagcacuucuguugauccaguaucaucuagcccaaggaggcaggcgggaugcucgcagcuuuguggaggcggcagguaccacaaacuucccugccaaugaaccaccggucgcucccgacgagucuugccugaaguccgccccuauugugggggaucaggaacaggcagagaagaaagaccucagaaguguguuuuucaacuuuauaaggaaucugcuuagcgagacuaucuucaagcgugaucagucuccagaacccaaaguuccugagcaaccaguaaaggaagaccggaaacugugugagcgacccuuggccuccucaccgccuagacucuacgaagaugacgagaccccaggcgcucugaguggauuaacaaagauggccgucagccagauugauggccacaugucggggcagaugguggagcaccugaugaacuccguuaugaagcuaugcgugaucauagcaaaaucuugugacgcgagccucgcugaacugggagacgauaagucaggugacgccaguaggcuuaccuccgcauuucccgauucuuuguacgagugccugccugccaaaggcacugggagcgcugaagccguccuccagaaugcauaucaagcuauucauaacgagaugcgcggaacguccggccagcccccagaagguugugccgcgccuacagugaucguaucaaaucacaaccugaccgacacugugcagaauaagcagcuucaagccguucugcagugggucgcugcaagcgaguugaacgugcccauccucuacuucgccggggaugacgagggcauucaggaaaaacuguuacaacugagugcugccgcaguggauaagggaugcucugucggcgagguucuacaguccgugcuccgguaugaaaaggagagacagcugaacgaggcgguggggaauguaaccccacuucaguugcuggacuggcucauggucaaccuguga

SEQ ID NO: 52627 - RNA, 2565 nt, Artificial Sequence
  derived and/or modified sequence opt3 from AKAP4__Homo_sapiens__NP_003877
augauggccuacagcgacaccacaaugauguccgaugacaucgauuggcugagaucucacaggggcgugugcaaggucgaccucuauaaccccgaggggcagcaagaucaggaccggaaaguuauuuguuucguggauguaucaacucuuaauguggaagacaaggauuacaaagacgcugcaaguagcuccucugagggaaaccugaauuuggguucguuagaagagaaggaaauaaucgucauuaaagauacggagaagaaggaccagucaaaaaccgagggcagcgugugccuguuuaagcaggccccuagugauccaguuuccgugcuaaacuggcuccugucugaccuucaaaaauaugcgcugggguuccagcaugcuuugagcccguccacaucaacuuguaagcacaaagucggagacaccgaaggcgaguaccaucgcgccaguagcgaaaauugcuauucuguguacgcagaucagguaaacaucgacuaucucaugaaucgaccccagaaccugcgucuggagaugacagccgcuaagaauaccaacaauaaccaauccccuucagcaccacccgccaagccuccaagcacucagagagcuguuauuagucccgauggugaguguucuaucgacgaucucuccuuuuacgugaauagguuaagcucgcuggucauacagauggcccacaaagaaaucaaggagaaacuugaagggaagucuaaaugcuugcaucacuccauuuguccuucaccaggaaacaaggagcggaucaguccgcgcacacccgcgagcaaaauugcauccgaaauggccuacgaggcuguggagcugaccgccgcagaaaugagaggcacgggcgaggaaucuagggaagggggacaaaagagcuuccuauauucagaacucaguaauaaguccaaaagcggugacaagcagaugucucagcgggagucaaaagaguuugcugauaguaucagcaagggccugaugguguacgccaaccaggucgcguccgacaugaugguuucucuuaugaaaacucugaaggugcacucgagcgggaagccuauaccagccuccguaguguugaaacgcguccuccugcgacauaccaaggaaauugugucagauuuaaucgacaguugcaugaaaaaccugcacaauauuacaggaguucucaugacugauucugacuucgugagcgcagucaagagaaaccuuuuuaaucaauggaaacagaacgcuaccgacaucauggaggccaugcugaagagguugguguccgcucuaaucggcgaagagaaggaaacaaaaucacagagccugucuuaugccucccucaaggcagguagucaugaucccaaaugucggaaucagagccuggaguucucuaccaugaaggccgagaugaaagaacgugacaaggggaagaugaaauccgauccuugcaagucacuuacgagugcugagaaaguaggagaacacauucugaaggagggcuugacuauauggaaccaaaaacagggcaauagcuguaagguugcgacaaaagcaugcucgaacaaggacgagaagggggagaaaaucaaugccuccaccgauucucucgcuaaggaccugauugugagcgccuuaaaacugauccaguaccaccuaacucagcaaacaaagggaaaagauaccugcgaggaagacuguccagguucaacgaugggcuauauggcacagaguacccaguacgagaagugcgggggaggccaguccgccaaggcucucucugucaaacaacuggaaagccaucgcgcccccgguccguccacaugucagaaggagaaccagcaccuugauucacagaaaauggacaugagcaauauaguguugaugcugauucaaaagcuccugaacgagaauccuuuuaaaugcgaagaucccugugagggggaaaacaagugcagugagccaagagcaucuaaggcggcuuccaugagcaauaggucggacaaagccgaggaacagugucaggagcaucaagaacuugauugcacuucaggcaugaagcaggcaaacggacaguucaucgacaaacuggucgagucugugaugaaguugugucucaucauggccaaauauaguaacgacggcgcugcccuggcagaauuagaggaacaggcugccuccgcgaauaagccuaacuuucgggggacccgaugcauucacagcggagccaugccccaaaauuaccaggauucucugggucaugagguuaucgugaacaaucaguguagcacaaacucccuacagaagcaacuccaggcuguacugcaguggauugcagccucacaguucaaugucccaaugcuuuacuuuaugggcgacaaagaugggcaauuggagaagcugccccaggugagugcuaaagccgcagaaaagggauauagcguuggcggucuccugcaggaggugaugaaauucgcgaaggaacgccaaccugacgaggccgucgggaaaguggcuagaaagcaguuacuggauuggcuuuuggccaaccucuga

SEQ ID NO: 52628 - RNA, 1284 nt, Artificial Sequence
  derived and/or modified sequence opt3 from AKAP5__Homo_sapiens__NP_004848
auggagaccacaaucagcgaaauucacguggagaacaaggacgagaaaagauccgccgaaggcucucccggggcugaaaggcagaaggagaaagcaucaaugcugugcuucaagcggcgcaaaaaggccgcgaaggcucucaaaccuaaggccggaagugaggcagccgaugucgcucgaaaauguccacaagaagccggugcaagcgaccagccggagcccacucguggcgcuugggccucccuuaagagacugguuacgaggcggaaacgcucugaaucgucaaagcagcagaagccuuuggagggggagaugcaaccagcgauaaaugcagaagaugccgacuuaagcaaaaagaaagcuaagaguagacugaaaauccccugcauuaaguuuccuaggggaccaaaacgguccaaccauucuaagaucauugaggauagcgacuguuccaucaaggugcaggaagaggccgaaauacuagauauccagacccagacaccccucaaugaccaagcaacuaaagcuaagucaacccaggaucugagugagggcauuagccgcaaagacggugaugagguaugcgaaucuaacguguccaauucaacaaccagcggggagaaggucaucaguguggaacuuggacuggacaacggccacucugccauucagacuggcacauugauccucgaggaaauagagaccauuaaagagaagcaggauguucaaccucagcaggcguccccacuggaaacgagcgagacugaccaucaacagccggugcugucggacgugcccccucucccagccauccccgaucagcagauugucgaagaggcaucuaauuccaccuuagaaucagcuccuaacgggaaggacuacgagaguacagagaucguagccgaagagacuaaaccaaaggauaccgaacugagccaagaguccgacuucaaagagaauggaaucacagaagagaagucuaaaagcgaagagucaaagcgaauggaacccauugcuauaaucauuaccgauacggagaucagugaguuugacguuacuaaguccaaaaacgugccgaagcaguuccuuauaagcgccgaaaaugagcaggucgguguguuugcaaacgauaauggcuucgaagacagaacaucugagcaguaugaaaccuugcugauugagacugccucaagucuagugaaaaacgcuauccaacucagcaucgagcagcuggucaaugaaauggcguccgaugacaacaagauuaacaaucuucugcaguga

SEQ ID NO: 52629 - RNA, 6960 nt, Artificial Sequence
  derived and/or modified sequence opt3 from AKAP6__Homo_sapiens__NP_004265
augcugaccauguccgugacccucagcccccuuagaucucaggaccuggauccuauggccacugacgcuucaccaauggcaaucaacaugacgccgaccgucgagcaaggcgaaggggaggaagccaugaaggauauggacagugaucagcaguacgagaaacccccuccauugcacacaggagcggacuggaagauuguuuuacaucugcccgaaauagagacuugguuaaggaugaccagcgagcgggugcgcgaucucacauauuccguacagcaagacucugauucgaaacacguggacguccaucuggugcagcuuaaggauaucugugaagacauuucagaucacguugagcagauccaugcucuguuggaaaccgaguucagccucaaacugcugaguuacuccgugaaugucauuguggacauccacgccguacagcucuuauggcaccaacugcgaguuucugugcuugucuugcgugagagaauacugcagggucuacaggacgcaaacggcaauuauacuaggcagacagauauccuccaagccuuuagcgaagagaccaaggaagggcggcuggacucccuuacggagguggaugacucaggacagcugacuauuaaguguagucagaacuacuugagccucgauugcggcaucaccgcuuucgaacugucugacuauuccccuucagaggauuuacugagcggucucggggacaugacaaguucucaagugaaaacuaagccauuugauuccuggagcuacucggagauggaaaaagaguuccccgaacuuauucgcucugucggacuguugaccguugcagccgacuccaucucaacaaauggcagugaggcugugaccgaagagguaagccaggugucccuaucugucgaugacaagggcgggugugaggaagacaacgccagcgcgguggaggaacagccuggacugacgcucgguguuucaaguuccagcggcgaggcacugacuaaugccgcucagccaucuucagaaacagugcaacaggagaguagcuccucuucgcaucacgaugccaaaaaccagcagccgguccccugcgagaaugcaaccccuaagagaacuauaagggacuguuuuaacuauaaugaagauagcccaacacaacccacccuuccuaagcgggggcuguucuugaaagaggaaacguuuaagaacgaccucaaaggaaauggcgguaagcgccagaugguggaucugaaaccagagaugucccgaucaacccccaguuuaguagacccgccugauagaucuaagcugugccuaguucuccagagcuccuaccccaacucaccaagcgcugccucucaguccuacgagugucugcauaaaguggggaauggaaaccuugaaaacacagucaaguuccacauuaaggagaucaguagcucuuugggcaggcugaaugacugcuauaaagaaaagucccggcucaaaaagccucacaaaacuucagaggaagugcccccaugucguacccccaagcgcggcacagggaguggaaagcaagcgaaaaacacuaagagcucggccgucccuaauggugagcuguccuacaccucuaaagcaauugagggcccacagacaaacagcgcuucaaccaguucccuugaaccgugcaaucagagaucuuggaacgccaagcugcaguugcaaagcgagacuuccucaagccccgcuuuuacgcagaguucugaauccagcguggggucggauaauaucaugucaccuguuccacuccugucuaaacauaagaguaagaaaggacaggccuccagccccucucacgugacaaggaacggcgagguagucgaagcaugguaugguagcgacgaguacuuagcccugccuucccaucuaaagcaaaccgaggugcucgcucugaaacuugaaaauuugacuaagcugcucccacagaaaccccgaggggaaaccauccagaacauugaugacugggaacugucagagaugaauagugauagcgaaauauauccgacauaccacguuaagaagaaacauacccgguuaggccgcgugucuccuuccucaaguagcgacaucgcguccucucugggagagucgauugagagcggcccacuuucagacaucuuguccgaugaagagaguucuaugccccucgcagggaugaagaaauaugccgacgaaaagagcgagagagcuuccucaucugagaaaaacgaaagccacagugccacuaaguccgcacugauacagaaacuaaugcaagauauucagcaccaggacaauuacgaggccaucugggaaaagaucgagggauucgucaacaagcuggaugaauuuauucaguggcucaaugaggcuauggagacaacggaaaacuggaccccucccaaagccgagauggacgaucugaaacuuuacuuggaaacucaucugagcuucaaauuaaacguggacucucacugugcacucaaggaggcgguagaagaggagggucaucaacugcuugaacugaucgcuucacacaaagccggcuugaaggauaugcucaggaugauugcaucccaguggaaggagcugcagcggcagauaaaacgccaacacaguuggauccuaagagcccuggacacaauuaaggcugaaauccucgccaccgaugugagcguugaggacgaagaggggacaggaucgccaaaagcagagguccagcugugcuaucuugaagcucagagggaugccguggagcaaaugucuuugaagcuguacuccgaacaguauacuagcucaaguaaacguaaggaggaguuugcggacaugucuaaggugcauuccgucggcagcaaugguuuacucgacuucgauucagaauaccaggagcugugggacuggcuuaucgauauggaaagucugguuauggacagccacgaucuaaugauguccgaggaacagcaacagcaucucuauaaacgguacucuguggagaugagcauucgacaccugaagaaaaccgaguugcuguccaagguggaagcccuaaagaaagggggaguacuccugccuaacgaccuucuggagaaggucgauucaauaaaugaaaaaugggaguugcucggaaagacgcugggcgagaagauccaggacaccauggcugggcauucuggaaguucgcccagagaucuacugagcccagaguccgguucucuugugaggcagcucgagguucgcauuaaggaacugaaaggcugguugcgggacacagagcuguucaucuuuaacucaugcuuaagacaagaaaaggaggggacuaugaauaccgaaaaacagcuccaguauuucaagagccuguguagggagauuaagcagcgccgacggggaguggcauccauccuucgucugugccaacacuugcucgaugacagagagacauguaaccugaaugccgaccaccagccgaugcagcuaauaaucgucaaccuggaaaggcgcugggaggcuauugugaugcaggccguucaauggcagacucggcuucagaaaaagaugggcaaagaaagugagacccucaaugugaucgauccuggucugauggacuugaacgggaugucugaggaugcauuagaaugggacgagauggauauuagcaauaagcugaucucacucaacgaagaguccaaugaccuggaucaagaacuucagcccguaauaccaagucugaaauugggcgagacgagcaacgaggaccccggauacgaugaagaggcggacaaucauggcgggucucaguacgccuccaacauuacagcuccuucaagcccacacaucuaucaggucuacucgcuacauaacguggaacuguaugaggauaaucacaugcccuuucucaagaacaauccuaaggugaccggaaugacucaaccgaacguccugacaaaaucucuuaguaaggacuccagcuucucauccaccaaaucuuuaccagaucugcucggcgguagcaauuugguuaagcccugcgccugucaugggggagacaugagucagaacuccggcagcgaaucugguauugugucagagggcgacacugagaccacaacgaauagugaaaugugccugcucaacgcaguagauggguccccuagcaaucuggagaccgaacaccuugacccacagaugggagaugcugugaacguccugaaacagaaguuuacugacgagggcgaaucuaucaaguugcccaauucgucacaaagcuccauaaguccugugggguguguuaacggaaaagugggcgaucuaaauucuaucacaaagcacaccccggacugccugggugaggagcuccaggggaaacaugaugucuucacauuuuacgacuauagcuacuuacagggauccaagcugaaacuucccaugauuaugaagcagucacaaagugaaaaggcccacguggaggauccacugcucagaggcuucuauuuugacaaaaagucuuguaaaagcaagcaucagacuaccgaauugcagccugauguucccccacacgagaggauccuggcauccgccucacacgagauggaccgaauuagcuacaaaucugguaacaucgaaaagacguucacaggcaugcaaaaugcuaagcagcucucccugcuuagucauagcucguccauagagucucuaucaccugggggagaucuguuuggcuuggggauuuucaaaaacggaagcgacaguuuacagcgcuccaccucucuggaaagcuggcucacuucauacaaguccaacgaggaccuguuuaguugccacagcucuggcgauaucucaguguccagcgguucugucggggaacuuaguaaacggacccuggaccucuugaauagacuggagaacauccagucgcccuccgagcaaaagauuaaaaggagcguaucagauaucacacuacagucuagcucccagaagaugaguuucacuggacagaugucacuggacauugcgucuagcauaaaugaagauuccgccgcaagucucaccgagcuuagcuccucugacgaacugucauuauguagcgaggauaucguguugcauaaaaacaagauuccagaaucgaaugcuuccuuccguaagcgccugacacggaguguugccgacgagucugaugugaacgucagcaugaucgugaauguaucaugcacguccgccugcaccgacgaugaggacgacucugaucuccugaguagcuccacucuuacacugaccgaagaggaacucuguauuaaagacgaggaugacgauucaagcaucgcuacugacgaugaaauauaugaggacugcacauugaugucuggccuggauuacaucaagaacgaguuacaaaccuggauuagaccgaaacuaagucugacgagggacaagaaacgauguaauguguccgaugaaaugaaggguagcaaggacaucucaucuuccgagaugacuaacccuucggauacccucaauauugaaacacuucugaacggcagcgucaaacggguuagugagaauaacgggaauggaaagaacucuucccacacccaugaguugggcacuaaacgcgaaaauaagaaaacaaucuuuaaggugaacaaggaccccuauguggcagacauggagaacgggaauauagaaggcauuccagagagacagaaaggcaagcccaacgucaccagcaaagugucagaaaaucuggguagucacgggaaggagaucuccgagagcgaacacugcaaauguaaggcccucauggauucucuggacgauucaaacacagcgggaaaggaguucguuagccaggacguaaggcaucuuccuaaaaagugcccaaaucaccaucacuuugaaaaccaguccacugcuucuacccccacggagaaaaguuucucggaacucgcccuggagacacgguuuaauaaccgacaagauagcgacgcauugaaguccucagaugacgccccuucuauggcuggcaaaagcgcaggcuguugccuggccuuagagcagaaugggaccgaagagaacgcgaguaucuccaauauuucauguugcaacugugaaccggauguguuccaccagaaggacgcugaggauugcucuguccauaauuuugugaaagaaauaaucgacauggccagcacugcacuaaaguccaagagucagccagagaacgagguugccgcucccaccagccugacacaaauuaaagaaaaggugcucgagcacucucauagaccuauccagcuucgcaaaggagacuucuacucauaucuguccuugagcagucacgauucugacugcggugaagucacuaauuacauugaggagaaguccucgacaccccugccacucgauacgacagacagcggccuggaugacaaagaagauaucgagugcuuuuucgaagccugcguggagggggacucagauggagaggaaccuuguuuuuccucugcacccccaaacgagagugcuguaccuagcgaagccgcgaugccgcuucaggccaccgcaugcucauccgaguucagcgacucuaguuuauccgcugaugacgccgauacugucgcucugagcucacccucuucgcaagaaagggcagaggugggcaaggaaguuaacggucucccacagacaagcuccgggugugccgagaauuuggaguuuaccccuaguaagcuggacucugaaaaagagucaagcggaaagcccggcgaauccggcaugccagaggaacauaacgccgcuagugcgaaaucuaaggugcaggaccuaagccugaaagcaaaucagccuacugauaaggccgcucuccaccccuccccgaagacacuuaccugcgaggagaaccuguugaaucugcacgaaaaacgucaucggaacaugcacagauga

SEQ ID NO: 52630 - RNA, 246 nt, Artificial Sequence
  derived and/or modified sequence opt3 from AKAP7__Homo_sapiens__NP_004833
augggccagcugugcuguuuccccuuuagcagagacgaggggaagaucuccgagaaaaacggaggugaaccugaugacgccgaacucgugaggcuuucuaagcggcuggucgagaaugcuguuuugaaagcagugcaacaguacuuagaagagacccagaacaagaauaaaccaggcgaggggucaaguguaaagacagaagccgcggaucagaacggaaaugacaacgagaauaaccgcaaguga

SEQ ID NO: 52631 - RNA, 11724 nt, Artificial Sequence
  derived and/or modified sequence opt3 from AKAP9__Homo_sapiens__NP_005742
auggaggacgaggaacggcagaagaaacuggaagccggcaaggcuaaacucgcucaauucaggcagcggaaggcccagagcgaugggcagucccccucuaaaaagcaaaagaaaaagcgcaaaaccucaaguagcaagcacgacguguccgcgcaccacgaucuuaacaucgaccagucucagugcaaugagauguacauuaacucgucacagcgagucgaaagcacuguuauaccugagaguacuaucaugcguacgcugcauuccggagagauuaccucucacgaacaagguuuuagcguggaguuggaauccgagaucucaacaacugcugaugacuguaguagcgaggugaauggcugcucuuucgugaugagaaccgggaaaccaacaaacuuacugagggaagaggaauuuggagucgaugacuccuauucagagcagggcgcccaggauagcccgacccaucuagaaaugauggagagugagcucgcagguaagcagcacgaaauugaggaacugaaucgggagcuugaagagaugcgcgugacuuacgggacagagggacugcaacaguugcaggaguucgaggccgcuaucaagcaaagagacggcauaaucacccagcucacggcaaaccugcagcaggccaggcgggaaaaagaugagacuaugcgcgaauuucuggagcucaccgagcaaucucagaaguuacagauucaguuccaacagcugcaggcuuccgaaacacuucgaaauagcacucacucgucuaccgccgcggacuugcugcaggcaaaacaacagauccuaacacaucagcagcaacucgaggaacaggaucaucugcuugaggacuaucagaagaaaaaggaggacuuuaccaugcaaauuuccuuccugcaggagaagaucaagguuuacgagauggaacaggauaagaaaguggagaacucaaauaaggaagagauacaggagaaagaaacgauuaucgaggaauugaacacuaagauuaucgaggaagagaaaaagacacucgagcugaaggacaaauuaaccacugccgauaagcugcucggcgaacuucaagagcagaucguccagaaaaaucaggaaauuaagaacaugaaacuggaguugacaaauaguaagcaaaaggaaagacagagcuccgaggagauaaaacagcuaauggggaccguggaggaacugcagaagaggaaccauaaagacucucaauuugaaacggauaucguacagcggauggagcaggagacccaacguaagcucgaacagcugcgcgcugagcuugacgaaauguauggacagcagauuguucaaaugaaacaggagcugaucagacagcacauggcccagauggaagagaugaagacaaggcacaagggugagauggaaaaugcauugcggagcuacucaaacauaacugugaacgaggaucaaauuaaacucaugaaugucgcuaucaacgaacugaauaucaaguuacaggacaccaacagucagaaagagaagcugaaagaagaacuaggccucauucuggaggaaaagugugcccuucagcgacaauuggaggaucugguggaagaacucuccuucagccgcgaacagauccagagagcgaggcagacaauugccgagcaagagucuaaacugaaugaagcacauaagucacuuaguacuguggaggaccugaaggcugaaauagucagcgccuccgagucucggaaagaguuggaacucaagcacgaggcugaaguuaccaacuauaaaaucaagcuggagauguuagaaaaagagaagaaugccgugcuggaucgcauggcagagucgcaggaagccgagcuagaaagacucaggacacagcugcuuuuuagccaugaggaagaguuguccaagcugaaagaggaccucgaaauugagcaccguaucaacaucgaaaagcugaaagacaauuuagggauucauuacaagcaacagauagauggacugcagaacgagaugucacagaaaaucgaaaccaugcaauucgagaaggacaaucuuauuacuaagcagaaccaguugauccucgagauuaguaaacugaaggaucuacagcaaucucugguaaauagcaaauccgaagagaugacgcuccagaucaacgaacugcagaaggagauagagauccuucggcaggaagagaaagaaaagggcacauuggagcaagaagugcaggagcugcaguuaaagaccgagcuccuggaaaaacaaaugaaggagaaagaaaaugaccuucaggagaaguuugcucagcuggaagcggagaacucaauuuugaaagaugagaagaaaacucucgaagacaugcugaagauccacacccccgucagccaggaggaacgacuaauuuuccuggauucuaucaaguccaaaaguaaggacagcgugugggagaaagaaauagagauucucaucgaggaaaacgaggaucugaagcaacagugcauucagcuuaaugaagagaucgagaaacagagaaacacauucucuuuugcagaaaagaauuucgagguuaacuaccaagaauugcaggaggaauaugccugucuguuaaaggugaaagacgaucucgaggacuccaagaauaaacaggagcuggaauacaagucaaaacuuaaggcucugaacgaggaacuacaccuccagaggauaaauccuaccacugucaagaugaaaaguagcguguuugaugaggacaagacauucguagccgaaacgcuggagaugggugagguuguggaaaaagacaccacugaguugauggaaaagcuggaggucacaaaacgcgaaaaguuagagcucucgcaacggcuguccgaucuuucugagcagcugaagcagaaacauggggaaaucagcuuuuugaacgaggaagugaagucacucaaacaggagaaggagcaagucagucugagaugcagggaacuagagauuaucauuaaucacaaccgcgcagaaaaugugcaguccugugacacccagguuucuagccugcuugauggagugguaacaaugacuucccgaggcgccgagggcucagucagcaaagugaacaagaguuucggggaagagucuaagaucaugguugaggacaaaguguccuuugaaaauaugaccgucggagaggaaagcaagcaagagcagcucauacuggaucauuugccaucggugacgaaagaaucaucucugcgggcuacccagcccagugagaacgacaaguuacagaaagagcucaauguacugaaguccgaacaaaacgaucuucgucugcagauggaggcccagagaauuugcuugagccucguguauucuacacacguugaccaggucagggaauacauggagaacgaaaaagauaaggcacuguguagccuaaaggaggagcugaucuucgcgcaagaagagaaaaucaaggaacuucagaaaauucaccagcucgagcugcagacuaugaagacccaagagacaggugacgaaggcaaaccuuugcauuuacugaucgggaagcuccagaaggcuguguccgaggaaugcucauauuuucugcagacucuuuguagugugcugggagaguacuauaccccagccuugaaaugcgaagucaaugcagaggauaaggagaacagcggcgacuacauuucugaaaaugaggaucccgaacuacaagacuaccgcuaugagguucaggacuuccaggaaaacaugcacacgcugcucaauaaagugacagaggaguacaacaagcugcuuguguuacagacccggcuguccaaaauauggggucaacagacugaugggaugaagcucgaauuuggcgaggaaaauuugccuaaggaggaaacagaguuccugucaauccauagucagaugaccaaccucgaggacauugauguaaaucacaaaagcaagcuguccucucuucaggaccuggagaagacuaaguuggaggaacaaguccaggagcuagagucgcugaucagcucacuccagcagcaauuaaaagaaaccgagcagaacuaugaagccgagauucauugccugcagaagagacuucaagcuguguccgaaaguacaguuccaccgucucugcccguggauagcgucgugaucacggaguccgacgcccagaggaccauguacccuggaucauguguuaagaaaaauauagauggcacuaucgaguuuucuggggaguucggagugaaggaggaaacaaacauuguaaaacucuuggagaagcaguaucaggaacaacuggaggaggaagucgcaaaagugaucgugagcaugaguauugcuuucgcccagcagaccgagcucucccgaaucagcgguggcaaggaaaauacagcgucuucaaaacaggcccacgcugucugccaacaggagcagcacuacuuuaacgaaaugaagcugucccaggaccaaauaggguuccagacuuuugagaccguugaugugaaguucaaagaggaauuuaagccacuuaguaaagagcuaggagaacauggcaaggagauucuguugagcaauucggacccccacgauaucccugagucuaaagacuguguauuaacgaucuccgaagagauguucagcaaggacaagacauuuauugugcgccagucaauacaugaugaaaucagugucucuuccauggacgcaagccggcagcugaugcucaacgaggaacaacuggaggauaugagacaggagcuugugaggcaguaucaagaacaccagcaggccaccgagcugcuccgucaggcucauaugcgccaaauggaacggcagagagaggaccaggaacaguugcaagaggagauuaaaaggcugaaccgacagcuagcccagcggucaaguaucgauaaugaaaaccugguuagcgagcgcgaaagagugcuccuugaggaacuggaggcauuaaagcaguugucccuggcggguagggagaaacucugcugugaacugagaaauucuagcacucaaacccagaacgggaaugagaaccagggcgaagucgaggagcaaacauucaaggaaaaagagcuugaccgaaagccagaagaugugcccccggagauucuguccaaugaaagauacgcccuccagaaggcuaacaaucgcuugcugaaaaucuuacuagagguugugaagacuaccgccgcagucgaggaaacaauaggaaggcacguacugggcauccucgaccguucaucuaaaagucagucgagcgcuucccuuauuuggcggucugaggccgaagcaucaguaaagagcugcguucacgaggaacauacgagagugaccgaugaguccaucccuaguuacucugggagcgacaugcccaggaacgauauuaauauguggucaaaagucacugaggaaggaacagagcugucccagcgcuuggugcgaagugguuuugccggcaccgaaaucgacccagagaacgaagaacugaugcucaauauaagcucuagacugcaagcugcgguagagaaacuucucgaagccauuuccgagacuucaagccagcuggaacacgcaaaggugacacagaccgaguugaugcgggagucguucaggcagaaacaagaagcuacggagucucugaagugucaggaagaguuacgcgaacgucuacaugaggagaguagagcccgggaacagcuggccgucgagcucuccaaagcugaagggguuaucgauggauaugcagacgagaagacucuuuuugaaaggcagauccaagagaaaaccgacauuaucgaucgccuggagcaggaauugcugugcgccagcaaccgacuccaggagcuggaagcggagcagcaacagauacaggaagagagagagcuuuuaucacggcaaaaggaagcuaugaaagccgaggcaggcccuguggaacagcagcugcuccaggagacagagaaguugaugaaggaaaaacuggaggugcaaugucaggccgaaaaggucagggacgaucuacagaaacaggugaaggcucuggagauugacguugaagaacaaguaucccgcuucaucgagcucgaacaggagaaaaauaccgaacuuauggaucugagacagcagaaccaagcauuggagaagcagcuggaaaagaugaggaaauuucucgacgagcaggccauugaucgggagcacgaacgugacguguuccaacaggagauccagaagcuggaacagcaauuaaaagucgugccccgcuuccagccaauaucugagcaccagacucgagaaguugagcagcuugcgaaucaucugaaggagaaaacagauaagugcagcgaacuccuacugaguaaggagcaauugcagagagacauucaggaaaggaacgaggagaucgaaaaacuggaguuucgggugcgcgaacucgagcaggcacuucuggucuccgccgauaccuuccaaaagguggaagacagaaaacacuuuggugcaguagaggccaagcccgaguugagccuggaaguccagcuccaggcugagagggaugccaucgaccggaaagaaaaggagauuacaaacuuagaagaacaacuggagcaguuccgagaagaacuugaaaauaagaacgaggaagugcagcagcugcauaugcaacuagagauccagaaaaaggagucuacuaccagacuccaggaacuggagcaggaaaauaaauuguuuaaggacgauauggagaaacuggggcucgcaauuaaggagucagacgcuaugaguacgcaagaucagcacguucuuuucggcaaguuugcccagauaauccaggaaaaagagguggaaauugaccaacugaacgagcaggucacaaaguuacagcagcaacugaaaaucaccacugauaauaaggugaucgaagagaaaaacgaguugauucgcgaccucgaaacccagauagagugucugauguccgaucaggaaugcguuaagaggaaucgggaggaagagaucgagcaacuaaacgaagugauugagaaacuucagcaggaacuggcgaauaucggacagaagacaagcaugaacgcccauucucucucggaggaagcagacucacugaagcaccaauuggaugucgugauugcugagaaacuggcccucgagcagcagguagaaacugcuaaugaggaaaugaccuucaugaagaacgugcuuaaagagacgaauuuuaagaugaaccagcugacacaagaguuauucagccugaaacgugaaagagaguccguugaaaagauccagaguauaccugaaaauucugucaacguggcaaucgaccacuugagcaaggauaaaccagaacucgaggugguccugaccgaggacgcccuaaagucccuugaaaaccagacuuacuuuaaaucauucgaggaaaauggcaaggggaguauuaucaaccuggagacaaggcuccugcaguuggaaucuaccguaagcgccaaagacuuagagcugacucaaugcuauaagcagauuaaggauaugcaggagcaaggacaguucgaaacagagaugcuccagaaaaagaucgugaaucuucagaaaauaguugaagagaagguggcugcggcacuggucucccaaauucagcuagaagccgugcaggaguacgcuaaauuuugucaggacaaccaaaccaucucaagcgagccggaacgcacgaauauucagaaccugaaucagcuccgggaggaugaauugggcucugacaucuccgcccugacucuucgaauaagugagcuggagagccagguuguggaaaugcauaccucgcucaucuuagagaaggaacaagucgagauugcagaaaagaacgugcuggagaaagagaagaaauugcuggaacuccagaaacuucuggaggguaaugagaaaaagcagagagagaaagaaaagaagaggucuccccaggauguagaggugcuaaaaacaaccacagagcuguuccacuccaacgaagagucaggguuuuucaaugaacucgaggccuugcgcgcugaaagcguugcgacuaaggccgagcuggcaaguuauaaagagaaggcugaaaaacuucaagaggaacuguuagucaaggagaccaacaugacgucccuccagaaggaccugucucaggugcgggaucauuuggccgaggcaaaagaaaagcugagcauccucgagaaagaagacgagacagaagugcaagagucaaagaaagccugcauguuugagccucuuccaauuaagcuguccaagaguaucgcuagccagacugauggaacccuaaaaauaucuucauccaaucagacaccccagauucuggucaagaacgccggcauccaaaucaaucuccagagcgaauguucuagugaggaaguuaccgagauuaucucgcaguucacugagaaaauagagaagaugcaggaguugcacgcggcagaaauucuggacauggaguccagacacaucagcgaaaccgagacauuaaaacgugaacauuacguggccguacaacuucugaaggaggagugcgguacgcucaaggcugugauucagugucugaggucaaaagaaggcucuagcaucccugaguuggcccacuccgaugcuuaucagacucgggaaauaugcaguucagacucugggagcgauuggggacagggcaucuaccugacccauucccaaggguuugacauugcaagugagggacgcggcgaggaaagcgaguccgccacagacucuuucccaaagaaaaucaagggucuccuucgagcuguccacaacgaagggaugcaagugcugucacuaaccgagagccccuacucggauggagaagaccauuccauucagcaaguuagugagccguggcuggaggaaagaaaagccuauaucaacacuauuucuagcuuaaaggaucucaucacaaaaaugcagcugcagagggaggcagaaguguacgacucaucccagucucacgagaguuuuagcgauuggcggggcgaauugcuucuggcgcuccaacaggucuuccuggaggagcgcuccguauugcuggccgcuuuuagaaccgaacuaacggcccucgguacuacagacgcagugggccuucugaauuguuuagagcagaggauacaggaacaagggguugaguaucaggcugccauggagugccugcagaaggcagaucgacggucacuccugagcgaaauucaggccuugcacgcucaaaugaacggacguaagaucacccuuaaaagagagcaggaaucugagaagccuagucaggaacugcucgaguacaauauccagcaaaaacagucccagaugcuggagaugcaaguggaacuaagcucaaugaaggaccgcgcgaccgaguugcaggaacagcugucuuccgagaaaauggucguggccgaacucaagucggagcuugcacagacuaagcuggaguuagaaacaacccugaaagcucaacauaagcaccucaaagagcuggaagccuucagguuggaggucaaggauaaaacagacgaagugcaucuucugaacgauacucucgccagcgagcagaagaagagucgggagcugcagugggcacuagaaaaagagaaggcuaaauuaggcagaucugaggaacgcgacaaggaggaacuggaggacuugaaauuuucccucgaaagccagaagcaaaggaaucugcagcuuaaccugcuccuggagcagcagaagcaauugcuuaaugaaucacagcagaaaauugagagucaacgaaugcuguaugaugcccagcuauccgaggaacaggggcggaaccucgagcugcagguuuuacuggaaagcgagaaggugagaauaagggaaaugucuucaacguuggaccgcgagcgugagcuccacgcgcaacugcagagcuccgauggaaccggccagucucggccaccccuuccuagugaagaccugcucaaagaguugcagaagcaacuggaagagaaacacucgagaaucguagaacuucugaaugagacagagaaguacaaguuagauagccuacagacuaggcagcagauggaaaaagaccgccaagugcaucgaaagacccuccagacagagcaggaagcuaacaccgagggucagaaaaagaugcacgagcugcaguccaaagucgaagaucugcagcggcaguuggaggaaaagagacaacagguuuauaaacucgaccuggaggggcagaggcuucagggaauuaugcaagaguuccagaagcaggagcuggagcgcgaagagaagagagaaucacggaggaucuuauaccagaaucucaacgagcccacuacguggucucugaccagcgaucguacacgaaauuggguguugcaacagaaaauugaaggcgagacuaaggagaguaacuacgccaaacuuaucgaaaugaaugguggcgggaccggauguaaccaugagcuggaaaugauacgccagaagcuacagugcgucgcauccaaacuccaagugcugccacagaaggccucagagagacugcaguucgaaacagcugacgaugaggacuuuaucuggguacaagagaacauugaugaaaucauuuugcagcuccagaagcugaccggccagcaaggggaggaaccuucucuugugagccccuccacaaguuguggaagccugacagagcgguuacucaggcagaaugcagagcugacgggccacaucucucagcuaaccgaagagaaaaacgacuugcgcaauaugguuaugaagcuggaggaacagauaagaugguaucggcaaacuggugccgggagggacaacucaucccgauucagccuuaauggaggcgcgaacauugaagcuaucaucgccagugagaaagagguguggaaucgugaaaagcucacacugcagaaaucucugaagagagcagaggccgaagucuacaaguugaaagcugagcuucgcaacgauucccuccugcagaccuuaucgccagacagcgaacaugugacccugaagcggauuuauggcaaauaccuaagggccgagucauuuagaaaggcacucauauaucagaaaaaguaccuguugcugcuucucgggggauuccaagagugcgaagaugcuacacuggccuuacuggcgcgcauggguggccagccggccuuuacugacuuggaggucaucacgaaucggccuaagggguucaccagguuucgauccgcagugagaguuucuauugcuaucagucggaugaaauuccucguaaggcgcuggcaccgugugacaggaagcgucucaauuaacaucaauagagauggcuuuggucugaaccagggggccgaaaagacugacuccuucuaucacagcucuggaggccuugagcuguacggcgaaccccgacauaccacauacaggagucgguccgaucuagacuauauacgcagcccacuccccuuucaaaauagauacccugggaccccagcagauuucaaccccggaucacuggcuugcucucaguugcagaauuaugacccugauagggcccugacugacuacaucacgcggcuugaggcccuccagcgcagacuggguacaauucaaucgggcagcaccacucaguuucacgcggggaugcgaagguga

SEQ ID NO: 52632 - RNA, 552 nt, Artificial Sequence
  derived and/or modified sequence opt3 from AKIP1__Homo_sapiens__NP_001193575
auggacaacugccuggccgcugcagcccucaauggcguggauagaaggagccuucagcgguccgcgcgccuggcuuuggaggucuuagaacgagccaagcguagagcaguugacuggcacgcccuggagaggcccaaaggguguaugggagugcuagcucgggaagcaccucaucucgagaagcaaccagccgcugguccgcagcgcguacugcccggcgaaaaauacuauucuucagugccugaggaagggggagccacccacgucuacagauaucauaggggcgagaguaaguugcacaugugccuggauaucgguaacgggcagcggaaagaccgcaagaagacaagccuuggaccaggcggcuccuaccagauuucugagcaugcgcccgaagcaucgcaaccugccgagaauauaucaaaagaucucuauaucgagguguacccagggacuuauagcguuacggugggaaguaacgaccugaccaagaaaacacacgucguggcuguagauuccggucagucuguugaccugguguuccccgucuga

SEQ ID NO: 52633 - RNA, 612 nt, Artificial Sequence
  derived and/or modified sequence opt3 from AKIRIN2__Homo_sapiens__NP_060534
auggccugcggcgcuacccugaagagaacacucgacuucgauccccuucugagcccugcauccccaaaaaggcggcgcugugccccguugucugcgcccacuucagcugccgcaaguccuuuaagcgccgcugcagccacggcugccuccuuuucugcggcagccgcuucgccacagaaguaccugcgaauggagcccucaccuuucggggacgugagcagucgucuaaccacagaacaaauccucuauaacauuaaacaggaguacaagagaaugcagaaaaggcggcaccuggaaacuuccuuucagcaaaccgauccaugcuguacaucugacgcccagccccaugcauuccuucugagcggaccugcuuccccagguaccucaagugccgcgagcucuccguugaagaaggagcagccccucuuuacucugcgccaggucggcaugauaugcgaaagacugcucaaagagagggaggaaaagguucgggaggaauaugaggagaucuuaaauacaaaacuggccgaacaauacgaugcauucgugaaguuuacccacgaccagauuaugcgccgauauggggagcagccugcuuccuacguaucauga

SEQ ID NO: 52634 - RNA, 4320 nt, Artificial Sequence
  derived and/or modified sequence opt3 from AKNA__Homo_sapiens__NP_110394
auggccagcuccgagaccgaaaucagaugggcugagcccggccuggggaagggaccucagaggcggcgcugggcaugggccgaagacaaacgagauguggaccguucuucaagucaaagcugggaggaagagagacucuucccaaacgcgacauccccggagcuucuggaagauuuuagguuggcucagcagcacuuacccccucuggagugggacccacauccccagccugauggucaccaagacucugaaucgggcgagacuucaggggaggaagccgaggcagaagaugucgacagcccagccaguucccaugagccccuagcuuggcucccucagcagggacggcagcuggauaugacggaagaggagccagacggcacccuugguucucuggaaguugaggaagcaggggagagcuccucacgcuugggauacgaagccggccucagucuggagggccacgggaauacaagcccgauggcucugggacauggucaagccagaggcuggguggcgucuggggagcaggcauccggagauaagcucucagaacacagcgagguaaaccccaguguggaauuaucuccugccagguccuggagcucgggcacugucucucuggaccacccauccgauucacuugacaguaccugggagggugaaacagacgggccccagccuaccgcuuuggccgagacucugccagagggacccagccaucaccuacucuccccggauggccggacaggcgggucuguggcacgcgcuaccccuauggaguuccaggacagcucagcucccccagcgcaaaguccucagcaugccacggaucgauggagaagggagacuacccgguuuuucugcccccagccaaaagaacacauuuggaagcaaacaaaaacuucccccaagccucugccaagccguuuuauaggaucuaucucaccgcuuaauccccagccucgcccaaccagacaggguaggccccugccucggcagggcgcaacauuggcugggcgaaguagcuccaacgccccaaaguauggacgcggccaacucaauuacccccugccggacuucucuaaaguugguccuagagugagguuuccaaaggaugagucguaucggcccccuaaaagccgcucccacaacagaaagccccaggcuccagccaggccuuuaauuuucaaaucacccgcagagaucguccaggaagugcugcucaguucuggggaggccgcucuugcgaaggacaccccaccggcacauccuauuacgcguguaccccaggaauuucaaacuccagagcaggccacagaacugguucaccaguugcaggaggauuaccaucggcuacugaccaaguaugcugaggccgaaaauacuaucgaccaacuccgacugggcgcaaaagugaaccuuuucagcgaucccccucagccaaaucacuccauacauacaggaauggucccccagggcaccaaggugcugucauuuacgaucccucagccgagaagcgccgagugguggccagggcccgcugaagacccucaagccucugcagcguccggauggccaagugcuaggggugauuugagccccucuucccucaccucaaugccuacacugggcugguuaccggagaaccgcgacauuagugaagaccagagcucggccgagcagacucaagcacuggccucccaggcuucucaguuccuagccaaaguggagagcuuugaacggcucauccaggcagggagacugaugccccaagaucaggucaagggauuccagaggcuuaaagcugcccacgcggccuuggaggaagaguaccugaaggcuugucgcgaacagcacccagcacaaccucucgccggcucaaaagguacccccgggcgauucgacccacggcgugagcuggaggcugaaauuuauagacuuggcaguugccuggaggaauugaaggagcauaucgaucagacacagcaggagccugaacccccaggauccgacucugcccucgauagcacuccggcacugccuuguuuacaccaacccacccaucugccagcgcccuccggccaggccccuaugccagcuauaaagacaucaugccccgagccugccaccacuacggcagcugccagcacagggccguguccacuacacguuaauguggaaguaaguucuggaaacuccgagguggaagacaggccccaggauccucucgcacgccugcggcacaaagagcuucaaauggagcaggucuaccaugguuugauggaaagauaccugagcgugaagucgcuccccgaggccaugaggauggaagaggaagaggagggcgaagaggaagaggaagaggaagggggaggcgacucacuggaaguugaugguguggcugcgaccccagggaaagccgaggcaacucgagucuuaccucgccagugccccgugcaggcugaaaagucucacggcgccccacuggaggaggccaccgagaaaaugguaaguaugaagccuccgggauuucaagccucccuugcacgggacggccauaugagcggguugggaaaggccgaagcggcucccccaggcccugguguucccccacacccucccgggacaaaaucugccgcaagccaucaguccucaaugaccagucucgaaggaagcggcauuucugagagacugccgcagaagccacuacacagggguggcgggccucaccuggaagagacuuggauggccucccccgagacagauucaggauucgugggcagugaaacgagccgugucuccccacucacccagacucccgagcaucgccugucucacaucucgacagcugggacccuugcacaaccuuuugccgcgagcgugccgcgggacggagcuucauaucccaaagccagaggcuccuugauuccaaggcgagcaacagaaccuaguacuccccggucucaggcccagcgcuaccugagcuccccuucagguccauuaagacagagggcucccaauuucucucucgagcggacccuggccgcagaaauggcugucccugggagcgaguuugagggacauaagcgaaucagugaacaaccacuucccaacaaaacgaucuccccgccuccagcccccgcgccugccgcagcuccacugcccuguggcccgaccgagacaauuccuagcuucuugcucacuagagccggucgcgaucaggcuauaugcgaacugcaggaggaagugucuaggcuacgucugcggcucgaggacucacugcaccagccccuucaaggcuccccaaccagaccugcaagugccuuugacaggcccgcccgcacacgagggagaccagcugauagccccgcgacuuggggaucgcauuauggcucuaaguccaccgagcgguugccuggggaaccaaggggagaggaacagaucguuccgcccggccgccagcgugcaagaagcucaagugugccucgggagguacugagguuaucucucuccagcgagucagaacugccaagucuuccccuguucagcgagaaguccaaaacgacaaaggacucuccucaagccgcucgcgaugguaaacgaggggucggaagcgccggcuggccagacagagugaccuuucggggucaguacacuggccacgaauaucacguucuaucccccaaggcagugccuaaagggaauggaacagucucauguccgcauugcaggccaauucgcacccaggaugccggcggggcugugacuggagacccccucggcccucccccagcggauacccugcaguguccuuugugcggucaaguagggucucccccagaggccgacggaccgggcagugcaacaucgggcgcugaaaaggccacgaccagaaggaaggcaagcuccacuccuucucccaaacagcggucaaagcaggccgggagcuccccacgucccccuccaggacugugguacuuagcuacagcgcccccugccccggcaccacccgccuucgcuuauaucaguucugugccuauaaugccauaucccccugccgcuguuuacuacgcacccgccgguccaaccagcgcucagccggccgcaaaauggccucccacagcgucaccaccucccgcccgccgacacagacauuccauucaacucgaucugggcgaccuugaggagcugaacaaggcuuugaguagggccguccaggcagcugaaagcgugcggucuacuacccgccagaugagauccucacucagcgccgaucugaggcaggcacacucgcuacgggggucuugccuguuuuga

SEQ ID NO: 52635 - RNA, 951 nt, Artificial Sequence
  derived and/or modified sequence opt3 from AKR1B10__Homo_sapiens__NP_064695
auggccaccuucguggagcugagcacaaaggcuaagaugcccaucgucggccucgggacuuggaaguccccucuuggaaaaguuaaggaagcagugaaaguagccauugacgcggguuacagacacauagauugcgcuuauguguaccagaacgagcaugaagucggcgaggccauccaagaaaagauucaggagaaggcagugaaaagggaggaccuguuuaucguuucuaaguuguggccaacguucuuugaacggccguuagugcgcaaagccuucgagaagacccugaaagaucuaaagcucucauaucuggacgucuaccuuauucacuggccccagggguuuaagaguggagaugaccuguucccuaaagaugacaagggcaaugcuaucggugggaaagcaacauuuuuggaugccugggaagcuauggaggagcucguggacgaaggacugguaaaggcccugggcguuagcaacuucucccauuuucagauagagaaacucuuaaauaagccaggccugaaauauaagcccgugacuaaccaagucgaaugucacccuuaccuuacccaggagaaguugauccaguauugccauucuaaagggauuacagugaccgcguacucgccacugggaucacccgaucgaccuugggcaaagccagaagacccgagccuacucgaggaucccaaaaucaaggagauugccgcuaaacacaagaagacugccgcacaggugcugauccguuuccacauacaaagaaaugucauuguuaucccuaaaagugugacaccagcuaggauuguagaaaacauccagguguuugacuucaaacuuuccgacgaggaaauggccaccauccugucuuuuaaucggaacuggcgcgcguguaaugucuugcagagcucccaucucgaggauuaccccuucaacgccgaauauuga

SEQ ID NO: 52636 - RNA, 951 nt, Artificial Sequence
  derived and/or modified sequence opt3 from AKR1B1__Homo_sapiens__NP_001619
auggccagcagacugcuccuuaacaauggcgcuaagaugcccauccugggguugggaaccuggaaauccccuccaggucaggugacagaggcagucaagguugccauugacgugggcuacaggcacauagauugcgcgcauguauaucaaaacgaaaaugaggugggggucgcuauccaggaaaaauuacgggaacaggugguuaagcgcgaagaacuguucauugugucuaaacuaugguguacuuaccacgagaagggacucgucaagggcgccugccagaaaacgcugucagaccuuaagcuggauuauuuggaccucuaccugauccauuggccgaccgguuuuaaacccgggaaggaguucuuuccucuggaugagaguggaaacgugguaccaagcgacacaaauauucucgauacuugggcagccauggaagaguuaguugacgagggccuggugaaagcuaucggcauauccaacuucaaucaccuucaagucgaaaugaucuugaacaagcccgggcugaaguauaaaccugcagugaaucagauugagugucauccauaccuaacccaggaaaagcucauccaguauugccaaucuaaaggaauuguggucacagccuacucgccccuggguucaccugaucgaccaugggcuaagccggaggaccccagccuucuggaagauccucguaucaaagccauagcggcaaagcacaacaaaaccacugcccagguuuugauuagauuuccaaugcagaggaaucucgugguaauccccaagagugugacaccugagcggauugcugagaacuucaaggucuuugacuucgaacuguccucucaggauaugaccacguuacugagcuacaaucgcaacuggagagugugugcccuccuuuccugcacuucacacaaagacuauccauuucaugaggaguucuga

SEQ ID NO: 52637 - RNA, 972 nt, Artificial Sequence
  derived and/or modified sequence opt3 from AKR1C1__Homo_sapiens__NP_001344
auggacagcaaguaccagugcgugaaacugaacgauggccacuucaugcccguccucggguuuggaaccuaugccccugcugagguuccaaaguccaaagcacuugaagccacaaagcuggcgaucgaggcugguuucagacauauugacucugcccacuuguacaauaacgaagaacaagugggcuuagcaauaaggucaaaaaucgccgaugggaguguaaagcgggaagacaucuuuuauacuagcaagcugugguguaauucccaucgcccggagcuagugcgacccgcucucgagcguucucugaaaaaccuucagcuggauuacgucgacuuguaucucauucacuucccugugucgguuaagccaggagaagaggugauucccaaagaugaaaauggcaagauccuguuugacacggucgaucugugcgcaaccugggaggccguggagaaauguaaggacgcuggucucgccaagucaauagggguaagcaacuucaauagaaggcaguuagaaaugauccugaacaaaccuggacuuaaguacaaaccaguuugcaaucagguggagugucaucccuauuuuaaccaacggaaguugcuggauuucugcaaaaguaaggacauuguccuaguggcguacuccgcacucggcucucaccgcgaggagccuuggguggauccaaauagcccgguccugcuugaagaccccguucugugugccuuggcuaaaaagcacaagagaacuccugcccucaucgcacugagguaccaguuacagcggggcgugguagugcuggcuaaauccuauaacgagcagcgcauucgacaaaauguccagguguuugaguuccagcucacaucagaagagaugaaggccaucgacgggcuuaacagaaauguuagguaccugaccuuggauauauuugcgggaccacccaacuauccuuucagugacgaauacuga

SEQ ID NO: 52638 - RNA, 420 nt, Artificial Sequence
  derived and/or modified sequence opt3 from AKR1C2__Homo_sapiens__NP_001128713
auggacagcaaguaccagugcgugaaacugaacgauggccacuucaugcccguccucggguuuggaaccuaugccccugcugagguuccaaaguccaaagcacuugaagccgugaagcuggcgaucgaggcugguuuccaucacauugacucugcccauguauacaauaacgaggaacaagugggcuuggcaauaagaucaaaaaucgccgaugggagugucaagagggaagacaucuuuuauacaagcaaguuaugguccaauucucaccggccggagcuggugcgccccgcucuagagcgaucgcucaaaaaccugcagcuugauuacguugaccuguauuugauucauuucccugugucagucaaggaagauauuggaauccucacuuggaaaaagagcccaaaacacaauaguuga

SEQ ID NO: 52639 - RNA, 972 nt, Artificial Sequence
  derived and/or modified sequence opt3 from AKR1C3__Homo_sapiens__NP_001240837
auggacagcaagcaccagugccugaaacucaacgauggccauuucaugcccgugcuuggguuuggaaccuacgccccuccagaggucccgagauccaaggcucuggaaguuacaaaauuggcaaucgaggccgguuucaggcacauugacucugcgcauuuauauaauaacgaggagcaagugggccuggcuauacggucaaagaucgccgaugggaguguaaaacgcgaagacauuuucuacacuagcaagcuaugguccacguuccaccgacccgagcucgugcguccugcacuggaaaauucucuuaagaaagcccagcuggauuaugucgacuuguaccucauccauucgccaaugucacugaagcccggagaggaacugagcccuaccgaugaaaacggcaaagugauuuuugacaucguugaucucuguacaacuugggaggcuauggagaagugcaaagacgcagguuuagccaagaguauagggguguccaauuucaacagaaggcagcuggaaaugauccuuaauaagccaggauugaaauauaagcccgucuguaaccagguggagugccacccuuacuuuaaucggucuaaacugcuagauuucuguaagagcaaagacauuguacucguugcuuauuccgcccugggcucacaacgcgauaagagauggguggacccaaacaguccgguccuucuggaagaccccguguugugcgcgcucgccaaaaagcacaagaggaccccugcacugaucgcuuuacgguaccagcugcagcgcggcguggucguucucgccaaaagcuacaaugagcagcgaauuagacaaaacgugcagguauuugaauuucagcuuacagcagaggauaugaaggcuaucgacgggcuggauaggaauuugcauuauuuuaacucugacuccuucgccucacacccaaauuaccccuauagcgaugaguacuga

SEQ ID NO: 52640 - RNA, 972 nt, Artificial Sequence
  derived and/or modified sequence opt3 from AKR1C4__Homo_sapiens__NP_001809
auggaccccaaguaccagagaguggagcugaacgauggccacuucaugccuguccucggguuuggaaccuaugccccaccggaaguucccaggaaucgggcuguggagguaacaaaacuugcaaucgaagccgguuuccgccauauugacagcgcguaccuguauaacaaugaggaacaagugggcuuggcuauacgauccaagaucgccgaugggucugucaaacgugaggacaucuuuuacacuucaaaguuauggugcacguucuuucagccucagauggugcagccagcacuggagaguagccucaaaaagcuacaacuggauuauguugaccuuuaccuguugcacuuccccauggcccucaagccuggagaaaccccacugcccaaagaugagaacggcaaggugauuuuugacacagucgaucuguccgcuacuugggaagugauggagaaauguaaggacgcaggucucgccaaaucuauugggguaucgaauuucaacugcagacaguuagagaugauccugaauaagccuggacuuaaguauaaaccaguuuguaaccagguggaaugccauccguacuugaaucagucaaagcugcuagauuuuuguaaaagcaaggacauaguccucguggcucacagugcccugggcacccaaaggcauaaacuuuggguggaucccaacuccccuguccuguuggaggacccaguucucugcgcgcuggcaaagaaacacaagcggacacccgccuuaaucgcucugcgcuaccagcuccagagaggcgugguagugcuugccaagucuuauaaugaacagaggauucgggagaacauccaagucuucgaauuucagcugaccagcgaggacaugaaaguguuggaugggcuaaaucgcaacuaccgauauguugugauggacuuccugauggaucacccugacuacccauuuuccgaugaguauuga

SEQ ID NO: 52641 - RNA, 858 nt, Artificial Sequence
  derived and/or modified sequence opt3 from AKR1D1__Homo_sapiens__NP_001177835
auggaccugagcgccgcuucccacagaaucccccucucugauggcaacucaauuccuauaaucgggcuuggaaccuacagugagccaaagagcacaccgaaaggugcaugcgccacuuccgugaaggucgcgauugacacgggcuauaggcauaucgauggggcuuacauuuaucagaaugaacacgagguuggagaagccauccgggagaaaauagcagaaggcaaggugcgccgagaggacaucuucuacugugguaaacugugggccaccaaccauguacccgagauggugcguccuacauuggaaagaacuuuaaggguccugcaacuagauuauguggaccucuacauuaucgagguuccaauggcuuuuaagcccggggaugaaauuuauccucgggacgagaauggaaaguggcuguaccacaaaucuaaccuuugcgcaaccugggagguggaaugucauccauacuucacacagcccaagcuguugaaauuuugccagcagcacgauaucgucauaaccgccuauucgccucucggcacuucacgcaauccaauuugggugaacguaagcaguccgccccugcugaaggacgcucucuuaaauucccugggcaaaagauacaacaagacagccgcgcaaaucguucuuagguucaauauucagcgcgggguggucgugaucccuaagucuuuuaacuuggagcggaucaaagaaaauuuccagauuuuugauuucagccugaccgaggaagagaugaaggacauagaggcacuaaacaaaaaugugcgauuugucgaacuccugauguggagagaucacccagaguaucccuuccaugacgaauacuga

SEQ ID NO: 52642 - RNA, 963 nt, Artificial Sequence
  derived and/or modified sequence opt3 from AKR1E2__Homo_sapiens__NP_001035267
augggcgacauccccgccguggggcugagcuccuggaaggcuucuccuggaaaagucaccgaggcaguuaaggaagccauugaugcggguuacagacacuucgacugcgcuuauuuuuaccauaacgagagggaagugggcgccgggauacgguguaaaaucaaggagggagcaguacgccgagaagaucucuucauugccacaaaacuuuggugcacuugucacaagaagucacugguggagacggcuugccguaaaaguuugaaggcauuaaaacugaauuaucuagaccucuaccugauccauuggccaaugggcuuuaagccgccccacccugaguggauuaugagcuguuccgaacuuucuuucugccugucgcauccaagaguccaggauuugccccucgacgagucaaacauggugaucccuagcgauaccgacuuucuggauacaugggaagccauggaggaccugguuauaacuggucucgugaaaaauaucggggucaguaacuucaaucacgagcaauuagaaaggcugcuuaacaagccaggauugcgguuuaagccccugaccaaucagauugagugucacccuuaucuaacacagaaaaaccucaucuccuucugccagucucgcgaugugagcguaaccgcuuacagaccacugggcggcuccugugaagggguugaccuuauugauaauccggugaucaagaggauagccaaagagcauggaaagucacccgcgcaaauucugauccgguuucagauucagcgcaacgucaucgugaucccugguaguauuacuccaagccacauaaaagaaaauauccagguguucgacuuugaguugacacaacaugacauggauaacauucucucucugaaucgaaacuuaagacuggcaauguuccccaucaccaagaaucacaaagacuauccuuuucacauagaguacuga

SEQ ID NO: 52643 - RNA, 519 nt, Artificial Sequence
  derived and/or modified sequence opt3 from AKR7A3__Homo_sapiens__XP_011539349
augagcagacagcuguccagggcccggcccgcuaccgugcucggcgcaauggagauggggcgccgaauggacgccccuacaucugcggcugucacucgugccuuccuugaaagaggacacacggagaucgauaccgcauuuguuuacucagaaggucaaagugagacaauucugggcggguugggauuaaggcugggcgguagcgacugccgggugaagauagauacuaaagccaucccacuauucgggaacucccucaagccggacucucugcgcuuucagcuugaaaccucgcugaaaagauugcagugucccaggguagaucucuucuaucugcauaugccugaccacucaacaccaguggaggagacccugcgggcuugccaucagcuccaccaagaaggaaaguuugucgaguuaggccugagcaauuacgcagccugggaaguggcugagauuuguacucuuugcaaaaguaacggcuggaucuugcccacaguuuaucagggggccuguuga

SEQ ID NO: 52644 - RNA, 1443 nt, Artificial Sequence
  derived and/or modified sequence opt3 from AKT1__Homo_sapiens__NP_001014431
augagcgacguggccaucgucaaggagggcuggcugcacaaaagaggggaauacauuaagaccuggaggccccgguauuuccuccuuaaaaacgauggaacauuuauagguuacaaggagcgcccucaggacguugaucaacgagaagcuccacugaauaacuucuccguggcacagugccaguugaugaaaacugagcguccgagacccaauacguuuaucauuagguguuuacaguggaccacaguaaucgaacggacuuuccauguggagaccccugaggaacgcgaggaauggacaaccgccauucaaacugucgcggacggccugaagaagcaggaggaggaagagauggauuuuagaucugggucaccaagugacaacagcggagcugaagagauggaagugucccuagccaaacccaagcacaggguuacaaugaaugaguucgaguaucucaaacugcuuggcaaggguaccuuugggaaagugauccuggucaaggaaaaggcaacgggacgguacuaugccaugaaaauauugaagaaagaggugaucguagcuaaggaugaaguugcacauacucucaccgagaaccgcgugcugcaaaauucucgacacccuuuccugacagcccucaaauacucguuucagacucaugacagauuaugcuucgucauggaauaugcuaacggcggcgagcuguuuuuccaccuuucaagggagcggguguuuagcgaagaucgugcccgcuucuacggggcggagauugugagugcauuggacuaccugcacuccgaaaagaaugucguuuauagagaucuaaaacucgagaaccugaugcuugacaaggauggacauaucaagauuaccgacuucggucuguguaaagaaggcaucaaggacggggccacaaugaaaaccuuuugcggaacgccagaguacuuggcucccgaggugcucgaagauaaugacuauggcagggccguagauugguggggucuggggguggucauguacgagaugauguguggacgguuaccuuucuauaaccaggaccacgaaaagcuguuugagcucauacuuauggaggaaauucgauucccacgcacucugggcccggaggcaaaaucuuugcuaagcggccugcucaagaaggaucccaaacagagacuugggggagguuccgaagacgcuaaggagaucaugcagcauagguuuuucgccggcauuguguggcagcacguuuacgaaaagaaacugucaccuccauuuaaaccccaagugacaagugagaccgauacucgguauuucgacgaggaauuuacagcgcagaugaucaccaucacgccuccagaucaggacgauagcauggagugcgucgacucugaacgcagaccccacuucccgcaauuuuccuacucagccagcgggaccgcauga

SEQ ID NO: 52645 - RNA, 771 nt, Artificial Sequence
  derived and/or modified sequence opt3 from AKT1S1__Homo_sapiens__NP_001092103
auggccagcggcagacccgaggaacugugggaggcuguggucggggcagccgaaagguuccgggcgcgcaccggaacagagcucguucuucugacugcugccccuccaccgcccccucgaccaggucccugcgcauacgccgcucacggccguggggcauuggccgaagcugccagaagguguuuacaugacaucgcgcuggcacaccgggccgcuacggccgcacgcccuccagcucccccuccagccccgcagcccccuuccccaacccccucuccuccaagacccacacuagcgagggaggauaacgaggaagacgaggaugaaccgacugagaccgagacaucaggagaacaacucggcauuagugacaauggugggcuguuugugauggaugaggacgccacccuucaggaucugccucccuucugcgaaagcgacccagaguccacugaugacggaucuuugucggaagagacacccgcaggcccuccaaccuguucaguacccccugcuagcgcccucccaacgcagcaguaugcuaagagucugccgguguccguccccguguggggcuuuaaagagaagcggacugaagcccgcucuagcgaugaggaaaacgggccuccauccucacccgaccuggaucgaauagcagccaguaugagagcucucguuuuaagggaggcggaagacacccaaguguucggagaccugccucggccacgucuuaauacaagcgauuuucagaaauugaagcgcaaauacuga

SEQ ID NO: 52646 - RNA, 1260 nt, Artificial Sequence
  derived and/or modified sequence opt3 from AKT2__Homo_sapiens__NP_001229957
augaagaccgagagacccaggccuaacacauucgugauccggugccugcaguggacuacggucauugaacgcaccuuucacguugacagcccagaugagcgagaagaguggaugcgugccauacaaaugguggcuaauucccucaaacagagagcaccgggcgaagaccccauggauuacaagugugggucuccuucagacaguagcacaacugaggagauggaaguagccguguccaaagcgagggcuaaggucaccaugaacgauuucgacuaucuuaaacuguugggaaaggguacauuuggcaaggugaucuuaguucgggagaaagccaccgggcgcuacuaugcaaugaagauucugagaaaagaagugaucauugccaaggaugaggucgcucauacugugacagagucuaggguacuacagaauacccggcacccauuccucacggcacugaaauacgccuuucagacucaugaccgccuuugcuucguuauggaauaugcuaacggaggcgagcuguuuuuccacuugucgcgagaaagaguguuuaccgaggaaagggcccgguucuacggugcggagaucgucucagcacucgaguaucugcauagccgugaugugguguaccgcgacauaaagcuggaaaaucucauguuagauaaggacgggcacaucaaaauuacagauuuuggacuguguaaggagggcaucagugacggcgccacuaugaaaaccuucugcgggacacccgaauaccuugcuccugaggucuuggaagacaacgauuaugguagagccguugacugguggggacugggcgugguaauguacgagaugaugugugggaggcuaccauuuuauaaucaagaucacgagcgguuauucgaacugauucuuauggaggaaauccgauucccccgcacccuguccccugaggcaaagucuuugcucgcuggacugcucaaaaaggacccaaaacagagacugggcggugggccgagcgaugccaaggaagugauggagcauagguuuuuccucuccauaaacuggcaggacgucgugcagaagaaacuucugcccccuuuuaagccacaaguuacgucagagguggauacucgguacuucgacgaugaauuuacagcgcagaguauuaccaucacucccccugaccgcuaugauagcuugggacuacuggagcucgaccagagaacacacuucccacaguuuucuuacuccgccucaauuagggaauga

SEQ ID NO: 52647 - RNA, 1398 nt, Artificial Sequence
  derived and/or modified sequence opt3 from AKT3__Homo_sapiens__NP_001193658
augagcgacgugaccaucgucaaggagggcuggguucagaaaagaggggaauacauuaagaacuggaggccccgguauuuccugcucaaaacagauggauccuuuauagguuacaaggagaaaccucaagacguggaucuuccauauccgcugaauaacuucucuguagccaagugccaguugaugaagacugaacgccccaaaccuaauacguuuaucauucgauguuuacaguggaccacagugaucgagcguacuuuccacgucgacaccccagaagagagagaggaauggacagaggcuauucaggcaguggccgauaggcugcaacggcaggaagaggagcgcaugaacugcucacccaccagucagaucgacaauauaggcgaagaggaaauggaugcgagcacuacacaucacaagagaaaaaccaugaacgacuuugauuaccuaaagcuccuggggaaaggaacguucggcaagguuauccuugugagggagaaggcuuccgguaaauauuacgccaugaagauucugaaaaaggaagucaucauugcaaaagacgagguggcccauacuuugaccgagucucggguacucaagaauacacgccacccuuuucugacuucgcugaaauauucauuccagaccaaggaucgacucuguuuuguuauggaauacgugaacgggggagaguuauucuuucaucugagcagagaaagggucuucagugaggaccggacacguuuuuacggcgcugaaaucguguccgcacuugauuauuugcacucuggcaagauaguguaccgcgaccugaaacuagagaaucucaugcuggacaaggaugggcacauuaaaaucaccgacuucggacuuugcaaggaggguauuacggaugccgcuacuaugaaaacauucuguggcaccccagaauaucuggcccccgaggucuuggaagacaacgauuacgggagagcgguugacugguggggacucggcgugguaauguaugagaugaugugcgguaggcugccuuuuuacaaucaagaucaugaaaaguuauucgagcugauccucauggaggacaucaaguuuccacggacucuuagcuccgaugcaaaaucacuguugagugggcuacugauuaaggacccgaacaaacgacucggaggcggccccgaugacgccaaggaaauaaugcgccacagcuucuuuucuggggugaauuggcaggacgucuaugauaaaaagcuggugccuccauucaagccccagguuacauccgagaccgacacgagauacuuugaugaagaguucaccgcucagacaaucacuauuaccccuccagagaaaugucaacagucagacugcggaaugcuugguaacuggaagaaauga

SEQ ID NO: 52648 - RNA, 879 nt, Artificial Sequence
  derived and/or modified sequence opt3 from AKTIP__Homo_sapiens__NP_071921
augaaccccuucuggagcauguccaccucuucagugagaaagaggagugagggcgaagagaaaacacugacuggggacgucaagacgagcccuccacggaccgccccgaaaaagcagcuccccuccaucccuaaaaaugcacuuccaauuacaaagcccacuucuccugcuccagccgcgcaaucgaccaacggaacacacgcuucauacggucccuuuuaucuggaauacagcuuguuagccgaguucacccugguugugaagcagaaacuaccuggcguauaugugcagccaaguuaccgcuccgcacucaugugguuuggggucauauucauccgacauggacuguaucaggauggcguguuuaaguucacuguuuacauuccggacaauuaucccgauggugacugcccucgucuuguguuugauaucccagucuuccacccccugguggacccuacaucuggggaauuggauguaaaaagagccuuugcuaaguggaggcggaaccauaaucacauuuggcaaguucucauguacgcacgcagaguguucuacaaaaucgacaccgccagcccacugaaccccgaggcugccguccuguaugagaaggauauacagcucuuuaaguccaaagugguggacucagucaagguuuguacggcgagguuauucgaucagccgaaaaucgaagacccuuacgcaauuaguuuuagccccuggaauccaucugugcaugaugaggcccgggaaaagaugcugacucagaaaaagccugaggagcaacacaacaaauccguacacguggcuggacuuucaugggucaagcccggcagcgugcagccauucaguaaggaagagaaaaccguugccacauga

SEQ ID NO: 52649 - RNA, 993 nt, Artificial Sequence
  derived and/or modified sequence opt3 from ALAD__Homo_sapiens__NP_000022
augcagccccaaagcgugcugcacuccggcuacuuccauccucuccuuagagccuggcagaccgcuacaacuacgcugaacgcaucuaauuugaucuauccaauuuuugucaccgacguuccggaugacauacagcccaucacaucauuaccugggguggccagguacggaguaaagcggcuggaggaaaugcuacgcccacucguggaggaaggucugcgaugcguccuuauuuucggcgugcccagucguguuccuaaagaugagagagggagcgcggcugacuccgaagagucuccagccaucgaggcaauucaccuguugaggaagacuuuucccaaccuccugguggccugugaugucugccuguguccuuauaccucgcauggacacugcggccucuuaucagaaaauggugcuuuccgggcagaggaaagccgccagagacuggccgagguggcucuugccuacgcgaaagcagggugucaaguaguugccccaagugacaugauggauggaaggguggaggcuaucaaggaagccuugauggcacauggccugggcaaccgggucuccgugaugucuuauagcgcuaaauuugccuccugcuucuacgggccguuucgcgacgcggccaagucaagucccgcauucggagaucgaagauguuaucagcuaccuccaggugcuaggggccucgcccugcgggcuguggaccgugauguccgcgagggggccgacaugcuuaugguuaagcccggaaugccuuaccuggauauagugagagaaguaaaagacaagcacccagacuugccccucgcaguguaccacgucagcggcgaguuugccaugcuguggcauggugcucaggcgggggcauucgauuuaaaagccgcugugcuggaagccaugacagcauuuaggcgggccggagcugacaucauuaucaccuauuacacuccgcagcuccuucaauggcugaaggaggaguga

SEQ ID NO: 52650 - RNA, 1923 nt, Artificial Sequence
  derived and/or modified sequence opt3 from ALAS1__Homo_sapiens__NP_001291372
auggagagcguggucagaaggugccccuuccugucccggguuccucaggccuuucuccaaaaggcuggcaaaucucuucuguucuacgcacagaacuguccaaagaugauggaagugggggccaaaccggcgccccgcgcuuugucaaccgccgcaguacacuaucagcagaucaaggagacaccuccagccagugaaaaagacaagacugcuaaggcaaaagugcaacagacgcccgauggaagccagcaguccccugacgguacccaauuaccaucuggccauccccugccugccacaucgcaggggacugcuucaaagugcccauuucuagccgcgcagaugaaucagcgaggaagcagugucuucuguaaagcaucccucgagcugcaagaagaugugcaggagaugaacgccguucguaaggagguggcugaaaccucugccggcccgagcgucguguccguaaaaacagacgguggggaucccucaggacuucugaagaauuuucaggacauuaugcaaaagcagagaccugagaggguuagucacuugcuccaggauaaccugccaaaaagcgugucuaccuuccaguacgaccgguuuuucgaaaagaaaauagaugagaagaaaaaugaccauacuuaucgcgucuuuaagacagugaacagaagggcacacaucuuccccauggcugaugacuacuccgauucacugauuaccaaaaagcaagugagcgucuggugcaguaaugacuaucucggcaugucucggcauccucgcguuuguggcgccgugauggacacguuaaagcagcacggggcgggagccgguggcacucgaaacaucuccgggaccagcaaauuucacguagaucuggagagagaacuugcagacuugcauggaaaggaugcugcccugcuauucucgucuugcuuuguggcuaaugacuccacacucuucacucuggccaaaaugaugccaggcugugagauuuacucagauagugguaaccacgcaagcaugauccaggggauaaggaacucccggguccccaaguauaucuuccgucauaaugacgugucucaccuucgcgaacuguugcagagaagcgauccgucaguuccuaaaauuguggccuuugagaccguccacaguauggacggagcugugugcccccucgaggaacugugugauguagcgcaugaguucggcgcaaucacauuuguugacgaagugcacgccgucggcuuauacggggcuaggggagguggcauuggggaucgggacggagugaugccaaagauggacaucauauccggcacccuggguaaggccuucgggugcgucggcggauacauugcaagcacgucuucacucaucgauacugugcgaaguuaugccgcuggcuuuauuuucacaaccagccuuccucccaugcuguuggccggggcacuagaguccguucgcauccugaaaucugcggaaggaagagugcucaggcggcaacaucagcgcaauguaaagcugaugagacagaugcuuauggacgcuggucugccagucgugcacugucccucgcauaucauuccuguuaggguggccgaugcagccaaaaacacugaggucugcgacgaauugaugagccgucacaauauauacgugcaggcuaucaacuauccaacaguaccgcggggcgaggagcuccugcgaauugcccccaccccucaccauacgccacaaaugaugaacuacuuuuuagaaaaucugcuagugaccuggaagcagguugggcucgagcugaaaccccacuccucagcagaaugcaacuucuguagaaggccucuucauuuugaggucaugagugaacgcgagaagucuuauuucagcggauuguccaagcuggugucagcucaggccuga

SEQ ID NO: 52651 - RNA, 1764 nt, Artificial Sequence
  derived and/or modified sequence opt3 from ALAS2__Homo_sapiens__NP_000023
auggugaccgccgcuaugcugcuccagugcugucccguccuugcaagaggcccuacaagccuguuggggaagguugugaaaacucaccaauucuuauuuggaaucgguaggugcccaauucuggccacgcagggcccgaacuguucccagauacaucuaaaggcgaccaaagcugggggagacucucccucaugggccaagggccacugcccuuucaugcucagugagcugcaggaugguaaaagcaagaucguacaaaaggcagccccagaagugcaggaggacgucaaggcuuuuaaaacagaucuucccuccucucuggugucgguuucauugcggaaaccuuucagcgggccacaggaacaggagcaaauuaguggaaaggugacucaucucauccagaauaacaugcccggcaauuacgucuuuuccuaugaccaguucuuucgcgauaaaauuauggaaaagaagcaggaccacaccuaccgaguguucaaaacaguaaaccguugggcagaugccuauccuuuugcucaacauuucucugaggccagcguugcguccaaggacgugucagucugguguaguaaugauuaccugggcaugagcagacacccacaggugcugcaggcaacccaagagacucuccagaggcacggggccggagcugguggcacacggaacaucucugggaccuccaaauuucauguggaauuagagcaggaacuggccgagcuucaccagaaggacucagcauugcuguucagcaguugcuuugucgcuaaugauucuacgcuauucacucucgccaaaauacugccgggaugugagaucuauuccgacgcgggcaaccaugccagcaugauucaagguauccgcaauucgggggcagcuaaguucguuuuuagacacaacgaucccgaccaccuuaaaaagcuguuggaaaagucuaauccuaaaauuccaaagaucguggccuucgagaccguacauuccauggacggagcuauaugcccccucgaagaacugugugaugugucacaccaguacggcgccuuaacauuugucgacgaagugcaugcaguuggccuguaugggaguaggggagccgguauuggcgagcgggaugggaucaugcacaaaauugacaucaucagcggaacucucggcaaggcuuucgguugcgucgggggcuacauugcguccacccgcgaucuuguggacauggugcgaucuuacgcagccggauuuauauucacaaccagccugccuccaaugguauugucaggcgcucuagagaguguuagacugcucaaaggggaagagggacaggcccugaggcgggcacaucagcguaacgugaagcacaugcgccaacuucugauggauagagguuugcccgucaucccguguccuucccacauuauccccauaagggugggcaaugccgcucucaacagcaagcugugcgacuuacugcuaucuaaacaugggauuuauguccaggccaucaauuacccaacggugccucggggagaggagcuccugcgacuugcacccucaccacaccauaguccccagaugauggaagauuuuguugagaaguugcugcucgcguggacugcugugggccugccucuucaggacguaagcgucgccgcaugcaacuucugucgcagaccagugcacuuugagcugauguccgaaugggagaggucuuauuucgguaacauggggccgcaauacguuacaaccuaugccuga

SEQ ID NO: 52652 - RNA, 1830 nt, Artificial Sequence
  derived and/or modified sequence opt3 from ALB__Homo_sapiens__NP_000468
augaagugggugaccuucaucagccugcucuuucuuuucuccucugccuacucaagaggcgucuuuaggcgggacgcucacaaaagugagguugcacaucgcuucaaggaucugggggaagagaacuuuaaagccuugguguuaauugcguucgcucaguaucugcaacagugccccuuugaagaccacguaaagcuagugaaugaggucacagaguucgccaaaacuuguguggcagaugaaagcgccgagaacugcgacaagucccuccauacgcuguuuggagauaaacuuuguaccguugcuacacugcgagaaacuuacggugagauggcagacugcugugccaaacaggaaccugagcguaaugagugcuucuugcagcacaaggaugacaacccaaaucucccgagacuggugaggcccgaagucgaugugauguguaccgcuuuucaugacaacgaggaaacauuccugaaaaaguaucucuacgagauagcccggcgccacccuuauuuuuacgcgccagaauuacuguucuucgcaaaaagauauaaggccgcuuuuaccgagugcugucaagccgcagauaaggcugccugccuuuugcccaaacuggacgagcuaagggaugaaggcaaggcgucuucggccaaacagcggcucaagugugcaucacugcagaaauucggggagcgcgcuuuuaaggccugggcuguagcccgacuuagccagagauucccuaaagcagaauuugccgagguuaguaagcuggugacugacuugacaaagguccacaccgaaugcugccauggagaccuccuggagugugcugaugacagggcggauuuagcaaaauacaucugcgagaaucaagacuccauuucuagcaagcugaaagaauguugcgagaagccacuccuugaaaaaucccacuguaucgccgagguggaaaacgaugagaugcccgcugaccugccuucauuggccgcagauuucguggagaguaaggacgucugcaagaauuacgccgaagcuaaagauguuuuucuaggcauguuccuguaugaguacgcccggcgucauccagacuauagcgugguacuccugcuucgccuggcaaagacguacgaaacuaccuuggagaaauguugcgcggcugccgauccgcacgaguguuaugcaaagguguuugacgaguucaaaccccucgucgaagaaccucagaaccugauuaagcagaauugcgaguuauuugaacagcugggugaguacaaguuccaaaacgcccuacucgugagauauacaaagaagguuccacaggugucuacucccacccuggucgagguguccaggaaucuugggaaaguaggaucaaaguguugcaaacacccugaagcuaagcggaugccaugcgccgaggacuacuugagcguugugcugaaccagcucuguguccugcaugaaaagacacccgugagugaucgagucaccaaaugcuguacggagucucuugugaaucgcagaccgugcuuuuccgcacuggaaguugacgagacuuacgugccuaaggaguucaacgcugaaacauucaccuuucacgccgauaucuguacuuugagcgagaaagaaaggcaaauaaagaaacagacagcgcucguagagcuggucaagcauaaacccaaggccaccaaggaacaguuaaaagcugugauggacgauuucgcagccuuuguugagaagugcuguaaagcugacgauaaggagacgugcuucgccgaagagggcaaaaagcugguggcagcgucgcaggccgcucuaggccucuga

SEQ ID NO: 52653 - RNA, 1713 nt, Artificial Sequence
  derived and/or modified sequence opt3 from ALCAM__Homo_sapiens__NP_001230209
auggaaagcaagggcgccuccucuugcagacuucucuucugucuucugaucucagcuaccguguuuaggcccggguugggaugguacacagucaacagugcauauggugacacuauuauaaucccuugccgguuagauguuccacagaaucugauguucggcaaauggaaguacgaaaaaccggacgggagccccguguuuauugccuuccgcuccucuacgaagaaaucgguacaauaugaugacgugccugaguacaaggaucgacuaaaccucucagaaaauuauacccugagcaucaguaacgcgcguauuuccgacgagaagagauuugucuguaugcuugugacagaagauaauguuuucgaggcuccaacuaucgugaaagucuuuaagcagcccucuaaaccugagauagugagcaaggcccuguucuuggaaaccgagcagcucaaaaagcugggagacugcaucuccgaagauucauacccagacggcaacauuacaugguauaggaaugguaagguacugcacccccucgagggggcaguugugaucauuuuuaaaaaggagauggauccugucacccaguuauacacuaugacaaguacccuggaauacaaaacgacuaaggccgacauccaaaugccauucaccuguagcgugacauauuacggaccgucuggccagaaaacuauacauuccgagcaggcuguguuugauauuuauuaccccaccgaacaggucacaauccaaguucuuccuccaaagaacgcaauuaaagagggcgacaauaucaccuugaagugccuggggaacggaaaucccccuccagaagaguuccuauuuuaucuccccggucagccggagggcauccggucaagcaacacguacacucugacagacgugcgcagaaaugccaccggggauuauaaguguagucuuauugacaaaaagucuaugauagcuuccacugccaucacaguacacuaccuggauuugagccucaacccuucgggagaagugaccaggcagauuggcgacgcgcugcccgucucuugcacgaucuccgcaucacggaaugccaccgugguuuggaugaaagauaacauacgcuuacgaaguagcccauccuucucuagccugcauuaccaggacgcugguaacuaugugugugagacagcccuccaagaagucgaggggcuuaagaaaagagaaucacugacuuugauuguggagggaaagccucagaucaagaugaccaaaaagacagaucccaguggccuauccaaaacuaucauuugccacguagagggcuucccaaagcccgcaauccaguggaccauuacagggagcggaucuguuauaaaucaaaccgaagagucaccuuacaucaacgguagguauuacaguaaaauuaucaucagcccagaagagaaugugacucugacguguacagcugaaaaccagcucgagcggaccgucaauucccugaacgugucugccaaugagaaccgugaaaaggucaaugaccaggcgaagcugauugugggcauaguuguggggcuguugcucgccgcacugguagcuggagucguguauugguuauacaugaaaaagucgaaaacugccagcaagcauguuaacaaagaucugggcaauauggaggaaaacaagaagcuagaggagaauaaccacaaaaccgaggcuuga

SEQ ID NO: 52654 - RNA, 2256 nt, Artificial Sequence
  derived and/or modified sequence opt3 from ALDH16A1__Homo_sapiens__NP_001138868
auggccgcuaccagagcaggccccagggcccgggagaucuucacaagccuggaauacgggccugugccagagucccacgcgugcgcucucgccuggcuugacacucaggaucgcugucugggacauuaugucaacgguaagugguugaaaccggaacaccgaaauucuguucccugccaagacccuauuacgggcgagaacuuagcaucaugucugcaggcccaggcugaagauguggcagccgcuguagaggccgcgcguauggcauuuaagggguggagugcccauccaggaguggucagagcucagcaccuaaccaggcucgccgaggugauacaaaaacaucagcggcugcuuuggacacuggagagcuugguuacuggccgcgcagugagagaggucagggacggugaugugcagcucgcucagcaacugcugcacuaccacgccauccaggcguccacccaggaagaggcccucgcagggugggagcccaugggaguaauuggcuuaauccugccuccaacauucucuuuucuugaaaugauguggcggauuugccccgcuuuggccguuggcuguaccguggucgcucuggugccuccagccucgccggcaccccuacuccuggcccagcuugcuggggagcugggaccuuucccagguaucuugaaugugcucucaggccccgcgagccuggucccuauauuagcaagucaaccagggauccgcaagguugccuuuugcggagcucccgaaggcggucugcgacuccuuauucaggaguccgugugggacgaagccaugagaaggcugcaggagcggauggggcguuugcgcucuggaagaggccuagauggcgcaguagacaugggggccaggggagcugccgcaugugaucuggugcaacgguucguccgagaggcgcagagccagggugcucagguguuucaagccggcgacguuccguccgaacgcccuuucuaucccccaacucucgugucaaaccugccucccgcaaguccaugcgcccaggucgaggugcccuggccuguaguuguggcuagcccauuuagaacagccaaagaagcacuucuggucgcuaaugggaccccgaggggaggcucugccuccguguggucagagcgguugggucaggcgcucgaacugggguacggcuuacaggucggaacgguguggaucaacgcccauggccugcgcgaucccagcguuccuacugggggauguaaggagagugguugcucuuggcacggcgggccagacggacuauaugaguaccucagacccuccggcaccccugcuaggcugagcugucuuucgaagaauuugaacuaugauacauucggucuggcagugccaucuacucuccccgccgggccggaaauuggcccuuccccagcucccccuuacggacuguuuguaggcgggcguuuccaagcccccggagcacggucaagucgaccaaucagagacagcuccgguaaucuucauggcuacgucgcggaagggggagccaaagacauaaggggcgcuguggaagccgcacaccaggcuuuuccugguugggccgggcagucucccggcgcacgcgccgcucuguugugggcgcucgccgcagcucuggagcggagaaagagcaccuuagccucaaggcuggaacgccagggagccgagcuaaaagcugcagaggccgaaguugagcucagugcgcgacggcugcgugcuuggggcgccagagugcaagcacaggggcacacacuucaggucgccggauugaggggcccagugcugcgccuccgggaaccgcuggguguauuagcugugguuugcccugaugaguggccccugcuugcauucgucuccuugcucgccccagcgcuggcuuaugggaacaccguggugaugguccccagcgccgcaugcccucuacuggcccucgagguuugucaggacauggcuacgguguucccagccggacuggcaaaugugguaacuggcgauagagaccaucuuacaaggugcuuggcucugcaccaagauguccaggccaugugguacuuugguucugcgcagggcucacaauucguggaaugggccagugcagggaacuuaaagcccguuugggcuagccgaggauguccucgcgccugggaccaggaggcugaaggcgcagggccggagcucggacugcggguggccagaaccaaagcccuuuggcugccaaugggcgauuga

SEQ ID NO: 52655 - RNA, 2382 nt, Artificial Sequence
  derived and/or modified sequence opt3 from ALDH18A1__Homo_sapiens__NP_001017423
augcugagccagguguacagaugcggcuuccaacccuuuaaccagcaccuccuuccuugggucaaguguaccacaguuuucaggucccauugcauccagccaucugugauucggcacguacgcucauggaguaauauaccguuuaucacugugccccugagccgaacgcaugggaaauccuucgcccaccguucugaguugaagcaugcuaaaagaauugucgugaaguuaggaucggcaguugugaccaggggugacgaauguggccuggcccuagggcggcucgcgucaaucgucgaacaggugagcguacugcaaaaccagggacgcgagaugaugcuuguuacaaguggcgcuguggccuuugguaaacagagacugaggcacgagauuuugcucucccagucuguccggcaagcacugcacagcgggcagaaucagcugaaggaaauggccaucccugugcucgaggcucgcgcaugcgccgcugccggacaguccggcuuaauggcgcuguaugaggcaauguucacucaauacucaauaugugccgcucagauccuugugaccaacuuggauuuucaugacgaacagaagcgaagaaaucugaacggcacacuacacgagcuccugaggaugaauauugucccaaucguuaacaccaaugaugccgugguacccccugcagaaccaaacagugaccuucaaggggugauuagcgucaaagauaaugacucucuggcugcccgguuggcgguggagaugaagacugaucuccugaucguuuuauccgacguggagggacuguucgauucacccccugguagcgacgaugccaaacucauagacaucuuuuauccaggcgaucagcagagugucacauucgggaccaagucucgugugggaaugggcgguauggaagcaaaaguaaaggcugcccuuugggcucugcagggcggaacguccguugugauugccaacggcacucauccgaaggucagcggccacgugauuaccgacaucgucgaggggaaaaaggugggaacauuuuucucggaaguuaaacccgcagguccuacuguggagcaacagggcgaaauggcccgcucugggggaagaauguuggcuacccuagagccagagcagagggcggaaaucauucaccaucuggcagaccuccugacagaucagcgggacgagauacuucuggccaauaagaaagauuuggaagaggcugaaggccgacucgccgcaccccuguuaaagcgccugucccuaucaaccaguaaacucaacagccuggccaucggucuuagacaaauugcugccuccucucaggacagcguagggagggucuugcggcgcacgagaaucgcaaagaaucuggagcucgaacaggugacuguuccuauaggcgugcugcuugucauuuuugagucaaggccagauugccugccccagguggcggcuuuggccaucgcaaguggaaacggccuccuguuaaaagggggaaaggaggccgcucacuccaaccguauccugcaucuacucacacaagaagcccugagcauucacgguguaaaggaggcagugcagcuuguuaauacccgggaagaggucgaggacuugugucgacuggauaaaaugaucgaccucauuauaccgagagggucuucacagcuggugagggauauccagaaggcugccaaagggauuccugugaugggacauagugaaggcaucugccacauguacgucgacagcgaggcguccguugauaaggugacucgcuuagugcgggacucuaagugugaauaucccgccgcuugcaacgcacuggagacacuuuugauccacagagaccuccugaggaccccacuauucgaucaaauuauagacaugcugcgcguagagcaggucaaaauccaugccgguccuaaguucgcuucguaccucacguuuagccccuccgaagugaaaucacugcgaaccgaguauggggaucuugaauuguguauugagguuguggacaauguccaggaugccaucgaccacauucauaaguacggcaguucucacacagaugugaucguuacugaagacgagaacaccgcagaguucuuucugcaacacguggauagcgcgugcguauucuggaaugccuccacacgguuuucagacggauaccguuucggcuuaggggcugaagucggaauaagcacuucuagaauccaugccagggguccagugggccucgaggggcugcuuaccacaaaauggcuguugcgcggaaaggaucacguggucuccgacuuuagugaacauggcagccucaaguaucugcacgagaaccuacccauuccucagcggaauaccaacuga

SEQ ID NO: 52656 - RNA, 1506 nt, Artificial Sequence
  derived and/or modified sequence opt3 from ALDH1A1__Homo_sapiens__NP_000680
augagcuccucuggcacccccgaccugccugugcuccuuacagaucugaagauccaguacacuaaaauuuucauaaacaaugaguggcacgacucagucagugggaagaaauuuccaguuuucaacccggccacggaagaggaauugugccaaguggaggaaggagauaaggaggacguagauaaagcugugaaggcagccagacaggcguuucagaucgguagccccuggaggaccauggacgcuuccgagcggggccgcuuacuguauaagcuagccgaucucauugaacgagaccgucugcuucuggcaacaauggagucuaugaaugggggaaaauuguacucgaacgccuaucucaaugaucuggcuggcuguaucaagacucugagauacugcgcagguugggccgacaaaauucaggggaggaccaucccuauagauggaaacuucuuuacauauacccggcaugaaccaaucggcgucuguggccaaauuauccccuggaauuucccucucgugauguuaauuuggaagaucgggccagcucugucaugcggaaacacuguuguggucaaacccgccgagcagacaccucuuaccgcguugcacguggcaagccugauaaaggaggccgguuuuccaccgggcguaguuaauauugugcccggguacggaccuacggcuggcgccgcaaucaguucccauauggacauugauaaggucgcuuucacugguucuaccgaaguggggaaacuaaucaaggaggccgcgggaaaaagcaaccucaagcgcgugacacuggaacuuggcggcaaauccccauguaucguccuggccgacgcagacuuggauaaugcuguugaguuugcccaccaugggguguucuaucaccagggacagugcuguauugcugccucaagaauauuuguagaagagaguaucuacgacgaguucgugaggcggagcgucgaacgcgcaaagaaauacauucucgguaacccccugacuccuggcgugacccaagggccacagaucgauaaggagcaguaugacaagauauuagaucugauugaaucugguaaaaaggagggcgccaaacucgaaugcggugggggccccuggggaaauaagggcuacuuuguucagccgacaguguucuccaacgucaccgacgagaugcgaaucgcuaaagaggaaaucuucgggccugugcaacagauuaugaaguuuaagucacuugaugacguaaucaaaagagcgaauaacacguucuauggacugagcgcaggaguuuuuacuaaggauauugacaaagccauaacaaucaguucugcuuugcaggccggcaccgugugggucaacuguuacgggguggucuccgcacaaugccccuucggaggcuuuaagaugagcgguaaugggagggagcuaggcgaauauggauuccacgaguacacugaagugaaaacaguuaccgugaagauuucgcagaagaacucuuga

SEQ ID NO: 52657 - RNA, 1494 nt, Artificial Sequence
  derived and/or modified sequence opt3 from ALDH1A2__Homo_sapiens__NP_001193826
augaagaaucagugcgagaccguguggcugaaaagccccaucaagcucaaacuuauuuucauaaauaacgaauggcaaaauuccgagucuggcagagucuuuccuguuuacaacccagccacaggggaacaggugugugagguacaggaagcugacaaggcagauaucgacaaagccgugcaggcggcuaggcuggccuucucauugggaagugucuggcggcgcauggaugcaagcgagcgaggucguuuacuggacaagcuagccgaucucguggagagagacagggcuguucuggcaacuauggaaucccuuaauggcgggaagccguuucugcaagccuucuauguggauuugcagggagucauuaaaacguuucgguacuaugcuggcugggccgacaagauccacgguaugaccauucccguggauggggacuacuucacauuuacucgccaugagccuaucggaguaugcggccagauaaucccauggaacuucccccuccugauguuugcguggaaaauugccccugcacuguguugcggcaauaccguugugaucaagccagcugaacagacaccccucucugccuuauauaugggggcacugauuaaagaggcuggauucccuccaggugucaucaacauacuuccgggcuacgggcccaccgccggagcggccauugcaucgcacaucggcauugauaagaucgcuuuuacugguucaacagagguggggaaguugauccaagaagccgcuggaagaagcaaucugaaaagggugacccuagagcucggcggcaagaguccuaacauuauauucgccgacgcagaucuggacuaugccgucgaacaggcucaucaggggguguuuuucaaucagggacaauguugcacggcggguucccggaucuucguugaggaaucuauuuacgaggaguuuguacgccgaagcguggaaagagcaaaaaggcgggucgugggcuccccauucgaccccacuaccgagcaggggccucagaucgauaagaaacaauacaacaagauacuugaacugauucagucaggaguugccgagggcgcuaaauuggaauguggugggaagggccucggacguaagggcuuuuucaucgagccaacaguguuuaguaaugucacugacgauaugcgcaucgccaaagaggaaauuuucgggcccgugcaggagauccugagauuuaagaccauggacgaaguaauugagagggcaaacaauagcgauuucggauuaguugccgcuguguuuacaaacgacauaaacaaagcccugaccgucucuuccgcaaugcaggcggguacgguguggaucaauugcuauaacgcucucaaugcccaaucaccguucggcggguuuaagaugagcggaaacggccgggaaaugggugaguucgggcuucgagaguacagugaagucaaaacugugacaguuaagauuccucagaagaacucuuga

SEQ ID NO: 52658 - RNA, 1539 nt, Artificial Sequence
  derived and/or modified sequence opt3 from ALDH1A3__Homo_sapiens__NP_000684
auggccaccgcuaacggcgcaguggagaaugggcagcccgacagaaagccuccagcccugccgaggcccauccggaaccucgaagucaaauucacaaagauuuuuauaaauaacgaguggcacgaaagcaaauccggaaagaaauucgcgacuugcaauccuucuacgcgcgagcaaaucugugaaguugaggagggugauaagccagacguggauaaggcuguagaagccgcacagguggccuuucagcgaggcucacccuggcguagacuugacgcucugaguagggggcgguuguuacaucagcuggcagaucuagucgagcgcgacagagccacccucgcugcccuggaaacaauggauacuggaaaaccuuuccuucacgcguuuuucauugaccuggagggcugcaucaggaccuugcgguacuuugcagguugggccgauaagauucaagggaaaacaaucccaaccgacgauaacgugguuuguuucacucgccaugagcccauaggagugugcggcgcuaucacaccuuggaauuuuccacuccugaugcuggucuggaagcucgccccggcauuauguugcggcaacaccauggugcugaaacccgcugaacagacgccucuuacugccuuguaucuggggagccuaauuaaggaggcgggauucccacccgguguaguuaauaucgugccuggcuuugggccaaccgucggagccgcaauuuccucucacccccagaucaacaagauagcuuucacaggcucgacugaaguggguaaacucgugaaggaggccgcuucacgaagcaaucugaaaagagucacccuugaacugggagggaagaacccguguauuguuugcgccgacgcagauuuggaccucgccguggagugugcucaucagggcguauuuuucaaucaaggccagugcuguacagcggcaaguaggguguucgucgaggaacagguguacuccgaguuuguucggcguucuguggaauaugccaaaaagcgcccugucggggaccccuucgaugugaaaaccgagcagggaccacaaaucgaccagaagcaguuugauaagauucuggaauuaaucgagagcgguaaaaaggagggcgcuaaacuggaaugcgggggauccgccauggaggacaagggccucuucaucaaaccuacgguauuuucagaaguuacugauaacaugagaauugcaaaggaggaaauauucggucccgugcaaccaauccuuaaguuuaaaaguauugaggaggucaucaagagggccaauagcacagacuacgggcugaccgcugccguguucacuaaaaacuuggauaaggcacuaaaacuggcgucugcucucgaauccggcacagucuggauaaacugcuauaaugcccuguacgcacaggcccccuuuggaggcuucaagaugucagggaacggacgggagcuuggugaauaugcucuggccgaguacaccgaggugaagacgguuaccauuaaauugggcgacaagaauccuuga

SEQ ID NO: 52659 - RNA, 1554 nt, Artificial Sequence
  derived and/or modified sequence opt3 from ALDH1B1__Homo_sapiens__NP_000683
augcugagauuccucgcccccaggcuucugagcuugcagggccggaccgcucgcuacuccucugcagccgcguuaccuucaccaauccugaacccggacauucccuauaaucaacuauuuauaaacaaugaguggcaggaugcugugaguaagaaaacauucccuacugucaacccaacgaccggggaaguuaucggacacguggccgagggugaccgagcagauguagaccgugccgugaaggcugcaagagaagccuuuaggcucggcagccccuggcggcgcauggaugcuuccgagagagggaggcugcuuaaucggcuggccgacuuggucgaacgcgaucgaguguaccucgcgucucuggagacacuggacaacggaaaaccuuuccaggagucguaugcacucgauuuagacgaaguuauuaagguguacagauauuuugccggcugggcugauaaauggcaugguaagacuaucccaauggacgggcagcacuucugcuuuaccaggcaugagcccgucggaguguguggccaaauuaucccuuggaauuucccacugguaaugcagggcuggaaacuugccccggcauuggcuacagggaacaccguugugaugaaggucgccgaacagacuccccugucagcgcuauaccucgccagccugauaaaggaggcaggauuuccuccagguguggugaauaucauuacaggcuaugggcccaccgcuggagccgcuaucgcccagcacgucgauguugacaaaguggcauucacgggcaguacugagguaggucaucuuauucaaaaggccgcuggggacuccaaccugaaacgggugaccuuggaacucggaggcaagucuccuagcaucguccuggcggaugcagacauggagcacgccguggaacagugccacgaggcuuuauuuuucaauaugggccaguguugcugugccgggucccguacauuuguugaagagucaauauacaacgaguuccuggaacgcacuguggagaaggcaaaacagagaaaggucggaaauccauucgaacucgauacccaacaggguccccagguggacaaagagcaauuugaaaggguacuuggcuacauucagcuggggcagaaggagggagccaaauugcuaugcggcggugagcgguucggggaacgaggcuuuuucaucaagccgacaguuuuuggaggcgugcaggaugacaugcgcauugcuaaagaggaaaucuucgggccuguccaaccccuguuuaaguucaagaaaaucgaggaaguggucgagagagccaacaauaccagguauggacucgcagcggcuguguuuacgcgggaucuggacaaggccauguacuucacucaggcacuucaggccgguacaguuugggugaacaccuauaacauuguaacuugucauacaccauuuggcggguucaaagagaguggaaauggccgcgaacugggugaggauggguugaaggcuuacaccgaagucaaaacggugaccauaaagguuccucagaagaacagcuga

SEQ ID NO: 52660 - RNA, 2739 nt, Artificial Sequence
  derived and/or modified sequence opt3 from ALDH1L1__Homo_sapiens__NP_001257293
auggccggccccagcaacccuccagcuaccaugaagaucgcagugauugggcagucccuguucggacaagaggucuacugccaccucagaaaagaaggucaugagguugugggcguauuuacagugccggacaaggaugggaaagccgacccccuuggacuggaagcggagaaggauggcgucccuguguucaaauauucuagguggcgggcuaagggucaggccuugccagacguuguggcaaaguaccaggccuuaggggcugaacugaauguccuacccuuuuguucacaguucauaccuauggagaucauuagugcaccacgccacggaagcaucauuuaucaucccucccuccugccucgacaccguggcgccucugcuaucaacuggacucuuauacauggcgauaaaaagggaggguuuucgaucuucugggccgacgauggucuggacacgggcgauuugcuccugcaaaaagagugcgaagugcugccagacgauaccguaucaacacucuacaauagauuuuuauucccggaggggauuaagggaaugguucaggcggugaggcugaucgcagaaggcaaagcuccccggcuuccucagccagaggagggugccacuuaugaagggauucagaagaaggagaccgccaaaaucaacugggaccaacccgcagaagcuauacacaauuggauucgcggaaacgauaaggucccuggcgccuggacagaggcgugugaacagaaauugaccuuuuucaauagcacucugaacacaaguggccuagugccagagggggacgcccuccccaucccgggagcacacagaccugguguggucaccaaggcuggccugauucuuuuugggaaugacgauaaaaugcuguugguuaagaacauccagcucgaggacggaaaaaugauccuggccuccaauuucuuuaagggcgcugccucuagcguguuagaacugacggaggcagaacucguaacugccgaggcugugagguccgucuggcagcggauucuucccaaggugcuggaaguugaggauucaaccgacuucuucaaaaguggugcggcaagcguggaugucgugcgcuugguagaggaaguuaaggagcuaugcgacgggcuggaacucgagaacgaagauguguacauggccucuacauuuggcgacuucauacaacugcuuguccgaaaacugagaggagaugacgaggagggcgaauguuccaucgauuauguggagauggcugucaauaagaggacugugcggaugccacaucaguuguuuauugggggagaauuuguugacgccgagggugcaaaaaccucagagacaaucaacccuaccgacggcagcgugauaugccagguaagucucgcccaagucacggauguggacaaggcuguugccgcagcgaaggaugcuuuugaaaaugggcguuggggaaaaauuucugcccgcgacagaggcaggcugauguaccgguuagcagaucugauggagcagcaccaggaagaacuagccacuaucgaagcucucgacgccggugcaguguacacacuggcucuuaagacccaugucgggauguccauccagacuuuccgauauuuugccggcuggugugauaaaauucaaggaagcacaauccccauuaaccaggcgcgcccaaacagaaauuugacccugacgaggaaggagcccgugggcguaugcgggauaaucauuccuuggaacuacccacucaugaugcugucguggaaaaccgccgcuugucuugcagccggaaauacagugguuaucaagccggcucaggucacuccccugaccgccuugaaguucgcagagcucacacugaaagcggguaucccuaagggcguggugaacgucuuaccagggucuggaucccugguuggccagcggcuaucagaccaccccgaugugcgcaaaauugguuuuacugggaguaccgaagugggcaagcacauaaugaaaagcugcgccaucuccaauguaaagaaggucucucucgagcugggaggcaaaagcccucuuauuaucuucgcugacugugauuugaacaaggccgugcaaauggggaugucaaguguuuucuucaauaaaggagaaaacugcauugcagcuggcagacuguuuguggaggacuccauccaugaugaguucgucaggcgugugguugaggaggugcggaagaugaaaguagguaauccacucgaccgagacacagaucacgggccccagaaccaucacgcccaucuggucaaguuaauggaauauugccagcacggagugaaagagggcgcaacccuggugugugguggcaaucaggucccgagaccuggguucuuuuucgaaccaacuguuuuuacggacguggaggaucacauguucauagccaaggaagagagcuuuggacccguaaugaucauuucuagguucgcugacggcgaucuugacgcgguguugucacgcgccaacgcaacagaguuugggcucgcuaguggagucuucacccgggauaucaauaaggcccuguacgugagcgacaaacuacaagccggcacuguuuuugugaacaccuauaauaagacagaugucgcugcaccuuucgguggguuuaaacaguccggauucggcaaggaccugggugaagccgcgcucaacgaguaccugagagugaaaaccguuacuuuugaauauuga

SEQ ID NO: 52661 - RNA, 1554 nt, Artificial Sequence
  derived and/or modified sequence opt3 from ALDH2__Homo_sapiens__NP_000681
augcugagagcugcugcaagguucggcccccggcucgggcgccgacuucugagcgccgcggcuacccaggccgugccugcaccaaaccaacagccggaggucuuuugcaaucagaucuucauuaacaaugaauggcacgacgccguuucccguaagacauuucccacugugaacccuucuacgggagagguaauaugucagguggcugaaggugauaaagaggacgucgauaaggcagugaaagccgcuagagccgcguuccaauugggcucaccauggaggcggauggacgcaagucaucgcgggagauuacugaauaggcuagccgaucucaucgaacgggaccgcaccuaccuggcugcccuugagacacuggauaacggaaagcccuauguuauuagcuacuugguggaccucgauaugguccugaaaugccugcgauauuacgcaggcugggcugacaaguaucacgguaagacuaucccuauugauggggacuuuuucuccuacaccagacaugagccagugggaguauguggccagaucauacccuggaauuuuccucucuuaaugcaggccuggaaacugggcccagcgcuugccacagggaacguuguggucaugaagguggcagaacagaccccguugacugcucuguauguggccaaucuaaucaaagaggcuggauuucccccuggugucguuaacauugugccaggcuucgggcccacagccggagcagccaucgcuucucacgaagauguagacaagguggcguucaccggcucgacggagauugguagggucauccaaguggcagccgggucaagcaaucucaaacggguuacucuggagcuuggaggcaagaguccuaacauaauuauguccgacgcugauauggacugggccguggaacaggcacauuuugcccuguucuuuaaucagggccagugcuguugcgcugggucucguaccuucguccaagaggauaucuacgacgaguucguggaacgcagcguagccagagcaaaguccaggguugugggaaacccauuugauucaaaaacagaacaggguccccaggucgacgagacucaauucaagaaaauuuugggcuacaucaauaccgggaagcaggagggagcgaaacuccuguguggcggugggaucgcugccgaucggggcuauuuuauucagccgacaguguucggagacguccaggauggcaugaccauagcaaaggaagagaucuuugggccugugaugcaaauuuuaaaauucaagacgaucgaagagguugugggacgagccaacaacaguacuuacggucuggcugccgcaguauuuacaaaggaccucgauaaagcuaauuaucuuagccaggcccugcaggcgggcaccgucugggugaacugcuacgacguuuucggggcccagucucccuuuggaggcuauaagauguccgguucagggcgcgaauugggcgaguacggacuacaagccuauacugaggugaaaacagucaccgugaagguaccacagaaaaauagcuga

SEQ ID NO: 52662 - RNA, 1362 nt, Artificial Sequence
  derived and/or modified sequence opt3 from ALDH3A1__Homo_sapiens__NP_000682
augagcaagaucuccgaggccgugaaaagagcuagggcagccuucucuucaggccggacccgcccccugcaguuucguauucaacagcucgaagcgcuucagcgacugauacaggagcaagaacaggaguuggucggggcuuuagccgcagaccugcacaagaacgaauggaaugccuacuacgaggagguuguguacguacuagaagagaucgaauauaugauucagaaacucccugagugggcugcagaugagccaguggaaaagacaccgcagacucaacaggacgagcuguacauccauagugaaccccuuggagucgugcugguuauugguacguggaacuauccuuucaauuugaccauccagccaauggugggcgccauagcugccgggaacagcgucgugcucaaacccuccgagcugucugaaaauauggcgucgcugcucgcaacaaucauuccucaguacuuagauaaggaccuguauccaguaaucaacggaggcguucccgagacuaccgagcuuuugaaggaaagauuugaucacauucuguacacagguucaaccggggugggaaaaaucauaaugacugccgcugccaagcaucuaacaccugucacccucgagcugggcggcaaaagcccaugcuacguggacaagaauugugaucuugacguggcaugcaggcggauugcuugggggaaauucaugaacaguggacaaacgugugucgccccggauuauauccugugcgaccccuccauucagaaucagaucguugaaaaguugaagaaaucucucaaggaguuuuacggugaagaugcgaaaaagagccgcgacuauggcagaaucauuuccgccaggcacuuccaacgggugauggggcugauagagggacagaaaguagcauacggcgguacuggggaugcugccacccgcuauaucgcuccuacaauuuuaacugacguggacccacagucacccgucaugcaggaggaaaucuuuggaccugugcugccaauaguuugugugcgaagucucgaggaagccauucaauucaucaaccagagagagaagccccuugcacuguacauguuuagcucuaaugauaaagucaucaagaagaugauugccgaaaccuccucaggcggcguggcugcgaacgacguaaucguucauauuacauugcacagccuaccguucgggggaguggguaauaguggcauggggucuuaucacggcaaaaaguccuuugagaccuucagccauaggcggucgugccugguccguccucucaugaacgaugagggacugaaagugcgcuaucccccaucuccugcaaagaugacgcagcacuga

SEQ ID NO: 52663 - RNA, 1458 nt, Artificial Sequence
  derived and/or modified sequence opt3 from ALDH3A2__Homo_sapiens__NP_000373
auggagcuggaagugagaaggguccggcaggccuuccucagcggccgcucccgaccccuucguuuuagacugcaacaguuggaggcuuuaaggcggaugguucaggaacgcgagaaggacauccugaccgcaauugccgcggaucuaugcaaaucugaguucaacguguacucacaggaaguaauaacagugcucggggagaucgacuuuaugcuggaaaaucuuccugagugggucacugcuaagccagugaaaaagaacguucugacgauguuggaugaagccuauauucaaccgcagccccucggagugguccugaucauuggugcauggaauuacccuuucgugcugaccauccagccacucauaggcgccaucgcugcagggaacgccguaauuaucaaacccagugaguuaagcgagaauacagcuaagauucuggccaaguuguugccucaguaucuggaccaagaucuauacaucguuauaaacggaggcguggaagagacuaccgaacuccugaaacagagauuugaccacauuuucuauacagguaauaccgcggucgggaagaucgugauggaggcagccgcuaaacaucuuacuccagugacacuggaauugggaggcaagucccccuguuacauugauaaagacugcgaucucgacaucgucuguaggcggaucaccuggggcaaguauaugaacugcgggcagacguguauugccccugauuacauacugugcgaggcaucuuuacagaaucaaaucguuuggaagauuaaagagacugugaaggaauuuuacggagagaacaucaaagaaucgccagacuaugagcgcauaauuaaucugcgacacuucaagagaauccucucacuucuggaaggucagaaaaucgcuuuuggcggggagaccgaugaggccacaagguacauugcgccgacuguauugaccgacguggaccccaagacaaaagucaugcaggaagagaucuucggaccuauucuaccaauagugcccguuaagaacguggaugaagccaucaauuuuauuaacgagcgggaaaagccucuggcacucuaugucuucagccauaaucacaaacugaucaagcguaugaucgacgagaccaguuccggcggugugacggggaacgauguaauuaugcauuuuacucuuaacucuuucccauucggaggcguuggcagcuccgggaugggagcuuaccacgguaaacacucauuugacacauucagucaucaacgccccugucugcuuaagagccucaaaagagagggcgccaauaagcugagguauccgccuaacucucaguccaagguggauugggggaaauuuuucuuacugaagcgguuuaauaaagaaaagcuaggacuccugcuuuugaccuuccugggcauagucgcugccgugcucgucaaagcagaguacuauuga

SEQ ID NO: 52664 - RNA, 1407 nt, Artificial Sequence
  derived and/or modified sequence opt3 from ALDH3B1__Homo_sapiens__NP_000685
auggacccccugggcgauacccucagaaggcuucgggaggccuuccacgcugggcgcacacgaccugcagaauuucgugccgcgcagcugcaaggauuggguagauucuuacaggagaacaagcagcugcuacaugacgcucucgcccaggaucugcacaaaagcgcauuugaauccgaggugucugaagucgccaucucacaaggcgagguuacucuugcucugaggaauuugcgggcauggaugaaggacgagcgcgugccgaaaaaccucgccacgcagcuggauagugcuuucauuagaaaggaaccauuugggcugguacucauaaucgcccccuggaauuacccuuuaaaccugacccuugugccauuggucggagcgcuggcagccggcaauugcgugguucuaaaacccagcgagauuuccaagaacguggaaaagauccucgcugagguccugccucaguauguggaccagucuuguuucgccguaguucuuggugggccacaagagacaggacagcuguuggaacauagguuugauuacauuuucuuuacuggcucgccccgggugggcaaaaucgucaugaccgcagcugccaagcaccucacaccugugacccuggaguuaggggguaaaaauccaugcuauguggacgauaacugugacccgcagacugucgcgaaucgcguugccugguuccgauacuuuaacgcaggacagacaugcguggcucccgauuauguacuguguucaccugaaaugcaagagagacuccuuccagcccugcagagcaccauaacgagguucuacggcgacgauccccagaguuccccuaauuuggggcggaucauuaaccaaaagcaguuucagcgucuacgcgcucugcucggaugcggcagaguggccaucggugggcagucugacgaaagcgacagguauauugcaccaacuguccugguggauguucaagagauggagcccgugaugcaggaagagaucuucggaccgauacuuccuauugucaaugugcagucccuggacgaagccaucgaguucauuaaccggcgagaaaaacccuuggcucucuacgcguuuucaaauaguagccagguaguuaagcgcgugcugacccaaacaucuuccggcggcuucugugggaacgauggauuuaugcauaugacuuuagcaucacugccauucgguggcgucggggccagcggaaugggcagauaccacgguaaguuuaguuucgacaccuuuucucaccauagggcuugccuacuccgguccccugggauggagaaacugaacgcccuucgcuaucccccacagagccccagaagguugcguaugcugcucguggcaauggaggcccagggcuguucgugcacacugcuuuga

SEQ ID NO: 52665 - RNA, 1539 nt, Artificial Sequence
  derived and/or modified sequence opt3 from ALDH4A1__Homo_sapiens__NP_001306147
augcugcuccccgccccugcucuuagaagggcacuguugagccggccauggaccggcgccggguuacgcuggaagcacacauccucucugaaaguggcgaacgagccgguccuagcuuucacucagggaucacccgaacgagacgcccuccaaaaggcacugaaagaucuuaagggucguauggaggccaucccuugcguugugggcgacgaagagguauggacgagugaugugcaguaccaggucagcccauuuaaucaugggcacaaaguggcuaaguucuguuaugcagacaagucccuguugaacaaagccauugaagcugcccucgcggcaagaaaggagugggaucugaaacccauagccgacagggcucagaucuuucugaaggccgcagauaugcucucuggaccucggcgcgcugagauuuuagccaaaaccaugguuggccaagguaagacagugauccaggcggaaauugacgccgcagcugagcugaucgauuucuuuagauucaaugccaaguacgcugucgaacuugaggggcagcagccaauaucggugcccccuucaacuaacagcaccguauauaggggauuggagggcuuuguugccgcaaucaguccauucaauuuuacagccauuggcgggaaccuggcuggagcgccggcacuaauggguaaugugguccucuggaaacccuccgacaccgccaugcuggcuucuuacgccguguaucggauccuucgcgaagcaggccugccuccaaacauuauccaauucgugcccgccgaugggccuuuguuuggagacacugucacaagcuccgagcaucucugcggcauaaauuucaccgguucaguuccaacguuuaagcaccuguggaaacagguggcucagaacuuagaucgauuccauacuuuccccagacuggccggggaauguggaggcaagaauuuucacuucguacacaggagugcagacguggagagcgucgugucuggcacccuccgguccgcguuugaauacgggggacagaaaugcucagcuuguagccgucuuuauguuccgcauagucuguggccucaaauuaagggucgcuugcuagaggagcacucuagaaucaaagugggcgaccccgccgaagauuucgggacauuuuucuccgcagucauugacgccaaggagaucuuuggaccagugcugagcguauacguuuacccugaugacaaguauaaagaaacucuccagcugguggauucgaccacaucuuacggccuuaccggugcugucuucucccaggacaaggaugugguccaagaggccacgaaagugcugaggaacgcagcugggaauuuuuauaucaacgacaagucaacuggcaguauuguuggacagcagcccuucggcggggcccgggcgagcggaacaaaugauaaaccagguggcccccauuacauauugcgauggaccuccccucaggugaucaaggaaacucacaagccacucggggacuggucuuaugccuacaugcaauga

SEQ ID NO: 52666 - RNA, 1647 nt, Artificial Sequence
  derived and/or modified sequence opt3 from ALDH5A1__Homo_sapiens__NP_733936
auggcaaccugcaucuggcugagaagcuguggcgcuaggcggcucggguccacauuccccggaugccgccuucgaccucgugccgguggccuggugccagccucugggccggcgcccggaccugcucaguugagauguuacgccggcagguuagcaggucugucagccgcucuacuccggacugacaguuuugucgggggacgcuggcugccagcagccgcuacguuccccguucaagauccugccagcggcgcggcacuuggcaugguggccgacugcgggguaagagaggcuagggccgcagugcgggcugccuaugaagcguuuugucgcuggcgagaggucuccgccaaggaaagaucuucgcuguugaggaaaugguacaaccucaugauucagaauaaggaugaccuggcacggauaaucaccgcugagucaggaaaaccacugaaggaagcccacggugagauucucuauagcgcuuucuuuuuagagugguucagugaagaggcccgucgcguguacggcgauaucauucauacacccgcaaaagacagaagggcccugguucuuaagcagccuaucgggguggcugcggucauaacuccauggaacuuuccguccgcaaugaucacccggaaggugggagccgcuuuggccgcaggcugcacaguaguugugaaacccgccgaagauaccccuuucucugcucuggcccuagcagaggucaaucaggguuuucuccuggaccuugauccacuguugcucgcgagccaagcugggauucccuccggaguguauaacgugaucccuuguucacgaaagaaugccaaagaggucggcgaagcaauuugcacugacccacugguuaguaagaucagcuucacaggcucuaccacgacugggaaaauauuacugcaccaugccgcuaacuccgugaagcgcguaucaauggagcucggaggucuugcccccuuuauuguguucgauagcgcaaaugucgaccaggcuguggccggcgcgauggccaguaaguuuagaaacaccgggcagacauguguuugcucuaaucaguuccuggugcaaaggggaauccacgaugcuuucgucaaagcauuugccgaagcuaugaagaaaaacuugcgggugggcaaugguuucgaggaagggacuacccagggcccgcuaauuaacgagaaggccguagagaaaguugaaaaacaggugaaugacgcagucuccaagggagcgacaguggucaccggcgggaagcgccaucagcugggaaagaacuuuuucgagccuacgcuccuguguaaugugacucaagacaugcuuugcacacacgaagagaccuuugguccccuggccccaguuaucaaauucgauacugaagaggaggcuaucgccauugcaaacgcugccgacgugggcuuggcaggguacuuuuauagccaggauccugcccagauauggagaguagcugaacaacucgaggucggaauggugggcguuaacgaaggucugaucucgucuguggagugccccuucgggggcgucaagcaguccggauuaggcagggaagggucaaaauacggaauugacgaguaccuggagcuaaaguauguguguuacgguggccucuga

SEQ ID NO: 52667 - RNA, 1608 nt, Artificial Sequence
  derived and/or modified sequence opt3 from ALDH6A1__Homo_sapiens__NP_005580
auggccgcucugcucgcagccgcggcugugagagccaggauccuucaggucagcuccaagguuaaaucuucacccaccugguacagugcaagcuccuucucuucgucagugccuacaguaaagcuguuuauuggcgggaaauucguggagagcaagagugacaaauggauagauauccacaacccagccacuaaugaagucauuggacgggugccgcaagcuacgaaggcagagauggacgccgcuaucgccuccugcaagcgcgcguuucccgcaugggccgauaccucuguuuugagccgacaacagguguuacugcguuaucagcagcuaauuaaagaaaaccucaaggagaucgcuaaacugauaacacuugaacaggguaagacucuggccgacgcagagggcgaugucuucagagggcuccaggugguagagcaugcuuguuccguuaccucauugaugaugggagaaacaaugccuaguaucaccaaagacauggaucuguacagcuauaggcugccacucggcgugugcgccgguauugcgcccuuuaauuucccugccaugaucccauuauggauguuucccauggcaauggucugugggaacacuuuccugaugaagccuucugagcgggugccaggagcuacaaugcuuuuggccaagcugcuacaggacuccggcgcuccggauggcacccucaauauuauccacgggcaacaugaagccgugaacuuuauaugcgaccaccccgauauuaaagcaaucucauucgucggaagcaauaaggccggugaguacauuuuugagcgcggcaguagacaugggaaaaggguucaggcuaacaugggagcgaagaaucacggcgugguaaugccugacgcaaacaaagaaaauacgcugaaccagcuugugggugccgcuuucggggccgcaggacagcgguguauggcccugucuacugcugucuuggugggcgaggccaagaaauggcucccagaacugguugagcacgcaaagaauuuacgcgugaacgcgggcgaucaacccggggcugaccugggaccucucaucaccccacaggccaaggaacgagucugcaaucuuaucgacuccgguacaaaagagggcgcaagcauucuguuggaugggagaaagauaaaagugaagggauaugagaacggcaacuuuguaggucccacuaucauuucgaauguuaaaccgaacaugaccuguuacaaggaagagaucuucgggccugugcuagucgugcuggaaacagagacccucgacgaagccauacagauugucaauaacaaucccuauggcaacggaacggcuaucuucacuacaaauggcgccaccgcaaggaaguacgcucaucugguggauguugggcaagugggaguaaacgucccaaucccugugccccuuccaauguuuucuuucacugguucccggucaaguuuucguggcgacacaaauuucuacgggaaacagggcauucaguuuuauacccagcugaagacgaucaccagccaauggaaagaggaggaugccacauuguccucucccgcgguugugaugccuacuaugggacgcuga

SEQ ID NO: 52668 - RNA, 1620 nt, Artificial Sequence
  derived and/or modified sequence opt3 from ALDH7A1__Homo_sapiens__NP_001173
auguggagacugcccagggcccucugcgugcacgcugcaaagaccagcaaacuuuccggcccuuggucucggccagccgcguucaugucaacacuguugaucaaccagccgcaauacgcuugguuaaaggagcuggggcuacgcgaagagaaugaaggagucuauaacgguaguuggggcgggcgaggagagguuauuacuacguacugucccgccaauaacgaaccuauagcacgugugagacaggccagcguagcugacuaugaggagaccgugaaaaaggcaagggaagccuggaaaaucugggcugauauuccagcccccaagcggggcgagaucguccgccagauuggugacgcgcucagagaaaagauccaggugcuggggucccuuguuucucuggagaugggaaaaauauugguggagggcgucggcgaagugcaagaguacguagauaucugcgacuaugcaguugggcucucgaggaugauuggagguccuauccugccaucagaacggagcggccaugcccugauugagcaguggaaucccguggggcucgucggaaucauaacagcuuuuaacuucccuguggccguguacggcuggaauaacgcaauugcuaugaucugugguaaugucugcuuauggaagggggccccaacuaccagucugauuuccguugcggugacaaaaaucaucgccaagguacuugaagauaacaaauugccgggagcaauuuguucucugaccugcggcggcgcugacauagggacugccauggcuaaggaugagcgcgugaaucuacucagcuuuacaggauccacccaggucgguaaacaggugggccugaugguucaagagcgauucgggagaucacuucuggaauugggaggcaacaaugccaucauugcauuugaggacgccgaucucagucuggugguccccagcgcuuuauucgcggcaguggguacggccgggcagagguguacuaccgcucggcgucuguuuauccacgaaucuauacaugacgagguaguuaaccgccucaagaaggccuaugcacagauuagagugggcaauccuugggauccaaacguccuuuacggaccccugcacacaaaacaggccguguccauguucuugggcgcugucgaagaggccaagaaagaagggggaacugugguuuacgguggcaaggugauggacaggccugggaacuauguagagccaaccaucgucacaggacuaggccaugaugcaucaaucgcgcacaccgagacguuugcucccauucuguacguguucaaauuuaagaaugaagaggaaguuuucgccuggaacaaugaggugaagcaaggucucagcaguucuaucuuuacuaaagaccuggggcggauuuuccgauggcuuggcccgaagggauccgacugcggcauagucaacgugaauaucccuacaagcggggcagagauuggaggugccuucggcggggaaaaacacaccggaggcggucgcgagucggggucugaugcuuggaagcaguauaugagaagguccacuuguacaaucaacuacucaaaagaccugcccuuggcccagggcaucaaguuucaauga

SEQ ID NO: 52669 - RNA, 1557 nt, Artificial Sequence
  derived and/or modified sequence opt3 from ALDH9A1__Homo_sapiens__NP_000687
auguuccugagagccggccucgcugcacuuagcccccuguugagguccuuacggccuucuccaguggccgcgaugucaaccgggacauuugucguuagucagccgcugaacuaccgcggaggugcucgaguggagcccgccgacgcaagcggcacugaaaaggccuucgagccugcuacggggcguguaaucgcaaccuuuacaugcuccggagaaaaagaggugaaucuagccguccaaaacgcuaaggccgcguucaaaauuuggucucagaagucgggcauggaaagauguaggauacuccuggaggcagcccggaucauucgcgagagagaagaugagaucgcuacuauggaaugcauuaauaacgguaaaucaaucuuugaggccaggcuugacauagauaucagcuggcagugucuggaguauuacgcaggguuggcugccaguauggcgggagaacacauucagcucccaggcggcuccuucggguauacccggcgcgagccccugggagugugcguugguaucggcgccuggaauuacccuuuucaaauugcaucuuggaaaagcgcuccagcccuggcuugugggaacgccaugguguucaagcccuccccuuuuacaccagucucagcacucuuacuggccgaaaucuauagugaggcuggagugccgcccggccuuuucaauguaguucaggguggggcggcaaccggacaguuuuugugccagcauccugacguggccaaggucagcuucacuggcucugugccaacaggcaugaagauaauggaaauguccgcuaaagggauuaagcccgugacccuggagcuaggagguaaaucaccucucaucauuuuuagcgauugugacaugaacaaugccgucaagggcgcacugauggccaacuuccuuacgcaagggcagguuugcuguaauggaacucgaguguucguacagaaggagauccuggauaaauuuaccgaagagguggucaagcagacacaaagaaucaaaauuggcgacccauugcucgaagauacuaggauggguccccugauaaaccggccgcacuuagagcgugugcugggguucguuaagguggcuaaagaacagggcgccaagguccucugcggaggcgacaucuacgugccugaggaucccaaacuuaaggacggguauuacaugcgcccauguguacugaccaauugcagagaugacaugacaugcguuaaggaggaaauuuuuggaccugugaugaguaucuugucuuucgacaccgaggcagaaguccuagagagggcgaacgauacgacuuuuggucuggcugccggcguguucacacgggacauacagcgagcacaucgcgucguggccgaacuccaagcugggaccuguuuuauuaauaacuacaacguuucccccguggagcugccauucggaggcuauaaaaagagcgguuuugggagagagaauggcaggguaacuaucgaauacuauucgcagcuuaaaacagucugcguggagaugggagauguugaaucugccuucuga

SEQ ID NO: 52670 - RNA, 1257 nt, Artificial Sequence
  derived and/or modified sequence opt3 from ALDOA__Homo_sapiens__NP_001230106
auggccagaaggaagcccgagggcagcuccuucaacaugacccaccugucuauggcuauggcauuuucauucccuccaguggccagugggcagcuccauccgcaacuuggaaauacacagcaccagacugaacuggguaaagaguuggcgacgaccagcacaaugcccuaccaguauccugcuuuaacuccagaacaaaagaaagagcuguccgacaucgcccaucggauugucgcacccggcaaggggauacuagccgcugaugaaucuaccggaucgaucgcaaaacgccuccagucaauuggcacagagaacaccgaggaaaaucgacguuuuuacagacagcugcuucugacugccgacgauaggguuaacccuugcaucgguggggugauuuuguuccacgagacacucuaucagaaggcugacgauggacggccauuuccccaaguaaucaagagcaaaggcggcguggucgggauaaagguggacaaaggaguugugccucuggccgguaccaauggcgaaacgacuacccaggggcuggauggacucagugagcgcugugcgcaguacaagaaagacggcgcagauuucgccaaguggagaugcgucuuaaagaucggugagcauacaccauccgcucuggccauuauggaaaacgcaaaugugcuugcuagguaugccucuaucugucagcaaaacgggauuguaccgaucguugagcccgaaauauugccugacggagaucacgaccugaaacggugccaguacgugacugagaagguccuagcggccguguauaaagcacucagcgaucaccauauuuaccuggaaggcacccuucugaagccaaauauggugacacccggccacgcuuguacccagaaauuuucccaugaggagaucgccauggcuacggucacugccuugcgccgaacaguuccuccagcagugaccgggauuacuuuccucucaggaggucaaagugaagaggaagccagcaucaaccugaaugcuaucaacaagugccccuuacugaaaccgugggcgcucacauuuucuuacggcagagcacuucaggccuccgcucugaaggccuggggagggaagaaagagaauuugaaggcagcccaggaagaguauguaaaaagggcucuagccaacucacuggcaugucagggcaaguacaccccuagcggucaagcgggggcugccgcaagugagucucucuucguguccaaucacgccuauuga

SEQ ID NO: 52671 - RNA, 1095 nt, Artificial Sequence
  derived and/or modified sequence opt3 from ALDOB__Homo_sapiens__NP_000026
auggcccacagauuccccgcucugacccaggagcaaaagaaagaacucagcgagaucgcacaguccauuguggccaacggcaaggggauacuugcggcugacgaaucugucggaacaauggguaauaggcugcagcggaucaaaguugagaacacugaagagaaucgccgacaguuucgugagauuuuguucucaguggauaguagcaucaaccaauccauuggcgggguaaucuuauuucaugaaacgcuguaccagaaggacucucagggaaaacuauucagaaauauacucaaggagaagggcaucguggucgguauuaaacuggaucaagggggagccccucuugcaggcaccaacaaggaaacaacuauccagggccuggacggguugucggagaggugcgcccaguauaaaaaggauggaguggacuuugguaaauggcgggcuguucuccgcauugcagaucaguguccaucaagccuggccauccaggagaaugcuaacgcccuggcgagauacgcaaguauaugccaacagaauggccucgugccgauugucgaacccgaggugaucccugacggggaucacgacuuagaacauugucaguauguaaccgagaagguucuggccgcuguguacaaggcccuuaacgaucaccaugucuauuuggaaggaacacugcuaaaaccaaauauggugaccgcaggccacgcuugcacuaagaaauacacacccgagcaaguggccauggcgaccgucacggcccuccacaggacuguuccugcagcugugccagguauuuguuuccuguccgggggaaugucugaggaagacgccacccuuaaccugaaugcuaucaacuugugcccccucccuaagccauggaaacugagcuuuuccuauggccgggccuuacaggcaucagcccuggcugcguggggcgggaaggcagccaauaaagaggcuacacaggaagccuucaugaagcgcgcaauggccaacugucaggcugccaagggacaauacguacauacugguaguagcggcgcagcgucuacccagucccucuuuacagcuugcuacaccuauuga

SEQ ID NO: 52672 - RNA, 1095 nt, Artificial Sequence
  derived and/or modified sequence opt3 from ALDOC__Homo_sapiens__NP_005156
augccccacagcuacccugcccuguccgcugagcagaagaaagaacucucugacaucgcacuuagaauuguggccccaggcaaggggauacuggcggcugaugagucagucggaaguauggccaaaagguugagccaaaucgguguugaaaacaccgaggaaaaucggcgcuuauaucgacaggugcuguucuccgcagacgaucguguaaagaaaugcauuggcggggugaucuuuuuccaugagacacuauaccagaaggacgauaacggagucccguuugugagaacuauucaggacaagggcaucguuguggguauaaaagucgauaagggggugguaccccucgccggaacggacggcgagaccacaacucaaggccuggaugggcuuucugaaaggugugcucaguauaaaaaggacggagcagauuucgccaaauggcggugcguucugaagaucucggagcgcaccccuucagcuuuggccauucucgaaaaugcgaacgugcuggcaagauacgccagcaucugucagcagaaugguauugucccaaucguggagcccgagauacugccugacggcgaucacgaccucaagaggugccaauaugugacagaaaaagucuuagcugccguuuacaaggcacugagugaccaucacguguaucuugaggggaccuugcugaaaccaaacaugguaacucccggacaugcuuguccuauuaaguacacaccagaagagaucgccauggcgaccgugacggcccuacggcgcacugucccgcccgcagugccuggcguuaccuuucucuccggugggcagucugaagaggaggcuagcuucaaucugaacgccauuaaucgaugcccacuucccagaccuugggcucugacauuuuccuacggaagggccuugcaggcaucagcccucaacgcuuggcggggccagcgugauaaugcgggcgcagccacugaagaguucaucaaacgcgcugaagugaacgggcuggccgcacaaggaaaguaugaggguaguggcgaagacgggggagccgcugcccagagcuuauacaucgcaaaucacgcguauuga

SEQ ID NO: 52673 - RNA, 1422 nt, Artificial Sequence
  derived and/or modified sequence opt3 from ALG10B__Homo_sapiens__NP_001013642
auggcccagcuggagggcuacugcuucagcgcugcacucuccuguaccuuucuugugucuugccuguuguucucagccuuuaguagagcguuaagggaacccuauauggacgagaucuuccaccucccucaagcucagcgguacugugaagggcauuuuagccuaucccagugggauccaaugauuacaacucucccgggacuguaucuugucucuguuggugugguaaagcccgccauauggaucuucggcuggucggagcacguggucugcucaauugggaugcugcgcuuugugaacuugcuguucagcguuggaaauuuuuaccugcuguaucucuuauuccauaaagugcagccucgaaacaaggcagccaguuccauccaacguguccugucuacgcuuaccuuggcuguguuuccaacacuguacuucuuuaauuuccuauauuacacugaagcaggcagcauguucuuuacccucuucgccuaccugaugugucuuuaugguaaccacaaaacauccgcuuuucugggguucugcggauuuauguucagacagaccaauauuaucugggccguauuuugugcgggcaacguuauagcacagaaguugacugaggccuggaaaacagagcuccagaagaaggaagacaggcugcccccuaucaaaggcccauucgcugaguuucggaagauuuuacaauuccugcucgccuacucaaugaguuuuaaaaaucuuagcaugcuguucugcuugaccuggcccuauauccuacugggguuucucuucugugcauucguggucgugaacggagguauugugaucggcgauagaucuucccaugaggcuugccugcacuuuccucagcuuuucuacuuuuucucauuuacgcuguucuuuagcuucccacacuugcucaguccgucuaagauaaaaacuuuucuguccuuagucuggaagcaugggauucuguuccuaguugugacccucguaagcguguuucuggucuggaaguucacauaugcccacaaauaccuuuuggcggacaaucgccauuauacuuuuuacguguggaagaggguuuuccagcgguacgccauccugaaauaucuccuggugcccgcauacauuuucgcuggauggucgaucgccgauucucuuaaguccaaaccuaucuuuuggaaccugauguucuuuauuuguuuguucauagucaucgugccacagaagcuccuggaauuucgcuauuucauuuuacccuacguaaucuaucgacugaauauaacccuaccuccaacaucaagacucguuugcgagcugaguugcuacgcuauugugaacuuuaucaccuucuauaucuuucuuaauaaaacguuccaauggcccaacagccaggacauucagagguuuaugugguga

SEQ ID NO: 52674 - RNA, 1422 nt, Artificial Sequence
  derived and/or modified sequence opt3 from ALG10__Homo_sapiens__NP_116223
auggcccagcuggagggcuacuauuucagcgcugcacucuccugcaccuuucuugugucuugucuguuguucucagccuuuaguagagcguuaagggaacccuacauggacgagaucuuccaccuuccucaagcucagcgguauugcgaagggcauuuuagccuaucccagugggauccaaugauuacaacucucccgggacuguaccuugucucuauagguguuaucaagcccgccauuuggaucuucggcuggucggagcacgugguauguucaauugggaugcugcgcuuugugaacuugcucuuuagcgucggaaauuuuuaucugcuguaccucuuauucugcaaagugcagccucgaaacaaggcagccaguuccauccaacguguucugucuacgcuuaccuuggcuguguuuccaacacuguauuucuuuaauuuccuauacuacacugaagcaggcagcauguucuuuacccucuucgccuaucugaugugucuuuacgguaaccauaaaacauccgcuuuucugggguucugcggauuuauguucagacagaccaauauaaucugggccgucuuuugugcgggcaacgugauugcacagaaguugacugaggccuggaaaacagagcuccagaagaaggaagacaggcugcccccuaucaaaggcccauucgcugaguuucggaagauuuuacaauuccugcucgccuauucaaugaguuuuaaaaaucuuagcaugcuguugcuacugaccuggcccuacauccuccugggguuccuguuuugcgcauucguaguugugaacggagguauagucauuggcgauagaucuucccacgaggcuugucugcauuucccucaguuguuuuauuucuuuucauucacgcucuuuuucagcuuuccacaccuguuaaguccgucuaagaucaaaacuuuccugucccuaguguggaagcgcaggauucucuuuuucguggucacccugguuagcguguuucuuguauggaaguucacauacgcccacaaauauuugcuggcggacaaucggcauuacacuuuuuacguguggaagcgcgucuuccagcgauaugaaaccgugaaauaccuccugguucccgccuauaucuucgcaggguggucgaucgcugauucucuuaaguccaaaucaauuuucuggaaccugauguucuuuauaugcuuguucacagugaucgucccucagaagcuccuggaguuuagauacuucauuuuaccauaugugaucuacaggcugaauauaccccuaccuccaaccagucggcucauuugugaacugagcugcuaugccguaguuaacuuuaucacguucuuuaucuuccuuaauaaaacuuuucaauggcccaacucccaggacauucagcguuucaugugguga

SEQ ID NO: 52675 - RNA, 1479 nt, Artificial Sequence
  derived and/or modified sequence opt3 from ALG11__Homo_sapiens__NP_001004127
auggccgcuggcgagagaagcuggugccuguguaagcuccuuagguucuuuuacucccuguucuuucccggguugaucgugugcggaaccuuaugugucugccugguuauugugcuaugggguauacggcuccugcuucagcgcaaaaagaaacugguaucuacaucaaagaacggcaaaaaucaaauggugaucgcauucuuucacccuuauuguaacgccgggggaggcggugaacgagucuuguggugcgcgcuccgugcucugcagaagaaguacccagaggccguguauguuguguacacuggggacgucaaugugaacggacagcagauucuggaaggcgcauucagaagguuuaauauccggcucauucauccgguacaauucguuuuucuccgcaaaagauaucugguggaggauagucuuuacccccacuucacguugcugggccagagccuaggguccaucuuucucggaugggaagcccugaugcagugugucccugacguguauauagauucuauggguuacgcuuucacccuuccacuguuuaaguacaucggcgggugccaggugggaucguauguccauuaccccacaauuucaacugacauguugagcguugugaaaaaccaaaauaucggcuucaacaaugcagccuucauuaccaggaacccuuuucucaguaagguaaaacugaucuauuacuauuuauucgcuuuuauauacggucuggugggguccuguucugaugucgugaugguuaauagcuccuggacacucaaccacauucuuucacuguggaaggugggaaauugcaccaacaucgucuauccacccugugacgugcagacuuucuuggauauuccucuacaugagaagaaaaugacaccaggccacuugcucguaaguguuggccaguuucggccggagaagaaucacccccugcagauccgcgccuucgcgaaacuucugaacaagaaaaugguggaaagcccuccaucuuugaagcucguccugaucgggggaugccgaaacaaagacgaugaguuaagagugaaucaacugaggcggcuauccgaagaccucgguguccaggaguacguggaguuuaagauuaacauacccuucgaugaacugaagaauuaccuuucagaggcaaccaucggcuugcauacgauguggaacgaacacuuugggauuggaguuguggagugcauggccgcuggcacuaucauacuggcccauaauagcggugggccuaaacucgacauuguagucccacacgaaggcgauaucaccggauuccuggcagagagugaggaagacuaugcugagacaaucgcccacauucuuucuauguccgcggaaaagcgucugcagauccgcaaaagcgccagagcaucggugucuagguuuuccgaccaagaguucgaaguuacuuuucugucaaguguggagaaguuauucaaauga

SEQ ID NO: 52676 - RNA, 1467 nt, Artificial Sequence
  derived and/or modified sequence opt3 from ALG12__Homo_sapiens__NP_077010
auggccggcaaggggagcuccggaagaaggccccugcuccuuggucuguugguggcugucgcaaccguucacuuagugaucugcccuuacacaaaaguagaggaaucuuucaaccugcaggccacucaugaccuacucuaucacuggcaagaucuggagcaguacgaccaucuugaauuuccaggcguggucccgcggacguuccuggggcccgugguuauugcgguguuuucaaguccugcugucuauguguugagccuccuggagauguccaaguucuacucucagcugauaguacgcggaguucucggcuuaggugugaucuuugggcuguggacccuucagaaagaaguccgacgucacuucggagccaugguggcaacaauguuuuguugggugacugccaugcaauuccauuugauguuuuauugcaccagaacacugccaaauguccuagcucuccccguugugcugcuugcacuggccgcuugguugaggcacgagugggcccgguucauuuggcucucggcguuugcaaucauuguauuccgcguggagcuguguuuauuucugggccuccuucuguugcuagcccugggcaacagaaaggucucagugguuagggcucuccggcacgccgugccugcagggauccugugccuuggacugaccgucgcuguggauagcuacuucuggcgccaguugacuuggccagaagguaaaguacucugguauaauacaguucugaacaagaguuccaauuggggcaccucucccuuacugugguacuucuacagcgcccuaccucgagggcucggauguucccugcuuuuuauaccauugggccugguggacagaaggacgcaugcgccgacuguccucgcccuggguuucauggcacuuuauucacuguugccccacaaggagcuccgguuuaucauuuacgcuuucccuaugcugaacaucaccgccgcucgugggugcaguuauuuacugaauaacuacaaaaagagcuggcuauauaaagccggaucucuccuggugauuggccaucuugucgugaaugcagccuacuccgcuacagcguuguauguuucacacuuuaacuacccaggcgggguggcaaugcagcgccugcaccagcucguacccccucaaacugauguccuguuacauaucgacguggccgcugcccagaccggaguuagcagauuccuucaggugaauagugcauggagguacgauaagcgggaagacguccagccagguacaggcaugcuggccuauacccacauauugauggaggcugcccccgggcuccuggcacuauaccgagauacgcaucgcgugcuggcgucuguagugggaacuacaggcguuucccucaaccugacccaacuuccgccuuuuaauguccacuugcagacuaaacugguguuacucgagagacugcccaggccaagcuga

SEQ ID NO: 52677 - RNA, 3414 nt, Artificial Sequence
  derived and/or modified sequence opt3 from ALG13__Homo_sapiens__NP_001093392
augaagugcguguucgucaccguuggcacaacuagcuuugacgaucugaucgccuguguguccgcucccgacucucuccagaaaauugagucacuuggguacaacagacugauauugcaaaucggaagggguacgguagugccugaaccauucaguaccgagagcuuuacauuagaugucuaucgguacaaggacucccugaaagaagauauucagaaggcagaccuagugaucucucacgccggcgcggggucgugccucgagacucuggaaaaaggaaagccgcuuguuguggucauuaaugagaagcugaugaacaaucaucaguuggagcucgcuaaacagcugcacaaggaaggccaucuguucuauuguaccugccgcgugcucacaugucccggucaagccaaaucaaucgcaagcgccccugggaagugccaggauagugcugcauuaaccuccacugccuuuucuggacuggacuucggccuuuugagcggcuaccugcacaaacaggcucuaguaacagccacccauccaacguguacucuccuguuucccuccugccacgcguucuuuccucuuccacugacccccacauuguauaagaugcacaagggguggaaaaacuacuguucacagaagagucucaaugaggcaagcauggaugaauaucugggaucuuuaggucuguuccgaaaacucacugccaaggacgcuuccugccuuuuucgugccauaucagagcaacuguucuguagccagguucaucacuuggagaucagaaaagcaugcgugaguuacaugagggaaaaccagcagaccuuugagucuuacgucgaaggcuccuucgagaaguaucuagaacggcugggggauccuaaagagagcgcuggacaacucgagauucgcgcccugucgcuuaucuacaauagagacuucauucuguauagguuuccaggcaagccgcccacauacgugaccgauaacgguuaugaagacaagaucuugcucugcuacucuuccucagggcauuaugacaguguguacagcaaacaguuccaguccucugcggccgucugucaagcaguucuguacgagauauuauauaaggauguguuuguaguggacgaagaggaacugaaaacggcuauuaagcuauuccggagcggaucaaagaagaaucgcaacaaugccgucacuggcagugaggaugcucacacagacuacaaguccagcaaccagaaucgaauggaggaauggggcgccugcuauaacgcagagaauaucccugaaggguacaacaaaggaaccgaggaaacuaagucuccagagaaccccucaaaaaugccuuuuccauauaaggugcucaaagcccuggaucccgagauuuacagaaauguugaguucgacguguggcuugauaguaggaaggaguugcagaaaagcgacuauauggaauacgcuggucggcaguacuaucugggcgauaaaugucaagucugccucgaguccgaggggcguuacuauaacgcgcacauccaggaagugggaaaugagaacaauucuguaacaguuuuuaucgaagaacuggcagaaaagcauguggucccgcuugccaaccugaaaccugugacccaggucaugucggugcccgcuuggaaugccaugccaagccgcaagggcagagguuaccagaaaaugccugggggcuauguucccgagauugugauauccgagauggacaucaagcaacagaagaaaauguucaagaaaauuaggggaaaggaaguauacaugacgauggcauauggcaaaggggauccauugcugcccccucggcuccagcacucaaugcauuacggacacgacccaccgaugcauuacagucagaccgccgguaacgucaugucuaaugagcacuuucacccccaacauccuagcccacgacagggccgcggguauggaaugcccagaaacuccucaagguucaucaaucggcacaacaugccuggcccaaagguggacuuuuaccccgguccggggaaacgcuguugccagagcuaugauaauuucucuuacagauccaggaguuuucgucggagccaucgacagaugucuuguguuaacaaggaaucccaauauggcuucacaccuggaaauggccagaugccaagaggguuagaggaaacuauaaccuucuacgagguggaggaaggagacgagacagcuuaucccacucugccuaaccacgguggccccucaaccauggucccagccacaaguggguacugcgugggaaggcgcggccacagcucggguaagcagacccuaaaccucgaagaggggaauggccaauccgaaaacggacgguaccaugaggaguaucuguacagagcagaaccugauuaugagacuucuggcguauacagcacgacagcgucaaccgcuaaucuuaguuugcaggacaggaaauccuguucuaugagcccccaggauacugugaccuccuauaacuacccacagaagaugauggggaauauugccgcaguugccgcuucaugcgccaacaaugucccggcaccugugcugagcaacggagcugccgcgaaucaagccaucaguacaaccucuguguccagccagaacgcuauccagccccucuuugucucgccacccacucacggccgcccuguuauugcaucaccaucuuaucccugucauagugccaucccucacgcuggugccucccugccgccacccccuccacccccuccgcccccaccucccccaccucccccaccgccucccccacccccuccacccccuccgccagcauuagacgugggggaaacaagcaaucugcagcccccucccccacuuccucccccaccuuacucuugcgauccgagcggauccgacuugccccaagauacgaaagugcuccaguacuauuucaaccugggccuacagugcuacuaucauucauacuggcacaguaugguauaugucccacagaugcaacagcagcugcacguggagaauuacccuguuuauaccgagcccccacucguggaccaaacugucccucaguguuacagcgaagugcgacgggaggaugguauucaggcggaagccucugcuaacgacacauuucccaaugccgauuccucaaguguuccgcauggcgcaguguacuauccaguaaugagcgacccuuacgggcagcccccacugcccggauucgacuccugccuuccugucgugccggauuauucuugugugcccccauggcacccugucggcaccgcuuacgggggaucgagccaaauacauggcgccaucaaccccgguccuauugggugcaucgcaccaucacccccugccucccacuauguuccacagggaauguga

SEQ ID NO: 52678 - RNA, 1395 nt, Artificial Sequence
  derived and/or modified sequence opt3 from ALG1__Homo_sapiens__NP_061982
auggccgcuagcugccuggugcuccuugcacuguguuuguuacugccccuacuccugcuuggcggguggaagagauggaggcggggacgcgccgcgcgacacgucguugcugugguacugggugacgugggccguuccccuagaaugcaguaccaugccuugucucucgcaaugcacggguucucagucacccugcugggauuuugcaacaguaaaccacaugaugagcucuuacaaaauaacaggauccagauugugggccugacagaacuucagagcuuggccguugguccgcggguguuccaguauggggucaaggugguacugcaagcuauguaccuacucuggaaacugauguggcgcgagcccggagcauauauauuucuucagaauccuccaggccugcccuccaucgccguuuguugguucgugggcugcuugugugggucuaagcucgucauugacuggcacaacuacggauauucgaucaugggucuggugcauggcccuaaucacccauuagugcugcucgcuaaaugguacgaaaaguuuuucgggagacuuucacaccugaacuugugcgucacuaaugccaugagggaggaucuagcggacaacuggcauauucgggcaguuacgguguaugauaagcccgccagcuuuuucaaagaaaccccucuggaccuccagcaccgccuguuuaugaaacuuggaaguaugcauuccccauuccgagcuagaucugagccggaggaucccguaacagaaaggagcgccuuuacugagcgggacgcaggcuccggucuggugacccguuugcgcgaaagaccugcucuccuggucucaaguacaagcuggaccgaggaugaggacuucucuaucuuacuggccgcgcuagaaaaauuugagcagcucacucuggaugggcacaaucuuccauccuugguguguguuauaacaggaaagggcccccugagggaauacuacucacggcucauccaccaaaaacauuuccagcacauucaggugugcaccccuuggcuggaggccgaagacuauccacuucuguugggcagcgcagaucucggggucugucugcauacgaguucuuccggauuagaccugcccaugaaggugguagacauguucgguugcugucuaccgguuugcgcugugaacuuuaagugccuccacgagcuggucaaacaugaggaaaauggccuuguguucgaggauagcgaagaguuggccgcucagcugcaaaugcucuuuucgaacuucccugaccccgccgggaagcugaaucaguuucgaaagaacuuacgcgaaucucagcaacugagaugggaugaguccuggguccagacugugcuuccauugguuauggacaccuga

SEQ ID NO: 52679 - RNA, 564 nt, Artificial Sequence
  derived and/or modified sequence opt3 from ALG1L__Homo_sapiens__NP_001015050
auggagagaagcgccuucauggaacuggacgcuggcuccaggcucgugaugcaccuucgggaguggcccgcacuguuggucucuucaaccggguggacagaauuugagcaguuaacucuggauggacauaaccuaccuagucucguuugcgugaucacggguagcguagaccugggcgugugucuucacauguccucuucggggcuggauuugccaaugaaggucguggacauguucggaugcugucucccgguuugcgccgugaauuuuaaaugucugcaugaacuggucaagcacgaggagaacggccucguguucgaagauucagaggaauuagcggcucugcaaaugcuuuuuagcaauuuccccgacccugccgguaaauugaaccaguuuuggaagaaucugcgcgagagucagcagcuacgaugggaugaguccuggguacaaaccguucucccacuggugauggacauucagcuucuggggcagcguuugaaacccagagauccuugcuguccaucuaggagcuucuuuuccgaaucacagggaaagcccuucuga

SEQ ID NO: 52680 - RNA, 1251 nt, Artificial Sequence
  derived and/or modified sequence opt3 from ALG2__Homo_sapiens__NP_149078
auggccgaggaacagggcagagagagggacagcgugcccaagccuuccguccuguuccuccacccagaucuugggguuggaggugcugaacggcugguguuggacgcagccuuagcgcugcaagcucgcggcugcucuguaaagaucuggaccgcccauuacgauccggggcacuguuuugcagagucacgagaacuacccgugcguugcgccggagacuggcucccuagaggccuggguuggggagggaggggcgcugcagucugugccuaugugcggaugguuuuccuugcucuguacguguuguuucucgccgaugaggaguucgacgucgugguaugcgaucagguuagugcguguauuccaguguuucgccuggcaagaaggcggaagaaaauacuguucuauugccauuuucccgaccucuuacugacaaagcgcgauagcuuccuuaaacgauuguacagagccccuaucgacuggauugaagaguauacuacgggcauggcugauuguauccuggucaacucccaguuuaccgccgcaguguucaaggaaacauuuaagucucuaucgcacauugacccagaugugcucuaccccucacugaaugucacuagcuucgacaguguugugccugagaaacuugacgaucugguaccaaaggggaaaaaguuuuugcuccuguccaucaacagguaugagcggaaaaagaauuuaacccuggcucucgaagcccuugugcagcugcguggacgcuugacaucucaagacugggagagaguccaucuaauaguggcggguggcuacgaugaaaggguucuggagaacguggaacacuaccaggagcucaagaaaaugguccagcagagcgaccuggggcaauaugugaccuuccuucgguccuucucagauaagcagaaaaucagucuguugcacagcugcacuuguguacucuacacaccgucuaaugagcauuuuggaauuguuccccuggaagccauguauaugcagugcccugugaucgcagucaacuccggcgguccauuagagucaauugaccacagcgugaccggguuccugugugaacccgauccuguccauuuuagugaggcuaucgaaaaguucauacgagagccaucucuaaaagccacgaugggacucgcuggccgcgccagagugaaggagaaauuuucccccgaagcauucacugagcagcuguacagguauguuaccaaacuuuugguguga

SEQ ID NO: 52681 - RNA, 1173 nt, Artificial Sequence
  derived and/or modified sequence opt3 from ALG3__Homo_sapiens__NP_001006942
auguucccggcccaggcuaaggagaacgcaggcuuuagcgggugcggaggugacaccgaaaucgauuggaaagccuacauggcggagguggaaggcgucauuaaugggacauaugacuacacucaacugcagggagauacgggcccucucguuuauccagcugguuucguguacauauuuauggggcuuuauuacgccaccuccagaggaacagacaucaggauggcacagaacauuuucgccguacuguauuuggcuacuuuacugcuaguguuucucaucuaccaccagaccuguaaggucccgcccuucguguuuuucuuuaugugcugugcaucuuaccggguucauucaauuuucgugcugcgccuuuuuaaugauccugucgccauggugcuguuguuccucaguaucaaccugcugcucgcucaacgauggggcuggggcugcugcuuuuucagcuuagccguauccguuaaaaugaaugugcugcuuuucgcgccaggguugcuguuucuacuccugacacaguucggauuucguggugcacuucccaagcugggcauaugugccggguugcaggucgugcucggacugccuuucuuacuggagaacccaucuggcuaucucucgagaucauuugaccuugguaggcaguuccuguuucacuggaccgugaauuggcgguucuugcccgaagcucuauuucugcaucgcgccuuccaccucgcacugcuuacugcucaucugacauugcuccuguuauuugcccuguguagauggcacaggaccggggagagcauccuaagucuccugcgggauccuuccaaacgcaaggucccaccgcaaccccuuacgccuaaccagauuguuucuacuuuguucaccagcaauuuuaucggaauuugcuucucccgaucacugcacuaccaguucuaugugugguacuuucauacacucccauaucugcuuugggcgaugcccgccagauggcugacucacuugcucaggcuguuaguacugggccuaaucgagcucaguuggaacaccuacccuagcacaucuuguuccucagcagcucugcauauaugccacgccgugauucuuuugcagcuguggcucggcccacaacccuuccccaagagcacccagcacaguaaaaaggcucauuga

SEQ ID NO: 52682 - RNA, 1404 nt, Artificial Sequence
  derived and/or modified sequence opt3 from ALG8__Homo_sapiens__NP_001007028
auggccgcucugaccaucgcaacaggcacugggaacugguucagcgcccucgcgcuuggagugacgcuguugaagugcuuacugauucccaccuaccacuccacagacuuugagguccauagaaauuggcuagcuauaacucacucucucccuaucucacagugguauuacgaagccaccagugaguggacacuggauuauccaccguucuuugcaugguucgaauacauucuuagccauguugccaaauauuuugaccaagagaugcugaacgugcacaauuugaacuacuccucuucgaggacccuccuguuccagcgguuuucaguaaucuucauggaugugcuguuugucuaugcugugcgcgaauguugcaaguguauugacgguaaaaagguuggcaaagagcucacugagaagcccaaguucaucuuaagcgugcugcuuuuguggaauuuugggcugcuaauagucgaucauauccacuuccaguacaacggauuucucuucggccugaugcuucugaguauugcacgauuguuccagaaacgucacauggaaggugccuuucucuucgcugugcuguuacauuuuaagcacaucuaccuguauguagccccugcguacgggguuuaucuccuuagauccuacugcuucacagcaaauaaaccagacggaucuauuagguggaagucuuuuuccuucgugcgggucaucucacugggcuuggugguguuucuagucagugcccugagccucggccccuuccuggcucuuaaccaacugccucagguuuuuagccgcuuguucccauuuaaaagagggcucugucaugccuauugggcacccaauuucugggcucuguacaacgccuuagauaaggugcuguccguaauaggacuaaagcucaaauuucuggacccuaauaacauuccaaaggcgucaaugaccagcggucuugugcagcaguuccaacacacggucuugccgagugugacuccccuggccacccucaucugcacacugauugcaauccuuccuucuaucuucugucugugguuuaaaccacagggccccaggggguucuugcggugccucacucugugugcuuuauccagcuuuauguucggauggcacguucaugagaaggccauucugcuagcuauacucccuaugucgcugcuuucugugggcaaagccggugaugcauccaucuuuuugauucugaccacaaccgggcacuauucacucuucccacuguuauuuacggcccccgaacugccgaucaagauacuuuugaugcuccuguucacuauuuacaguaucagcucccuaaaaacacuguuucgccgaucuuucacccucgucgcucaggcgggagugcaguggcaugaccugagcuga

SEQ ID NO: 52683 - RNA, 1836 nt, Artificial Sequence
  derived and/or modified sequence opt3 from ALG9__Homo_sapiens__NP_001071158
auggccagcagaggcgcuaggcagcggcugaagggguccggagcaucuucaggugacaccgcccccgcggcugauaaacuccgcgagcuucugggcagucgagaagccgggggagcagagcaccguacagaauugagcggcaacaaggccggucaagugugggcuccugagggguccacugcauucaaaugcuuacugucugccagacuaugugcugcccuccugucgaauaucucagacugcgaugaaacguuuaacuacugggagccaacccauuaucuuauuuacggagagggcuuccagacaugggaauauagcccggcguacgcaauaaggaguuaugccuaccuguugcuccacgcuuggcccgccgcauuucaugcucggauccugcagacuaauaagauucuggucuucuauuuucuccgcuguuuacuggccuucguuuccugcaucugugagcuuuacuuuuacaaagcggugugcaagaaguucggcuugcacguaucuagaaugaugcuggccuuucuagugcucagcaccgggauguucuguuccucaagugcauuucugccuagcucuuucugcauguauacaacccuuauugcuaugacuggaugguacauggacaaaacauccaucgccguccuggguguggcugccggcgcaauauugggguggccauuuucagccgcucucggacugcccaucgcguucgauuuacugguuaugaagcauagguggaaaaguuucuuucacuggagccucauggcacuuauucuguucuuggugccugucgugguaaucgacucuuauuacuauggcaagcuaguuauugccccacugaacaucgugcucuacaaugucuuuacgccccacgguccugaucuguaugggaccgaaccaugguacuucuaccuuauaaacggauuucugaauuucaacguggcuuuugccuuggcacuccugguguuaccgcugacuucccuaauggaguaucuccugcagcgguuccauguccaaaaucuuggccaccccuacugguugacccuggccccuauguauauuugguuuaucauuuucuuuauccagccacauaaagaggaacgcuuccucuuucccguuuacccucugaucugucuuugcggcgcuguggcccugagcgcauugcagaaguguuaucacuucguauuccagcgauacagacucgagcacuauacagugacuucgaacuggcuggcguuagggaccgucuuucuguucggacuacucucuuuuuccaggucaguggcucuguuccgggguuaccauggcccacuugacuuguaccccgaauuuuaucguauugccacagauccgaccauacacacgguuccugaggggcgccccgugaaugucugcgugggaaaggaaugguacagauucccaaguagcuuucugcucccugacaacuggcaacugcaguucauccccuccgaguuuaggggccaguuaccaaaacccuucgcagaggguccucuggccacucggauuguaccaacagauaugaaugaccagaaccuugaggaaccgucucgauauaucgauauaagcaagugccauuacuugguugaccucgacaccaugcgcgaaacucccagagagccuaaauauucaaguaauaaggaagaguggauuucccuggcuuacaggccauuucuagaugccagccggucuucaaaacugcuccgcgcauucuaugugcccuuucugagugaccaauacacagucuacgugaacuauaccauccuuaagccuagaaaagcuaagcagaucaggaagaaaagcgggggcuga

SEQ ID NO: 52684 - RNA, 1170 nt, Artificial Sequence
  derived and/or modified sequence opt3 from ALKBH1__Homo_sapiens__NP_006011
augggcaagauggccgcugcaguggggagcgucgccacccuggcgacagagcccggagaagacgcuuucagaaaacucuuuagguucuaccggcagucccgcccugguacugccgaucuugagggcguuaucgacuuuucugcagcccacgcugcacgagggaagggaccaggcgcccagaaagugauuaagucacagcugaacguaaguagcguguccgaacagaaugcuuaucgugccgguuugcagccggucucuaaauggcaagcguacggguuaaagggauaucccggcuucauauuuaucccuaacccauuccugcccggcuaccaguggcauugggugaagcagugccuaaaacucuauucgcagaagccuaauguuuguaaccuggauaaacacaugucaaaggaggaaacgcaagaccuuugggagcagagcaaagaguuucugagauacaaggaagcaaccaagaggcggccacgcaguuugcucgagaaacugagaugggugacagucggguaucauuacaauugggauuccaagaaauacucugccgaccacuauacucccuucccuagcgaucugggauuucucuccgaacagguggcugccgcaugcgguuucgaggacuuuagggcugaggccggcauuuuaaacuacuaucggcuggauucaacccuugggauccauguagaccgcagugaauuggaucacagcaagccacugcuaucuuucuccuuuggacagucagcgauuuuccuccugggcggucuucaacgagacgaggccccgacagcaauguucaugcacagcggggauaucaugauaaugaguggauuuucuagacuguugaaucaugcuguucccagggugcucccuaacccagaaggcgagggccugccccacuguuuagaagccccucugccagcuguccucccccgggacuccaugguggagccgugcagcauggaggacuggcaagugugugccucguaccuuaaaaccgcacgugucaauaugacuguucgccaggugcuggccacagaucagaacuucccuuuggaacccaucgaggacgaaaagagagauauuucuaccgagggguuuugccaucuagacgaucaaaauuccgaaguaaaaagggcucggaucaacccagacucauga

SEQ ID NO: 52685 - RNA, 786 nt, Artificial Sequence
  derived and/or modified sequence opt3 from ALKBH2__Homo_sapiens__NP_001001655
auggacagauuccuggugaagggcgcccaagggggacuccuuaggaaacaggaggaacaggagcccaccggugaggaaccugcuguccugggcggggauaaggaaagcacacggaaacgcccacgacgugaggcaccgggaaacggcggucacuccgccgggcccucuuggagacauaucagggcggagggauuggacugcucauacacuguuuuauuuggcaaggcugaagccgaugagauuuuccaggaacuggagaaagagguggaauauuuuacgggcgcacuagcccggguacagguguucgggaaguggcacagugucccucgcaagcaagcuaccuacggagacgcaggucucacauauacuuuuagcggccugacccuuuccccaaaacccuggauaccugugcuggagagaaucagggaucauguuucuggggugacaggacagaccuucaauuuugucuugauuaaccgguacaaggacggcugugaucacaucggugaacaucgcgacgaugagcgagaacucgccccagggucgcccauugcuucagugagcuucggagccugcagagacuuuguauucaggcacaaagauagucggggcaaguccccuucucgucgcguugcgguggucagacugccacuggcacacggcagccucuuaaugaugaaucauccgacuaacacacacugguaucauucccugcccgugaggaaaaaggugcuugccccucgggucaauuugaccuuucgaaagauccugcuaacgaaaaaguga

SEQ ID NO: 52686 - RNA, 861 nt, Artificial Sequence
  derived and/or modified sequence opt3 from ALKBH3__Homo_sapiens__NP_631917
auggaggaaaagagaaggcgggcccgcgugcagggcgcuugggcagcccccgucaaaagccaagcgaucgcucagccugccaccacagcaaagucccaucugcaccagaaaccagggcagacuuggaagaacaaagagcaccaucucucugaccgagaguucguuuuuaaggaaccgcaacaggugguacguagagcccccgaaccuagggugauugaucgggagggagucuacgagauaucacuuaguccaacgggugugagccgcguuugccuguaucccggcuucguggacgucaaggaagcugauuggaucuuggagcaguuaugucaggacgugccuuggaaacaaagaaccgggauuagggaagauaucacauaccagcagccacggcugacugcaugguauggagagcuacccuacaccuauucccgcauuacaauggagccuaauccacacuggcauccgguacuccgaacccugaagaacagaaucgaagagaauacuggccacacauuuaacucucuucugugcaauuuguacaggaacgaaaaagacucgguugauuggcacucagacgaugagcccagccucggucgguguccuauaaucgccagucuguccuucggggcuacccguacguuugaaaugcgcaagaaaccacccccugaggagaauggagacuauacuuacguggaaagagucaagauuccacuggaucauggcacccucuuaaucauggagggcgccacacaggcggacuggcaacacagggugcccaaggaauaccauucucgggagccgcgagugaaccugacuuuccgcaccgucuauccugaucccagaggggcaccaugguga

SEQ ID NO: 52687 - RNA, 666 nt, Artificial Sequence
  derived and/or modified sequence opt3 from ALKBH7__Homo_sapiens__NP_115682
auggccggcaccgggcugcucgcucuuagaacacugcccggaccuagcugggugagggguuccggcccaucugucuugucacgguuacaggacgcagccguugugcgcccgggguuccugaguacugcggaggaagagacgcuaagccgagaacucgagcccgaacugcguagaaggcgguacgaguaugaucacugggacgcugccauccauggauuucgcgagaccgaaaaguccagauggucugaggcaucgagggccauucuucaacggguacaggcugcagccuucggcccuggucagacacuguugucaagcgugcacguccucgaucuggaagcucgcggguacauaaaaccacauguggacaguaucaaguuuugcggagccacuauugcgggccugucccucuuaucucccagcguuaugcgacuggugcacacccaggagccuggcgaguggcuugaauugcugcuagagccagggucccucuauauccugagaggaucagcaagguacgauuucagucaugaaauucuucgggacgaggagagcuuuuucggugaacgucgcauccccagaggcaggcggauaucugucaucugucgaucccugccugaggggaugggaccaggcgaaucaggucaaccgcccccugccugcuga

SEQ ID NO: 52688 - RNA, 2004 nt, Artificial Sequence
  derived and/or modified sequence opt3 from ALKBH8__Homo_sapiens__NP_001287939
auguucgccauggacagcaaccaccaguccaauuacaagcugucuaaaaccgagaagaaauuucucagaaagcaaaucaaagcuaagcauacacuucugaggcacgaaggcauugagacugugucauaugcaacgcagaguuuggucguugccaacgggggauuagguaauggcgugagccggaaccagcugcuacccguacucgaaaagugcgggcugguggaugcgcuucugaugccuccaaauaaaccguacuccuucgcucgcuaucgaaccacagaggaaucuaagcgugccuacgucacuuugaacggaaaagaggugguugacgaucucggccagaagauaacccuguaucugaauuuuguggagaaaguccaauggaaggaacucagaccccaggcauuaccuccaggucugauggugguagaggaaaucauuucgucagaggaggaaaagaugcuuuuggagagcguugacuggacagaagauaccgacaaccagaauagucagaaaucccugaagcauaggcgggugaaacacuucggguacgaguuucauuaugaaaacaauaacgucgauaaggacaaaccccuaucuggaggccucccugauaucugugagagcuuccuggagaaguggcuucgcaaaggcuacauuaagcacaagccagaccaaaugacuaucaaucaguacgaacccgggcagggaauaccugcccacaucgauacacauuccgcuuuugaggacgaaauugugucacugaguuuggguagcgagaucgugauggauuucaaacacccagacggcauugcagucccgguuaugcuccccagaaggucucuguuagugaugaccggggaaucccgguaucuguggacgcauggaaucacuugccgcaaguuugacaccguacaggccucagagagccucaaaaguggcauaauuacaucugaugugggugaccuuacucuguccaagcgaggguugagaaccagcuucacauuuaggaaaguccggcaaaccccuuguaacugcucguacccccuagugugugauucucagcguaaggagacgccaccuuccuucccagaaucagacaaggaggcuagucgccuggaacaggaguauguucaccaaguguacgaagagaucgccggacacuuuagcuccacuagacauacacccuggccgcacauugucgaguuccucaaagcgcugccuucuggcagcaucguggcagauaucggcugcgggaauggaaaguaucuugguauuaacaaagaacuguacaugauaggcugugacaggucacagaacuugguagauaucugccgggagcgacaguuccaggccuuuguuugugacgcucucgccgugcccguccgcaguggguccugcgaugcauguauuagcaucgcugugauacaucacuucgccaccgcggaaagaagggucgccgcacugcaagagauugugcgguuacugcgcccaggaggcaaggcucuaaucuauguuugggccauggagcaggaauacaauaaacagaagucuaaguaccucagagguaaccguaauucacaggggaaaaaggaggaaaugaacagugacacuagcgugcaaaggucccugguagagcagaugcgggauaugggcucucgagacucggcuagcuccgucccuagaaucaaugacucacaggaaggaggcugcaacagucgccaggugucuaauagcaaacuucccguucaugugaacaggacauccuuuuauucacaagaugucuuggugccauggcaccugaaggggaaucccgacaaaggaaagccuguagagccauucgguccgauuggcagccaggaucccucuccuguguuucaccgguacuaucauguuuucagagagggggaacucgagggagccugcaggaccgucuccgacgugcgcauccugcagaguuacuaugaucagggcaacuggugugugauucuucaaaaggcauga

SEQ ID NO: 52689 - RNA, 4863 nt, Artificial Sequence
  derived and/or modified sequence opt3 from ALK__Homo_sapiens__NP_004295
augggcgccaucgggcugcucuggcuucugcccuuguuacugagcaccgcugcagugggauccgguaugggcacagggcagagagccggaucuccugcggcuggcccaccgcuacaacccagggagccucucucauacagucggcugcagcgcaagagccuugccgucgacuucguugugccaucccuguuucgaguauaugcacgugauuugcuccugcccccuucuucgucagaacugaaagccgguagaccagaggcuagggggagccucgcauuagacugcgcaccccugcuucgguugcugggaccugcuccaggcgugaguuggacugccggcuccccggcgcccgcagaagcccgcacgcuaucuagaguccucaaagggggaagcgugaggaaacugcggcgcgcuaagcagcuuguucuggaguugggugaagaggccauucucgagggcuguguggggccuccaggagaagcagcugucggccuguuacaguucaaccuguccgagcucuuuucaugguggauacgacaaggugaagggagacuuaggauccggcugaugcccgagaaaaaggccagugaggugggacgugaaggccgcuugagcgcggccauuagagcaucucagccuaggcuacuguuccagaucuuuggcaccgggcacuccucacucgagagcccaacaaauaugcccaguccgucuccugauuacuucacuuggaaccugaccuggauuaugaaggacuccuuucccuuccuuagccaucggucgcgauauggacuggaaugcucuuuugauuucccaugugaguuggaauacuccccuccccuccacgaccugcgcaaucagucauggaguuggagaaggaucccaagcgaggaggcuucccaaauggauuuacuggacggucccggcgccgaacggucuaaagagaugccucgcgggagcuuucuacuccugaacacaucagcugauaguaagcauaccauacuuuccccauggaugagaucuagcucagaacacugcacuuuggccguaaguguucauaggcaucugcagccgagcggacguuauaucgcacagcuccugccccacaaugaggccgcucgggaaauucuucugaugccuacaccaggcaaacacgguuggaccguguugcaggggcgaaucggcagacccgacaacccuuucagggucgcgcucgaguacauuuccucuggaaaucgcucgcugagcgcaguggacuuuuucgccuuaaagaacuguuccgagggcacgucaccagggaguaaaauggcucugcaaucuagcuucacuugcuggaauggaaccgugcuacagcucggucaggccugugauuuucaccaagauugcgcacagggcgaagacgagucccagaugugucggaagcugcccgucggguucuauugcaacuuugaagacggauucuguggcuggacacaggguacucuuucaccgcauaccccucaauggcagguuagaacauugaaggaugccagguuucaggaccaccaggaucacgcucugcuccugagcaccacggacgugccagccucugaguccgcaacuguaacaagugcgaccuuccccgcuccuaucaaaagcucucccugcgaauuacgcauguccuggcugauacgaggggugcuucggggcaaugucucauuggugcucguugagaacaagacuggaaaagagcaaggccguaugguguggcaugucgccgcauacgaagggcugagucuauggcaguggauggugcugccacuccuggauguaagcgacagauuuuggcuucagaugguugccugguggggacaggguucgagggcuauuguggccuucgauaauaucuccauuucuuuggacugcuaccugacaaucagcggcgaggauaagaucuuacaaaacaccgcaccuaaaucacgcaaucucuuugaacggaaccccaacaaggagcugaaaccaggggagaauaguccgagacagacgccuauuuucgaccccaccguccacuggcuuuuuacaacuuguggagcuuccggcccacauggucccacccaggcccagugcaacaaugcguaucaaaacucuaaucugagcguggaagucggguccgagggcccuuugaagggaauacagaucuggaaggugccagccacagauacuuacucaauuagcggcuauggggcugcaggaggcaaaggugggaagaacaccaugaugaggagucacggaguuucugugcucggcaucuucaaucuggaaaaagacgacaugcuauacauacugguaggucagcaaggcgaggaugccugucccuccacaaaccagcucauucagaaggucugcaucggggaaaauaacgugaucgaggaggaaauucgaguuaaucgcagcgugcaugagugggcuggaggcgggggaggcggugggggagccaccuaugucuuuaaaaugaaggacggcgugccuguaccgcugaucauugcagcggguggcgggggacgggccuacggcgcuaagacugauacguuccacccagaaagacuugagaacaauucgucaguguuggggcugaacggaaauucuggcgccgccggugggggaggcgguuggaacgacaacacaaguuuacucugggcuggcaaaucccugcaggaaggggccaccggaggccacagcuguccccaagcaaugaagaaaugggggugggagacuaggggaggcuucggugggggaggcggcgggugcucuagcggagguggcgggggaggcuauauaggugggaaugccgcuuccaacaaugauccugagauggacggagaagauggcguuucauuuaucaguccacuuggcauucuguacacccccgcgcuaaaggucauggaggggcauggagaagugaacaucaaacacuaccucaauuguagccauugcgagguggacgaaugucacauggauccugagucucacaaggucaucugcuucugugaccaugguacaguucuggccgaggauggcguguccugcauugugucaccgacccccgaaccacacuugccucugaguuuaauacucagcguagucacuuccgcacugguggcugcccuuguucuggccuuuucugggaucaugauuguguaucgucgcaagcaucaggaguugcaggcuaugcagauggaacuccaaucgcccgaguacaaacugagcaagcuacggacaucaacgaucaugaccgacuauaacccaaauuacugcuucgcaggaaaaacuuccaguauuucugaucugaaggaggucccuagaaagaacaucacacuuauaaggggccucggucacggggccuuuggagaaguguaugagggccagguuagcggcaugcccaaugacccauccccgcugcaaguggcgguaaagaccuugccugaagucuguucagagcaggacgaacuggauuucuuaauggaggcucucaucauuucuaaguuuaaccaucagaauaucgugcgaugcauuggggugagccugcagagucuuccccgguucauccuguuggagcucauggccggaggugaccugaaauccuuucuacgcgaaacaagaccaaggcccagccagccuucuucacuggcaaugcuugaucuccugcacgucgcccgggacauagcuuguggcugccaauacuuggaggaaaaccacuucauucaucgagauaucgcagccagaaauuguuuacugacuugcccagggcccggacgcguugcgaagauuggcgacuuugguauggcuagggauaucuaucgugccuccuacuaccggaaagggggaugugcaaugcucccugugaaguggaugccgccagaggccuucauggaaggcauauuuaccaguaaaacggacaccuggagcuucggcguacugcuuugggagaucuucucgcugggguauaugcccuacccuucuaaguccaaccaggagguguuggaauuugucacaagcggagguagaauggaucccccuaaaaauugcccaggccccguguauaggauuaugacucaguguuggcagcaccaaccagaggaccgcccuaacuucgcuaucauucuagaacgaaucgaguacugcacccaggauccggacguuauaaacacagcccugcccauugaauaugggccacucguggaggaggaagagaaggucccugugagacccaaggauccagaaggaguuccuccccugcuugugucacagcaggcaaaacgggaggaggaaaggaguccggcugccccaccucccuuaccaacuaccucuuccggcaaggcggccaaaaagcccacggcagcugagaucagcguccgcguaccucgugguccggccguggaagggggacauguuaauauggcuuuuucacaaaguaaucccccaagcgagcugcacaaagugcauggcuccagaaacaagccuacaucucucuggaaccccaccuacggcagcugguucacugaaaagccuaccaaaaagaauaacccaaucgccaaaaaggagccccacgaccgggggaauuugggacuggaggguuccuguacagucccuccaaacguggcaacuggcaggcuccccggggccucacugcuucuggaaccgucuaguuugaccgcuaauaugaaagagguaccucuauuucgccugcgacacuucccaugcggaaacgugaauuauggcuaccagcagcagggucuccccuuagaagcggcaacagccccuggggcuggccauuacgaggacacgauucugaagucgaagaacagcaugaaucaaccaggacccuga

SEQ ID NO: 52690 - RNA, 1176 nt, Artificial Sequence
  derived and/or modified sequence opt3 from ALLC__Homo_sapiens__NP_060906
auggacauggccagcgaguccgugggcgggaagauccuguucgcuaccgaugacuuuuucgcacccgccgaaaaccucauuaaaucugauucaccuugcuuuaaggagcacgaauacacagaguucggaaaauggauggacgguugggaaacuagaaggaagcggauaccaggccaugauugguguguccuucgccuggggauccagggaguuauucgaggcuuugacguggauguaaguuauuucacgggugacuacgcgccgcgugugagcauccaagcugccaauuuggaggaggauaaauuacccgaaauuccugagagagggaccaggacaggagcagccgcuacuccagaagaguuugaggcaaucgccgaacugaaguccgacgauuggucuuaucuaguccccaugaccgagcucaagccuggcaacccagcuucgggccacaauuacuuccuggugaacucacagcagcgguggacacauauacgccuuaauaucuuucccgacgggggaauugccagacugaggguuuucgguaccggccagaaagauuggacugcgacagacccuaaggaaccagcagacuugguggccaucgcuuuugggggagucugcgugggcuucagcaacgccaaauuuggucacccgaauaacauuaucgggguaggaggcgcaaagaguauggcugauggcugggagaccgcccggcgccucgaccgacccccuauacuggaaaaugaugagaacgggauucugcucguuccaggaugugagugggcgguguucagauuagcccaucccggugucaucacgaggauugaaaucgacacuaaauauuucgagggcaaugcaccugauuccugcaagguggacggguguauccugaccacacaagaagaggaagcugugauucggcagaaguggauacuuccagcccacaaauggaagcccuugcugccggucacuaaacuaucuccuaaccagagccaccucuuugauucccugacccuugagcugcaggacguuaucacacaugcucguuugaccauugugcccgauggaggcguaucacgccucagacugagggguuucccaaguagcaucugcuuacugcggccucgagagaagcccaugcucaaauuuucuguguccuucaaggccaauccauga

SEQ ID NO: 52691 - RNA, 12510 nt, Artificial Sequence
  derived and/or modified sequence opt3 from ALMS1__Homo_sapiens__NP_055935
auggagcccgaagaccugccuuggccaggcgagcucgaagaggaagaggaggaagaggaagaggaggaagaggaagaggaagaggaggccgcugcagccgcggcugccaacguggaugacgucguugugguagaagagguggaagaggaagcagggagagagcuugauagcgacucccacuacggaccgcagcaucuggagucuaucgaugacgaagaggaugaagaggccaaggcuugguugcaagcacaccccgguaggauuuuaccuccacugucacccccucagcaucgguauagugaaggcgagcgcaccagccuagagaaaauagucccacucacaugccacguguggcagcagaucguuuaccaagggaauucccgaacucagauuucugacacgaacguggucugucuggaaaccacagcccagcguggaucgggcgaugaccagaagacugagucauggcauugccuuccccaagaaauggauagcagucagacccuggacacaucccagaccagauucaaugugaggacugaggauacagagguaaccgacuuuccuucuuuggaagaggguauccucacgcagagcgaaaaccaaguuaaagagccaaaucgggaccuguucuguuccccgcugcucgugauucaggauucauuugcuagucccgacuuaccucugcuuacuugcuugacccaggaucaagaauucgccccagacagccuguuucaccagucugagcuauccuucgcgccccuccgcgggaucccugauaagucagaggacacagaauggagcaguagaccaucugaggucuccgaagcacuguuucaggccacugcugagguggccagcgaucuugcaucgucuagguucuccgugucacagcacccccugauaggaaguaccgcugucggcagccaauguccguuuuugccuuccgaacagggcaacaaugaggagacaaucucuagcguugacgaacucaaaauucccaaggauugcgaccgguaugaugaccuguguucauacaugaguuggaagacccgcaaagacacgcaguggccagagaacaauuuagccgauaaggaccagguguccguagcgacuagcuucgauaucacagacgaaaacauugccaccaaacgaucugaucauuuugacgcagcuagaucauaugggcaauacuggacucaggaggauaguagcaagcaggccgaaacauaucugaccaaaggacuccaggguaagguggaguccgacgucaucacgcuugauggccugaaugagaacgcugugguuugcucugaaaggguggccgaguugcaacggaagccuacccgugaaucggaguaccacagcuccgaccuacgcaugcugagaaugucacccgauacagucccaaaagcacccaagcaucucaaagccggggacacuaguaagggaggcauagcuaaagugacccagucuaaucugaagagcgguauuacaacuaccccuguagauuccgacaucgggucacaccuuagccugucuuuggaggaccucucccagcuggcgguuaguagcccauuagaaacaaccacuggacagcacacggauacacugaaccaaaaaacccuagcagacacucaucucaccgaggaaacacugaaggugaccgccauuccggagcccgcugaucagaagacugccacaccuacgguccuuucuuccucacacagucauaggggcaaaccaagcaucuucuaccagcaaggcuugcccgacucgcaccugaccgaagaggcacucaagguguccgccgcuccugggcuggccgaucagacuacaggaaugucuacccuuacaagcacuucauauagucaucgggagaaaccagguaccuuuuaccagcaggaacugcccgaguccaauuugacggaagagccgcucgaagucucugcagcgccuggcccaguggagcaaaagaccgggauccccacaguuagcuccacuucacacagccacguggaggaccuguuauucuucuaucgacagacccugccugauggacaucuaacagaccaggcucucaaaguaagugccgucucuggccccgcagaucagaagacugguaccgccacggugcuguccacaccacacagccaucgcgaaaagccugggauuuuuuaccaacaggaguucgcugacucgcaccagaccgaagagacucuuacaaaaguuucagccacccccggcccagcagaucagaagacugaaauaccggcugugcaaucuaguuccuauagccagagagagaaaccuucuaucuuguacccccaggaccuggccgauagccaccucccagaggaaggacugaaggucuccgcgguggccggccccgcugaccaaaaaaccggguuaccuacaguaccaucaagugcauauagccauagggagaagcugcuuguguuuuaccagcaggccuugcucgacucucaccugcccgaagaggcucuaaagguuuccgccgucucaggaccugcagaugguaaaacgggcaccccggcggugacuaguacaagcuccgccucuucgagccugggggagaagccaucagcuuucuaccagcaaacccuccccaacucccaucugacagaagaggcccuuaaagugaguauugucccuggaccaggcgaccagaagacugguauccccucugcaccuagcuccuuuuauucacaccgggaaaaaccgauaauuuucucucagcagaccuugcccgauuuucuguucccagaggaagcuuuaaagguuagcgccgugagugugcucgcagcccaaaagacggggacaccuaccguauccagcaacucucauucacacuccgagaaaaguagcgucuuuuaccagcaggagcugcccgacucggaucuuccacgcgaaucucugaagauguccgcuaucccuggcuugacugaccagaaaaccgugcccacaccaacuguuccgagcggaucauucagucacagagagaagccuucuaucuuuuaucaacaggaauggcccgauuccuacgcgaccgagaaagcccucaaggugagcacaggcccagggcccgcagaccagaaaacggaaauuccugcuguccagucaaguagcuauccacaaagggagaagcccuccgugcuguacccucagguucuaucugauagccaucugccggaggaaucccucaaggugucagccuucccaggacccgccgaccagaugaccgauacuccugcuguacccucuacauuuuauagucaacgugagaaaccagguaucuucuaccagcagacccugccugaaucgcaccuucccaaggaggcauugaaaauuagcgucgccccaggccuggcggaccagaagacugggacaccuaccgugacguccacuucuuacucacaacaucgggaaaaaccgagcauauuccaccagcaggcuuuacccggaacccauaucccagaggaggcccagaagguguccgcagucacaggcccugguaaucaaaagaccuggauuccccgaguucucaguacuuuuuauucucagagagaaaaaccagggaucuucuaccagcagacacugccuggcagccacauccccgaggaagcccaaaaggugucaccgguacuuggaccagcugaccagaaaaccggcacaccuacucccaccuccgcaaguuauagccacacggagaagccagggauuuuuuaccagcaagugcugcccgauaaccauccuacagaggaagcccuaaaaauaucugucgcguccgagccgguggaccagaccacuggaacccccgcuguuacaucaacuagcuauucgcaguacagggaaaagccaucuaucuucuaucagcaaagucucccuuccagccaccugaccgaggaagccaagaaugugucagcaguccccggcccugccgaucagaaaacggugauuccaaucuugcccuccacauuuuacucucauaccgagaagccugguguuuucuaccagcaggugcugccacacagccaccccacugaggaagcuuuaaaaauuagugucgccuccgagccgguagaccaaacaaccgggacuccuacagugaccagcacgucuuauucacagcauacugaaaagccaaguaucuuuuaccagcagucccuccccggaagccaccugaccgaggaagcaaaaaacguuucugcugugccuggcccaggugaucgcaagacaggcauacccacccuuccgucgacauucuauucacauacugagaagccugggagcuuuuaccaacagguccugccccacucccauuugccagaggaagcccucgaggugaguguagcgccuggacccguggaccagaccaucggcacgccaacagucacuucucccagcuccucauucggggaaaaaccuauuguuaucuauaagcaggccuuuccagagggacaccugccggaagagagucuaaaagugucuguggcacccggcccugucggucaaaccacaggggcuccaaccauuacuagccccuccuacucacagcaccgggccaagagcggaucuuucuaucagcuggcucuucucggcucccaaaucccugaggaagcacugagagugaguagcgccccaggucccgccgaucagaccacaggcauaccuacgauuacuucgaccuccuacucuuuuggggagaaaccgaucguuaauuacaagcaggcuuucccagacggacauuugcccgaagaggcgcugaaaguaucaauugugagcggcccuacagagaagaagaccgauauccccgcagggccauuaggaaguuccgcccucggcgaaaaaccuauaacuuucuauaggcaggcucugcuugacucuccccugaacaaggaggucgugaaaguuagcgccgcaccagguccggccgaucaaaagacagaaaccuugccugugcacucaacguccuacaguaaucgcgggaaacccgucaucuuuuaucagcagacucucagcgacucucaucugccagaggaagcucuaaaggugcccccuguaccaggacccgaugcgcagaagacagagaccccuucagucuccagcucucuguacaguuaucgagagaaaccgauuguguucuaccaacaggcccuuccagacucggaacucacccaggaggcacugaagguuuccgcugugccccagccugccgaccaaaaaacuggcuugagcacagucaccucaucuuuuuauagccacacagaaaagccaaacaucuccuaccagcaggaguuacccgauagucaccugacugaagaggcacucaaagugucaaauguuccuggucccgccgaccaaaagacgggcgugucuaccgucacaagcacuuccuacagucaucgggagaagccaauugugagcuaucagcgugaacugccgcacuucaccgaggcugggcuuaaaauccugagaguaccuggacccgccgaucagaagacaggcauaaacauuuugccauccaauucuuacccucagagggaacauucagugaucagcuaugagcaagaacuacccgaccugaccgagguuacucucaaagcgaucggggucccaggaccugcagaucagaagacgggcauucagaucgccucguccaguucuuacagcaaccgcgagaaagcuucaauuuuucaccagcaagaacugcccgacgugaccgaggaagcccuuaauguguucgucguaccgggucagggggaucggaagacagagauaccaacugugccuuuauccuauuacucuagaagggagaagcccaguguuaucagccagcaggaacugccagacucccaucucaccgaggaagcuuugaaagugucacccgucagcauuccugcagagcaaaagacaggaaucccgauuggccugucuaguuccuauagccacucacacaaagaaaagcucaaaaucucuaccgugcauauaccagaugaccagaagacugaguuucccgccgcuacacuguccucguacagccagaucgagaagccuaaaauuaguacgguuaucggccccaacgaucaaaagaccccaucucagacugccuuccacuccagcuacucacagacagugaaaccuaauauucuuuuucagcaacagcugcccgaccgagaucagaguaaggggaucuugaaaauauccgcagucccagaacuaaccgacgugaacaccggaaagccuguaagccugucuucaagcuauuuccaucgcgagaaauccaacauuuuuucuccgcaggaacuccccgguagucacgugacagaggacguuuuaaaggucucgacuaucccaggcccugcggggcaaaagacggugcugcccaccgcccuuccaagcuccuucucacaccgggaaaaaccugauaucuucuaccagaaggaccugcccgauagacaucucacagaggacgcuuugaaaauuucuagcgcccugggacaggcagaucagauaacuggccuccaaaccgugccgagugguacauauucccacggggagaaucauaagcuggucucagaacacguucagaggcuuaucgacaaccuaaauucuagcgauuccagugugagcucuaacaauguacuguugaacucacaggcugacgaucguguggucauuaauaaaccagaguccgccggauuucgcgacgugggcagcgaagagauccaggaugcagaaaacagugccaagaccuuaaaggagauucggacucugcucauggaggcugaaaauauggcgcugaaaagauguaacuucccugccccccuugcaagguuucgagacaucucugacauauccuucauccaaucgaagaaaguugugugcuuuaaggagccaagcucaacgggcgucuccaauggggaucugcuccaucggcagcccuucacagaagagucuccuaguagccgcuguauucagaaagacaucggaacccaaacuaacuugaagugcagaagggguauugagaauugggaauuuaucucauccaccacaguacggagcccccugcaggaggcugaaucuaaggugaguauggcccuagaggaaacucugcgacaguaccaggccgcaaaauccguuaugagaagcgagccagagggcugcucagggaccauaggaaacaagauuaucaucccuaugaugacagugauuaaaucugauucgagcuccgacgcuagugauggcaaugguucuuguucaugggacagcaaccucccggaaucccuugagagugucucugaugugcuguuaaacuucuuucccuaugucagcccaaagacguccaucaccgacucacgcgaagaggaaggggugagcgagucugaggauggaggcggcuccaguguugacucauuggccgcgcacgugaaaaaucugcuccaaugcgaaagcucgcugaaccacgcuaaggagauacuuaggaaugccgaagaggaagagucccguguacgggcacaugccuggaacaugaaguucaaucuggcucacgauuguggguacucuauuagugagcucaacgaagacgauagaaggaaaguggaggaaaucaaggcagaguuguuuggacauggucgcacuacagaccugagcaaaggcuuacagucaccucgagggaugggaugcaagcccgaggccgucuguucccacauuaucauagaaucucaugagaaaggcugcuucagaacccuaacuagcgaacacccacagcuggaccggcacccuugugcguuuaggagugcuggucccuccgagaugacacgcgggcgucagaauccgagcucuugcagagccaagcauguuaaccucucagcaucccuugaucaaaauaacagccacuucaaaguguggaauagucugcaguugaagucucauucaccuuuccagaacuuuauuccagacgaauucaagaucuccaaaggacugcggaugcccuuugaugagaagauggacccuuggcucagcgagcuggucgaaccagccuucgugcccccuaaagagguagauuuucacucgucuagucagaugccaucccccgaaccgaugaagaaauucaccacgagcaucaccuuuucaucucacaggcauagcaaguguauuuccaauaguucagugguuaaggugggcgucacagagggcagccaaugcacuggggcuuccgugggagucuucaacucucacuuuaccgaagagcagaauccuccccgcgaccuuaaacagaagacaaguagcccauccucauucaaaaugcauucuaacucgcaagauaaggaggugacuauccucgccgaaggucgaagacagagccagaaacugcccguugacuuugagcgguccuuccaggaagagaagccuuuggaaaggagugauuuuaccggcucucacagcgagccaucaacacgcgcaaacuguuccaauuucaaggagauucaaauaagcgacaaccauacccugaucucuauggggagacccaguuccacuuuaggaguaaauaggucaagcucucggcuaggcgugaaagaaaagaacgucacgauuacaccugaucugccaucgugcaucuuccucgagcagcgugaacuuuuugagcaguccaaagcuccgcgcgccgacgaccacgugcgaaagcaccauagucccagcccucagcaccaagauuauguugcgccagaccugcccucaugcaucuucuuggagcagagagaacuguuugagcaguguaaagccccuuacguggaucaucagaugagggaaaaucacucuccacucccccaaggucaggacuccauugcaagcgaucugccgaguccuauaucacuugagcagugccaguccaaggcuccaggggucgacgaucaaaugaacaagcaccauuuccccuuaccucagggacaggacugugugguagaaaaaaauaaccaacacaagcccaaaagccauaucucuaauauuaacguggaggccaaguuuaauaccguugucagucagagcgcaccaaaccacugcacucuggcugccuccgccucuaccccgccuucaaaucggaaagcgcucagcugugugcauaucacauugugccccaagacguccucgaaacuggauucuggcacccuagacgagcgcuuccacagucuggaugcugcaagcaaggccagaaugaacucagaauuuaauuucgaccuccacacuguguccucuaggagccuugagccaacauccaagcuguugaccaguaaacccgucgcucaggaucaggaaucacugggcuuucucgggccuaagagcucucuggacuuccaaguugugcagccauccuuacccgacaguaacacuauuacacaggaucuuaaaaccaucccuagccagaauucacaaauaguaacaucucggcagauccaggugaacauuuccgacuuugagggacauucgaacccagaagguacuccggucuucgccgaucgacugcccgagaagaugaaaaccccucucagcgcauuuagugagaagcuauccucugacgccgugacgcagaucaccacagaaucaccagagaagacucuguucagcuccgaaauuuucaucaaugcugaggauagaggccacgaaauaauugagcccgggaaccaaaaauugcgcaaggcgccuguuaaauuugccucuagcaguucagugcagcaggucaccuucuccaggggaacagacggccaaccacugcuccuucccuacaagccuagcgguucuacuaaaauguauuacgugccgcagcugcggcagauccccccaaguccugauuccaagagcgacaccacgguagagucaucgcauucugggagcaaugaugcaauugcucccgacuuuccagcccagguuuugggcacacgugaugacgaucuguccgcaaccgugaacaucaagcacaaagaaggaauauauaguaagagagucgugacuaaagccucacucccugugggcgagaagcccuuacaaaaugaaaacgcugacgccucuguccagguucugaucacaggggacgagaaucuuagcgauaaaaagcagcaggagauucauuccaccagggcggugacugaagcagcccaagcuaaggagaaagaaagucugcagaaggacaccgccgauagcucugcagcugccgcugccgagcacuccgcacagguaggagacccagaaaugaaaaaccuaccggauacaaaggcgaucacgcagaaagaggagauucaccgcaagaagaccgugccugaagaggccuggcccaauaacaaagaaucacuccaaaucaauauagaggaaagcgagugucauucggaguucgaaaacacuacacgguccgucuuucgaucugcuaaguucuacauucaccauccagugcaccugcccagugaccaggauaucugccacgagucauuggguaaaagcguuuuuaugagacauuccuggaaggacuucuuucagcaccauccugauaaacacagggaacauaugugucugccacuccccuaucaaaauauggacaagaccaaaacugauuacacacgcaucaagucucuuagcauuaacgugaaucugggcaacaaggaggucauggacaccacgaaaagucaggugcgggacuauccuaagcacaacgggcagaucucagauccgcagagagaccaaaaaguaacacccgaacagaccacucagcacaccguuuccuuaaaugagcuguggaacaaguaccgugagaggcagcggcaacagcgccagccagaauugggagaucgaaaagagcucagccugguggacagacuagauaggcuugccaagauacugcagaauccuauuacacauucucuccaagucuccgaaaguacucacgacgauagccggggcgagcgcucagugaaggaguggucugguagacagcagcagaggaacaaacugcaaaagaaaaagcgauucaaauccuuggaaaagagccauaagaauaccggggagcugaaaaagucgaaaguucucagucaccaccgggcaggccguucuaaccagaucaagauugaacagaucaaauuugacaaguacauacuuucaaagcaacccggauucaauuauaucuccaacacaagcucugauugcagaccaagcgaggaauccgagcuguuaacggacacuaccacaaauauucugaguggcaccacuucaacaguggagagcgauaucuugacccagacggaccgcgaagucgcucuccaugagagguccucuagugugucaacuauugauaccgcccggcugauccaggcauuugggcacgaaagaguaugucuaagcccucgcaggauuaaacuuuacuccucuaucacaaaccagcaacgacgguaucuggagaagagaucgaaacauagcaagaaagugcucaauaccggacacccccuggucacuuccgaacauacaaggcgccgucacauacagguugccaaccacgugauuaguucagacucuaucagcuccagugcgucuagcuucuugucauccaauagcaccuucugcaacaagcagaauguccauauguuaaacaaagguauccaggcuggcaaccuggagauugugaauggggccaagaagcacacacgggacguaggaauaacuuuuccaaccccgucuucaagugaggcaaaacucgaagagaacuccgaugugacgagcuggucggaagagaagagagaagagaaaaugcuuuucacaggcuacccugaggacaggaagcugaaaaagaauaagaaaaacucucaugaagguguuuccugguuugugcccgucgagaauguggaaagccgcucaaagaaagagaacguuccaaauaccugcgggccuggcaucaguugguucgagcccauuacuaagacccgaccauggcgggaaccucuaagagagcaaaacugucagggacagcaccuggauggcaggggguaucucgccggacccggccgcgaagcugguagagacuugcugcggccguuugucagggccacacuucaggagucucugcaauuccaccguccagauuuuaucucccgaagcggggaacgcauuaaaagacucaaguuaaucgugcaggagcggaagcugcagucaauguugcaaacugagagggacgcacuguucaauauagaucgcgaaagacagggacaucagaaccggaugugcccccucccuaaaaggguguuucuugcuauccagaagaauaaaccaauuaguaagaaagagaugauccaacgauccaagcguauuuacgaacagcugcccgagguacagaagaaaagagaagaggagaagcgcaaaagcgaauauaagucuuaccggcuaagggcccagcuguacaaaaagagagucacgaaccaacucuugggccgcaaagugccuugggacuga

SEQ ID NO: 52692 - RNA, 2106 nt, Artificial Sequence
  derived and/or modified sequence opt3 from ALOX12B__Homo_sapiens__NP_001130
auggccaccuacaaggugagagucgcuacaggcacugaccugcucagcgggacgagggauuccaucucucuuaccauuguuggaacacagggugagucacacaaacaacuguugaaccauuucggccgggacuuugcaacuggggccgugggacaguauaccguacagugcccccaggauuuaggcgaacugauaaucauucgccuacacaaggagcgauacgcguucuuuccuaaagacccaugguauuguaauuacgugcaaaucugcgcuccgaacggucguauuuaucauuuccccgccuaccaguggauggauggguaugaaacacucgcacugagagaggccaccggaaagacuacagcugacgauagucuuccuguccuguuggaacacaggaaagaggagauccgggcaaagcaggacuuuuaccauuggcgcguguuccucccaggccugcccagcuacguucacauaccuuccuauagaccacccgugaggcggcaccgcaauccuaaccgaccagaauggaauggcuacaucccgggguuucccauucugaucaacuucaaggccaccaaauuucucaauuuaaaccugagauauucuuuccuuaagacggcuucguuuuucgucagguugggaccuauggcccuggcguuuaaagugcggggucuacucgauuguaagcauucauggaaacgucugaaggacauucgcaagaucuucccaggcaaaaagagcguaguuagugaguacguggcagaacacugggccgaggauacuuucuuuggguaucaguaccuuaauggagucaaccccggccugauaagaaggugcacccggauuccugacaaauucccagugacagaugacaugguggcucccuuuuugggugaggggacuugucuccaagccgaacuggagaagggaaauaucuauuuagcagacuaccgaauuauggaaggcaucccgaccgucgagcuguccggccgcaaacagcaucacugcgcuccucucugucuucugcacuucgggcccgaaggaaagaugaugccaaucgccauucaguugucucagacaccuggucccgauugcccaauauuucuacccagcgacuccgagugggauuggcugcucgcgaaaaccuggguuagauacgccgaguucuauucacaugaagcaaucgcucaucugcuugagacgcaccugauugccgaggcuuuuuguuuggcccuccugaggaacuuaccuaugugccacccacuguacaagcuacucaucccgcauacucgguauacagugcaaauaaauaguauuggccgcgcaguacugcuuaacgaagggggauugagcgccaagggcaugucucuggguguggaaggguucgcuggcgucauggugagagcgcucuccgagcugaccuacgacucacuuuaucugcccaaugauuuuguugagaggggagugcaggacuugccuggcuacuauuaccgugaugacagccucgcagucuggaacgcccuggaaaaauacgugacugagaucaucacauauuacuauccaagugaugcugccguagaaggggaccccgaguuacagucuuggguucaagaaauuuucaaggagugucugcuaggacgggaguccagcgguuuuccucgaugccucagaaccgugccagaacugaucagguacgucacgauugugauauauaccugcucggcaaaacacgccgcugucaacacaggccagauggaguucacugccuggaugcccaauuuuccggcaucuaugcgcaacccuccaauccagaccaaggggcuuacaacuuuggaaaccuucauggauacacugcccgacgugaaaaccacuuguauuacgcuccugguuuuauggacacugucccgggagccugacgauagaaggccccuuggacacuucccagacauccauuuuguggaggaagcgccucgccgaucaaucgaggcuuuccggcagcguuugaaucaaauuagucacgauauaagacagaggaacaagugccuccccaucccauacuauuaccuggacccgguacuaauugaaaauagcaucuccauuuga

SEQ ID NO: 52693 - RNA, 1992 nt, Artificial Sequence
  derived and/or modified sequence opt3 from ALOX12__Homo_sapiens__NP_000688
augggcagauacaggauccggguggccaccggggcuuggcuguucagcggauccuauaaccgcguccagcucuggcuuguugguacacgaggcgaggcagaacuggaguugcaauuacgucccgccagaggggaagaggaagaguuugaccacgauguggcggaggaccugggacuacuccaguucguaaggcugcggaagcaucacuggcuuguggaugacgcuugguuuugcgaucgcauuacuguccagggcccuggugccugugcagaaguggccuucccaugcuacagauggguucagggggaggacauacugucuuugccggaaggaacggcuaggcuccccggcgauaaugcacuggacauguuucaaaaacaucgggagaaggagcugaaagaucgccagcagaucuauuguugggccaccuggaaggaaggccucccuuuaacaauugcugccgaccgaaaagaugaccugccacccaacaugagauuccacgaggaaaagaggcuugauuuugaguggacuuugaaggcgggggcacuggaaauggcccuaaaacggguguacacccuccugucaaguuggaauugccuugaggacuucgaccagaucuuuuggggacaaaagagcgcucuggccgagaaaguccgucaguguuggcaggaugacgaauuguucuccuaucaguuucucaacggugcaaauccuaugcuguuacgcagaucuacaucgcugccaucaaggcucgugcuucccagcggcauggaggaacugcaagcucaguuggagaaggaacuacagaacgggagucuguucgaggccgauuuuauucuccuggacggaaucccugcgaauguaauacggggcgagaaacaauaccuugccgcaccacugguuauguugaagauggaaccgaacgguaagcuccagcccauggugauccagauucagccuccaaaucccuccucuccuaccccaacucuguucuuacccagcgauccgccucuggcuuggcuacucgccaaauccuggguccgaaacucagacuuccaacugcaugagauccaguaucaccuuuugaauacacaccugguggcugaagugauugccgucgcaaccaugcgcugccuccccgggcugcauccaaucuuuaaguuccuuauaccucacauuagauacacgauggagaucaacacuagggcccggacccagcugauuagugauggaggcaucuuugacaaagcuguuagcacaggcgggggaggucaugugcaguugcuccgcagagcggcagcccaacugacuuacuguucuuuaugucccccagaugaccuggcugauaggggccuacucgggcugcccggagcccuuuaugcacacgacgccuugcgucugugggaaaucauugcucgguacguagagggcauagugcaccucuucuaucagcgagacgauaucgucaagggugacccugagcugcaggccuggugcagagaaauuaccgaggugggguuaugccaggcacaagauaggggcuuuccaguuuccuuccagucacagagccagcugugucauuuucuuacaaugugcguguuuaccugcacggcgcaacacgcugccaucaaucagggacaguuggacugguacgcaugggucccgaacgcccccuguacuaugcgcaugccuccacccacaaccaaagaagaugugacuauggcuacaguaaugggcagucucccugacguucggcaagccugccugcagauggcaauaucuuggcaucuauccagaaggcagccagauauggugccccuggggcaccauaaggagaaauauuucagcggaccgaagccuaaggcuguccucaaucaguuccgcaccgaccuggagaaacuugaaaaggagauuacggcccgaaacgaacaauuggauuggccauacgaguaucugaaacccucguguaucgaaaacucugugaccaucuga

SEQ ID NO: 52694 - RNA, 1944 nt, Artificial Sequence
  derived and/or modified sequence opt3 from ALOX15B__Homo_sapiens__NP_001034219
auggccgaguucagagugagggucagcaccggcgaggcuuuuggggcaggaacaugggacaagguuuccgugucuaucguagguacucggggcgaaucacccccucugccacucgauaaccuugggaaagaguucacggccggagcggaagaagacuuucaggugacccugccggaggaugucggccgcguguuguuacugcgaguucacaaggcucccccugugcuaccacuccuggguccccuugccccugacgcaugguucugccguugguuucaacugacaccacccagagggggacauuugcuguucccuuguuaccaguggcuggagggcgccggcacucugguccuccaggaagggaccgcuaaagugaguugggcagaucaccauccaguauuacagcaacagaggcaggaggaacugcaggcccggcaagagauguaucaguggaaggcuuacaauccgggauggccccacugccuugacgagaaaacaguugaagauuuggagcugaacauuaaguauagcaccgccaagaaugcgaacuuuuaccuacaggcagguuccgccuucgcugaaaugaaaauaaagggccuccuggaccgcaaagggcuuuggagaucucugaaugagaugaagaggaucuuuaacuuccggcgcacuccugccgcagaacaugcuuuugagcacuggcaggaggaugccuucuuugcgucgcaauucuugaauggacucaacccagugcugauucgaagaugucacuauuuacccaaaaauuucccugucacagacgccaugguggcaucagugcugggcccagguaccagccuccaggcugaacuugagaaggggagucuguuuuuggucgaucauggaauccuauccggcauucagacgaacguuaucaauggcaagccccaauucucugccgcuccgaugacucugcucuaccagagcccugggugcggaccccugcuuccacuggccauacaguugucccagaccccuggucccaacucaccaaucuuucuccccacagacgauaaaugggacuggcuguuagcaaagacuugggugaggaaugccgaguucaguuuucacgaagcucugacccaucuacuccacagccaccuccuuccugaaguauucacauuggcgacccugcggcaacucccacauugucacccgcuguuuaaaucuacgggcauugggaucgagggauucuccgagcuuauucagcguaacaugaagcagcugaauuauucauugcucugccugcccgaagacauccgcacuagaggcguggaggauauaccugguuacuacuauagggacgaugggaugcagauuuggggcgcagucgaacgguuugugagcgagaucauuggaaucuacuauccaagugacgaaucuguucaagaugaccgagaguuacaggccugggugcgcgagaucuucuccaaaggcuuucugaaccaggaaagcucggggauucccucuucccuagagacaagagaagcucucguccaguacgugaccaugguaauauucacuuguucagccaagcaugcagccguuagugcuggacaauuugauagcugcgccuggaugccuaaccugccacccuccaugcagcuuccgccuccaacaucuaaagguuuggcaaccugugagggcuucaucgcgacgcugcccccugugaaugcuaccugcgacgucauucucgcccugugguuacugagcaaggagcccggggaucagaggccacuuggaacauauccugacgaacacuucacugaggaagcaccccggcgcucaaucgccaccuuucagaguagauuggcucaaauauccaggggcauucaggagcguaaccagggucucgugcugccauacacauaucuagauccgccucugaucgaaaauagcgucucuaucuga

SEQ ID NO: 52695 - RNA, 1989 nt, Artificial Sequence
  derived and/or modified sequence opt3 from ALOX15__Homo_sapiens__NP_001131
augggccuguacagaaucagggugagcaccggggccucccucuaugcuggaucuaacaaucagguccaacuuuggcugguuggucagcacggcgaggcagccuuggggaagcgguuauggcccgcgcgcggaaaagaaacagagcugaagguggaaguaccugaguaccuaggcccacuccuguucgugaaacuucgaaagcgucaucuguugaaagacgaugcuugguuuugcaacuggauuucaguccaggguccgggggccggagacgaagugagauuccccuguuauagguggguugagggcaauggcgugcucagucugccugaggggacuggacggacggucggugaagauccacagggccuguuucaaaagcaccgcgaggaggagcucgaggaaagaaggaaguuauaccggugggggaacuggaaagacggacugauacuuaauauggcaggcgccaaguuguaugaucugcccguggacgagcgcuuccuagaagauaaacgaguagacuuugagguuagccucgcuaagggucuggcagaucuugccaucaaagacucccugaacguguugaccugcuggaaggaucucgacgauuucaauagaauuuucuggugugggcagucuaagcuggcugaaaggguccgggacucguggaaagaggacgccuuauucggauaccaguuucugaacggcgcgaauccuguggugcuccgucgcucagcacaucuuccagccagacuggucuuucccccuggcauggaggaauugcaggcucaacuagagaaggaacuggaagggggaacacucuuugaagccgauuucagccugcuugacgguaucaaagcaaacguuauucugugcagucagcagcacuuggcugccccacucgugaugcugaaguuacagccggauggcaaacugcuacccaugguaauccaacuccagcugccuaggacuggguccccacccccuccacucuuuuugcccaccgacccgccuauggcguggcugcucgccaaguguugggugcggucuagcgauuuccagcugcaugagcuucaaucccaccuguugcgaggacaccucauggcagaggucauagugguugcuacaaugcgcugccugcccucaauccauccaauuuucaaauuaaucauuccucaccugagauauacccuagaaaucaaugugagggcccggacuggccucgucagugacauggguauauuugaucagauuaugagcacagggggcggaggccaugugcagcugcuuaagcaggcuggggccuucuugaccuacucuuccuuuugucccccagacgaucuggcagaccgcggacuccuggguguaaagagcucauucuacgcccaagaugcuuuaagacugugggagaucauuuauagguacguugaaggcaucgugagucuucacuauaaaacggacgucgcggugaaggacgaucccgaguugcagacuuggugccgugaaaucaccgagauugggcuccagggagcacaggaccggggcuuuccugucucucugcaagcccgagaucaggugugucacuucguuacaaugugcauauuuacuuguaccggucagcaugcuuccgugcaccuagggcagcuggacugguacagcuggguaccaaacgccccgugcacaaugagacuucccccuccaaccacgaaagaugcaacucuggagacagucauggccacccuucccaauuuccaucaggcuucguugcaaaugucuaucacuuggcagcugggcaggcgccagccugugaugguugccgugggacaacacgaagaggaauauuuuuccggcccagagcccaaggcaguccucaaaaaguuccgggaggaauuagcggcucuggacaaggagauugaaaucagaaacgccaaacuugauaugccguacgaguaucugaggccuucagugguagaaaauaguguggcaauauga

SEQ ID NO: 52696 - RNA, 657 nt, Artificial Sequence
  derived and/or modified sequence opt3 from ALOX5AP__Homo_sapiens__NP_001191335
augcugaccuucaaccacgacgcccccuggcauacacagaagacucucaaaacgagcgaguuuggcaaguccuucgggacccuuggacacaucgguaauauuucucaucaaugcugggcuggcugugcagccgggggcagagcggugcugucaggagaaccugaggcuaacauggaucaggaaacagucgguaauguuguguuguuagccauaguaacucugaucagugugguccagaacggguuuuucgcacacaaaguggagcaugaaagcaggacccagaauggacgguccuuucaacgcacaggcacccuagccuucgagcgaguuuacacugcuaaccagaauugcguggacgcauauccaacauuucucgccguccuguggucugcuggccuucuguguucacaggugccggccgcguucgcaggguugauguaccucuuuguacgucagaaguauuucguuggauaccugggugagagaacccaaucgacgcccggcuauauuuuugggaaaaggaucauucuguuccucuuuuuaaugagcguggccggaaucuucaacuacuaucugauauucuuuuucggcagugauuuugaaaauuacaucaagacuauuuccaccacaaucucuccucuuuugcugauuccauga

SEQ ID NO: 52697 - RNA, 2025 nt, Artificial Sequence
  derived and/or modified sequence opt3 from ALOX5__Homo_sapiens__NP_000689
augcccagcuacaccgugacagucgccacuggcucccagugguucgcugggacggacgauuauaucuaccugucucucguuggaucagcagguugcagugagaagcaccuucuggacaaaccuuuuuauaacgauuucgaaagaggcgccguggacagcuacgauguaaccguggacgaggaauugggggagauucaauuagucaggauagaaaagcggaaauauuggcugaaugaugacugguaccuaaaguauaucacacucaaaacuccacauggagauuacauugaguuuccguguuaccgcuggaucaccggcgacguggagguugugcugcgagauggucgugcgaagcucgcuagagacgaucagauucacauccugaagcagcauaggcggaaagaauuggagacacgccagaagcaauauagauggauggaauggaaccccggguucccucucuccauagacgccaaaugccacaaggaccugccaagggauauccaguuugacucugagaaaggagucgauuucgugcugaauuacucgaaggcaauggagaaccucuuuauuaaucgguucaugcauauguuucagucaagcuggaacgacuucgccgauuuugaaaagaucuucguaaaaauuaguaauaccaucuccgagcgcguuaugaaccacuggcaggaagacuuaauguuuggcuaucaauuccugaauggcuguaaccccgugcuuauacgaagaugcacugaguugccugaaaagcugccagucacaaccgagaugguggaguguucucuagaaaggcagcucagccuggagcaggaagugcagcaagggaauauuuucaucgucgauuuugagcuucuggacggaauugaugcuaacaaaacggaccccugcacuuugcaguuccucgcagccccuaucugucuguuauacaagaaucuggcuaacaaaaucguuccaauugccauacagcucaaucaaaucccgggugaugaaaaccccauuuuucuuccuuccgacgcgaaguaugacuggcuguuggcaaaaaucugggugcggucaagugauuuccacguacaucagaccauaacacaccuacugcguacucaucucgugagcgaggucuuuggcauugccauguaccgccagcugccagcugugcaccccaucuucaaacuucugguugcccacgugagauuuaccaucgcaauuaacacaaaggcuagggagcaguugaucugcgaaugugggcuuuucgacaaggccaaugcgaccggaggcggugggcauguccaaauggugcagcgggccaugaaggaucugacguaugcaucuuuaugcuuuccugaggcuauuaaagcccgaggaauggaauccaaggaggacauaccauacuacuucuaucgcgaugacggccugcuaguaugggaagcuaucagaacuuuuacagccgagguuguggauauuuacuaugagggcgaccaggucguggaagaggaucccgaacuccaggacuucgucaacgauguguacguuuaugggaugaggggacggaaaucaagcgguuuuccgaagagugugaagucucgcgagcaacuguccgaguaccuuaccguagucaucuucacugcaagcgcccagcacgcugcggugaauuucggccaguaugacugguguucguggaucccuaacgcacccccaacaaugagagccccucccccaaccgcuaaagggguugugacgauugaacagauagucgauaccuugcccgacaggggacguucuugcuggcaucugggcgccgugugggcacucucccaauuucaggagaaugaacuguuccuugguauguacccugaggaacacuuuaucgagaagccaguaaaagaggccauggcucgguuccgaaagaaccuggaagccauugugucaguuaucgcagagagaaauaaaaagaagcaguugccguacuauuaccucagucccgacaggauuccuaacagcgucgcgaucuga

SEQ ID NO: 52698 - RNA, 2532 nt, Artificial Sequence
  derived and/or modified sequence opt3 from ALOXE3__Homo_sapiens__NP_001159432
augcccagaggcgccuucaggccuugccugccagcucucuacuuugcauuccuuaccuguccgacacccgagcagcggaugagcgggacucaagccccugacauccaccugggagaaccagcgcgcgguacgggcugcgugcgagggaagcagaccuccauucguguccaggauuguggaagaagggaggaagcucgggccgcaucucgcgaguugagaagggaaaaagcccaggagcauccccgggagucaugggcucacccucaaccauaucccgcaccucagccauuagcccugcgcccggaaacacagcccugcccugcuugucgaaguagcccacccggcagacuacuccugaggccugcccuuccaggucaucccuuucuguugccgauaauggcgguuuaccggcucugcgugacuaccgggccuuaucugcgugcaggaacacuggacaacaucuccguaacccucgugggcacuuguggcgagucucccaagcagcgcuuagauagaauggggagggacuucgccccaggaucgguccaaaaauacaaggugcggugcacagcugaacugggugagcuuuugcugcuacgaguucacaaagagcgcuaugccuuuuucagaaaggauucaugguacuguagcaggauuugcgugaccgaaccugacggcagugucucccauuuucccuguuaucaguggaucgagggguacugcacgguggaacuccggccaggaacugcacgcaccauuugccaggauucucugccccuucuguuggaccacagaacaagggagcuccgugcucggcaggaauguuaccgauggaagaucuaugccccuggcuucccaugcaugguagauguuaauagcuuucaagagauggaguccgacaaaaaguucgcgcugacuaaaaccacaaccuguguggaucagggugacucaagugggaacagauacuuaccgggauuucccaugaagauagauaucccuagccugauguauauggaaccaaaugucagguacucugccacgaaaacuauuucccuccuuuucaacgcaauccccgcuucacugggcaugaaguugcgcggccuacuggaccggaaggggagcuggaaaaagcucgacgauaugcagaauauuuucuggugccacaaaacauucaccacuaaguaugugacagagcauuggugugaagaccacuucuuuggauaccaauaucugaacggugugaauccugucaugcuucauugcaucaguucucugccauccaaauugcccguuaccaacgauaugguggccccgcuccugggccaggacacguguuuacagaccgagcuggaaagagggaauauauuccuagcugauuacuggauucucgccgaggcaccuacacacugccugaacggaaggcagcaauacguagccgcuccacuuuguuugcuguggcucagcccccagggcgcgcuggugccucuugcaauccagcugucgcagacucccgguccagacucuccuaucuuuuugcccaccgauuccgagugggacuggcuccuggccaagacauggguccgcaauucagaauuuuuagugcacgagaacaauacucauuuucugugcacccaccuacucugugaggcuuucgccauggcaacacugcgacaacuuccauugugccauccgauuuauaaacugcuccugccucacacccgguacacuuuacagguuaacacgaucgcccgugcuacacugcuuaaucccgaaggguugguggaucaggucaccaguauuggcagacagggacucauauaucugaugagcacuggccuagcccauuuuaccuacacaaacuucugccugccagacucccucagggcacgcggggugcuggcgauccccaacuaucacuaccgggaugacggacuuaagauuugggcugccaucgaaucuuuuguaagcgagauaguugguuauuacuacccuucagacgcaagugugcaacaggauuccgaguugcaggccuggaccggcgaaauuuucgcucaggccuuucuggggagagagagcucuggauucccaucaagguuauguacucccggcgaaauggucaaguuucucacagcaaucaucuucaauugcagugcucaacacgccgcggugaacagcggucagcaugacuucggggccuggaugccuaaugcuccguccucuaugcgacagccacccccucaaacgaaaggcaccacuacacugaagaccuaucuugauacacugccagaggucaacauuucguguaauaacuugcuccuguuuuggcuagugagccaggagcccaaagaccagcgcccucugggaacuuacccggaugaacacuucaccgaggaagcaccccggagauccaucgccgcuuuucagucaaggcucgcccaaauuagucgugacauacaggagcgcaaucagggccuggcacuuccauauacguacuuggauccuccccugaucgaaaacucuguuagcauuuga

SEQ ID NO: 52699 - RNA, 1587 nt, Artificial Sequence
  derived and/or modified sequence opt3 from ALPI__Homo_sapiens__NP_001622
augcagggccccugggugcugcuccuucugggguugagauuacaacugagccuaggagucaucccugccgaggaagagaacccagcuuucuggaauaggcaggcagccgaagcgcucgacgcugccaagaaacugcagccgauucagaagguugccaaaaaccuuauacuguuuuugggugauggccucggggugcccaccguaacagcaacucggauccugaagggacagaaaaauggcaagcuggguccugagacgccacucgcuauggaccgcuuccccuacuuagcacuguccaagaccuauaacguggaucgacaagucccugacucugccgcuacagccacugcguaccuuugcggggugaaagcaaauuuucagaccauuggauugucagccgcugcccguuucaaccaguguaauacaaccagaggcaacgaaguuaucagugugaugaauagggcaaagcaagcuggcaaaagcgucggggugguaacuacaacccggguucagcacgccuccccagcgggaacguaugcccauacugugaaccgcaauugguacucugaugcagacaugcccgcuucggccagacaggaggguugccaggauauugcuacccaacugaucucaaacauggacauagaugucauccuaggcgggggaaggaaguauauguuuccuaugggcacaccagacccggaguaccccgccgaugcaagccagaaugguauucggcucgacgggaaaaaccuggugcaggaauggcuugccaagcaccaaggagcuugguauguguggaaucgcacugagcugaugcaggcgaguuuggaucaguccgucacccaucucaugggccuguucgaaccuggcgacacaaaguacgagauccaccgagacccaaccuuagaucccucucugauggagaugacggaagcagcccucagacuucugagcaggaacccucggggguuuuacuuguucguugagggaggucguauugaccauggccaccacgaagggguggcuuaucaggcccuaacugaggcaguaauguuugaugacgccaucgaacgcgcuggacaacugacauccgaggaggauacccucacucuggugacagccgaccauucacacgucuucaguuuuggcgguuacacccuuagagggagcucuauauucggccuggcaccauccaaagcgcaggauucaaaggcuuauacgagcauuuuguacggaaacggccccggguauguguuuaauaguggaguuaggccggacgugaacgaaucugaguccgguagcccugauuaccagcagcaagccgcagucccccucucgucugaaacccauggcggggaggacguggccguauucgcucggggaccacaggcccaccugguucacggcgugcaggaacaguccuucgucgcacaugugauggcuuuugccgcguguuuagagccuuauacagccugcgaucuggcucccccagcauguacuaccgacgccgcucaccccgucgccgcaucacuaccucuccuggcggguacacuuuugcugcucggggccagugcugccccauga

SEQ ID NO: 52700 - RNA, 3735 nt, Artificial Sequence
  derived and/or modified sequence opt3 from ALPK1__Homo_sapiens__NP_001095876
augaacaaucagaagguggucgccguucugcuccaagagugcaaacaggugcuugaccagcuguuguuagaagcucccgauguaagcgaggaagacaaguccgaggaucagagauguagggcacugcuaccuucugaacuccggacccugauccaagaggccaaagagaugaaguggccauucgugccggaaaaauggcaguacaagcaggcggucggccccgaggacaagacaaaccuuaaagaugugauuggggcuggacugcagcaauugcucgccucacugcgcgcaaguauacuggcccgagacugcgcugcagccgcugccaucguuuuucucguggaucguuucuuauauggucuggacgucagcggcaaguugcuucagguggcgaaagggcugcacaagcuacagccugcaacuccaauugcuccccagguaguuaucagacaagccaggauuuccgugaauagcggaaaacuccugaaggccgaauacauccuuucgucacugauaagcaacaauggcgcaacggguaccugguuguaucggaacgagagugauaagguccucgugcaguccguguguauccagauucgcgggcaaauccugcagaaauuaggaaugugguacgaggcugccgaacugauuugggcgucuaucgucggcuaucucgcccuuccucagccagacaagaaaggccugagcacauccuuggggauacuagcagauauuuuuguuucaaugaguaagaaugacuacgagaaauucaagaacaauccccagaucaaccugagccuccugaaagaauuugaucaucaccuucugucugcugccgaggcuugcaaguuggccgcagccuucuccgcuuauacuccucucuuugugcugaccgcgguaaauauuagaggaacauguuuacugucauacagcaguucuaacgacugcccaccggaacuaaagaaucuccaucugugugaggcaaaagaggccuucgaaaucggucuuuugaccaagagggacgaugagcccgugacuggcaaacaagaacugcacuccuuugucaaggcugccuucgggcucacaaccgugcaucggcgccugcacggagagacgggcacuguucacgcagccagccagcuuugcaaagaagcuauggguaagcuguacaacuuuucgaccucuucccgaucacaggacagagaggccuugagucaggaggugaugagcgucaucgcacaagugaaggaacaucuccagguacaguccuucucuaauguugaugacaggagcuaugugccugagucauuugaaugucggcuggauaaauuaauucugcacgggcagggagacuuccaaaagauacuagauacauacagucagcaucacacuuccgucugcgagguguucgaaagcgacuguggcaacaacaaaaaugagcagaaggaugcgaaaaccggcgucugcaucacagcucucaagaccgagauuaagaacaucgacacggugucuacuacacaggaaaaaccacacugccaacgugauaccgggauaucaaguagccugaugggaaagaauguucagcgcgagcuuagaagggguggccggcgaaacuggacucauuccgacgccuuucgcgugucuuuggaccaggauguagaaacagagaccgagcccucggacuauagcaauggggaaggagcagucuucaacaaaucccugucaggcagucaaacgucuagcgccugguccaaucucucagguuuuucuucuuccgcuaguugggaggaagugaacuaccacguugaugacagaagcgccaggaaggagccugggaaagaacaucugguggauacccaguguucuacagcauuauccgaggagcuggaaaaugaccgggagggccgcgcuaugcacucacuucauagucaguugcacgaucucagccugcaggaaccaaacaaugacaaccuagagcccucgcaaaaucagccgcagcagcaaaugccucugacucccuucuccccacacaacaccccuggaauuuuucucgcccccggcgcggggcugcuugaaggagccccagaggguauccaggaggucagaaauaugggccccaggaacacaucugcucauagccguccuucauaucggagugcauccuggucuagcgauuccgggcgaccaaagaacaugggaacucacccgucagugcagaaggaagaggccuucgaaaucauuguagaguuucccgaaaccaauugcgacgugaaagauagacagggcaaggagcaaggugaggaaaucagcgagcgcggggcuggcccuacauucaaagccaguccaucuuggguugaccccgaaggagagaccgcagaguccacugaagaugcgccuuuggacuuucauaggguccugcacaacagcuuaggcaauauuucgaugcucccauguucaucuuucacgcccaacuggccggugcagaauccugacagucggaaguccgggggaccaguggccgagcaggguauagaucccgacgcuagcacagucgaugaagagggccaacugcuugacucuauggauguuccuugcaccaacgggcacggaagccauagacuguguaucuugaggcagcccccaggccagcgcgccgaaacuccuaauuccucagugagugguaacauucucuuucccgugcugagcgaggacugcaccacaaccgaggaagggaaucagccaggcaacaugcuaaauuguucucaaaacuccucaaguagcuccguaugguggcugaaaucuccggcauucucgagcggaucauccgagggcgauaguccuuggucuuaccucaauagcuccgggucaucuugggucagccugcccggaaagaugcgaaaagaaauccuugaggcucggacuuugcagccagacgauuuugaaaagcuguuagccggcgugcgucacgacuggcucuuucagagacuggagaacacagguguuuucaagcccagucagcuucauagggcacacuccgcccugcuacucaaauauagcaagaaaucugagcuguggacggcucaagaaaccaucguguacuugggggauuaccugacugucaagaaaaagggacgccagcggaaugcguuuugggugcaucacuuacaccaggaggaaauucucggcagauauguugguaaggacuacaaagagcagaagggccuguggcaucacuucacagauguggaaaggcaaaugaccgcccagcauuauguaacagaguuuaacaaacgacuuuacgagcagaacauaccuacucagaucuucuauauuccaucaaccauccuguugauucucgaagacaagacgaucaaagggugcauauccgucgagcccuacauccugggagaauuugugaagcuaaguaauaacaccaagguggucaaaacagaguauaaggcaacugaguacggccuggcuuacgggcacuucagcuaugaauuuucgaaucaucgcgacguugugguagaucuucaaggaugggugaccggcaacgguaaagggcucauuuaccugacagacccucagauccacucugucgaucagaagguguucacuaccaauuuuggaaaacggggcauuuucuauuucuucaacaaucaacacguugaguguaacgaaaucugccauagauugucccugacgaggccgagcauggagaagccauguacauga

SEQ ID NO: 52701 - RNA, 6513 nt, Artificial Sequence
  derived and/or modified sequence opt3 from ALPK2__Homo_sapiens__NP_443179
augaaggacucggagggcccccagagaccuccacugugcuuccucuccacccuucugucucaaaaagugccggaaaagucagaugccgucuugagguguauaauuagugggcagcccaaaccugagguuacgugguacaagaacggacaggcuauagacgguagcggcaucauuuccaauuaugaauuuuucgagaaccaguacauccacguguuacaucugucuugcuguacuaaaaaugaugcugccguauaucaaauuucggcgaagaacucauuugggaugaucugcuguagcgcuaguguggaagucgagugcuccucugagaauccacagcuaagccccaaccucgaagacgaucgggaccgcggauggaagcacgagacgggcacccaugaagaggagcgagccaaucagauagaugaaaaagagcacccuuacaaggaagaggaauccaucucaccagguacaccccguagugcagacagcucuccuuccaaaucaaaccauagccugagucuucagucucuggggaauuuggauauuuccgugagcucgucugagaacccacucggaguuaagggcacuagacacaccggcgaggccuaugacccguccaauacagaagagaucgcuaacgggcugcuguuccucaauucaagucacauuuacgaaaaacaagauagguguugccauaagaccgugcacagcauggcauccaaguuuacugacggagauuuaaacaaugacgguccccaugacgagggccugcggucuagccagcagaacccuaaaguccagaaguauaucucauucagucuuccauuguccgaagccacagcucacauauaccccggggauagcgccguggcgaacaaacaaccuucuccacagcugucaagugaggacagcgauuccgacuacgagcuaugucccgaaauuacccucacguauacugaggaauuuucugaugacgaucuggaguaccuugaaugcucggacguaaugaccgauuauagcaaugcaguuuggcagcgcaaccuguugggaacagagcacguguuccuccuggaguccgacgaugaagagauggaauuuggcgagcauuguuuaggugggugcgagcacuuccugucaggaaugggcugcggcaguagagucucuggggacgccggaccgaugguggcuacugccgguuuuuguggccaucacagccaaccucaggaagugggggucagguccucacggguuagcaagcauggacccucuuccccacagaccggcaugacacucauccuugguccucaccaggacgggaccaguagcgugacggagcaaggccgcuacaaacugcccacugcaccagaagcugccgagaaugauuaucccggcauucaaggagaaacacgagacucucaccaggcgagagaggaguucgccuccgauaacuugcuaaauauggacgaaucaguaagggagaccgaaaugaagcugcucaguggggagagcgaaaacucgggaaugucccagugcugggagacugcagcugauaaacggguggguggcaaggaccuguggucuaagcgugggagccgcaaaucagccagagucaggcaaccuggaaugaagggcaaucccaaaaagccgaacgcuaaucuucgggagaguacaaccgaagguacgcugcauuuguguuccgccaaagagucugcagaacccccucucacccagagcgauaagcgagagacaucccacacuaccgccgcugcgacagggcgcucaagccaugcagacgccagagaaugcgcuaucaguacucaggccgagcaggaggcaaagacccugcaaacaucuaccgauuccgugagcaaagaaggcaacacuaauuguaagggagagggcaugcagguuaacacguuauuugaaacaagccaggugccagacuggucagaucccccucagguccaagugcaggagaccguaagggagacuaucucuugcagucagaugccagccuucuccgaacccgcuggggaggaaagcccguucaccggaacaaccacuauuucuuuuagcaaucuggguggcguucacaaagagaacgccucccuagcacaacacucagaagugaagccuuguacaugcgggccacagcaugaggagaaacaggaccgggauggaaauauacccgacaacuuccgcgaagaccucaaguacgagcagaguaucagcgaagcgaacgaugagacgaugucuccuggcgucuuuuccagacaucugccaaaggacgcuagggccgauuuccgugaaccaguggcagucucaguggccaguccugagcccaccgacacugcucuuacauuggagaauguuugugaugaaccacgggaccgagaggccgugugcgcaauggaauguuuugaggcuggugaucaagggaccugcuucgacacaauugauagccugguaggcagaccggucgacaaauauuccccucaggaaaucugcucuguggauacugagcucgccgagggacagaacaagguuucggaccuguguagcucaaaugauaaaacccuugaaguguuuuuccagacgcaagucuccgagaccagugugucuacaugcaagagcuccaaagacggcaacucaguaaugucuccccuguuuacuagcaccuucacauugaauauaagucacacugcguccgaaggggccaccggagagaaccucgcuaagguggagaauagcacguacccacuggcaucuacaguucacgccggccaggaacagcccucaccuuccaacagugguggguuagacgagacccagcugcuaagcucggaaaauaacccacucguccaauuuaaggagggaggcgauaaaucucccuccccuagcgcugccgacacuacagcaaccccggcgucauacaguucuauuguguccuucccaugggaaaagcccacuacccugacagccaauaacgaguguuuucaggcuacgagggagaccgaagauacuagcacagugaccaucgccacagagguccauccugcaaaauaucuugcuguuucaaucccagaagacaagcacgccgguggcacugaggaacgcuucccccgggcaagucacgagaaagugagccaguucccuucccaagugcaguuggaucauauucugucuggggccaccaucaagagcacgaaagagcuccugugcagagcuccguccguacccggagucccacaccauguguuacagcugccugaaggcgagggguuuuguucaaauucuccccuucagguugacaacuugaguggagauaagucgcaaacaguggacagggcggauuuccgcagcuacgaagagaauuuucaggaacgaggcuccgagaccaagcaggguguccagcaacagucucucucacagcaggggagccuguccgccccagacuuccaacagagucuaccuacuaccucugcagcucaggaggaacggaaccuggugcccacagcccacagcccagccucaucccgugagggagcuggccagagaagugguuggggcacuaggguuagcgugguagcagaaaccgccggggaggaggauucucaagcgcucuccaacgucccgucacugagcgacauucuuuuggaagagucgaaagaauaucgcccuggaaauugggaggcuggcaacaagcugaaaauaaucacauuagaagccucugcaagugagauuuggcccccacggcagcucacaaauuccgagagcaaggccucagacgggggacugaucauccccgauaaagugugggcugugccugacucccuuaaggcagaugccgucguuccagaacuggcgcccucugagauugcugccuuggcacauagcccugaagacgccgagagugcucucgccgauuccagagaaagccacaagggcgaggagccgaccauaucugugcacuggaggucacugaguucccgagguuuuagccagccacgccuacuggaaucuucgguagaccccguggaugagaaagaacucucagucacugacagccuguccgcagcuagugagacagggggaaaggaaaacgugaauaacguuucucaagaucaggaggagaaacagcuuaagauggaccauaccgccuucuuuaaaaaguucuugacuugcccuaagauccuggaaagcuccguggaucccauugacgagaucucagucauugaauacacacgggcgggcaaaccagagccuagugagaccacgccccagggugccagagaaggcgggcaaucuaaugauggaaacaugggccacgaggcagaaauccagccagcuauauuacaggugccuugucuccaggggacuauccugagcgagaauaggauuucccguucacaagaaggaagcaugaagcaggaggccgagcagauccagccggaagaggcuaaaaccgcaauuuggcaaguucuucagcccucugaaggcggugagcgcaucccauccgggugcaguauaggacagauucaagaaagcucggacggcucccugggcgaggccgagcagucuaagaaagacaaggccgaacuaaucucaccuacaagcccccucaguuccugucugccaauuaugacccaugcuucuuuggggguggauacucacaacagcacaggacagauccacgacgucccugagaaugauauaguagaaccccggaagagacaguauguguuuccgguuucacagaaaagggguaccaucgagaacgaacgaggcaagccacugccuuccagucccgacuuaacacgguucccaugcacuagcucucccgaggggaaugugaccgauuuucucauuucacauaaaauggaggaaccuaagaucgagguccugcagauuggagaaacgaaaccgcccuccagcucuaguucguccgcgaagacacuugcauucaucagcggcgagcgcgagcuggaaaaagccccaaaguugcuccaggacccuugucagaaggguacccuggggugcgcuaaaaagucaagagagagggaaaaaucucuagaggcccgggcaggaaagagccccggcacucugaccgccgugacaggcuccgaagagguaaaacgaaagccugaggcuccagggaguggacaccuugcggaaggugugaagaaaaagauacucucaagagucgccgcacugcgcuugaaacuggaggaaaaggagaacauuaggaaaaauucugcauuuuuaaagaagaugcccaaacucgaaacuagccugucccauaccgaggagaagcaagauccuaaaaagccaaguugcaaacgugaaggccgggcccccguucuucugaagaagauccaggcagagauguucccggaacacagcgggaacgugaaauuguccugucaguucgccgagauccaugaagacucuacgauuugcuggacaaaggauucaaaaagcaucgcucaggugcaaagaucggccggagacaacuccaccgucaguuuugcgauugugcaggcaucuccuaaggaucagggccucuacuauuguugcaucaaaaauagcuacgguaagguuacugccgaguucaaccugacagcugagguacuaaagcagcugucauccaggcaagacaccaaagggugugaagagaucgaauuuucucagcuuauuuucaaggaggauuuucuccacgacaguuacuucggaggccgccugcgaggccagaucgccacugaggaauugcacuuuggggagggagugcauagaaaggcuuuccggagcacagucaugcacgguuuaaugccaguguuuaaacccggccaugcaugcguucugaaagugcacaaugccauugcuuaugggaccaggaacaaugacgaacucauccaacgcaacuacaagcuggccgcacaggaguguuauguccagaauacggcgcguuacuaugccaaaauauacgcugccgaagcacagccucuugagggauucggcgaggugccagaaaucauucccaucuuucugauucacagaccggagaacaauaucccuuaugcuacuguagaagaggaauugauaggugaguucgucaaguacuccauucgggaugggaaggagaucaacuuccuaaggcgcgaaucagaggccggacaaaaaugcuguaccuuucagcauuggguguaccagaagacaagcggcugccugcucguuaccgacaugcagggcguggggaugaaacugacagaugucggaaucgcaacucuugccaaggguuauaaaggcuucaaggggaauuguucuaugaccuuuauugaccaauucaaggcuuuacaccagugcaacaaauacugcaagaugcugggacucaaaaguuugcagaauaacaaucagaagcaaaaacagcccuccauaggcaagagcaaggugcagacgaacucaaugacaaucaaaaaggcggguccagaaacuccuggggagaaaaagaccuga

SEQ ID NO: 52702 - RNA, 5724 nt, Artificial Sequence
  derived and/or modified sequence opt3 from ALPK3__Homo_sapiens__NP_065829
auggagguggccuggcuggucuacguucucggccagcagccccuugcucggcagggggagggacagagcaggcuggugccuggucggggcuugguauuauggcugccagggcucccgcgcuccucucccucauggccugcaguggaccucgccccacuggcgcccgcucgaccucguggaccacuuaucugccacaccggccacgagcaggccgguagagaacccgggccuggaaguagcacuaagggcccaguccugcacgaucaagacacuaggugugcauucuugccgcggcccccuggcccacuccagacgcgcagauauugcaggcaucaggggcggcagggauccggucugggcgccgggcccggagcuggcaccugggccccugcaccacccggugugucuaaaccgcgcuguccugggcgagcuagacccggagagggccaacagcagguuacaacugccaggcccccugcgauuaaccggggcgcacgucagccccgcgccggggcugccgcagcuggaagagguccaggcgccggggcguggaggaccggagaagccgcagcuucggccggccccgcugugggugaagggggcgccaugggaucacggcgagcaccuagccgcggcuggggagccggagguagaaguggcgcugggggagauggcgaggacgaugguccagucuggauaccgucccccgcgucuaggagcuaccugcucuccgugcggccugaaacaucauuaaguagcaaucgccugucucacccauccucagggagaagcaccuuuugcaguaucauugcacaacuuacugaggaaacacagcccuuguucgagaccacgcugaagucuagguccguaagcgaggacucggauguucguuuuacuuguaucgugaccggcuauccugaaccagaggucacaugguacaaagacgauacugaacuagaccgguauugcggacuccccaaguacgagauuacccaucagggcaaccgacacacacugcaacuuuauagauguagggaagaggaugccgcuaucuaccaggccucugcacaaaauuccaaagggauagugucaugcaguggagugcuggaggucgguaccaugacggaauacaagauccaccagcgcugguucgccaaguugaaacggaaggcugccgcaaaacucagagagauugaacaaagcuggaagcaugagaaagcgguuccgggcgaaguggacacucugaggaaguuauccccugaucgcuuucagcgaaagcggcgucugucuggggcucaggccccaggacccagcguaccuacaagagagcccgagggcgguacccucgcagccuggcaggaaggggagacugaaacagcucaacacucaggccuuggacugaucaacaguuucgccuccggcgaggugaccacgaauggggaagcagcuccagagaacggagaggacggcgaacaugguuugcuaaccuauauuugugacgccauggagcuggggccucagagggcgcucaaagaagagagcggagccaagaaaaagaaaaaggaugaggaaucuaaacagggccugcgcaagcccgagcuugaaaaggcugcacagucacggagaaguagcgagaauugcaucccauccucugacgaaccggauucgugugguacacaaggcccugucgggguggagcagguucagacucagcccaggggacgagccgcucgcggcccagggagcuccggaaccgacucaacacggaaacccgccagugcagugggcacuccugauaaggcgcaaaaagccccaggucccgggccuggacaggaggucuacuuuucucugaaggacauguauuuggaaaacacccaggcugugagaccgcucggcgaggaagguccacaaacacugagcguaagggcccccggcgaguccccuaaagggaaggcaccauuacgugcucgcucagaaggaguucccggcgccccugggcagccgacccacagccugacuccccagccaacgcggccuuucaauagaaagagguuugcacccccaaaaccuaagggagaggccacaaccgauucuaaacccauauccagucuaagccaggcuccagagugcggcgcgcaaucucucgguaaggccccgccucaggcauccgugcagguccccacuccacccgcucgacggcgccacgggaccagagacucaacacugcagggacaagccggccauaggaccccuggugaagugcuugagugccagacuacaacggccccaaccaugagugcuagcucguccucugaugucgcaagcauuggcgugucaacaagugggucccagggaaucauugaacccauggacauggagacacaggaagauggccggaccucugccaaccaacgaacagggagcaaaaagaauguucaggcggacggaaagauccagguggacggcagaacucgcggugaugggacccaaacggcucagaggacccgugccgaccggaaaacacagguagaugcaggaacucaggaguccaagagaccucaaucagacaggagcgcccagaaaggcaugaugacccagggccgcgcugagacacaguuggaaacuacccaagcaggggagaagauccaggaagaucgaaaagcccaggcggacaagggaacgcaggaggauagacggaugcaaggugagaagggcaugcagggggaaaaaggaacacagagugagggcucugcuccgaccgccauggaaggucaguccgagcaagaagucgcaacuagccuggggccacccucgaggacaccuaagcuaccaccaaccgccggaccucgcgcuccccugaacauugaguguuucgugcagacuccagagggcucaugcuuuccuaaaaagccgggcugucuuccccguucugaagaggccguugugaccgcaaguagaaaucacgaacagacaguccuggggccauuguccggaaaccucaugcugccugcucaacccccacaugaggguagcguggaacagguaggcggggagcggugcaggggaccucagucuagcggccccguggaggccaaacaggaagacuccccguuccaauguccaaaggaggaacgcccuggugggguucccugcauggaucagggaggcuguccauuagcgggccugucacaggagguccccacgaugccuagucuaccggggaccggacucacugccagccccaaagcagguccaugcucuacaccuaccucccagcacggcucaacagcuacuuuucugcccagugaagaccaagugcuuaugagcuccgccccuaccuugcaucuggggcucggaacgccaacacagucucaucccccugagaccauggcuacuucgagcgagggcgcaugugcccaggugccagaugucgaaggucgaacccccgggccgagaucaugcgacccuggacugauagauuccuuaaagaauuaccugcuuuugcuccugaagcuaaguucuacagagacuagcggcgccggcggggaaucccagguuggagcugcgaccgguggccuggugccaucagcaacacucacgcccaccguggagguagccgggcugucuccucggacuagcaggcgcauccuugagagagucgaaaacaaccacuuggugcaaagugcucagacacuguuacucuccccauguaccagcaggcggcugacuggacuucuggaccgugagguucaggccggccgccaagcauuggccgcugcgcgagguucuugggggcccggaccgucaucccucacagugccugccauugucguggacgaagaggaucccggccuggcaagugaaggcgcuagcgagggggagggagaaguuucgccagaggguccuggccuacugggggccucucaggaauccagcauggcaggaagacucggcgaggccggugggcaggcugcccccggccagggaccaucagcggaaaguaucgcacaagagcccucucaggaggaaaaauucccuggcgaggcccugaccgggcuuccagcugccacgccggaagaguuggcucugggagcaaggcggaagcgcuucuuacccaaagugagagccgcuggugacggcgaagccacuaccccugaggagagggaauccccaacaguaagcccccgggggccucgaaagucacucgucccaggaagucccggcaccccugguagagagcgcaggagcccgacucaggggcggaaagcauccaugcuggaagugccacgugcggaggaggaacuugccgcuggcgaucugggacccucuccuaaggccggcgggcuagacacagagguggcacucgaugaaggaaagcaggagacccuggcuaaacccagaaaggccaaagacuugcugaaggcaccacaagucauaaggaaaauucgcguugaacaguuuccugaugccagcgguuccuuaaagcucuggugccaguucuuuaauauccugucagacucugugcuuacaugggcuaaggaucagcggcccguaggcgagguggggcgaagugcgggagacgagggcccagccgcacuggcuaucguccaagccucgccgguggauugcgguguuuauagauguacuauucauaacgaacacgggagcgccuccaccgacuucugcuugucuccugaggugcucucaggcuuuaucagcagggaagagggagaagucggcgaggagauugaaaugacgcccaugguguucgcaaaagggcuggcugauuccggauguuggggcgacaagcuauuuggucgccugguuagugaggaacuuagagggggcggguacgguugcggccucagaaaagccucucaggcgaaggugauauaugggcuggagccaaucuucgaaagcggacguacauguauuaucaaagucucauccuugcugguauuuggccccaguagcgagaccucuuuaguggggaggaauuacgacguuacuauccagggaugcaagauucagaacaugucccgggaguacuguaagauauucgcugccgaagcacgcgccgcuccuggcuuuggugaggugccagaaaucauuccccucuaucugaucuaccgaccugcaaauaacauuccguaugccacccuugaggaggaucuggggaaaccauuggaaucauacugcagcagagaguggggaugugcggaagcucccacagccucgggcucuagugaggcaaugcaaaagugccagacuuuccagcauuggcucuaucaauggaccaaugguuccuuucuggucacggaccuagccggcguggauuggaaaaugacagacguacagaucgcuaccaagcugaggggguaccagggacuuaaagaaagcuguuucccugcccuccuggaucgguucgcaucaucccaccagugcaacgcuuauugcgaguuguuaggccugacuccacucaaggggcccgaggccgcgcacccucaagccaaagcaaagggaucuaagagccccagugcuggccgcaaagguucccagcugagcccacagccgcagaagaaagggcuuccuucuccccaaggaacaagaaagucagccccaaguuccaaagcaaccccucaggcuagcgaacccgugacuacacagcuguugggccagccaccuacccaagaggaaggcucuaaggcccaggggaugagguga

SEQ ID NO: 52703 - RNA, 1608 nt, Artificial Sequence
  derived and/or modified sequence opt3 from ALPP__Homo_sapiens__NP_001623
augcugggccccugcaugcuccuucuguuguuacugcuagggcucagacugcagcuuagccugggaaucauuccuguggaggaagagaacccagacuucuggaauagggaagccgcugaggcauugggugccgcgaagaaacuccaaccggcucagaccgccgcaaagaaccugauaaucuuucugggcgaugggaugggagucuccacaguuacugccgcucggauucucaaaggccagaagaaagacaaguuaggucccgaaaucccucuggcaauggaucgcuucccauacguggcccuuucuaagacguauaauguagacaaacacgugcccgauucaggggcuaccgccacagcguacuuguguggagucaagggcaacuuucagacuauuggccugagugcagccgcucgauucaaucaaugcaacaccacacgugggaaugaggugaucagcguuaugaacagagccaaaaaggcaggaaaauccgugggugucgugaccacuacaaggguacagcaugcuucuccugccggcaccuaugcgcacacgguuaaucggaacugguacucggacgccgaugugccagcaucagcucgccaggaggggugucaggacauagccacucaacuaaucagcaauauggauauugacgucauccucggaggcgguagaaaguauauguuuaggauggggacccccgauccugaauacccagacgauuauagucagggaggcacacggcuggacggcaagaaccuugugcaggaguggcuggcuaaacgccagggggcccgauacguguggaauagaacugaauugaugcaagcaucccucgacccgucugucacccaucugaugggauuauucgagcccggugauaugaaguacgagauucacagggacagcacacuggauccuucccucauggaaaugaccgaggccgcgcuucggcuguugucacguaacccacgcggcuuuuuccuauuuguugaagggggaagaaucgaccauggccaccacgagaguagggcuuaucgggcacugacggaaacuauaauguucgaugacgccauugagcgagcuggucagcucacaagcgaggaagauacccugucucuugugacugccgaccauucccacguauuuucauucgggggcuacccccugcgcggaagcaguaucuuuggcuuggcaccugggaaagccagagauaggaaggcuuauacagugcuccuguacggaaaugguccaggcuaugucuuaaaagacggggcccggcccgaugugaccgagucugaauccggaagcccggaguaccgccagcaaucggcaguuccucuggacgaagagacgcaugcgggcgaggacguggcugucuucgccagagguccccaggcacaccuagugcacgggguacaggaacagaccuucauugcccauguuauggcuuuugccgcaugccucgagccauauacagcuugugaucuggccccucccgcgggcacuaccgacgccgcucacccaggaaggucugugguccccgcacuuuugccucugcucgccggcacacugcuucuguuggaaacugcuaccgccccauga

SEQ ID NO: 52704 - RNA, 1599 nt, Artificial Sequence
  derived and/or modified sequence opt3 from ALPPL2__Homo_sapiens__NP_112603
augcagggccccugggugcugcuccuucugggguugagauuacaacugagccuaggaaucauuccugucgaggaagagaacccagacuucuggaauaggcaggccgcugaagcacucggugccgcgaagaaacugcagccggcucagaccgccgcaaagaaccuuauaaucuuucugggcgaugggaugggaguuuccacagugacugccgcucggauuuugaaaggccaaaagaaagacaagcucggucccgagacguuccuggcaauggaucgcuuuccuuacguagcccugucuaagaccuauucaguggacaaacacgucccagauaguggggcuacagccacugcguaccucugcggagugaagggcaauuuccagaccaucggcuuaagcgcagccgcucgauuuaaccaguguaauacaacccgugggaacgaaguuauuuccgugaugaauagagccaaaaaggcaggaaaaucugucggugugguaacuacaaccaggguucagcaugcuucgcccgccggcgcguaugcccacacggugaaccggaauugguacucagacgcagaugucccugcuagcgcccgccaagaggggugccaggacaucgcuacucagcugauaaguaacauggauaucgacgugauucuuggaggcgguagaaaguauauguucccaauggggacccccgauccugaguacccagacgauuauucccagggaggcacaagguuggacggcaagaaucuggugcaagaauggcuagccaaacaucagggggcacgguacgucuggaaccgcacugagcuccugcaggccucucuugacccgagcguuacccaccugaugggauuguuugaacccggugauaugaaguacgagauccaucgagacuccacacucgauccuucacugauggagaugaccgaagcugcguuacugcuccuuaguagaaauccaaggggcuucuuucuguucguggaagggggacggauugaccacggccaccaugagagccgugcauaucgcgccuugacggagacuaucauguuugaugacgcuauagaaagagccggucaacuaacaucugaggaggauacccugucccucguaacugcagaccacucacauguguucagcuuugggggcuacccccugaggggaaguucuauuuucggccuugccccugggaaagcucgggaucgaaaggccuauacaguccuguuguacggaaacgguccaggcuaugugcucaaagacggggcacgccccgauguuaccgaauccgagagcggaucgccggaauacagacagcagucugcggugccucuggacggcgagacgcacgcuggugaagacgucgccguguucgcaagggggccccaggcccacuuaguacauggcguucaagagcagaccuuuaucgcucacgugauggccuucgcagcuugucuggagccauauacagccugcgaucuagcgccucgggccggaacuaccgacgcugcacaucccggcccauccgucgugcccgcccuccugccucuuuuggcugggacacugcuccugcuuggaacugccaccgcaccauga

SEQ ID NO: 52705 - RNA, 2862 nt, Artificial Sequence
  derived and/or modified sequence opt3 from ALS2CL__Homo_sapiens__NP_001177636
augugcaaccccgaggaagccgcucugcucagacuugaggaaguguucagcgcaacccuggcccacgucaauuccuugguuuuacagccucugcuaccagcggcuccggaccccucugauccuuggggcagggagugucuccggcugcuucaacagcugcauaagucaagucagcaguugugggaagugacagaggagagccuccacucccugcaagaacgccugcgauacccagacucuacugggcucgagucguuacugcuuuugcguggagccgauagaguacugcaggcacauaucgaauauauugagucauacacgagcugcauggugguccaggccuuucagaaagcugcaaagaggcggagugaguauuggcgcggucaaagaaaagcccuaaggcagcuccuguccggcgugucuagcgaaggguccguuggagcuucacuuggccaggcccugcaccagcccuuggcgcaucacgugcaacaguacguccuccuguuacugagucucggugacaccauaggggagcaccauccuacacgggaacuugugguaaacgcaguuacucuguucggaaauuugcagagcuuuaugaagcaagagcuagaucaggccguggcuacccaggcccuguggcacacacuccgcggccgacugagagacguccuuuguaccccagcacauaggcuguugcaggauucucaagacgugcccgugacugucgcuccucuccgggccgaacguguucuguuauucgaugacgcgcuggugcuacuccagggccacaacguacacacauuugaucugaaacuugugugggucgacccagggcaggauggaugcaccuuccauuugcugacgccggaggaggaauuuuccuucugugccaaggacucacagggucaagcaguguggcaguggaagguuacuugggcugugcaccaggcccuccauggcaaaaaggacuuucccguccugggggcuggacuugagccuagccagccacccgauugccgcugugccgaauauaccuuccaagcagagggcagacugugccaggccacauacgaaggugagugguguagggggcggccucacggaaaaggcacuuugaaguggccagacggccgaaaucauguggggaacuuuugccagggacucgagcacgguuucggcauccgccuguuaccccaggcuagugaagauaaauuugacuguuauaagugccacuggagagaggggucuaugugcggauacggcauuugugaauacuccaccgaugagguauauaaggguuacuuccaagaagggcugaggcauggcuucggaguucuagagagcggcccgcaggcgccucagcccuuucgguauacagggcacugggagcgcggacaaagaucggguuacggcaucgaagaggacggggauaggggagaacguuauauuggcauguggcaggcaggucagcggcaugggccaggcgugauggucacccaggccggagugugcuaccaaggcacguuccaggcugacaaaacugucgggccuggaauccuccugucugaggaugacucccuuuaugaggguacauuuacccgagauuugacucugaugggcaaggggaaagugacauuccccaauggauuuacccucgaaggcucauucgguaguggggccggcagaggacugcacacgcagggcguuuuagacaccgcagcccugccacccgacccuagcuccacauguaagaggcagcuuggggugggagcuuuuccaguagagucucgcuggcaaggcgucuacagcccguuccgggauuuugugugcgccgguugucccagagacuugcaggaagcacuccugggguucgauguucagucaaguagggagcuacgccgaucccaggacuaccugagcugcgaacggacucacccugaggauucugugggaucaauggaggacauacucgaggaacugcuucaacaucgugaaccaaaagcguugcagcuguauuuaagaaaggcucucaguaacagccugcacccccuuggcaaacuguugaggacccucaugcugacauuucaggccacuuacgccggugucggcgcaaauaagcaucuacaagagcuggcucaggaagaggugaagcagcacgcccaggagcucugggcagcuuaucgcgggcugcuucggguagccuuggaaagaaaaggacaagcgcuggaggaagaugaggacaccgaaacaagggauuuacaggugcauggccucguucugccucuuaugcugccauccuucuacucugagcuauuuacccucuaucuguugcugcacgagcgagaagacucguucuacagccaggggaucgccaacuuaucccucuuccccgauacucagcugcuugaguuucuggacguccaaaagcacuuguggccgcucaaagaucugacgcuaacaucaaaucagcgcuauagucuggugcgggacaaguguuuccuuucugcuaccgaaugccuccagaaaauuaugacuaccguggacccuagagagaagcuggaggucuuggaaaggacauacggagagaucgaaggcaccguuagccgugugcugggucgcgaguacaaguuaccaauggaugaccuccugccccuucugauuuaugugguaucccgggcaagaauccagcauuugggggccgaaauacaccucauuagggauaugauggacccuaaccauacuggaggccuguacgauuuucuacugacagcucuugagucauguuaugagcacauccaaaaagaagacaugcgacuccaucggcugcccggucacuggcacagccgcgaguugugguga

SEQ ID NO: 52706 - RNA, 1269 nt, Artificial Sequence
  derived and/or modified sequence opt3 from ALS2CR12__Homo_sapiens__NP_001120863
auguaccccaacccucugaucuauugcaccuguugggacccauggaaucucggcccgagaaaacuuauuaaaacaccccagcugccuaggaagaacagcacuggguccucuaaauugacgccauuagugcccgccccuaagaaucacaacuaccugcaaccaaccaaacccgucguuucaccuaagaugaagauacauagugcucggcaggaggaaacaaauaagagcuucuaugaggugaucaacguauccccaggauaccagcuagugcgcaaucgagaacagauuucugucacucucggugaugagauguuugaccguaagaaaagaugggaaucggagaucccggauaagggcagguucucacggaccaacauuaucagcgaccuggaggaacaaauaagugagcuuacagcaaucauugaacagaugaaucgcgaucaccaguccgcccagaaacuguugucuagcgagauggaccucagaugcgcggagaugaagcaaaacuuugaaaauaagaacagggagcugaaagaagcucaugaggccgaacuguccgagcucgagaauaacuauaaggcagccuuaaaagcugaaaagcuggcagcccaggagaaacuugaagagauggggaaggaauacaaauauuugaagaauauguuccggaccuaccaggauucaaucuacgacgagauggaggaaaaguggaguaaacagaaggcuaaauggaagaaagaugagaaguuugaacgcgagaacauucugcuacaacagaagaaaaagaugacuaaaaaguucgaaauggagagcggagaggaagacaaaaagaucaacgagucuuguuccgccguguuugaaaauuucauacaggagaaggaggaacuccugaaacaacaccagucagauacacuucagcuggaggaauugcgaaagaccaaagagguuaugcaggaggaacuccaugcgcaagcacugauuuuagagagccugaacacgaaucucuauuacacucagcuugaacugcagaaggagaaagccaucgugggcaacuuggaaaagaugcuacagaccaaguuugcugagacagaagagaaauauaagcacacuauucaaauccugaccgaggaaaauauccaccucaaacagaagauuauaaguaaaaacgaggaaaucugcgaggguuguucugggagacuggccuccauuacagucagcaaggacgauucggacaccgugcaggacggaucuaaaaagggccaggaauccuga

SEQ ID NO: 52707 - RNA, 1191 nt, Artificial Sequence
  derived and/or modified sequence opt3 from ALS2__Homo_sapiens__NP_001129217
auggacagcaagaaaagauccucuaccgaggccgaaggcucaaaggagagggggcuggugcacaucuggcaggcuggaaguuuccccauuacaccugaacggcucccagguuggggcgggaaaacuguccuucaagcagcccugggaguuaagcauggcguguuguuaacggaggauggugaaguauacagcuuugggacccugccguggcgcuccggacccguggagauaugcccuucuucgccaauccuagagaacgcgcucgucggccaguaugugauuacaguugcuacuggcucauuccacagcggggccgugaccgacaauggagucgcauacauguggggugaaaacagugccggccagugugcuguggcaaaucagcaauauguacccgagccuaacccaguuuccaucgccgauucugaagcuagcccccugcuugccgugcguauucugcaguuggcgugcggggaggagcauacacucgcacuguccaucucacgagaaauaugggccuggggaaccggcugucagcugggucucaucacuacagcuuuuccugucaccaaaccacagaagguggagcacuuagccgggagagugguccugcaaguugcaugcggagcuuuccauagucuugccuuggugcagugucugccgagccaggaccuaaagcccguaccugaaaggugcaaucaguguucucaacuccugauuacgaugacugauaaagaggaccacgugaucauuuccgauucacacugcuguccacuuggcgucacccugacagaaagccaggcggagaaccaugccaguacugcauugucucccuccaccgagacacucgaccggcaggaagagguguuugaaaauacccugguugcuaacgaucaaagcguggccacggaguuaaaugcugucucggcccagaucacuucuuccgacgcaaugucaagucagcagaacgugaugggcacaaccgaaauaagcuccgcccgcaauauuccuucuuacccagauacucaagcuguaaacgaguaucugagaaagcucagcgaccacucaguuagggaggauagugaacauggggagaaacccgugccgucccaggucccugcgcaguucuacaagaucaaagugugccuugaacugaauuguaugggauuuagcuuggagacacuaaaguga

SEQ ID NO: 52708 - RNA, 981 nt, Artificial Sequence
  derived and/or modified sequence opt3 from ALX1__Homo_sapiens__XP_005269222
auggaguuccugagcgaaaaguuugcccucaaaucucccccuuccaagaacucagacuucuacaugggcgcugggggaccacuugagcacgugauggaaacccuggauaaugagaguuuuuauagcaaagcauccgccgguaagugcguccaggcguucggcccguugcccagagcugaacaucacguuagguuagagcggacaucuccuugucaagacucgucagugaacuacgggaucacuaaaguagagggacagccacugcauacggaacuaaaucgcgccauggauaacugcaauagccuccgaaugagucccgugaagggcaugcaggagaagggugaacuggacgagcuuggggauaaaugugacuccaacgucucuagcuccaagaaacguagacacaggaccacauuuacuucacugcaguuggaggaacucgagaagguguuccagaaaacccauuauccugauguuuacgugcgggaacaacuggcacugcgcacagagcucaccgaagccagaguccaggugugguuucagaauaggcgggcuaaguggcgcaagcgagagagauauggacaaauucagcaggcaaaaagucacuucgccgcuacuuacgacauaagcguauuaccaaggacagauucuuauccccagauccaaaacaaucugugggccggcaacgcguccggcgggucaguugugaccagcugcaugcuuccucgggacacgaguucuuguaugacuccauacucccacagcccgcguaccgauucgucuuacacaggauuuuccaaucaucagaaccaguucucacacguccccuugaauaacuuuuucacugacagucugcuaaccggugcaacaaauggccaugccuuugagaccaagccugaguucgaacgcagaagcuccucuauugcugugcucaggaugaaagccaaggaacacacggcaaacaucagcugggcuauguga

SEQ ID NO: 52709 - RNA, 1236 nt, Artificial Sequence
  derived and/or modified sequence opt3 from ALX4__Homo_sapiens__NP_068745
augaacgccgagaccugcgugagcuacugugaaucccccgcugcagccauggacgcguauuacucuccugucucacagaguagagagggcagcuccccauucagggcuuuucccgggggagauaaguucgguacaacuuuucugucugccgcagccaaagcucaaggcuucggggacgcaaagucgcgggcccgcuauggagcuggccagcaggaucucgccacgccccuugaaucaggugcgggggcacgaggcagcuuuaauaaauuccagccucaaccaaguaccccgcagccucagccacccccucagccacaaccgcagcagcagcaaccccagccucagccacccgcccaaccucaccuguacuugcagcguggagcuugcaagacaccacccgacggcuccuuaaaacugcaggaggggucuagcggacauuccgccgcacuacagguuccguguuaugcuaaggaaucaagucucggugagccugagcugcccccagauagcgacacugugggcauggauucuuccuaccuuucaguaaaggaagccggggugaaaggaccucaagacagagcgagcagugaucugcccucuccauuggagaaggccgacuccgaaagcaacaaaggcaagaaaaggcggaaucgcaccacauuuaccucguaucagcucgaggagcuggaaaaggucuuccagaagacucacuaccccgauguguacgcaagagagcagcuggcuaugaggacagaccucaccgaagcccggguucaagugugguuucagaaccgccgagcuaaauggagaaagagggagcgguucggucagaugcagcaaguccguacgcauuuuucuacugccuaugaauuaccucugcuuacccgcgcagagaauuacgcccagauccagaacccauccugguuggggaauaacggagcugcgucaccggugcccgcaugcguaguuccuugugauccagugcccgccugcaugaguccucacgcucauccacccggcagcggcgccuccucugucacagacuuccugagcgugucaggggcaggaagucacgugggucagacucacaugggcucccuauuuggggccgcuagccucucuccgggacugaauggcuaugagcuuaacggugaaccugacagaaaaaccucaaguauugccgcacugaggaugaaggcgaaagagcauagcgcugccauauccugggcaacauga

SEQ ID NO: 52710 - RNA, 795 nt, Artificial Sequence
  derived and/or modified sequence opt3 from ALYREF__Homo_sapiens__NP_005773
augcccgacagcgccccugcuauggcagauaagauggacaugucccuggaugacaucauuaaacucaacagaucucagaggggcgggcggggagguggccgcgggcgaggacgugccggcucacaaggugggagaggaggcggcgcgcaggcugccgcaagggugaaucggggaggggguccaauacgcaacagaccggccaucgcuaggggcgcagccgggggaggcggucggaaucgccccgcuccuuacagucgaccaaagcagcuucccgauaaauggcagcacgaccuguucgauagcggguuuggaggcggcgccggggucgagaccggagguaaguuguuaguuuccaaccuggacuucggcgugucugaugcggacauucaagaacuauuugcagaguucgggacacucaaaaaggccgcuguacauuaugauagaucgggaaggucacugggcacugccgacgugcacuuugaacggaaggcagaugcucuuaaagccaugaagcaguacaauggugucccucuggacgggcguccaaugaacauccaguuggugacgagccagauugacgcgcaacgcagacccgcccagaguguuaauaggggcggaaugacccggaaccgaggcgcagggggauucgguggcgggggaggcacacgcagagguacuaggggcggggcucggggacgcggcagaggggccggacguaauuccaaacagcagcucucugcugaggaacuggaugcccaacuggacgcauauaacgccaggauggauaccagcuga

SEQ ID NO: 52711 - RNA, 1185 nt, Artificial Sequence
  derived and/or modified sequence opt3 from AMACR__Homo_sapiens__NP_001161067
auggcccugcagggcaucagcguggucgagcucuccgggcuugcucccggaccuuucugcgcaaugguucuggccgacuuuggugcgagagugguaaggguggaucggccaggcucucgcuacgacgucucacgauuggggcguggaaagagaaguuuagugcuggaucuaaaacaaccgaggggcgcugccguucuccggcgccuguguaagagaagcgacgugcuucuggaacccuucaggcggggugucauggagaaauugcagcucgggccugaaauucugcagcgcgagaacccacgacugauauaugcaagacucuccggauuuggccagucuggcucguucugcagguuagccgggcacgauaucaauuaccuggcucuuucaggaguguugagcaagauuggucggaguggcgaaaaccccuaugcaccucugaaucuacucgccgacuuugcugggggaggccugaugugugcccuugguaucauuauggcgcuguucgaucguacccgcacagggaaaggacaaguaaucgacgcaaacaugguugagggcacugccuacuuguccucuuuucucuggaagacgcagaagcugagcuuaugggaggcuccaagaggccagaauaugcuggaugggggagcccccuucuauaccacauacaggacugcagacggugaauuuauggcugugggcgccauagagccucaguucuaugaacuccuuaucaaagggcugggauugaaguccgaugagcuaccaaaccaaaugucaauggacgauuggccggagaugaaaaagaaauuugcggacgucuucgccgaaaagaccaaggcagaguggugccagauuuuugacggcacagaugcuugugugacccccgugcugacuuucgaagaggucguucaucacgaccauaauaaagaacgggguaguuucaucacaagcgaggagcaggaugugucuccucgaccagcuccccuccugcuuaacaccccugccauuccauccuuuaagcgcgaccccuucaucggggaacacacggaggaaauacuggaggaauuuggcuucucaagagaggagauuuaccaguugaauagcgauaaaaucauugaaaguaacaaggccggaucuaaauuuuggauccucuacccgacucauuccaauauccaaaaguga

SEQ ID NO: 52712 - RNA, 1344 nt, Artificial Sequence
  derived and/or modified sequence opt3 from AMBN__Homo_sapiens__NP_057603
augagcgccuccaagaucccccuguucaaaaugaaggaccucauucuuauacugugcuuguuagagaugucuuuugcugugccuuucuuuccacagcaaucaggcaccccggggauggcaagucugagccuagaaacaaugagacagcucggaucccugcagaggcuuaacacucugucucaguacucgcgguaugguuucggcaaaucauuuaauagcuuguggaugcacgggcuccugcccccucauaguucccugccauggaugcgcccccgagagcacgaaacgcaacaguacgaguauucucucccuguccauccacccccuuuaccaagccagccgucccugaagccccagcaaccuggacuuaaaccauucuugcagucagccgcggcuaccacaaaccaggccacugcacugaaggaagcccuacagcccccuauccaccucggccaucugccacuucaagagggugagcugcccuugguucagcagcaaguggcuccgagugauaagccucccaaaccagaacucccugggguagacuuugcagauccccagggaccaagccugcccggcauggacuucccugauccacagggcccgucuuuacccgggcuggacuuugccgauccucagggauccaccauuuuccaaaucgcucgucucauuucacacgguccaaugccccagaauaagcagagcccucuuuacccaggcaugcuguaugugcccuuuggggccaaccaguugaaugcgccggcaagacuaggaaucaugaguucugaggaagucgccggcgguagggaggacccuauggcuuacggggccauguucccaggauuuggcggcaugcggcccggguucgagggaaugccucacaaccccgcaauggguggcgauuucacacuggaauuugacuccccaguggcugccaccaaagggccugagaaugaagagggaggcgcgcaagguagccccaugccagaagccaacccggauaaucucgagaacccugcauuccugacugagcuugaacccgcuccacaugccgggcuguuggcucuccccaaggacgauauaccuggccugccacgcucgcccucuggaaaaaugaagggcuuaccuuccguuacaccggccgcagccgacccacugaugacccccgagcuagcugacguguauagaacguacgaugcggacaugacuaccucagucgauuuucaggaagaggcaacaauggacacuaccauggccccuaauagucuccagacaagcaugccagggaacaaggcucaggaacccgagaugaugcacgaugccuggcauuuccaagagccuuga

SEQ ID NO: 52713 - RNA, 1059 nt, Artificial Sequence
  derived and/or modified sequence opt3 from AMBP__Homo_sapiens__NP_001624
augagaagccugggcgcccuccuucuguuguuauccgcuugccuggcagugucugccgggcccgucccuaccccaccggacaacauccagguucaagagaauuucaacauuucaaggauauacggaaagugguauaaucuagcgaucgguaguacaugucccuggcucaaaaagauuauggaucggaugacugugagcacgcugguacuuggcgaaggggcuaccgaggccgaaaucuccaugacaucuacucgcuggcgaaaaggagugugcgaggaaaccucgggcgcauacgagaagacagacaccgaugguaaauuucuguaucacaagucaaaguggaacauuacuauggagagcuacgucgugcauacaaauuaugacgaauacgccaucuucuugaccaaaaaguuuagucgucaccaugggccuacgauaacugcuaaacucuauggcagagcaccacagcugagggagacccugcuccaggauuuccggguuguggcccagggagucggcauccccgaagacuccauuuuuacaauggcugaucgcggggagugugugccuggagagcaagaaccagagcccaucuuaauuccuagaguaaggcgggccguucugccacaggaagaggaagguucuggcgggggacagcuugugacugaggucaccaagaaagaggacagcugccaguugggcuacuccgcggguccguguauggggaugacaucacgcuacuucuauaacggaaccaguauggcaugcgaaacguuucaauacggcggcuguauggggaauggaaacaauuucgugacugagaaggaaugccugcagacaugucgaaccguggccgcuugcaaccuacccaucgucagagguccuuguagggccuuuauacagcucugggcauucgaugcuguuaagggcaaaugcgugcuguuuccauaugggggaugccagggcaaugguaacaaguucuacagcgagaaagaaugucgggaguauugcgggguacccggcgacggagaugaggaacuucugcguuuuucuaauuga

SEQ ID NO: 52714 - RNA, 3906 nt, Artificial Sequence
  derived and/or modified sequence opt3 from AMBRA1__Homo_sapiens__NP_001254711
augaaggugguccccgagaaaaacgccguuagaauccuguggggcagggaacgcggggcucgggcaaugggagcccagcgacuccuucaagagcugguggaagacaagacccguuggaugaaaugggaggguaagagaguagaauugccugauagcccaagguccacauucuuacuggcguuuucuccggaccggacucuacucgcuucaacgcacgugaaucauaacauuuacauaaccgaggucaaaacaggcaagugcgugcacagucugaucgggcaucgcagaacucccugguguguuaccuuccacccuacaauuagcggacuuaucgccuccggcugccuggauggugaggugaggauuugggacuugcaugggggaucugaaucgugguuuaccgauucaaauaacgcaaucgccagccucgcuuuccacccaacugcacagcugcugcucauagccacagcuaaugagauccacuuuugggacuggagucggcgcgaacccuucgccgucgugaagaccgcguccgagauggagcgaguaagauuaguuagguuugauccucugggccauuaucuuuugacggcaauugugaacccaucuaaucagcagggcgacgaugaacccgagaucccuauugacgggacugaacugagccacuaccggcaacgugcccuacuccagucccagccaguccgcagaaccccgcugcuucauaacuuccugcacauguugucaaguaggagcucuggaauccagacagagcccuuucacccuccagaacaggcuuccucaacucaacaggaucagggucuccugaaucggcccagcgccuucaguaccgugcaaucuuccacagcaggcaacaccuuacgaaaucugagccucgggccuacgcgcagaucgcuuggaggcccacugucuucccaucccucaagguaucaccgggagauagcuccggguuugacugggagugaguggacacgcaccgugcuaagccugaacuccagaucugaagccgagagcaugccucccccaaggacuucagcgaguuccgucagccuccugucuguucuucgucagcaggaaggaggcucacaagccaguguguacacaagcgcaaccgagggccggggguuuccugcuuccggacuggccacggaaucugacgguggcaaugggucgagccagaacaauuccggaucaauucgacaugaguugcagugugaucucagaagguucuuucuggaguaugaccgcuuacaggaacuggaccaaagucuaucuggcgaggcuccccagacccagcaggcccaagaaaugcucaacaacaauaucgagagcgaacggccaggucccucccaccagccuacaccacauucaagcgagaacaauucuaaccuguccagagggcaccuuaauaggugccgcgcaugucacaacuugcugacuuucaauaacgauacccuccgaugggagcggacaacuccgaauuacaguagcggcgaagccucuuccucauggcagguacccaguagcuucgagucggugccuuccucuggaagccagcugccaccccuugaacguaccgagggccaaacaccuucaaguuccagacuggaguugucuagcuccgcuucaccacaggaagagaggaccgucgggguggcguuuaaccaggaaacuggacauugggagcgcauuuauacgcagagcagucggucugguacaguuucccaagaagcacuccaccaggacaugcccgaggagagcucggaagaggauucacugagaaggcgaucuuuagcccugaguccgcgccuagaauacuccggcgcuauccucgcccauugcaaacugcggcuuccugggagcugucacucuccagcaagcgccucccagguggcuggaaccacuggcgcccaccaucacgcaagauugaucuucgcguuucuggucgagauggaguuccaucacgugucacaagcuggucucgagcuguuaaccaguggggaccugcccacaagcgccucucaguccgcaggcauuaccggaguaucacauagggccuggccucgucuuuuggagaguagccucauaucccugucucgcuacgauggcgcugggucgcgggaacaccccaucuauccagacccugccagacuaagccccgcagcuuacuaugcccagaggaugauucaguaccugucacgacgggauuccauccgccaaagaaguaugagguaucagcagaaucggcuccgaucuagcacuuccucaucuagcagugacaaccagggaccauccguugaggguacagaucuggaauuugaggacuucgaagauaauggcgacagaagccgccacagggcgccgcguaacgcccggaugucugcuccuucacuugggagauuugugcccaggcgcuucuugcugccagaguacuuacccuaugcaggaauauuucaugagcgaggccaaccuggucucgccacgcacuccagugucaauagagugcuggcuggggccgucauuggcgacggacagagcgcaguggcgucgaacaucgccaacaccacuuaccggcuucaguggugggauuucacaaaguuugaccugccagaaaucucuaaugcuuccguuaacguguugguacagaauugcaaaauuuacaacgaugccagcugugacaucucagcagauggccaacuccuggcugccuucauucccaguucucagaggggguuuccugacgagggaauacuagcagucuauucccuggccccgcauaaucucggcgaaaugcuguacaccaagcgcuucgguccaaacgcuaucagcgugucacuuagucccauggggcguuauguuauggugggauuggcgagcagacggauucuguuacacccuuccacagagcauauggucgcccagguguucaggcuccaacaggcacacggcggugagacuucuaugcgccgaguauuuaaugugcuguacccaaugcccgcugaucagagacggcacguuagcaucaacuccgccagguggcuuccugaaccgggccuggggcuagccuauggaaccaauaaaggcgaccucgucaucugccgccccgaggcucugaacucagggguggaauacuauugggaucaguugaaugagacgguguucaccguccauucuaacaguagaucgagcgaaaggccaggaacaucccgggcaacuuggcguaccgaccgcgauaugggccugaugaaugccauugguuuacaaccucgaaaccccgcgacaucuguuacuucacaggggacccagacgcucgcucugcagcuucaaaaugccgagacacagaccgagagagaagugccagagccuggaacugcagccagcggccccggugaaggcgagggguccgaauacggagcuaguggcgaggacgcacugucuaggauacagcgguugauggccgaagggggaaugacagcggugguacagcgcgaacaaagcaccacuauggcuucaaugggcgguuuugggaacaacaucauugucucccacagaauccauaggaguagccagaccggaacagagccaggcgccgcacacacgucuuccccgcagccuucaaccagccggggucuccugcccgaagccggccagcuagcugagcgagggcugucgccaagaacugccucuugggaucaacccggaacaccuggccgcgaaccaacccagcccacacuuccuaguuccagcccggugccaauucccguuucacucccuuccgcagaggggcccacucugcacugugaguugaccaauaacaaucaucuguuagacggaggcucuagcaggggugacgcugccgggccacggggagaaccucguaacagauga

SEQ ID NO: 52715 - RNA, 918 nt, Artificial Sequence
  derived and/or modified sequence opt3 from AMD1__Homo_sapiens__NP_001274143
auggaggccgcucacuucuuugaaggcaccgagaagcugcucgaagugugguucagcagacagcaacccgacgcaaaccagggguccggagaucuuaggacaaucccuucugagucaaguauguuugucagcaaacggcgcuucauucugaagacuugcgguacgaccuuguuacugaaagcccuaguuccacuccugaaacuugcgcgagacuacuccggcuuugauucuauacagucguucuuuuauucacguaagaauuucaugaagccgagccaucagggguacccccacagaaacuuucaagaagagaucgaguuccugaaugcuauuuuuccuaacggagccgcauauuguaugggcaggaugaauagugacugcugguacuuguauacacucgauuucccagaaucccgggugaucucucagcccgaccagacucuggagauucugaugagcgaacucgauccugccguaauggaccaguuuuacaugaaggauggugugaccgcuaaagacgucacacgcgaguccgggaucagagauuuaauaccaggaucagugaucgacgcaaccauguucaaccccuguggcuauaguaugaauggcaugaaguccgaugggacuuacuggacaauucauaucaccccugagccagaguucucuuacguuuccuuugaaacgaaccugucacaaacuagcuaugacgaccuuauuaggaaaguggucgaaguguucaagccgggaaaauuuguaaccacauuguucguuaaucagaguucuaagugccggacugugcuggccagcccccagaagaucgaggguuuuaaacgccuagauugucagagcgcuauguucaacgacuacaauuuugucuucaccucguuugccaagaaacaacagcagcaacagucuuga

SEQ ID NO: 52716 - RNA, 576 nt, Artificial Sequence
  derived and/or modified sequence opt3 from AMELX__Homo_sapiens__NP_001133
augggcaccuggauccuguucgccugccuccuuggggcugcauuugccaugccccugccuccacacccgggacaucccgguuacauuaacuucagcuaugagguguugacaccuuuaaagugguaccaguccauaagaccacccuauccuucuuacggcuaugaaccaaugggaggguggcugcaccaucaaaucauucccguccuaucacagcagcacccuccaacucauacgcuccagccgcaccaccauauccccguugugccugcgcaacagccaguaauuccccagcagccuaugaugccagugcccggccaacacaguaugaccccgauccagcaucaccagccuaaucugcccccuccagcucagcaacccuaccagccacagcccguccaaccucagccacaccagccgaugcagccccaaccuccagugcaucccaugcagccucuuccaccccagccgccucugccacccauguuuccuaugcagcccuugccaccuaugcuccccgaccugacacuggaggccuggccaagcacugauaaaaccaagagggaagagguugacuga

SEQ ID NO: 52717 - RNA, 579 nt, Artificial Sequence
  derived and/or modified sequence opt3 from AMELY__Homo_sapiens__NP_001134
augggcaccuggauccuguucgccugccucgugggggcugcauuugccaugccccuuccuccacacccgggacaucccgguuacauuaacuucagcuaugagguccugacaccuuugaagugguaccaguccaugauaagaccacccuauucuucauacggcuaugaaccuaugggagggugguuacaccaucaaaucauuccaguugugagucagcagcacccccugacucauacgcuacagagccaccaccauaucccuguagugccagcgcaacagccgaggguccggcagcaggcucucaugcccgugccuggccaacaguccaugaccccaacacagcaccaucagcccaaucugccucuuccagcccaacagcccuuucagccgcaaccuguucagccccagccacaccagccuaugcaaccccagccacccgugcagccuaugcagccacuguugccgcaacccccucucccacccauguucccucugcgcccacugcccccgauucucccugacuuacaccuggaggcauggccagccacugauaaaaccaagcaggaagaggucgacuga

SEQ ID NO: 52718 - RNA, 3408 nt, Artificial Sequence
  derived and/or modified sequence opt3 from AMER1__Homo_sapiens__NP_689637
auggagacccagaaggacgaagccgcucaagcaaaaggcgccgcggcuagcggguccacaagagagcagacugccgaaaagggagcaaagaacaaggccgcugaggcaacggaaggucccaccucugagccuucaaguagcggcccagggaggcugaaaaagacagccaugaaacucuucggaggcaaaaaggguaucugcacucuuccguccuuuuucgggggaggccggucuaaaggcucggggaagggaucaagcaaaaagggucugaguaaguccaaaacccacgauggcuugucugaggcugcccaugggcccgaagacguggucagcgagggaacaggcuuuuccuuaccucugccagaacuacccugucaguucccuucaagucagagcgcgcacggugcacucgagaccgggucucgcugcaagacuuccguugccggagcuacagagaaagccguggcagaaaaguuuccaucaaugcccaaaccuaagaaaggccugaagggcuucuuuagcaguauucgacgucauagaaagucuaaaguaaccggggcugagcaauccgaaccaggagccaaggguccggagagggugcgggcgcgcccccacgaacaugucagcucggccccucaggugccauguuucgaggagacguuucaggcacccagaaaagaaaaugcuaacccucaggaugccccaggccccaagguuucuccgacuccugagcccuccccacccgcuaccgagaaaauggccugcaaggaccccgaaaagccaauggaagcaugugccucagcucacgugcaacccaaaccugcgccagaggcaaguagccuugaggaaccgcacucccccgagacaggggaaaaggucguggccggagagguaaauccuccaaacggccccguuggugauccucugucucucuuguucggggacgugacuagccugaaaucauuugauagucugaccggcugcggagacauaaucgcugaacaggauauggacuccaugacagauagcauggccucuggcgggcagagggcaaaucgggacggaaccaagcgcucaaguugucucgucacguaccaggguggcggggaggagauggccuuaccagaugacgacgaugaagaggaagaggaggaagaggaaguggagcuggaagaggaggaagaggaagugaaagaggaagaggaggacgaugaccuugaauauuugugggagacugcucaaauguacccccgaccgaacaugaaucugggauaucauccuacaaccagcccaggccaccaugguuacaugcuacucgaucccgucagauccuauccugggcuggcccccggcgaacuucugacuccacagucugaccagcaagagucggcaccuaacagcgaugaaggauacuaugacuccacaacccccggcuucgaggaugacucaggggaggcguugggacucguuaggcgggauugccugccacgugacaguuacucuggugacgcuuuauacgaauuuuaugagccggaugacagccuggaaaauuccccucccggcgaugacugucucuacgaucuucacgggcgcucaagcgagauguucgacccauuccugaacuuugagcccuucuugucuuccagaccuccaggagccauggaaacggaggaagagaggcuagugaccauucagaagcagcugcucuauugggaacugcggcgagagcagcuugaggcacaagaagcccgcgcuagagaggcccacgcaagggaagcucaugcccgggaggcguacacacgcgaagccuauggcagagaggcuuacgcaagggaggcccacacuugggaagcucauggucgugaggcccggacccgagaagcacaggcgagagagguaaggugccgcgaaacacaggugcgggagacucaggccagacaagagaagcccguccuggaauaucagaugaggccuuuggggccgagugugaugggccucgcugccggaguuagcggcaccucucagaucucccaccgcgggauuacaucagcauuuccaaccacugcuaguagcgagcccgauuggcgagacuuccggccucuggaaaaacguuacgagggaacguguucgaagaaagaucaguccacaugcuuaaugcaacuguuucagucugacgccauguucgagccagauaugcaggaagcaaauuuuggcgguagccccagaagggccuacccuaccuauucaccgcccgaggacccagaagaggaagagguggagaaggaagggaacgcuacugucaguuucucccaggcgcuaguggaguuuaccucuaauggaaaccucuucagcuccaugucaugcagcagugauucugacuccagcuuuacacaaaaucugccugaacuucccccaaugguaaccuucgacaucgccgauguugagcgcgacggcgaagguaaaugugaggagaacccugaauuucauaacgaugaggacuuggcagcuucgcuggaagccuucgagcucggcuacuaucacaagcacgccuucaauaacuaccauucacgguuuuaucaggggcugcccuggggagugucuagucuuccaagauaccugggcuugccggggcuccacccuaggcccccacccgcugcaauggcccugaaucgacgcucccggagcuuagauacugcggaaacacuggagauggagcuaucuaacagccaucucguccagggauaucuggaauccgacgagcuucaagcucagcaggaagauucagacgaggaggaugaagaggaagaggaaggcgaguggaguagagacagcccuuugucucuguacacggagccacccggugccuacgauuggccugcaugggccccgugcccacuccccguggggccuggacccgcuuggauauccccaaaucagcuggacaggccuucaagucaaagccccuaucgucaggcaaccuguugcaucccaccuaugacuauguccauuucuuuaucggucccggaaagccgcgcccccggcgagucagguccacagcuggcgcggccuucccaccuucacuugcccaugggcccauguuacaaccuccagccucaagcuagucagucuaugagagccaggccccgagaugugcugcuaccgguugacgaaccaagcugcuccucaucuagcgggggauucaguccuuccccucugccacaggcaaagcccgugggcaucacacaugggauuccucagcucccgcggguacgccccgagcacccacaaccucagcccacccauuauggaccuagcucucuggaccuuucaaaagaaagagccgagcagggcgcuuccuuggccacaaguuacagcucgacugcaaugaaugguaaccuggcuaaguga

SEQ ID NO: 52719 - RNA, 2016 nt, Artificial Sequence
  derived and/or modified sequence opt3 from AMER2__Homo_sapiens__NP_689917
auggagaccagcagauccaggggcgggggaggugccgugucugaacggggcggggcuggagcaucagucggcguuugccgccgaaaggccgaggcgggugcugggacaggaacucuggccgcagacauggaucuccacugugacugcgccgcugaaacgcccgcagccgagccuccaaguggcaaaaucaacaaggcugccuucaaacuuuuuaagaaacguaagagcggcgggaccaugccguccauuuucggagugaagaauaaaggugauggcaagucuucggggcccacaggacugguaagaucaaggacucaugacggcuuggcggaaguguuaguccuggagagcggucggaaagaggaaccucgcgggggaggcgauaguggcgggggagguggcgggagaccaaaccccggaccuccaagggcagccggccccggugggggcucccuagcuucuagcuccguggccaagucacacagcuuuuucagucuccugaaaaagaauggacggucugagaacggcaagggggaaccuguugacgcauccaaagcuggagguaagcagaaacgcggccuucgagggcuguuuucaggaaugagauggcauaggaaggauaaacgggccaaggcggaggccgcagagggccgugcuccaggugggggcuugauacucccgggaagccugaccgccagucuggaaugugugaaagaggaaacaccccgcgcugccagagagccugaagaaccaucucaagacgcacccagggauccugccggcgagccagcugggggagaagagguccccgcgccggcagaccgggccccugcucgauccugccgcgaagccgagggucucgcacaccccggcgauaccggggccagaggagaagacgcugccggccauaggcgggcagagccagguccuggggaggugcgcacugcggaagaugcuagcagaacaggcgccguacccguuaagaccgugccauuagucgacucggagggaggcucugggagggcacccgccgcuccugacccagccuccguggauccgcccucagacccuagugcagaucguaucugucugauguucagcgacgugacgucccuuaagucuuuugauagcuugacuggaugcggcgacauuaucgcugaucaggaagaggaagccgguccaucaugugacaaacacguccccgggccuggaaagccagcgcugaguaaaaagaaucccggcguuguggccuaccaggguggcggggaggagauggcuuccccggaugaaguagacgauaccuaucuacaggaguucugggacaugcucagccaaacagaggagcagggaccugagccacaggaaggcgcagccaaaguggcugccgcacuggagacuaaggucgugcccgaaaccccuaaggacacacggugcguugaggcggccaaagaugcuucuucagugaagcgaagaaggcuuaaccgcauucccaucgaaccacacccuaaagaggagcccaagcauccagaaaaagagcagcaagaaggggucccgaauagugacgagggauacugggauagcaccacgccuggccccgaagaggacuccucuucgagcgguaagaaggccgggauaccacgggauuccuauucaggagacgcacuguacgauuuguaugcugaccccgauggcaguccugccacucucccagguggcaaagacaacgaggaaacaucuagccuguccagauuaaagcccgugucaccugggaccaucacuuguccgcugaggacaccaggaagccuccuuaaagauucuaagauucccaucuccauuaaacaccugaccaauuugccuaguagccauccaguaguucaccagcagcccucucgcuccgagaugccucgaacgaagaucccggugucaaagguccuagugcggcgugucaguaacagaggccuggcagggaccacaauaagggccacugcuugccacgacagcgcgaaaaagcucuga

SEQ ID NO: 52720 - RNA, 2586 nt, Artificial Sequence
  derived and/or modified sequence opt3 from AMER3__Homo_sapiens__NP_001098663
auggagcugaagagaggcaaaaccuucaucaagagcucccuccaggugucucacgaaaaacccccugacccagccgcugucgcagccgcgagggaggggacaggaccguggucaguucuucccgguggccaacagcggccucauagugaaaaggggccacaggcuagccccuccgcccaggaguacgaucgcugcccuaacaaaggagcacaacuggacccaaagggcggucccgccgcuuuguguggggcaacuuuuaagccugugcgaaaaugcaagacgcacgauucuaugucgggagccggccgugcuaccgccgcgacaggccaguuaguagggucagccagcuucccaggaaguccggguuccagaaggaugauugacuaucggcauuuugugccccagaugccuuucgucccagccguggcuaaaucuauaccccgcaagagaaucagccugaaaaggccuaagaaguguuuucggaaucuauuccacauucgccgaaacaaaacugaagaucucgccucccuggcagcugagggcaagucacuuccaagucccggggacccgagcgauccuggaggcagaaggucuaaagccuuucugcccccaggugaggggccuggauuggacggccucugccaggaucugcuggacuccgaacucuuagcggaugccucauucggccugugucgggcacuuugcgaggacguugcuagcuugcaaaguuuugauucucugaccggguguggagaaguguucgccgacgaguccagcguccccucgcuagagcucaaugaagguccagagucucccacacaggcugcccagggccuggaauccaaggugccucgugggccacuucagggaucaguagagcaacuggcaaguccggcccagaacgaagcuagcgacuuuacccgcuucugggauuccguuaauagaucugugaggcagcaacagcgggcguugcucggccccuggcugagcgguccucaggggacugaccgagaucagucacgcuuagacacagcaggccuggccgagcucccacuuugccccuguagagauccuaggaguggauccaaagcuagcucuaucgacaccggcacgccaaagucagagcaacccgaaagugucagcacuuccgaugagggguacuaugacucuuuuucgccgggacuggaagaggauaaaaaggaagccgagagcccugguaccccagcagccacauucccccgggacuccuacucaggcgaugcuuuguaugagcuauuccaugacccuagugaagggccccugggaccaucuccugacgaugaccucugcgugagcgagucccugucaggccccgcccuugguacuccacugagcauuuguucuuuucgcgugggggcagaagagaacuuggcgccggcuccuggccccgaucuccugucccagggauucuuacagaguagcuggaagggcaaagaaugccugcuaaagcucugcgacaccgagcuggccaucacaauggggauagucucuuggcuuagaaggggaccaacgccccgugcaccuccaacccccggucagccugccgcuccgccaggcucccaaggggcaccccgggcaccuacugagaaauugggaggccgagaaggucuggcuucagaugccgggggcgcgacaguuuguagugccccaagcagacaggagcucugggcucaccccggaaccacuggccugcuugcaggggaaucgaaggcccugggaggcgcuacacaggguaccgggacguuguccagggacgccucucgcgaggaggaaacccggggacacagcgagggccucuuuucaaguauggaauccgcagcgacaucuacuaccgauacaagcgguaaaaauaaggccccugugccguccacuuggcccugcucacagaaggagccaggcccucccgggguacugggauguuucagaggcccauggaggccugggcauggaggcgacaccuuagaugcugaacccaugcuggccgguugcguggcacgcgucgcugcccuaaaaaucagcaguaacgagcaaccaccggcagccuggccuccccgacaggacauggggucuggacucuuuggccagcggugggcucgugguccagauaugcuggagcagaagcaauccagcucgucacccucuaugacaaccauucacggccuuccuuacagugcguccacucaggaccagagauguagggaucgcgugcaagacuugagcuggcugcggguugaaccaacggggcucggagugcaggccugggcaucugucgaggaccagccccugcaguuaagcacagaagcuguggagcaaguagcccauggcucccagcuggauucagaaccuagaagugccccggcugcaagguggagcucucaggggcaccacccagagucccuuggauugacccucaauucacagcaagagggcgguguuagugccagcgcgcccgaaugccgauguucccugcuagcucgcgaggggcugcucugcggacagccugaagugggcgccucuggucccgcaauggccgagccacaucuguga

SEQ ID NO: 52721 - RNA, 1932 nt, Artificial Sequence
  derived and/or modified sequence opt3 from AMFR__Homo_sapiens__NP_001135
augccccuccuguuccuugagagauuuccuuggccaagccugaggacuuacacaggcuuguccggguuagcccugcuaggaacuaucauuucugcuuaucgggcacucucacagccggaagccggucccggcgagccugaccaacugacggcgagucuucagccagaacccccugcuccagcccgccccagcgcagggggaccucgagcccgugauguggcucaguaccuguuguccgacucucucuucgucuggguucuggugaacaccgcaugcuguguacugaugcucguggccaaguuaauacagugcaucgucuuuggcccacugagagugucggagaggcaacaccuuaaagauaaguucuggaauuuuauuuucuauaaauuuaucuucauuuuugguguuuugaacgugcagacagucgaagaggugguaauguggugucugugguucgcugggcuaguuuuucuccaucugauggugcagcuuugcaaggaccgguucgaguaccugucauuuagcccgacuacccccaugaguucccacggacgcgucuugucucuccugguggccauguuacugagcuguugcggccucgcggcaguguguuccaucacaggcuauacccaugggaugcacacucuugccuucauggcugccgaaucacuguuggucacaguuagaaccgcacaugugauacuaagguacguaauccaccugugggaucucaaucacgagggaacgugggaagguaaaggcacuuauguguacuacaccgacuucgucauggagcugacacuucugaguuuggaucucaugcaucacauucauaugcuguuauuugggaacaucuggcugagcauggcuucucuagugauuuucaugcagcuccgguaucuguuucacgagguucaacgccgaaucagaaggcacaagaauuaccuucggguggucggaaacauggaagcccguuucgcgguggccacuccugaggaauuggcaguaaauaacgacgauugcgcuauauguugggacuccaugcaggccgcucgcaagcugccaugcggccaucucuuucacaauucaugucugagaagcuggcuugagcaggauaccaguugccccacaugcaggaugucucugaacauugccgacaauaaccggguucgagaggaacaucagggugagaauuuggaugaaaaccucgugccugucgcagccgcugaggggcgcccaagacugaaucaacacaaccauuucuuucacuucgacggauccaggaucgcgagcugguuacccucguuuucuguggaagucaugcacaccacgaacauucugggcaucacucaggcauccaauucacagcuaaacgccauggcucaucaaauccaggagauguucccucaggugccguaucaccucguucugcaggaccuucaauugacacggaguguggaaauuaccacugauaauauacuggagggccgcauccagguacccuuuccaacacagagaagcgacuccauuaggccugcccucaacucucccgucgagcguccaagcucagaucaggaagagggggaaaccagugcacaaacggagcgggugccccuggacuuauccccucgacuggaagagacccuugauuucggagagguugaaguggagccaagcgaagucgaggacuuugaggccagagguucuagguucucaaaaagugcugaugaacgccagcggauguuggugcagagaaaggacgagcuccugcagcaagccaggaaacgcuuccuaaauaagagcuccgaagaugacgcagcgucugagucguuucugccgagcgaaggcgcuuccucagaucccguaacacuccgacggcguaugcuggccgcagccgcugagagaaggcuucagaaacagcagaccaguuga

SEQ ID NO: 52722 - RNA, 1683 nt, Artificial Sequence
  derived and/or modified sequence opt3 from AMH__Homo_sapiens__NP_000470
augagagaccugccccucaccagccuugcccugguguuguccgcuuuaggcgcacugcuagggacagaggcccucagggcggaagaaccugcugucggaacuucuggucugaucuuccgggaagaucuugacuggccaccgggcucaccccaggagccucugugcuugguugcccucgggggagauaguaacggcagcuccucuccacugcgcgugguaggugcacugucggccuacgaacaggcuuuucucggggcagugcaacgagcccguuggggacccagagacuuagcuacguucggcgucuguaauaccggcgauaggcaggccgcgcugccuucacuucggcgcuugggggcauggcugagagacccaggaggucagaggcuagugguucuccaccuggaggaggugacaugggaacccacuccuagccuucgguuucaagagccaccgcccggcggggccggaccuccagaacuggcuuugcucguccuguaucccggcccugguccagaggugaccguaacacgcgccggguuacccggagcacagagucugugcccgucccgagauaccagauaccucguucuugcuguggacaggccugccggcgcguggcggggcucugggcuggccuugacucuacagccccguggagaggauagccgccuguccacagcaagacuccaggcucugcuuuucggugacgaucauagguguuuuacccggaugacgccagcccuguugcuccugccucgaucagaacccgcuccauuacccgcccacggccaacuggacacugucccuuucccaccgccccgcccuagugcagagcuagaagagagcccacccucugccgauccuuuucucgaaacccugacaagacuugugagggcuuugcgggugccacccgcgcgcgcauccgccccgagacuggcucucgacccugacgcccuggcaggguucccacagggacuugucaaccugucagaucccgccgcuuuggagaggcuccuggacggcgaggaaccuuuacugcuacuccugcgucccacugccgcaaccacaggugauccagcgccucuucaugaccccaccagcgcuccaugggccacggcauuggcccggcgaguugcugccgagcugcaggcagcugccgcggaacucagaagucugccgggguuaccucccgccacugcuccacugcuugcaagguugcucgcccugugccccggcggaccuggcgggcuaggagauccacugcgcgcucuccugcuuuugaaggcccugcaggguuuacggguggaguggagaggcagggacccccgcgggccuggacgagcacaacggucugcgggcgccacagcugccgaugguccgugugcacuccgugaacuguccguagaccuuagagcugagaggagcgugcugauuccagagaccuaucaggccaauaacugccagggggucuguggcuggccccaaucggaucgcaauccucgguacggaaaccacgugguuuugcuccugaaaaugcaggcaagaggcgccgcucuagcgaggccacccugcugugugccuacugccuaugcagggaagcugcucauaucucuguccgaggagcgaaucucagcucaucacgucccgaauaugguggccacagaaugcggaugucgcuga

SEQ ID NO: 52723 - RNA, 1437 nt, Artificial Sequence
  derived and/or modified sequence opt3 from AMHR2__Homo_sapiens__NP_001158162
augcugggcagccucgggcuuugggcccuguugcccaccgcuguggaggcaccuccaaacagaaggacaugcgucuucuuugaagccccgggaguucgggguuccacuaagacguuaggcgagcugcuagacaccgggacagaacucccccgcgcgauccgaugucuguacucucguugcuguuucggaauuuggaaucuuacucaggauagagcucaaguggagaugcagggcugcagggacucagaugaaccugguugugagagucugcacugcgacccaagcccccgggcccacccuuccccagggucuaccuuguuuacauguucgugcggaaccgauuucuguaacgcaaauuauucacaccucccucccccaggcagcccgggcacucccgggagucagggaccucaggccgcuccaggugaguccauauggauggcacugguacugcucggcuuauuucugcuuuugcugcuacuccuggggucuaucauucuugcccuguugcaacgcaaaaacuacagagugaggggagaacccgucccugagccacggcccgacagcggccgcgauugguccguggaacuccaggagcugccggaguuaugcuucucacagguuauccgagaaggugggcaugcuguggucugggccggacagcugcaaggcaagcucguggcgauuaaagcauuuccucccagaaguguagcccaguuccaggcugagagggcccuuuaugaacugccaggcuugcagcacgaccauaucguucgguuuauaacagcaagccgugggggaccuggucgccuacugucuggcccccuccuggugcuugagcugcacccaaagggguccuugugucacuaccucacccaauauacgucagauuggggaagcagucugagaauggcuuuaucucuggcccagggccuagcguuccuccaugaagagagguggcagaauggucaauacaaacccgggaucgcccaccgggaccuguccagccagaacguccuuauucgagaggauggcucgugcgcaaucggagacuugggccuggcucucgugcugccugggcuuacucagccaccggccuggacccccacacagccucaaggaccagcugccauuauggaagcagguacucagcgcuauauggcccccgagcuguuggauaagacccucgaccugcaggacuggggcauggcuuuaagaagggcggauaucuacucucuggcacuacuccugugggaaauacuuucccggugcccugacuugcgcccagccgugcaucaccccucaaauuggccgaugagacagaacugggcuauuccucugccacucaugaguuacgggcccuggcaauguaggcguggaggcgucccuacaagccaucccccaggugccgcacugccucagaccuuaaugggguga

SEQ ID NO: 52724 - RNA, 1185 nt, Artificial Sequence
  derived and/or modified sequence opt3 from AMICA1__Homo_sapiens__NP_001091996
auguucugcccccugaagcucauccuucugccuguguuguuagacuacucgcugggccuaaacgaucucaaugucuccccaccggagcugaccguucacgugggggacucugcccuuaugggauguguauuucaaucaacagaagauaaaugcauuuucaagauagacuggacucugagucccggugagcaugcuaaagaugaauauguguuguacuauuacagcaaccucuccgucccuaucggcagauuucaaaauagggugcaccugaugggggacauucuguguaacgauggaucucucuuacugcaggacguucaggaggcagaucagggcacguauaucugcgaaauucggcuuaagggugagucgcaaguguucaaaaaggccgucguguugcauguacugccagaggaacccaaggagcuaaugguucacgucgggggacucauccagaugggcuguguguuucagucaaccgaagugaaacaugugacaaaggucgaguggauauucagcggccgccgagcgaaagaggaaaucguuuuucguuacuaucacaagcugagaaugaguguggaguacucccagucuugggggcacuuccaaaauaggguaaaccuugugggagacauuuuucggaaugaugguagcaucaugcugcagggcguccgcgaauccgacgggggaaacuacacuugcucaauucauuugggcaaucucguguucaaaaagaccaucguucugcacgugaguccugaggaaccaagaacauuagucacccccgcugcccugaggccucucgugcuuggugggaaccagcugguaauaauuguuggaaucgugugugcaacuauuuugcuacugccaguccucauccugaucgugaagaaaacaugcggcaauaagagcucugucaacuccaccgugcuuguuaaaaauacgaagaaaacuaacccggagauuaaggagaaacccugucauuuugaacggugcgagggcgaaaagcacauauauucaccuaucauugugcgcgagguaaucgaagaggaggaaccaagcgagaagagugaagccaccuacaugacaaugcaccccgucuggccuucucugcgauccgauagaaauaacagcuuggagaaaaagagcgggggagguaugccaaaaacucagcaggcuuucuga

SEQ ID NO: 52725 - RNA, 1569 nt, Artificial Sequence
  derived and/or modified sequence opt3 from AMIGO2__Homo_sapiens__NP_862830
augagccugagagugcacacccuccccacacuucugggcgccgucguuaggccugggugccgggaguuguuaugucugcuaaugaucacugugacgguaggaccaggugcuuccggcgugugcccgaccgcauguauuugcgccacagacauagucucuuguacuaacaagaaucucucaaaagugcccgggaaccuguuccgccuuaucaagcgacuggauuugaguuacaaucguauuggacuccuggacagcgaauggaucccuguuuccuuugcgaaacugaacacccucauuuuaagacauaauaacaucacaucuauaucgaccggcucauucagcacuacaccaaaucugaagugccuugauuugaguuccaacaaacugaagaccgugaagaaugcugucuuucaggagcuaaaagugcucgaaguacugcuucuguauaacaaucacaucucuuacuuggaccccagcgccuucggugggcucucccaacugcagaaguuauaucugucaggaaacuuucucacgcaguucccuauggaucuuuacguuggcagguuuaaacuggcagaguugauguuccuagacgugaguuauaaucggauuccaagcaugcccaugcaucacaucaaccuggucccuggcaagcagcuccgcgggauuuaccugcauggaaauccauuugugugugauugcucucuuuauucccuguugguguucugguacagaaggcacuuuucaagcgucauggacuucaaaaacgauuacacuugucggcucuggagugacucucgccacucccgacaaguucuguuacugcaggauagcuuuaugaacugcucggacucuaucauaaaugguuccuucagagcccuaggcuucauucaugaagcucaggugggggagaggcucaugguacacugugauucaaagaccggaaacgcaaauacagacuuuaucugggugggcccggacaaccggcugcuugagcccgauaaggaaauggagaauuucuaugucuuucauaacgguaguuuggugauugaaagcccucguuucgaggacgccgggguuuacuccugcaucgcuaugaauaaacagcgccugcucaacgagacuguggaugucaccaucaaugugucuaacuuuacaguaagcagaucacacgcccacgaagcguucaauaccgcauuuacgacucuggccgcuugcguugccaguauugugcuuguccuguuguaucucuaccugacaccaugucccugcaaguguaaaaccaagaggcagaaaaacauguuacaucaauccaaugcacacagcucuauacugucaccuggaccagcuagugacgccagcgcggaugagcggaaggccggcgcaggcaaacgaguggucuuccuagaaccccucaaggacacugcugccgggcagaacggaaaggugcgccuguuuccguccgaggcuguuaucgccgaagguauucuuaaaucuacaagaggcaagucggauagcgacuccguaaauucaguguucagugauaccccuuuugucgcaucuacguga

SEQ ID NO: 52726 - RNA, 891 nt, Artificial Sequence
  derived and/or modified sequence opt3 from AMMECR1__Homo_sapiens__NP_001020751
auggccgcuggcugcuguggggugaagaaacagaagcugagcuccucucccccuucaggaagugguggcgggggaggcgcaagcuccucuucgcacugcucaggugagagccaauguagagccggggaacucggacuuggcggcgcggggaccaggcugaacggauuggguggcuuaacagggggaggcagugguuccgggugcacucugucuccaccgcagggauguggcggcgggggagguggcaucgcucuaagcccucccccauccugcggggucggaacgcuccugucaacccccgccgcagccacaaguagcucuccuuccucaagcagugcugcaucuuccagcucgccaggcucucggaaaaugguuguguccgccgagauguguugcuucuguuuugacguacuuuacugccaucuguaugguuaccagcagccccgcacuccucgauucaccaaugaaccauaugcuuugaaggauucacguuuuccgcccaugacaagagacgagcucccuaggcuguucuguagugugagccugcucaccaacuuugaagaugucugcgacuacuuagauugggagguggggguucacggcauucggauagaguucaucaaugaaaaaggauccaagcgcacugccacauaucugccagagguggcgaaggaacaaggcugggaccauauucagaccaucgauucucuuuugagaaaagggggauacaaggcacccauuacgaacgaguuuaggaaaacuaucaagcugacccgguaucgcagcgagaaaaugacacuaucauacgccgaauaccucgcucaccgacagcaucaccacuuccagaaugguauaggccauccucugccacccuauaaccacuacaguuga

SEQ ID NO: 52727 - RNA, 1362 nt, Artificial Sequence
  derived and/or modified sequence opt3 from AMN__Homo_sapiens__NP_112205
augggcgugcuggggagaguccuccuuuggcugcaguugugcgccuuaacccaagcuguuagcaagcugugggugcccaacacagacuucgauguagcagccaauuggucccagaacaggacuccuugugcgggaggugcuguggaguuuccagccgacaaaauggucucugugcuaguucaggaaggccacgcagugucagauaugcuccugccgcuugacggggagcuggucuuggccaguggagcuggcuucggugugagcgauguagggucccaucucgacugcggagcaggcgaacccgccguuuuucgggauucugaccgcuucucguggcacgauccucaucuguggcgaucaggcgacgaggcuccagggcuguuuuucguggaugccgaacguguccccuguagacacgacgauguguuuuucccuccaagcgcgaguuuuagggugggacucggucccggcgcauccccuguccggguucgcucuaucagcgccuuagggagaacguucaccagggacgaggaccuggcuguguuucuugccucccgggcaggacgcuugcgauuccauggcccaggugcucugucaguagggccggaggauugcgccgaccccaguggaugugugugcggcaaugcggaagcccagccuuggauuugugcagcucuacuccaaccacugggcgggagaugcccccaggccgcuugucacagcgcccuuaggccucagggacagugcugugaucugugcggugcagucguguugcucacacacggcccagccuuugaccuggagcgguaccgugcucgcauauuagauacuuuccuggggcucccccaauaucauggacuucagguugcggugucuaaggucccgagauccucaaggcugcgggaagcagacaccgagauccaggugguauugguugagaacggcccugaaacagguggggccggccgacuagcucgcgcccugcucgcagauguggccgagaauggagaagcucugggcguccuugaggccaccaugagagaaagcggggcacacguguggggaaguucugcggcuggucuggccggcggggucgcagccgcuguguugcucgcccuguuaguucugcuaguggcacccccacuccugaggcgggcuggacgccuuagauggaggcgucaugaggccgcggccccugcuggcgcacccuuggguuuccggaacccaguauuugacgucacugccuccgaggaacugccccucccucgaagacugagccuugugccaaaagcugccgcagauucgacaucucacuccuacuucguuaauccgcuguuugcgggggccgaggcugaagccuga

SEQ ID NO: 52728 - RNA, 2028 nt, Artificial Sequence
  derived and/or modified sequence opt3 from AMOT__Homo_sapiens__XP_005262147
augcccagagcccagccuagcuccgcuucuuaccaaccagugccggcagaccccuucgccaucgucucaagggcgcagcagaugguugagauucugagugaugaaaaccggaaucuccgccaggagcuugaaggcugcuaugagaagguggcucgacugcaaaaaguagaaaccgagauacagcgugugagcgaggccuacgaaaacuuggucaaguccucuucgaaaagagaggcauuagaaaaggccaugaggaauaaacuggagggggagauccggcgcaugcacgacuuuaacagagaucuaagggaacggcucgagacagcuaauaagcagcuggcagaaaaggaguaugaaggaucagaggacacucgcaaaacgauuagccagcuuuucgccaagaacaaagagagucaacgagaaaaggagaaacuggaagcugaguuggccaccgcgagauccacaaaugaagaucagaggcggcauaucgagauucgugaccaggcacucucuaacgcccaggcuaaggugguuaagcuggaggaagaacugaaaaagaaacaaguguacgucgauaagguggagaaaaugcagcaggcccucguacaauuacaggcagcuugugagaagcgcgaacagcuggagcacagacuuaggacucgguuggagcgagaacuggagagccuacgcauccagcaaagacaggguaauugccagccuaccaacguuuccgaauauaaugccgcggcccucauggagcugcuuagggagaaagaggaacggauacuggcauuggaagcugacaugacaaagugggagcagaaguaccucgaagagaacgugaugcgccauuuugcccuggaugcugccgcaaccgucgccgcucaaagagacacuacagugaucucacacaguccaaauaccagcuaugauacggcguuagaggcaaggauucagaaagaagaggaagagauccugauggccaacaagcguugucucgacauggaaggccggauuaaaacucuucaugcucagaucauagagaaggaugccaugauuaaagugcugcagcaacgaucuagaaaggagcccuccaagaccgaacaguugucaugcaugaggccugcaaaaagccuaaugaguaucucuaaugccggguccggacugcucagccacucgucuacacugacuggcuccccaauuauggaggaaaagcgcgacgacaaaucauggaaggguagucuugggauccuguugggaggcgauuaccgggcugaguacguccccagcaccccuuccccaguuccgcccucuacaccucuccugagcgcccacucaaaaaccggcaguagagacuguuccacgcagacugaaagggggacagagagcaacaagaccgcagcgguggcuccaaucucuguacccgccccuguggcagccgcugccacugcagcugccauuacagcgaccgccgcuacgauaaccacaacuauggucgcagccgcuccaguggccguugcagcggccgcugcccccgcagcugccgcagccccgaguccugcuaccgcggccgcaacagcugccgccgugucacccgcugcagccggacagaucccagcggcugccagcgucgcauccgccgcugcaguggccccuucugcggcugccgcagccgcuguacaaguugcccccgcagcuccagcccccgugccugcgccagccuuagucccggugcccgcuccugcagccgcucaggcaucggccccagcccagacucaagcucccaccagcgcgccugcagucgccccaacacccgcuccgaccccuacuccagccguggcacaggccgagguucccgcuuccccugcgacgggucccggcccacaucgccugucaauuccuagucuaacaugcaaccccgauaagaccgacgggccaguguuccacucuaauacucucgaacgaaaaaccccgauccagauacugggacaggagccugaugccgaaaugguagaguaucuuauuuga

SEQ ID NO: 52729 - RNA, 2721 nt, Artificial Sequence
  derived and/or modified sequence opt3 from AMOTL1__Homo_sapiens__NP_001287936
auguggagagccaagcugaggcgggggaccugcgagcccgcugugaaagucgaagacccucucuguaacuuccacagcccaaauuuucuucgcaucuccgagguugaaaugcgagggucugaggaugcagccgcgggaacagugcugcagcguuugauucaagaacaguuaagauacgguacuccgacggagaacaugaaucugcuagcuauacagcaucaggccaccggcucagcagggcccgcccacccuacaaacaauuucaguagcacugagaaccucacccaagaagacccacagaugguauaucaguccgcuaggcaggagccccaaggacaggaacaucagguggauaauacagucauggagaaacaggugcggucuacccaaccucagcagaacaaugaggaacugccaacuuacgaggaagcaaaagcccaaucgcaguuuuuccgcggccagcagcaacagcagcagcaacagggugcuguugggcacggauauuacauggccggcggcacaucacaaaagagcagaaccgaggggaggcccacggugaaccgggcgaauaguggacaggcacauaaagacgaagcccuuaaggagcugaagcagggucacguccgcuccuugucugagcgaaucaugcagcucagccuggaaagaaacggcgcuaaacagcaccuuccuggguccggaaauggcaaggguuuuaaagugggcggaggcccaucaccggcccagcccgcaggcaagguacucgauccuagggggccacccccugaguauccauucaaaacuaagcaaaugaugagucccguuagcaagacccaggaacauggauuauuuuacggugaccagcacccgggcaugcugcaugagauggugaaaccuuaucccgcuccacaaccuguccggacagauguggccgugcuucguuaccagcccccacccgaauacggggucacuucucgcccuugccaguugccauucccguccaccaugcagcaacacucacccaugagcagucagacaucuuccgcgagcggaccucugcacucgguuucucuaccacucccccugccuauggcccuuggcgcaccacagcccccgccugcugccuccccaucacagcaacugggucccgacgcuuuugccauuguggagagagcacagcagaugguagagaucuugaccgaagagaacagggugcuccaucaggaacugcaaggguauuacgauaaugccgacaaguuacacaaauucgagaaggaacugcagcggauuagugaggcuuaugagagccucgucaaauccacgacuaagcgagaaucucuugauaaagcgaugcgcaacaagcuggagggcgaaaucagaagguugcaugacuuuaaccgggaucuacgcgacagacuggagacagcaaauaggcagcucagcucacgugaguacgaaggacacgaggacaaggccgcugaaggccauuaugccagucaaaacaaagaguuccugaaggaaaaagagaagcuggagauggaacuggcagccgugcggaccgcuuccgaggaucaccgaagacacauagaaaucuuggaccaggcccucagcaaugcacaggcgaggguuauuaaacuggaggaagaguuacgcgagaagcaggcuuacguggaaaaggucgagaaacugcaacaggcccuaacucagcuccagucugcaugugaaaagcgggagcaaauggaaagaaggcugcgcacauggcuugagcgagaguuggaugcccugcggacccagcagaaacaugggaacggacagccugcuaauaugcccgaauauaacgccccagcacuccuggagcuugugcgugaaaaggaggagagaauccuggcuuuggaagccgacaugacgaaaugggagcaaaaguaccucgaagagucaaccauuaggcacuuugcgaugaaugccgcugcaacagccgcugccgaacgcgauacuaccaucauaaaccauagucggaaugguagcuacggcgaguccucucuggaggcacacauuuggcaggaagaggaagagguaguucaggcgaacagaaggugccaggacauggaauauacaaucaagaauuuacacgccaaaauuaucgagaaggaugcuaugaucaaagugcugcaacagcgaucgcgcaaggacgccgggaaaacugauagcuccucacuacggccugcaagaaguguccccucuauugcugccgcaaccggaacacauagcaggcagaccucccucacuucaagccaacuggccgaggaaaagaaggaggaaaagacguggaagggcucuauaggucuuuugcuggggaaagagcaccaugaacacgcuuccgcgccacuccugccgccucccccaacaagugccuuaagcucuaucgcauccaccacugcugccucaagugcccaugcuaagaccggcagcaaagacucguccacacagaccgauaagucugcagagcuguucuggcccagcauggccucacuuccuagucguggacgcuuguccacuacaccagcgcacucucccgugcucaaacacccugcugccaagggcacggcagagaagcuggaaaacagcccggggcauggaaaauccccagaccaccgggguagagucucaagccuacugcauaagcccgaguucccugacggcgaaaugauggaggugcucauuuga

SEQ ID NO: 52730 - RNA, 1785 nt, Artificial Sequence
  derived and/or modified sequence opt3 from AMPD2__Homo_sapiens__XP_011539550
augagaaagcugacccacggcacagggcccaggccucgggugggaagcggucagccauaccgcggcgucguugccgcucauguggcaccgcgaaaacguaagaaauggagagggggaguaggcaggcggcgcagaggucaagccggggcgggacccagggcugccgagccuggcgcagaaccagcccgguucugguggggccucacuugcugugugacgcccccucaguccgggcgcggaucuccaacccuuaacgcucaggguguccugcgagagaucuggacaucauuuggcaguagaagccucggguccacuuggcccaccucuuuaucgauugcaggacugggcgguagggacacagggguggcccuacggccuguucgucucccacgcucagcuggagugcaccugagaccggccggcaauuucgaaaggcuucccuauuuuccucaucugagcgcgcgggcaggcgccuugggggucaccuggcucggaaguguggcucgauccccaugccgccccucugguccuggccugagcgccguacagacuuccagagggcaaccaccccugggaacaagggcaucauggccgcaggaguuguucacccggaguuuagcugaaagcgagcugcgcucugccccuuacgaguuucccgaagaguccccaauagaacagcuugaggagagaaggcagcguuuggaacggcaaaucucacaggauguuaagcuggagccugacauucuacuccgagcgaaacaggauuuccugaagacggacagcgauagugaccuucagcuguauaaggaacaaggcgagggucagggggauagaucuuugagggaacgcgacgugcucgagcgggaguuucagagagucacuaucuccggcgaagagaaauguggagugcccuucaccgaucuguuagacgccgcaaagagcguggucagggcucuguuuauucgcgaaaaauacauggcccucucgcuucaaucuuucugcccaacaacucgacgguaucugcagcaguuggcugagaagccccuagaaacccguacauacgagcagggcccugauaccccaguuuccgccgacgcaccggugcaucccccugcccuggagcaacacccauaugaacacugugagcccucaacgaugccuggggaucucggacugggucuuagaaugguaaggggcgugguccacguguacacucgccgggaaccagacgagcauugcagugaaguugagcugcccuacccggacuugcaggaguuuguggcugaugucaacgugcucauggcgcugaucauaaaugggccuaucaagagcuucuguuauagaagguuacaguaccuguccucuaaauuucagaugcacguacuacucaacgaaaugaaggagcuggcagcccagaaaaagguuccacaucgagacuucuauaauauucgcaaaguggauacacacauccacgcuagcucaugcaugaaccaaaagcaucuuuugcgguucauuaaaagagccaugaagaggcaccuggaagagaucguccauguggagcagggacgugaacagacccuccgcgaggucuuugaaaguaugaaucugacugcauacgaccuuuccguggauacacuggacguucacgccgaucggaacaccuuccauagauuugacaaauucaaugcuaaguauaaccccauaggcgagagcguguugagggaaauuuuuaucaagacggauaaucgaguaucugguaaauacuucgcccacauuaucaaguga

SEQ ID NO: 52731 - RNA, 2331 nt, Artificial Sequence
  derived and/or modified sequence opt3 from AMPD3__Homo_sapiens__NP_000471
auggcccugagcuccgagcccgcugaaaugccuagacaguucccaaagcucaacaucucugagguggacgaacaagucaggcuucuggcagagaaaguuuuugccaagguguugcgggaagaggauucaaaagacgcguuaagucuguucaccguaccggaggauugccccauuggccagaaggaagcuaaagagcgcgaacuacagaaggagcucgccgagcaaaagagcguggaaacagcaaaacgaaagaaauccuuuaagaugauacguucucagucgcugucacuucagaugccuccacagcaggacuggaaagggcccccugccgcuagcccagcaaugagucccacuacgccugucgugaccggagccacaucccugccaacuccggcucccuacgccaugccugaguuccaaagaguuaccaucucuggugauuauugugcgggcauuacauuggaagacuacgagcaggcagccaagagccucgcuaaggcccugaugaucagggaaaaauaugcacggcuggcuuaccaccgcuuuccaagaauuaccucccaguaucucgggcaucccagggccgauacugcgccuccagaggagggauuacccgacuuccacccgccuccccugccacaggaagauccuuacugccuugacgaugcacccccaaauuuggacuaucuggugcauaugcaaggcgguauccuauuugucuacgauaacaagaaaaugcucgagcaccaggaaccccauucacugccuuacccagaccuugagacauauaccguggacaugagucacauacuggccuugaucacggaugggccgacuaagaccuacugucaccggcgccucaauuuccuggaaagcaaauuuucuuuacaugagaugcugaacgagauguccgaguucaaggaacucaaaucaaauccccaccgagacuuuuauaacguaagaaagguugauacacauauucacgcugccgcuugcaugaaucagaagcaccuucugagguucaucaaacauacuuaccaaaccgaaccugaccggacaguggccgagaagcguggacgcaaaauuaccuugagacaggucuuugauggccuacacauggacccauaugaucugacgguggacagccucgaugugcaugcaggcaggcagacuuuccaccgguucgacaaguuuaacaguaaauacaaucccgucggggccucugaacugcgagaucuuuaucugaagacagagaacuacuugggaggugaguacuucgcucgcaugguuaaggaaguggcgagagagcucgaagaguccaaauaucaguacagcgagccuaggcugucgaucuauggccggucuccagaagaguggcccaauuuagcauacugguuuauacaacauaagguauauuccccgaacaugcgcuggauuauccaggugccuagaauuuacgacaucuucaggucaaagaagcugcuaccaaauuuugggaaaaugcucgaaaacaucuuccugccccuuuuuaaggccaccauuaauccucaggaccaccgugaguugcaccuguuccucaaguaugucacuggauuugauaguguggacgaugaaagcaaacauuccgaccacauguucucugauaagagccccaacccagacguuuggacaucagagcagaacccucccuacaguuacuaucuguacuauauguacgcuaauauaauggugcuuaacaaucugcggcgagagagaggcuuguccaccuuucucuucaggccacauuguggugaagccgggagcaucacgcaccuggucucugcauuuuuaaccgccgauaacauuucacacggacugcuacucaaaaagaguccggugcugcaauaucuuuacuauuuggcucagaucccuauagccaugagcccccuguccaauaacucucucuuccuggaguacucgaaaaauccauuacgcgaguuccugcauaagggccuucacguuagcuuguccacagacgaucccaugcaguuucauuacacuaaggaagcacucauggaagaguaugcgauugcugcccagguauggaaacugucaaccugcgaccuaugugagaucgcacggaacagugugcugcaaucuggccucagccaccaggaaaagcagaaauuccuggggcagaauuacuauaaggagggaccugaagguaacgauaucagaaaaacaaaugucgcccaaauuaggauggcuuuucgcuacgagacucuuugcaacgaauuguccuuccugucagacgccaugaaaagcgaggagaucaccgcauuaacaaauuga

SEQ ID NO: 52732 - RNA, 2088 nt, Artificial Sequence
  derived and/or modified sequence opt3 from AMPH__Homo_sapiens__NP_001626
auggccgacaucaagaccggcauuuucgcuaaaaacgugcagaagagacugaauagggcacaagagaaaguccuccagaaacuugggaaagccgaugaaacaaaggacgagcaguuugaagaguacguucagaacuucaagcggcaagaagcggagggaacucgccugcagcgagaguugcgugguuauuuagcugccauaaaaggcaugcaggaagcaagcaugaagcugacggagucccuacacgaaguguacgagcccgauugguaugggagagaggacguaaaaauggugggagaaaagugcgauguccucugggaggacuuucaucagaaacugguggauggcucucuucugaccuuggacacauaccucggucaauucccugauaucaagaauaggauugccaagcggucacgcaaacugguugacuaugauagugcuagacaccaucuggaagcacuccagagcuccaagaggaaagacgagucucggaucucgaaggccgaagaggaguuucagaaagcucagaagguguucgaagaguuuaacgucgauuuacaagaagaacugccaucacuuuggagccgccgagugggguucuacguaaauacuuuuaaaaacguuaguuccuuggaagccaaguuccacaaggagauugcggugcugugucauaaacuauaugaggucaugaccaagcucggagaccagcacgcagacaaagccuuuacaauccagggcgcuccgucugauagcggcccccugagaauagccaagaccccuuccccacccgaagaaccuucaccacuucccaguccuacugcaagcccaaaucacacacuggcuccggccucucccgcgccugccaggccacggucccccucacaaacccguaaagggccuccagugcccccguugccuaaggugacgcccacuaaggaacuccagcaggagaacaucauuagcuucuuugaagacaauuucgucccagagaucaguguuaccacaccuucucagaacgaggugcccgaaguaaagaaggaggaaacucuguuagaucuggacuucgauccauuuaaacccgaggugaccccugcaggauccgcuggugucacacauagcccaaugucgcaaacccucccgugggaccuuuggacgacuucuacagaucuggugcagcccgccuccggcgggucauucaauggauuuacccagccucaggacacaaguuuguucacuaugcaaaccgaucagagcaugauuugcaaccuagcugaguccgaacaggccccacccacggagccuaaggcagaggagccacuggccgcuguuacccccgcggugggccucgaccuggguauggauacacgcgcagaggagccggucgaggaagccgugaucauaccuggggcugacgccgacgcagccguaggaacucuuguuucugcugccgagggcgcaccaggcgaagaggcggaagcugagaaagccaccgugcccgcaggggagggagucagccuggaagaggccaagauugguacagaaacuaccgagggcgcugaaucagcccagccugaggcagaggaauuggaggcuacagugccccaagaaaaggucaucccaagugugguuauugagccugccuccaaucacgaggaagagggggaaaacgagaucaccaucggagcggaacccaaagagacuacggaggaugccgcuccaccgggcccuacaagcgaaacccccgagcucgcaacugaacagaagccaauucaggacccccagccuaccccaucugcccccgcuaugggugccgcagaucaacuggcgucagccagagaggcuagucaggaauuaccuccgggguuucuguacaaaguggagacacuacaugacuucgaggccgcaaauagcgaugaacucacccugcagaggggcgacguaguccuugugguuccauccgauucugaggcugaccaagaugccggaugguuggugggcgucaaggaaucggacuggcugcaguaccgggaucucgcaacuuauaaagggcuguuucccgagaacuucacacgacgccuugacuga

SEQ ID NO: 52733 - RNA, 1212 nt, Artificial Sequence
  derived and/or modified sequence opt3 from AMT__Homo_sapiens__NP_000472
augcagagagccgugagcgucguugcuaggcugggcuuccggcuccaagcauuucccccugcccuuugccgcccacuguccugugcgcaggagguguugcgacguaccccguuauacgacuuccaccuggcucaugggggaaagaugguagccuuugcagguuggucucuacccgugcaguauagagauucacacacagacagucaucuccacacuaggcagcauugcagccuguucgaugucucccacaugcuucaaacgaaaauccugggcucugaccgggugaaguugauggaaucgcucguugugggggauauugccgagcugcgcccuaaccagggaacccugucacucuuuacaaaugaagcuggcgguauauuagacgaucugaucgucacuaacaccagcgaggggcaccuuuacgugguaaguaaugcaggauguugggaaaaagacuuggcccugaugcaggauaagguuagagagcuacagaaccaaggcagggacgugggccucgagguccuggauaaugcacuucuggccuugcaggggccaacagcggcacaggugcuccaggccggaguggcugacgaucugcggaaauuacccuucaugaccuccgccgucauggaaguuuuuggugugucuggcugccgcguaacucgauguggguauacaggagaggacggcguggaaauuagcgucccuguggcuggugcuguucaucuggccaccgcgauccucaagaacccagaggugaaacuugccgggcuggcagcuagagacuccuugaggcuagaggccggacugugccucuacggcaaugauauugacgaacacacgacucccgucgagggcucacugaguuggacccuugggaagcggcgucgcgcugccauggauuucccuggagcaaaggugaucguaccacaacugaaagguagaguucagaggcggcgagugggcuugaugugugaaggggccccgaugcgcgcucauagccccauacucaacauggagggaacaaagaucggcacugucaccucugguugcccuuccccaucacugaaaaagaauguggcgaugggguauguccccugugaauacagcagaccuggcacaauguuacugguggagguuaggcggaagcagcaaauggcagugguaaguaaaaugccauuuguccccaccaacuauuacacgcuaaaguga

SEQ ID NO: 52734 - RNA, 1497 nt, Artificial Sequence
  derived and/or modified sequence opt3 from AMZ1__Homo_sapiens__XP_011513452
augcugcagugcagacccgcccaagaguucagcuuuggcccuagggcucucaaggacgcacuuguguccaccgaugccgcgcugcagcaguuguacgucucugcuuucucaccagccgaacgguuauuucuggcagaggccuauaacccgcagcgcacacuauucuguacucuccugauccgaacgggguuugacuggcuucugagucgucccgaagcuccugaggauuuccaaaccuuucacgcaagccuucagcauagaaaaccaaggcucgcccggaagcacauuuaccugcagcccauagaccuguccgaagaaccuguuggaucuucgcucuuacaucagcugugcucauguacagaggcuuucuuucuugguuugcgcgugaaaugccugccaagcguagccgcggcaaguaucagauguuccucuaggcccagccgggauuccgaccgccuacaacuccacacugauggcauucugucauuccuuaagaauaacaaaccuggggacgcccugugcguguugggacucacccugagugauuuauauccacaugaggcuuggagcuuuacauucucuaaguuucugccgggccacgaggucgguguguguuccuucgcccgauucucaggggaauuucccaagagcggaccuagugcaccagaccucgcucuuguugaggccgcggccgauggccccgaggcaccucugcaggacagaggcugggcuuugugcuucucugcccuagggauggugcaguguugcaaagucaccugucacgaacugugccaucuccugggacuugguaauuguagguggcugcggugcuugaugcagggcgcucucucccuggaugaggccuuacgucgcccacuggaccuaugccccaucugucucagaaagcugcaacacgugcuuggguuuagguugauugaacgguaccagcgacuguauacuuggacacaggcaguaguuggaaccuggccgagccaagaggccggcgaaccuucggugugggaggacacgcccccagcuucugcggauuccgguaugugcugugagucagacagugaaccugggacuagcgucuccgagccccucaccccagaugcaggaucucauacauucgccagcggccccgaagagggccugucauaccuugcugccagugaagcaccucugccacccgggggaccggccgaggcuaucaaagagcacgaacgcugguuggccaugugcauacaggcacuccagagagagguggcggaagaggaccuggugcaggucgauagggcuguugacgccuuagaucggugggaaauguuuacuggucaacugccugcaacccgccaggacccacccuccagcagagauucugugggccuaaggaagguacucggggacaaauucucaagucugcgucggaaguugagcgcccgaaaguuggcuagagccgaguccgcaccuaggccaugggauggagaggaaucuuga

SEQ ID NO: 52735 - RNA, 591 nt, Artificial Sequence
  derived and/or modified sequence opt3 from ANAPC10__Homo_sapiens__NP_001243638
augggcggggugaaggagaccaacauccugaaaaugacaacucccaauaagacgccuccaggagccgacccgaaacagcucgaaagaaccgguacagucagggagauuggcagccaagcuguuuggucccuuucuucaugcaagcccggguucggaguggaucagcugcgggacgauaacuuggaaacuuacuggcagagugacggcagccagccucacuuaguaaauauacaauuucgccgaaaaaccacagugaagacccuguguaucuaugcagauuacaaguccgacgagucuuauacuccaucgaaaauuucaguccguguggguaacaauuuccauaaccuacaggaaaucagacagcucgagcugguugagcccagcggguggauucacgugccucuuacagauaaucauaagaaaccaaccaggacguuuaugauccagauagccguccuggcgaaccaccaaaauggacgggacacucauaugcgccagaucaagauuuacacccccguggaagagaguuccaucggcaaauucccuagaugcacaacuauugauuuuaugauguauaggucuauccgguga

SEQ ID NO: 52736 - RNA, 591 nt, Artificial Sequence
  derived and/or modified sequence opt3 from ANAPC11__Homo_sapiens__NP_001002244
augaaggugaaaaucaagugcuggaacggcgucgccaccuggcuguggguugcuaaugacgagaacugugggauuugcagaauggcauucaauggauguugccccgauuguccucuccacggugaaagcauauccaggugccuuggcugguguccacagccggugcccguacugggagggcgggcccauccucaagugccaaucaacacagcgucucccacuccuggccagcacacggguucauugaugagucgcgaggaaagcucccgaucuccagaccccaccccuccagcuuuagaucaggagacaucgucacugcuacguugcacuagcccguggugucucgaccauaguugcgaucuguuugggauuaccgaccaggucuccgccgauggacccagagcauguaggcaaggcgcccggcgcagacuuccugcuggcguggggccaguucugcccuugcucccucacgcacugcauccacagguggccgcuaggacagccggagcggcagcccugccccacgucccgccugguauggaagugcagggcguacggcccgaccucgcuuuagccgggggagcaucuuga

SEQ ID NO: 52737 - RNA, 225 nt, Artificial Sequence
  derived and/or modified sequence opt3 from ANAPC13__Homo_sapiens__NP_001229304
auggacagcgaggugcagagagauggcaggauccuggaccucauugaugacgccuggcgggaagauaaacuucccuacgaggacgucgcuauaccucugaacgaauugccagagccggaacaagauaaugggggaaccacagaguccguuaaggagcaggaaaugaaguggacugacuuagcacugcaguaucuacacgagaacgugcccccuaucgguaauuga

SEQ ID NO: 52738 - RNA, 5835 nt, Artificial Sequence
  derived and/or modified sequence opt3 from ANAPC1__Homo_sapiens__NP_073153
augagcaauuucuacgaggaaagaaccacuaugaucgccgcuagggaccugcaggaguuugugcccuucggccgggaucacugcaagcaucacccuaaugcacucaaccuucagcugcgccaguugcagccggccuccgaauuauggucuucagacggggcggcuggacuggucgguaguuugcaggagguuacuauucaugaaaagcaaaaggagagcuggcagcuccgaaaaggcguguccgagauaggggaagauguagacuaugaugaggaacuguacguggccggaaauauggucaucuggucuaagggcucgaaaucacaggcacuugccguguauaaggcuuuuacgguugacagcccggugcagcaagcacuguggugugauuucauuaucagucaggacaaguccgagaaagccuacucuagcaacgaggucgaaaagugcauuuguaucuugcaguccucaugcauuaauaugcacaguaucgaggguaaagauuauauugcuagccuccccuuucagguggccaacguauggccuaccaaguacgggcugcuguucgaacguucugcguccucacaugagguuccacccggaagcccuagagaaccacuccccacaauguuuaguauguuacacccucuggacgagaucacuccacuuguguguaaaucuggcuccuuguucggcagcucgaggguccaauaugugguggaucacgcaaugaagauugucuuucugaauaccgacccgucuaucguuaugacauacgaugccgugcagaacguacauuccguguggacccuacggcgcgucaagucagaggaagagaaugugguucucaaauucagugaacaagggggaacuccccaaaacguggcuacaagcuccucucugaccgcccaccuuagaagccugucaaagggugacaguccugucacguccccauuucagaauuacagcucuauacauucacagaguaggagcacuuccucucccucguugcacagccgguccccuucaauuaguaacauggcagcucucucucgcgcccacagcccagcgcugggcgugcauuccuucucagggguacagcgauuuaauaucagcucucacaaccaaucccccaaaagacauaguauuagccacucuccaaauuccaacucaaacggaaguuucuuagccccugagaccgaacccaucguuccagagcugugcaucgaccaucucuggacagagacuauuaccaauauaagggaaaagaacagccaggcaucgaaaguguucaucacauccgaucuuuguggccagaaguuucugugcuucuuggucgagucucagcuacaacugcggugugugaaauuucaggaaagcaaugacaagacccagcucauuuucgguucagucacgaacaucccugcuaaggaugccgcucccguggagaaaauagacacuaugcugguucuugaagggaguggaaaucugguguuguauacaggcguaguccgugugggcaagguuuuuauuccagggcuccccgccccuucccugaccaugucuaacacuaugccacgcccgagcacacccuuagauggaguguccaccccuaaaccacugucaaagcuacucgguagccuggacgaggucgugcuuuugagucccguaccugagcugagagauucuuccaaacuccacgacagccuguacaaugaagauugcacguuccagcaacuuggcaccuauauccacucgaucagggacccagugcauaaccggguuacacuggaguugucaaaugggucuaugguccgaauuacuauccccgaaauugcaaccagugagcucgugcagacaugucugcaggccauaaaguuuaucuuaccgaaggagauugcugugcagaugcuggucaaaugguacaacguucacuccgcgccuggaggcccaagcuaucauucugaauggaaucuauucgugacuugccucaugaacaugauggguuacaauaccgaucgccuggcauggacaagaaacuuugacuucgaggggagccuuucccccgugaucgccccuaagaaagcuaggcccucagaaaccggcagugacgaugacugggaguauuugcugaauagcgauuaccaccaaaacguagaaucucaccuccugaaccgguccuuaugccugucaccaagugaggccagccagaugaaggacgaggauuuuucccagaaucuuucuuuggacucgagcacucuccuguucacgcauaucccugcaauauuuuucguccuacaccugguguacgaggaacucaaacugaacacacuuaugggagaaggcauauguucauugguugagcuguuagugcaacucgcccgcgaucugaaacuugggcccuaugucgaccauuacuauagagauuacccaacccuggugaggacuaccggacagguuugcacaaucgacccgggucagaccggcuucaugcaccauccuuccuuuuucacaagugaacccccaucuauuuaucagugggugagcuccuguuugaagggggagggaaugcccccuuacccauaucuccccggcaucugcgagcguucacggcugguaguccuaucuauugcucuguacauccucggugaugaaagccuggugagugacgaguccagccaauaccuuacacgaauaacgaucgccccucagaaacuacagguggaacaggaggaaaauagauuuucuuucaggcacucaaccuccgucaguagccuggcagagcgcuuaguuguguggaugacuaacguaggguuuacacuccgggaucuggagacccuuccguucggcauugcgcugccaaucagagacgcuauuuaucacuguagggaacaacccgccucggacuggccugaggcagugugccuacucaucggacgccaggaucugucuaagcaggccugugaaggcaauuugccaaaagggaaguccguccugagcucagacgugcccaguggaacagagacugaggaagaggaugacgguaugaacgauaugaaucaugaaguuaugucuuuaauaugguccgaggaccuccgagugcaggauguccggcgucugcuucaaagcgcucacccugugagaguuaacgugguccaguacccggaacugucagaccaugaguuuauugaggaaaaagagaauagguugcuccagcugugccaacgcaccauggcccuacccguaggccgggggauguucacgcuguuuaguuaucacccagugccuaccgaaccccuuccaaucccuaagcucaaccugacaggcagagcucccccaaggaauacuaccguugauuugaacagcggaaauauugacgugccgccuaacaugacauccugggcuucuuuccauaauggugucgccgcggggcugaagaucgcccccgcuagccagauagauuccgcauggaucguguacaacaaaccaaagcacgccgaguuagcuaacgaauaugccggcuuucucauggcacugggacuuaauggccaccugacuaaauuggcgacccucaacauucaugacuaccugacgaaggggcacgagaugacaucaaucggacuacugcuuggcguaucugccgcuaaacucgguaccauggauaugaguauuacucgacuguugucgauccauauacccgccuuacugccuccaacaagcaccgagcucgacgugccccacaauguccagguugcagcugugguggggauuggacuggucuaucagggcacugcccaccgccauaccgcagaagugcuucuggccgagaucggucggccuccgggcccagaaauggaguacuguacagacagagaauccuacucuuuggcugcggggcuagcccugggaaugguuugccucggccacgggucaaaccugaucggaaugagcgaucuuaauguacccgagcaauuauaucaguacauggugggcggucauaggcguuuccagacggggaugcaccgcgagaagcauaaauccccuaguuaucagauuaaggaaggagacaccaucaacgucgaugugacuugucccggcgcaacacuggcucucgccaugauuuacuugaagaccaauaaccggucuauagccgacuggcugagagcuccagauacaauguaucuccuggacuuuguuaaaccugaguuccuucuguugaggacucuagcacgaugccugauccucugggaugacauuuuacccaauagcaaguggguggauucaaacgucccacaaaucauucgggaaaauuccaucagucugagcgagauagagcuuccuugcucugaagaccugaaccucgagaccuugucccaggcccacguguacaucauugcgggugcuugucugucacucggcuuccgcuuugccgggagcgaaaaucugucggcauucaacugccuucacaaauuugccaaggauuucaugacguaucuaucugcuccgaaugcaaguguaacaggaccccauaaccuggagaccuguuuguccgucguguuacugagccucgccaugguuauggcgggcucagggaaccugaaagugcuucagcugugcagauuucuccacaugaagacuggaggcgaaaugaauuacgguuuccauuuggcucaccacauggcccuggggcuacuguuucucggaggcgguagguacucccuuucuaccagcaacaguuccaucgcagcccuguuaugugcuuuguauccacauuucccugcccacagcacagacaaucgguaccaucugcaggcacuccgacaccuguauguccuugcugccgagcccagacugcucgugccaguugacguggauacuaacaccccuugcuacgcguugcuggaggucacauauaagggcacgcaaugguacgaacagaccaaagaggaauuaauggcccccacucuacugccggagcuccaucuucugaagcagauuaaagugaaggggccacgcuauugggaauugcugaucgaccucucuaaaggaacacagcaccugaagucaauacuuaguaaggauggcguacucuacgugaaacugagggcagggcaauuguccuacaaggaggacccuaugggauggcagagccuguuagcucagaccguugccaaucguaacucugaggcucgggcauuuaaacccgaaacuauuucggccuucacaucagauccagcccuacugagcuuugcugaguauuucuguaagcccaccgucaauaugggccaaaaacaggaaauccucgaccuuuucuccagugugcuguacgagugcgugacgcaggaaacuccugagauguugccggcguauaucgcaauggaucaggccauuagaaggcugggucgccgagagaugucugaaaccagcgagcucuggcaaauaaagcugguccuugaauuuuucuccucaagaagucaccaggagcgguuacagaaccaucccaagagggggcuguuuaugaacucugaguuccucccaguagugaaauguacaaucgacaacaccuuggaucaguggcugcaaguuggaggcgacaugugcgugcacgcuuaccuaagcggccagccucuggaagagucccagcucucaaugcuugccuguuuucuggucuaucauagcgugcccgcaccucagcacuugccacccauugggcuggaaggaucuacuuccuucgccgagcuccuguuuaaguucaaacaauuaaagaugccuguucgcgcacuucugcgucucgcgccacuacuguuggguaauccccagccgauggugauguga

SEQ ID NO: 52739 - RNA, 2469 nt, Artificial Sequence
  derived and/or modified sequence opt3 from ANAPC2__Homo_sapiens__NP_037498
auggccgcugcaguggucguugccgagggcgacagcgauuccagacccgggcaggaacugcucguggcguggaacaccguaucuacaggacuugugccuccagcugcccuggguuuggucucaaguaggacuagcggcgcagugccgcccaaggaggaagaguuacgggccgcuguugaagugcugcgcgggcacggacuacauuccguccucgaggagugguucguggaaguacugcaaaaugaccuucaggcaaacaucucuccugaguuuuggaaugccauuucgcagugcgaaaacucagcugaugagccacagugucuguugcuccugcuggacgccuucggccucuuagagagccgacuggaucccuaccuucguaguuuggaacugcuagagaaauggacgagacucggucugcuuauggggaccggagcgcaaggccugagggaagagguucacacaauguugcggggcgugcucuuuuucuccacuccucgcaccuuucaggaaaugauacagagacuguaugggugcuucuuaagggucuacaugcagucuaagcggaaaggagaggguggcacagacccagagcuggaaggggagcucgauagccgcuaugcacgaagaagguacuaucggcuucugcaaucccccuugugugccggaugcucaagugacaagcagcaguguuggugccgucaggcucuagaacaauuucaucagcugagccaggugcuccaccgccugucucuucuggagagaguguccgccgaagcagucaccacuacauugcaucaaguuaccagggagcggauggaggaucgaugucgcggcgaauacgagagaucauuccucagggaauuucacaaauggaucgagcgggugguagguuggcuggggaagguguucuuacaggacggaccugcucgcccagccagcccggaagcgggcaauacgcugagaagguggcguugccacguccagcgguuuuucuaucgaauuuacgccagucuaagaaucgaggagcucuuuucuauugugagggauuuccccgacucccgcccugcaaucgaagaucugaaguacugucuugagcggacugaccagagacaacaguugcugguuagccucaaagcugcccuggaaaccaggcuucugcauccaggcgugaacacaugcgacauaaucacuuuguauauuucggcuaucaaggcccuccgcguccuggaucccucuauggugauuuuagagguagcaugugagccuauccgacgguaccugcguaccagagaagacacaguuaggcagauaguggccgggcuaaccggagauuccgacgguacgggcgaucucgcugucgagcugucaaaaacugacccagcgagucuugaaacagggcaggauagcgaggacgauuccggagaacccgaggacugggugccggauccugucgacgcagaccccggcaagucuagcucaaaacgccggaguuccgauauuaucagcuugcuggugucuauuuaugguucaaaggaccucuucaucaaugaguacagaagucuguuagccgauaggcugcuucaccaauuuagcuucuccccagaacgagagauccgcaacguugaauugcucaagcugcgguuuggggaggcuccuaugcauuucugcgaagugaugcuaaaagacauggccgauucuagaaggauuaaugcaaacauacgugaggaggacgaaaagcgccccgccgaggaacagccacccuuuggcguauaugcugucauccugucgagcgaguucuggccuccauuuaaagaugaaaagcucgaggugccggaggacauucgggccgcacuggaagcguacugcaaaaaguaugagcagcuuaaagcuaugagaaccuuguccuggaagcacacucugggauuaguuacaauggauguggaacucgccgacaggacccugucagucgcagugacgcccguacaggccgugauccuucuguacuuccaagaucaggcuaguuggaccuuggaggagcucucuaaggccguuaaaaugccugucgcacugcuacgacggcgcaugagcguguggcugcagcagggcgugcucagagaagaaccacccgggacauuuuccgucauagaagaggaaaggccucaagaccgggauaauaugguucugauugacucagacgaugagagcgacucuggaauggcuucccaggccgaucagaaggaggaggagcuuuugcuguucuggacuuacauccaagcgauguuaaccaaccucgaaagucugagccuugaccgaaucuauaauaugcugagaauguuuguggugacagguccagcccuagcugagauugaucuccaggaacugcagggcuacuugcagaaaaagguacgcgaccaacagcuggucuauucugcagggguguacagguuacccaaaaacuguuccuga

SEQ ID NO: 52740 - RNA, 2430 nt, Artificial Sequence
  derived and/or modified sequence opt3 from ANAPC4__Homo_sapiens__NP_001273685
augcugagauucccuaccugcuuucccagcuucaggguggucggcgagaagcagcucccacaagaaaucauuuuucuuguuugguccccgaaacgggaccugauagccuuggcuaacacagcaggggagguguuacugcaccgccuagccucuuuccaucgaguauggucauuucccccuaaugaaaacacuggaaaggaggugacgugucucgcguggcguccagaugguaaacugcuugcuuucgcccuggcagacaccaagaaaaucgucuugugcgauguggaaaagcccgagagucuccacagcuuuuccguugaggccccugugucuuguaugcauuggauggaagucacaguggagucgucaguacugacuagcuucuacaaugcugaagacgagaguaaccugcucuuaccaaagcugcccacccuuccuaaaaauuauuccaacacaucuaagauuuuuagcgaggaaaauuccgaugagaucauuaaauugcugggcgacguuagacuaaacauccucgugcuugggggaucaaguggcuucauagaacuuuacgcauaugguauguuuaagaucgccagggucaccgggauugcuggaacuugccuggccuugugucucagcucugaucugaaauccuuaucaguggugacagaggucagcaccaauggcgcgagugaaguuucuuacuuccagcuggagacgaaccuccuuuauuccuuucugccagaggugacucggauggcacgcaaguucacccacaucagcgccuugcuacaguacauuaaucugucgcucacaugcaugugugaggcuugggaagaaauccugaugcagauggacucuagacuuacuaaguucguacaagagaaaaacaccacaaccuccgugcaggaugaauuuaugcaucuguugcucuggggcaaggccucagcagagcugcagacguuacugaugaaucagcuaacugucaaagggcucaagaaacugggacaaaguauagagagcuccuauucuagcauucagaagcuggugaucucacacuugcagagugguuccgaaagccugcucuaccaccugucugagcuuaaaggcauggcuucauggaagcagaaguacgaaccgcugggguuggacgccgcgggaauugaggaagccaucacagcaguuggcaguuucauccucaaagcuaacgagcuguuacaagugauugauagcuccaugaagaauuuuaaagccuucuuuagguggcuguaugucgcuaugcuacggaugaccgaggaccaugugcuccccgaacugaacaagguaaugacucagaaagauauaacauucguugccgaguuucuuaccgaacacuucaacgaggcaccugacuuguacaaucgcaaggguaaguauuuuaacguggagcgagucgggcaguaccugaaagacgaagaugacgaucucgugucuccacccaauacggagggaaaccaaugguaugacuuccugcaaaauucgagccauuuaaaggaauccccucugcuuuuuccauacuaucccagaaaaucauugcacuucgucaagaggcggauggagaacaucauugaucagugccuccagaaaccggccgacgugaucggcaagaguaugaaucaggcuauauguauuccucuguaccgugauacccgcucugaagacagcacaagaaggcuauuuaaguuccccuuccuguggaacaauaaaacuuccaaccuccacuaccugcuuuuuaccaucuuggaggauucacuguauaagaugugcaucuuacggcgacauacagacauuagccagucuguuuccaauggccucaucgcgauuaaauucgggaguuuuacuuacgcaaccacagagaaggugcgcagaagcauauauucuugucuggaugcccaguucuacgacgacgaaaccguaacugucgugcuuaaagauacgguuggaagggagggucgggaccgccuguuggugcagcucccacugucccuagucuauaacucagaagauagugcugaguaccaauuuacaggcaccuauagcacuagacuggacgaacagugcucggccaucccuaccaggacaaugcacuucgagaagcauuggcgucuccuggaguccaugaaggcacaguacguggccgggaauggauuucggaaaguaucuugcgugcuuagcucaaacuugcgacacguuagagucuucgaaauggauauugacgaugagugggaacuggacgagaguuccgaugaagaggaggaggcuucuaauaagcccgugaaaaucaaggaagaaguguuaagcgaguccgaggccgaaaaccagcaagcaggcgcggcugcccucgcaccagagaucgucauuaaaguugaaaagcuggaccccgagcuugauucauga

SEQ ID NO: 52741 - RNA, 1932 nt, Artificial Sequence
  derived and/or modified sequence opt3 from ANAPC5__Homo_sapiens__NP_001131031
auggccgagggcgaacugaaggacauggagcaguucuuugaugaccucagcgauuccuucucugggaccgaacccgaggugcacaaaacaucagucguuggacuuuuucugagacauaugaucuuggcuuacaguaaguuauccuucucccaaguguuuaaacuguauacugcacuacagcaguacuuccagaacggugaaaagaaaacgguagaggacgccgauauggagcucaccucuagggacgaaggcgagcggaagauggaaaaggaggagcuggaugugucgguccgcgaagaggaagugucaugcagcgggccucuuagucaaaaacaggcggaguuuuuccugucccagcaggcuucuuugcucaagaaugacgaaacaaaagcccugacuccagcaagccugcaaaaggagcucaacaauuuacugaaauuuaacccggauuucgccgaggcucacuaucuuuccuacuugaauaaccugcgaguucaggacguguuuucaaguacccauagccuacuccacuauuucgaucgucugauucuuacaggagcagaaucuaaguccaauggcgaggaagguuacgggagaucacugagguaugccgcuuugaaccucgccgcgcugcauugucgguuuggacacuaccagcaggcagaguuagcccugcaagaagcuauacgcaucgcccaggagagcaaugaccacgucugccuccagcauugucuuaguuggcuguacguguugggccaaaagagaucugauuccuauguacuacuggagcacagcguuaaaaaggcagugcauuucggccuccccagggcuuucgccgggaaaaccgcgaacaagcugauggacgcccuuaaagacucggaucuguugcacuggaagcacucucucuccgaacugauugacaucucaauugcacagaaaacugcuaucuggcgguuauacggacgcaguacaauggcccugcagcaggcucaaaugcuacucagcaugaauagccuggaggccgucaacgccggugugcagcagaauaacaccgaaucuuuugcaguggcucuuugccauuuggcggagcugcacgcagaacagggcuguuucgccgcugccagcgagguccucaagcaucugaaggagcgauuuccuccaaauucacaacacgcacagcuuuggaugcugugcgaucagaaaauacaguucgacagagccaugaacgaugggaaguaucauuuggcugacagucucguuacgggaaucacugcccugaacuccauugaaggcguguacaggaaagcaguaguguuacaagcgcagaaucagaugagcgaggcucacaagcugcuacagaaacuccugguccacugucaaaaacuuaagaacaccgaaauggugaucucuguuuugcugucaguggccgagcucuauuggcggaguagcucccccacaauugcacugccuauguuacugcaggcccuugcuuugucuaaggaguaccgucuccaguaucuggccucggaaacuguccuaaaucuggcauuugcucaacucauccuggguauaccagagcaggcccuuagcuugcugcauauggcgauugaacccaucuuagccgauggggcuauucucgacaagggacgcgcaauguuccugguggccaaaugccagguagcuuccgccgcaucauacgaucagccuaagaaagcggaggcccuugaagcugccaucgagaaccugaaugaggcaaagaacuacuuugcuaagguugacuguaaagaaagaaucagggauguggucuauuuccaagcccgguuguaccacacccucggcaagacacaggagcgaaaucgcugcgcaaugcuguuuagacagcuacaucaggaacugccaagucacggcgugccgcucauuaaccaccuguga

SEQ ID NO: 52742 - RNA, 1614 nt, Artificial Sequence
  derived and/or modified sequence opt3 from ANAPC7__Homo_sapiens__NP_001131136
auggaccccggcgaugccgcuauccuggagagcucccucaggauucuuuacagacuguucgaaucuguguugccuccauuaccggcagcccugcagucacggaugaacgucauagaccacguucgcgauauggcggcugccgggcuacauaguaaugugcgacuccugagcucccuucuguugaccaugucuaacaauaaccccgagcucuuuucgccuccacaaaaguaucagcugcugguauaccacgcagacucacucuuccaugauaaagaauaucguaaugccgugagcaaguacacaauggcuuuacagcagaaaaaggcacugaguaaaacuuccaaggucagacccucuacgggaaacagcgccuccaccccucaaucacagugccuuccaagugagaucgaagugaaguauaaaauggcugaguguuacacaauguugaagcaggacaaagaugccauugcgauccuggacgguauucccagcaggcagcggacuccuaagaucaauaugaugcuagcaaaccucuauaaaaaggccggccaagagcgcccaucuguuaccuccuacaaggaagugcugagacagugcccgcuugcucuggaugccauauuggggcuccugucauuaagcgucaaaggagcagagguggcuaguaugacaaugaauguaauccagaccguucccaaccuggacuggcucucuguguggauuaaggccuacgcguuuguccacacuggcgauaauuccagggccaucagcacaauuuguucgcuugagaaaaagucucuguugcgggacaacguggaucuacuggguucccucgcagaccuguauuuccgcgcuggggacaauaaaaacucagugcuuaaguuugaacaggcccaaaugcuggauccuuacuugaucaaaggaauggacgucuauggcuaccuccuggcucgagagggcagauuagaagauguugagaaucuggggugcaggcuauucaacauaagugaccagcaugccgaaccaugggugguaagcggaugucacuccuuuuauucuaagcgguacagccgugcacucuaucugggugccaaggcuauucagcuuaacucaaauagugugcaagcguugcugcucaaaggcgcagcccugcgcaacauggggagaguccaggaggcuaucauucacuucagggaagccauccggcuugcacccugccgacuggauuguuacgagggauugaucgagugcuaccucgccuccaauagcauucgcgaagcuauggugauggccaacaauguuuauaagacccugggcgcaaacgcgcagacguuaacucugcuagcuaccgugugucucgaggacccugucacacaggaaaaagccaagacucugcuugauaaagcauugacccaaagaccagacuacauaaaggccgugguaaagaaagcugagcugcucucuagggaacagaaguaugaggaugguaucgcccuguuacggaaugcacuggcuaaccagucagacugcguucuucaucgcauuuugggggauuuucucguggccgucaaugaguaccaggaagcgauggaccaauauaguaucgcccugagauga

SEQ ID NO: 52743 - RNA, 444 nt, Artificial Sequence
  derived and/or modified sequence opt3 from ANG__Homo_sapiens__NP_001091046
auggugaugggccuggggguccuccuucugguuuucguguugggauuaggucugacacccccuacccuagcccaggacaacagcagauacacucacuuucucacgcaacauuaugaugcuaagccacagggcagggacgaucgguacugcgaguccaucaugcgccgacgugggcugaccucuccguguaaagacauuaauacauucauacacggaaacaagagaucaaucaaagcaauuugcgaaaauaagaacggcaauccccauagggagaaccuucggaucaguaaaagcuccuuucagguaacuaccuguaagcugcacggugggucuccuuggccacccugccaguaucgcgccacagcgggauucagaaauguggucguggcuugugaaaacggcuugccuguucaucucgaucaaucgauuuuuaggcggccauga

SEQ ID NO: 52744 - RNA, 1497 nt, Artificial Sequence
  derived and/or modified sequence opt3 from ANGPT1__Homo_sapiens__NP_001137
augaccguguuccugagcuuugccuuccucgcugcaauccuuacacacauuggcugcuccaaccagagaaggucucccgaaaauucagggcggcgcuacaaccgaauacaacauggacagugugccuauacuuuuauccugccugaacacgacgguaauugccgugagaguacgaccgaucaguacaacacaaaugcguugcagagagacgcuccacaugucgaaccggauuucagcucccaaaaguuacagcaccuggagcauguuauggaaaacuauacucaguggcuacagaaacucgagaauuacauuguggagaacaugaagucugaaauggcccaaauccagcagaaugcaguacagaaccacaccgccacaaugcuggagauuggcaccucgcuucugucacaaacugcugaacagacaaggaaauugaccgacguggagacgcagguccucaaucaaacuagccggcuggagauccagcugcucgaaaacaguuuauccaccuauaagcuggagaaacagcuuuugcagcaaacaaaugaaauacugaagauccacgagaagaacucucuacucgaacauaaaauucuggagauggaggggaagcacaaagaggagcuugauacucugaaggaagagaaagaaaauuugcagggacucgugacccgccagacauacaucauucaggagcuggagaagcaauuaaacagagcaaccacgaacaauagcguucugcagaagcagcagcucgaacuuauggacacugugcauaaccuggucaauuuguguacaaaagagggcgugcuacugaagggugggaaaagggaagaggaaaagcccuuucgggauugcgccgacguauaucaagcuggauucaacaaauccggcaucuacaccauauacauuaauaacaugccugagccaaagaaaguuuucuguaauauggaugugaacggcgggggauggacugucauccagcaccgcgaggacgguucacucgauuuccagcgaggcuggaaggaauauaagaugggguuuggaaaucccaguggcgaguacuggcuggguaacgaauuuauuuuugccaucacaagccagagacaauauaugcuuaggaucgagcugauggacugggaggggaaucgggcguacucucaguaugaucguuuccacauuggaaacgaaaaacagaauuaccgcuuguaucucaagggccauaccggcacggcagggaaacaauccucacugauauuacacggagccgacuuuagcaccaaggacgcugauaacgacaauugcauguguaaaugcgcccugaugcuaacagguggcuggugguucgaugcaugugggccuaguaaccucaacggaauguucuacacugcuggccagaaucaugguaagcugaacgggaucaaguggcacuacuuuaaaggcccaucuuauucccuuagaagcaccacaaugaugauuaggcccuuggacuucuga

SEQ ID NO: 52745 - RNA, 1488 nt, Artificial Sequence
  derived and/or modified sequence opt3 from ANGPT2__Homo_sapiens__NP_001112359
auguggcagaucguguucuuuacccugagcugcgaccucguccuugccgcugcauacaacaauuucagaaaguccauggauucuauuggcaaaaagcaauaucagguucagcacgggucauguaguuacacauuucuguugcccgagauggacaacugcaggagcuccucuucgccuuaugugucaaaugccguacagcgggaugcgccauuagaauacgacgauagcgugcaacgccugcagguccuagagaacauaauggaaaauaacacucaguggcucaugaaacuggagaauuauauccaggacaacaugaagaaagaaaugguggagauucaacagaaugcuguucagaaccagacggccgugaugaucgagauuggaaccaaucuucugaaccaaacagcagaacagacucgaaaguugaccgaugucgaggcccaggugcucaaucaaacaacccgucuggaacugcagcucuuagagcauagucuguccacuaacaaacuugagaaacagaucuuggaccagacaucugaaauaaauaagcugcaagauaaaaacagcuuccuagagaagaaaguacucgcuauggaagacaagcacaucauucagcugcaguccaucaaggaggaaaaagaucagcuucaaguucuggugucaaagcagaacaguauuaucgaggaguuggaaaagaagauagucaccgcaacggugaauaacagcgugcuccagaaacagcaacaugaccugauggagacugucaauaacuuacugaccaugaugucuacauccaauucaaaggauccgacuguugccaaagaagaacagauuagcuuuagagacugugcugaaguguucaagaguggucacaccacaaacggcaucuacacccucacguuucccaauucuacugaggagauuaaggccuauugcgacauggaagcagggggaggcgguuggacaaucauccagaggcgggaggauggguccguagacuuccagcgcaccuggaaagaauacaaggugggauuuggcaacccuagcggcgaguacuggcuugggaaugaguucgucucgcaacugacuaaccagcagagauauguguugaaaauucaucuaaaggauugggagggaaaugaggcguacucucuguaugaacacuuuuaccucuccucagaggaacugaacuauaggauacaccuuaaaggucugacaggcaccgccgggaagaucaguagcauuucccaaccaggaaaugacuucucuacgaaggauggcgacaacgauaaauguaucugcaaguguagccagauguugaccgguggguggugguuugacgcuugcggacccucaaaucucaacggcauguacuauccucagcggcagaacacaaauaaauucaacggcauaaagugguacuacuggaaagggaguggauauucccugaaggccacuaccaugaugauucgcccagcagauuucuga

SEQ ID NO: 52746 - RNA, 1512 nt, Artificial Sequence
  derived and/or modified sequence opt3 from ANGPT4__Homo_sapiens__NP_057069
augcugagccagcucgccaugcuucaaggcucccuguuguuaguggucgcuaccaugucuguugcacagcagacaagacaggaggccgacagggggugcgaaacucuggugguacaacacggacauuguucauacacguuccuacuccccaagagugagccuugcccaccgggucccgaagugagccgggauuccaacacccugcagcgcgagucucuugcgaauccucugcacuugggcaaacucccaacacagcaggucaagcaacuggaacaggcucugcagaacaauacucaguggcucaaaaaguuagagcgagccaucaaaaccauucugcguucgaaguuggagcaagugcagcagcaaauggcacagaaccagacagcccccauguuggaacuggggaccucacuacucaaucagacuacagcucaaauaagaaagcugaccgacauggaggcacagcuucugaaccagacgagcaggauggaugcccagaugccugaaacuuuucuuaguaccaauaaacucgagaaccaacuguuacugcagcggcagaagcuccagcaacuucagggacaaaauuccgcucuggagaaacgcuugcaggcccuagaaacaaagcagcaggaggaacuggcgucuauccucagcaaaaaggcaaagcugcuuaacacucuguccagacagucagccgcuuugaccaauauugagaggggccuccgggguguucgccauaacaguagccuguuacaagaccagcagcacucucugcgacagcuacucgugcugcuuagacauuugguccaagaaagggccaaugcauccgcuccagccuucaucauggcgggggaacagguguuucaggauugugccgagauucagcggucaggagcaagcgcuaguggcguauauacaauccaaguuucuaacgccaccaaaccccguaagguguucugcgaccugcaguccagcggcgggcgcuggacgcucauacagagaagggagaauggaacugucaacuuucagcggaacuggaaagauuacaagcaagguuucggcgacccugcuggggagcacuggcugggaaaugaaguggugcaccagcuuacacgacgcgccgcauauucgcugagagucgaguugcaggauugggaaggccaugaggccuacgcucaauaugagcacuuucaucucgguucugaaaaccagcuguacagguuauccguugugggguauucaggaagugcgggccggcagagcucccugguacuacagaauaccucuuucagcacucucgacucagauaacgaccacugucugugcaaaugugcacaagugaugaguggcggguggugguuugaugccugcggacuuuccaauuugaacggugucuacuaccacgcuccagacaauaaguauaaaauggacggcauccgcuggcauuacuucaaggggccgagcuauucucugagagccucaaggaugaugauucguccccucgauaucuga

SEQ ID NO: 52747 - RNA, 1476 nt, Artificial Sequence
  derived and/or modified sequence opt3 from ANGPTL1__Homo_sapiens__NP_004664
augaagaccuucacauggacucugggcgugcucuuuuuccuucuggucgacacggggcacugcagaggaggucaguuuaaaaucaagaaaauuaaccaaaggcgguacccccgcgccaccgauggcaaggaggaagcuaaaaagugugcauauacauucuugguuccugagcagcgaauaacugggccaaucugcgugaauaccaagggacaggacgccagcacaauuaaagauaugaucacccguauggacuuagaaaaccugaaggauguacuauccagacagaaaagggagauugacgugcuccaacuggucguggauguugacggcaauaucgugaacgaagucaaacuucugcggaaggagucucgcaauaugaacucaagagugacucaguuguacaugcagcuccugcaugagauaaucaggaagcgggauaauagucuggaacucagccaguuagagaacaagauucugaauguaacaaccgaaaugcuuaaaauggcgacgcgcuaucgagaguuggagguuaaguacgcuucccugacugaccuagugaacaaucaaucugucaugaucacccuccuggaggagcagugucuuagaaucuuuucgaggcaggauacacacgugucaccgccccuggugcaggucguuccucaacauauuccaaacagccagcaguauacucccgguuugcucgggggaaaugaaauacaacgggacccuggcuacccacgugaucugaugcccccuccagacuuagccaccaguccgacaaaaucccccuucaagauuccuccagugaccuuuaucaacgagggccccuucaaagacugccagcaggcaaaggaagccgggcacucuguaagcggaauuuauaugaucaaaccugaaaauuccaacgguccaaugcagcuguggugugagaacucacucgaucccggcggguggacggugauccaaaagcgcacugacggaagugucaacuuuuucagaaauugggaaaauuacaagaaaggcuuugguaacauugauggggaguacuggcuuggacuggaaaauauauauauguugagcaaccaggacaauuacaagcuacugaucgagcucgaagauuggucugacaaaaagguguaugcugaguacuccucauucaggcuggagccggaaagcgaguuuuaucggcuucgacugggcacauaccagggcaacgcaggggauaguaugauguggcauaauggaaaacaguucaccacuuuggaccgcgauaaggacauguaugccgguaacugcgcucacuuccacaagggcggguggugguacaaugccugugcgcauucuaaccucaauggaguuugguacagaggcggucacuauagguccaaacaucaagaugggaucuuuugggcagaauaccggggcggaagcuauucgcugcgcgccgugcagaugaugauuaagccuauagacuga

SEQ ID NO: 52748 - RNA, 1482 nt, Artificial Sequence
  derived and/or modified sequence opt3 from ANGPTL2__Homo_sapiens__NP_036230
augagaccccugugcgugaccuguugguggcucggccuucuggccgcuaugggggcagucgccggacaggaagacgguuucgaaggcacagaggaagggagcccuagggaguuuaucuacuugaaccgguauaagcgcgcgggagaaucccaagauaaaugcacuuacacguucauuguuccacagcagcgagugaccggcgcuauauguguaaauucuaaggagccggagguguuacuggaaaaccguguccacaaacaggagcuagaacuccugaauaacgagcuucugaagcagaaaagacaaaucgagacauugcagcagcucguggaaguugacggugggauugugucagaggucaagcugcugaggaaggaaagucggaauaugaacagccgcgugacucaacucuauaugcaguuacugcaugagaucauuagaaaaagggauaaugcccuugaauugucccagcuggagaaccggauccuaaaucagaccgcagacaugcuccaacuggccucuaaguacaaagaucuugagcacaaguaucagcaucuggcuacauuggcacacaaccagucggaaauaaucgcccaacucgaggaacauugccagcgcguacccucagcucgaccuguuccacagcccccuccagccgcgcccccuagaguguaccagccaccgaccuauaauaggauuaucaaccaaauuagcacuaaugagauccagagugaccagaaccugaaagucuuacccccuccacugcccacaaugccuacccucacgucccuuccaucuagcacugauaagcccuccggaccguggcgggacugucugcaggcauuggaagauggccacgacaccucaaguauauaccuagugaagccugagaauacaaaccgucugaugcaaguguggugcgaucagcgccacgaccccggcggguggacugucauucagagaaggcucgauggaagcguuaacuuuuuccggaauugggagaccuacaaacaggguuuuggcaacaucgacggggaauauuggcugggacuugagaauauuuacuggcugacaaaccaaggcaauuauaaguugcucgugaccauggaagacuggucuggucgaaaaguauucgccgaguacgcuuccuuucgccuggaaccagagucagaguauuacaaguuaagacuggggagguaucauggaaacgccggcgauagcuucacguggcacaauggcaaacaguuuacuacacuagaccgggaucaugacguguacaccgggaacugugcacacuaccagaagggagguuggugguauaaugcuugcgcccacaguaaccucaauggcgucugguaccgcgggggacauuauagaucuagguaccaggauggcguguauugggcggaguuccgugguggguccuacagccugaaaaagguugugaugaugauccggccuaaccccaauacuuuucacuga

SEQ ID NO: 52749 - RNA, 1107 nt, Artificial Sequence
  derived and/or modified sequence opt3 from ANGPTL4__Homo_sapiens__NP_001034756
augagcggcgcccccaccgcuggggcagcccugaugcucugcgcggcuacagccgugcuucuguccgcacagggagguccuguccaaucuaagucaccaagauucgccaguugggacgagaugaacguuuuggcucacggcuuacugcagcuagggcagggacucagggaacaugcagagcggacucgcagccagcuguccgcccuugaacgacgucugucugcuuguggcucggccugccaagguacggaggggucaaccgauuugccgcucgcgcccgaaagcagaguggacccugagguacugcacagucugcagacacagcucaaagcacaaaauuccaggauccagcaguuauuucauaagguggcccagcagcaacggcaccuggagaaacagcaucuucgcauucagcacuugcaaucucaguucggacugcuagaucacaagcaucucgaccacgaagucgcuaaaccagccagaaggaagcggcugcccgagauggcacagccuguggauccagcucauaacguuagccgccuucaccacggcggcuggacugugauacagcgaagacaugacggguccgucgauuuuaauaggcccugggaagccuacaaggcgggauucggugacccucacggcgaguuuuggcugggguuggagaaagugcauucaaucaccggagaucggaacagucgucucgccguacaacugcgcgacugggauggcaaugcagaauuacugcaguucagcguucaccucgguggggaggacacagcuuauucucuucagcugaccgccccaguggcuggacaguugggcgccacuacagucccgcccuccggccuaucagugccuuuuagcaccugggaucaagaccaugaccugagaagggauaagaacugugcaaaaagucucucugggggauggugguucgguacgugcucccacagcaaucugaacggccaguacuuucggucgauuccacagcagcgacaaaaacuuaagaaggggaucuucuggaagacuuggcgcggaagauauuacccccugcaggccaccacaauguugauucagccuauggcugcggaagcagccucuuga

SEQ ID NO: 52750 - RNA, 1413 nt, Artificial Sequence
  derived and/or modified sequence opt3 from ANGPTL6__Homo_sapiens__NP_114123
augggcaagcccuggcugagagcccuccagcuucuguuguuacugggggcuagcugggcaagggccggagcgccucggugcaccuacacauucgugcuaccaccgcaaaaauuuacuggugcugucuguugguccggccccgccucuacgcgcgcaaccccugaggccgcuaacgcaucagaacucgccgcucugcgaaugcguguugggagacacgaggaacuucugagggaguugcagcggcucgccgcggcagacggagccguggcuggcgaaguacgcgcccugagaaaggagaguaggggucugagcgcacggcucgggcaguuacgcgcucagcugcaacaugaggccggaccaggcgcgggccccggggccgaucuuggagcagaaccugcugccgcuuuggcccugcuaggugagcgagugcucaaugcauccgccgaagcucagagagcggcagccagguuccaccagcuggacgucaaauuucgggagcuugcucagcuggugacacaacagucuucguugaucgcccgucucgagcgccugugcccaggcggggcaggaggccagcagcaaguuuuacccccuccaccgcuggugcccgucgugccuguaagacucguugguucaacuagcgauaccaguaggaugcuugacccagcccccgaaccucagcgggaucagacacaacgacagcaggagccaauggcuucccccaugccggccgggcauccugcagugcccaccaagccagucggaccuuggcaggacugugcggaagcucgccaagccggccacgagcagucuggcguguaugaacugagaguggggaggcaugucguuagcguguggugcgagcagcaguuggagggagguggcuggacuguaauucaacggcgccaggauggguccgugaacuucuuuacaaccuggcagcacuacaaagcaggauucggcagacccgacggugaauauuggcuagggcuggagccagucuaccagcucacgucaaggggcgaucacgaacugcuugugcuguuggaggacuggggaggccguggggcccgggcucauuaugauggauuuagucucgaacccgagagcgaccacuaccgacugagauuaggucaauaucauggcgaugccggggacucucuguccuggcacaaugacaagccuuucucaacuguugauagggaccgcgauagcuacaguggaaacugugcacuauaccagcggggcgguuggugguaucacgcuugcgcccauucuaaucucaacgggguguggcaccauggcggacacuacagauccagguaucaggacggcgucuacugggcggaguuucgcgggggagccuauagccugcgaaaggcugcaaugcuuauacggccauugaaacuguga

SEQ ID NO: 52751 - RNA, 5643 nt, Artificial Sequence
  derived and/or modified sequence opt3 from ANK1__Homo_sapiens__NP_000028
augcccuacagcgugggcuucagagaggccgacgcugcaaccuccuuucugagggccgcgcggucugggaaccucgauaaggcucuugaccaccugcgcaauggagucgauaucaacacaugcaaucagaacgguuugaauggcuuacaucuggccucaaaagaagggcacguuaagauggugguagagcuacuccauaaagaaauuauacuggagacuacgaccaagaaaggaaacacagcacuucacaucgccgcucuggcaggccaagacgaagugguccgagaguuggugaauuauggugccaacguuaaugcucagagucagaagggguucacuccucucuacauggccgcgcaggagaaccaucuggaaguggucaaguuucugcucgagaauggagcaaaccaaaauguggccaccgaagauggcuucacaccauuagcuguagcccugcagcagggccacgagaacguuguggcacaccuuauuaauuaugggaccaaaggaaagguccguuugccggcucugcauaucgccgcgagaaacgacgauacuaggacagccgcagugcuacuccagaacgaccccaauccugaugugcugagcaaaaccgguuuuacgccacuucacauugcugcccauuacgagaaccugaaugucgcucaauugcuccugaaccggggcgccuccguuaauuucacuccccagaacgggaucaccccuuuacacauagcaucucgcagaggaaaugugaucaugguaaggcugcuccuugaccggggcgcccagauugaaacaaagacuaaagaugagcugaccccauugcacugugcugcgcgcaacggucaugugcgaaucucggaaauucuacuggaccacggggcacccauccaggccaagacaaagaauggacucucaccuauacauauggcugcccaaggcgaucaccuggacugcgucagacuucuguugcaguaugacgcagagauugaugacaucacccucgaucaucugacgccauuacacguggccgcucacuguggccaucacaggguugccaaagugcugcuagacaagggggcaaaaccgaacagccgggcgcucaauggauuuacuccccugcauauugcuugcaagaaaaaccacguccgugugauggaacuuuugcugaagacaggugccaguaucgaugcaguaaccgaguccggccucacuccucugcacguugccucuuucauggggcaucuuccaaucgugaaaaaucuguugcagcgcggagcuagccccaacgucuccaaugugaaggucgagacaccucuccacauggccgcaagagcuggccauaccgaaguggccaaguaccuguuacaaaacaaagcgaagguuaacgccaaagcuaaggacgaucagacgccacugcacugugcagccaggauuggucauaccaauauggugaaacuacuccuggagaacaaugcuaaccccaaucuugccacaacugcagggcacaccccguugcacauagcggcccgggaaggccauguagagacaguccuggcucuccuggaaaaggaggccucacaggcaugcaugacuaagaaaggauuuaccccuuuacacguggcugccaaguauggcaaaguucgaguggcagagcugcuuuuggaacgcgacgcccaucccaacgcugcggggaagaauggacucacaccacugcacgucgccgugcaucacaacaaucuagauaucguaaaacugcuccugccuagagguggcaguccccacagcccagcauggaacggguacaccccccuucauauugcugccaagcagaaucaaguggagguugccaggucuuugcugcaguacggaggcuccgcuaacgcagaaucaguccagggugugacuccuuuacaccucgccgcgcaggaggggcaugcugaaaugguggcccugcuucugagcaagcaagcaaauggcaacuugggaaauaaaaguggccucacgccacugcaccuagucgcccaggaggggcacguuccgguggcugacgugcugaucaagcauggaguaauggucgaugcaacaacccggauggguuauacuccccuccacguggccucucauuacggcaacauaaaacugguuaaguuccuuuugcagcaccaggcggacgugaacgcuaaaaccaagcugggguauuccccuuuacaucaagccgcacagcagggacacacagacauugucacccuccugcuuaagaauggcgccagcccaaacgaggugucgucugaugguacuacaccccuggcuaucgccaaacgccuaggguacaucuccguuacggacgugcucaagguagucaccgaugaaacuucauuugugcuggugagugacaaacacagaaugagcuucccugagacagucgaugaaauuuuggacguuuccgaggaugagggcgaagagcugaucucuuuuaaggcagaaaggcgugacagccgggauguggacgaggaaaaagaguuacucgauuucguaccaaagcuggaccagguggucgagucacccgcuauuccgcgaauaccuugugccaugccagaaaccgugguuaucagaagugaggaacaagagcaggcguccaaagaauaugaugaggacagccuuauucccucuucaccugccacagagacuagugacaauaucagccccguggcauccccaguccauaccggauuccuggugucuuuuaugguugaugcuaggggcgggucgaugcgcggaagccggcacaacggcuugagaguggucaucccucccaggacgugcgccgcuccaacccgcauuacaugucgacucguaaagccgcagaagcuguccacuccucccccacuagcagaagaggaaggucuggccucacggauaaucgcccuugggcccaccggagcucaauuccucaguccugugauuguugagaucccacauuuugcgucucacggccguggugacagagaacugguggucuugaggagcgagaauggcuccguguggaaagagcaccgcucacgguacggggaaagcuaucuggaucagauuuuaaacggaauggacgaggaacucggcucucuggaggagcuugaaaagaaaagaguaugcaggaucauaacaacugauuucccccuguacuuugugaucaugucccgauugugucaggacuacgauaccauugggccugagggaggcagucucaagagcaaacuggucccgcuaguucaggcaacguucccagaaaaugccgugacaaagcgcgugaagcuggcucuucaagcccagcccgucccugacgagcucgugaccaaacuguuggguaaccaggcaacuuuuucuccaaucguuacaguagaaccccggagaaggaaguuccaucguccuauuggguuacgcaucccgcugcccccauccuggaccgauaauccucgggacucaggagagggcgauacuaccagucucagacugcuuugcagcgugauagguggcacagaccaggcccaaugggaggauauuacggggaccacuaaacuggucuaugcuaacgaaugcgcgaauuuuacaaccaacgugucggccagguucugguuguccgacuguccccgaacagcagaggcuguuaauuuugccacucuacuguacaaggaacucaccgcagugccauauauggccaaauucgucaucuuugcuaagaugaacgacccucgggagggacgccugagaugcuacuguaugacggaugacaagguggauaaaacacuugaacagcacgagaauuucguagaggucgccaggucucgggacauugaaguguuagagggcaugagccuguucgcggaacucucagggaacuugguucccgugaagaaagcagcccagcagcgaaguuuucauuuccaauccuuuagagagaaccgccuggcuaugccagucaaggugagggauucuagccgugaaccgggaggcucccucucauuccugcggaaagccaugaaguaugaggacacccagcacauccuuugccaucugaauauaacuaugccucccugugcuaaggguagcggggcagaggauagaaggcgcaccccaacacccuuggcccuacgauacaguauccugucugaauccacuccuggaagccucucgggcaccgagcaggcugaaaugaaaauggccguuauuucagagcacuuaggucugucuugggcagagcuugcgagagaacugcaauuuaguguggaggacaucaaccggauuagggucgaaaauccaaacucccucuuggagcagagcguggcccugcucaaucuguggguaauccgcgaaggccagaacgcuaauauggagaaccuuuauacagcccuacagucuauagaucguggggagauugugaauaugcuggaaggaagcggcagacaaucccggaacuugaagcccgacaggcgccacacggaucgagacuacucauuaaguccuagccagaugaauggguacucuucccugcaggacgagcuccugucaccggcaagucuuggaugcgcucugagcuccccacucagagccgaucaguauuggaacgaaguugcagucuuggacgccaucccccuggcugcgaccgagcaugauacuaugcuagaaaugucugacaugcaaguguggucggccggccugacaccuagccucgugaccgcagaggauucaucccuugaguguaguaaagcugaagacucugaugccacuggucacgaguggaagcuggaaggggccuuaagcgaggaaccccggggaccagaguugggcucccuggagcucgucgaagacgauacaguagacucagaugcaaccaauggccugaucgaccuucuggagcaggaagaggggcagaggucugaggaaaaacucccuggaagcaagcgccaggaugacgcuacgggugccggccaagacagugagaacgaaguguccuugguuagcgggcaucagagaggacaggcgaggauuacucacucucccaccgugucacaggucacagagcggucccaagaucgucugcaggacugggaugcugacggcaguaucgugagcuacuuacaggaugccgcacaagguucguggcaggaagagguuacccaggggccacacucuuuccagggaacuuccacaaugaccgagggccuagaaccuggcgggagccaagaguaugaaaaagugcuggucucagugagugagcauacauggacugaacagccggaggccgagucuucccaggcugaccgcgaucgaagacagcaaggacaggaagagcagguacaggaagcaaagaauaccuuuacgcaagugguucaggguaacgaguuccagaauauucccggcgaacaagucacagaggagcaguuuaccgacgaacaggggaacauagugacuaagaaaaucauuaggaaggugguccggcagaucgaucucagcucagccgacgcggcucaagagcacgaagagguugagcuucgcggaaguggccugcagccagauuugauugaagguagaaaaggggcccagaucgugaagagggcaagccugaaacggggaaagcaguga

SEQ ID NO: 52752 - RNA, 5592 nt, Artificial Sequence
  derived and/or modified sequence opt3 from ANK2__Homo_sapiens__NP_001120965
augaccacaaugcugcagaagagcgacuccaacgccucuuuccucagagcugcaagggccggcaaucuugauaaaguggucgaguaccugaaggggggaaucgacauuaacacuugcaaucaaaacgguuugaaugcguuacaccuggcugccaaagaaggccauguugggcuagugcaggagcuccugggacggggcucaaguguagauagcgcaacgaagaaagguaacaccgcccuucacauagcuucccuggcagggcaggccgaaguggucaagguguugguuaaggagggagcuaauaucaacgcccagucucaaaauggcuuuacaccccucuauauggcggcacaggaaaaccauauugacguggucaaauaccugcuggagaauggcgccaaccagucgacugcuaccgaggauggguucacaccucucgccguggcauuacagcaaggacacaaucaggcuguagccauccugcuugaaaacgacaccaaggguaaaguucgcuugccagcgcugcauauugccgcacgaaaggaugacacuaaaucagcugcccuacuccugcagaaugaucacaacgcugacgugcagagcaagaugauggucaaccguacaaccgagaguggcuuuacgccgcuucacaucgccgcacauuaugggaaugugaacguggccacucuguugcucaauagaggagcugcggucgauuucaccgcaaggaacggcauaacaccccugcacguugccuccaagcgggguaauacuaacauggugaaauuacugcucgaccgcgggggacaaaucgaugcuaagaccagagacggccuuacaccucugcauugugccgcaaggucuggccacgaccagguaguggaauugcuacuggagcggggggccccacuccuggcucgcaccaaaaauggacuuagcccccugcacauggccgcacagggugaucaugucgagugcgugaagcacuugcuccaacauaaagcgccuguugacgaugugacgcuggacuacuuaacugcucugcacgucgccgcacauuguggccacuaucgagugacaaagcuacuccuggauaaaagagccaacccaaaugcuagggcccuuaacggguuuacccccuugcacauugcaugcaagaagaaucggaucaaaguaauggaacugcucguuaaguacggagcuuccauucaggccaucacugagucaggccugacaccuauacauguggcggccuucaugggucaccuuaacauuguccuguugcuccugcagaauggggcuaguccagacgugaccaacauccguggcgaaacggcauuacauauggccgcucgcgccggacaggucgaggugguuagaugucugcuaaggaauggcgcacucguggaugcgcgggcccgagaagagcaaaccccgcugcacauugcuagccgccuugggaaaacagagaucguacaguugcugcuccagcacauggcccaucccgacgcagcuacuaccaacggauauacaccucugcacaucucugccagagaaggucaggucgauguggcauccguuuuacuggaggccggcgcugcgcauucacuugccacuaagaaaggguuuaccccauugcacguggcagcuaaguacggaagccucgacgucgccaagcugcuacugcaaaggcgggccgcugcagauagugccggcaaaaacggucucacaccccugcauguggcggcucacuacgacaaucagaagguagcccuuuugcuguuagaaaaaggggcaucuccucacgccaccgcuaagaacggcuauacuccacuccauauugcagccaaaaagaaucagaugcagauagcguccacgcugcuuaacuacggagcugagacaaauaucgugaccaagcaaggcguuacuccccugcacuuggccagccaggaagggcauaccgacauggucacacuccugcuagauaaaggagcaaacauucacaugucgaccaagucuggucugacuucccuccaucuggccgcucaggaggacaaagugaauguggccgauauccuuacaaagcacggcgcagaccaggaugcucacacgaaauugggguauaccccgcugauagucgccugccauuacggaaacguuaagauggugaauuucuuacucaagcaaggcgcgaacgugaaugccaaaacuaagaacgguuauacaccucugcaccaggcagcucagcaagggcauacccacauuaucaauguacuucugcagcacggcgccaaacccaacgcuacaacugcaaauggaaacaccgcccuagccaucgcuaagcgccucggcuacauuucagucguggacacgcugaaaguugugaccgaggaagucacaacuaccacaacuaccaucacggagaagcauaaauugaacgugccagaaacaaugaccgagguucuggaugugagugacgaagagggggaugacacuaugacaggagauggcggugaguauuuaagaccugaagaccucaaggagcugggggaugacagccuucccuccucucaguuucuggacggaaugaauuacuugagguacagccucgaaggcggucguucagauagucugcgguccuucagcucugaccgaucacacacccuaagucaugcgagcuaucugagagauuccgcaguaauggacgauucugucgugauuccaucgcaccaggugagcacucuugccaaggaggcugagaggaacuccuaccgccucucauggggcaccgaaaaucuggacaacgucgccuugaguucuagccccauacauuccgggcgggcaucaccuugucuggagagagauaauagcucuuuuuuaguuuccuucaugguggacgccaggggaggcgcuaugcgcgggugccgacacaacggacuccggaucauuaucccaccgcguaaauguacagcgcccacgagaguaaccugcaggcuggugaagcgccaccggcuugccacuaugccuccaauggucgaaggcgagggucuggcaaguagauugaucgaaguggggcccagcggagcucaauuucucggcaaacugcaucuaccuacagccccacccccgcugaaugagggugagucucuuguuuccaggauucuccagcugggcccuccagggaccaaguucuugggacccgugauagucgaaaucccucacuucgcagccuuacgaggcaaagagcgcgaacuggugguucuccggucagagaacggggauaguuggaaggaacauuuuugugacuauacagaggaugagcugaaugaaauucuuaacggaauggacgaggugcuggauagccccgaagacuuggagaagaaaagaaucugcaggauuaucacucgugacuucccacaguacuuugcugucguaucgcgcauaaagcaggauuccaaucuaaucggcccugaagguggggugcugucuagcaccguugugccccaaguccaggccguguucccagagggagcgcucacgaaacggauuagaguaggccugcaggcacagccgaugcacucagagcuugugaagaaaaucuuagguaacaaggccacauuuaguccuauugucacccuggaacccaggcgacggaaguuccacaaaccaaucacuaugaccauacccguuccuaaggcuuccucugacgugaugcucaauggcuuugggggagaugccccaacauugcgccugcucugcagcauuacuggcgggaccacacccgcucaaugggaggacaucacgggaaccacuccucugacauucgugaacgaaugugucuccuuuaccacuaaugugucagcaagauucuggcuuauugauugcaggcagauccaggagagcguuacauuugccagucaaguauaucgggagauaaucugugugccguacauggcuaaauucgucguguuugccaagucucaugacccaauugaagcacgacugagaugcuucuguaugaccgaugacaaaguugauaagacguuggagcagcaggaaaacuucgcggagguggcccgcuccagggacgucgaagugcuagagggcaagcccaucuauguagauugcuuugguaaccuggucccucucacuaaaagcgggcagcaccauauuuucucguuuuucgcuuuuaaggagaaucguuuaccacuguucgugaaaguucgggacaccacacaagaacccuguggaagacuuucauuuaugaaggagccuaaaucuaccaggggccuggugcaccaggccaucugcaaccucaauauaacuuugccgauuuacacaaaggaaagugaguccgaccaggaacaggaggaggaaaucgauaugaccagcgagaaaaacccccaagacgaacaggagcgcaucgaagagcgacuggcauacauugcugaucaucucggcuucucuuggacagagcuggccagagaacuugacuuuacugaggaacagauccaccagauucggauagagaauccaaacagccuacaagaucagucccacgcacuguugaaguauugguuagagagggacgggaagcaugccaccgauacgaaucuggucgaaugucucacaaaaaucaaccgcauggacauugugcaccugauggagaccaauacugaaccucuucaggagcguaucucacauaguuacgcugaaauugagcagaccaucacacuggaucacagcgagggauucucuguucuccaagaagaguugugcacugcgcagcacaagcagaaagaagagcaagccguguccaaggaaucagagaccugugaccaucccccaauagucagugaggaagauaucagcguggguuauuccacguuucaggacggcguaccuaaaacagagggggauucuucggcaaccgcucuguucccccagacucacaaggaacaggugcaacaggacuuuagcggaaagaugcaggaccuaccagaggaaucaucccuggaguaccagcaagaguauuucguuacaaccccgggcacugaaacaagugagacccagaaagccaugauugucccuucuagccccuccaagacgccagaagaggugucaacucccgccgaggaagagaaacucuaccuucagaccccuacaucuagcgaaagaggugggaguccaaucauucaggagcccgaagagccuuccgagcaucgggaagagagcucuccgaggaagaccucacuggugaucgucgaauccgcagauaaccaaccagagacaugcgaacgcuuagacgaggaugcugccuucgagaaaggagacgauaugcccgaaauaccucccgagacuguaaccgaagaggaauauauugacgagcacggccauacggugguuaagaaggugacacgaaaaaucaucagacgguacgucaguagcgagggcacugaaaaggaggaaauuauggugcaggggaugccacaggagccuguuaauauagaggaaggagaugguuacucgaaagugaucaagagggucguguugaaaucugacaccgagcaauccgaagauaacaaugaguga

SEQ ID NO: 52753 - RNA, 5586 nt, Artificial Sequence
  derived and/or modified sequence opt3 from ANK3__Homo_sapiens__NP_001191332
auggccagcuccgcuucuucaagucccgcaggcaccgaggacagcgccccugcgcaggggggauucgguuccgauuacucuagaucgucaaggaagagcgacgcuaacgccaguuaucugcgggcagcccgcgcuggccaccucgaaaaagcacuugauuacaucaagaaugggguggacauuaacauaugcaaucaaaacggacugaaugccuugcauuuagcuuccaaagagggccacgucgaaguugugucugagcugcuacagcgagaagccaacguagaugcggcaacaaagaaagguaauacugcccuccauaucgcuagccuggccgggcaggcagagguggucaaggugcuuguuacgaacggagcuaaugugaacgcccagucccaaaauggcuuuaccccacuguauauggcggcccaggagaaccacuuggaagucgugaaguuccuccuggacaauggcgcaucacagagucuggcuacagaggauggguuuacuccgcucgccguagcuuuacagcaaggacaugaccagguugugagccugcuuuuggaaaacgauaccaaagguaagguccgucugcccgcccuacacauugcagccagaaaagacgauacaaaggcugcggcacuccugcuucagaaugacaacaacgccgauguggagucuaaauccggcuucaccccucugcacaucgcugcccauuacgggaauauuaacguggcaacuuugcuccugaauagggccgcugccgucgacuuuacagcacggaacgacaucaccccauuacacguugcgucaaagcgcggaaaugcuaacauggugaagcugcuccuugauagaggcgccaaaauagacgcaaagacgagggauggucugacucccuugcauuguggggcccggagcggacacgagcagguaguggaaaugcuacuggaccgcgcugccccuauccucaguaaaaccaagaauggccugucuccacuucacauggcaacacaaggcgaucaucugaacugcguccaguugcuccugcagcacaaugugcccguugacgaugugacuaacgacuauuuaaccgcucugcaugucgccgcgcacugugggcauuacaaaguggccaagguacuacucgauaaaaaggcuaauccuaacgcaaaggcccugaauggauucacaccacuucacauugcuugcaaaaagaaccgaaucaaaguuauggaguugcugcucaagcacggugccuccauucaagcagugaccgaaagcggccugacgccgauccaugucgcggccuuuauggggcacgugaauauagucucgcagcuuaugcaucacggagcuucucccaacacuacaaacgugagaggcgagaccgcccugcacauggcagcuagguccggucaggccgaaguugugcgguauuugguacaggacggggcacaagucgaggccaaagcuaaggaugaccagacuccucuccauauuucagcgcgucugggcaaggccgacaucgugcagcaguuacugcaacagggagcaaguccaaaugcugccacaaccagcggcuacacgccccuacaccucuccgcccgcgaggggcaugaagauguugcugcauuccugcuugaccacggagccucuuugagcauuaccacaaaaaaggguuuuacuccucugcauguggcggcuaaauacggcaagcucgaggucgccaaccuguuacugcagaaaucagcaaguccagaugccgcugggaaguccggacuuacccccuugcacguggcagcccacuaugacaaucagaagguagcgcuccugcuacuggaucaaggcgcuagcccgcaugccgcagccaaaaacgguuacacaccucuccacaucgcugccaagaaaaaucagauggacaucgcaacuacccugcuugaauauggggcugaugccaacgcggugacaagacagggcauugccucuguucauuuggcagcucaggagggacacgucgacauggugucacuguuacucggcaggaaugccaacgugaaucugaguaacaagagcgggcuuaccccccugcauuuggcugcacaagaagaucgggucaauguugccgaggugcucgugaaccagggagcccacguagacgcucagacuaaaauggguuacacgccacugcacgucggcugucauuaugggaauauaaagaucgugaacuuccuacugcaacacuccgcgaagguuaaugcaaaaacaaagaacggauacaccccucuccaucaggccgcucagcagggccacacucacauuaucaacgugcugcuucaaaauaacgccucucccaaugaguugaccgucaacgguaauacagcacuggggauagcccgacgcuuaggcuauauuucggugguugauacccucaaaaucgugacugaagagacaaugacgaccacuacaguaaccgaaaagcauaaaaugaacgucccagagacaaugaaugaagugcuggacaugagcgaugacgaggugagaaaggcuaacgcgcccgagaugcuuuccgacggagaauacaucucagaugucgaggaaggcgaggacgccaugacuggggauaccgacaaauaccugggaccucaggaucuaaaggagcucggcgacgauagucugccagcagaagguuauaugggguuuucuuugggagcuaggagcgccucccugcggucauucagcucugaccgcuccuacacguuaaauagaaguagcuaugcaagggauucuaugaugauugaggaacuccugguuccguccaaggagcagcaccuuaccuuuacacgugaauucgacucagauagucugcggcauuacagcugggccgcugacacuuuggauaacgugaaucucguaucgucccccauccacucuggcuuccuggugagcuuuauggucgacgcccgagguggcucaaugagagggaguaggcaucacggaaugcgcauuauaaucccuccacggaaaugcaccgcgcccacaagaauuacuuguaggcuagugaagcgccacaaacuggcaaacccuccacccaugguugagggcgaggggcuugccucccgacucguggaaaugggaccggcuggcgcccaguuccuggguccugucaucguggagaucccacauuuugggucuaugcggggaaaggaacgugaguugauuguucugagaagcgaaaauggcgagaccuggaaagagcaccaauucgacuccaagaacgaagauuuaacggagcuccugaaugguauggacgaagagcuugauucacccgaagagcugggcaagaaaaggauaugccgcaucauuacaaaggacuuuccucaguauuucgcuguggucagccggaucaaacaggagaguaaccagauugggcccgaaggaggcaucuugucuuccaccacuguaccacucgugcaagcaagcuuuccugagggggcccugacaaagagaauaaggguuggacuacaggcucagcccgugccagaugaaaucgucaaaaagauucugggcaacaaggccaccuucucgccgaucgugacuguagagccucgacgccggaaauuucauaagcccauuaccaugacaaucccagugcccccuccaucaggugagggggucucuaauggauacaaaggcgacacgacccccaaccuuagacuccuguguaguauaacugguggcacauccccugcacaaugggaagauauuaccgggacaacuccguugaccuucaucaaggacugcguuagcuuuacgacaaaugugucugcgagguucugguuagccgauugucaccaggugcuggagaccgucggacucgcuacucagcuguaucgugaacuuauuugcgugccauacauggccaaauuuguuguauucgcaaagaugaacgaccccguggagagcucccugcgcugcuucuguaugaccgaugacaaggucgacaaaacauuggaacagcaagagaauuuugaggaaguggcucggucaaaggauaucgagguucuagaaggcaaaccuauauacguggacugcuaugggaaccuggccccacucacuaagggaggccagcagcuggucuucaauuuuuacaguuucaaagagaacagacuucccuuuagcaucaagauuagggauaccucucaggaaccuuguggucgauuauccuuccugaaagagccgaagacaacgaaggggcucccccaaaccgcagugugcaauuugaacaucacucugccagcccacaaaaagauugagaaaacagaccggcgccagucauuugcuagucucgcgcugagaaagagguauagcuaccuuaccgaaccuggaauguccccccagucuccaugugagcggacugauauccgaauggccauaguagcagaccaucugggcuugucguggacagaacuagcuagagagcugaauuucagcgucgaugaaauuaaccagauccgcguggagaauccuaacucacucaucucccaaaguuuuauguuacugaaaaaguggguuaccagggacggcaagaaugccacgacugaugcccuuaccucugugcugacaaaaauuaaccguaucgacauugucacccucuuggaggggcccauauucgauuauggaaauaucagcgguacucgguccuuugcagacgaaaacaacguguuccacgauccaguugacggcuacccgucacugcagguggagcucgaaacaccuaccgggcugcauuauacacccccaacucccuuucagcaggacgauuacuucucugacauuagcaguaucgaguccccucuuagaaccccaagcaggcuaucugauggacugguccccucacaaggcaauauugagcacuccgcugacgguccuccggugguaacggccgaagaugcgaguuuggaggacagcaaguuagaagauucggugccacugacagagaugcccgaagcuguugacgucgaugagucucagcucgagaacgugugccuguccuggcagaaugaaaccagcucagggaaccuugagaguugugcccaagcacgccgagugacuggaggccugcucgacagauuggaugacucuccugaucagugccgggacuccaucaccagcuaccugaaaggcgaagccgggaaguucgaggcuaauggaucacauacagaaauaacucccgaggcaaaaaccaagaguuauuuuccagagagccagaacgacgucgguaagcaguccacgaaagaaacacuaaagccuaaaauccacggcucugggcacguagaggaacccgccagcccacuggcggcuuaccaaaagucccucgaggaaaccucaaaacuuauuaucgaggagacuaagccuugugugccgguuucuaugaagaaaaugaguaggacaucgcccgccgauggaaagccacgccugagcuuacaugaagaggaaggcuccucugguucagagcagaaacagggggagggauucaaggugaaaaccaagaaggaaauucgucacgucgagaaaaagagccauuccuga

SEQ ID NO: 52754 - RNA, 2292 nt, Artificial Sequence
  derived and/or modified sequence opt3 from ANKFN1__Homo_sapiens__NP_694960
auggaggccagccugaccagaaggcuccuuuucaaggaccggcacuuuacaugcuccaaaaucauuggccgccgauucgcuuguuuugcacagcgucugucucauagaaggaagcaaucacagugcgauuuguuaaacgaaaguacugggcagcugcccacgaccuguagcuccgccgcgucuaauucgauaaacuggaauugccgggugaaaaugacacagcaaaugcagaaccuacaccucugucagucaaagaaacauagcgcuccuaguuccccaaaugccgcaaagcgccuguacagaaaccuuucugagaagcugaaaggaagccacuccucauucgacgaagccuauuuuaggacucggaccgaucgcuugagucuccgaaagacaagcgucaauuuccaggguaacgaggcuauguuugaagcaguugagcaacaggacauggaugccgugcagauccugcuguaccaguauaccccggaggaacucgacuuaaauacucccaacucugagggccugacaccucuugauauugcuaucaugaccaauaacguaccaauugccagaaucuugcugaggacgggggcgcgggaaucaccccauuucgugucccuagagagccgugcaaugcaccucaauacucugguccaagaggcccaggaacgcgugagugagcuuucugcucagguugaaaacgagggauuuacccuggacaauacagaaaaagagaagcaauugaaagccugggaguggagauacaggcucuaucggcgaaugaagacuggcuucgaacacgcacgcgcuccugagaugccaaccaacgugugccugauggucacauccagcaccucguuaacggugucuuuucaggaaccccuguccguaaacgccgcgguugugacuagauacaaggucgaguggucaaugagugaagauuucagcccucucgccggugagauaaucauggacaaucuucagacacugagguguaccauuacuggguugacaaugggacagcaauauuuuguccagguguccgcauacaacaugaaaggcuggggcccagcucagaccacgaccccggccugcgcuucucccagcaauuggaaggauuacgacgaucgggagccucgccauaaagggcagucagaagugcuagagggacugcuccaacagguuagagcccugcaccagcauuauaguuguagggaauccacaaaacuucagacuaccggucguaagcaaagcgugucucggucacugaagcacuuguuccacaguagcaacaaauucguaaagacacucaagcgaggccuguacaucgcagugaucuuuuauuacaaagacaauauuuuagucacuaacgaggaccaggugccaauaguugaaauugaugacucccauaccucuucgaucacacaggauuuccugugguuuaccaagcuaagcugcaugugggaggacauuagauggcucaggcaguccauccccaucucaaguucuagcuccacugugcugcaaacgcgccagaaaaugcuugccgcuacagcgcaguugcaaaaucugcucgggacccacaaccugggacgggucuauuacgagccuauuaaggauagacauggcaauauacuuaucgugacuauuagggaaguagagaugcuguauucauucuuuaacgguaaauggaugcagaucagcaaguugcagucucagcgcaagucccucaguaccccagaggaacccacagcacuggacauauuacugauuaccauccaagauauccuaagcuaccacaaacgaucucaucagcggcuuuucccggggcuguaccuuggauauuugaagcuguguuccucaguugaccagauuaaagugcucgucacucagaagcugccuaauaucuuaugccacgugaaaauucgugagaacaauaacauaaguagagaagagugggaauggauccaaaagcugagcggcucggaguccauggaaucugucgaucacacaagcgacugccccaugcagcucuuuuucuacgaguugcagauggccgugaaggcucuccugcagcaaauuaauaucccacuacaucaggccaggaacuuucgccuguauacgcaggagguucucgaaaugggccacaacgugucauuccugcuuuugcugccugcaagugaugacguauguaccgcccccgggcaaaauaacccauacacuccccauuccggauuuuuaaaucucccucugcagauguucgagcuugguaucgucgcuugcuuuacauga

SEQ ID NO: 52755 - RNA, 3513 nt, Artificial Sequence
  derived and/or modified sequence opt3 from ANKFY1__Homo_sapiens__NP_057460
auggccgaggaagagguggcuaagcuggaaaaacaccucaugcuucugagacaggaguacgucaaguugcagaaaaaguuagcagaaaccgagaaaaggugcgcccugcuagcggcucaggccaacaaggagagcuccucugaaucauucaucagucggcuccuggcaauuguugccgaccuuuaugagcaggaacaguacagcgaucugaagauaaaagugggcgaccgccauaucuccgcucacaaguuuguauuggcagcccgaucugauucguggucacucgcuaaucugagcaguacaaaagagcuggaccucuccgaugccaaccccgaggugacuaugacgauguuacguuggauuuauaccgacgaacuggaguucagagaagaugacgucuuucuuacagaguugaugaagcuggcgaauagguuccaacuacagcuccugcgggaacgcugugagaaaggggugaugucucuuguuaacgugagaaauugcaucagguuuuaccagacugcagaggaacugaacgccagcaccuugaugaauuauugugcugagauuaucgccucccauugggaugaccuccggaaggaagauuucucaaguaugagcgcacagcuguuauacaagaugauaaaaucuaagacagaguauccucugcacaaagcuaucaaggucgaacgcgaggacgugguauuucucuaccuuauugagauggauucccaacugccaggaaaauugaacgaagccgaccauaauggugaccuagcgcuggaucucgcccugucacgaagacuugagagcaucgcaaccacucugguuagucacaaggcugacguggauauggucgacaaaucuggcugguccuugcuccacaaggggauucagaggggagaucuguucgccgcuacauuuuuaaucaagaacggcgccuucgugaaugcagccacccugggugcucaggaaacgccgcuacaucucguggcgcuguacagcucgaaaaagcacucugcagacgucauguccgagauggcccagauagcugaagcccuuuugcaagcaggggccaaccccaauaugcaggauucaaaaggacggacuccucugcauguuaguauuauggcuggcaacgaguauguguuuagccagcuccugcaaugcaagcagcuugaccuggaguugaaagaucacgaaggcuccaccgcccucuggcuggcaguacagcacaucacagugucuagcgaccagucagucaauccauucgaggaugugcccguugugaacgggaccaguuuugacgaaaacuccuucgcggcucguuuaauucaacgcggaagccauacugacgccccugauacagcaaccgguaauugucugcuacagagagccgcuggcgccgggaacgaggcagcugcccucuuccuggcgacgaauggagcccacgucaaccauaggaauaaguggggcgagacuccacuucacacagcuugccggcaugguuuggcaaaccugaccgccgaacuccugcagcagggggcuaaucccaacuuacaaacugaggaagcccugccucuuccaaaggaggcagcgucuuugacaucacucgccgacagugugcaucugcagaccccgcuacacauggcuaucgccuacaaucaccccgauguaguuagcgugauccuggaacagaaagcaaacgcucuccacgccacgaauaaccugcagauuauaccugacuuuucccuuaaggauucucgagaccaaaccgucuugggacuggcauuauggacaggcaugcauacuaucgccgcucagcuccugggcucgggggcggccauuaaugauaccaugagcgacggacagacacuucugcacauggcaauccagcgccaagauuccaaaucagcuuuguuccuccuggagcaccaggccgacauaaacgugaguagaacucaggauggugagaccgcccuacaacuggcuauuaggaaucagcucccacuggucguggacgcaaucuguacacggggcgccgauaugucuguucccgacgaaaaggggaacccuccacuuugguuggcgcuggcuaacaauuuagaggacaucgccagcacccucgugcgccauggaugcgaugcaacuuguuggggccccgguccugggggcugccugcagacgcuucugcacagagccauugacgaaaacaaugagccgacagcuuguuuucuaaucagguccggaugcgauguaaacucaccccgucagccaggcgcaaauggggaaggagaggaggaagcccgggacggucaaaccccucuccaucuggcggcuagcuggggcuuggaggaaacuguccagugccuguuagaguucggggccaacgugaaugcacaggaugccgaaggacgaacccccauucacguugcuauaucuucccagcauggcgugaucauucaacuccuggucagucacccagacauccaccuuaacgugagagauaggcagggucugacacccuuugccugugcaaugaccuucaaaaauaacaagagcgcugaggccaucuugaagcgcgagucuggggcggccgaacagguagacaauaaaggccggaacuuucuccauguggcaguucaaaauuccgauauugagucaguccuguuccuaauaagugugcacgcuaacgugaauagcagaguccaagacgccucgaagcugacuccucuucaucucgcuguucaggcaggauccgaaaucauugugaggaaccuguugcuggccggcgccaaagugaacgaguuaacaaagcaccgccagacggcucuccaucuggcggcacaacaggaucuuccaaccaucugcucuguacuguuggagaauggggucgacuuugccgcuguggaugaaaacggaaauaacgcccuccaccuggcaguuaugcacggucgacuaaauaacauucgggugcugcuuacugaguguacagucgacgccgaggcuuucaaucuccguggccagagcccgcugcauaucuuggggcaguauggaaaagaaaacgcggccgcaauauuugacuuauuccuggaaugcaugcccggcuacccucucgauaagccagacgcugaugguucaaccgugcugcuucuggccuauaugaaggggaaugcaaacuuguguagagccaucguuaggaguggcgcucgccuaggagugaauaacaaucaaggcguaaacauuuuuaauuaccaggucgccacaaaacagcuccuguuccggcugcuugacauguuauccaaggagcccccuuggugcgaugggucuuauuguuacgagugcacugcgagauucggagugaccacgaggaaacaccauugucgacacugcggccgccugcucugucacaagugcagcaccaaagaaaucccaauuaucaaguuugacuugaacaaacccgugcgggucugcaacauauguuucgauguucugacacucggugggguguccuga

SEQ ID NO: 52756 - RNA, 7854 nt, Artificial Sequence
  derived and/or modified sequence opt3 from ANKHD1-EIF4EBP3__Homo_sapiens__NP_065741
augcugaccgacaguggcgggggagguacuuccuucgaggaggaucucgacucuguggcccccagaucagcuccugcaggcgccagugagccaccgcccccugggggagucggccuugguaucaggacuguucggcuguuuggggaggcgggaccagcuagcggcgugggcuccucugggggagguggcucggggucaggaacgggcgguggggaugccgcauuggacuucaaguuagccgcugcaguacugcgcaccggaggcggcgggggagccagcgguagugaugaggacgaaguguccgaggucgagucuuuuauuuuagaucaggaagaccucgauaaccccgugcugaaaaccacuagcgagauauuccuuuccucaaccgcugaaggcgccgaccugcgaaccguugauccugagacccaagcgcguuuggaggcacuccuggaagccgcugggaucggaaagcugaguacugccgacggcaaagcauuugcugauccagaggugcucagaagguuaacaagcucugucuccugcgcccuggacgaagcggccgcagcucuuacccggaugaaggccgaaaauucacacaacgcuggucagguggacacgcgcagcuuggccgaagcauguagugauggggacguaaaugccguuagaaaacugcuagaugagggcaggucugugaacgagcauacugaagagggagaaucccuccugugccuugcuuguagcgcgggcuacuaugagcuggcacaggucuugcucgccaugcacgcuaauguggaagaccgggggaacaagggagauauuacaccacugauggccgcaucgucugguggcuacuuagacaucgugaagcugcuccuucugcaugaugccgacgucaauucccagucagcuacagggaacacugccuugaccuaugcaugcgcgggaggcuucguugauauugugaaaguacuacugaaugagggugcuaacaucgaggaccacaaugaaaacgggcauacaccucucauggaggccgcaagugccggccacguggaagucgcucgcgugcugcuugaucacggagccggcauaaauacccauagcaacgaguuuaaggaauccgcacugacguuggcuuguuacaaagggcaccucgacaugguucgauuccuguuagaggccggagcggaccaagagcauaagacugaugaaaugcacacagcccugauggaggcuugcauggacggucacguggaagucgcaagacuacuccuggauucuggcgcccaggugaauaugccagcugacagcuuugagucaccgcuuaccuuggccgcaugugggggacauguagagcuggcggcccuccugaucgaaaggggcgcuaaccuugaggaaguuaacgaugaggguuauacuccccugauggaagccgcacgggaggggcacgaggaaaugguggcuuugcuccuggcccagggcgcaaauauuaacgcccagacagaggaaacccaagagacggcuuuaacccuggcgugcuguggaggcuucagugaagucgccgacuuucuaaucaaagcaggggcugauauugagcucggaugcuccacaccucugauggaggccagccaggaaggccaucuugaguuggugaaguaccugcucgccucuggugcuaauguccacgcaacuaccgccacaggggacacugcgcugaccuaugcuugugaaaacggacauacagauguggccgacguuuuacugcaggcaggcgccgaucuugagcacgaaucagaggguggccguaccccauugaugaaggcugcacgcgccgggcaccucugcacugugcaguuccugaucaguaaaggagcgaauguaaacagagcuacggccaauaacgaccauacagucgugagccuagcaugcgccggcgggcaccuggcuguuguggagcuccugcuugcccauggagcagaucccacccacagguugaaggacggcuccacuaugcugauagaagcugccaaaggugggcacaccaaugucgugucuuacuuacucgacuacccuaacaauguacugucggugccaacaaccgauguuagccaacuucccccgccuucccaggaccagucacaagucccccgggugccaacucauacacuggcgaugguggucccuccccaggagccagaucgaacgagucaggaaaacucucccgccuugcucggaguucagaagggcaccagcaaacaaaaguccucaagccuacagguggcagaccaggaucuacugccuucuuuucacccauaucagccgcucgaguguauuguggaggaaacugaggguaaacugaaugaacuuggccaacgcaucuccgcuauugagaaggcccaguugaagagucuggaauuaauccagggggagccccucaacaaagacaagaucgaggaacugaaaaagaauagagaggaacagguacagaagaagaagaaaauucuuaaggagcugcagaaagucgaaaggcagcuacagaugaagacacaacagcaguucaccaaagaguaccucgagacaaagggacaaaaggauacugugagccugcaucagcagugcucucaccggggcguuuucccugaaggggagggagacggcuccuugccagaagaucauuuuucagagcugccccagguggacaccauauuauucaaagauaacgacgucgaugacgaacaacagaguccuccaagcgcugagcagaucgacuuugugcccguucagccgcucucguccccucaauguaacuucucuagcgaucuggguucaaaugggacgaacagucuugagcugcagaagguguccggaaaucagcagauuguaggccaaccacagaucgcaauaaccggucacgaccagggcuugcucguccaagaacccgaugggcugaugguggccacuccugcccagacucuaaccgacacacuggaugaccuuauugcugcggugucuacucgcguccccaccggaagcaacuccucaagccagacgacagagugccucaccccagaaaguuguucucagacuacauccaauguugcaagccaaucgaugccucccguguauccaucaguagauaucgacgcccacaccgagucuaaccaugauacugcucugaccuuggccugcgcaggcgggcacgaggaacuggugagugucuuaaucgccagagacgcuaaaauugagcauagggauaagaaaggauuuacaccgcucauccuggcggccacggcaggccacguggguguuguggaaauucuucuggacaaagggggagacauagaggcucaguccgaacguaccaaggauacuccuuugagccucgccuguucuggcggccggcaggaggucguggaccugcuacuggcacgaggggccaauaaagagcauagaaacguuagcgauuacacaccccuuucccucgcugccucaggagguuaugugaauaucauuaagauccuguugaacgcgggcgcagaaaucaauaguaggaccgggagcaaauuaggaauuucuccacugaugcucgccgcuaugaacggccacguccccgccguaaagcugcuucuggacauggguuccgauauaaaugcucagaucgagacaaaccgcaauacugcauugacccuagccugcuuccaagggcgggcugaagugguuucacugcuccuggacagaaaagccaacguggagcacagggcaaagacgggacuuacaccuuuaauggaagcggccaguggcggcuacgcugaggucgggcgcgugcugcucgauaaaggagccgacguaaacgcaccacccgugccuagcucccgagauaccgcuuugacuauugccgcagacaagggucauuauaaguuuugugagcugcucauccaccggggcgcccauauugauguccguaauaaaaaggggaacaccccgcuguggcuugcuucuaauggaggccacuucgacguugugcagcuguuggugcaggcgggugccgaugucgacgcagcugacaacagaaaaaucacaccacuaaugucggccuuuaggaaggggcacgugaaaguuguacaguaccuggugaaggaagucaaucaauuccccagcgauauagagugcaugcgcuacaucgccacuauuaccgacaaggaacuccugaaaaagugucaucagugcguggagacaaucguuaaagcaaaggaucagcaggcugccgaagcgaacaaaaaugcuucaauucugcuuaaggagcuggaccucgagaagucccgggaagagaguagaaaacaagccuuggcagccaagagggaaaaacgaaaggagaaacgcaagaagaaaaaggaggaacagaaacggaagcaggaggaagaugaggaaaacaaaccuaaggaaaauucugagcugccagaagacgaggaugaagaggaaaacgacgaggauguggagcaagaaguccccaucgagccuccgagcgcuacgaccacuacaaccauaggaauuuccgcaacuucagccacauuuaccaauguguucggcaaaaagagagcgaacguagucacgacucccucuaccaauaggaagaacaaaaagaauaaaacaaaggaaaccccaccuacugcucaccucauccugcccgagcagcauaugagccuugcccagcagaaagcagacaagaacaagauuaacggcgaaccacgugggggaggugccggcgggaauagugauuccgacaaccuagauagcacagacugcaauucugagucauccaguggaggcaaaagccaagagcugaacuuugugauggacguuaauucgucuaaguauccuuccuuguuacugcacagccaggaagagaaaaccucaacagcuacaaguaagacccagacgcgccucgaaggugaggugacacccaacucucuguccaccagcuacaaaacugucucacuuccacugaguagcccgaauaucaagcucaacuugaccuccccuaagcgggggcagaaaagagaggaaggauggaaggaggugguuaggcgaucuaaaaagcugagcgugcccgccuccgucgugucacggauaaugggccgcggcggguguaauaucacagcaauucaagauguaacuggagcucauaucgacguggauaaacagaaggacaagaacggugaaagaaugauuaccaucaggggcgggacggagucuacacgguaugccguucagcuaauaaaugcgcugauucaggauccagccaaagaacucgaggaccuuauccccaagaaccacauccgaaccccugcaaguacuaaaucgauucacgcuaauuucagcuccggagucggcacaaccgccgcaucuucaaagaacgcuuucccacugggugcccccacuuuagugacaagccaagccaccacguuguccacuuuucagccugcgaauaaacugaacaagaaugugccgaccaacgucagaaguucuuucccaguaagccucccccuggcuuacccucauccccacuuugcacuucuggccgcucagacaaugcaacagauccgccauccaaggcucccuauggcccaguucgggggaaccuuuucacccuccccaaacacauggggcccuuucccggugcgucccguuaauccaggcaacacuaauaguagcccuaagcacaacaauaccucucgguugcccaaccagaaugggacggugcugccauccgagucagcaggauuagccacagcuagcugcccuauuacugucucgucugugguugcggccagucaacagcuaugugugaccaacacaagaacccccuccagcgucaggaaacagcuguuugcaugcgugccgaagacuucacccccugcuaccguaauauccucugugacaagcacguguaguucccuccccagcguuucuucagccccaaucacaaguggucaggcacccaccacauuccuuccugccuccaccagccaagcucagcugucuucgcagaaaauggaaucauuuagcgccgucccgcccacuaaggagaaaguguccacacaggaucaaccaauggcgaauuugugcaccccuaguucuacggcaaacagcuguuccucaagugccucuaauacucccggcgcuccugaaacacacccaagcuccucacccaccccuaccagcucuaacacucaggaggaagcccagccauccagugugagcgaccugucgcccauguccaugccguucgcaucuaauucagagccugcuccacucacacugaccagcccccgcauggucgccgcugauaaccaggacacaaguaaucuuccucaacucgccguuccagcaccccgagugucccauagaaugcagccgcgggggucuuuuuauagcaugguaccuaacgcgacuauucaccaggauccccaaucaaucuucgugacgaacccagucacccugacaccuccccagggaccacccgccgcugugcaguuguccagugccguuaauauuaugaacggcagccagaugcauaucaauccugcaaacaagucucugccaccgacuuuuggucccgcuaccuuauucaaucacuucucaucccuauuugacagcucucaagugccugccaaccagggguggggcgacggaccacugaguucgagggucgcaacagaugccuccuucaccguacagagcgcguuucucggcaauucagugcuugggcaucuggagaacaugcaccccgacaauucuaaagcuccuggauuccgcccacccagccagcguguuuccacuagcccuguggguuugccgucaauagauccaucuggcagcucccccaguagcuccucugccccucuggcaucauuuagcgggauccccggaacgagagucuuccuccaaggcccagccccuguggguacccccucguuuaaccggcagcacuucuccccacauccguggacaagugcuucuaauagcucaacuuccgccccucccacccuggggcagccaaagggcgucucugcaagucaggacaggaagauucccccuccaaucggaacagaacgccuugcucgaauuagacaaggcgggagcguggcccaggcgcccgcuggaaccuccuuuguugccccugugggucacucaggcaucuggagcuucgggguaaacgcagugucugagggauuaaguggcuggucccagagcgucauggguaaucauccgaugcaccaacagcugucagauccaucuacuuuuucccagcaccagcccauggaacgggacgauucggggaugguugccccuagcaacauauuccaucaaccaauggcuaguggcuucguggacuuuucuaaaggacuccccauuuccauguacggcgggacaaucaucccuagccacccccaguuggcagaugucccaggaggcccgcuguucaauggucuacauaacccugaccccgccuggaacccaaugauuaaggugauacaaaauucaacggagugcaccgaugcgcagcaagccagucugcucccuuccguacccgcucuuaaaggggaaaucccaagcccucagcugacuaggcccaagaaacgcauuggaagaccgaugguggcaucuccaaaccagaggcaccaggaccauuugcggccuaagguucccgccggcgugcaagagcugacacacuguccagauacaccccuccugccuccgucagacagccguggucacaauuccucuaacaguccaucguuacaggcuggcggggccgagggagcaggcgaccgcgggcgagauaccagauga

SEQ ID NO: 52757 - RNA, 7629 nt, Artificial Sequence
  derived and/or modified sequence opt3 from ANKHD1__Homo_sapiens__NP_060217
augcugaccgacaguggcgggggagguacuuccuucgaggaggaucucgacucuguggcccccagaucagcuccugccggcgccagugagccaccgcccccugggggagucggccuugguaucaggacuguucggcuguuuggggaggcgggaccagcuagcggcgugggcuccucugggggagguggcucggggucaggaacgggcgguggggaugccgcauuggacuucaaguuagccgcugcaguacugcgcaccggaggcggcgggggagccagcgguagugaugaggacgaaguguccgaggucgagucuuuuauuuuagaucaggaagaccucgauaaccccgugcugaaaaccacuagcgagauauuccuuuccucaaccgcugaaggcgccgaccugcgaacaguugauccugagacccaagcgcguuuggaggcacuccuggaagccgcugggaucggaaagcugaguacugccgacggcaaagcauuugcugauccagaggugcucagaagguuaacaagcucugucuccugcgcccuggacgaagcggccgcagcucuuacccggaugaaggccgaaaauucacacaacgcuggucagguggacacgcgcagcuuggccgaagcauguagugauggggacguaaaugccguuagaaaacugcuagaugagggcaggucugugaacgagcauacugaagagggagaaucccuccugugccuugcuuguagcgcgggcuacuaugagcuggcacaggucuugcucgccaugcacgcuaauguggaagaccgggggaacaagggagauauuacaccacugauggccgcaucgucugguggcuacuuagacaucgugaagcugcuccuucugcaugaugccgacgucaauucccagucagcuacagggaacacugccuugaccuaugcaugcgcgggaggcuucguugauauugugaaaguacuacugaaugagggugcuaacaucgaggaccacaaugaaaacgggcauacaccucucauggaggccgcaagugccggccacguggaagucgcucgcgugcugcuugaucacggagccggcauaaauacccauagcaacgaguuuaaggaauccgcacugacguuggcuuguuacaaagggcaccucgacaugguucgauuccuguuagaggccggagcggaccaagagcauaagacugaugaaaugcacacagcccugauggaggcuugcauggacggucacguggaagucgcaagacuacuccuggauucuggcgcccaggugaauaugccagcugacagcuuugagucaccgcuuaccuuggccgcaugugggggacauguagagcuggcggcccuccugaucgaaaggggcgcuaaccuugaggaaguuaacgaugaggguuauacuccccugauggaagccgcacgggaggggcacgaggaaaugguggcuuugcuccuggcccagggcgcaaauauuaacgcccagacagaggaaacccaagagacggcuuuaacccuggcgugcuguggaggcuucagugaagucgccgacuuucuaaucaaagcaggggcugauauugagcucggaugcuccacaccucugauggaggccagccaggaaggccaucuugaguuggugaaguaccugcucgccucuggugcuaauguccacgcaacuaccgccacaggggacacugcgcugaccuaugcuugugaaaacggacauacagauguggccgacguuuuacugcaggcaggcgccgaucuugagcacgaaucagaggguggccguaccccauugaugaaggcugcacgcgccgggcaccucugcacugugcaguuccugaucaguaaaggagcgaauguaaacagagcuacggccaauaacgaccauacagucgugagccuagcaugcgccggcgggcaccuggcuguuguggagcuccugcuugcccauggagcagaucccacccacagguugaaggacggcuccacuaugcugauagaagcugccaaaggugggcacaccaaugucgugucuuacuuacucgacuacccuaacaauguacugucggugccaacaaccgauguuagccaacuucccccgccuucccaggaccagucacaagucccccgggugccaacucauacacuggcgaugguggucccuccccaggagccagaucgaacgagucaggaaaacucucccgccuugcucggaguucagaagggcaccagcaaacaaaaguccucaagccuacagguggcagaccaggaucuacugccuucuuuucacccauaucagccgcucgaguguauuguggaggaaacugaggguaaacugaaugaacuuggccaacgcaucuccgcuauugagaaggcccaguugaagagucuggaauuaauccagggggagccccucaacaaagacaagaucgaggaacugaaaaagaauagagaggaacagguacagaagaagaagaaaauucuuaaggagcugcagaaagucgaaaggcagcuacagaugaagacacaacagcaguucaccaaagaguaccucgagacaaagggacaaaaggauacugugagccugcaucagcagugcucucaccggggcguuuucccugaaggggagggagacggcuccuugccagaagaucauuuuucagagcugccccagguggacaccauauuauucaaagauaacgacgucgaugacgaacaacagaguccuccaagcgcugagcagaucgacuuugugcccguucagccgcucucguccccucaauguaacuucucuagcgaucuggguucaaaugggacgaacagucuugagcugcagaagguguccggaaaucagcagauuguaggccaaccacagaucgcaauaaccggucacgaccagggcuugcucguccaagaacccgaugggcugaugguggccacuccugcccagacucuaaccgacacacuggaugaccuuauugcugcggugucuacucgcguccccaccggaagcaacuccucaagccagacgacagagugccucaccccagaaaguuguucucagacuacauccaauguugcaagccaaucgaugccucccguguauccaucaguagauaucgacgcccacaccgagucuaaccaugauacugcucugaccuuggccugcgcaggcgggcacgaggaacuggugagugucuuaaucgccagagacgcuaaaauugagcauagggauaagaaaggauuuacaccgcucauccuggcggccacggcaggccacguggguguuguggaaauucuucuggacaaagggggagacauagaggcucaguccgaacguaccaaggauacuccuuugagccucgccuguucuggcggccggcaggaggucguggaccugcuacuggcacgaggggccaauaaagagcauagaaacguuagcgauuacacaccccuuucccucgcugccucaggagguuaugugaauaucauuaagauccuguugaacgcgggcgcagaaaucaauaguaggaccgggagcaaauuaggaauuucuccacugaugcucgccgcuaugaacggccacguccccgccguaaagcugcuucuggacauggguuccgauauaaaugcucagaucgagacaaaccgcaauacugcauugacccuagccugcuuccaagggcgggcugaagugguuucacugcuccuggacagaaaagccaacguggagcacagggcaaagacgggacuuacaccuuuaauggaagcggccaguggcggcuacgcugaggucgggcgcgugcugcucgauaaaggagccgacguaaacgcaccacccgugccuagcucccgagauaccgcuuugacuauugccgcagacaagggucauuauaaguuuugugagcugcucauccaccggggcgcccauauugauguccguaauaaaaaggggaacaccccgcuguggcuugcuucuaauggaggccacuucgacguugugcagcuguuggugcaggcgggugccgaugucgacgcagcugacaacagaaaaaucacaccacuaaugucggccuuuaggaaggggcacgugaaaguuguacaguaccuggugaaggaagucaaucaauuccccagcgauauagagugcaugcgcuacaucgccacuauuaccgacaaggaacuccugaaaaagugucaucagugcguggagacaaucguuaaagcaaaggaucagcaggcugccgaagcgaacaaaaaugcuucaauucugcuuaaggagcuggaccucgagaagucccgggaagagaguagaaaacaagccuuggcagccaagagggaaaaacgaaaggagaaacgcaagaagaaaaaggaggaacagaaacggaagcaggaggaagaugaggaaaacaaaccuaaggaaaauucugagcugccagaagacgaggaugaagaggaaaacgacgaggauguggagcaagaaguccccaucgagccuccgagcgcuacgaccacuacaaccauaggaauuuccgcaacuucagccacauuuaccaauguguucggcaaaaagagagcgaacguagucacgacucccucuaccaauaggaagaacaaaaagaauaaaacaaaggaaaccccaccuacugcucaccucauccugcccgagcagcauaugagccuugcccagcagaaagcagacaagaacaagauuaacggcgaaccacgugggggaggugccggcgggaauagugauuccgacaaccuagauagcacagacugcaauucugagucauccaguggaggcaaaagccaagagcugaacuuugugauggacguuaauucgucuaaguauccuuccuuguuacugcacagccaggaagagaaaaccucaacagcuacaaguaagacccagacgcgccucgaaggugaggugacacccaacucucuguccaccagcuacaaaacugucucacuuccacugaguagcccgaauaucaagcucaacuugaccuccccuaagcgggggcagaaaagagaggaaggauggaaggaggugguuaggcgaucuaaaaagcugagcgugcccgccuccgucgugucacggauaaugggccgcggcggguguaauaucacagcaauucaagauguaacuggagcucauaucgacguggauaaacagaaggacaagaacggugaaagaaugauuaccaucaggggcgggacggagucuacacgguaugccguucagcuaauaaaugcgcugauucaggauccagccaaagaacucgaggaccuuauccccaagaaccacauccgaaccccugcaaguacuaaaucgauucacgcuaauuucagcuccggagucggcacaaccgccgcaucuucaaagaacgcuuucccacugggugcccccacuuuagugacaagccaagccaccacguuguccacuuuucagccugcgaauaaacugaacaagaaugugccgaccaacgucagaaguucuuucccaguaagccucccccuggcuuacccucauccccacuuugcacuucuggccgcucagacaaugcaacagauccgccauccaaggcucccuauggcccaguucgggggaaccuuuucacccuccccaaacacauggggcccuuucccggugcgucccguuaauccaggcaacacuaauaguagcccuaagcacaacaauaccucucgguugcccaaccagaaugggacggugcugccauccgagucagcaggauuagccacagcuagcugcccuauuacugucucgucugugguugcggccagucaacagcuaugugugaccaacacaagaacccccuccagcgucaggaaacagcuguuugcaugcgugccgaagacuucacccccugcuaccguaauauccucugugacaagcacguguaguucccuccccagcguuucuucagccccaaucacaaguggucaggcacccaccacauuccuuccugccuccaccagccaagcucagcugucuucgcagaaaauggaaucauuuagcgccgucccgcccacuaaggagaaaguguccacacaggaucaaccaauggcgaauuugugcaccccuaguucuacggcaaacagcuguuccucaagugccucuaauacucccggcgcuccugaaacacacccaagcuccucacccaccccuaccagcucuaacacucaggaggaagcccagccauccagugugagcgaccugucgcccauguccaugccguucgcaucuaauucagagccugcuccacucacacugaccagcccccgcauggucgccgcugauaaccaggacacaaguaaucuuccucaacucgccguuccagcaccccgagugucccauagaaugcagccgcgggggucuuuuuauagcaugguaccuaacgcgacuauucaccaggauccccaaucaaucuucgugacgaacccagucacccugacaccuccccagggaccacccgccgcugugcaguuguccagugccguuaauauuaugaacggcagccagaugcauaucaauccugcaaacaagucucugccaccgacuuuuggucccgcuaccuuauucaaucacuucucaucccuauuugacagcucucaagugccugccaaccagggguggggcgacggaccacugaguucgagggucgcaacagaugccuccuucaccguacagagcgcguuucucggcaauucagugcuugggcaucuggagaacaugcaccccgacaauucuaaagcuccuggauuccgcccacccagccagcguguuuccacuagcccuguggguuugccgucaauagauccaucuggcagcucccccaguagcuccucugccccucuggcaucauuuagcgggauccccggaacgagagucuuccuccaaggcccagccccuguggguacccccucguuuaaccggcagcacuucuccccacauccguggacaagugcuucuaauagcucaacuuccgccccucccacccuggggcagccaaagggcgucucugcaagucaggacaggaagauucccccuccaaucggaacagaacgccuugcucgaauuagacaaggcgggagcguggcccaggcgcccgcuggaaccuccuuuguugccccugugggucacucaggcaucuggagcuucgggguaaacgcagugucugagggauuaaguggcuggucccagagcgucauggguaaucauccgaugcaccaacagcugucagauccaucuacuuuuucccagcaccagcccauggaacgggacgauucggggaugguugccccuagcaacauauuccaucaaccaauggcuaguggcuucguggacuuuucuaaaggacuccccauuuccauguacggcgggacaaucaucccuagccacccccaguuggcagaugucccaggaggcccgcuguucaauggucuacauaacccugaccccgccuggaacccaaugauuaaggugauacaaaauucaacggagugcaccgaugcgcagcaaaucuggccugggacuugggcaccccacauuggaaacaugcaucugaaauauguaaauuga

SEQ ID NO: 52758 - RNA, 1479 nt, Artificial Sequence
  derived and/or modified sequence opt3 from ANKH__Homo_sapiens__NP_473368
auggugaaguuccccgcccugacccacuacuggccucucaucagauuucuugucccacugggcauuacaaacauagcuaucgacuucggggagcaggcauugaauaggggaauugccgcgguuaaagaagaugcuguggagauguuagccagcuauggucuggcauacucccuaaugaaguuuuucacuggcccgaugucugacuuuaaaaacguagggcucguguucgucaauucaaagcgggaucgcacgaaagccgugcugugcaugguuguggcuggagcaaucgccgcugucuuucauacccuuauugccuauagugaccugggcuacuauaucauaaacaaguugcaccauguggaugaaagcguagguuccaagacacgacgugcguuccucuaccuggcagccuuucccuucauggacgcuauggccuggacucacgcagggauccugcucaaacauaaguauucguuuuuaguuggaugugcuucuauuucagaugugaucgcccaagucguguucguggcgauucugcuucacagccacuuggagugcagagaaccucugcuaaucccaauacucagucuguacaugggcgcccuugucagguguaccacacugugcuugggcuacuauaaaaauauucaugacaucauucccgaucgguccgggccugagcucggaggugacgcaaccauccgcaagaugcugucuuuuugguggccauuagcucugauccucgccacucagagaauuagcaggcccauaguuaaccuuuucgugucccgggaucugggcgggucaagugcugccacagaggcaguagccaucuugaccgcuacguacccugugggacacaugccauauggcuggcuaacugaaauucgcgcggucuacccggcauucgacaaaaauaaccccagcaauaagcuggugucuaccuccaacacaguuacugccgcucauaucaagaaauuuaccuucguguguauggcccucucacugacacuuugcuuugucauguucuggaccccuaaugugagcgagaagauacugauugauaucaucgguguagacuuugcauucgccgaauuguguguugugccacuccgaauuuuuaguuucuuucccgucccugugacggucagagcucaccugacugggugguuaaugacacugaaaaagaccuucgugcuagccccaucuuccguucucaggaucauugugcugauagcaagccuuguagucuugcccuaucugggagugcacggcgcgacucucggcguugggucgcugcuugcuggauuugugggugagucuacaauggucgccaucgcagccugcuacguguaucggaaacagaagaaaaagauggagaacgaauccgcuaccgagggcgaagacucagccaugacggauaugccgccuaccgaggaaguaacagacauuguggagaugcgugaggaaaaugaguga

SEQ ID NO: 52759 - RNA, 2298 nt, Artificial Sequence
  derived and/or modified sequence opt3 from ANKK1__Homo_sapiens__NP_848605
auggccgcugaccccaccgagcugagacucggcagccuuccuguguucacaagggaugacuuugaaggggauuggcggcuggucgcauccggagguuucucucagguuuuucaagcccgccaccgacguuggagaacugaguacgcgaucaagugcgcuccauguuugccgcccgacgccgcaucaagugaugugaacuauuuaauugaagaggccgcuaaaaugaagaaaauaaaguuccagcauaucguaagcauuuacggcgugugcaaacagccucuggggaucgucauggaauuuauggcaaauggaucccuagagaaggugcucucuacgcacucgcuguguuggaagcugagguuccggauuauccaugagaccucacuggccaugaacuuuuugcacagcauaaaaccaccccuccugcaucuggaccucaagccuggcaauaucuuacuggauaguaacaugcacguuaaaauuuccgacuucggucuuucuaaguggauggaacagagcacacgcaugcaauauaucgagagauccgcuuugagggggaugcugucauacauuccacccgaaauguuucuagagaguaauaaagccccuggaccaaaguaugauguguacagcuucgcgaucgucauaugggagcuccugacucagaagaaaccguauucuggcuuuaacaugaugaugauuaucauucggguggcagccggcaugcgccccucccuucagccuguaucagaccaguggccaagcgaagcucaacagaugguugaucugaugaagcgaugcugggaccaggaucccaaaaagagaccuuguuucuuggacaucaccaucgagacagacauucuccugaguuuacugcagucuaggguggccgucccagaauccaaagcacucgcucggaaggugagcugcaaacuuucgcugcgucaacccggggaggugaaugaagauauaucucaggaguugauggacuccgauucaggaaacuaccuaaagcgcgcccugcagcucagugacagaaagaaucuggucccgagggaugaggaacuuuguaucuacgagaacaaaguuaccccucugcacuuuuugguggcgcaagguagcguagaacaggugcggcuccuguuagcccaugaggucgacguggauugccagacugcauccggcuauacaccccugcuaauugcugcccaggaccaacagccagaucucugugcucugcuuuuggcccacggggcagacgccaaucgaguugaugaagacggaugggcuccucugcauuucgcggcacagaacggcgacgaugguaccgcccgccuccugcuugaccacggggcuugcguggaugcccaggagagagagggauggacgccccugcacuuggcagcccaaaauaacuucgaaaaugucgcuaggcuccuggugucucggcaggccgacccaaacuuacaugaggcagaaggcaagacuccccugcacguagcggcuuacuuuggccauguuagccuagugaaacuccugaccucacagggggccgagcuugaugcacagcaacgcaacuugagaacaccucugcaccucgccgucgaaaggggaaaggugcgugcuauccagcaucuguuaaaaaguggugccgucccagacgcacuggaucaguccggcuaugggccgcuucacacugcugccgcgcggggaaaguacuugauauguaagaugcuccugcgauauggcgccagccuagagcugcccacccaccaggguuggacaccucuccaucuggcugcauacaaagggcaccuugagauuauccauuugcuggccgaaucucacgcuaauaugggcgccuuaggagcagugaacuggaccccacuccaccuggcggccagacauggcgaggaagcuguugugucagcccuucugcaaugcggggcagaccccaaugcugccgagcagaguggauggacgccuuugcaccucgcaguacagaggagcacuuuccuguccgucaucaaccuacuggagcaucacgccaaugugcaugcucgcaacaagguugguuggacaccagcgcaccucgccgcacugaaaggcaauaccgcuauucuuaagguguuggucgaagccggggcccaacuggaugugcaggacggaguaucuugcacucccuuacagcucgcucugcggucgagaaaacagggcaucaugagcuuucuugaggguaaggaaccguccguggcaacacuugggggcucaaagccuggagccgagauggaaauuuga

SEQ ID NO: 52760 - RNA, 1956 nt, Artificial Sequence
  derived and/or modified sequence opt3 from ANKLE1__Homo_sapiens__NP_001265373
auguggacccccgugagaaggggcgccgcuuggcuggggacacuccuuggaccuggugagggcccaccggaaccccgcgggggagcagcccacgcgcauaagccuccagcuggcagccggaaauccacugaccaggccguccgauucggucccucucaagggaugugcucagaggcacgucuggccagaagguugcgggaugcuuuacgcgaagaggaaccuugggcaguugaggagcugcuaagauguggagccgacccaaaccucgugcuggaagauggcgcugccgcgguacaccuugcagccggcgcuaggcauccccgggggcugcgcugcuugggagcccuccugcgacaggguggcgacccuaaugcaagaaguguggaggcucugacgccacuccacgucgccgcggccuggggguguaggcggggauuagaacugcuuuugagccagggcgcagauccggcucugcgugaccaggauggucuacgcccccucgaccuggcccuucaacaggggcaucuggagugcgcuagaguguugcaggaucucgacaccaggacacggacucgaacccgcaucggagccgagacacaggaaccugagccagcacccggcaccccuggccuguccgggccaacugaugaaacauuagacucuauugcccugcaaaagcagcccuguagaggagauaacagggacauaggucucgaggcugacccgggcccucccucgcuuccaguuccucuggaaaccguggauaaacacgggucaagcgcgagucccccaggacacugggacuacuccucugaugcuagcuuugucacggccguggagguauccggcgcugaggaccccgccucagauacuccuccaugggcagguaguuugccgcccacccggcaggggcuacugcauguugugcacgccaaucagcgcgucccuagaagccaaggcacagaagcugagcucaacgccaggcugcaggcacuuacucugaccccacccaaugcggcuggauuccagucuuccccuucaagcaugccauugcucgaccguagucccgcccauucuccgccucggacaccaacccccggcgcauccgauugccacugucugugggaacaccaaacgagcaucgacucggauauggccacuuuauggcugacagaggacgaagcaucuuccaccgggggacgagagccugugggucccugcagacaucuaccagugucaacugucagugaucucgagcugcuuaagggcuugagggcccuggggccugaauuuagcggacacucccucgagcuggcagcugcccuucgcacaggcuguauucccgacguucaggcggacgaagaugcccuggcucagcaguucgagcaaccagacccggcacggagauggagggaaggugugguaaaaucuagcuuuaccuauuugcuccuggauccucgcgagacgcaggacuuacccgcccgagcuuucucacugaccccagccgagcggcuacagacauuuauccgugcaauuuucuacguggggaagggcacuagagcgaggcccuauguccaucucugggaagcccugggacaccauggccgcagucggaagcagggguccagaaggagcccuacccgaucuaaaggaacagcuauggagugguggcaagccggucaccuuuugguggcaggcgcuugggggugcacuuguugcaccguuccaucacugaguagcuggcucaaggccuccgauucuuuuaucccccgcacaucgcggccuggagcagaaugcuggggcgugggucacccggccuggggcgagauguucgaguguagcuccugcccaaugcugaccgcugcgcccauaucaggguuuagaaggggagucugugugugcguauguguuugcgugugugucugcguguguuuaugcgucugugugugcguuuga

SEQ ID NO: 52761 - RNA, 2817 nt, Artificial Sequence
  derived and/or modified sequence opt3 from ANKLE2__Homo_sapiens__NP_055929
augcuguggcccagacucgccgcugcagagugggccgcgcuugcuugggaacuguugggcgccagcguguuacugaucgcagucagguggcuaguucggcgccucgggccucgaccaggaggucugggccguuccgggaccccggugcccccuccaucugccgcugcagcccccgcuucaggagagaugacaauggacgcccuucuggcgagauugaagcuccugaacccugaugaccugagggaagagauuguaaaagcaggccucaagugcgguccaauaacgaguacuacccgguucaucuuugagaaaaaguuagcccaggcucugcuugaacaagggggacgcuugagcuccuucuaccaccaugaggccggcgugacagcacugucucaggauccccagagaauuuugaaaccugcugaaggcaauccaacugaccaggccggguuuucggaggauagggacuucggauauucagucggucucaacccgcccgaagaggaggcggugaccagcaagacauguaguguuccuccauccgauaccgacacuuaccgggccggcgcaacagcuucuaaggaacccccucuguauuacggggugugcccagucuaugaggaugugcccgcccgcaaugaacgaaucuacguauaugagaacaaaaaggaagcccuucaagcuguuaaaaugauuaagggaagcagauuuaaagcauucuccaccagggaggacgccgagaaguuugcucggggcaucugugauuacuucccgucaccuaguaagacgagccugcccuugucuccagugaaaacugcgccucucuuuuccaaugaccgucugaaggaugguuuaugccugucagaaagcgagaccgucaacaaagaacgcgcaaauaguuacaagaaccccagaacacaggaccucacugccaaacuuaggaaggcuguggagaaaggggaagaggacaccuucucugaucugauaugguccaauccacgguauuugaucggaagcggcgacaaccccacaauugugcaggagggcugucgauacaaugucaugcacguugccgcaaaggaaaaccaggccucgaucugccaacuaacccuggaugugcucgagaauccugacuuuaugcgccugauguauccagaugacgaugaagcuaugcuucagaagagaauuagguacguaguggaccuguauuugaacacgccggauaaaaugggguacgacacuccccuccauuucgccuguaaguuuggaaaugcagaugucgugaacguucugucuucccaccauuuaaucgugaaaaacucacggaauaaguaugacaaaacaccugaggacgucauaugcgaacgcaguaagaacaagagcguggagcugaaagagagaauuagggaauaccuaaagggucacuacuauguaccacuccugcgugcggaggaaaccuccucucccguuaucggcgagcuuuggagcccugaucagacugcugaggccucacacgugagucgguacgggggauccccacgagaccccgucuugacacugagagcauucgccggcccgcucagcccugcuaaagccgaagauuucaggaagcuguggaaaaccccaccccgcgagaaggcagguuuucuucaucacgugaagaaaucugacccugaacggggguucgagagagucggcagggaacuggcucaugaguugggauaucccuggguggaguacugggaauuucucggcuguuucguugaucugucaagucaggagggguuacaacgccuggaagaguaucuaacgcagcaggaaauuggaaagaaagcccaacaggagaccggugagcgagaagcgagcugccgggacaaggccacaacuuccggcucuaauucgaucagcgugcgugcuuuucucgaugaggacgauaugucccuggaagagaucaaaaacagacagaaugcagccaggaacaauucaccaccuaccguaggggcuuucggacacacacgcuguagugccuuuccccuugaacaggaggcagacuugauugaggcggccgaaccaggcgguccgcacucuagccggaacgggcugugccauccucucaaucacuccagaacucuggcuggcaagaggcccaaggccccacgaggagaggaagcacauuuacccccugucucagaucugaccguggaguucgacaaacuuaacuugcaaaauauaggccgcagcguuucuaagacaccagaugaguccaccaaaacuaaggaccagauccucacgagucggauuaacgcuguggaaagagaccugcuagagcccagcccugccgaucagcuggggaauggacacaggcguacagaaucugagauguccgcacgcaucgccaaaaugucacucaguccgagcucgccacggcaugaagaccagcuggaggucaccagagagcccgcuaggcgacuuuuucuauucggugaggaaccuuccaagcuggaucaagacguguuagcggcccucgaaugcgcagauguagacccacaccaguuucccgcugugcaccgguggaaaucugccguucuguguuacagcccuucagaucgccagaguuggccgucccccgccgucaagggcagauucaagucucagcuuccagaccugagcgggccucauuccuauucacccggaaggaacagcguggcuggcaguaauccagcaaaaccugguuuggggucucccggccgguacuccccagugcacggaagccaacuccgaagaauggcccgccuggcggagcuagcugcccuguga

SEQ ID NO: 52762 - RNA, 3093 nt, Artificial Sequence
  derived and/or modified sequence opt3 from ANKMY1__Homo_sapiens__NP_001269700
auggagggcgcccacgcuagccugucccucgaagacgaggugucuggggcaggaucaagacagaggccccuugaagguaagggcggggagaccccugccgcggaggagccaggaagucugaaaaacuacgcugucuucgccacacgggauguuagcgcagccccggagaaggaagaggaagaggcugagggccccuugcgcgcacaagacuuacgagaauccuauauccagcuggugcaggguguacaggaguggcaagaugggugcauguaccagggagaauuuggccuaaauaugaaacucggcuaugggaaguucucuuggccuacuggagagucguaccauggucaguuuuaucgugaccacugucauggccuggggacguacauguggccagauggaagcucauucaccggcacauuuuaucuuagucacagagaagguuacgggacuauguacaugaaaaccaggcuguuccagggauuguauaaggccgaccaacgguuuggccccggcguggagacauacccugaugggucccaggacgucggacucugguuccgcgagcagcugauuaagcugugcacccagauaccaucugguuuuagccucuuaagauaucccgaguucuccucauuuaucacucauaguccugcuaggauuagccugucugaagaagagaaaacagaauggggccuucaagaggggcaggauccauucuuuuacgacuauaagcgguucuugcugaacgauaaucuaacccucccgcccgagauguacguguauuccacgaacucagaccaccuuccuaugacuagcaguuuccgcaaagaacuugaugcccgaaucuuucugaaugagauuccacccuucguugaagacggagagccuugguuuaucauaaacgaaaccccauugcucgugaagauccagaaacaaacauacaaguucagaaauaagcccgcgcacacuucuuggaacaugggcgcaauucuggaggguaaaagguccggguuugccccguguggcccuaaggagcaguuaagcauggaaaugauccugaaagcugaggaaggaaaucaugaguggauuugccggauccucaaggacaacuucgccucggcagaugucgcugacgccaaaggcuacaccgugcuugcggccgcagcuacacacugucauaaugauauaguaaaccuguugcuagacugcggggccgauguuaauaaguguucugacgagggacugaccgcucucuccaugugcuuucugcuucacuaucccgcccagucauucaaaccaaacguggcagaacguacgauuccugagccccaggaaccacccaaguuuccugucgugccaauccugaguagcuccuucauggauacuaauuuggagucucucuacuaugaagugaacgucccgagccaagguucauacgagcugagacccccuccagcccccuuacugcuaccucgcguuaguggcucccacgaagggggacauuuucaggacacaggccaguguggugggagcauugaucacaggucuucaagucucaagggcgacagcccacuggugaaaggaucccuuggccauguagaaucuggguuggaggaugugcugggaaacaccgaccgggguucgcucugcagcgcugaaacuaaguucgaguccaaugucugugugugcgacuuuucaaucgaacugagucaggcgaugcuugagcgaucugcacaaagccacucccuguugaaaauggccucacccagcccgugcacaucuuccuucgauaagggcaccaugcgcagaauggcucucaguaugaucgagaggcggaaacgcuggagaacgauuaagcuguuacugaggcguggggccgacccuaaccuauguugcguuccaaugcagguccucuuccuggcagugaaggccggagauguggacggcguacggcuuuugcuggaacauggugcucgaaccgauauauguuuucccccucagcucagcacacugacucccuuacacaucgccgcagcgcugccaggggaggaaggcguucagauuguggagcuuuugcuccacgcuaucaccgacgucgaugccaaagcaucugacgaagaugacacauauaagccuggaaaacuggaucuacugcccuccucacucaagcugaguaaugagccaggcccgccucaagccuacuauagcacugacaccgcucugcccgaggaagggggaagaacagccuugcauauggcaugcgagagggaagaugacaacaaaugugcucgcgacauagugcggcuguuacucucgcacggcgccaauccaaaccugcuuugguccggucauucuccccugagcuugucaauugcgagugggaaugagcucgucgugaaggagcugcuaacccagggagccgauccuaaccugccacucacuaagggccuggguuccgcucuuugcguugcaugugacuugacguacgaacaccagagaaauauggauucuaaacuggccuuaaucgacaggcucaucagccacggcgcugauauucugaagcccgugaugcuucgccagggggagaaagaagccguaggaacagcagucgacuacggcuauuuccgauuuuuccaagaucggcguaucgcgagaugcccuuuucauacccugaugccggccgagagggaaacuuuccuagcucgcaagcggcuccuggaguacaugggguugcagcugagacaggccguguuugcaaaagagucccaaugggacccaaccugguuauaucucuguaagagggcugaacugauucccucacaccgaaugaagaaaaagggaccuagccuuccacgcggccuggauguuaaagagcagggucagauacccuucuuuaaguucugcuaccagugugggcggaguaucggagugagauugcucccuugcccgaggugcuauggcauucugacauguucuaaauacugcaagaccaaagccuggacugaauuucauaagaaggacuguggugaucuagucgcaaucgugacacaacuggagcagguaucccgucgccgggaagaguuccaguga

SEQ ID NO: 52763 - RNA, 663 nt, Artificial Sequence
  derived and/or modified sequence opt3 from ANKRD10__Homo_sapiens__NP_001273650
augagcgccgcuggcgcaggggccggaguggaggcggguuucuccucugaggaacugcucucacuuagauuuccccugcacagggcuugccgggacggcgauuuggccaccuuauguagucugcuacagcaaacaccucaugcacaccucgccagcgaagacuccuucuacggguggacuccaguccauugggcugcacacuuuggaaagcuggagugccuuguucagcuggugcgcgccggcgcuacguugaacguaucuaccacacgauaugcccagacuccggcgcauaucgcagccuucggugggcacccccagugucucguguggcugauucaagcuggagccaauauaaacaaaccugauugcgaaggcgagaccccaauccacaaggcagcucguucgggcucacuggaguguauuagcgcccucgucgcgaauggggcccauguggaauuuaucagucaguccucuguucacagcugcuuacccggagagcugcagcauggugugacauucgacccuuccguccuuauucaguguuugaaaccagaaaagugccaauggcccgauucaaguagacacuguaccaacccuggcuuuccaagggugugcccgguaagccuggagcccccugagcuaucuuccgaaccauuccucuga

SEQ ID NO: 52764 - RNA, 7992 nt, Artificial Sequence
  derived and/or modified sequence opt3 from ANKRD11__Homo_sapiens__NP_037407
augcccaagggcgggugcccuaaagccccacagcaagaggaacugccgcucagcuccgacaugguggagaagcagaccggcaagaaggauaaagacaaggucucucuuacaaagacucccaaacuggaaagaggugauggcgggaaggagguuagggaacgggcuucaaaacgcaaguugccuuucacggcuggagccaacggcgagcagaaagacagugauaccgagaagcaggguccagaacgaaagcguaucaaaaaggagcccgugacaagaaaagcgggguuacuguuuggaaugggccuuagcggcauuagggcuggguacccucucuccgaacggcaacagguugcccugcuuaugcagaugacugcagaggagucugccaauucgccaguggacaccacacccaagcacccuucacagagcaccgucugucaaaaaggaacuccaaacagugcuuccaagacaaaagauaaggugaauaagcgcaacgaaagaggugagaccaggcugcaucgggcagccauacgcggcgacgcucgaagaaucaaagaauugauuucugagggggccgauguuaaugugaaggacuucgcgggauggacggcacuccacgaagccugcaacaggggcuauuacgaugucgcuaaacagcugcuggccgcuggugcugaggugaauacuaaggggcucgacgaugacaccccguuacaugacgccgcgaacaauggacacuauaaaguaguuaagcugcuuuugcgguacggcggcaacccccagcagagcaaucguaagggggagacaccucugaaaguggccaacuccccaacuauggucaaucuacuccugggaaaggguaccuauacaucaagugaagagagcucuaccgaauccucagaggaagaggaugcacccagcuuugcuccuaguucuuccguggacggcaacaauacggauagcgaguucgaaaaagggcuuaagcauaaagccaagaacccagagccccaaaaggcuacugccccggugaaagacgaauacgaguuugaugaagacgaugagcaggaccgcgucccucccguugaugacaagcaccuguugaaaaaggauuauagaaaagagacaaagucgaacucuuucaucuccauuccaaagauggaagugaaaucauacaccaagaauaacacuaucgcaccuaaaaaggccagucacaggauacucagcgacacauccgacgaggaagaugcuucuguaaccgugggaacgggcgagaaacugcgguuaagcgcgcauaccauccugcccgguucaaagacacgagagccaaguaaugcaaaacagcaaaaggaaaagaacaaagucaagaaaaagcgcaaaaaggagacuaaggggagagaagugagguuuggcaaacgguccgacaaguucuguagcucugagucagaaagugagagcuccgagucuggagaagaugaccgcgauucgcucggcagcuccgggugccuuaaaggaucaccccugguuuugaaggacccuagucuauuuucuagccuguccgccucaagcaccucuucccacgguaguagcgcugcccagaaacagaauccaucucauacagaucagcacacuaagcacuggagaaccgacaacuggaagacaauuuccucaccggcauggagugaggugagcucgcucuccgauucuaccaggacucgucugacgagcgaaucagacuacaguuccgagggcucuagcgucgaaucccuuaaacccgugcggaagcgacaagagcauagaaaaagggccucacugagcgagaagaaaaguccuuucuugucuuccgcugaaggggccguaccaaagcucgauaaggagggaaaaguugugaagaaacacaagacaaaacauaagcacaaaaauaaggaaaagggccaguguagcaucucgcaggagcugaaauuaaagucauuuaccuaugaauacgaggacucuaaacagaagagugauaaagcaauucugcuagagaacgaccucuccacugaaaauaagcugaagguccuuaaacaugaccgcgaucacuucaagaaagaggaaaaguugagcaaaaugaagcuggaggagaaggaauggcucuuuaaagacgagaagucucugaaacggaucaaggauaccaacaaagacauaagcagauccuucagggaagagaaggaucgcucaaauaaggcggaaaaagagcgaagucuuaaggagaaaagccccaaggaagagaaacugcgguuguauaaggaagaacguaagaaaaagucuaaagacagaccuuccaagcucgagaagaagaacgaucugaaagaggacaagauuucaaaggagaaagaaaagaucuucaaagaggauaaggaaaaauuaaagaaggagaaaguguacagggaagacagugcuuuugaugaguauugcaauaagaaccaauuccuggagaaugaagacacaaaauuuagccuauccgaugaccagcgcgaccggugguucucugaucucucggacagcucauuugauuucaagggugaggacuccugggauaguccagucaccgacuacagagauaugaaaucugacagcguggccaagcugauucuugaaacuguuaaggaggauuccaaagagaggcgacgcgacucacgggcaagagaaaagagggauuaucgugagcccuuuuuccgcaaaaaggaccgggacuacuuggauaaaaacucugaaaagagaaaggagcagacagaaaaacacaagagcgugccgggguaccugagugagaaagacaagaaaaggcgagaguccgccgaagcuggccgggaucgcaaggacgcccucgagagcuguaaagaaagaagggauggacgggcaaagccugaggaagcucaucgagaggagcugaaggaaugcggcugugagucuggguuuaaagacaagucagauggagacuucgguaaaggcuuagaaccaugggagagacaccaucccgcccgcgaaaaggagaaaaaggaugggccugacaaggagaggaaagaaaagacgaaacccgagcguuauaaggaaaaauccagugauaaggacaagagcgagaaaucgauccuggagaagugccagaaagauaaggaauuugacaaauguuucaaggagaagaaagacaccaaggaaaaacacaaggauacucacggaaaagacaaggagcggaaagcgucucuugaucaaggcaaggaaaagaaagagaaggccuuuccagguaucauuuccgaggacuucagcgagaaaaaggaugacaaaaaggggaaggagaaaucaugguacauagcugauaucuucacagacgaaagugaggaugacagagauucuugcaugggcuccggauuuaagaugggcgaagcaagcgacuugccuaggaccgaugggcuccaggagaaagaggaaggacgcgaggccuaugcuucagaccgacauagaaagaguagcgacaaacagcaccccgaacggcagaaggauaaggagccaagggaccgccguaaagauagaggcgccgcagacgcgggucgggauaagaaagaaaagguauucgagaaacauaaggagaagaaagacaaggaauccacagagaaauacaaggauaggaaagaccgcgccucugucgauagcacucaagacaagaagaacaaacagaagcugccggaaaaagcugagaagaaacacgccgcagaggauaaggcuaaauccaagcauaaggaaaaaucagacaaggagcacucuaaagaacgaaagaguucgagaagcgccgacgcagagaaaucccuacuggaaaagcucgaggaggaagcccugcacgaguaucgggaagauucuaaugacaagauuucagaggugagcuccgauaguuuuaccgacagggggcaggaaccuggacuuacggcuuucuuggagguuucuuuuaccgagcccccaggcgaugacaaaccccgcgaaagcgcgugccugccugagaaguuaaaagaaaaggagagacauaggcacucauccaguagcucuaaaaagucccaugaucgggaacgugccaagaaagagaaggcagagaaaaaggaaaaaggugaggacuacaaggaaggcgggucacgcaaggauagcggacaauaugagaaagacuuccucgaggcugaugccuacggcgugucguacaacaugaaggccgacaucgaagaugagcuggacaaaacaauagaacuauuuucuacugagaagaaagacaagaaugauagugaacgagagccauccaaaaagauugagaaggaacugaaacccuaugggagcucagcuaucaacaucuugaaggagaaaaagaaaagagaaaagcacagggagaaguggcgggacgaaaaagagcgccauagagauaggcacgcagacggacuccugcggcaccaucgagaugagcuacugagacaccaucgcgacgaacagaagccugccaccagggauaaagacuccccgccacggguccucaaggauaaaucucgugacgagggccccagacugggugaugcgaaacuuaaggaaaaauucaaggacggggcugagaaagaaaagggagacccugugaaaaugagcaauggcaacgauaagguagccccaaguaaggaccccgguaaaaaggaugcaaggccucgcgagaaauugcugggcgacggggauuuaaugaugacauccuuugagcggaugcucagccagaaggaccuggaaauugaggaacgacacaaaagacacaaggagaggaugaaacagauggagaaacuucgccaucggucuggagauccgaagcugaaagaaaaggccaaacccgcugacgauggcagaaagaaagggcuagacaucccagcaaagaagccucccggacucgauccaccuuucaaagacaagaaacugaaggagucaacucccauuccaccggccgcggaaaauaaauugcacccugcuaguggcgccgauuccaaggacuggcuggcagguccccauaugaaggagguguuaccagccagcccccguccugaccaaucuaggccaaccgggguucccacgccuacaucgguccucucauguccgagcuacgaagaggugaugcacaccccacggacucccuccugcagugcugaugacuaugccgaucugguguuugacugugcagauucucagcauagcacaccuguccccaccgcuccaacuuccgccugcucaccuaguuucuuugaccgcuucucuguugcgagcuccggacuuucagagaacgccagccaggcacccgcucgaccacugucuaccaauuuguacagauccgugaguguggauauaaggcggacaccugaagaggaguucagcguaggcgacaaacucuuucgccagcaaucggucccggccgcuuccucuuaugauucacccaugccaccuagcauggaggacagagcaccccugccaccugugcccgccgaaaaguucgccugucuaaguccggguuacuauuccccagauuacggccugccuucucccaaaguugacgcacuucacugcccacccgcggcaguggucacggugaccccuagcccggaggggguauuuucaucccuccaggccaagcccaguccaagcccuagggcugagcuguuggugcccucucuggaaggagccuuaccuccagaucucgacacuucagaggaccagcaggcaacagccgcuaucauucccccugaaccauccuaccuggagccccuugaugaaggcccguucagcgcgguaaucaccgaggagccugucgaaugggcccacccaucugagcaagcacuggcuaguucguugaucgggggaacauccgaaaaccccgugagcuggccugugggcucagaccuccugcuaaaaucuccacagcgauuucccgagagcccgaagcgguucuguccugccgauccccugcauuccgcagccccagguccuuuuagugcuucagaggcccccuauccagcgcccccugcaucuccagccccguacgcacuuccagucgccgaaccugggcucgaggacguuaaggauggaguggacgcuguaccagcagccauuagcacuuccgaagcugcccccuaugcaccuccaaguggccuggagagcuucuuuuccaauugcaaaucuuugcccgaagcgccuuuagauguggccccggagccagcuugugucgccgcaguggcucagguugaggcccugggcccccucgaaaacucauuccuggacgggagccguggacuuucgcaccugggucaaguggagccuguccccugggcagaugccuuugcuggcccagaagacgauuuggaccuagggccuuucucccugcccgagcucccacugcagaccaaggacgcggccgauggagaagcagagccgguggaggaaagucuugcuccucccgaggaaaugccacccggcgccccugguguuauaaaugggggagacgugucuacggucguagccgaggaaccacccgcauuaccuccggaucaggcuagcacaagacugccagccgagcucgagcccgaaccuucaggcgagccaaaauuggacguggcgcuggaagcugccguugaggcagagaccgugcccgaagaacgcgccaggggcgauccugacuccucugucgaacccgcuccagugccgccugagcagcggccccucgggaguggagaucaaggugcagaagccgaggggcccccugcggcuagccugugcgcccccgacggcccagcaccuaacacuguagcccaggcucaggccgcagauggagcuggccccgaggacgauaccgaagccuccagagcggccgcaccggcugaggguccaccugggggaauccagcccgaagccgcagagccaaagcccacagcugaagccccuaaagccccgcgcguggaggagauuccacaaaggaugacucgaaaucgggcgcagaugcuugcuaaccagucaaagcagggacccccucccagcgaaaaggagugugcaccaaccccugcccccgucacaagagcuaaagccaggggcucugaagacgaugacgcacaagcccagcauccacgcaagcgucgguuccagagaaguacgcagcaacugcagcagcaauugaacaccuccacucagcagacaagggagguuauccagcaaacccuagcugcgauuguggacgccaucaaacuggaugcaauagaaccuuaccacagcgaccgcgcuaauccguauuuugaguaccuccagauccgaaagaaaauugaggaaaagcggaaaaucuuaugcugcauuacuccccaggccccacaguguuaugcagaguacgugacauacaccgggucauaucugcuugauggaaagccucugucuaagcuccacauccccgucauagccccaccucccuccuuggcugaaccgcugaaagaacucuucagacaacaggaggccgugagggguaagcugcgccuucagcauucgauugaaagagagaaacuaaucguuagcugcgaacaggagauucugcggguacacuguagggcggcacguacgaucgccaaccaagcugugccauuuagugccugcacuauguuguuagacucugaagucuacaauaugccucuggagucccagggcgaugagaacaagagcgugcgagaccgcuucaaugcaagacaguuuauaucauggcuccaagauguugacgauaaauaugaccggaugaagaccugucugcuuaugaggcagcagcaugaagcugccgcucugaacgccgugcagcgcauggaguggcaacucaagguccaggaauuggaucccgcagggcacaaaagucugugcgugaaugagguaccauccuucuacguccccaugguggacguuaacgaugacuuugugcuacugccugcguga

SEQ ID NO: 52765 - RNA, 6120 nt, Artificial Sequence
  derived and/or modified sequence opt3 from ANKRD12__Homo_sapiens__NP_001190985
augcccaagagcggauucaccaaaccuauccaguccgaaaacucugacucagauaguaauaugguggaaaagccauacgggagaaaaagcaaggacaaaauugccuccuauucuaagacaccgaagauagaaaggucggaugucucaaaagaaaugaaggaaaagagcaguaugaagcggaaacugcccuuuacuaucuccccuucucgcaacgaagaacgagacagcgauacggaaaaggaaggaccagagaagaaaaagaccaaaaaggaagcugguaauaaaaaguccacacccguuucaauucucuucggcuacccucuuagugagcguaaacaaauggcacuguugaugcagaugacugccagagacaacagcccagauucuacccccaaucacccuucccagacaaccccagcgcagaagaagacuccgucaagcaguucuaggcaaaaagacaaggugaacaaacggaaugagcgcggggaaacacccuuacauauggcugccaucagaggagauguaaaacaggugaaagagcugauuucccuaggcgcaaacgucaaugugaaggacuuugccgguuggaccccucuccacgaggcuugcaacguuggguauuacgauguggcaaagauccugauagccgcuggagccgacgucaauacgcagggccuugaugacgacacuccacugcaugauagcgcgucgucuggccacagggacaucgugaaauugcuccugcggcaugggggaaaccccuuccaggcaaauaagcacggugagcgcccuguagauguugccgaaaccgaggagcuggaacucuuacugaaacgagaggugccacuuuccgacgaugacgaaucauauacagauagugaggaagcucaaagcgucaaccccuccucuguggacgagaauauugauagcgagacugaaaaggacucauugaucugugagaguaaacagauucugccguccaagaccccucuacccagcgcccucgaugaauacgaguuuaaggacgacgaugacgaagagaucaacaaaaugauagaugacagacacauucugaggaaggagcagcggaaagaaaacgagccagaagcagagaagacacaucuuuucgcuaaacaggagaaggccuuuuauccuaagucuuucaaaucaaagaaacaaaagcccagucgugugcuguacagcuccaccgaaucuucggaugaggaagcguugcagaauaaaaagaucagcacguccugcucagucauuccagagacaaguaacucugacaugcagacuaagaaggaauacguugugagcggcgagcacaagcaaaaagggaagguaaaacgcaagcucaaaaaucagaacaagaauaaggagaaccaggaacugaaacaggagaaggaaggaaaagagaauaccagaaucacuaacuuaacagugaauaccggccuggauuguuccgaaaagacgagggaggaggguaacuuucggaaaucauucagccccaaggacgauaccucucuccaucuuuuucacaucuccacagggaagaguccuaaacacagcugcggacugucugaaaagcaauccacuccauugaaacaggagcauaccaagacaugucuaucaccgggcaguagcgaaaugucgcugcagcccgaccucguccgauaugauaauacugaguccgaguuccugccugagucuagcucagugaaaaguugcaagcacaaggagaaauccaagcaucagaaagacuuucaccuugaguucggcgagaagucuaacgccaaaauuaaggaugaagaccauagcccaaccuucgaaaauuccgacuguacacugaaaaagauggauaaggaggggaaaaccuugaagaaacacaagcucaaacacaaggaacgcgagaaggaaaaacauaagaaagagauagaaggagagaaggagaaauacaagacuaaggacucagcaaaagaacugcaaagaagcguugaguuugauagggaguucuggaaggagaacuuuuucaaaagugacgaaacggaggauuuauuucugaauauggagcacgaaucucuaacacucgagaagaaauccaagcuggaaaagaacaucaaagacgauaagagcaccaaagagaagcaugugucgaaagaacggaacuucaaggaggagcgcgacaagauuaaaaaggaaucagagaaaucuuuuagagaagagaagaucaaagaucuuaaggaggaaagggagaauauacccacugacaaagauagugaguucaccuccuuggguaugagcgcuauugaggaaucuaucggccugcaccucgucgagaaggagaucgacauugaaaagcaggagaaacacaucaaggaaagcaaagagaagccugaaaaacguucccagauuaaggagaaggauauagagaaaauggaacggaagacauuugagaaagaaaagaaaaucaagcaugagcacaagucagaaaaagacaagcuggaccuuagugagugcguggauaaaauuaaggagaaagacaagcuguauagccaucacaccgaaaagugucauaaagagggggaaaagucuaaaaacacugccgcuaucaagaaaacagaugaccgagagaaguccagagagaaaauggauaggaagcacgacaaggaaaaaccagagaaggaacgccacuuggccgagucaaaagaaaagcaucucauggagaaaaagaauaagcagagugauaacagcgaguacuccaaaucugaaaagggcaaaaauaaggagaaagaccgggaacuggauaagaaggagaaaucgagagacaaggaaagcaucaacauuacaaauucaaaacacauacaagaggagaagaaauccaguaucguagauggcaacaaggcacagcaugaaaagcccuuaucucugaaagagaagaccaaagacgaaccgcuaaagacuccugacgguaaagagaaggauaaaaaggacaaggauauugacagguauaaagaacgcgauaagcacaaagacaagauccagauuaauagccuccugaaacuuaaguccgaggccgauaagccaaaacccaagucaucuccugcuagcaaagacacacgacccaaggagaaacgguugguuaacgaugaccugaugcagaccaguuucgaacguaugcucucccugaaggauuuagagaucgaacaauggcauaagaaacacaaggagaaaauaaagcagaaagagaaggaaagacugaggaaucgcaacugccuugaguugaagaucaaagacaaggagaaaacgaagcacacuccaaccgagagcaaaaauaaggaacucacgcggucuaagucauccgaggugaccgaugcguacacaaaagagaagcagccuaaagacgcagucaguaacagaagccaaucgguggacacuaagaaugucaugacccuggggaaaucuuccuuugugagcgauaacucacuaaacaggaguccccgaucugaaaaugagaagccaggccuguccagccgcucaguuaguaugauuagcguggccuccucugaagacagcugucauacaacuguaaccacgccgcggccucccgucgaguaugauuccgacuucaugcucgaaucaucugagagucagaugucguuuagccaguccccauuccugucuaucgcuaaaucacccgcccuucacgagagagaauuggauagccuggcagacuuaccugagaggauuaagccacccuacgccaaccgucucuccacaagucaucugcgcucuagcucaguggaagauguuaaacuuaucauauccgagggacggccuaccauugaagugagaaggugcaguaugccgagcgucaucugcgagcacacuaaacaguuccaaacaauuucugaggaauccaaucagggcucacuguugaccgugccaggggacacuagccccucgccuaagccagagguauuuucuaacgugcccgaacgagaucucaguaauguuuccaacauccacagcucauucgcuaccuccccuacaggagccucuaauagcaaauacgucagugcagaccggaaccugauaaagaauacggcgccggugaacaccgugauggauucccccguccaucuagagccaagcucucagguuggugugauccagaauaaaucaugggagaugccuguggaccgccuggaaacucucaguacaagagauuuuauuugucccaacuccaauaucccagaccaagagagcucucugcagucguucugcaacucagaaaauaagguacuuaaggagaacgcugacuuuuugagccugaggcagaccgaauuaccuggcaacuccugugcccaggaucccgcaaguuucaugccaccgcaacagccuugcucuuuucccagccagucccucucagacgccgagaguauuucuaaacacaugagccuguccuaugucgcuaaucaagagccagggauccuucagcagaagaacgccgugcagauaauuucaagcgcacuggauacagacaaugaaucuacuaaagauaccgagaacacguucguucuaggagacgugcaaaagacagaugcuuuuguccccguguacuccgacaguaccauccaggaagccagcccuaauuucgagaaagcguauacucucccaguucugcccucggaaaaggauuuuaacggcuccgacgccucuacccaguugaauacacauuacgcuuucucaaagcugacuuauaaaagcaguuccggucacgagguggagaacucuaccacagauacgcagguaaucagccaugaaaaggagaauaaauuagaaucacucguccugacccaccuuucccggugugacagugaccugugcgagaugaacgcagggaugccuaagggcaauuugaacgaacaagauccgaaacacuguccagagagcgagaagugccuccugucuauugaagacgaggaaucacagcaguccauccuaagcucucuggagaaucauagucagcaaucgacucagcccgagaugcacaaguacggacagcuugugaaaguggaacucgaggaaaacgccgaggaugacaagacagaaaaucagauuccucaacgaaugaccagaaacaaagcuaauacuauggccaaccaguccaagcagauacuggcaagcuguacauugcugucagagaaagauucugagagcuccaguccccgcggcaggauccguuuaaccgaagacgaugacccacaaauucaucacccucggaagagaaaagucucaaggguuccccagccagugcagguaucuccuagccuccugcaggcgaaggagaagacgcaacagucccuugccgcuaucguggauagucugaaauuggacgaaauucagccguauagcuccgagcgcgccaaccccuacuuugaauaccuccacauccgaaagaaaauagaggagaagagaaaacugcuaugcucugucaucccacaggcaccucaauauuacgaugaauaugugacuuucaaugggucauaccugcuugacggaaacccccucagcaagauuuguaucccaaccauuacaccucccccgucgcuguccgauccauugaaggaguuauuccggcagcaggaaguugugaggaugaaacugcgccuccagcauaguaucgagcgugaaaagcugauagucucuaaugagcaagaggugcuuagaguucacuaucgggcugccaggacccuggcaaaccagacuuugccuuuuagcgccugcacagugcuacuggacgcugaagucuacaauguaccccucgacucacaguccgaugacucuaaaaccagugugcgcgaucgauucaacgcgagacaauuuaugagcuggcugcaggacguugaugacaaguucgauaaacuuaagacaugcuuacugaugcggcagcagcaugaggccgcagcucucaaugccgugcaaagguuggaauggcagcugaagcuccaggagcuggacccagccacuuauaaauccauuucaaucuacgagauccaggaauuuuacgucccccuuguggauguaaacgacgauuucgagcugaccccuauuuga

SEQ ID NO: 52766 - RNA, 2979 nt, Artificial Sequence
  derived and/or modified sequence opt3 from ANKRD18A__Homo_sapiens__NP_671728
augagaaagcuguucagcuuuggcaggcggcucgggcaggcccuucuguccucuauggaccaagaguacgcuggacccgguuaugauauucgcgacugggaauugcgaaaaauucaccgugcagccauaaagggcgaugcggcugagguggaaagaugcuuaaccaggcgguuccgcgaccuggaugccagagacaggaaagaucggacaguccuacaucucgcaugugcccacgggcgcguucaggugguaacucugcuucugcaucgaagaugccagaucgacauuugugauagguugaaccggacgccucucaugaaggcugugcacucacaggaggaagcaugcgccaucguccugcuggaguguggagcuaauccaaacauugaggacaucuacggcaauaccgcccuccauuaugcgguguacaacaaagguacaaguuuagcagaacgucugcuuagccaccacgccaauauagaggcuuugaacaaggaagggaauacuccgcugcuauuugccaucaacucccgcagacaacauaugguugaguuccuccugaagaaucaggcaaacauucacgcuguggauaauuuuaaaaggaccgcccuuauccuggcgguccagcauaacuugucuucgauugugacacuccuguuacagcaaaauauccggauaucaagccaggacauguucggacagaccgccgaggauuaugcacugugcagugaccuccgauccauucgccagcaaauccuugaacacaagaacaaaaugcugaagaaucacuugagaaacgacaaccaggagacugcugccaugaaacccgcuaaucuaaagaagaggaaagaacgggccaaggcagagcauaaccugaaaguagccucugaagagaagcaggagcgccuccaaagaagcgaaaauaaacagccucaggauucccagucauacggcaagaaaaaggacgcuauguauggcaacuuuaugcugaagaaagauauugcgaugcuuaaggaggaacuguacgcaaucaaaaaugacaguuugaggaaggagaaaaaguacauccaagaaauuaagagcauaacagagaucaacgccaauuucgagaaaucuguucgucucaacgaaaagaugauuaccaaaacgguggcucgguauucccagcagcugaaugauuuaaaggccgagaacgcacgacuaaauucagaacuggagaaagaaaagcacaacaaggagagacucgaggccgaagucgagagccugcauaguucucuugcuacugccaucaaugaauacaacgagauaguggagaggaaagacuuggaacuggugcucuggcgcgcagaugacgucucccggcacgagaagauggggagcaauauuucgcagcugaccgauaaaaacgaacuucugacagagcaaguucauaaggcgagagugaaauuuaacacuuugaagggaaagcucagggaaacccgcgacgcucugcgagagaaaacauuagcccuggguucuguacagcuagaucuccggcaggcacagcaccguaucaaggagaugaaacaaaugcacccaaauggcgaagccaaggagucccagucaaucgggaaacagaacagucuggaagagagaauuaggcagcaagaacuugagaauuugcugcucgagcgccagcuggaagacgcucggaaggagggagacaacaaagaaaucgugauuaauauacauagagauuguuuagagaacggcaaggaagaccugcuugaggagaggaauaaggaauugaugaaagaguauaacuaccucaaggaaaaacugcuacagugcgagaaggagaaagccgaacgagaggucaucgugcgcgaguuccaagaagaacugguugaucaccucaagaccuuuagcauuuccgagucuccccuggaggguacgagccauugucacaucaaucuuaacgaaacuuggacaucaaagaaaaaguuguuccagguggagauccagccugaagagaaacacgaagaguuucggaagcuguucgaguuaauuagucuccugaauuauaccgcagaccagauaaggaaaaagaacagagaacuugaggaagaggcuacuggguacaagaaaugccuggaaaugacaaucaauauguugaacgccuucgcgaaugaggauuuuuccugucauggagaccucaacaccgaucaacugaagauggacauucuauucaaaaagcugaaacagaaguuuaacgaucucgucgccgagaaggaagcugugagcucugagugcguaaaucuggcaaaagacaacgaaguucuucaccaggaguugcugucaaugcguaaugugcaggagaagugcgaaaaauuagagaaggauaaaaagaugcucgaagaggaaguccugaaccuuaaaacgcauauggagaaggacaugguggagcugggcaagcuacaagaauauaaaagugagcucgaugaacgcgccguccaggagaucgaaaagcuggaggagauucacuugcagaaacaggcugaauacgagaagcaacuggaacaguuaaauaaagacaacaccgccagccucaagaagaaagagcugacacuuaaggacguggaauguaaauucuccaagaugaaaacugcauacgaggagguuaccacagaacuggaggaauuuaaggaggcguucgccggcgcugugaaggccaauaacucuaugucgaaaaaguugaugaaaagcgauaagaaaaucgcaguaauauccacuaagcucuuuaccgagaagcagcggaugaaauauuuccugucaacacuaccaaccagacccgaaccugagcugccaugcgucgaaaaucuuaacaguaucgagcucaauaggaaguacauuccgaaaacugcuauccgaauccccacgucuaacccucaaacaagcaauaacuguaagaauuuucugaccgaaguguugcugugcuga

SEQ ID NO: 52767 - RNA, 960 nt, Artificial Sequence
  derived and/or modified sequence opt3 from ANKRD1__Homo_sapiens__NP_055206
augauggugcugaaggucgaggaacucguuaccggcaaaaagaacgggaauggagaggccggugaguuccuucccgaggacuuuagagauggcgaauacgaggcugcagugacacuggagaaacaggaagacuugaagacuuuacuggcccacccuguaacgcuaggggagcaacaguggaaaagcgaaaagcagagggaggcggagcucaagaaaaagaaacuggaacagcgguccaaacuugagaaccuggaagauuuggagaucauuauacaacucaagaagcgcaagaaauaucgaaagaccaaagugccagucgugaaggaaccggagcccgagaucauuacagaaccuguugacgugccaacuuuccugaaagcugcccuggagaauaagcuccccgucguggaaaaauuuuuaucugauaagaacaauccugacguaugcgaugaguacaagcguaccgcacugcauagagccugucuugaaggacacuuggcuaucguugagaaacugauggaggcaggcgcccagauugaguucagggacaugcuagaaucaacagcuauccauugggccagucggggugggaaccucgaugugcugaaacuucuguugaauaagggagcgaagauaagcgcacgcgacaaacuccuguccaccgccuuacacgucgcugugagaacuggccauuaugaaugcgccgagcaccugaucgcaugugaagcugaucucaacgccaaggacagggagggcgauacaccacuucacgacgcggugcggcugaaucgcuacaagaugauucgauugcuaaucauguauggggccgaccugaacauuaaaaauugcgcaggaaagacccccauggaucucguccugcauuggcagaacgguacgaaagcuaucuuugacucucuuagagaaaauucguacaagacuucaaggauagccaccuucuga

SEQ ID NO: 52768 - RNA, 918 nt, Artificial Sequence
  derived and/or modified sequence opt3 from ANKRD23__Homo_sapiens__NP_659431
auggacuucaucagcauucagcaacugguguccggcgagagagucgaagggaagguucucggauuuggucacggcgugcccgauccuggggccuggccaucugacuggaggcggggaccgcaggaggcuguagcacgcgaaaaacuuaagcuggaggaagagaaaaagaaaaaguuggagcgauucaacucaacccguuuuaauuuagauaaccuggccgaccuagaaaaucucgugcagagaaggaagaaacggcugcgccauagaguucccccuaggaagccagagccccuugugaaaccucagagucaagcgcagguugaaccagugggccuggagauguucuugaaggcugccgcagagaaccaggaauaccucauagauaaauaucugacagacgguggggaucccaaugcccacgacaagcugcaucggacugcucuccacugggcaugcuuaaagggacauagccagcuggucaacaaacuuuugguggccggcgcuacgguagaugcccgcgaccugcuagaucgaaccccugucuuuugggcguguagaggcgggcaccucgugauccugaagcaacuucugaaucagggagcaagggucaacgcccgggacaaaauugguuccacaccauugcacguggcugugcguacucgccauccggauugccucgagcaccugaucgaauguggcgcccauuuaaaugcacaggacaaggagggggacaccgcucugcacgaagccgucagacacggaucuuacaaagcgaugaagcuccuucuguuguauggcgccgagcuagguguuaggaacgcagcuucggugacacccguacagcuggcccgggauuggcaacgagggauucgcgaggcucuccaggcccauguggcacacccuagaaccaggugcuga

SEQ ID NO: 52769 - RNA, 5133 nt, Artificial Sequence
  derived and/or modified sequence opt3 from ANKRD26__Homo_sapiens__NP_055730
augaagaaaaucuucuccaagaaaggcgagagcccccuggggucuuuugcccgaaggcaacggucaagugcuggagguggcggggaaccuggagagggcgcauacagccaaccagguuaucacgugcgcgaccgagaucucgggaagauucauaaagccgcguccgcuggaaacgucgccaagguucagcagauacuucuguugcguaagaauggcuuaaacgacagagauaaaaugaauaggacagcacugcaccuagccugcgcuaacggccauccggaagugguaacgcuccugguggaccggaagugucagcuuaaugucugcgauaacgagaaucgcacugcacugaugaaagccgugcaaugucaggaagagaagugcgcuacgaucuugcucgagcacggggccgaccccaaccuggcggauguucauggaaauaccgcacugcacuacgccguguauaacgaagacauuucugucgcuacaaaacucuuacuguacgaugccaauaucgaggcaaagaacaaggacgaucuuacuccuuugcugcuagcugugucggguaaaaagcagcagaugguagaguuccucauuaaaaagaaagccaauguuaacgcgguggacaagcuggagucaagccaccaacuuaucagugaguauaaagaagagagaauaccaaagcauuccucucagaauagcaacuccgucgaugaaucaagugaggacagccugucuagguuguccggcaagcccgggguggacgauucauggccuaccagcgacgaugaagaccucaacuuugauaccaagaaugugccaaagcccagucuggccaaauuaaugaccgcaucucagcagucccggaagaaccuggaggcuacuuacggaacaguccgcaccggcaaucgaacacucuucgaggacagagauagcgacucgcaagaugaaguugugguagagucucuuccuacuaccuccaucaaagugcaguguuuuucacacccaacauaucagaguccggaccuguugcccaagccuagccauaagucccuagccaacccaggucugaugaaagaagaacccacuaagccugggauugcuaaaaaggaaaauggaaucgauauuaucgagucugccccacucgagcaaaccaacaaugacaaccugacauacgucgacgaagugcacaaaaauaacaggagcgauaugaugucagcacuuggccugggccaggaggaagacauagagagucccugggauuccgaaagcauuucugagaauuucccgcagaaguacguugacccuuuggccggggcugcggauggaaaggagaaaaacaucgguaaugaacaggcagaggacguguuuuauauucccucaugcaugaguggcagccggaacuucaagauggccaaacucgaagauacccguaaugucgggaugccaguggcucacauggaguccccugagcgcuaccugcauuuaaagcccacgaucgaaaugaaagacucuguaccaaacaaggccggaggcaugaaggauguucaaacuucgaaagcagccgagcacgaccuggaaguggcuagcgaggaagaacaggagagagaagguuccgagaacaaucagccccaggucgaagaggaaaggaagaaacaucggaacaaugagauggaggugucagccaacauccacgauggggcaacagacgaugcggaagacgacgaugacgaugacggccuaauucaaaagcgaaaaaguggagagaccgaucaucagcaguuuccucgcaaggaaaauaaagaguaugcuucuagcggcccagcccuccagaugaaggaagucaaguccacugagaaagagaagagaacaucaaaagaaagcgugaacucuccgguuuucgggaaggcaucccugcuuaccggagguuugcugcaaguggacgaugacaguagccucucugagauagaugaagacgagggcaggcccacgaaaaagaccuccaaugagaagaacaaaguaaagaaucagauccagucaauggaugacgucgaugaccugacacagaguagcgaaacugccucggaggacugugaacuuccucacuccucuuacaaaaacuuuaugcuguugauugagcaacucgggauggaaugcaaggauagcgugucacuguuaaaaauccaggacgcugcccugaguugugagcggcuacucgagcugaagaagaaucacugcgaacuuuugaccguuaaaauaaagaaaauggaggauaaggugaacguccugcagcgcgaacucuccgagacaaaagaaauuaagucucaacuggagcaucagaagguggagugggaaagagaguuauguagccugagguucucccuuaaucaggaagaggaaaaacgucggaacgcagacacuuuguaugagaagauccgagagcagcucagaaggaaagaggaacaauaccgcaaggaaguagaggugaaacagcagcuggagcuaucacugcagacccucgaaauggagcugcggacaguuaagagcaaucuuaaccaagucgugcaggaaagaaacgaugcucagaggcaguugagucgcgagcaaaaugcccgaaugcugcaggacggaaucuuaaccaaccaccucucuaaacagaaggaaauugagauggcgcaaaagaaaaugaacuccgagaacagccauucgcacgaagaggaaaaggaucugucacacaaaaauucuaugcuucaggaggaaaucgccaugcugcgguuggagauugacacuauaaagaaccagaaucaggagaaagaaaagaagugcuuugaggaucucaaaaucgugaaggagaagaaugaggaccugcaaaagacgauuaaacagaaugaagagacacuaacccagacuaucagucaguauaacggccgucuguccguccucaccgcugagaaugcaaugcugaacagcaaacuugaaaaugagaagcaaucuaaagaaagauuggaggccgagguugaaagcuaccauuccaggcuggcugccgcaauccacgaucgcgaccagucagagacaaguaagcgggaauuagagcucgcguuccagagagccagggacgaaugcagccgacugcaggauaaaaugaacuucgacgugucuaaucuuaaggauaacaacgagauucugucccaacagcuauuuaaaaccgagucaaagcucaauagucuggaaauagaguuccaucacacucgcgacgcuuugcgggaaaagacacuggguuuagagagagugcagaaagaucucagccagacgcaaugucagaugaaggaaauggagcagaaauaccaaaacgagcagguaaaggucaauaaauauaucgggaagcaggaauccguggaggaaaggcugucucagcuucaaucggagaacaugcuguugcgucagcagcucgacgaugcccauaauaaggcagacaacaaagaaaagaccguuauuaauauccaggaucaauuucacgcuauugugcagaaacugcaggccgagagcgagaagcagucacuacugcuugaggaacgcaacaaagaacucaucuccgagugcaaucaccugaaggagcggcaauaccaguaugaaaacgagaaagcagaaagagaggucgugguuaggcaguugcaacaggaacuggccgacacuuuaaagaagcagaguaugucugaggcuagccucgaggugacaucccgauaccggauaaaucuggaagaugagacccaggaccuuaaaaagaaacugggccaaauccgcaaccaguugcaggaagcgcaggauagacauacagaggccguaaggugugcagaaaagaugcaagaccacaaacagaagcucgagaaggacaaugcuaaacugaaggucacugugaaaaagcagauggauaaaauugaggaacuacagaagaaccugcuuaaugccaaccucucagaggacgaaaaggagcaacugaaaaaguugauggaauuaaaacagucucuggagugcaaucucgaucaggagaugaagaaaaacguggaacuggagcgggaaaucaccggauucaagaaccuucugaagaugacgcgcaaaaaguugaaugaguaugagaacggcgaauuuagcuuccauggggaccuaaaaaccagucaguuugagauggauauucaaaucaauaagcugaaacacaagauagacgaucucacagccgaacuggagacugcuggauccaaaugucuucauuuagacaccaagaaccagauucugcaggaggaacucuugagcaugaagacaguccagaaaaagugcgagaaacugcagaagaauaaaaagaagcucgaacaggagguuaucaaccugagaucucacauugaaagaaauaugguggagcuuggucagguaaaacaauacaagcaggaaaucgaggagagggcacgucaggaaauagccgagaaacugaaggaagugaacuuguuccuacaggcgcaagcugccucacaggagaaucuggaacaguuucgggagaacaauuucgcauccaugaaaagucagauggagcucagaaucaaggauuuagaaagcgagcugucgaagauuaaaacuucucaagaagacuuuaacaagaccgagcuugagaaauauaagcagcuguaccucgaagaguugaaagucaggaagucccugagcucaaagcucacgaaaacaaaugaacgccuggccgaggugaacaccaaacuucuaguugaaaaacagcaaagucgaucucuguucacuacauugaccacuagaccagugauggagcccccuugugucggcaauuuaaacaacucccuggaucucaaucggaagcugaucccaagggagaaccuugugauuagcaccucaaauccccgcgcuaguaacaauagcauggaaaacuaccuguccaaaaugcagcaggagcucgaaaagaauaucacacgugaguugaaagaagcagccgcggagcuggagucugggagcauagcuuccccgcuaggaucaacggacgaaucuaaccugaaucaggaucucguuuggaaggccaguagagaguaugugcaaguccuuaagaaaaacuacaugauuuga

SEQ ID NO: 52770 - RNA, 3162 nt, Artificial Sequence
  derived and/or modified sequence opt3 from ANKRD28__Homo_sapiens__NP_056014
auggccuuccugaagcucagagaccagcccagccuugugcaagcuaucuuuaacggcgauccugacgaggucagggcacugauuuucaaaaaggaagauguuaauuuucaggacaacgagaaacggaccccauugcacgccgcggcuuacuuaggggaugccgaaauaaucgagcugcuaauucucuccggagcacgcgugaaugccaaggacucuaaauggcugacaccgcuucaucgagcuguagcaucaugcagugaagaggccgugcagguccuguugaagcacagcgcugaugugaacgcccgugacaagaauuggcagacuccccuccauaucgcggcagccaacaaagcuguuaagugugccgaggcacuggugccucugcucuccaaugucaacgugucugauagagcugguaggacggccuuacaccaugcggccuucucgggccacggggaaaugguaaaacugcuuuugucacggggagcaaauauuaacgcuuuugacaagaaagaucgcagagccauccacugggcugccuauaugggccauauagagguugugaagcugcuagucagccacggugcagaagugaccugcaaggacaaaaagaguuacacaccacuccaugccgcugcguccucugggaugaucagcguggucaaauaucugcuugaucugggaguugacaugaaugagcccaacgcauacggcaauacuccuuugcacguggccuguuauaacggccaagacguaguggucaaugagcucauugauugcggggcuaucgugaaccagaagaacgaaaaaggauucaccccacugcacuuugccgcagccuccacacauggugcuuuaugucuggagcuccuuguuggcaauggggccgacgugaacaugaagucaaaagauggaaagacaccccugcacaugacugcauugcauggcagguucagucggagccagacaauuauccagucuggugcggucauagacugcgaagauaagaaugggaacaccccucuacacauugcugcccgcuacggacaugagcugcucaucaauacgcugauuacuuccggcgcagacaccgccaaacgaggcauccacgggauguuuccacuucaccuggcugccuugucaggauucagcgauuguugcagaaagcuccugaguucugguuuugacaucgauacaccggacgauuucggcaggacuuguuuacaugcagcugccgccgggggaaaccuggaaugccuaaaucuccugcuuaacaccggcgcggacuuuaauaaaaaggacaaauucggucggucccccuugcacuaugcugcagccaacuguaauuaccaaugccuguucgcucucguggggagcggcgccucgguaaacgaucuggacgagcguggaugcacaccucuucauuacgcagcgaccucugauacggacggcaagugucuggaguauuugcuccgcaaugaugccaacccagggauuagagacaagcagggauacaaugcuguucacuauuccgccgcauacggucacaggcugugcuuacagcugauagcuucagaaacuccccuagaugugcucauggagacaaguggcaccgacaugcugagcgauuccgacaaccgggccacuaucucuccucuucauuuggcagccuaucacgggcaucaccaggcucuggaaguccucgugcaaagccuguuagaucuggacguccgaaacucaaguggacgcacaccacuugauuuggcggccuuuaaaggccauguggaguguguugacgugcucauuaaucagggugcauccauccugguaaaggacuacauacuaaaaagaacccccauucacgcugccgccacgaacgggcacagcgaaugccugaggcuccugaucggcaaugcugagccgcagaacgcagucgauauccaagacggaaauggccagaccccucuuauguugucugugcugaacgggcauacagauuguguuuauucauuacucaauaagggagccaacguggacgcgaaagauaaguggggucggacugcucugcaccgcggcgccgucaccgggcaugaggaaugcguggacgcacuucugcagcacggagccaaguguuugcucagagauaguaggggccguacacccauucaucugagcgcugcaugcggucacaucgggguacuaggcgcccugcuccaguccgcggcuucuauggacgccaauccagcaacugccgauaaccacggauacaccgcucugcauugggccuguuacaauggccacgagacaugcguggaacuuuugcuggagcaagaaguuuuccagaaaaccgaggggaacgcauuuucgccuuuacauugugcugucauuaaugacaacgagggagccgcggaaaugcucauagauacucugggcgccagcaucgugaaugcaacggacuccaagggucggacaccccuucacgcugccgcuuucaccgaucacguggagugccugcagcuacuccugucacauaacgcacaggucaacaguguugacucuacugggaaaaccccauugaugauggccgccgaaaauggacaaacaaacaccguggagaugcuggugagcuccgcuucagcggaguuaacucuccaggacaauagcaagaacacagcacugcaccuugccugcucuaaaggccaugaaacguccgcucuguugauucucgagaagaucaccgaucgaaaucugaucaacgccacuaaugcagcccuacagacaccccugcacguagcugcgagaaacggucuuaccauggucgugcaggaacuccugggcaagggggccaguguuuuggcaguggacgagaauggauauaccccugcucuggccugugcaccaaacaaagaugucgccgacugcuuagcucucauucuggccacuaugaugccggugucuagcuccucaccccuuaguagccugaccuuuaaugcgauaaacagguacacgaauaccucgaagacaguuuccuucgaagcauugccuaucaugcgcaacgagccaucuagcuauuguucauuuaauaacauuggcggggagcaagaauaccucuauacugauguggacgagcugaacgauagugacuccgaaaccuacuga

SEQ ID NO: 52771 - RNA, 984 nt, Artificial Sequence
  derived and/or modified sequence opt3 from ANKRD2__Homo_sapiens__NP_001123453
auggccaaggcucccagcugggcaggcgugggggcccuggcguacaaagcuccugaggcccucuggccagcagaagccgucauggacggaaccauggaggauuccgaagcuguucagagagcaacagcccuuaucgagcaaaggcuggcucaggaagaggagaacgaaaaguugcggggugacgcccgccagaaauuaccgauggaucugcuagugcucgaggacgaaaagcaccauggcgcgcagucugcagcccugcaaaaaguaaaggggcaggagcgagugcguaagacuucacuugaucugagaagggagauuauagacgucggaggcauccagaauuugauugaacuccggaaaaagcgcaaacagaagaaaagagaugcucuggccgcaagucacgagcccccuccagaacccgaggaaaucacggguccuguggacgaggagaccuuccugaaggcugccguugaagggaagaugaaagugauugagaaguuucucgcggauggaggcagcgccgacacaugcgaucaauucaggcggacugcauuacaucgcgcuucccuggaaggccacauggagauccuugaaaaauugcuggacaacggggccaccgucgauuuucaggaccgacuagacuguacagcuaugcauugggccugcagaggaggucaccucgaggugguaaagcugcuucagucucacggcgcagauaccaauguuagggacaaagagggggauacugcccugcaugacgcugugcgguugaaccguuauaagauaaucaaacuccuguuacugcacggagcggauaugaugacaaagaaucucgcaggcaagaccccaacggaccuuguccagcuguggcaagccgauacucgccaugcuuuggaacaccccgagccuggugccgaacacaacgggcuagagggaccaaaugacucgggcagagaaaccccgcagcccgugccugcacaguga

SEQ ID NO: 52772 - RNA, 4026 nt, Artificial Sequence
  derived and/or modified sequence opt3 from ANKRD30A__Homo_sapiens__NP_443723
augaccaagaggaaaaagacaaucaaccugaauauucaggacgcccagaaaagaacugcucuccacugggcaugcgugaacggccaugaggaagucguuacguuccuuguggaucggaagugucaacuggacguauuggauggggagcaccgcacccccuuaaugaaagcccugcagugccaucaggaagcgugugcuaauauacuaaucgacagcggagccgauauuaaccucguggacgucuacgguaauacagcacugcacuaugccguguacuccgagauccuuucuguuguggcuaagcuguugucacauggcgcagucauugaagugcacaacaaggccagucucacuccucugcugcucagcaucaccaaacgauccgagcaaauaguagaguuuuuacugaucaagaaugcuaacgccaaugcgguuaacaaauauaagugcacagcacuuauguuggccgugugucacgggucuucggaaauugucggaaugcugcuacagcagaauguggauguguucgcugccgacaucugcggcgucaccgcagagcauuacgcuguuacuugugguuuucaccauauucacgaacagaucauggaguauauacguaaacucucaaagaaccaccaaaauacaaacccagaggggaccagcgccggaacgccggaugaagcggcaccccuggccgagagaacuccugacaccgcugaaagucuuguggagaagacaccagaugaagccgcuccccugguagagaggacuccugacaccgccgaguccuugguggagaaaacaccagaugaggcagccucucucgucgaaggcaccagcgacaagauucagugccuggagaaagcuacguccggcaaguucgaacagucagcggaggagacuccccgggaaaucacaaguccugcaaaagagaccagcgaaaaguuuacuuggccagccaaagggcgcccgagaaagauugcuugggagaagaaagaagacacacccagggagaucaugucuccugccaaggagaccuccgaaaaauucacgugggcagccaagggacggccacgcaaaaucgcuugggagaagaaggaaacccccgugaaaacagguuguguugcccgagugacuucaaauaagaccaaagucuuagagaagggcagaagcaaaaugauugcaugcccuacaaaggagaguucuacuaaggcguccgcuaacgaucagagguuuccaagcgaaucgaaacaagaggaagacgaggaauacucuugugauucccggucacuguucgagaguagcgccaagauacaggugugcauccccgaguccauuuaucagaaaguaauggaaaucaaccgugagguugaggaaccgccuaagaaacccucugcauuuaagccagccauagaaaugcaaaauagcgugccuaacaaggcuuucgagcucaaaaaugagcagacccuucgcgccgaccccauguuuccacccgaaucaaagcagaaagauuacgaggaaaacaguugggacuccgagagccugugcgaaacagucucucagaaggauguguguuugccuaaagcaacccaucaaaaggagauugacaaaaucaaugggaagcuagaggaaucaccaaacaaggauggacugcucaaagcuacuugcggcaugaaggucaguaucccgacgaaagcccuggagcuuaaggacaugcagacauucaaagcggaacccccugguaagccaagcgccuuugagcccgcuaccgagaugcagaaguccgugccuaauaaagcacuggaauugaagaacgagcagacucucagagccgaugaaauucugccaucugagucgaaacaaaaggacuacgaagagaauagcugggacaccgaguccuuaugugaaacaguuucacagaaagaugugugccugcccaaggcugcccaccagaaggagaucgacaaaauuaacgggaagcuagaaggaaguccgguaaaagauggccuccugaaggcaaauuguggcaugaaagucucuauaccuaccaaggcgcuugaguugauggacaugcagacuuucaaggccgaaccacccgagaaaccuagcgcuuucgagcccgccaucgaaaugcaaaaguccgugccaaacaaagcacuggagcucaagaaugaacagacacugagggcugaugagauucuuccuucagaaagcaaacagaaggacuaugaggagucuuccugggauagugaaagccugugcgagacgguuucucagaaagacguguguuugcccaaggccacccaucaaaaggaaaucgauaaaaucaacgggaagcucgaggaguccccagacaaugauggauuucugaaagcaccgugccggaugaaggucucaauuccuacuaaagccuuagaacugauggacaugcagacauucaaggcugagcccccagaaaagcccagugcguuugagccugccauagaaaugcagaaaagcgugccaaacaaggcacuagagcucaaaaacgagcaaacccugcgagcugaucagauguuccccucggaauccaagcagaaaaagguagaggaaaauucuugggacagcgagucacuucgcgaaacagugagucagaaggacguuugugucccuaaagccacucaccaaaaggagauggauaaaaucuccgguaaguuggaggacucuaccagccuguccaaaauucucgauacggugcauucaugcgaaagagccagggagcugcagaaggaccacugugaacagcggaccggcaagauggagcagaugaaaaagaaauuuugcguguuaaagaaaaagcugagcgaagcuaaggagaucaaaagucaacuugagaaccagaaggucaaaugggaacaggaguugugcucuguucgccucacacugaaucaggaagaggagaagagaaggaacgcagauauucuaaaugagaaaauccgugaagaacuggggcggauagaggaacaacaccgaaaggagcucgaggugaaacagcagcuggaacaagcccuuagaauccaggacauugaguugaaguccguggaaagcaaccugaaucagguaucgcauacucacgagaacgaaaauuacuuacuccaugagaacuguaugcugaagaaagagaucgcgaugcuuaagcuggaaauugcuaccuugaaacaccaguaucaagagaaggaaaauaaauacuucgaggauaucaagauacucaaggagaaaaacgccgaacugcagaugacacuaaagcugaaagaggaaucacucacuaagagggcaucucaguauaguggacagcugaaaguccuuauugccgagaauaccauguugacguccaagcugaaggaaaaacaagacaaggagaucuuagaggcugaaauugagagccaccauccgcgccucgcaucugccgugcaggaucacgaccagaucguuacaagccggaaaucccaggaaccagcguuucauauagcuggcgaugccugccugcaaagaaagaugaacguggacgucucaaguaccaucuacaauaacgaggugcuucaccagccccugagcgaagcacagaggaaaucuaagucccuaaagauuaaccucaauuaugccggugaugcucugcgcgagaacacuuugguuucagagcaugcccagcgagaccaacgggaaacacagugucagaugaaagaggcagaacacauguaccaaaaugagcaggacaacgugaauaagcacaccgaacagcaggagagucuggaucaaaaauuauuccagcuccagagcaagaacauguggcugcagcaacagcuuguacaugcucacaaaaaggccgacaauaaauccaagaucacuauugauauccauuuucuggagcguaagaugcagcaccauuugcucaaagaaaagaacgaggaaauauucaauuacaacaaucaccugaaaaacagaauuuaucaguacgagaaggaaaaagcggagaccgaaaauucuuga

SEQ ID NO: 52773 - RNA, 4062 nt, Artificial Sequence
  derived and/or modified sequence opt3 from ANKRD36B__Homo_sapiens__NP_079466
auggagagacugugcagcgacggcuucgccuuuccccacuacuauaucaagccuuaccaucucaaaaggauucaccgggcugugcuucgcgggaaccuggaaaaguugaaauauuuacugcuaaccuacuaugaugcaaauaagcgagaccguaaagagagaacagcccuccaucuggcgugugcuacuggacagccagaaaugguccaccuucugguuuccaggcggugcgaguugaaccucugugaucgcgaagacagaacgccgcugauaaaggccgugcaacugaggcaggaggcaugcgccacccucuuacugcagaauggugcugaucccaacaucacagacguauucggccggacugcacuucauuacgccguguauaaugaggauaccucuaugauugaaaaguugcugucacacgggacaaacaucgaggaauguaguaaaaaugaguaccagccucuacuccuggcugucagccgccgaaaggugaaaaugguugaguuucuucugaagaaaaaggccaacgugaaugcgauugacuacuugggaagauccgcacucauccuggccgucaccuuaggcgaaaaggauauagugauccugcuccuucaacacaacauugacguauucucuagggauguuuaugguaaacuggcugaggacuacgccucggaagcagagaaucgggugaucuuugauuugauuuaugaauacaagcguaaacgcuaugaggaccuaccaaucaacucaaaucccgucagcccucagaagcagagagcugagaaagccacuucggacgauaaggacuccgugucuaacauagcgacagaaauuaaagaggggccaaucagcggaaccguguccucacagaagcaacccgccgaaaaggcaacgagugaugagaaagacagcgucucuaauauugcuacugaaaucaaggagggccagcaguccggcaccguuucaccucagaaacaaagcgcccagaaggugaucuucaaaaagaagguaagucugcucaacauugcuacaaggauaaugggaggggguaaaucuggcacuguguccagccagaagcaaccagccucgaaaaccgcaucugauaagacagacuccgcccugaacaccgcuacggagaucaaagaugggcuucagugcggaacugucucaagucagaagcagcaagcgcugaaggcaacaaccgacgaagagggcagcguguccaauauugccacugaaaucaaagauggugagaagucugggacaguuagcucacagaaaaagccggcuuugaaagccaccagugacgaaaaggauuccuuuagcaacauaacgcgggagaagaaagacggagagauuucucgaaccgugucaagucagaagcccccugcacucaaagccacaagcgucaaggaagacuccgugcugaauaucgcucgcgagaaaaaggauggcgaaaaaucuagaacuguaucguucgagcagccacccggcuuaaaggccaccagggacgagaaggauagccugcuaaacaucgcacgggggaaaaaggacggagagaaaacacgcagaguuuccucacauaagcaaccuagucucaaagcgacuucugauaaggaggacagcgugccaaauauggcuaccgaaacaaaggaugagcagauuuccgguaccgucucaugucagaaacagcccgcccugaaggcaacuagcgacaaaaaggauucuguguccaacaucccgacggaaauuaaagacggccaacagagugggacagucagcucucagaagcagccugccuggaaggcuaccuccgugaaaaaggauucaguuaguaauauagccacugagaucaaagacggacaaauuaggggcaccgugagcucgcagcgucggcccgcacuuaagacaaccggugaugagaaagacuccguaucuaacaucgcucgagaaaucaaggacggggaaaagagcggcacugucucaccacagaaacaaagugcccagaaggugauuuuuaaaaagaaaguuuccuugcugaauauagcgacaagaaucacgggaggcgggaagucuggaaccgaauacccugagaaccucaggacucugaaagccacaauugaaaauaaggauagcgugcuuaacaccgcuacaaagaugaaagagguccagacuuccacccccgcagagcaggaccuggaaauggccucagagggugaacaaaagcgcuuggaggaauaugagaauaaccagccacaggugaaaaaucagauccacagccgggaugaccucgaugacauuauccaaaguucucagacgguauccgaggauggcgacagccugugcuguaacugcaagaacgugauauuacugaucgaucagcaugaaaugaaauguaaggacugcguucaccuacucaagauuaaaaauaccuucugccuguggaagagacuuaucaaauugaaggauaaccacugugagcagcugagggucaaaauucgcaagcucaagaauaaagcuagugugcugcaaaagcgaaucucagaaaaagaggagauaaagucucaguuaaaacaugaaauucuggagcuugaaaaggaguugugcagucuccgguuugccauccagcaagaaaagaaaaagcguagaaacguggaggagcugcaccagaaagucagggaaaagcuacgcauuacagaggaacaguaccggaucgaggcagacguuacuaaacccauaaagccugcgcugaaguccgccgaaguggagcucaaaaccgggggaaauaacagcaaucaggugucugagacagaugaaaaggaggaccugcuucaugaaaacagauugaugcaagacgagaucgcuaggcugcgauuagaaaaagauacuauuaagaaucagaaccucgagaaaaaguaccugaaagacuucgagaucguaaagcgcaagcacgaagaucuucagaaagcccugaagcggaauggcgagaccuuggcaaaaacgauugcuuguuauagcggucagcucgccgcacugacagacgaaaacaccacucuaagauccaagcuggagaaacaaagggagucacgucagcgccucgaaacagagaugcagaguuaccggugcagacugaaugccgcuaggugugaucaugaccagagccacucuuccaagcgagaucaagaacuugcguuucaggggaccgucgacaagugccggcacuugcaggagaacuuaaauucacaugugcugauccucagucugcagcuuagcaaagccgaauccaagucucgcguucugaaaacugagcuacacuauaccggcgaggcacucaaggaaaaagcucugguguucgagcauguccaaucggaauugaagcagaagcagagccaaaugaaagauauagagaagauguacaaaucaggauauaacacaauggaaaaguguauugagaaacaggagagauucugccagcugaagaagcagaacauguuacuccaacagcagcuggacgaugccaggaauaaagccgacaaccaggaaaaggcuauccuuaauauccaagcacggugugacgcccgagugcagaaccugcaggcggagugcagaaaacaccgcuugcuccuggaagaggauaauaagaugcuaguuaacgaacugaaucacuccaaagagaaggagugucaguacgaaaaagagaaggcugaaagggagguggccguacgucaacuucagcagaagcgggacgauguccucaacaaaggcagugcaacgaaggcccuguuggacgcuucuagcagacauugcaccuaucuggagaaugggaugcaagauuccaggaaaaaguuagaccagaugcgcucacaguuucaggaaauucaagaucagcucacugcaacaauccgaugcaccaaagagauggaaggagacacacagaagcuggagguggaacacgugaugaugagaaagauuaucaaaaagcaggaugaccaaauagagcggcuugagaaaauucugcagcauucuagcuugaugcuccaggucuucgaaaguuga

SEQ ID NO: 52774 - RNA, 5826 nt, Artificial Sequence
  derived and/or modified sequence opt3 from ANKRD36__Homo_sapiens__NP_001157787
auggaagacggcaagagagaaagauggcccacccugauggagcggcucugcagcgauggguucgccuuuccucaguacccgaucaaaccguaucaccuuaagcgcauucaucgagcugugcugcacggaaacuuggaaaaauuaaaguaccugcuccucacuuauuacgacgcaaauaaacgugauagaaaggaaaggacugcccugcaucuugcgugugcuacgggucaacccgaaaugguccaccuguugguuucccggcgcugcgaacucaaccugugugacagagaggauaggaccccucugauaaaggccgugcagcuccggcaggaagcaugcgccacuuuacugcuucagaauggcgcuaacccaaauaucacugacuucuuugggcgcaccgcauugcauuaugccguauacaacgaggauacaucuaugauugaaaaacugcugucacacggaaccaauaucgaggaguguaguaagugcgaauaucaaccccuccuguucgcugugagccgaagaaaagucaagaugguggaguuucuucugaaaaagaaggccaacguuaaugcgauugacuacuugggcagguccgcacucauccacgccgugacucugggugaaaaagauauagucaucuuacugcuccagcauaacauugacgugcuuucucgggaugcuuuccguaagaucgccggggacuacgcaauugaggcuaaaaaucgcguaaucuuugaucugauauaugaauacgagagaaagagguaugaggacuugccuauuaacucgaauccaguuucaagccagaaacagcccgcccuaaaggcgacaaguggaaaagaagacuccaucucuaacauugccaccgagaucaaggauggccaaaagagcggcacgguguccucacagaaacagccugcacugaaggacacaagugauaaagacgauagcgucucuaauaccgcuacagaaaucaaggacgagcagaaauccgggacugugcucccagccguggaacaaugucugaaccggucacuuuaccgaccggaugcugucgcccagcccguuaccgagaacgaguucagccuggaaagugagauuauaucuaaguuguauaucccuaagcgcaaaauuaucuccccaagaagcauaaaggacgugcuacccccuguagaagaggcaguggauaggugccuguacuuacuggaccgguuugcccagccagucacaaaagauaaguucgcucuagaaucggagaauauuucugagcccuauuuuaccaaccgcagaacgaucucccaacagucagcggaaaaucucgacgcagccuguggaaucgacaaaacugagaacgguaauauguucgaagaucagaacguggacaaggagggcaaggcucugccggccacagggcagaaagcaaauguuaguccugagcaacccccacuuuuuacccacacugugaaggauagggaccauauuagcacacguuucuugggaggcauggauucccugaccucuagcgaagagucaagugaacggccuccccucuccacgcugacccuuaaagaggccgacccaagcucuaaggcugccaugcgaagaaaagauucacccccuccagguaaggucaguagccagaagcagccggcagaaaaagcgacauccgacgauaaggacucugugucgaacaucgcuacugagauuaaagaggggcccauaagcggaaccguauccucacagaagcaaccugccgaaaaagcaacaagugaugagaaggacucuguuagcaauaucgccacugaaauuaaaaagggccagcaguccggcaccgugucaccacagaagcaaagcgcuuggaaagucaucuucaagaaaaaggugucucuguugaacaucgccacaaggauuaugggaggggguaaauccggcaccgucaguagccagaagcagcccgcaucuaaggcuacuuccgauaaaacggacucagcccucaauauagcgacagagaucaaggacgggcugcagugcggaaccgugaguagccaaaaacagccugccuuaaaggcuacuaccgaugaagaggacucgguuuccaacauugcaacagagaucaaagauggcgaaaagucugguaccgugagcucacagaagcaaccagcccugaaagcuacuacagacgaggaagauaguguauccaauauugccacggagaucaaggacggggaaaaaucuggcaccgucagcucccagaagcagcccgcacuaaaagcgacuacagaugagaaggacucagugagcaacauagccaccgagaucaaggauggagagaaaaguggcacaguuucuucccagaagccgccugcucucacugccaccagcgacgaggaagggucggugcugucaauugcacgcgagaauaaagauggagagaagucucggacggucaguuccaggaaaaagccagcucuuaaagccaccagcgacgaaaaggauucuuuuagcaacaucacaagggguaagaaagacggcgagauuucccgcaaggugucaagucaaaaacccccuacuuugaaggggaccagcgacgaagaggauucuguacugggaaucgcacgagaaaacaaagacggcgagaagucccggacagugucaagugagaagcccccaggucucaaagccagcuccgcugaaaaggauucuguucugaauauagcgcgugggaaaaaggacggcgagaaaacuaagagagucucgagcaggaagaaaccuucauuagaagccaccuccgaugagaaggacaguuucucuaacauuacgcgcgagaaaaaggauggagagaucagccggaaaguguccucacagaagcccccagcacugaagggcacaucugacgaggaagauagcgugcuugggauugcuagagagaauaaagacggagaaaagaguaggaccgucuccagcgagaaaccgccugguuugaaggccacuucugaugaaaaagacucaguucucaacaucgcccgaggcaagaaggacggggagaaaacacgcaccguguccagucagaagcccccaacucugaaagcuaccagcgaugaggaagacucggugcuaucuauagcacgggagaauaaggauggagaaaaauccagaacaguaagcucagagaagcccaguggccugaaagccacgucugcggagaaggacuccguccucaacaucgcuagggguaagaaauacggggaaaagaccaaacgugugagcucacgcaagaaaccugcccugaaggcaacaagugaugagaaggacagcguucuuuacauugcccgggagaaaaaggauggcgagaaauccagaacagugucuagcccaaagcagcccgcuuugaaagcaaucugugacaaggaagauuccgucccuaauauggccaccgagaagaaagacgagcaaauuucaggaacagugucuugccagaagcagccggcgcugaaagcuaccagugauaagaaagacucgguuagcaacaucccaacugaaauaaaggauggccagcaauccgggacggugucuucacagaagcagcccgccuggaaagcaacaagcguaaagaaagacuccgucaguaauauugccaccgagaucaaggacggacaaaucaggggcacugguauuuuagaauauaccuuuaacgugauguucgaucagaucgaggaaaaauuuacaucucucaauaagagcgcuggggugucaccucagaaacaguccgcccaaaaggucauuuucaagaaaaagguuagucugcuuaacauagcaacucgaaucaccggaggcuggaaaagcgguacagaguacccagagaaucugcccacguugaaggcuaccauugaaaacaaaaauucugugcucaacacugccacaaagaugaaggacguacagaccuccacuccugcggagcaggaucuggaaauggccucagagggcgaacagaaacggcuagaggaguaugaaaacaaucaaccacaggugaagaaccagauccacagccgcgacgaucuggacgauauuauccagucgucucaaacagucagugaggacggggauucccucugcuguaauugcaaaaacgugauacugcuuaucgaccagcacgaaaugaaguguaaagauugcguucauuugcugaagauuaagaauaccuuuuguuuauggaaaagacucaucaagcugaaagacaaccacugcgagcagcuuagggugaagauucggaaacugaagaauaaggcaagcguccuacagaaacgaaucucagagaaggaagagauaaaaucccaacucaagcaugaaauucuggaguuggaaaaagagcuguguucuuuaagauucgcuauccagcaggagaagaaaaagcgcaggaacguggaagagguucaccaaaaggugcgugaaaaacuccggaucacggaggaacaguacagaauugaggccgaugucacuaagcccauaaaaccagcucuaaagagcgcagagguagaacuuaaaaccggaggcaauaacaguaaucagguguccgagacagacgaaaaggaggaccuguugcaugaaaacaggcucaugcaggaugagaucgcccgccugcgacuagagaaggacaccauuaaaaaucaaaaccuggaaaagaaauaucuuaaggauuuugagaucguuaaaagaaagcacgaagaccuccagaaggcccugaaacggaauggggagacuuuggcuaagacaauugcgugcuacagcggacagcuggcagccuuaaccgaugagaacacaacucucaggucuaaacuggaaaagcagcgcgagucacgucaaagacuugaaaccgagaugcagaguuaucacugucggcugaacgcugccaggugcgaccaugaucagucccacagcucuaaacgcgaccaggaauuggcauuccaaggcacgguggauaagugucgacaucuccaggagaaucugaacucgcacguccuaauccugucacuucagcucagcaaggccgaguccaaaaguagagugcugaagacagaauugcacuacaccggugaggcuuuaaaagaaaaggcgcugguauuugagcaugugcaaucugaacucaaacagaagcagagccagaugaaggacauagagaaaauguacaaguccggguauaauacuauggagaaaugcaucgaaaagcaagagcgguucugccagcugaaaaagcagaacaugcuucugcagcaacaguuggaugacgccaggaauaaagcagacaaccaggaaaaggcuauucuaaauauccaggcccgcugugaugcaagaguccaaaaccugcaggccgagugcaggaagcaccggcuccugcuugaagaggacaauaaaauguuaguuaacgagcugaaucauucaaaggaaaaagagugucaguacgaaaaggagaaagcugagcgugaaguggccgugcgccagcuccaacagaagcgagaugacgucuugaacaagggaagugcgaccaaagcacugcucgaugccucuagcagacacugcacauaucuggagaauggcaugcaggacuccaggaagaaacuugaucaaaugcggucacaguuucaggaaauucaggaccaacugacugcuaccauccgcuguacgaaggagauggaaggugauacacagaaauuggagguggagcauguuaugaugagaaagauaauuaagaaacaggacgaucagaucgaaaggcuagagaagauccugcaacacagcucucucauguuacagguauucgaauccuga

SEQ ID NO: 52775 - RNA, 477 nt, Artificial Sequence
  derived and/or modified sequence opt3 from ANKRD37__Homo_sapiens__NP_859077
augcugcuccuugacugcaaccccgagguggauggccugaagcacuuguuagaaaccggggccagcgucaaugcuccuccagacccguguaaacagucccccguucaucuggcagccggaucuggucuagcgugcuuccuccuguggcaacuucagacaggcgcugaucugaaccagcaggacguguugggggaggccccucuccacaaggcagccaaaguaggaucacuggaaugucugagucucuuaguggcuagcgaugcacaaaucgaccugugcaauaagaacggccagacugccgaggaucuugcuugguccugugguuuuccagacugcgccaaauucuugacgaccauuaaguguaugcagacaauaaaggcgucugaacaucccgauagaaaugacugcgucgcagugcugaggcagaaacggucgcuagggucaguugagaacacuagcggaaagcgcaaauguuga

SEQ ID NO: 52776 - RNA, 2982 nt, Artificial Sequence
  derived and/or modified sequence opt3 from ANKRD44__Homo_sapiens__NP_001182073
auggccgugcugaagcucaccgaccagcccccucuuguccaagcuaucuucagcggcgauccagaggaaauuagaaugcugauacacaaaacagaggacguuaacacuuuggauuccgaaaagaggacgccguuacauguggcagccuuucugggggacgcggagaucauugaacuacucauccugucuggagcucggguaaaugccaaagauaacauguggcuuacaccccugcaccgcgcaguggccucacgaagugaggaggcuguccagguguugauuaagcauagcgcagacguuaaugcccgugauaaaaacuggcagaccccucuccacguggcugccgcgaauaaggcagucaagugcgccgaagugaucauaccacugcuguccucuguaaacguuucggacagagguggcaggacugcucuccaucacgccgcauuaaaugggcacguggagauggucaaccugcuuuuggcuaaaggagccaauaucaacgcguucgauaagaaagaccggcgcgcccugcauugggcagcuuacaugggccaccuagaugugguggcccuccugauuaaucauggugcugaagucaccuguaaggacaaaaagggguauacaccccuucacgccgcagccucaaacggacagaucaauguugugaagcaccuguugaaccucggcguagagauugaugagaucaauguguacggcaacaccgcucugcauauagcgugcuauaacgggcaagacgcagucgugaaugaauuaauugacuacggagccaacguuaaucagccuaacaauaacgguuuuacuccacugcacuucgcugccgcaagcacacauggcgcccucugucuugagcuguuggugaauaacggggcugaugucaauauccagaguaaagacggaaagucuccccuacacaugaccgccgugcauggcagauuuacgaggucccagacucugauucaaaacgguggggaaaucgauugcguagacaaagauggaaauaccccucuccacguugcagcgcgguauggccacgagcugcuuaucaacacacugauuacuagcggcgcugacaccgccaagugugggauacauuccauguucccauugcaccucgcagcccugaaugcucauucagauugcugucgcaaauuacugaguagcggauuugaaaucgacacaccggauaaguucggucgaaccugccuacacgccgcagcugccggcgggaacguggaguguauuaaacuccugcagucuuccggagcggacuuucacaagaaggauaaaugcggcagaacgccccuucauuacgccgcugcaaauugucacuuccauugcaucgagacuuuggucacaaccggugccaacgugaacgaaacugacgacugggggaggacagcucugcacuaugccgcagcgucagauauggaccggaauaagaccauacucggcaacgcccaugauaauagcgaggaacuggagcgugcucgcgaacuuaaagagaaggaggccacgcugugcuuggaauuucuccugcagaacgacgcaaauccuaguauuagagauaaagagggauacaacucuauccacuacgcugccgcauauggccacaggcaguguuuagaacugcuacucgagcggaccaauuccggguucgaagagagcgacucgggagccacaaagucuccacugcaucuugcugcguacaacggucaccaucaagccuuggagguccugcuccagucccugguggauuuagacauccgagaugaaaagggccgcacugcacuggaccuugcugccuuuaaagggcacaccgagugcguugaagccuugauuaaucagggagcuucaaucuucgugaaggauaacguaacaaaaagaacuccccuccaugcaagugucauuaauggccacacccugugucuaaggcugcuccuggagauagccgacaacccugaggcgguggauguuaaggacgcuaaaggucaaacaccacuuauguuggccguggcauaugggcacaucgacgccgucagccuguuacucgaaaaggaggcuaauguggauaccguagacauucugggcugcacugcacuucaucggggaaucaugacgggccacgaagagugugugcagaugcuguuggaacaggagguuuccauccucugcaaggauucucgcgggagaacaccccugcauuacgccgcggcuaggggacacgccaccuggcuaagcgagcugcuccagauggcacugucagaagaggacuguugcuucaaagauaaccaagguuauacuccgcuucacugggccuguuacaauggcaacgaaaacugcauugaggucuugcuggaacagaaguguuuucguaaauucauagggaauccuuuuacccccuuacauugcgcuaucauuaacgaccacggaaauugcgccagucuccugcuuggcgcaaucgauuccagcauugugucuugucgggacgauaagggucgaacaccacugcaugcugccgcguucgccgaccacguggagugccuacagcuccuguugagacauucagcaccugucaacgcuguugauaauagugggaaaaccgcccugaugauggcugcagagaacggccaggccggagccguggacaucuuagugaauagcgcucaagcggaucucacuguaaaggacaaggaccugaacacaccccuucaccuggcauguuccaaaggccacgaaaagugcgccuugcucauacuggauaaaauccaggacgagucucuaauuaaugaaaagaacaaugcucugcagacgccacuucaugucgccgcaaggaacgggcucaaagugguuguggaggaacuguuggccaagggagcuuguguccuggcgguggaugagaaugccucgcgcagcaacggcccccgguccaccccugguacugcaguucagaaagaggaauga

SEQ ID NO: 52777 - RNA, 801 nt, Artificial Sequence
  derived and/or modified sequence opt3 from ANKRD45__Homo_sapiens__XP_011507772
auggagagcgaagggcccccugaguccgaaucuucagaguucuuuagucagcaagaagaggagaacgaagaggaagaggcccaggagccagaagagaccggcccgaagaauccccugcuccagccugcucuuacaggagacguggaaggucugcagaaaaucuucgaggauccagaaaacccccaccaugagcaagcaaugcaguuguuacuggaggaagacauugucggcagaaaucuacucuacgccgcgugcauggcugggcagagcgauguuauaagggcccuggcaaaguauggagugaaccuuaaugagaaaacuacgcggggcuacacccuguugcacugugccgcugcauggggucgccucgaaacacugaaggcccugguagagcucgacguggauaucgaagccuuaaacuuucgagaggagcgugcuagagacgucgcggcaagguauucccagacugaaugcguggaguuccuggauugggccgacgcucggcuuaccuugaaaaaguacauugccaagguuucucuggcagugacagauaccgaaaaagggucgggaaagcuacucaaagaggacaagaauacuauccugucagcuugucgcgccaaaaacgaauggcuugagacacauaccgaggcgagcauuaaugaacuguuugagcaaagacagcaguuggaagauaucgucacgccuauauucacuaagaugaccacaccaugccaggugaagagugccaaauccguaacuucucacgaccaaaagaggagccaggaugacaccuccaacuga

SEQ ID NO: 52778 - RNA, 699 nt, Artificial Sequence
  derived and/or modified sequence opt3 from ANKRD46__Homo_sapiens__NP_001257308
augagcuacguguucgucaacgacuccucucagaccaauguuccccugcuccaagccugcaucgauggcgacuuuaacuauucaaagagacuucuggagaguggguucgauccuaauauuagggacagccggggacgcacagguuugcacuuagcugcagcccgaggcaacguggauauaugucagcugcuacauaaguuuggggcggaccuccuggcuacugauuaccagggaaauacggcccuucaccugugcggccauguagacaccauccaguucuugguguccaacggucucaagauugauaucuguaaucaccaaggggcaacaccacugguccuggccaaacguagaggagugaacaaggacguuauuaggcucuuagaaucucuggaggaacaggaggugaaaggcuuuaaucggggcacucauucgaaacuugaaaccaugcagacagcugagucagagagcgcaauggaaagucacuccuugcugaacccgaaucuacagcaaggggagggaguccucucuagcuuccgcaccacuuggcaggaauuuguggaggaucuggguuucuggagaguacuucuguugaucuuuguuauagcccuccuguccuuaggcaucgcuuauuacaggcggacacugcgccucgggucauucgcccgacaggacagaaguaggauucaggcgaucuga

SEQ ID NO: 52779 - RNA, 3753 nt, Artificial Sequence
  derived and/or modified sequence opt3 from ANKRD50__Homo_sapiens__NP_001161354
augaagcccccucagcaaagccuguaccuccuuguggacuccgucgaugagggcugcaacaucaccgaaggggagcagacaucuacuucacugaguggaacgguugccgcuuuguuagcaggucaccacgaguucuuuccaccguggcugcuacuccuguguagcgccagaaaacaguccaaggcggugaccaaaauguucacaggcuuuaggaagauuucucuugacgaucugcggaaggcuuauauaguaaaagacgugcagcaauacaucuugcaccgccucgaucaggaggaagcccugcgacagcaucugacuaaggagaccgcagagaugcucaaucaguuacacauuaaaucgucagggugcuuccuguaucuugaacgugucuuggacggagugguugagaacuuuaucaugcugagagaaauuagggauauccccggcacacuaaauggucucuaccuguggcuuugucaacggcuguucgugcgcaagcaguuugccaaaguccagccuauauugaacgugauccucgcugcaugcagaccacugaccauuacugaguuauaucaugccguauggacaaagaauaugagccugacccucgaggacuuccagaggaaacuugauauccugaguaaguugcuaguugacgggcugggaaacacgaagauucucuuucacuacuccuucgcugaauggcugcuugaugugaaacacuguacucaaaaguaucugugcaaugccgcggagggccaucggauguuggcaaugucuuacaccugucaggccaaaaaccucacaccccuggaagcucaggaguuugccuuacaccugaucaauagcaaccuacaacucgaaacugcagagcuggcucuuuggaugauauggaauggcaccccuguccgcgacuccuugucaacacugauuccaaaggagcaggaagugcuccagcugcuugugaaagccggggcgcaugucaacagugaggaugaccgaaccagcugcaucguuagacaggcccuggaaagggaggacucuauucggacguugcucgauaauggagcauccgugaaccaaugugacucaaauggucguacucuguuagcuaacgccgcuuacagcggcagucuggauguagugaaccuacucgucucucgcggggccgaccuggaaaucgaggaugcacacggacacacaccccuuaccuuggccgcuagacagggccauacuaaggugguuaauugccugaucgguuguggggcgaacauuaaucacacagaccaggauggauggaccgcacucagguccgccgcuuggggcggccauacggagguggucagcgcccuguuauaugcaggggugaaaguagacugcgccgaugcugacucgcggaccgcccugcgagcagcggcuuggggaggucacgaagauauaguucuuaacuugcuccagcauggcgccgaggugaauaaggcagacaacgaagggcgcacagcccugaucgcugccgcauacaugggacacagagagauugucgaacaccuacuggaccauggcgcugaggugaaucacgaggaugucgacgguaggacugcccucucuguggcggcccugugcguuccugcuuccaaggggcaugcaucagugguaagucuuuugaucgaucggggcgccgaagucgaccacugugauaaagacggaaugaccccacuguuaguggcugccuaugagggccacguugauguggucgaccuccugcuugaagggggagcagauguggaccauacagauaacaauggucgcacuccgcuguuggcggccgcuagcaugggccacgccuccguagugaacacccuccuguucuggggagcagcuguugacucuauagauagcgaggggagaacaguccuaucaauugccagugcacaaggcaauguggagguggucaggacccugcucgaccguggucuggacgaaaaccaucgggaugacgccggguggacuccccuucacauggcugcguuugagggccaucgauugaucugcgaagcccugaucgagcagggagcaagaacgaaugaaauugauaacgacggcaggaucccuuucauuuuagcuucccaggaggggcacuacgauuguguucagauacuccuggagaauaagagcaacaucgaccaacgcggauaugauggucggaacgcccuuagaguggccgcucuggaaggccacagggacauuguggagcuacucuucucucauggggcagauguaaauugcaaagacgccgauggacgcccaacacuguacaucuuggcgcuggaaaaccaguuaaccauggcugaguauuuucucgaaaauggcgccaacgucgaggcaucagacgccgagggucgaacugcucugcacgugaguuguuggcaggggcauauggaaaugguucaggugcuuaucgcauaccacgccgaugucaaugcggcugacaacgagaagcggagcgcccugcaauccgcagccuggcagggccaugugaaaguugugcaguugcucauugaacacggagcuguagucgaccauaccugcaaucaaggcgccacagcacuguguauagcugcccaggaggggcacaucgauguggugcagguccuacuggaacacggagcggaccccaaccaugccgaucaguucggccguaccgcaaugagaguugcugccaagaauggucacucucaaauuaucaagcugcucgagaaauacggggcuucgagccugaacggaugcuccccuucaccagugcacacuauggagcagaagcccuugcagagucugucuagcaaaguacaguccuuaacaauuaagucaaauagcucuggcuccacggguggcggggacaugcaaccgagucucaggggacugccuaacggccccacccaugcauuuagcucuccauccgaaucaccugauaguacuguggaccgccagaaaagcucgcuuuccaauaacucucuuaagagcucaaagaauaguuccuugcggacaaccucuagcacagccacugcccagaccguccccaucgauuccuuccacaaccucucauuuacggagcagauacaacagcauagccugccaagaaguaggucucgacaguccaucgugagccccucgucaaccacacaaucucuagggcagagucacaacuccccuagcucugaguucgaauggagccagguuaaaccaucccugaagucaacuaaagcuaguaagggaggcaaaagcgaaaauucugcgaaguccgguucagcagggaagaaagccaagcagaguaacagcucccaaccgaaagugcuugaauaugagaugacccaguuugaccgccggggacccauugcuaagucuggcacagccgcaccuccaaaacagaugcccgccgaaucgcaguguaagaucaugauuccuagcgcucaacaggagaucgguagaucacagcagcaauuccucauacaucagcaguccggcgaacagaaaaagaggaaugggauuaugacuaacccaaauuaccaucugcaaaguaaccaggucuuuuugggacgugugucuguuccccgcaccaugcaggaucggggccaccaagagguguuagagggguauccgagcuccgaaacggagcugucacucaagcaggcgcugaaacuucagaucgaaggaucugacccuagcuucaauuacaagaaagagacaccacuguga

SEQ ID NO: 52780 - RNA, 1845 nt, Artificial Sequence
  derived and/or modified sequence opt3 from ANKRD55__Homo_sapiens__NP_078945
augaugagacaggccaccauggacuucagcacacccuccguguuugaucaacagaggggcgacucuucagaggaagucgaucugacuaugguuuaccaggcugcaaguaacggggacgugaaugcccucacggcgguaauccgggaggauccuagcauucuugaaugcugugacuccgagggaugcaccccacugaugcacgcugugucuggucgccaggccgauacagucaaguuguuacugaaaaugggcgcaaacauaaauaugcaagacgccuaugggcgaacuucgcuaugucucgcuaccuaccugggauggcuugaaggcugcgugucacuguugcguaacggugcaaagcauaauaucccggauaaaaacgggagacucccccugcacgccgcuacagccgagccugacaugaggcugcucaccguuuuacugcagcagagcaauauuagugagaucaaccaucaggauaaugaaggaaugacuccacuucacugggcggcauuccauaaccaaccccagcacacacagauguugcugaagaaaggcgccgacccuacccuaguggauaaggacuuuaagacggcucuccacugggccguccaguccggcaaucggauucuguguucuaucauacuuagccaucaccaagggccauccaucauuaacuaugacgaugagucaggaaaaacuugcgugcauaucgcagcugccgcggguuucagugacauuauccacgaacuggcccgcguacccgaguguaauuugcaggcacucgauguugacgauagaaccccucugcacugggcugccgcugccggcaaggcagagugcgugcagagcuuacuggaacucgggauggacucuaaccuuagggauauaaaugaguccacaccacuggccuacgcuuuguauuguggacauacugcgugcgucaaacuacugucacaagaaagccggaccgagccgacacgacccccuccaagucagucuucccgcccccagaagaaagaaagaagguuuaacgugcucaaccagauuuucuguaagaauaagaaagaggagcaacgggcacaccagaaggacccuagccgugaucgcuacagagaagaggacaccucggaagugaacgauaucauuacgacuuuugacucuaucgucggcacaaauugccaggagcagccaggugaccaaguugccaugguggaauuuaaaaagaaaaccuccgauaacucaaaguaucugcuucccgagaaaaagccgcuggcuaggaagggguugccucccauccggacucagagucucccaccuauuacacugggaaauaacuucuuaaccgccagccaucgagcaacgucccacgccggccugucuagcgcuccccaucacauggcccagcgcucacagaaaaguagauccgagcaagaccuacucaauaacaggaccggcugccagaugcugcuugauaauccauggaaaagcgacucuaaccagguauucucauacaagguguggacagucaguagcuccgauaaguugcuggaccggcuccugucugugcgccccgggcaccaggaaguuucggugccuccacaucuuagacaucugcacaauccgagcuccggacaaaacuuucagcacuugucacccaauaggcacaaaauacgugaucucccuuucacucggaacaaucuggcaccauuacccgaccagaaguuucugaguggugagccucuacgaaccaacagaguccucccagcgauccccucucaaaggcgccauagcacagcugccgaagaguccgaacacucagcaaacccgacuagcgaugagaauuga

SEQ ID NO: 52781 - RNA, 2184 nt, Artificial Sequence
  derived and/or modified sequence opt3 from ANKRD6__Homo_sapiens__NP_001229738
augagccagcaagacgccguggcugcacuguccgagagacuccuugucgccgcguacaagggccagaccgaaaacguugugcagcugaucaauaaaggggcuaggguagccgugacaaagcacggacggacucccuugcauuuagcagccaacaaaggucaccuaccugucgugcagauucuacucaaggcuggcugcgaucuggacguucaagaugacggggaucagacggcacuucaucgcgccaccguggucggaaauacagagauaaucgcugcccugauucacgaaggcugugcguuggaccgacaggauaaagacgguaacacugcacuccaugaggccucuuggcacggguucucacagagugcuaagcugcugaucaaggccggagcaaaugugcucgcuaaaaacaaggccggcaauaccgcguuacaccuggccugccaaaacagccauucccagucuacacguguacuuuugcuggcaggcucgagagcugaucugaaaaauaacgccggggacaccugucuccacguugcugccagguauaaucaucugucaauuauccggcuucuguugacugcauuuugcagcgugcacgaaaagaaccaggccggagauacagcucuccacgucgcggcagcccugaaucauaaaaagguggcuaagauauuacuggaggccggugcagacaccacgaucgugaacaaugccggccagacuccacucgagaccgcucgcuaccacaacaacccggaagucgcccuucuguugacaaaagcaccccaaguucuaagauucaguagggggcggucccugcgcaagaaacgagagagacucaaggaagagaggcgggcgcagucugugccucgugaugagguagcucagagcaaaggauccgugucagccggcgacacuccaaguagcgaacaagcagucgcccgcaaggaggaagcuagagaggaauuucugucugccucccccgagccuagggcaaaagacgaucggcgacgcaagucaagaccaaaggugagcgcuuucagugaccccaccccuccagccgaucagcagccgggucaucagaaaaaucuucacgcgcauaaccaccccaagaaaaggaaucggcaccgcuguucuuccccuccacccccucaugaguuuagagccuaucaacuguacacauuguauagggggaaggacggaaaaguuaugcaggcuccaauuaacggcugccguugugaaccccucaucaauaagcuggagaaccaguuagaagcaaccguggaggaaauuaaggccgagcugggcagcguccaggauaaaaugaauacgaagcuagggcaaauggagaacaaaacucagcaccagaugcgggugcucgacaagcugaugguagaacgacuuucggcugagagaacagaaugcuugaauaggcugcagcaacauucugauaccgagaaacacgaaggagagaagcgccagaucucccucguugacgagcugaagacuugguguaugcuuaaaauacagaaccuggaacagaaguugucaggugauagucgggccugcagagcaaaaagcacaccguccaccugugagucuagcacgggcguggaccaacucgucgugaccgcggggccugccgcugccucagauaguuccccacccgucgugaggccuaaggaaaaagcacugaauagcacagcuacucagcgcuuacagcaagagcugucuucaagugacugcaccggaagccgacuacggaacguuaaggugcagacagcccuccugcccaugaaugaggcagcccguuccgaccagcaggcuggcccaugcguaaacagagguacucaaaccaagaaaucugggaagucgggccccacaaggcaccgcgcgcagcagccugccgcaagcuccaccuguggacagccaccgcccgcuacuggcucagaacaaacggggccucauauucgggauacaagucaggcccuugaguugacccaguacuucuuugaagccgucucuacucagauggagaaaugguaugaaagaaagaucgaggaggcuaggagccaagcaaaucagaaagcccagcaagacaaggcgacccugaaagaacacauuaagucccucgaggaggaacuggcuaaguuacgaacacgcgugcagaaagaaaacuga

SEQ ID NO: 52782 - RNA, 765 nt, Artificial Sequence
  derived and/or modified sequence opt3 from ANKRD7__Homo_sapiens__NP_062618
augaacaagcuguucagcuuuuggaaaagaaagaaugagaccaggucccagggcuacaaccuccgggaaaaagaccuuaagaaacugcaccgcgccgcuucugugggggauuugaagaaguuaaaagaguaucugcaaaucaagaaauacgacgucaauaugcaggauaagaaauaucgaacaccccuacaucucgcaugcgccaacggacacacugacguugugcuguuccuuauugaacagcaguguaagauaaauguacgugauucagagaacaagaguccucugaucaaagcggugcaaugccagaaugaagacugugcuacgauuuugcucaacuuuggugccgauccagaccugagagauaucagguacaauaccguccugcauuaugcagugugcggccagagccucuccuuaguugagaagcugcuugaguacgaagccgacuuggaggcuaaaaacaaggauggguauacaccgcugcuaguggcagucauuaauaacaaucccaaaauggugaaguuccuccuggaaaaaggagccgacguaaacgcuucugauaauuaccagcggacugcccuuauccuggcgguuucgggcgagccuccauguuuggugaagcuccuguuacaacagggugucgagcugugcuacgaagggauaguggacucacagcuccgcaacauguuuaucagcauggugcuucugcacagauauccccaguucaccgcaagucauggaaagaaaaagcacgccaaauga

SEQ ID NO: 52783 - RNA, 3405 nt, Artificial Sequence
  derived and/or modified sequence opt3 from ANKS1A__Homo_sapiens__NP_056060
augggcaaggagcaggaacugcucgaggccgcuagaaccgggcaccuucccgcaguggaaaaacuguugagcggaaagagguuauccucugguuucggcgggggaggcggugggggaucaggcggcgggggagguggcagugggggaggcggugggggacugggcagcuccucucauccucuaucgucacuccugagcauguggcggggcccaaacgucaauugcguugacaguacaggguacacuccgcuucaccaugccgcgcugaacggacacaaagaugugguagagguguugcuccgcaaugacgcucugacgaacgucgccgauuccaaggguuguuauccccugcaucucgcagccuggaaaggcgacgcucaaaucgugcgauuacugauucaccaggggccuucucacacccguguuaaugaacagaacaaugauaacgagacagcacuucauugcgccgcucaguacggacacacugagguggucaagguguugcuggaagaacuaaccgacccaacaaugagaaauaacaaguuugaaacuccccucgaucuggccgcgcuuuauggcaggcuggagguaguuaaaauguugcucaaugcacauccuaaccuguuaagcuguaauaccaagaaacacacaccacugcaccucgccgcucggaacggucauaaggccgugguccaagugcuucuggacgcagggauggauuccaauuaccagaccgagaugggcucagcuuugcacgaagccgcgcuauucggaaaaacggacgugguccagauacugcucgccgcaggcacugauguuaacaucaaggacaaccaugggcugaccgcucuugauacagugcgcgagcugcccagucaaaagagccagcagauugccgcuuugaucgaagaccacaugacuggaaaaagaucuaccaaggagguagacaaaacaccuccaccgcagcccccucucauuuccucaauggauagcaucagucagaagucucaaggugacguggaaaaagccgucaccgagcugauaaucgauuuugacgcaaaugccgaggaagagggcccauaugaagcucucuacaacgcgauuuccugccauagccuggauucgauggcaucugggagguccucagaccaggauaguacgaauaaggaggccgaagcugccggagugaaacccgcaggcguucggccucgcgagcgaccacccccgccugccaagcccccaccugacgaggaagaggaagaucacaucgacaagaaauauuucccccuaacugcuagcgaggugcucuccaugagaccaaggauucacgguucugccgcacgggaagaggaugagcaucccuacgaacugcuuuugacagcggagaccaagaaagucgugcugguagacgggaagacuaaagaccaccgucgcagcucaaguuccagaagccaggauucugcugaaggccaagacggacagguuccugagcaguuuucaggccuccugcaugggaguagcccagugugugaggucggacaggauccguuccaacuucugugcacagccggucagucccaccccgacggcucuccucagcagggggcaugucacaaggccucgaugcaauuggaagagaccggagugcaugcuccaggcgccagccagcccuccgcacucgaucagucaaagagggucgguuaccugacgggguuaccuaccacaaacagucggucucacccagaaacucugacccauacagcuagcccccacccgggcggagccgaggaaggcgaccgauccggggcgcgcucaagagccccuccaacuagcaaacccaaggcugagcuaaaacucucuaggucccugaguaagagcgauucugaccuuuugaccugcuccccuacagaggaugcaaccaugggaucacggagugaaagccugucgaauuguuccaucggcaaaaagcgccucgagaagucucccagcuuugccucagaaugggacgagauagaaaagauuaugaguuccaucggugaggggauugauuucucucaggagagacaaaagaucagcggacugaggacuuuagaacaguccgugggcgaguggcuggaaucaaucggucuucagcaguaugagagcaaauugcuccugaacggcuuugacgauguucauuuccuagggaguaaugugauggaggagcaagaccugcgugacauuggaauaucugauccacagcaccggcgaaagcuccugcaggcugccagaucccuuccuaaaguaaaggcauugggcuacgacgggaacucgcccccaagcgucccgucauggcuggauucuuuaggacuccaagacuaugugcacaguuuucuguccagcggcuacucuagcaucgauacgguuaagaaucuuugggagcuggaauuggugaacguccucaaagugcagcugcuaggucauaggaagcgcauuaucgcgucccuggccgaccggccuuaugaggaacccccacagaaacccccuagauucucacagcucaggugccaagaucugcuuagucagacaagcucuccauugucccagaaugacucauguaccgggcgcagugcugaucuguuauuacccccuggagacacuggccgacggcgucacgauagccugcaugacccggccgcaccauccagagcugagagguuucgcauacaggaggaacaccgggaggccaaacuuacccugagacccccuucucuagcagccccauacgcucccguacaaucguggcagcaucagccugaaaaacucauuuucgagagcugcgguuaugaagcgaacuaccugggcucaauguugaucaaggaucugagggggacagaguccacccaggacgccugcgcaaaaaugcgaaagaguacugagcacaugaagaaaaucccgacaauuaucuuaucuauuacguacaagggagugaaauucauagacgcuagcaauaagaacguuaucgccgaacacgagauucgcaauaucuccugugccgcucaagaucccgaagaccucugcaccuuugcauauaucacuaaagaucugcagacaucacaucacuacugucaugucuucucuaccguggacgugaaccuuacauaugagauuauacugacuuugggccaggccuuugaagucgcguaccaacucgcucugcaggcccaaaagagccgggcaaccggggccagugcugcagagaugaucgagacgaaguccagcaaaccaguuccuaagcccagagugggagugaggaaaucugcccuagaaccaccugauauggaccaggaugcgcagucacacgcuuccguaaguugggucguggaccccaagccagauagcaaacguucgcugucuaccaacuga

SEQ ID NO: 52784 - RNA, 1074 nt, Artificial Sequence
  derived and/or modified sequence opt3 from ANKS1B__Homo_sapiens__NP_001190995
auggccaacggcuucgacaaugugcaguuuauggggagcaacgucauggaggaucaagaccugcucgaaauugguauucuuaauuccggacacagacagaggauacugcaggcuauccaguuguuacccaagaugcggccuauuggccaugauggguaccacccaaccucuguugcagaguggcuggacucaaucgaacuaggagauuauacaaaagccuuccucauuaacggcuacacgaguauggaccugcuuaagaaaaucugggagguggaacugauaaaucaaagcuccguaugcgagaucuggacuaaccagaaugcggguuuuccguucucugcuauucaucaggugcacaacaccggggauuggggagagcccucgaucacauugcgcccuccaaaugaagccacugcaucaacccccguccaguauuggcaacaucacccugagaagcucauuuuucagagcugugacuacaaagccuucuaucugggcaguaugcugaucaaggaacuccgaggcacagaguccacccaggaugcuugcgcaaagaugcgugccaacugucagaaaucuacugagcaaaugaagaaagugccaacaauaauuuuaagcguuuccuacaagggggugaaauuuaucgacgcuaccaauaagaacauuaucgccgaacacgagaucagaaauauuucaugcgcggcacaggaucccgaagaccugaguacguucgccuauauaacuaaggaucuuaaaagcaaccaucacuacugucaugucuuuaccgcuuucgacgugaauuuggccuacgagaucauucugacacuaggacaggcauuugaaguagcuuaucaacucgcccugcaggcgaggaaggguggccacucuuccacucuuccugagucauucgagaacaaaccaagcaagccgauccccaaaccucggguuaguauacgcaagucugugauugacccauccgaacagaaaacccuggccaacuugcccuggaucgucgagccugggcaggaagcaaagagaggaaucaauacaaaguacgagaccacgaucuuuuga

SEQ ID NO: 52785 - RNA, 1254 nt, Artificial Sequence
  derived and/or modified sequence opt3 from ANKS4B__Homo_sapiens__NP_665872
augagcaccagauaccaccaggccgcuuccgacucuuaucuggagcuccuuaaggaagcaacaaaaagggaucugaacuugucagacgaggauggcaugacucccacguuacuggccgcguaccaugggaaucuagaagcucucgagaucauuugcagucggggaggugacccugaucgcugugacauauggggcaacaccccacugcacuucgccgcaagcaaugggcaugcccacugcguguccuuucuugucaacuucggagcuaauaucuuugcacuggauaacgacuugcaaacaccgcucgaugccgcugccucucgagaacagaaugaguguguugcgcugcuggacaaggcagccacugcucagaacauuaugaaucccaaaaaggugacccgucucaaagagcaggcccaaaagaacgcaagaaggcagaucaaggaaugcgagcgguuacaggaaaaacaucagaauaagauggcucacacauauucgaaagaggagucaggcacccugagcaguuccaaggguacuuucucucgcagcuccccuucaaacgccagugcgccagggacauuuggaagccuuucuaaaggcauuaaggauaccuucaagaucaaauuuaagaaaaauaaggacacggccgaacaaguaggcaaagaggggagauccggacagaggaacgugauggaagucuuccgggaggaagaggaggauucauuuagcggugacuucaaggaaaaauugcagcugagugcagaggaagacggcucugugcaccaugaguccauacuaaaucgccccgggcucggaagcaucguuuuucgaagaaacaggauuucgucuccugaagauaucuccgacucaaagcgggaguucggcuuuaagcugccaagugagcuucugcagcgucaaggugcuagcgaagccgaugagggggcugccgacgaagagggagaagagaacggcuugaaagaugaccuccccugggaugacgaugagguggaaugggaggaagacgucguggaugcaacuccucuggagguauucuuacugucccagcaccucgaggaguuccuuccaauuuuuaagcgcgaacagaucgaccuggaagccuugcuacuguguucugacgaggaucuccaaagcauacagaugcagcugggcccgaggaaaaagguucuuaaugcuauuaacagacggaaacaggugcugcaacagcccgggcaguuggucgacaccucacucuga

SEQ ID NO: 52786 - RNA, 2616 nt, Artificial Sequence
  derived and/or modified sequence opt3 from ANKS6__Homo_sapiens__NP_775822
augggcgaagggggacugcccccugccuuccagcuccuucugagagcuugcgaccaaggugauaccgaaacagcaaggcgguuguuagagccaggcgccgcggaaccggcugagcgcggggccgaacccgaggcaggagccgagccugcuggcgcagaaguggccgguccaggggcugccgcggcaggagccgucggcgcucccguuccuguggacuguagcgaugaggccggcaacacugcacugcaguuugcugccgccgggggacacgaaccccuaguacgauuccuccugcguagaggugcguccgucaauucuaggaaccauuacggcuggucagcacuuaugcaggcugcccgguuugggcacgugaguguggcucaucuguugcucgaccacggagccgauguuaaugcacagaaccgccugggcgccagcgugcugacggucgcuuccagaggugggcaucucggagugguaaaguuacugcuugaggcgggcgcauucguugaccaccaccaucccucuggcgagcaauuggggcugggagguucgagggaugaaccucuagacaucaccgcccucauggcugccauucagcacggccaugaggcagugguccggcugcuuauggaauggggagccgauccaaaucacgcugcccgcacagugggguggucaccgcugauguuggcagcgcucacuggccgacuggguguggcucagcaguuagucgagaaaggggccaaccccgaccaccugagcguucucgaaaagaccgcauuugagguggcccuugauugcaaacauagagaccugguagauuauuuggacccucuaacaaccgugaggccaaagacugacgaggaaaaacggcgucccgauauauuccacgcucugaagaugggcaauuuucaacucgucaaggagaucgccgacgaagauccuagucaugugaaccugguuaauggagacggcgcaacaccacuuaugcuggcugccgugaccgggcaguuggcgcucguccagcuguuaguggagcgccacgccgauguagacaaacaggauuccguucauggauggacggcucugaugcaagcaacuuaccacgguaacaaggaaauugugaaauaucuacucaaucagggcgccgacgucacccugagagcuaagaacggguacacagccuucgaucuugugauguugcugaaugaccccgauacugagcucgucaggcugcuugcaucuguguguaugcagguuaacaaagacaagggacggccgagccaccaaccuccccugccacauuccaaggugcgacagccuuggucaauccccguauugccagacgauaaaggcggucucaagaguugguggaaucgcaugagcaacagauuuaggaaacugaaguuaaugcagacccugccccgggggcuaucuuccaaccagccucucccauucucagacgagccggaacccgcgcuggauagcacaaugcgcgccgcuccucaagacaaaaccaguagaucugcccuuccagaugcagcucccgucacgaaggacaauggcccuggauccacuaggggcgagaaagaagauacauugcugaccacuaugcuccguaacggggccccacugacacgguuacccagcgacaagcugaaggcagugauuccgccuuuucuuccacccucgucuuucgaguugugguccucagaucgaaguagaaccaggcacaauggaaaagccgacccuaugaagacggcucucccccagcgcgcgagccggggucauccaguuggcgggggaggcaccgauacaacuccugugagacccgucaaauuuccaucccugccgaggucuccugccagcucagcaaacagugguaauuucaaccacuccccacacagcucugggggcucaaguggagugggcguaagccgccaugggggagaacuacugaaucgauccggcgguucuaucgacaacgugcucucgcagauagcugcccagcggaagaaagccgcugggcugcuugagcaaaagccaagccaccguuccucacccguuggaccugcaccaggcaguucucccagcgaguugccugccuccccggcggguggcucagcuccagucgggaagaaacuggaaaccagcaagagacccccuucuggaacauccacuaccaguaaaagcacaucuccaaccuuaacucccuccccuucaccgaagggccauacggccgagaguagcgugucguccucuagcucacacaggcagaguaaauccucugggggaagcuccucaggcacaaucaccgaugaagacgagcucacugguauucugaagaaacuuagccuggagaaguaucagcccaucuucgaggagcaggaaguggacauggaggcauuuuugacccucacagauggggaccugaaggaacuaggaauuaaaaccgauggcagucgccaacagauccuggccgcuauaucugagcucaaugcagguaagggccgggagagacagauucugcaggaaacuauccauaacuuccacuccagcuuugagucgucagccucuaauacaagggcgccagggaacaguccuugcgcuuga

SEQ ID NO: 52787 - RNA, 3264 nt, Artificial Sequence
  derived and/or modified sequence opt3 from ANLN__Homo_sapiens__NP_001271230
auggaccccuucaccgagaagcugcucgaaagaacaagggcccggcgcgagaaccuucagcgaaaaauggcugaacguccuacugcagccccaagaagcaugacgcacgcgaagagggcucggcaaccgcuguccgaggccucuaaucagcagcccuugucaggcggggaagagaaaaguugcaccaagccuagcccauccaaaaagcgcuguucugauaacacagagguggaagucucgaauuuagagaacaagcagcccguugaaucaacuagcgcaaaaaguugcuccccuucuccagugagcccccaaguacagccucaggccgcugacaccaucuccgauucaguggcagucccagccagucugcuaggaaugagaaggggucucaauagccggcuggaggcuacagccgcgucuuccgugaagacccgcaugcagaaacuugcagagcaacgaagaaggugggacaacgaugacaugacugaugacauuccggaaucaagccuguuuagucccaugccuucugaggaaaaggccgcuuccccaccccggccuuugcucagcaaugccucggcaacaccaguuggccgucgcgggagacuggcuaaccuggccgcgaccauauguucuugggaggaugacgugaaucauuccuucgccaaacagaacucaguccaggaacagcccggaacggcaugccucaguaaguuuagcuccgcuucuggcgccagcgcuaggaucaauucaaguuccgugaagcaagaggccacuuucuguagccagcgggauggugacgcaucuuuaaacaaagcccugucaaguagcgcugaugacgcgucccuuguaaaugcaucuauuucgagcuccguuaaggccaccucaccggugaaaaguacaacuucuaucaccgacgcuaagagcugcgaggggcagaacccugaauugcugcccaaaacaccaauuuccccucuaaagaccggagucucaaaacccaucgugaaaagcacgcucucucaaacugugccauccaagggcgagcugagucgagaaauaugucuucagagccagucuaaagauaaguccacaacccccggcgggacuggaaucaaaccuuuucuggagcgcuucggugaaagaugccaggagcacucaaaggagaguccagccaggagcacaccgcaucggacccccauuaucacgccuaauaccaaagcaauucaagaacgcuuguuuaagcaggacacaucguccucuacuacccaccucgcccagcagcugaagcaagagagacagaaagaauuagcuugucugaggggccguuucgauaaggggaacaucuggagcgccgagaaaggaggcaacucaaagaguaaacagcucgaaacaaagcaggagacucauugccaauccaccccacuuaagaaacaccagggugucucuaagacacagagccugcccguuaccgagaaagugacugaaaaucagauaccugcaaagaacuccucaacggagccaaaagaaguaauucgggagaucgagaugagcguggacgaugacgauauuaauaguucuaaggucaucaacgacuuguuuuccgaugugcuagaagagggggaacuggacauggaaaagagccaagaagagauggaucaggcgcucgcugagucgucagaagaacaggaagacgcccugaauaucucuaguaugucccuucuggcacccuuggcccaaacaguuggaguggucagcccggagucucucgugagcaccccucgacuggaauuaaaagacacuuccagaucagaugagaguccaaagcccggcaaauuccagaggacccgcguaccucgggcugagagcggcgacucucugggguccgaagauagagaccuacucuacucaauugaugccuauaggagucagcgcuuuaaggagacagaacgacccagcauaaaacagguuaucgugcggaaggaggacgucaccuccaaacuggaugaaaagaacaaugcauucccaugucaagugaacauuaagcagaaaaugcaggagcuuaauaacgagaucaauaugcagcaaacugucauauaccaggcuucucaggccuugaacugcugcguggacgaggagcacggaaaggguucgcuggaagaggcggaggccgaacgucuccugcuuauugcuacaggcaaaagaacgcuguugaucgaugagcucaauaagcugaaaaacgaagggccucagaggaagaauaaggcaagcccccaaucagaguuuaugccauccaaaggaaguguuaccuuaucugaaauccgccugccgcuaaaggccgacuucguguguagcacuguacagaaaccugaugcugccaacuauuacuaucucauuauccugaaggcaggcgcggagaacauggucgccacaccccuugcuuccaccucaaauucuuugaacggugacgcccugacauucacuaccacguuuacccuccaggaugugagcaaugacuucgagauuaacauagaaguuuacagucuggugcaaaagaaggacccauccggguuagauaagaaaaagaaaacaagcaagucuaaagcaaucacucccaagcggcugcuuaccucaauuacaacuaaguccaauauccauaguagcgucauggcuucgccuggcggauugucugccgugagaaccuccaacuuugcacucguaggcagcuauacgcugucacuaaguucuguggggaauacaaaauucguucuggacaaggucccauuucucuccagccuggagggacacaucuaccuuaaaauuaagugccaggugaacucaaguguggaagagagggguuucuugaccauauuugaagaugucagcggcuucggggccuggcaucgacgcugguguguucuguccggaaauugcaucucuuacuggacuuaucccgacgaugagaaacggaagaacccuauuggcagaaucaauuuagcuaacuguacaagcaggcagauugagccggcgaaucgugaauuuugcgcccgccggaacaccuucgagcucaucacugugagaccacagagggaagacgaucgagagacccuggugucccaaugucgggacacacuuugcguaacgaaaaauuggcugucagcagauaccaaggaggagcgcgacuuguggaugcagaagcucaaccagguccugguggauauaagacuauggcagcccgacgcuuguuacaaaccuaucgguaagccauga

SEQ ID NO: 52788 - RNA, 1884 nt, Artificial Sequence
  derived and/or modified sequence opt3 from ANO10__Homo_sapiens__NP_001191760
augaaggugacccugagcgcccucgacacauccgagucuucauucacuccccuugucguuaucgaacuggcucaggaugugaaagaggaaacgaaggagugguugaaaaacagaauuauagcaaagaaaaaggacggcggggcccaauuacuguuuaggccucuacucaauaaguacgaacaggagacccuggagaaccagaaucuuuaucugguaggagcgaguaaaauccggauguugcucggugcugaagccgugggccuggucaaggagugcaacgauaauacaaugcgcgcauucacuuaccgaacccgucagaacuuuaaaggguucgacgauaauaacgacgauuuucugacaauggccgaaugucaauucauuaucaagcacgagcucgagaauuuaagagcuaaagacgaaaagaugauuccaggauauccgcaggcaaagcuguaccccggcaaaagccuuuugaggcggcugcuaaccuccgguaucgugauacagguuuuuccucuccaugauucugaggcccugaagaaacuugaagacacuugguauacacgcuucgcucugaaguaccagccaaucgauucgauuagaggguauuuuggagagaccaucgccuuguacuucggcuuucucgaauacuucacguuugcgcugauucccauggcagugaucggcuuaccuuauuaccuguucgucugggaggacuaugauaaauacgugauauucgccucauuuaaccucauuuggagcacuguaauccuugagcuguggaagagggggugcgcuaauaugaccuaucgguggggaacauugcuaaugaaacgcaaguucgaggagccacgacccgguuuucacggcguucuggggauuaacaguaucacuggaaaggaggaaccucucuacccauccuauaaaagacaacugaggaucuaccuugugucucugccguucgucuguuugugccucuacuuuagccuguaugugaugaugauuuacuucgacauggaagugugggccuuaggccugcaugaaaauuccgguucagaguggaccaguguccuacucuauguucccagcauaaucuacgcaauugugaucgaaauaaugaaccggcuguaucguuacgcugccgaguuucuuacaucuugggaaaaucaccgcuuggaguccgcguaucagaaccaucugauucucaagguacugguguucaacuuucuuaauuguuucgccucacuguuuuacaucgcauucgucuugaaagacaugaagcuccugagacagagcuuagcuacccugcuaaucacgagucagauucucaaccaaaucauggaaucuuuucugccuuacuggcuucagaggaaacacggggugcggguuaagcgaaaggugcaggccuugaaagcugauauugacgccacucuguaugagcaagucauacucgagaaggaaaugggaacauaccugggcaccuucgaugacuauuuagagcuguuccuucaguuuggcuacguguccuuguucagcugcguauauccacucgcagccgcuuuugcgguucugaauaacuucacugaagucaauucggaugcacuaaaaaugugucgcguguuuaagagacccuucucugagccuuccgccaacaucgggguguggcagcuggcuuuugagacaaugucagucauuagugugguuaccaauugcgcccucaucggaaugagcccacaggugaacgcaguauuccccgaauccaaagccgaccugauccuuauugucguggcuguugaggccgcaucuuguaaguuggugagccugccgagguacucauggaguaccaauuccgucccugguacggugauaggccccgggguauga

SEQ ID NO: 52789 - RNA, 2961 nt, Artificial Sequence
  derived and/or modified sequence opt3 from ANO1__Homo_sapiens__NP_060513
augagagugaacgagaaguacagcacccugcccgccgaagacagguccguccacaucauuaauauaugcgcuaucgaggauauuggcuaucucccuucugaagggacacuucugaacucauugaguguugacccagaugcagaguguaaauacggauuauauuuccgggacggucgccgaaagguggauuacauccugguauaucaucacaaacguccgagcggcaauagaacucuagugaggcggguccagcauuccgacacgcccucuggggcccgcucggugaagcaagaucacccucucccaggaaaaggcgcgucacuggacgcugguagcggggaacccccuauggauuaccaugaggacgauaagagauuuaggcgggaggaauaugagggaaaccuucuggaagccggcuuggagcucgagcgcgacgaagauaccaagauucacggcguuggguucgugaaaauccacgcaccauggaauguccugugccgagaggccgaauuucugaagcucaaaaugcccacaaagaaaauguaccauauaaacgagacuagaggauuacugaagaagaucaauagugugcuucagaaaauuaccgacccuauccagccaaagguagcugaacacaggccgcagacaaugaaacgguuguccuaccccuucucucgugagaagcaacaucuguuugaccuaagcgauaaagacuccuucuuugauucaaagacccgcaguacuauuguuuaugagauccucaaaagaacaaccuguacgaaggcaaaguacagcauggguauaacuucucugcuugccaacggcguguaugcugccgcguacccucugcacgacggggauuauaauggagaaaacgucgaguucaaugacaggaaauugcucuacgaagagugggcacgguauggcguguuuuacaaguaccagccaauugaucuggugcgaaaauauuucggugaaaagaucggguuauacuuugccuggcugggagucuauacccagaugcucauucccgcuuccaucguuggcaucauuguguuccuuuacggcugcgccacaauggacgagaacauaccuucaauggagaugugugaucagcgccacaauaucacuaugugcccacugugugacaaaaccugcagcuauuggaagaugaguucugcaugugcuacagccagagcgucccauuuguuugauaaccccgccaccguauucuucagcguguuuauggcacuaugggcugccacguucauggaacacuggaagaggaaacaaaugcggcugaauuaccgcugggaccucacuggguuugaggaagaggaagaggcugucaaggaccauccgagagccgaguaugaagcaagggugcuggagaaaucgcuuaagaaagaaucucguaacaaggagaagcggcgacacauuccugaggaauccacaaacaaauggaagcagagaguuaaaaccgccauggcuggagugaagcugacugauaaagucaaguugacauggagggaccgcuuccccgcguaccucaccaaucuggugucaaucauauuuaugauugcaguaacguucgccaucguuuuaggugugaucauuuaccggaucaguauggcugccgcacuggccaugaacagcuccccaucugucagaagcaauauuagggugaccgucacagcuacugccgugauaaucaaccuaguugugauuauccuccuggaugagguauauggcugcaucgcacgcuggcuuaccaagauugaagucccuaaaacagagaagucauuugaagaacgauugauauucaaagcguuucugcucaaguucgugaauaguuacacucccaucuuuuauguugcuuucuuuaaagggcgguucgugggacguccaggcgacuacgucuauauuuucagauccuuuaggauggaggaaugugcccccggugggugccugauggagcuuugcauccagcugagcauuaucauguugggcaagcagcucauacaaaacaaucuguucgaaaucggcauuccuaaaaugaagaaguuaauccgcuaccugaaacuaaagcagcagucuccaccggaucaugaggaaugugugaaacggaagcaaagauaugagguagacuacaaccucgagcccuuugcaggacugaccccugaauacauggagaugauuauccaguucggguuugugacacuuuucguugccucauuuccauuggcuccccuguucgcccuccugaauaacauaauugaaaucagguuagaugcuaaaaaguuugucaccgagcugcgacgcccuguggcagugcgggccaaggacauuggaaucugguauaauauacuuagagguaucggcaaauuggcggucauuaucaacgccuucguuauuaguuuuacuagcgauuucaucccaaggcucguguaccuguauauguacuccaagaaugggacgaugcacggauuugugaaccacacacuaucuucguucaauguaagcgacuuccagaacggcaccgcucccaacgauccgcuggaccucgguuaugaaguccagauaugccguuacaaagauuaucgcgagccuccaugguccgagaauaaguacgacauuucaaaagacuuuugggcagugcuggccgcucggcuugccuucguuaucguguuucaaaacuuggucauguucaugagugauuuuguggacuggguuauccccgauauuccuaaggacaucucucagcagauucauaaggaaaaagugcugaugguagaguuauucaugagagaggagcaggauaagcaacagcuccuggagacuuggauggaaaaagagaggcagaaggacgaacccccauguaaucaccauaacaccaaagcaugcccugauagccuugggucccccgcgccaucacacgccuaccacggcggaguccuguga

SEQ ID NO: 52790 - RNA, 3012 nt, Artificial Sequence
  derived and/or modified sequence opt3 from ANO2__Homo_sapiens__NP_001265525
auggccacccccggcccuagagacaucccacugcucccggggagccccaggcggcuuuccccucaggcuggaucucgcgguggccaagggccaaagcacggacagcagugccugaaaaugcccggcccucgagcaccagguuugcaagggggaucaaaccgugaucccggccagccuuguggcggggagaguacaagaagcuccucugugauuaauaacuacuuagacgccaaugaaccagucucgcuggaggcgaggcuaucacggaugcauuuccacgauagccagcgcaagguugacuaugugcucgcuuaccauuauagaaaaaggggaguacaccuggcccaggguuuuccgggccauagucuugcaauaguguccaacggggaaacuggaaaggagccccacgccggcgguccuggggauaucgaacugggaccauuggacgcucucgaggaggaacggaaagagcagcgcgaagaguucgagcacaaucugauggaagcaggccuggagcucgaaaaggauuuagagaacaagucucaaggcagcauuuuuguccgaauccaugcccccuggcaagugcuggcuagagaagccgaguuccuuaaaauuaagguuccuacgaaaaaggagauguacgaaaucaaagcagggggauccauagcaaagaaguuuucagccgcuuugcagaaacugaguagccaccuacagccaagggugcccgagcauucuaauaacaagaugaaaaaucucuccuauccguucucacgggaaaagauguaccuguauaacauccaggagaaagacaccuuuuucgauaaugccacacguagccgcauuguccacgaaauccuuaagagaacugcaugcaguagggcuaacaauaccauggguauuaacucucugaucgccaauaacauauacgaggcggccuacccuuugcacgacggcgaguaugauucccccgaagacgauaugaacgaccggaaacuccuguaccaggagugggcacgauaugggguguuuuacaaguuccagccaauugacuuaauccgcaaguauuuuggagagaaaauuggccuguacuucgcuuggcucggucuuuauaccagcuuucugaucccuucgucuguaaucgggguuauuguguucuuguacggcugugccacaauagaggaagauauccccuccagagagaugugcgaccaacagaaugcuuucacuauguguccacuaugcgauaagucaugugacuacuggaaccugaguagcgccugcggaacagcacaggccucccaucucuuugauaaucccgcuaccgucuucuuuucuauuuucauggcgcugugggcaacgauguuucuugagaacuggaaaaggcugcagaugcgguugggcuauuucugggaccucacugggaucgaagaggaagaggagcgcgcccaagaacacagcagaccugaguacgaaaccaaggugagggagaaaaugcugaaggaaucaaaucagagugcugugcagaaguuagagacaaacacuaccgaguguggagaugaagacgaugaggacaaacugacauggaaggaucguuuuccagguuaucuaaugaauuucgccuccauacucuuuaugauugcacugaccuucagcaucgucuuuggcguuaucguguaccggauuacgacugccgcugcccuuucuuugaacaaagcaacacgaucaaauguaagagugaccgucacugcgacagcugugaucauuaaccugguugugauacucauccuggacgaaauuuauggggccgucgcaaaguggcuuaccaaaaucgaggugccgaagacggaacagaccuucgaggagaggcugaucuugaaggccuuucuccugaaauucguaaaugcuuacagucccauuuucuauguugccuuuuucaagggacgcuuugugggccggccugguagcuacgucuacguguucgacggguauagaauggaagagugcgcaccaggcggauguuuaauggaacugugcauacaacuauccaucauuaugcucggcaaacagcugauccagaacaauauuuuugagaucgggguccccaaacuuaaaaaguuguucaggaagcugaaagaugaaacagaggcuggagagacugacucugcccauucgaagcacccugaacagugggaucucgacuacagccuggagccauauaccgguuuaacacccgaauacauggagaugauaauccaauuuggcuucgugacucuguuuguugcguccuucccgcuugccccuguguuugcuuugcucaacaauguaauugagguccgccuggaugcgaaaaaguucgugaccgaacuacgacggccagacgccguucguacaaaagauaucgggauuugguuugacauccugucaggaauaggcaaguucagugugauuucuaacgcuuucgucaucgccauuaccagcgauuuuauccccagacucguguaucaguacuccuauucacauaacgguacucugcacggguucguaaaucacacgcuuagcuuuuucaacgugucucaguugaaagagggcacacagccugaaaauucccaauuugaccaggagguucaguucugcagguuuaaggauuaccgcgaacccccaugggcaccuaaccccuacgaguucaguaagcaauauugguuuauacugagcgcgcgguuagccuucgucaucauuuuucagaaucucgugauguuccugucugugcuugucgacuggaugaucccagauauuccgaccgacaucuccgaccagauaaagaaggagaaaucacuguugguugauuucuuucucaaggaagaacaugaaaaacugaagcuaauggacgagccugcucugagaagucccggaggcggggauaggagccgaucgcgcgccgcauccucugcuccaagcggacagucacaacucggcaguaugauguccucugguagccagcacacuaacguguga

SEQ ID NO: 52791 - RNA, 2946 nt, Artificial Sequence
  derived and/or modified sequence opt3 from ANO3__Homo_sapiens__NP_113606
auggugcaccauagcggcuccauccagucuuucaagcaacagaaagggaugaacauuucaaagagugagauaaccaaagaaacaagccugaagcccucccggaggucucucccuugccuugcccagucguacgcuuauucaaaaagccugagucaguccacuucuuuguuucaaagcacggaguccgaaucacaggcaccaaccaguaucacauuaauuagcacugacaaggccgagcaggucaauaccgaagagaacaagaaugauucuguucugcgguguuccuucgcggaccuaucagauuuuugccucgcucugggaaaagacaaggauuacacagacgagagcgaacacgccaccuaugaucgcagucgacuuaucaacgacuucgugauuaaagauaagucugaguuuaaaacuaagcuguccaagaaugacaugaacuacaucgcaagcucggguccguuguucaaagauggcaagaaacguauagacuauauccucguauacagaaagacaaauauucaguaugauaaaaggaacaccuuugaaaagaaucugcgggccgaggggcugaugcucgagaaagaacccgcuaucgcaucuccugacauuauguucaucaagauacauauuccaugggacacguuauguaaguacgccgagcgccugaacaucagaaugcccuuuaggaaaaagugcuacuauacugauggacgguccaaaucaaugggccgcaugcaaaccuacuuccgaagaauuaagaauuggauggcucagaacccuauggugcuugacaaaagugccuuuccagauuuggaagagagcgacuguuauacaggucccuucuccagggcgcggauccaccauuuuaucauuaauaacaaggauacuuucuucucuaaugcaacccguagccgcauagucuaccacaugcuggaaagaacaaaguaugagaacgggaucucaaaagugggaauuaggaagcuaaucaacaauggcaguuacauagccgcuuuuccuccacacgagggcgccuauaaauccagccagccgauuaagacccaugggccccagaacaaucggcaccuccuguacgaacgaugggcacgcuggggaaugugguacaaacaucaaccucuugaccugaucagauuguauuucggugagaagaucggccucuacuuugcuuggcuggggugguauacgggaauguuaauuccagccgcgaucguuggccugugcguguucuuuuacggucucuucacuaugaacaauucucaggucucacaggaaauuuguaaggccacagagguguuuaugugcccccuuugugauaaaaacugcagucugcaaagguugaaugacagcuguauauaugcaaagguaaccuaccuauucgauaacgggggaacuguguuuuucgcuaucuuuauggccauuugggcuacaguuuuccuggaauuuuggaaacggcgcagauccauccucaccuauacgugggaccugaucgagugggaggaagaggaagagacccuuaggccucaguucgaagccaaguacuacaaaauggagauugucaauccaauaacaggcaagcccgagccgcaccagccuucuucggauaaggugacucgucuguuggugagcgucuccggcaucuucuuuaugauuucacucguuaucaccgcaguguucgggguaguggucuaucggcuggugguuauggaacaguuugccaguuucaaauggaacuuuauuaagcaauacuggcaguucgcuacaucugcggcagccgugugcaucaauuuuauaaucauuauguuacugaaccuagcuuaugagaaaaucgccuaccuccugacuaaucuugaauauccccgaaccgagagcgagugggaaaacuccuucgcauugaagauguuucuguuccaguuugucaaucucaacucaagcauuuucuacaucgccuuuuuccugggaagauucgugggucacccaggcaaauauaacaagcuguuugacagguggcgccuggaggaaugccauccuucuggguguuugauagaccucugccugcagaugggaguaauuauguucuuaaaacaaaucuggaauaacuuuauggagcugggcuacccccuaauucagaauugguggucccggcacaagaucaagagagguauacaugaugcuaguaucccacagugggaaaacgacuggaaucuccagcccaugaaccugcacgggcuuauggaugaguacuuggagaugguucugcaauucggcuuuacaaccauuuucguggccgcauuuccucucgcgccacuguuagcucugcuuaauaacaucauugaaaucagguuggacgccuauaaauucgucacucaguggcgccgaccgcuccccgcacgggccacggauauaggaauuuggcugggcauccuagaggggaucgguauucuggcugugaucacaaaugccuuugucauugcaauaaccagcgacuacaucccucguuucguguaugaauacaaguauggaccaugugcuaaccauguugagcccucugaaaauugccucaaaggcuacgugaacaauucccugucauuuuucgaucuuagugaguuggggaugggaaagagcggcuauuguagauacagggacuaccgcgguccuccauggucguccaaacccuaugaguucacucugcaguacuggcacauuuuagccgcgcggcucgccuuuaucauuguauucgaacaccuggucuuugggaucaagucuuucauagcuuaucuuaucccggaugugccuaagggccugcaugacagaauuaggcgagagaaauacuugguucaggaaaugauguaugaggcagaacucgagcaccuucaacagcagcgcagaaagagcggacaaccagugcaucacgaguggcccuga

SEQ ID NO: 52792 - RNA, 2868 nt, Artificial Sequence
  derived and/or modified sequence opt3 from ANO4__Homo_sapiens__NP_001273545
auggaggccagcuccucuggcaucaccaacgggaagacaaaaguuuuccaccccgaaggaggugucgaccugcagggcuaccaacucgauaugcagauucuuccugacgggccaaagucagauguugacuuuagugagauacugaaugcuauccaggaaauggcaaaagaugugaacauuuuguucgacgaguuagaagccguaagcuccccgugcaaggaugacgauucucugcuacaucccggaaaucucacuucgacgucagacgaugcgagcagacuggaggcuggcggugagaccgugccugaaaggaacaaaaguaaugggcuuuauuuucgggacggaaagugucgcaucgauuacauucuggucuaucgaaaguccaacccacagacagagaaacgugaaguguucgagagaaauaucagggccgagggcuugcaaauggaaaaggagucuagccucauaaacuccgacaucauuuuuguuaaacugcacgcacccugggaagugcugggccgguacgccgagcagaugaauguccgcaugccuuucagaaggaagaucuauuaccucccacggcgcuauaaauuuaugucacgaauugacaagcagaucaguagauucaggcggugguuacccaagaaaccuaugcgucuggauaaggaaacucuuccagacuuggaggagaacgauugcuacaccgcuccguuuagccagcaacgcauacaucacuucauuauccauaauaaagaaacauuuuucaacaaugcaaccagaucuaggauugugcaccacauccugcagcggaucaaguacgaggaagggaaaaacaagauuggacuaaaucgacuccugacuaacgguuccuaugaggccgcuuuuccccuucaugaaggcucauaccgcagcaaaaacaguauaagaacacacggggccgagaaucauaggcaccuguuguaugaguguugggcgucuuggggaguaugguacaaguaucagccucucgaccugguucggcgcuacuucggcgaaaagaucgguuuauauuucgcauggcuggggugguacaccggaaugcucuuuccagccgcuuucauuggccuuuuuguguuccuguacggcgucacgacuuuggaucacucccaggugagcaaagaggugugccaagccaccgacaucauaaugugucccgucugcgauaaguauuguccuuuuaugagacuaucggacucuugcguuuacgcaaaagugacacaucuguucgauaacggggcuacuguauuuuucgccguguuuauggcggucugggccaccguguuccucgaauuuuggaagaggcgucgggcaguuauugcuuaugacugggaucugaucgacugggaggaagaggaggaagagauccgaccacaguucgaagccaaauacuccaagaaggagagaaugaaucccauuucaggaaaaccggagccuuaucaggcuuuuacagacaaguguaguaggcuuaucgugagcgccuccgguauuuucuucaugauaugcgucgugaucgcagccguauuuggcauuguuaucuaccgcguggucaccgugucuacguucgcugcguuuaaaugggcacugauccggaacaauagccaagucgccacuacagggaccgcuguguguauuaacuucugcauaaucauguugcucaauguucuguaugaaaagguggccuuacugcuaacuaaccucgagcagcccagaacagaaucagagugggaaaauaguuuuacccugaaaauguuccuuuuucaguucguaaacuugaacuccagcacguuuuacauugcauucuuucugggaagguucaccggccacccaggugccuaccuccgccugaucaaucgauggcggcuugaggagugccauccuucugggugucugauugauuugugcaugcagaugggcaucauaaugguccucaagcaaacauggaauaacuuuauggaacugggauaucccuuaauccagaauugguggacucguagaaaggugaggcaggagcacggcccagaacgcaaaauuucauucccccagugggagaaggacuacaaccugcaaccuaugaacgcuuaugggcuauucgaugaauaccucgagaugauccugcaguuuggauucaccacaauuuuuguugccgcauucccacuugcgccguugcuggcucuccugaauaacaucauagagauucgguuagacgccuauaaauuugugacucaguggagaaggccccuggcaagucgagccaaggauaucgguauuugguacggcauccuugaagggauaggaaucuugagcgucauuaccaaugcuuucgugaucgccauuacauccgacuuuaucccucgccucguauaugcauacaaauacggcccaugugcuggucagggggaggccggccaaaagugcauggugggauauguuaacgcgucucugucggucuuccggauaagcgauuuugaaaauagauccgagcccgaaucagacggcagugaguucucugggaccccucuaaaguacuguagguaucgugauuaccgcgacccaccccauagccuggugccguauggauacacucuccaguuuuggcacgugcuggccgcucggcuugcauucauuaucgucuucgagcacuugguguuuugcaucaaacaucugauuuccuauuuaaucccugaucucccaaaggaccugagagauaggaugcgacgggaaaaauaccuuauucaggagaugauguacgaagccgagcuggagcgcuugcagaaggaaagaaaagagaggaagaaaaacgguaaggcucaccauaaugaauggcccuga

SEQ ID NO: 52793 - RNA, 2742 nt, Artificial Sequence
  derived and/or modified sequence opt3 from ANO5__Homo_sapiens__NP_998764
augggcgaccccgaucugcucgaggugcuugccgaagagggggaaaaggucaacaaacacaucgacuacagcuuccagauguccgagcaaucucugucaaguagagaaaccagcuuuuugauuaaugaggagacaaugccugcuaagagguucaacuuauuucugcggcgccgacuaauguuccagaaaaaucagcaguccaaggauucuauauuuuuccgugacggaaucagacaaauugauuuuguucucucguauguggacgauguuaaaaaggacgcagaacugaaggccgagaggcggaaagaguucgaaacuaaccuucgcaagacgggucuggaguuggaaaucgaggauaaaagagacucagaagauggcaggaccuacuuugugaagauucaugcgccaugggagguccucgugacauaugcugaaguucuggggaucaaaaugccgauaaaggagagcgacaucccccggccuaagcacacuccaauuaguuacgugcugggacccguccgccucccuuuauccgugaaauauccacaucccgaguacuucaccgcccaguuuucucgacacagacaggaacuguuccuuaucgaggaucaggcaacauuuuucccuagcuccucaaggaaucggauuguauauuacaucuugagucguugcccauucggcauagaagacgguaagaaacgcuuugggauugagagacugcuaaacagcaauaccuacucuuccgccuauccgcuccaugacggacaauacuggaagcccucagaaccuccaaaccccacuaaugagagguauacacugcaccagaacugggcucgguucagcuacuuuuauaaagagcagccucuugaucugaucaagaauuacuauggcgagaaaauuggcaucuacuucguauuuuugggguucuacaccgaaaugcucuuuuucgcagccguggucggacuggcuuguuuuaucuaugguuuacugaguauggaacacaacacgucuuccacugagauuugcgacccagaaauaggcgggcagaugaucauguguccccucugcgaucaagugugugacuacuggcgacuuaauucgaccugccuggccagcaaguucucucauuuguuugauaacgaguccacaguguucuuugcgauuuucaugggaaucugggucacucuauuccuggaguuuuggaagcagcgccaggcaagacucgaauaugagugggaccugguugauuucgaagaggagcaacagcagcuucagcugaggccggaauuugaggccauguguaaacaccggaaguugaaugcugugaccaaagaaauggagccuuacaugccccucuauacacgcauaccaugguacuuccugucaggcgccaccguaacguuauggaugagucugguggucacuagcaugguggcaguuauuguguauagacuauccgucuuugcuacauucgccucuuuuauggaaagcgacgcgucacucaagcaagugaaaaguuuccugaccccucagaucacuacaucccuuaccgguagcugcuugaacuuuaucguaauucugauccucaacuucuuuuacgagaagauuucugccuggauaacgaagauggagauccccaggaccuaccaggaauaugagucaagucugacacuuaaaauguuccuguuucaguucguuaauuucuacagcuccuguuuuuauguggcauucuuuaaggggaaauucgucggauacccaggcaaguauacuuacuuguuuaacgaauggcguucugaggaaugcgaucccggcgggugucucauugagcugaccacacaauuaacuaucaucaugaccggaaaacagauuuucgguaauauaaaggaggcuaucuauccucuggcccuaaacugguggcggcgaagaaaggcuaggacaaauucggaaaaacucuacagccgcugggagcaggaccaugaucuggaauccuuuggcccacuuggguuguucuacgaguaucuggaaaccgugacucaguuuggauucgucacgcucuuuguggccucauucccgcuggcacccuuacuggcccuuauuaacaauaucguugagauucggguggacgcuuggaaguugacaacccaauacagaaggacuguagcgaguaaagcacacucuaucggcgucuggcaggacauacucuaugguauggccgugcugagcguugcuaccaacgccuucaucguggcauuuacauccgauauuaucccucgccuagucuacuauuacgccuauucaaccaaugcuacucagccaaugacaggguacgugaacaauagccugucuguauuccucauugccgacuuucccaaccacacggcaccuuccgagaagcgagauuucauaaccugccgguaccgugacuauagauacccacccgaugacgaaaauaaauauuuucauaacaugcaguucuggcacgugcuggcggcuaagaugacuuuuaucauuguuauggagcaugucguguuccuugugaaguuuuugcuggccuggaugaucccggaugucccuaaagacguuguggaaaggauuaagcgcgagaaauuaaugacaaucaagauacuccacgauuucgagcugaauaaacuuaaggaaaaccugggcaucaacaguaaugaguuugcaaaacaugugaugauugaagagaacaaggcccaauuggcuaagagcacccucuga

SEQ ID NO: 52794 - RNA, 2733 nt, Artificial Sequence
  derived and/or modified sequence opt3 from ANO6__Homo_sapiens__NP_001020527
augaagaaaaugagcagaaacgugcugcuccagauggaggaagaggaagacgaugacgauggcgacaucguccuugagaaucuggggcaaaccauuguucccgauuugggauccuuagaaucucagcacgacuucaggacaccugaguuugaggaauuuaacgguaagccagauucacuguuuuucaaugacggccagcggcgcauagauuuugugcuaguauacgaggacgaaagucgaaaagagacuaacaagaaagggacgaaugagaagcagcguagaaagaggcaagccuaugaaagcaaccucaucugccauggacugcagcuugaggcuacccgguccgugcuggaugacaaauuggucuucgugaagguucacgcaccgugggaagugcucuguacauacgccgagauuaugcauaucaaacugccccugaagccuaaugaucucaaaaacagaucuucggcguuuggcacuuuaaauugguucaccaagguccugucaguggacgaaagcauuaucaagccagagcaggaguuuuucacagcucccuuugagaaaaaccgcaugaaugacuucuauauaguagauagggacgccuuuuucaacccugcaacccggagucgcaucguuuacuucauucuuucccgagugaaguaucaggucaucaauaacgugucuaaauuugguauuaauagauuggugaacagcgggaucuacaaggccgcuuucccacugcacgauugcaaauuuaggcggcaauccgaggaccccucauguccuaacgaacguuaucuacucuaccgcgagugggcacauccaagaaguauauacaagaaacagccgcuggaucuuauuaggaaguauuacggagaaaagaucggcauuuauuucgccuggcugggcuacuauacucagauguugcuccuggcugccgucguugggguggcgugcuuuuuauacggauaucugaaucaggacaacuguacauggagcaaagagguaugccaccccgauaucgguggcaagaucauuauguguccucaaugcgaccggcucuguccauucuggaaacuuaauauaaccugcgagucuuccaagaaacuguguaucuuugauucauucgggacguugguguuugcagucuucaugggaguguggguuacucuauuucuggaguucuggaagcgacgccaggccgaacucgaauacgagugggacaccguggaacugcagcaagaggagcaggcuagacccgaauacgaggccaggugcacacacgucgugauuaacgaaaucacucaggaggaggaacggauaccuuuuaccgcauggggcaagugcauucgcaucacacuuugugcuagcgccguauucuucuggauccuguugauuaucgcgaguguuauugguauaaucguguauagacucucugucuuuauuguguucuccgccaaacugccaaagaauaucaacgggaccgaucccauccagaaauacuuaacgccgcaaacugcaacaagcauuaccgcuucgauaaucucuuuuauuaucauuaugauccugaauacuauauaugagaaggucgccaucaugauuacaaacuucgaacuaccuaggacccagacggacuacgaaaauucccucaccaugaaaauguuucuguuccaguuugugaacuauuacucaaguugcuucuauaucgcuuucuucaagggaaaguuuguuggcuaccccggcgacccaguguacuggcuugggaaauaucguaaugaagagugugauccuggagguugcuugcuggagcucacaacucagcugaccauuaucaugggcgggaaggccauauggaacaauauucaagaaguacuucugcccuggaucaugaacuugauuggacgguuccaucgagucagcggcuccgagaaaaucacaccaagaugggaacaggacuaccaccuccagcccauggguaagcugggguuauuuuaugaguaccuggaaaugauaauccaguucggcuucgugacucuauuuguugcaucuuucccucucgccccacugcuugcuuuggugaauaacauucuggagaucagggucgaugcguggaaacucaccacacaauuucgccggcuggugccggagaaggcacaggacauuggagccuggcagcccaucaugcagggcauagcuauuuuagccguagugaccaacgcaaugaucaucgccuucacuagcgauaugauuccuagacugguuuauuacuggucauuuagugucccacccuauggggaccauacguccuacacaauggaaggauacaucaauaacacccuuagcauuuucaagguggcugauuuuaaaaauaagucuaaagguaacccuuauucagacuugggcaaucacacuaccuguagguaccgcgauuuccgauauccacccgggcacccgcaagaguacaagcauaacauauauuacuggcacgugaucgccgcaaaacucgcguuuauuaucgucauggaacauguuauuuauagugugaaguucuuuaucagcuacgcuauaccugacguguccaaacggacaaagucuaagauccagcgugagaaauaccugacccagaagcuacugcacgaaaaucaucucaaagauaugacuaagaacaugggaguaauugccgagagaaugaucgaggcagucgacaauaaccugaggccaaaaucggaauga

SEQ ID NO: 52795 - RNA, 540 nt, Artificial Sequence
  derived and/or modified sequence opt3 from ANO7__Homo_sapiens__NP_001001666
augagaauggccgcuaccgcaugggccggccugcaggggcccccucucccaacacuuugcccggcggugaggacuggacuguacugucgggaccaagcucacgccgagcgcugggcaaugacgagcgaaaccuccucugguucacauugcgcccgaagucguauguugagaaggcgggcucaggaggaagauagcacagucuuaaucgacguuucucccccugaggcagaaaagcgcggcuccuaugggucgacugcccacgcuucagagccaggaggccagcaggccgcggcauguagagccgguagccccgcuaaaccuaggauugauuucgugcugguaugggaggaagaccuaaagcucgaucggcaacaggacagugccgcacgcgaucgaaccgacaugcauagaacauggagggagaccuuucuggauaaccuucgggcugccgggcugugcguggaccagguccguggaggcugucacggccaggggccacgccccugcauacauuccgugacucacgauuuggcggccuga

SEQ ID NO: 52796 - RNA, 750 nt, Artificial Sequence
  derived and/or modified sequence opt3 from ANP32A__Homo_sapiens__NP_006296
auggagaugggcagaaggauccaccuggaacuccggaaccgcacccccagcgacgugaaggagcuuguccuggauaauucccgaucuaacgaagggaaauuggagggauuaacagacgaguucgaggagcuggaauuucuaucaacuauuaauguuggucucacgaguauagccaaccugccuaaacuuaauaagcugaagaaauuggagcucagcgauaaccguguguccggcgggcuggaaguacuggcugagaagugcccaaaucucacccauuuaaaccugucuggaaauaagaucaaagaccuuucgacaauugagccguugaagaaacuggaaaaccuaaagucacucgaucuguucaauugugaggugacuaaccuuaaugacuacagagaaaacgucuuuaaacuguugccccagcucaccuaucuggauggcuacgacagggaugacaaggaggcaccugauagcgacgccgaagguuauguggagggguuagaugacgaggaagaggacgaagaugaggaagaguacgacgaggaugcgcaaguuguggaagacgaggaagaugaggacgaagaggaggaaggagaggaagaggaugucaguggcgaggaagaggaagacgaggaaggcuauaaugauggggagguggacgaugaggaagacgaggaagaacugggagaagaggagcggggucagaagcgcaaaagagaaccagaggacgaaggcgaggaugacgauuga

SEQ ID NO: 52797 - RNA, 756 nt, Artificial Sequence
  derived and/or modified sequence opt3 from ANP32B__Homo_sapiens__NP_006392
auggacaugaagagaaggauccaccuggagcuccggaaccgcacccccgccgcugugcgagaacuuguccuggauaauugcaaaagcaacgacggcaagauugagggguugacagcagaguucguuaauuuagaauuucugucccuaauaaacgugggacucaucucuguaucaaaucugccuaaacuuccaaagcugaaaaaguuggaacucagugagaaccguauuuucgguggccuggauaugcuggccgagaagcucccgaauuuaacucaucugaaccuuagcgggaauaaauugaaggacaucuccacgcuggaaccccucaaaaagcuagagugucugaaaucucuugaucuguuuaacugcgaagugaccaauuugaacgacuacagagagucggucuucaagcuccugccucaguuaacauaucuggauggauacgacagggaggaucaagaagcgccagacucagaugcugagguggacggcguugaugaagaggaagaggacgaggaaggugaggacgaagaggaugaagacgaugaggacggggaggaagaggaauuugaugaggaagacgaugaggacgaggauguggaaggagacgaggaugacgacgaagucagcgaggaggaagaggaguucggccucgaugaagaagacgaggaugaggacgaagaugaggaagaggaagagggcgggaagggagagaaacggaagcgcgaaacugacgaugagggugaagacgauuga

SEQ ID NO: 52798 - RNA, 396 nt, Artificial Sequence
  derived and/or modified sequence opt3 from ANP32D__Homo_sapiens__NP_036536
auggagaugggcaaguggauccaccuggaacucagaaacaggacccccagcgacgugaaagagcuuuuccuggauaauucccagucuaacgaagggaaguuggagggauuaacagacgaauuugaggagcuggaacuacucaauacuauuaacauaggucugacgucaaucgccaaucuuccuaaacugaacaaguugaaaaagcucgagcugaguagcaaucgggcuuccgucggccuggaaguucucgcagagaagugcccaaacuuaauucaucugaaucuuucugggaacaaaaucaaggauuugucgaccauugagccgcugaaaaagcuagaaaaucucgagucacuggaccuuuucacaugugaagugacuaaccugaauaacuacuga

SEQ ID NO: 52799 - RNA, 2904 nt, Artificial Sequence
  derived and/or modified sequence opt3 from ANPEP__Homo_sapiens__NP_001141
auggccaagggcuucuacaucagcaaaucccuggggauucucggaauacuucuggguguggcugcagucugcaccaucauugccuugucuguuguguauucacaggagaagaacaaaaaugcgaacaguagccccguagcuuccacaacuccuucugccucggcaacgaccaauccagccucagcuacaacuuuagaccaaagcaaggcauggaacagauacaggcugccgaauacccuaaaacccgauaguuaucgggugacacuccgcccuuaccugaccccaaacgaccgaggccuuuaugucuuuaagggguccucuacugugcguuucacauguaaggaagccaccgauguuaucauuauccacagcaaaaagcugaauuacacguugucccagggacauagagugguccucaggggcgugggugggucacagcccccugacauagauaaaacugagcugguagaaccaaccgaguaucugguugugcaccucaagggaaguuuagucaaagacagccaguacgaaauggauucugaguuugagggcgaacuggcugacgaucuugccggcuucuaccgguccgaguauauggaagggaacgugcgcaagguggucgcgacaacucaaaugcaggcagccgacgcuagaaagucauuucccugcuucgaugagccugccaugaaagcagaguuuaauaucaccuugauucauccaaaggaccugacagcucuaagcaacaugcucccgaaaggacccaguaccccucugccagaagaucccaauuggaacguuacggaguuccacacuacaccuaagaugucuaccuaccuucuggccuuuaucguguccgaauuugacuauguagagaaacaggcgagcaaugguguguugauuaggaucugggcccggccaucggcaauagcugccggccauggggacuacgcucucaacgucacuggacccauucugaauuucuucgccggccacuaugauacaccguacccuuuacccaagucugaccagaucggucugccagauuuuaacgcaggggccauggaaaacuggggacucgugaccuaucgcgaaaauucccuucuguucgacccuuugucaaguagcuccucuaacaaagagcgaguugugacggucauugcucacgaacuagcgcaucaaugguucggcaaucuggugaccaucgagugguggaacgaucucuggcugaaugaaggcuuugcaagcuacguagaguaccuuggggccgacuaugcugaacccacauggaaccugaaggauuugaugguucucaaugacguguacagagucauggccguggaugcacuggccucaagucacccauuauccacucccgcuagcgagaucaacaccccugcccagauuucugagcuguucgacgcaauaucauauaguaagggagcgagcguccuaaggaugcucuccucuuuucugucggaagauguguucaaacagggucuugcuagcuacuugcauacauuugccuaucagaauacuaucuaccugaaccucugggaccaccuucaagaggcaguuaauaaccgguccauucagcuuccaaccacagugcgugacaucaugaaucgcuggacccugcagaugggcuucccgguaauaacugucgauacgucaacagggaccuugagucaagaacacuuucuccuggaccccgauucuaacgugacuagaccuagcgaguucaauuauguuuggauugugccaaucaccuccaucagggacggacggcagcagcaggauuacugguuaauugacguccgagcccaaaacgaucuguuuucaacaagcggcaacgaaugggugcuacucaaucugaacguaaccgguuacuaucgcgugaauuacgacgaggagaacuggagaaagauccagacucagcuucagagggaucauucugcuauucccguuauaaaucgggcccaaaucauuaacgacgcauucaauuuggcuuccgcccacaaagucccugugacacuggcgcucaacaauacgcuguuuuuaaucgaggagcgccaguauaugccaugggaagccgcucugaguagccuuucuuacuucaaguugauguuugauagauccgagguguaugggcccaugaaaaacuaccucaagaagcaggucaccccgcuguucauccauuucaggaauaacacuaauaacuggcgugagauuccugaaaaucuaauggaccaguauucagagguuaacgcaauaaguacagccuguagcaacggcgugccagaaugcgaggaaauggugucgggacuguuuaaacaauggauggagaaucccaacaauaacccuauccaccccaaucuccgguccaccguauacuguaacgcuauugcccagggcggggaggaagagugggauuucgcaugggaacaguuucgaaaugcgacacuggucaacgaggccgacaagcugagagcugccuuggcaugcucuaaagaacuguggaucuuaaauagguaccucagcuauacucugaacccagaccuuauucgcaagcaggaugcuaccucaacgaucauaaguaucaccaauaacgugauuggacaaggucugguuugggacuucgugcaguccaauuggaaaaaguuguuuaacgauuacggcgggggaucuuucagcuuuuccaaucucauccaggccgucacacggagauucucaacugaguaugagcugcaacagcuagaacaguuuaagaaagacaacgaggaaaccggcuucgguagcgggacaagggcacuggagcaggcccucgaaaagacuaaagcuaacauuaagugggugaaagagaauaaggagguugugcugcaaugguuuaccgaaaacaguaaguga

SEQ ID NO: 52800 - RNA, 1002 nt, Artificial Sequence
  derived and/or modified sequence opt3 from ANTXR1__Homo_sapiens__NP_060623
auggccaccgcugagagaagggcacugggcaucggguuccaguggcucagccuugccacacugguguugauuugcgcgggacaagguggccggcgcgaagacgggggacccgcuuguuacggcgguuuugauuuauauuucauacuggacaaguccgggucuguccuacaccauuggaacgagaucuacuauuuuguugaacagcucgcccacaaauucauuucaccucagcugcgaaugaguuuuaucguguucagcacucguggaacgacccuuaugaagcugacagaggauagagaacagauuaggcaaggcuuggaggagcuccagaaaguacugccaggcggggacacuuacaugcaugaaggauuugagcgggcauccgaacagaucuauuacgagaaucgccaggguuauagaaccgccucugugauaaucgcucugacagauggcgagcuccacgaagacuuauucuuuuacucggagagggaagcaaaccggucacgcgaucugggggccauugucuacugcgugggaguuaaggacuucaaugagacccaacuugcucgaaucgccgauagcaaagaccauguguuuccggucaacgauggcuuccaggcguugcaggguauuauccacaguauacugaagaaguccuguauugaaauccuagcagccgagcccucuacuauuugcgcuggggagagcuuucaggugguaguuagaggaaauggcuucaggcacgcccggaacguggaccguguccucuguuccuucaaaaucaaugauucagugacacugaacgaaaagccuuuuaguguggaggacaccuaucuucugugcccagcacccaucuugaaagaagucggcaugaaggcugcccuccaaguuagcaugaaugacgggcugucuuucauuuccucaagcgugauaaucacgacuacccauuguaguuuacacaaaauugcgucuggaccuacaacugccgcaugcauggaguga

SEQ ID NO: 52801 - RNA, 1470 nt, Artificial Sequence
  derived and/or modified sequence opt3 from ANTXR2__Homo_sapiens__NP_001139266
augguggccgagagaagccccgcuagguccccuggcucuuggcuguucccagggcucuggcuucuggucuugucaggaccggguggcuuacugcgggcacaggaacaacccaguugccgccgagccuuugaccuauacuucguucucgauaagagcggguccguggcgaacaauuggaucgagauuuauaacuuuguacagcagcuggcugaacguuucgugucuccugagaugagacuuucguuuauagucuucucaagccaggccaccaucauucugccauugacaggagacaggggcaaaaucaguaagggucucgaagaucugaaacgggugucccccguuggggagacuuacauucacgagggacugaagcucgcaaaugaacaaauccagaaagccggcggcuuaaagacgucuagcauaaucauugcucugaccgacgggaagcuggauggauuggugccuuccuaugcagagaaagaagccaagaucucacgcagucugggugcuagcgucuacugugugggcguacuagacuuugagcaggcccagcucgagagaauugcggauucuaaagaacaaguuuucccagugaaagggggauuucaggcacugaagggcaucauaaacuccauucuugcccagucaugcacagagauccuggaauugcagcccagcagugucugugugggugaggaguuccaaauugugcucucugggaggggauuuaugcugggcucccggaauggcagcgucuuaugcacuuauaccguuaacgagacauacaccacuucggugaagccuguaucugugcagcuuaauuccaugcucuguccagcuccgauccuuaacaaggccggggagacacuggacgucucagugaguuucaauggagguaaaagcguuaucuccggcucuuugauugugaccgcaacggaaugcagcaacgggauagcugccaucauugucauccuagugcugcuccugcuucugggaauaggcuugauguggugguuuuggccccucuguugcaagguaguuauuaaagauccuccacccccuccagcgcccgccccgaaggaggaagaggaagaaccucugcccacuaaaaaguggccaaccguggacgcaucauauuacggugggcgcggcgucggaggcaucaaacgaauggaggugagauggggagauaaggggaguacagaagagggugcuagguuagaaaaggccaaaaaugcugucgugaagaucccugaggaaacugaggagcccauucggccacgucccccucgcccaaaaccgacccaucagcccccucaaacaaagugguacaccccaaucaaaggcagacuggacgcccuaugggcacuccugaggcggcaguaugaucgaguuucccuuaugcgcccccaggaaggggacgagguguguauuugggaaugcauagagaaggaguugacggccuga

SEQ ID NO: 52802 - RNA, 975 nt, Artificial Sequence
  derived and/or modified sequence opt3 from ANXA10__Homo_sapiens__NP_009124
auguucugcggcgacuacgugcaggggaccaucuuucccgccccuaacuucaauccaauuauggaugcucaaaugcugggaggugcacuccagggcuuugacugugauaaggacaugcuuauaaacauccugacacagagaugcaaugcccagaggaugaugauugcggaggcuuaucaaagcauguacgggcgggauuugaucggagacaugcgcgaacaguuauccgaucacuucaaagacgucauggccggccugauguauccgcccccucuauacgaugcacaugagcucuggcacgccaugaaggguguugggacugacgaaaacugucugauugagauccuugcuucucgaacgaauggagaaauauuucagaugcgugaggcauauugccugcaguacucaaacaauuugcaagaggauaucuauagugaaaccagcggccauuucagagacacacucaugaaccuggugcagggcacuagggaggaaggguacaccgauccagccauggcugcccaggacgcgaugguacugugggaggcaugucagcagaaaacaggagagcacaagaccaugcuccaaaugauuuuaugcaauaaauccuaccagcaacugcggcuuguguuucaggaguuccagaacaucucuggucaggacauggucgaugccauuaaugaauguuaugacggcuacuuucaagaauugcugguggcuaucguucuaugcgugcgcgauaagcccgccuauuucgcauacagacucuauucggcuauacaugacuuuggguuccacaacaagacugucauuaggauccugauugcccggucagagaucgaucuucugacaauccgcaaacgauacaaggaaagauauggaaaaaguuuguuucacgacauuaggaauuucgcgagcggccauuacaagaaagcccuccuggcaauaugugcuggugaugccgaggacuacuga

SEQ ID NO: 52803 - RNA, 1518 nt, Artificial Sequence
  derived and/or modified sequence opt3 from ANXA11__Homo_sapiens__NP_001265336
augagcuaccccggcuauccuccaccgcccgggggauacccuccagccgcucccgguggcgggccuuggggaggcgcagccuauccacccccuccauccaugccgcccaucggucuggacaacguggcgaccuacgcugggcaguucaaucaagauuaucucucuggaauggccgcaaacaugucaggcacauuuggcggggccaauaugccuaaccuuuacccaggagcucccggugcaggcuauccuccagucccgcccgggggauucggccagccucccagugcccagcagccaguuccucccuacgguauguacccacccccugggggaaauccaccgagcagaaugcccuccuauccuccauaccccggcgcuccugugccaggccaacccaugccgccuccagggcagcagcccccuggagccuaucccggucagccaccuguaacuuaccccggccaaccaccggugccucugcccgggcagcagcagccaguccccucuuauccuggauacccaggcucggguacggugacccccgcgguuccuccgacacaauuugggucaaggggcacuauuaccgacgcaccaggauucgaucccuugcgggacgccgagguguuacgcaaggcuaugaaaggcuuugggacagaugaacaggccauaaucgacugccugggaagccgaaguaacaagcagcgucaacagauucuacucuccuucaaaaccgcauaugguaaggaucugaucaaagaccuuaagucugagcugagcggcaauuuugaaaagacuauuuuggcucucaugaaaacaccuguccuguucgauaucuacgagauaaaggaagccaucaaaggggugggaaccgacgaggcgugucugauugagauccucgccuccagaucaaacgaacacauuagggaguuaaaucgggcauacaaggcugaauuuaaaaagacgcuggaggaggccauccgcagugauacuagcggccauuuccagagacuuuugauaucucugucccaggguaacagggacgaaucaaccaauguagauaugagccuagcucaacgggacgcccaggagcucuaugcagccggggaaaaccgccugggcacagacgagaguaaguuuaaugcuguucuuugcucucgauccagagcgcaccugguggcagucuucaacgaauaccagaggaugacuggacgggauauugagaaaagcaucugucgugagaugucgggcgacuuggaagaggggaugcucgccguggugaagugccugaaaaauaccccagccuuuuucgcugaacgcuuaaacaaggcaaugagaggagccgguacaaaagauaggacccugauucggaucauggucucucgauccgagacggaccuccuugauauccgcucagaauauaagagaauguacggcaaaagucuguaucaugacauuagcggggauacuuccggagacuacaggaagauauugcuaaagaucuguggcgguaacgauuga

SEQ ID NO: 52804 - RNA, 1074 nt, Artificial Sequence
  derived and/or modified sequence opt3 from ANXA13__Homo_sapiens__NP_001003954
augggcaacagacacagccaguccuacacccugucugaggggucacaacagcuccccaagggagacagucagccuagcacagugguccagccacuuucccauccgucuaggaauggugaacccgaggccccucaaccagcuaaagcaucgucaccccagggcuucgauguugaccgggaugccaagaaacugaacaaggcgugcaaagggaugggaacuaaugaagcugccaucauugagauauugagcggccgcacgagugacgaacgacagcagaucaagcaaaaguauaaagcaaccuacgguaaggaguuagaggaagugcugaaauccgagcuaucugggaacuuugaaaagacagcccucgcucugcuugaucguccuagcgaguaugcagccagacagcugcagaaagcuaugaagggauugggcacugacgaguccguacucauugaagugcuguguaccaggacaaauaaggagaucauugccaucaaagaagcguaccagcggcuguucgaucgcucacucgagagugacgucaagggcgauaccagcgggaaccugaaaaagauauuagugucucuuuugcaagcaaauagaaacgaaggagacgauguugacaaagaucuggccggucaggacgcuaaggaccuauaugaugccggcgaggggagguggggaacugacgagcucgcauuuaaugaagugcuggcuaaacgguccuacaagcagcuucgcgccacauuccaagcguaucagauccugauuggcaaggauaucgaggaagccauugaggaagagaccucaggugacuugcagaaagcauaccucacgcugguccgaugcgcucaggauugugaggacuacuuugccgaaagauuauauaagagcaugaaaggggcuggaacugaugaggaaacccugaucaggauagugguaacacgggccgagguugaccuccaaggcauuaaggcaaaauuccaggaaaaguaccagaagagucuuucugauauggugcguuccgacacuagcggcgauuuucgcaaacuguuggucgcccuacugcacuga

SEQ ID NO: 52805 - RNA, 1074 nt, Artificial Sequence
  derived and/or modified sequence opt3 from ANXA1__Homo_sapiens__XP_011516910
augaaccugauccucagauacaccuucagcaagauggccaugguguccgaguuucuuaaacaggcuugguucauugaaaaugaggaacaagaguauguccagacaguuaagucuucaaaaggcgggcccggaagugcagugagcccuuacccaacuuuuaacccguccucugacguagccgcgcugcacaaggcuauaauggugaaaggugucgaugaagccacgaucauugacaucuugaccaagaggaauaacgcacagcggcagcaaauuaaggccgcuuauuuacaggagacaggcaaaccccuggaugagacucuaaagaaagcacucaccgggcaucuggaagaggugguucuugcccuguugaagaccccugcucaguucgacgccgaugaacuccgcgcggcaaugaaaggacugggcacagacgaggauacucugaucgagauacucgccucgcgaacaaauaaggaaauccgugacauuaacagaguguacagggaggaauuaaagcgggaucuggcuaaagacaucaccucagauacgagcggugacuuucgcaaugcccuuuugagucuggcaaagggggauagauccgaggacuucggagucaacgaagaccuagcugauucugacgccagggcgcucuaugaggccggcgagcggcgcaaaggcacugaugugaauguauuuaacaccauucugacaacucgaagcuacccacagcuuagaaggguuuuccaaaaguauaccaaauacuccaagcacgacaugaauaaagugcuggauuuggaacucaagggggacaucgagaagugccugacagcaauagucaaaugugcuaccucaaagcccgccuuuuucgcugaaaaauuacaucaggccaugaagggaguggguacgcggcacaaagcacugauucguaucauggugagucgcagcgagauugauaugaacgacaucaaggccuuuuaccagaagauguauggcaucucucucugccaggcuauucuugaugaaacuaaaggggacuacgagaagauacuggucgcguuguguggaggcaauuga

SEQ ID NO: 52806 - RNA, 1074 nt, Artificial Sequence
  derived and/or modified sequence opt3 from ANXA2__Homo_sapiens__NP_001002858
augggcagacagcuggccgggugcggagacgcugguaagaaagccagcuucaagauguccaccgugcacgagauccucuguaaacuuucucuggaaggcgaucauucaacacccccuagugcauacgggagcgucaaggcguauacuaacuuugacgcugagagggaugccuugaauauugaaacggcaauaaaaaccaagggaguugacgaggugacaaucguaaacauuuuaacuaaucgguccaacgcccaacgccaggauaucgcuuucgcauaccagcgacguaccaagaaagaacuggccucugcucuaaagucggcccucucaggccaccuggagacagugauucuuggucuguugaaaaccccagcgcaguaugacgcaagcgagcucaaggccaguaugaaagggcugggaacugaugaagacucccugaucgagauaaucugcucuagaacaaaucaagaacuccaggagauuaacagggucuacaaggagauguauaagaccgauuuagaaaaagacaucauuagcgauacguccggcgacuuucggaagcugaugguggcucuugccaaaggccgcagagcagaggaugggucaguuaucgacuacgaauugauagaccaggaugcuagggaccuguaugaugccggagugaagcggaaagguacugacgucccgaaguggauuaguaucaugaccgagcgcagcgugccccaucuacagaaaguauucgaucgauacaagucuuacuccccuuaugacaugcucgaaucaauuagaaaggagguuaaaggcgaucuggagaaugcguuucuuaaccuggugcaauguauccagaauaagccauuguacuucgccgacaggcucuaugauagcaugaaagggaagggaacacgggacaaaguccugauccguauuauggugagucgcucugaaguggauauguuaaagauaagauccgaguuuaagaggaaauacggcaagagccuguauuacuauauccagcaggacacuaaaggugacuaccaaaaggcacuccuuuaccugugcgggggagaugacuga

SEQ ID NO: 52807 - RNA, 582 nt, Artificial Sequence
  derived and/or modified sequence opt3 from ANXA2R__Homo_sapiens__NP_001014301
auggagcagcacuuccugggcugcgugaagagagccugggacagcgcugaagucgcacccgagccucaaccaccgcccaucguuuccucugaagauagggggccuuggccacucccccuuuacccugugcugggagaguauucauuggacaguugugauuuaggucugcuaagcuccccaugcuggcggcuccccggcguauacuggcagaacgggcugucuccuggagugcagucgacccuugaaccaucaacagccaaaccgacugaguuuagcuggcccggcacgcagaagcaacaggaggcgccugucgaagaggugggucaggcugaggaaccagaccgccugcgauugcagcaacuccccuggaguuccccucugcauccaugggaucgucagcaggacaccgagguuugugauucugggugccugcucgaaagaaggcacccgcccgccuuacagccuuggcggcaucugcccggauucagcgacugucuugaguggauuuugcgcgugggcuuugcagccuucuccguccugugggcuugcuguucaagaauaugcggcgcaaaacaaccauga

SEQ ID NO: 52808 - RNA, 972 nt, Artificial Sequence
  derived and/or modified sequence opt3 from ANXA3__Homo_sapiens__NP_005130
auggccagcaucugggugggccacagagggaccgucagggacuaccccgauuucuccccuucuguugacgcugaggcaauucagaaggccauacggggaaucgguacagaugagaaaaugcugauuucaauccucacugaacgcaguaacgcgcaacgacagcuuauugugaaggaauaucaggcugccuacggcaaagagcugaaggacgauuugaaaggggacuuaagcggacauuuugaacaccugaugguagcccuagugacgccaccggcagucuucgaugcuaagcagcucaagaaauccaugaagggcgcagguaccaaugaggacgcccugaucgagauacuuacaacucguaccucuagacaaaugaaagauaucucgcaggcuuauuacacaguguauaagaaaucacugggggacgauauuagcagugaaaccuccggagacuuuaggaaggccuugcucacucuggcggauggccggcgcgacgagucucugaagguugacgaacaucucgcaaaacaggaugcccagaucuuauacaaggcuggcgagaacagaugggggacagacgaggauaaauucaccgaaauucugugccuuaggagcuuuccccaauugaagcugacguucgacgaguaucggaauaucucccagaaagauauaguggacucaauuaagggagaacuaaguggucacuuugaggaucuccugcuugccaucgucaacugugugcgcaauacuccugcauuccuggcugaacgauugcauagagcccucaaaggcauugggaccgacgaguuuacacugaacaggaucaugguaagccggucugagaucgauuuacuggacauucguacugaguucaagaagcacuacggauacucccucuauucagcgauaaaaagcgauaccaguggcgacuacgaaaucacacuucugaagauuugcgguggggacgauuga

SEQ ID NO: 52809 - RNA, 966 nt, Artificial Sequence
  derived and/or modified sequence opt3 from ANXA4__Homo_sapiens__NP_001307627
auggccauggcuaccaagggcgggacagugaaagcagccagcggauucaacgcgauggaggacgcucagacucugagaaaggccaugaaaggucucggcacggaugaagacgcaaucauuuccguccuugccuacaggaauaccgcucaacggcaggagauacgcacagcauauaagucuacuaucgggcgagaucugauugacgauuugaaaucagaauuaaguggaaacuuugagcagguuaucgugggcaugaugacccccacaguacuguacgacgugcaggaacuacguagagccaugaagggugcugggaccgaugagggaugccucauugagauccuggccagcaggacuccugaagagauacggcgcaucucccaaacauaucagcagcaguacggcagaucucuugaagacgauauuaggucggacaccucauucauguuucaacggguccuggugagcuugagugcgggcgggcgcgaugagggaaauuaucucgacgaugcacugguucgacaggacgcccaggaccuguacgaggcuggugaaaagaaauggggcacggaugaggugaaguuccucacugucuuauguuccagaaacaggaaucaucugcuucacguguuugacgaauauaaacggaucucucagaaggauauugagcaaagcaucaaauccgaaaccucagggaguuucgaggacgccuugcuggcaauaguaaagugcaugcguaacaagagcgcuuacuuugccgagaaacuauacaagucuaugaaaggacucggcacagaugacaauacucugauucgcguuaugguguccagagcggaaaucgauaugcuugacauuagggcccacuucaagcggcuguaugguaaaucauuguacagcuuuaucaagggggauaccaguggagacuaucgaaaaguccuccugguguuauguggcggcgaugacuga

SEQ ID NO: 52810 - RNA, 963 nt, Artificial Sequence
  derived and/or modified sequence opt3 from ANXA5__Homo_sapiens__NP_001145
auggcccaggugcugagaggcaccgucacagacuuccccggguuugaugagagggcugacgcagaaacucuccggaaggccaugaaaggacuugguacggaugaggaaagcauccugaccuuguuaacaucccgcucuaacgcgcaacgacaggagauuucagcugccuucaagacucuguuuggccgugaccuacucgaugaccugaaaagugaacuuaccgggaaguucgagaaacugauaguugcauugaugaagccuagcagacucuacgaugccuaugagcugaagcacgcucugaaaggagcaggcacaaaugaaaaggugcucaccgagaucauugccuccaggacuccagaagaguuacgggcuaucaaacagguauacgaggaagaguaugguucuucgcuggaagacgauguggucggggacacaucaggauacuaucagcgcaugcuugugguuuugcugcaagccaacagagauccggacgcgggcauugaugaggcacagguggaacaggacgcccaggcucuauuucaagccggcgagcucaagugggggaccgacgaggaaaaauucaucacgauauuuggaacuaggagcgucagucaucugcggaagguguucgauaaguacaugaccaucuccgguuuucagauugaggaaacaaucgaccgcgagacuucuggcaaucuugaacagcuguugcucgcaguaguuaaaagcauucgauccauccccgcuuaucuggccgagaccuuauacuacgcgaugaagggggccggaacagaugaccacacccugauaagagugauggucucaaggagugagauugaucucuucaacauccggaaagaauuucguaagaauuucgcaacgagccuuuauucuaugauuaaaggcgacacuuccggugauuacaagaaagcucuguugcuacugugcggggaggacgauuga

SEQ ID NO: 52811 - RNA, 2022 nt, Artificial Sequence
  derived and/or modified sequence opt3 from ANXA6__Homo_sapiens__NP_001146
auggccaagcccgcucagggcgcaaaauacagagggagcauccacgacuucccuggauuugauccaaaccaagacgccgaggcgcuguauaccgcuaugaaggguuucggcuccgauaaagaagccauucucgacauaaucacaucuaggucaaaucggcagcgccaggaggugugccagaguuacaagagccuuuaugggaaagaucugauugcagacuugaaguacgaauuaacuggaaaguuugagcgacugaucgucggccuaaugcguccgcccgccuauugugaugcuaaagaaauuaaggacgcaaucuccgguauagggacggaugagaaaugccucaucgagauucuggccucuagaaccaacgaacaaaugcaucagcuuguugcugccuacaaggacgcguaugagagggaucuggaagcagacaucauuggagauacaucgggccacuuccagaaaauguuggugguacuccugcagggcacucgggaggaggacgacguggucucagaagaucuggugcaacaggacguucaggaucucuacgaggccggggaauuaaaguggggaaccgacgaggcucaguuuaucuacauacuggguaaucgcagcaagcaacaucuuagauugguguucgaugaauaucugaaaacaaccggcaagccuauugaggccaguaucaggggagagcuauccggggacuuugaaaaacucaugcuggcagucgugaaguguauucggucuacuccagaguacuucgcugaacgccuuuuuaaagccaugaagggccuggguacacgagauaacaccuugaucagaaucaugguaagcagguccgagcucgacaugcuggauauucgggaaauauuccguacgaaauaugagaagucauuauacaguaugaucaagaaugacacuagcggggaguauaaaaagacccugcucaaacuuucuggaggcgaugacgacgcggccggccaguuuuuccccgaagcagcucagguugccuaccaaaugugggagcuguccgcuguggcccgcgucgaauugaaggggacagugagaccugcaaacgauuuuaauccagacgccgaugcuaaagcgcuaaggaaggcaaugaagggacuggguacugacgaggauaccauuaucgacauaauuacacaccggucaaacgugcagcgacagcagauccgccaaaccuucaaaagccauuucggcagagaucucaugacggaccugaagagugaaaucucuggggaucuugccaggcugauuuugggacucaugaugcccccugcucacuaugacgccaaacagcugaagaaagcaauggagggcgccgguacugaugagaaggcuuuaaucgaaauucuggccacacggaccaaugcagagauacgcgcgaucaacgaggcuuacaaggaagacuaccacaaaucccuagaggaugcccucagcucggacacuucugggcauuuuagaaggauucugaucucccuugcaacaggccaccgugaagagggaggcgaaaauuuggaccaggcccgggaggaugcucaggucgccgcagaaauccuggagauugcugacaccccaucaggggauaagacgagucucgagacccgauucaugacaauacugugcacuagaagcuauccgcaucuuaggcgcguuuuucaagaguucaucaaaaugaccaacuacgacguggaacacacaauuaagaaagaaauguccggagauguacgggacgccuuuguggcgaucguccagucugugaagaauaagccccuguucuuugccgauaaauuguauaagagcaugaaaggugcuggcacugacgagaagacccucacaagaauuaugguuucaaggagugaaaucgaucuguuaaacauacgccgagaguucaucgagaaauacgacaagucccugcaccaggcaauugaaggggauaccagcggagacuuucuaaaagcccuccuggcucuuuguggcggugaggauuga

SEQ ID NO: 52812 - RNA, 1401 nt, Artificial Sequence
  derived and/or modified sequence opt3 from ANXA7__Homo_sapiens__NP_001147
augagcuaccccggcuauccuccaaccggguacccgcccuucccuggauauccacccgccggucaggaguccucuuuuccuccaucaggccaauaccccuauccuaguggguucccaccgaugggaggcggugcuuacccccaggugccuagcuccggguauccaggagcaggcggcuaccccgccccugggggauacccagcgcccgguggcuauccgggggcuccucagcccggaggcgccccaucuuacccuggugugcccccagggcagggauuuggcguucccccuggcggggcaggauucucggguuauccacaaccgcccucacagagcuacggcgggggaccugcccaggugccacugcccggcgguuuuccugggggccagaugccaagucaauaucccggaggccagccgacauacccuucccagccagcuacuguaacgcaggucacccaagggacaaucagacccgcagccaacuucgacgcuauuagggaugccgaaauacuccggaaggcgaugaaaggauuugguacugacgagcaggcaaucgucgaugugguugccaaucgcucuaacgaccagcgacaaaagauuaaagcugccuucaagaccagcuauggcaaagaucuuaucaaggaccugaaguccgaauugucagggaauauggaggaauuaauucuggcacuauuuaugccucccacauacuacgaugcuuggagucuccguaaagccaugcagggagcgggcacccaggagagagugcugaucgagauacuuugcacuaggacaaaccaggaaauccgggagauuguccgcuguuaucaaagcgaguucgguagagaccuggaaaaggauaucaggucugacaccuccgggcacuuugagcgguugcucgugucaaugugccagggcaaucgcgaugaaaaccagagcauuaaucaucagauggcccaagaggacgcacagcgacuguaccaggcuggagaaggcagacuggggacggaugagaguuguuucaacaugauccucgccacuaggucuuuuccacaguuacgggcuaccauggaagccuauucccguauggcaaaucgcgaccugcuuagcucgguaucuagagaguucuccggauacguugagucagguuugaaaacaauacugcaaugcgcccuaaacaggccugcuuucuuugcggaacggcucuauuacgcaaugaagggcgccgggacugacgauaguacccuggugcgaauugucgugacacgcagcgagaucgaccuugugcagauuaaacagauguucgcucagauguaucaaaagacccugggaacgaugaucgccggcgauacuuccggugacuacagaagguugcuccuggcaaucgucgggcaguga

SEQ ID NO: 52813 - RNA, 984 nt, Artificial Sequence
  derived and/or modified sequence opt3 from ANXA8__Homo_sapiens__NP_001035173
auggccugguggaaaagcuggaucgagcaggaaggcgugaccgucaaauccucuucacacuucaaccccgacccugaugcugagacacuguacaaggcaaugaaagggauuggaacuaaugaacaagccauaaucgacguucucacgaagagaaguaacacccagaggcagcagauugcgaaauccuuuaaggcucaauucgguaaggaucuuacagagacucugaaaagcgaauugucuggcaaguuugagcgguuaaucguggcccugauguauccaccguaccgcuaugaggcaaaagaacuacaugacgccaugaaggggcucggaaccaaagagggcguaauuaucgaaauacuggcuucgcgaacaaagaaucagcuucgugagaucaugaaggcauacgaggaagauuaugguucaagccuggaggaagacauucaggccgauaccaguggguacuuggagagaauccucgugugccugcugcagggauccagggacgaugucucuagcuucguggaccccggccucgcuuuacaagaugcccaggaccuguaugcggcaggcgaaaagauucgggggacugaugagaugaaguuuaucacaauacuuuguacccgcuccgccacgcacuugcugagaguuuucgaggaauacgagaaaauugcuaacaagucaaucgaagacaguauuaaaagcgagacucauggaucucuagaagaggccaugcucaccguggucaagugcacacagaaucugcacuccuacuuugcagagaggcuuuauuacgcuaugaaaggugccggcacucgggacgggacccugauccgcaacaucgugucacgaagcgaaauugauuugaaucucauaaagugucauuucaagaaaauguauggaaagacacugaguucuaugaucauggaggacaccuccggcgauuacaaaaacgcguuacugagccucguagguucggacccuuga

SEQ ID NO: 52814 - RNA, 984 nt, Artificial Sequence
  derived and/or modified sequence opt3 from ANXA8L1__Homo_sapiens__NP_001092315
auggccugguggaaggcuuggaucgagcaggaaggcgugaccgucaaaagcuccucucacuucaaccccgacccugaugcagagacacuguacaaggccaugaaagggauuggaacuaaugaacaagcgauaaucgacguucucacgaagagaucaaacacccagaggcagcagauugcuaaaaguuuuaaggcccaauucgguaaggaucuuacagagacucugaaaagcgaauuguccggcaaguuugagcgguuaaucguggcacugauguauccaccguaccgcuaugaggccaaagaacuacaugacgcuaugaaggggcucggaaccaaagagggcguaauuaucgaaauacuggcaucucgaacaaagaaucagcuucgugagaucaugaaggccuacgaggaagauuaugguucgucacuggaggaagacauucaggcugauaccagcggguacuuggagagaauccucgugugccugcugcagggaaguagggacgaugucuccucuuucguggaccccgcccucgcguuacaagaugcacaggaccuguaugccgcuggcgagaaaauucggggcacugaugaaaugaaguuuaucacaauacuuuguacccgcagcgccacgcacuugcugagaguuuucgaggaauacgagaaaauugcaaacaaguccaucgaagacucaauuaaaagugagacucaugggagccuagaagaggcuaugcucaccguggucaagugcacacagaaucugcacucuuacuuugccgagaggcuuuauuacgcgaugaaaggagccgguacucgggacggcacccugauccgcaacaucgugucccgaucagaaauugauuugaaucucauaaagugucauuucaagaaaauguaugggaagacacugagcaguaugaucauggaggacaccucuggagauuacaaaaacgcauuacugucccucguaggcagcgacccuuga

SEQ ID NO: 52815 - RNA, 2067 nt, Artificial Sequence
  derived and/or modified sequence opt3 from AOAH__Homo_sapiens__NP_001170977
augcagagccccuggaagauccugaccguggccccucucuuccuucuguuguccuuacaaucuucagcuaguccagcaaacgacgaucagagcagaccgucccugucuaauggccacacaugcgucggguguguucuagugguaucggugauugagcagcucgcccagguccauaacucaacugugcaagcgagcauggaaaggcugugcaguuaccuucccgagaaacuguuuuugaagacgaccuguuaucucguuauagacaaauucggauccgauaucauuaagcugcugucugcugacaugaaugccgauguggucugccacacacucgaauuuuguaaacagaacacuggucagccuuuaugccaucuguacccacuucccaaggagaccuggaaguucacauugcagaaagcacggcaaaucgugaagaaaagcccuauucugaaguauucccgcucaggcagugacaucuguagccuaccaguacucgccaaaauaugccagaagaucaagcuggcuauggaacagucuguucccuuuaaagauguggacuccgauaaguacucagucuucccuacccuucgaggguaucacuggcguggaagagacuguaaugauagcgacgagaguguguacccaggcaggcggccgaacaauugggaugugcaucaggacucuaacugcaaugguauuuggggagucgaccccaaagaugggguuccuuaugagaagaaauuuugugaaggcucccaaccacgcggcaucauucuguugggggacagcgcaggagcccacuuccacaucucgcccgaguggauaacugcuucucagaugucccucaacucauuuauuaaucugccuacagccuuaaccaacgaacuggauuggccacagcucaguggugcgacgggcuuccuugacagcacuguggggaucaaggagaaauccauuuaccugagauuguggaagaggaaucauugcaaccaccgggauuaccaaaauaucucucgcaacggagcaagcucacgaaaccuaaagaaauuuaucgagagucuguccagaaauaagguacucgacuaucccgccauugugauauacgcuaugaucggcaacgaugucugcagcgguaaaucugacccggugccugccaugaccacacccgaaaagcuguauucaaauguuaugcagacucuuaaacaucugaacagucacuugccaaaugggagccacgugauucucuacggacugccugauggcaccuucuuaugggacaaccugcauaauagguaucacccccuaggccagcucaacaaggauaugacauacgcacagcuguauuccuuucuuaauuguuugcaagucucuccaugccauggguggaugucgagcaacaagacccugcggacgcucacuuccgagcgugcugaacagcugucaaauacacuuaaaaagaucgccgcgagugagaaauucaccaacuucaaucuguuuuacauggacuucgccuuucacgaaauaauucaggaguggcagaagcgcggaggucaacccuggcaguugaucgagccuguggacggcuuccauccaaacgaaagaaaaucuauccuccugaaggggauuuuaaugacuagccagacacuggauaaucaggaguggacccaacuaacguccuggaucaagggaaaccucaccugugacucaaggacacgggaauggcugugcuguugcuggcgaauuauaagcggcaaacgcuguucuuccaguggucccaagagcugggagagaaggauccggucuacuccgcgccuuaacagaugcuuggaaaccaaagcagggacagagccucugagguccaugcacccauggggcgcucagggaggccgugggcucggaaagcugauuccccagacuuuauggggucugccucggcaccgaccaaaaggcuuguuuuucucaaguaucuuugccaagugucuuagccucaaugaggaacauaucuggaccacaguacagugcuguguucugcccgggucggugacccuaccgcuguuccucaaguga

SEQ ID NO: 52816 - RNA, 2313 nt, Artificial Sequence
  derived and/or modified sequence opt3 from AOC1__Homo_sapiens__XP_011514310
augcccgcccugggcugggcuguggcagccauccucaugcuucagaccgcgauggcugagccuagcccagggacacugccgagaaaggccggagucuucuccgacuugucuaaccaagaauuaaaagcaguucacucauuucuguggaguaagaaagagcuaaggcuccagcccagcuccacuacgaccauggccaagaauacaguguuccugauugaaaugcuucugccuaaaaaguaccauguauugcgguuucucgauaagggugagcgccacccagugcgagaagcucgugcagucauauucuuuggcgaccaggagcaucccaacgugacugaguucgccguugggccucugccaggacccugcuauaugagagcucugucuccuaggccaggcuaccagucgucaugggccagccggccgaucaguaccgcggaauaugcacucuuauaccacacacugcaagaggccaccaaaccccuucaucaguuuuucuugaauacuacagguuuuuccuuccaggauugucacgaccgcugccuggcuuuuaccgauguggccccuagaggggucgcaucuggacagaggcggagcuggcuaauuauccaacgcuauguggaaggcuacuuccuccacccaacgggccuggagcuucugguagaccauggguccacugaugcuggacacugggccguugaacaggugugguauaacgguaaguuuuacggcucacccgaagaguuggcgcgaaaauacgccgacggggaagucgauguggugguccucgaggacccucugccaggaggcaagggucaugauaguaccgaggagcccccguuauucagcucucacaaaccuagaggggacuuccccuccccaauucacguuucaggaccuaggcuggugcagccccauggcccacgguuucgucucgagggcaaugcaguacuuuaugggggauggagcuucgcuuuucgccugagaaguucuuccggucuacagguguugaacguccacuucggcggggaaaggaucgccuacgaggugagcguucaagaagcuguggcccuguauggaggccauacacccgcagguaugcagacuaaguaccucgaugucggguggggccugggaucggugacccacgagcuugccccuggcauagacuguccagaaacagcuaccuuucuggacacguuccauuauuacgaugcggacgauccgguacacuauccccgggcauugugccucuuugagaugccuacugggguuccacugcgacgccacuucaauucuaacuuuaagggagguuucaauuuuuacgccggcuuaaaaggacaggugcugguccuaagaacaaccuccacuguguacaacuaugacuacaucugggauuucaucuuuuaucccaauggggucauggaggcuaagaugcaugccacaggcuacgugcacgcaaccuucuauacgccugaaggucucaggcaugggacccggcugcacacacaccuuauuggcaacauucauacucacuugguucauuaccgcguggaccuggauguagccggaaccaaaaauucauuccaaacacuccagaugaagcuggagaacaucacuaauccauggagucccagacacagggucgugcagccgacccuugaacagacacaauauagcugggagcgucaggcugccuuucgguucaaacgaaagcugccuaaauacuugcucuuuaccuccccacaggaaaaccccuggggccauaagagaacuuacaggcugcagauacacucuauggcagaccaaguuuuaccucccggguggcaggaggagcaggcgauuacgugggcucgcacagaaggaggucagccacgggcccugagccaagcagccucaccugugcccggcagauauccacuagcugucaccaaguacagggagagugaacucuguuccagcucuaucuaucaccagaacgauccguggcauccucccgugguauucgagcaguuucugcacaauaacgagaauauugaaaacgaggaccuuguggccuggguuacugucggguucuugcauaucccacacucagaagauauccccaauaccgcaacaccuggaaacagugugggcuuucugcuccgcccauucaacuuuuuccccgaggacccuagccuggcuucccgagacaccgugauugucuggccgcgggauaaugguccaaauuacguucagcguuggauacccgaagacagagauugcucuaugccuccacccuuuucguauaacgggacuuacaggccuguguga

SEQ ID NO: 52817 - RNA, 2190 nt, Artificial Sequence
  derived and/or modified sequence opt3 from AOC2__Homo_sapiens__NP_001149
augcaccugaagaucgugcucgccuuccuugcucugagcuugauuaccauauuugcauuagccuacguccugcuaacaucccccggcgggucuucacagccuccacauugcccgaguguuagccacagagcgcaacccuggccucauccaggacagucccaguuauucgcugaccugucuagggaggaacuuacugccgugaugcgguuucugacgcagcgcuugggucccggccucguagaugcagcccaagcucagccuucggacaacuguaucuucucaguggagcugcagcugccacccaaagcagccgcucucgcccacuuagaucgagggagcccuccaccggcgcgugaagcacuggccauuguccuuuuuggaggccagccccaaccuaaugugagugaguugguuguggguccacugccccauccuuccuauaugagagacgucaccguggaaaggcacgggggaccacuacccuaccaccggcgcccgguacucagagcugaguucacacagauguggaggcaucugaaggagguugaacuuccuaaagcccccaucuuucugucuagcacuuucaacuauaauggcuccaccuuggcagcugugcacgccacaccacggggccuccgcucaggggaucgagcgaccuggauggcccuguaccauaacauuaguggagucgguuuauuucugcacccugugggccucgagcuucuguuggaccacagagcacuagaucccgcucauuggacugugcagcaggucuucuaucuggggcacuacuaugccgaccucggacaacuggaaagggaguuuaagagcggccggcuugagguugugcguguaccacugcccccuccaaauggugcuucuuccuugcgcucaagaaacagcccggggccccucccuccacugcaguucaguccccagggaucucaauacuccgugcagggcaauuuagucgugagcucgcuguggucuuuuacauucggccaugggguuuucuccggacuaaggaucuuugaugugcgguuccagggugaacgaauagccuacgaggucucagugcaggaaugcguaaguaucuauggcgcagacagcccuaaaaccaugcucacgcgcuaccuggauuccucuuuugggcuuggaagaaacagcaggggcuugguucgggguguggacuguccauaucaagccacuauggucgauauucacauccugguggggaagggcgcuguccagcuccugcccggagcggugugcguuuucgaggaagcacagggccuuccgcugcgcagacaucacaauuacuugcagaaccacuuuuaugggggacucgccucaagugcucuggugguaagguccgucagcucuguggguaauuacgacuauauuugggacuucguuuuauacccuaacggcgcccuggaggggcgugugcaugcaaccggauacaucaauacagccuuucuaaagggcggugaggaagggcuccuguucggcaaccgggucggagagcgagugcuuggcacuguacacacccaugcuuuucacuucaaauuggaucuggacguggccgggcucaagaauuggguugucgcagaagaugugguguuuaaaccagucgcggcucccuggaacccugagcacuggcugcaaagaccccaguuaacaaggcagguucugggaaaggaagaccuuaccgccuucucauuggguaguccacucccucgcuaucuguaccuagcaagcaaccagacgaaugccuggggccaucaacggggguaucagcugguggugacucagagaaaagaggaggaaucccagucuucgagcauauaccaccaaaacgauauuuggacacccaccguaacuuuugcugacuucaucaauaacgagacacuccugggagaagaucuugucgccugggugaccgcauccuucuugcauauuccacacgcugaggacaucccgaauacgguuacccugggcaacaggguggguuuucuccuccgcccuuauaauuucuuugaugaagaccccucaaucuucaguccagggucugucuacuuugagaagggccaggaugccggacuguguagcauuaaccccguggcgugccuuccugaccuggccgcuuguguuccagacuugcccccuuucuccuaucauggcuuuuga

SEQ ID NO: 52818 - RNA, 2292 nt, Artificial Sequence
  derived and/or modified sequence opt3 from AOC3__Homo_sapiens__NP_003725
augaaccagaagaccauccuggugcuccuuauucuggccgucauaacaaucuucgcuuugguuugcguguuacugguaggcagagggggagacgguggcgagcccagccaacuaccucacuguccauccgugucuccgucagcacagcccuggacucauccugggcagagucagcucuuugccgaucugagcagggaagaacuuacggcggucaugcgguuccugacccaacgcuugggaccaggccucguggacgcugcccaggcacgacccuccgauaauugcguguuuucuguugaacugcagcugccuccaaaagccgcugcacucgcccacuuagaccgugguucgcccccuccagcuagagaggcccuggcgauugucuucuuugggaggcagccgcaacccaacgugucagaacuuguaguuggaccuuugccacaucccagcuacaugcgggaugugacagucgagcgccacggcggcccucugccauaucauagaaggcccgugcuauuccaggaguaccucgacaucgaucagaugauuuuuaaucgggaacugccgcaggcaagugggcuucugcaccacuguugcuucuauaagcaucgcggacgaaacuuggugacuaugaccacagccccuagaggucuccaauccggcgacagggcuaccugguuugggcuguacuauaauaucucuggagccggcuucuuuuuacaccaugucggucuggagcuccuuguuaaccacaaagcacuggaucccgcucgguggacuauacagaagguguucuaccaggggcguuauuacgacagcuuggcccaacuagaagcgcaguuugaggccggacugguaaaugugguccucaucccagauaacggcacaggcggguccuggucacugaaaaguccugugcccccaggacccgcaccuccacuucaguucuacccgcaggguccccgcuucagcguucaaggcucuagaguggcuuccucacuguggaccuuuagcuucggguugggagccuuuaguggcccuaggauuuucgacguccgguuucagggugagcgacucguguaugaaaucucucugcaggaggcuuuagccauuuacgggggcaauuccccagcagccaugacgacucgcuauguagauggaggcuucgggaugggaaaguacaccacaccccugacuagagguguugacuguccuuaucuagcuaccuacguggacuggcacuuucuccuggaaagccaggcgccaaagacaaucagggaugcauucugcgucuuugagcaaaaccagggccuucccuugcggcgccaucacucggaccuguauucucauuacuucgggggacucgccgaaaccgugcuggucgugagauccaugucaacgcuucugaauuacgauuauguuugggacacuguguuucacccgaguggcgcuauagagauuagguucuacgccacagguuauaucagcuccgcauuuuuguucggggccaccggcaaauacggaaaccagguaucugagcauacucucggcacaguccacacccacagcgcucauuucaagguggaucuggacguugccggguuagaaaauugggugugggcagaggauauggucuuugugccuauggcgguaccauggucacccgaacaccagcugcaacgucuacaggugacgcggaaacuccuggagauggaggagcaggcugccuuccuuguuggaagugcaaccccucgauauuuguaccuggccuccaaccauagcaauaaguggggucaccccagaggcuauaggauucagaugcucucuuuugcuggggagccacugccucaaaacucaaguauggcccgcggauucagcugggaacgguaccaguuagcagucacacagagaaaagaggaggaacccuccucuucgagcguguuuaaccaaaaugacccaugggcuccgacuguggauuucuccgacuuuaucaacaaugaaaccaucgccggcaaggaucuggucgcguggguuacagccgguuuccuucacauuccucaugcugaggacauacccaacacugugaccguggggaauggcguaggauuuuucuugaggccauacaacuuuuucgacgaggaucccucauuuuauagugcagacucuaucuacuuccgcggcgaucaggacgccggggcuugugaagucaauccucucgccugccugccacaggcagcggccugugcucccgaucuaccugccuucagccacggaggcuuuucccauaacuga

SEQ ID NO: 52819 - RNA, 4017 nt, Artificial Sequence
  derived and/or modified sequence opt3 from AOX1__Homo_sapiens__NP_001150
auggacagagccagcgagcuccuguucuacgugaacggcaggaaggucaucgaaaagaauguugaucccgagaccaugcuucugccuuauuugcggaagaaauuacgccugacagggacuaaguacggaugcgguggcgggggauguggcgcuugcacggugaugauuucccgauauaacccaauaaccaaacguaucagacaccauccggcaaaugccugucuaauucccaucugcucucucuacggugcggcuguaacaacuguggaagggauuggaucaacccacacaaggauccauccuguccaggagcggauagccaagugucacggcacccaaugcggcuuuuguacuccagggauggugaugaguaucuauacacugcuucgcaaccaucccgaaccuacccuggaccaguugacggaugcacucggagguaaucugugcagauguacuggcuacaggccaauuaucgacgccugcaagaccuucuguaaaacaagcgggugcugccaguccaaggagaacggaguuuguugccuggaucagggcauuaauggucuccccgaguuugaagaggggucuaaaacuucgccuaaguuauucgcugaagaggaguuucugccacuugacccgacccaagaauugaucuuucccccugagcugaugauaauggcagaaaaacagucacagcggacacgcguguucggaagcgagcgaaugaugugguucaguccagucacccuaaaggaacuccuggaguuuaaguucaaauauccccaggccccugugauuaugggcaacacguccguaggcccagagguuaaguuuaaagggguguuccaccccgucaucauuucuccggauagaaucgaggaacuuagcguggugaaucacgcuuacaacggacugacuuugggugccggccucucccuggcgcaagucaaggacaucuuagcagauguugugcagaaacugccugaagagaagacacagauguaccaugcccuccuuaaacaccuggggaccuuggcuggaucacagauuaggaauauggccagucuaggcggucauauaaucagccggcaccccgacucugaucugaacccaauucucgcaguagggaauuguacucugaaccuucuguccaaggaaggcaagcgucaaaucccuuugaaugagcaguuucucucaaaaugccccaacgcugaccugaagccacaggagauauuagugagcgucaacauucccuauagucgcaaaugggaguucgugucugccuucagacaagcgcagaggcaggaaaaugcccuggcaaucguuaacuccggaaugcggguguuuuucggcgaaggggauggaaucauucgagagcuauguaucagcuacgguggcgucgggccugcuacaauuugcgccaaaaauucgugucagaaacucauaggacgccacuggaacgaacaaaugcuggacaucgcuugcagacuuauuuugaaugaggugucucugcucggcuccgccccaggugggaagguagaguuuaagaggacccugaucaucucauuccuuuuuaaauucuaucuggaaguuagucagauuuugaagaaaauggacccggugcauuaccccagccucgcagauaaguaugaguccgcccuggaagacuuacacucuaaacaucacuguagcacgcugaaguaccagaacauaggcccuaagcagcauccagaggaucccaucggacacccuauuaugcaccuaucaggcgucaaacaugcuaccggggaggcgaucuauugcgacgauaugccacucguggaccaagaacuguuucuuacauucgucacuucgucccgggcacacgccaagauugugagcaucgauuugucugaggcucugucaaugcccggaguuguggacauaaugaccgccgaacaucucagugauguaaauagcuuuuguuucuuuacagaggcagaaaaauuccuggccacugacaaggucuuuugcgugggucaguuaguuugcgcugugcuggccgauuccgagguccaggcaaaacgcgcggcuaagagagugaagaucguauaccaggaccuugagccguugauucucaccaucgaagagucuauucaacacaacucgagcuucaaaccugaaaggaagcuggaguacggcaauguggacgaagccuucaaaguugucgaucagauccuagagggggagauacacaugggaggccaggaacauuuuuauauggagacacaguccaugcugguggugccaaagggugaagaccaagagauggaugucuacguuucaacccaguuccccaaauauauucaggacaucguggcaaguacucucaagcugccugccaacaaagugaugugucacguacgucgggucgggggcgcuuuuggaggcaaggugcuuaagacggggauuaucgccgcaguuacagcuuucgccgcgaauaaacauggacgagccgugagaugcgucuuggaaaggggcgaggauaugcugauaaccggugggcgccaccccuacuuaggaaaguauaaagcuggcuuuaugaacgacggucggauccucgcacuggauauggagcauuacucuaaugccggcgcuagccuugacgaaucccuguucgugauugagaugggguugcucaagauggauaacgccuauaaauuuccaaaucugagauguaggggaugggcaugccgcacuaaccuaccuucaaacaccgcguuccgaggcuuuggguucccccaagccgcucugaucacagaaagcuguauuaccgagguugccgcaaagugcggacucucuccagagaaggugcggaucauaaauauguacaaagaaauugaccagacuccguacaagcaggagaucaacgcuaaaaaucugauccaguguuggcgugaaugcauggccauguccaguuauagccuuagaaagguagcagucgagaaauuuaacgccgaaaauuacuggaagaagaaaggcuuggcuauggugccucugaaguuccccguggguuuagggucuagggcggccggacaagcagcugcccucguccacauuuaucuggauggcuccguucuugugacacacgguggcaucgagauggggcagggaguacauacgaaaaugauucagguggucucacgcgagcugcggaugccaaugaguaacgugcaccuaagaggcaccagcacugaaacaguucccaaugccaacauaagugggggauccguggucgcugaccucaauggccuggcagugaaggaugccugucagaccuugcugaaaagguuagagccuaucauuucuaagaacccaaaggguacauggaaagacugggcgcaaacugcuuuugacgaaagcaucaaucucucagccguuggguacuuccgaggauaugagagugauaugaacugggaaaagggcgagggucagcccuucgaguacuuuguguauggcgcagccugcuccgaagucgagauugacugucugaccggggaucauaaaaauauccgcacggacauaguaauggaugugggaugcucuaucaacccugcuauugacaucggccagauugaaggggcauucauccagggaaugggccuuuacaccauagaggaacugaauuacagcccgcaagguauuuugcacacacgggggccagaucaguauaagauccccgccaucugcgacaugccuacugagcuccauauugcgcugcuaccacccucccagaacucaaacacccuguacagcaguaaaggacuuggcgagucuggcguuuuucucggguguuccguguucuuugcuauacacgaugccgucagcgcagccagacaagaaaggggacugcacgguccuuugacauuaaauucgccgcugacucccgagaagauccguauggcuugcgaagacaaauucaccaagaugauuccacgcgaugagccuggcucauaugugcccuggaacguaccaaucuga

SEQ ID NO: 52820 - RNA, 810 nt, Artificial Sequence
  derived and/or modified sequence opt3 from AP1AR__Homo_sapiens__NP_001121898
augggcaacugcuguuggacccagugcuucgggcugcucagaaaggaggccggaaggcuucaacggguggguggcgggggaggcagcaaauacuuucgcacauguucccgaggugaacaccugacuaucgaguucgaaaauuuggucgagucugacgaaggggagucacccggaaguagccaucguccuuuaacggaggaagagauuguugaucugagagaaaggcacuaugacuccauagcugagaagcagaaagaucuagacaagaaaauccagaaggagcaggaacggcaacgcauugugcagcaguaccauccaucuaacaauggcgaguaucagucgucaggcccggaagaugacuuugagagcugccucagaaacaugaagagucaauacgaaguauucagguccucucggcugagcuccgaugcaaccgugcuuacacccaauacugagucaaguugugaccugaugaccaaaacaaagagcaccucugggaacgaugacuccacuucauuggaucucgagugggaagacgaggaaggaaugaaucgcaugcugccuaugcgagagagaagcaaaacagaagaggauauccugagggccgcgcucaaguauaguaacaaaaagaccgguucuaauccaacguccgcuagcgacgacucgaacggcuuagagugggaaaaugauuuugucucugccgagauggacgauaacggaaauuccgaauacucaggguucgugaaccccguucuggagcuuagugacagcggcauucggcacuccgauacugaccagcagacccguuga

SEQ ID NO: 52821 - RNA, 2760 nt, Artificial Sequence
  derived and/or modified sequence opt3 from AP1B1__Homo_sapiens__NP_001159491
augaccgacagcaaguacuucacaacuacgaaaaagggcgagaucuuugaacugaaagccgagcucaacuccgauaagaaagaaaagaagaaagaggcugugaagaaagucauugcaucuaugaccguugggaaggacgugucagcccuuuuccccgauguagugaauugcaugcagacagacaaccuggaauugaaaaaguuagucuaucuguaccuaaugaauuaugcgaagagucaaccugauauggcuauaauggccgugaacacuuuuguuaaagacugugaggauccaaauccgcucaucagagcacuggccgugaggaccaugggaugcauucgggucgacaagaucacagaguaccuuugugaaccccugcgcaaaugcuugaaggaugaggacccuuaugugcgaaaaaccgcugcaguauguguugccaagcuccacgauauuaacgcucagcugguggaagaccaggguuuccuggauacucucaaagacuuaaucagcgacuccaauccaauggucguggccaacgcgguggcagcccugucugagauagcugagucgcaucccucaagcaaucuuuuggaucugaacccucagaguaucaauaagcuacucacagcccugaacgaaugcaccgaguggggccaaauuuuuauccuugacugucuggcaaauuacaugccaaaggaugaccgugaagcucaguccauuugcgagagagucacgcccagguugucucacgccaacagcgcgguugugcucuccgccguaaaagugcugaugaaguucauggaaauguuaucaaaagaucuggacuauuacgggacucuccuuaagaaacuggcaccuccauuggucacccuacugagugcugagccggagcuccaguacguggcccugcggaauaucaaccuuauaguucagaagcgccccgaaauucugaagcaugagaugaaaguguuuuucgucaaguauaacgauccuaucuacgugaaauuggaaaagcucgacauuaugaucagacuggcuagccaagccaauaucgcacagguauuagccgagcugaaagaauaugcuacagagguugauguggacuuugucaggaaggcggugcgggcaauuggacgcugugccauaaaggucgagcagucugcugaacgaugcguguccacucuacucgaucugauccagaccaaaguuaacuacgugguacaagaggccauugucgugaucaaggacauauucagaaaauauccaaauaaguacgaaucaguuauugcaacacuuugugagaacuuggacagccuggaugaacccgaggccagggcugccaugaucuggaucgugggcgaguaugcagaacggauugacaaugcggaugagcuccuggaaaguuuucuugaggguuuccacgacgagucuacccagguccagcugcaauugcucacggcuaucgugaaacuguuuuuaaagaagccuacugaaacacaggagcugguacaacaggugcuaucccucgccacccaggauagcgacaacccagaucugcgugaccgcggguacauuuacuggagacuuuugucgacugaucccguugcagccaaagaagucgugcuggcugagaagccgcucauaucugaagagacagaccugaucgagccuaccuuacuggaugaacuuauuugcuauaucggaacguuggccuccguguaccauaaacccccaucagcauucgucgagggcggcaggggcguugugcacaagagucucccuccccggaccgcuagcuccgaaucugccgagagcccagaaacagcgcccacuggagccccuccaggugagcagccggacgugauccccgcucagggcgaucugcuaggggaccugcucaaucuggaccuuggaccuccaguaucagggcccccuuuggcaaccaguuccguccagaugggugccguggaucuguuagggggaggccucgacagccugauuggcgggacaaacuucguugcuccacccacugccgcagugccggcgaaucuuggagccccuauagguucuggccugucagauuuguuugaccucaccaguggggucggaacacugagcggcuccuauguggcuccaaaagccguugguucuaucucgauggaucuacaacugaccaacaaggcacuccaggugaugacugacuucgcuauucaguuuaaucgaaacagcuucgggcuggcccccgcagccccucuucagguacacgcucccuuguccccaaaucaaacggucgagaucucacugccuuuaaguacagugggcucugugaugaaaauggaaccccucaacaaucugcaggucgcgguuaagaacaacauugauguguuuuacuucagcacccuuuauccacugcauauccuauuuguagaggacggaaagauggaucgccagauguuccucgccacuuggaaagacauaccgaaugaaaacgaggcacaguuucaaaucagagauugcccucugaaugcugaagccgccuccucaaaguugcagagcucuaacauuuucaccguggcuaaaaggaaugucgagggccaggacaugcuguaccaauccuuaaagcucacaaacgggaucugggugcuggcagagcuucggauucagcccggaaauccaaguuguacccugagcuugaaaugccgcgcccccgaaguuucucagcacguguaucaggcguacgagacuauccucaagaacuga

SEQ ID NO: 52822 - RNA, 2478 nt, Artificial Sequence
  derived and/or modified sequence opt3 from AP1G1__Homo_sapiens__NP_001025178
augcccgccccuaucagacugagggagcucauucggaccauacgcacagcucgaacucaggcagaggaacgugaaaugauccaaaaggagugcgccgcgauuagaagcuccuucagggaagaggacaacacguaccggugucgcaauguggcuaaacuucuguauaugcacauguugggcuacccagcccauuuugggcaguuagagugccugaagcuaaucgcaucucagaaauucaccgauaagagaauuggauaucucggugccaugcugcuucuggacgaaaggcaggauguccacuugcucaugacaaacuguaucaaaaaugaccugaaccauucaacucaauuuguucagggccuggcucucugcaccuuaggguguaugggaaguagcgagaugugccgggaucuggcaggcgaaguggagaaacuuuugaagacauccaauucuuaccugcgcaagaaggccgcucuaugugccguacacgugauacgaaaagucccggagcucauggaaauguuccugcccgcgaccaagaaccuucugaaugagaaaaaccaugguguguugcacacuucgguugugcuccugacagaaaugugcgagagaucaccugacauguuagcacacuuuaggaagaaugaaaagcuggucccacagcucgugcggauccuuaaaaaccugauuaugagcggguauagucccgagcaugauguauccggaaucucugacccuuucuugcagguucguauucuacgccugcucagaauccugggcaggaaugaugacgauagcuccgaggccaugaacgacauacuugcucaaguggccaccaauacggaaacuucaaagaacgucggcaaugcaauucuguacgagaccguguugacaaucauggauauuaaaagugaaagcgggcuccgggugcuggcuaucaacaucuuaggacgauuucugcuaaacaaugacaagaacauucgcuaugucgcccucacuucucugcuuaaaaccguucagacagaccacaaugcggugcagagacauagguccaccauaguagauuguuugaaggaccuggaugugucaaucaaacggcgcgccauggagcucagcuucgcacuggucaacgguaauaacauuagaggcaugaugaaggaacuucuguacuuuuuggacaguugcgagccagaguucaaggcugauugugccucugggaucuuucucgcugccgaaaaauacgcacccuccaagagguggcacauagacacgauuaugcgugugcugacuacagccggaagcuauguucgggaugacgcugugccuaauuuaauccagcugaucaccaacucggucgagaugcacgcguacacugugcaacgacuauauaaagcaauucucggcgauuacucucagcagccacugguacaaguugccgcuuggugcaucggugaauauggggaccuuuugguguccggacagugcgaggaagaggagccgauucaggucacagaagaugaggugcuggacauacucgaaucaguccugaucaguaauaugagcaccuccgugacgagaggcuacgccuuaaccgcaauuaugaagcugucuacaagguucacuuguaccguuaaccgcaucaaaaaggugguaagcaucuauggcucaaguauugacgucgagcuucagcaacgggccguggaguacaaugcuuuguuuaagaaauacgaucauaugagauccgcccuccuggaaaggaugcccguuauggagaaggugacaacuaacgggccuaccgaaauaguccagacaaauggagagaccgaaccagcaccccuagagacuaaaccuccacccagcgguccgcagccuacgucucaggcgaacgaccugcucgaucugcuuggcgggaaugacaucacacccgugauuccaaccgcuccuacuucaaagcccaguagcgccggaggcgaguugcuggauuuacucggugacaucaaccugaccggggcaccagccgcugcccccgcuccugcauccguaccacaaauuucucagccgcccuuccuucuggauggcuugucgagccagccucucuucaacgacaucgccgcgggaauaccauccaucacagccuauagcaaaaauggccugaagauugaauuuaccuucgagcgcaguaacacuaaucccucugugacaguuaucacgauucaggcuagcaacuccaccgaacuagauaugacugacuuugucuuccaagcagccgugccuaagacauuucagcugcagcuccugucaccaucaucuuccaucgugcccgcuuucaauaccgggacaauaacucaggucauuaaaguucuuaacccgcaaaagcagcaguugcgaaugcggaucaaacugaccuacaaucacaagggaagugccaugcaagauuuagcagaggugaacaauuuuccuccacagagcuggcaguga

SEQ ID NO: 52823 - RNA, 1308 nt, Artificial Sequence
  derived and/or modified sequence opt3 from AP1M1__Homo_sapiens__NP_001123996
augagcgccuccgcuguguacguccuggaccucaagggcaaaguucuuaucugcagaaacuauaggggagauguggacaugucugagguagaacacuucaugcccauucugauggagaaggaagaggaagggauguugucaccuauauuagcacaugguggcgugcgguuuauguggaucaaacacaauaaccuguaccuagucgccaccaguaagaaaaaugcgugugugagccucguuuucuccuuucuguauaaggugguccagguguucucugaguacuuuaaggagcuugaagaggaaucgauucgcgauaacuucguaaucauuuaugagcuguuggacgagcucauggauuuuggguacccacaaacaacugacucaaaaauccugcaggaauauauaacgcaggagggacauaagcuggaaaccggcgcuccgcgacccccugccacaguuacuaaugcagugagcuggcguagugaggguaucaaauacagaaagaacgaagucuuccucgaugugauugaguccgugaauuuacuggggaaauacccaggagucggcuggcuuggccacaccguuucugccaacgggaauguguugaggagcgagaucguaggauccauuaagaugcggguguuucugucagguaugcccgaacuacgccucggccugaacgacaagguccuuuucgauaauacagggagaggaaaaaguaagagcguggagcuggaagacguuaaauuucaucagugcgugagguugucucgguucgagaacgaucgcaccaucuccuuuauaccuccagacggcgaguucgagcucaugucauaucgacugaauacucacgucaagcccuuaauuuggaucgagagcgugauugaaaaacacagucauucuagaaucgaguacaugaucaaggcuaaaucccaauucaagaggcggagcacagcaaacaauguagaaauucacauaccuguuccaaacgaugccgacucgccgaaguuuaaaaccacgguggguucugucaagugggugcccgagaacuccgaaaucgucuggucaauuaaaaguuucccugggggaaaggaguaucugaugcgugcucauuuuggccucccaagcguggaggccgaagacaaagagggcaagcccccuaucuccguuaaguucgaaauaccauacuuuacuaccucugggauucaggugcgcuaucuuaaaaucaucgaaaagagcggauaccaggcgcugcccuggguaagauauauuacacagaauggugauuaccaauugaggacucaguga

SEQ ID NO: 52824 - RNA, 1272 nt, Artificial Sequence
  derived and/or modified sequence opt3 from AP1M2__Homo_sapiens__NP_005489
augagcgccuccgcuguguucauccuggacgucaagggcaaaccccucauuucuagaaacuacaagggggauguugcaaugucaaaaauagagcacuuuaugccucuucuggugcagagggaagaggaaggagccuuggcgccauuacugagucauggucaaguacacuuccuauggaucaagcauagcaaucucuaucugguggcuaccacauccaaaaacgccaaugcaucucuugucuacucguuucuguauaagacuauugagguguucugcgaauacuuuaaggaguuggaggaagagucaauccgggacaacuucguuauuguguaugaacuccuggaugagcugauggacuuuggcuucccgcagacgaccgauagcaaaauccuccaggaguacauaacacagcaaaguaauaaguuagaaacugggaaaucccgcgugcccccuaccgucacaaacgccguaucuuggcgaagcgagggaaucaaguauaaaaagaaugaaguuuuuauugacgugaucgaguccgucaaccugcuugugaaugcuaacggcucaguguugcugagugaaauugucgguaccaucaagcuaaaaguuuuccucagcgggaugccagagcugcgucuuggacugaaugauagaguguuguuugagcucacuggcaggucuaagaacaaauccguagaacuggaggacgugaaguuccaccaguguguccgguuaucacgcuuugauaaugacagaacaauuagcuucauacccccugauggcgacuucgaacugaugaguuacaggcucucuacccaggugaaaccacuuaucuggauugaguccguuaucgaaaaguuuagccauucgcggguggagaucauggucaaagcaaaggggcaguucaagaaacaaucuguggccaacggaguagagauuuccguucccgugccuucagaugcugacaguccacgcuuuaagacgagcgucgguuccgccaaauacgugccggaacgaaaugucgugauauggucuaucaagagcuuccccggcgggaaagaguaucugaugagagcgcacuuuggauugccuucaguugaaaaggaggaaguggagggcaggccacccauugguguaaaguucgagaucccuuacuuuacugucagugggauacaggugcgguauaugaaaauuaucgaaaaguccggauaccaggcacuaccauggguucguuauaucacccagagcggcgacuaccaacugcgcacaucuuga

SEQ ID NO: 52825 - RNA, 477 nt, Artificial Sequence
  derived and/or modified sequence opt3 from AP1S1__Homo_sapiens__NP_001274
augaugagauucaugcugcucuuuagcaggcagggcaaacuucggcugcaaaagugguacuuggccaccuccgacaaggagcgcaaaaagauggugcgagaauuaaugcaggucguucuggcucguaaacccaagaugugcucuuuccuagaguggagagaucucaaggugguauauaaaagguacgcaucacuguauuuuuguugcgccaucgaagggcaggacaacgagcuuauuacacuggaauugauacaccgguacguggagcuccuggauaaguauuucggaagugucugugagcuggacaucauuuuuaauuucgaaaaagcguacuuuauccucgaugaguucuuaauggguggcgacgugcaggauacuagcaagaaauccguucugaaggcuauugaacaagccgaccuuuugcaggaggaggaugaaucuccucgcucggugcuggaggaaauggggcuagcauga

SEQ ID NO: 52826 - RNA, 483 nt, Artificial Sequence
  derived and/or modified sequence opt3 from AP1S2__Homo_sapiens__NP_001259000
augcaguucaugcugcucuuuagcagacaaggcaaacuuaggcugcagaagugguacgugcccuuguccgacaaggagaaaaagaaaaucacccgggaauuaguccagacaguucuggcccgcaagccuaagaugugcucuuuccuagaguggcgagaucucaaaauuguguauaagcguuacgcuucacuguauuuuuguugcgcaauagaagaccaggauaacgagcuuaucacucuggaaauuauccacagauacguagaguugcucgacaaauauuucgggagugugugugagcuggauauuaucuuuaauuucgaaaaggccuacuuuauacuggacgaguuccucuuaggaggugaaguccaagagacgagcaaaaagaacgugcugaaggcgaucgagcaggcugaucuuuugcaggaagacgccaaagaggcagaaaccccaagguccguucuggaggaaauuggccuaacauga

SEQ ID NO: 52827 - RNA, 465 nt, Artificial Sequence
  derived and/or modified sequence opt3 from AP1S3__Homo_sapiens__NP_001034658
augauccacuucauucugcucuuuagcagacagggcaaacuuaggcugcaaaagugguacauaaccuugcccgacaaggagcggaaaaagaucacacgcgaaauugugcagaucauuuuaucccgagggcaucguacuucuucauucgucgauuggaaagagcugaagcuaguuuauaagagauacgccagucucuauuuuugcugugcuaucgaaaaccaggacaaugagcugcuuacgcuggaaauagugcacagguacguagaguugcucgauaaauauuucggaaacgugugcgagcuggacaucauuuuuaauuucgaaaaggcauacuuuauccuggaugaguucauuaucgguggcgaaauacaggagaccagcaaaaagauugccgucaaagcgaucgaggacuccgauaugcuccaagaaacaauggaggaauauaugaacaagccuacuuuuuga

SEQ ID NO: 52828 - RNA, 2934 nt, Artificial Sequence
  derived and/or modified sequence opt3 from AP2A1__Homo_sapiens__NP_055018
augcccgccgugagcaagggcgacgggaugagaggacuggcugucuucaucuccgauauuaggaacugcaaaucuaaggaggcagaaauaaaacggaucaauaaggagcucgccaacauucgcucaaaauuuaagggugacaaggcgcuugauggcuacaguaaaaagaaauauguuuguaagcuguuguucaucuuuuuacuggggcacgacauugauuucggacauauggaagcugugaaucuacucagcuccaacaaauacaccgagaagcagaucggcuaucuguuuauaucuguacuugucaauucgaacucagaacugauccgauugauuaauaacgccaucaagaaugaccucgcaagccguaacccuacauucaugugccuggcccugcacuguauugcuaauguggguaguagagagaugggggaggcauuugccgcugauaucccaaggauacucguggccggagacuccauggauucuguuaaacaaagcgcggcauuaugccugcuucgguuguacaaggccuccccggaccuggugcccaugggcgaauggacugcucgcgucgugcaucuacucaacgaucagcacaugggcguaguuacggccgcagugucacugauuaccugucuuugcaaaaagaauccugacgauuucaaaacaugugucagucuggcugugagcagauugucuaggaucguguccucagccagcacugaccuccaggacuauaccuacuauuuugucccagcgcccuggcugaguguuaaguuacugcggcuccuucagugcuacccuccacccgaggaugccgcagugaaagggcgccugguagaauguuuggagacagugcuaaacaaggcucaagagccuccaaagucuaaaaagguccagcauuccaaugccaaaaacgcuauucuguucgaaaccaucagccucaucauucacuacgacucggagccgaaccugcuugugcgagccugcaaucagcugggacaguuuuugcaacacagagaaacuaaccucagguaucuggcauuagagucuauguguacacuggccuccucagaauuuagucaugaggcuguuaagacccacauagauacggugaucaaugcgcuaaaaacugagcgggacgucagcgugcgucagcgcgcagccgaucuccuguacgcuaugugcgacagauccaacgccaagcagauuguaucugaaaugcuuagguauuuggagaccgcagauuacgccauccgggaagagauaguucugaagguggcuauucucgccgaaaaauaugcagucgacuacagcugguauguggauacaauccugaaucuuauccgaauugcgggugacuacgucucagaggaggugugguaccgcguucugcagaucgugacuaacagagaugacguacaaggcuaugcugccaagaccgucuuugaagcauugcaggcccccgcuugccaugagaauauggugaaaguugggggauacauucucggcgaguucgguaaccugauagccggggacccuaggaguuccccacccgugcaguucagcuuacugcacucuaaguuucaccuauguucagucgcaacacgggcucuccugcuuaguaccuauaucaaauucauuaauuuguuuccugaaacgaaggccacuauccaaggagugcugcgcgcgggcagccagcucagaaacgccgauguagaacugcagcagagggcuguggaguacuuaacacuguccucuguugcaucgaccgacguccuugccacuguguuggaggaaaugccacccuucccggagcgugaaagcuccauccucgcuaagcugaaacggaagaaaggcccuggggccggaucagcacuagaugacggucgaagagaucccaguucuaaugacauuaacggcgggauggagccaacaccuagcaccguguccacgcccucaccaagcgcggaucugcucggacugagggccgcucccccuccagccgcaccgcccgcuucugccggcgcagguaaucuuuuggucgacguuuuugaugggccugccgcucaaccaucccugggccccaccccugaggaagcguucuuaagugagcucgaaccacccgccccggagagcccuauggcacugcuugcugacccagcccccgccgcugauccuggacccgaagacauaggcccaccuauccccgaggcagaugagcuguugaacaaguuugugugcaaaaauaacgggguacucuucgaaaaccagcugcuacagauuggagugaagucugaguuucgccagaaucugggucggauguaucucuucuacggcaacaagacauccguccaauuucagaauuucucaccaacugugguucauccgggggaccugcagacccagcuugccgugcaaacaaaaagagucgcggcucagguggacggaggcgcccagguucagcaaguguugaacaucgaaugucugagggauuucuuaacuccuccccuccugaguguacgcuuccgauaugguggggcaccacaggcccuuacccugaagcuacccgucacaauuaauaaauucuuucagccuaccgagauggcugcacaagacuucuuucagcgguggaagcagcucagccugccacagcaagaagcccagaaaaucuucaaggcgaaccaccccauggaugcugaggugacuaaagccaaguugcugggcuuuggaucggcauuacucgacaauguggauccuaacccggagaauuucgucggcgccgggauaauccagacgaaggcucugcagguuggaugccuucugcguuuggaaccaaacgcccaagcacagauguacagacucacacugaggaccuccaaagagcccgugucucgccaucuaugugaacugcuugcucagcaguuuuga

SEQ ID NO: 52829 - RNA, 2856 nt, Artificial Sequence
  derived and/or modified sequence opt3 from AP2B1__Homo_sapiens__NP_001025177
augaccgacagcaaguacuucacaacuaacaaaaagggcgagaucuuugaacugaaagccgagcucaauaacgaaaagaaagagaagagaaaggaagcugugaaaaaggucauugcagccaugacgguugggaaagauguguccucucuuuuccccgacguagugaauugcaugcagaccgauaaccuggaguugaagaaauuagucuaucuguaccuaaugaauuaugcgaagucacaaccugacauggcuauaauggccgugaacaguuuuguuaaggauugugaggacccaaauccgcucaucagggcacuggccgugcggacaaugggaugcauucgcgucgauaaaaucacugaauaccuuugugagccccugcgaaagugcuugaaagacgaagauccuuaugugcguaagaccgcugcaguauguguugccaaacuccacgacauuaacgcucagaugguggaggaucaggguuuccuggacagccugagagaucucaucgccgacuccaauccaauggucguggcgaacgcaguggccgcuuuaucugagauaucggaaucacaucccaauagcaaccugcuugacuugaauccucagaacaucaauaagcugcuaacagcccucaacgagugcaccgaauggggccaaauuuuuauccuggauugucuuaguaacuacaauccaaaagacgauagggaggcacaguccauuugcgaacgggucacuccccgccugucucacgcuaacagcgccguuguguuguccgcgguaaaggugcucaugaaguuccuggaguuacugccuaaagacucagauuauuacaauaugcuccuuaagaaacuggccccaccguuggucacacuacugaguggggagcccgaagugcaguacguugcacucagaaacaucaaucugauagugcagaagaggccugagauucuuaaacaagaaaucaaggucuuuuucgugaaguauaacgacccaauuuacguaaaacuggagaaguuggauaucaugauccggcucgcuagccaggccaauauugcucagguucuggccgaauuaaaagaguaugcaaccgagguggacgucgauuuugugcgcaaggccguccgagcuauaggaagaugugcgaucaaaguggaacagucugcagagaggugcguuuccacgcugcuagaccucauucaaacuaaggugaacuacguaguccaggaagccaucgugguuauacgggauauuuuccguaaguaucccaauaaauacgagucaaucaucgcuacccugugugaaaaccuugacagcuuggacgagccugaugcccgcgcagccaugauuuggaucgugggcgaguaugcugaaagaauugacaaugccgaugagcugcucgaaaguuuucuggaggguuuccaugacgagucuacacagguccaacuuacucuguugaccgcaauagugaagcucuuucugaaaaagccauccgaaacacaggaguuaguacaacaggugcugagccuagcgacccaggauucggacaaccccgaucucagggaccggggguacaucuacuggcgacugcuuucuacggauccgguuacugcuaaagaagucguguuguccgagaagccucugauuucagaagagacagaccucaucgagcccacccuguuagaugaacugaucugccacauuggaagucuugccagcguguaucauaagccaccuaaugcauucgucgagggcucccacggcauacaccgcaaacauuugcccauccaccaugggucuacugacgccggagauagcccaguugguacaaccacggcuaccaaccucgaacagccccaggugauuccuucacagggcgaccugcuaggggaccugcucaaucuggaucuuggaccaccggugaacguaccccaagucaguuccaugcagaugggcgccguggacuugcugggugggggauuagauagccuccugggcucugaccuuggcgggggaaucgguggcucaccggcaguugggcagaguuucauuccaagcuccgugcccgcuacauuugccccuucuccaacucccgcggucgugucgagcggacugaacgauuuguucgagcucuccaccggcaucgguauggccccugggggcuacguugcuccuaaggcaguguggcugccagccguaaaagcuaagggacuagaaauaucaggcacauuuacucacagacaggggcacaucuauauggagaugaauuucaccaacaaagcccugcaacauaugacagacuuugcaauucaguucaauaagaacaguuuuggagucauccccucuaccccucucgcgauucacacuccccugaugccaaaucagagcaucgaugugucccuuccuuugaacacgcugggucccgugaugaaaauggagccauuaaauaaccuccaggucgccguuaagaauaacauagacguguucuacuuuucaugccugauuccgcuuaauguacuguucguggaagauggcaagauggagaggcaagucuuucuagcuacauggaaagacaucccuaacgaaaaugagcuccaguuccagauuaaggaaugucaucugaacgccgauaccgugagcucuaaauugcaaaauaacaacguuuauacuaucgcaaagcggaauguggaggggcaggacaugcuguaccaguccuuaaaacucaccaacggaauauggauccuggcugagcuucgcauucagcccggcaauccaaacuauacacugaguuugaagugcagagcccccgaagucagccaauacaucuaccagguguaugauucuauucucaagaauuga

SEQ ID NO: 52830 - RNA, 1302 nt, Artificial Sequence
  derived and/or modified sequence opt3 from AP2M1__Homo_sapiens__NP_001020376
augaucggcgggcuguucauuuacaaccacaagggagaggugcucauaagcagagucuauagggacgauaucggucggaaugccguugacgcuuuucgcgugaacguaauucaugcacgacagcaagugcguucccccgucaccaauaucgccagaacaucuuucuuucacgugaaaaggucaaacauuuggcuugcggcuguuacuaagcagaaugugaacgccgcaauggucuucgaauuucuguacaaaaugugcgaugugauggccgcuuauuucggcaagaucagugaggaaaauaucaaaaacaauuuuguauugauauacgaguuacuggacgaaauucuagauuucggguauccucagaacagcgagacgggagcacucaagaccuuuaucacacagcaaggcauuaagucccagacuaaagaggaacagucucagaucaccucgcaaguuacaggucagauaggguggcggcgcgagggaauuaaguacagaaggaaugaacuguuccuugacgugcuggagucagucaacuugcucaugagcccacagggccaggugcugagugcccauguguccggccgggucguuaugaaaucuuaucugagcgggaugccggaguguaaguuuggaaugaaugauaaaaucgugauugaaaagcaagguaagggcaccgcugacgagacuuccaaaucagggaagcagaguaucgccaucgaugacugcacauuccaccaguguguacgccucagcaaauuugauucugaacgauccauuucauucauacccccugacggagaguucgaauuaaugagauacaggaccacgaaggauaucauucugccauuucgggugaucccccuuguccgugaggugggccgcacuaaauuggagguuaagguggucauaaaaagcaacuucaagccuagucugcuagcgcaaaagauugaagugagaaucccaacaccccucaauaccucugguguacagguuaucugcaugaaagggaaggcaaaauacaaggccuccgagaacgcuauuguguggaaaaucaagaggauggccggaaugaaggaaagccagauuucggcagagauagaacugcuuccuacuaacgacaaaaagaaaugggcucggccaccgaucucuaugaauuuugagguccccuucgccccuuccggccugaaggugcgauauuugaaagucuuugagccaaagcucaacuacucagaccaugaugugauuaaguggguucgcuauaucggcagaagugggaucuacgaaaccagguguuga

SEQ ID NO: 52831 - RNA, 429 nt, Artificial Sequence
  derived and/or modified sequence opt3 from AP2S1__Homo_sapiens__NP_004060
augaucagauucauucugauacagaacagggccggcaagacccggcucgcuaaaugguacaugcaauuugacgaugacgagaagcagaaacuuaucgaagaggugcacgcagucguuacagugcgcgaugccaagcauacuaauuucguagaauuucgaaacuucaaaauuaucuaucguagauacgcggggcuguauuuuugcauuuguguggacgucaaugauaacaauuuggcuuacuuagaggccauccacaacuucguggaaguucugaaugaguauuuucauaacgugugcgagcuagaccucgucuucaauuuuuacaagguguauacgguaguugaugaaauguuccuggcaggagagauaagggaaaccagccagacaaaggugcuuaaacagcuguugaugcuccaaucccuggaguga

SEQ ID NO: 52832 - RNA, 3138 nt, Artificial Sequence
  derived and/or modified sequence opt3 from AP3B1__Homo_sapiens__NP_001258698
augcuggagagcaacaaggacuccgccaaacucgaugcuaugaagagaaucgugggcaugauugcaaaagggaagaaugccucugaacuuuuccccgcggucguuaaaaacguggcuucaaagaauauagagaucaagaaacugguauacguguauuuggucagguacgccgaagaacagcaagacuuagcacugcuaaguauuagcaccuuucagcgggcccucaaggauccuaaccagcugauccgcgcuuccgcacuucgagugcugucuucgauucguguuccaaucauagugccgaucaugauguuggccauuaaagaggcuucagccgaccucagccccuaugucagaaagaaugcggcacacgccauccagaaacuguacagucuggauccugagcaaaaggagaugcucauugaagugaucgagaaguuacugaaagacaaguccacacuuguagcuggaucuguugugauggccuucgaagaggucugcccagauaggauagacuugauucauaaaaacuaucggaagcuguguaaucuacucguggauguggaggaauggggucaggucguuaucauucacaugcugacucgcuacgcaagaacgcaguuugugagccccuggaaagagggcgacgaacuugaggauaacgggaagaauuucuaugaauccgacgaugaccagaaagagaagaccgacaagaaaaagaaaccuuacacaauggauccagaccauaggcuguugauccggaacacuaagccccuccugcaaucacgcaaugcugccguagugauggcggucgcccaguuauacuggcacaucaguccuaaaagcgaggcaggaauuauaucuaagucccuggugcgacuccuuagaucaaacagggaaguucaguauaucgugcugcagaauauugcuaccaugagcauccaacggaagggcauguuugagccauacuugaaaaguuucuauguccguucuacagauccgaccaugauaaagacucuaaaacuggaaauucucacaaaccuggccaaugaggcuaacaucuccacccuucugcgcgaauuucagacguacgugaagucccaggacaaacaauucgccgcagccacuauccagaccauugguagaugcgcuacaaacaucuuggagguaacugauaccugucucaaugggcugguuugcuuacugucgaacagggacgagauuguggucgcggaaucuguggucgugauaaagaagcuacuccagaugcagcccgcacaacauggagagaucauuaaacacauggccaagcugcuugauuccaucacaguuccuguggcucgggccucaaucuuguggcugauuggcgaaaauugugagcgaguaccaaaaauagcacccgacguccuccgcaagauggccaaaaguuuuaccagcgaagaugaccuggugaaacuucagauccugaacuugggcgcuaagcucuaucugacgaauagcaaacagacuaaguuacugacacaguacauucuaaaccucgggaaauaugaucaaaauuacgacaucagagacaggacccgguucauucgccagcugaucguuccuaacgugaagucuggagcccuuagcaaauacgcaaagaaaauauuuuuggcgcagaagccagcuccccugcucgagucaccguucaaggauagagaccacuuucagcuggguacuuuaagucauacacugaauaucaaagccaccggcuaucuugaguuguccaacuggccugaagucgcacccgauccaagcgugaggaauguagaggugauugaacucgccaaggaguggacgccugcugggaaagccaagcaagagaacucugcaaagaaguucuacucagaaagugaggaagaggaagacagcuccgauucuucgagcgacuccgagucagagaguggaucugaaagcggcgagcagggugaauccggggaggaaggagauucaaaugaggacagcucugaggauuccaguagcgaacaggacucugaguccggccgugaaucaggccuggagaacaagcggaccgcuaaacgaaauaguaaggccaaaggaaagagcgauucggaagacggggagaaagagaacgaaaaguccaagacaucugauagcucaaacgacgagaguuccucuaucgaagacagcuccucagauagcgagagugagucugaacccgaguccgaaagcgagucgagaaggguuacuaaagaaaaggagaaaaagaccaaacaggaccgcacaccacuaacuaaggaugucucacugcucgaccuggaugacuucaaucccgugucuaccccuguggcgcuuccaacaccggccuugagucccucccugauggcugauuuagagggucuccaccugagcaccucuagcuccgucauuucaguuaguacuccugcauuugugccaacgaagacacaugugcuucugcaccggaugagcggcaaaggguuggccgcucacuauuucuuucccagacaaccuugcaucuucggagacaagaugguaucuauacagauuacccucaacaauacuaccgauaggaaaaucgaaaacauucauaucggcgagaagaaacugccaauagguaugaagaugcacgucuuuaaucccaucgacucccuagaaccggaggggucaauuacagugaguaugggcaucgauuucugugacagcacccagacugccuccuuucaacugugcacaaaagaugacuguuucaacguuaauauucagccuccagugggagaacuccugcuucccgucgcaaugucugagaaggacuuuaagaaagagcagggcguguugacggggaugaacgaaaccucggcgguuaucauagccgcuccucagaauuucacucccagcgugauuuuucaaaagguagucaacguggccaaugugggagcagucccaucaggucaggauaacauccaucgcuucgcugccaaaacaguucacuccggcagucugauguuagugaccguagagcucaaggaagggucuacagcacagcugaucauuaauacugagaaaaccgugaucggaagcguccuucugcgagaacuaaagccugugcucucccagggcuga

SEQ ID NO: 52833 - RNA, 3648 nt, Artificial Sequence
  derived and/or modified sequence opt3 from AP3D1__Homo_sapiens__NP_001248755
auggcccugaagauggugaaaggcagcaucgacagaauguucgauaagaaccuccaggaccuugucagggggauucggaaucacaaagaggaugaagcuaaguacauaucccaaugcaucgacgagauuaaacaggaacugaagcaggauaacaucgcaguuaaggccaaugcgguguguaaauugaccuauuuacagaugcugggauacgacauuucuugggcugccuuuaacaucauagagguaaugucagcaaguaaguucacauuuaaacgcaucgguuaucuagccgcuagccaauccuuccaugaaggcacugaugugauuaugcucacgaccaaucagauccgaaaggaccugucuucgcccucacaguacgauacaggggucgcacuuacuggacugagcugcuuugugaccccugacuuggcccgugaucucgcuaacgacauuaugacacugaugagucacaccaaaccauauaucagaaagaaggccguucugauaauguacaaaguguuccucaaguauccggaguccuuaaggcccgcguuuccucggcugaaagagaaacuugaagauccagaccccggcguccagucugcagccgugaauguaauuugugaguuggcucgcagaaacccuaaaaauuaccugagccuagccccacucuucuuuaagcugaugacuuccucaacaaacaauuggguucuuaucaaaauuaucaagcuguucggugcauugaccccucucgaaccuaggcuggggaagaaauuaaucgagccacugacgaaccucauucauaguacuagcgcuaugucucuucuguacgagugcgugaauaccgucauagccguguugaucucccuaucaagcggaaugccgaaccacagugcgucuauucaacugugugugcagaagcuccggauccugauagaagacuccgaucagaaucuuaaauaucugggcuugcucgccaugagcaagauucugaaaacacaucccaagucgguccagucucacaaggacuuaauccugcaaugccuagaugacaaagaugaguccauccgccuccgagcacuggaccuuuuguacggcaugguuucaaagaaaaaccugauggaaauugugaagaaacucaugacucacguagauaaggcugaggggaccacauauagagacgaacugcuuaccaagaucauugauauauguagucagagcaacuaccaguauaucacgaauuuugagugguacauuuccauccugguggaguugacuaggcucgaaggaacacggcauggucaccugaucgccgcucaaauguuagacgucgccauucgugugaaagcaauacgcaaguucgccguuucucagaugagcgcucugcuagauucagcgcaucuccuggcaaguuccacccagagaaacggcaucugcgaggugcuuuaugccgcugccuggauuuguggggaauuuagcgagcacuugcaggaaccucaccauacucuggaggcaaugcucaggccacgggucacaacccugcccggacacauccaagccguguacguacagaauguugugaaauuauacgcuucuauucugcagcagaaggagcaagccggcgaagcagagggugcgcaggcugucacgcagcuuaugguggaccgauugccucaguucguccaaucagccgaccucgaagugcaggagcgcgcaaguugcauccugcagcuaguuaaacauauacagaagcugcaagccaaggaugugccaguagcugaagaggucagcgcccucuucgcaggggagcugaaccccguggcuccgaaagcccagaagaaaguuccugugcccgaaggacuugacuuggaugcguggaucaaugagccacuguccgacucugaaucggaggaugagagaccuagggccgucuuucacgaagaggaacagcggcgccccaagcauagaccaagcgaggcugacgaagaggaguuagcaaggcgucgggaagcccgaaaacaagagcaggcuaacaaucccuucuauauuaaguccucaccuaguccacagaaaagauaccaggauaccccgggcguggaacacauccccguagugcaaauugaccucucuguuccucugaaggucccaggccuucccaugagcgaucaguaugugaagcuggaggaagagaggcgccaccggcagaaauuggagaaggacaaaagaaggaagaaacgcaaggaaaaggagaaaaaggggaaacgacggcauuccucacucccuacagaaagcgaugaggacaucgccccagcacagcaaguggauauagucacugaagagaugcccgagaacgcgcugccgucugacgaagacgauaaggacccuaaugauccauaccgugcccuagacauugaucuggacaaaccccucgcugauuccgagaagcugccuauccagaagcacagaaacaccgaaacaaguaaaagccccgagaaggacguuccaaugguggagaaaaagucuaaaaagccuaagaaaaaggaaaagaagcauaaagagaaggaaagggauaaagagaagaagaaagaaaaggagaaaaaggccgaggaccuugauuuuugguuguccacuacacccccaccggcacccgcucccgccccagcacccgugccuucaaccggagaacugaguguaaauaccgucacuacgccaaaagacgagugugaagaugccaagacagaggcucagggugaagaggacgacgcggagggccaggaucaagacaagaaaagccccaagccuaaaaagaaaaagcaccgcaaggaaaaagaggaacggaccaaggggaaaaagaaaucgaagaagcagccgccaggauccgaggaagccgcaggcgagcccgugcagaacggugcuccugaggaggaacaauuaccacccgaaucuagcuauucacuccuggccgagaauaguuacguuaaaaugacuugcgauauuagagggucccuucaggaggacucucaggugaccgucgccaucgugcuggaaaacaggagcuccucaauacuaaagggcauggagcucagcguucuggauaguuugaaugcucgaauggcacgcccucagggaucuuccgugcacgacggcguaccgguccccuuccaacugccaccuggggugagcaacgaagcccaguauguguuuacaauccagucgauugucauggcgcagaaauuaaagggaacccucucauucaucgcuaaaaacgaugagggugccacucaugaaaagcuggacuuucggcuucacuucucuugcaguuccuaccugauuacaacgcccuguuacagcgaugcauuugccaaguugcucgagucuggcgaccugagcauguccucaaucaaaguugaugggauaagaaugaguuuccaaaaucuacuggcuaagauuugcuuucaucaccauuucagcgugguagagaggguggacucuugugcauccauguauucacguaguauccagggacaccacgucugccuucucgugaaaaagggcgaaaacagcguuuccguggacgguaaauguucugauucgacccuguugagcaaucuguuagaggaaaugaaggccacucucgcgaaaugcuga

SEQ ID NO: 52834 - RNA, 1257 nt, Artificial Sequence
  derived and/or modified sequence opt3 from AP3M2__Homo_sapiens__NP_006794
augauccacagccuguuccucauuaacuccucuggcgacauauuucuugagaagcauuggaaaucaguggucaguagaagcguuugcgauuacuucuuugaagcccaggagagggcuaccgaagcagagaaugugcccccuguaaucccaacaccgcaccauuaucuguuguccguguaccggcacaagauuuucuuugucgccgugauccaaacugaaguucccccuuuauucgugauugaguuucugcaucgcgucguggacacguuccaggauuauuuugggguauguucugagccaguuaucaaagacaacguggucgugguguacgaaguccuagaggaaaugcucgauaauggauucccccuggcgaccgagucgaacauacuuaaggagcugaucaaaccuccaacaauuuugcgaacuguugugaauaccaucacagguucaaccaacguaggcgaccagcuccccacugggcagcugagcguggucccuuggcguagaacaggagugaaguauaccaauaacgaggcuuacuuugauguuauugaagaaaucgacgccauaauugauaagaguggcuccacgaucacugcagagauucaaggugugaucgacgccugcgucaaacugaccgggaugccagaucucacauuaucuuucaugaauccgaggcugcuugacgaugugagcuuucaccccuguguacgguucaagcgcugggaauccgagagaaucuugucauucauuccuccagacggaaacuuuaggcugcuaaguuaucacguuagcgcucagaaucucguggcaauacccgucuacgugaaacauaacaucucuuuccgggacuccucaagccugggccgcuuugagauuacugucggcccuaagcagaccauggggaaaacaaucgaaggagugaccguuacgagucagaugccaaagggugugcuuaauaugucucugacucccucccaaggcacacacaccuucgauccgguaacuaagauguugagcugggacgucgggaaaauaaacccucagaagcuccccucgcugaaaggaacaaugucuuuacaggccggcgcuuccaagccagaugagaauccuaccauuaaccugcaguuuaaaauccaacagcucgccaucucaggucuuaaggugaaccgacuggacauguacggggaaaaauauaagcccuucaagggaauuaaauacaugacgaaggcgggcaaauuucagguuagaaccuga

SEQ ID NO: 52835 - RNA, 582 nt, Artificial Sequence
  derived and/or modified sequence opt3 from AP3S1__Homo_sapiens__NP_001275
augaucaaggccauucugauauucaacaaucacggcaaaccaagacucagcaaguuuuaccagccuuauuccgaggacacccaacagcagaucauuagggaaacauuccaucuugugucuaaacgggaugagaacgucugcaauuuucuggaagggggauuguuaaucgguggcucagacaacaagcugauuuaccgccacuaugcuacucuauacuucguguuuuguguugauaguagcgaguccgaacucgggauccuggaccuuauacagguauucguggagacgcuggauaaaugcuuugagaaugucugugaauuggaccucaucuuccauguggauaagguucacaacauucuggcagagauggugaugggaggcaugguccuggaaaccaauaugaacgagaucgugacacaaauugacgcccagaauaagcucgagaaaucugaagcggguuuagcuggggccccagcacgagccguaucggcuguuaagaacaugaaucugccggagaucccccguaacauaaauauuggagauaucucaauuaaagugccuaaccuucccagcuuuaaguga

SEQ ID NO: 52836 - RNA, 582 nt, Artificial Sequence
  derived and/or modified sequence opt3 from AP3S2__Homo_sapiens__NP_005820
augauccaggccauucugguguucaacaaucacggcaagcccagacucgucagguuuuaccaacgguucccugaggaaauacagcagcagaucguucgcgagaccuuucaucuugugcugaaacgagacgauaacauuugcaauuucuuggaaggggguagcuuaaucggaggcuccgacuauaagcugauuuaccgucacuaugcuacacuauacuuuguauucuguguggauucuucagagagugaacucgggauccuggaccuuauacaagucuuuguggagacucuggauaaaugcuucgagaacguuugugaauuggaccucaucuuucauauggauaaggugcacuauauucugcaggaggucgugaugggaggcaugguacuggaaacgaauaugaacgagaucguugcacagauugaggcccagaauagacucgagaaaagcgaagguggguuauccgcggcuccagccagggcagugucugccgucaagaacaucaaucugccggaaauaccccggaacauuaauaucggagaccuuaacauuaaggugccuaauuugucgcaauucguguga

SEQ ID NO: 52837 - RNA, 1995 nt, Artificial Sequence
  derived and/or modified sequence opt3 from AP4B1__Homo_sapiens__XP_011538826
augcccuaccugggcagcgaggacguggucaaggaacucaaaaaggcccuuugcaauccucacauccaggcugauagacugagguaucggaauguuauucaacgcgugauacgaaugccagggguacaggaguacauccagcagccgauuuugaacggauuacgugacaaagcauccuaugugagaagggucgccgugcuggguugugcgaagaugcauaaucuacacggcgauucugaaguugacggggcucucgugaacgagcuguacucacuucugcgggaucaagaccccaucgucgugguaaauugcuugcgcagucucgaagagauucugaaacaggagggaggcguugugaucaacaagccuauagcccaucaucugcucaauagaaugagcaaguuagaucaguggggucaggcagaaguccugaacuuccuuuugagguaucaaccacgguccgaggaggaacuguuugacauccuaaaucuccuggauucuuuccuuaaaucgucaagccccgggguggugaugggagccaccaagcuguuuuugauucucgcuaaaauguucccucacguccagacagacguucuggugcgcguaaagggcccauuacuggcagccuguaguuccgagucucgagaacucugcuuuguggcucuuugucacgucagacagauccugcacagcuugcccggccauuucuccucacacuacaaaaaguuuuucugcaguuauagcgagccucauuacauuaagcuacagaaaguggaaguucugugugagcucgugaacgaugaaaauguccaacaggugcuggaggagcuuaggggguacugcacugacguaucugccgauuuugcgcaggcagccaucuucgcuauaggagguauugcccggacguauaccgaccaauguguucagauccugacagaauugcucggccugcgucaggagcacauuacuaccguggucgugcagacauuucgcgacuuagucuggcugugcccacaauguaccgaagcagugugccaggcucuaccggggugcgaggaaaacauccaggauuccgagggaaagcaggcccucaucuggcugcuuggcguucacggugagcggauucccaaugcgccuuacguguuggaagacuucguagagaacgucaaaucagaaacuuuuccagccgugaagauggagcugcucacagcacugcuuaggcuguucuugagccggcccgcugaaugucaagauaugcucgggcgacuguuauauuacugcauagaggaggaaaaagacauggccguucgcgauagaggacuguucuauuacaggcuacuccuggugggcaucgacgaggucaagcggauucuuuguaguccuaaaucugauccaaccuugggccugcucgaagaccccgcugagcgcccgguaaauuccugggccagcgauuuuaacacgcuggugccuguguaugggaaggcacauugggccacuaucucgaagugccagggagcugagagaugugaccccgaauuaccaaaaaccucuuccuucgcggcaucagguccucugauacccgaggaaaacaaggagaggguucaggaacuuccagauaguggcgccuugaugcucguccccaaucgucagcugacagcugacuacuuugagaaaacuuggcuaagccugaagguggcccaccaacaggugcucccuuggagaggggaguuccauccagacacccugcagauggcacuucaggucguuaacauucaaacaaucgccaugucccgagcuggaucuagaccguggaaagccuacuugagcgcacaggaugacaccggcugccuguuuuuaacggaacuccugcuugagcccgguaauucagaaaugcagaucagugugaagcaaaacgaggcgaggacugaaacacugaacuccuucauuagcguguuggagaccguaaucgggacuauugaggaaauaaagucuuga

SEQ ID NO: 52838 - RNA, 3414 nt, Artificial Sequence
  derived and/or modified sequence opt3 from AP4E1__Homo_sapiens__NP_031373
augagcgacaucguggagaagacccugacagcccuccccggccuuuuccugcagaaccaaccugggggagguccagcugcagccaaagcguccuuuucuucaagauugggcaguuuagucagggggauuacugcucugacgagcaagcacgaagaggaaaaacuaauacagcaggagcucuccucucugaaggccaccguuucggcaccgacaacuacccuuaaaaugaugaaggaaugcauggugcggcugaucuacugugagauguugggauaugaugccucauucggcuacauucaugcuaucaagcucgcacagcaagguaaucugcuggagaaacgcguaggguaucucgccgugagcuuauuucugcacgaaagucaugagcuuuugcugcuacucgucaacacagugguuaaggaccugcaguccaccaaucuuguggaagucugcauggcucugacugugguaucucagauuuuccccugugagaugaucccugccguuuugccacucauagaggauaaacugcagcacagcaaggaaaucgugcgacguaaagcggucuuagcacuguacaaguuucaucucauugcccccaaccaagugcagcacauccacauuaaguucagaaaagcucuuugcgacagggaugugggagucauggccgcaucccugcauaucuauuugcggaugauaaaggaaaauucaaguggcuacaaagaccuaacaggcagcuuuguuaccauucugaaacaggugguagggggaaaacucccuguggaguucaacuaucacucugucccagcucccuggcugcagauccaacuucugcgcauuuugggucuccugggcaaggaugaccagagaacguccgaguuaauguacgaugugcuggacgaaucacuaaggcgggccgagcucaaucauaacguuacuuacgcgauccuguuugagugugugcacaccgucuauagcaucuacccuaaaagugaacuuuuggagaaggccgcaaagugcauugggaaauucgugcugucuccaaagauaaaucucaaauaucugggacuuaaggcucugacauacguaauccagcaagauccgacuuuggcccuccagcaccagaugaccauuaucgaaugucuggaccaucccgauccuauaauuaaacgcgagacauuagaacugcuauaucgaaucaccaacgcucagaauaucacgguuauugugcaaaagaugcucgaguaccugcaccaguccaaggaggaauaugucaucgugaaccuugucggcaaaauugccgaguuggcagaaaaguacgccccagacaaugcuugguuuauacagacuaugaacgcgguguucagcguugguggggacgugaugcaucccgauaucccuaauaacuuucugagacuccuggcagagggauucgacgaugaaacagaggaccagcaauuaaggcuguacgccguacagucguaucuuaccuugcucgauauggagaacgucuucuacccacagcgguuucuucaggugaugucuuggguucuaggcgaauauuccuaccugcucgacaaagagacucccgaagaggugauugcuaagcuguauaaacuuuugaugaaugauucagucaguagcgagacaaaggccuggcugaucgcagccgugaccaaguuaacgucccaagcucacucuagcaacaccguagaacgucucauccaugaguucacaauuucacuggacacuugcaugcgccagcacgccuuugaacuuaaacaccuucaugagaauguggaauugaugaagagucuccugccgguugauagauccugugaggaccuagucguggaugcaagccugucuuuccucgacggcuuuguggcggaggggcugucacagggagcugccccuuacaaacccccacaccagaggcaagaagagaagcugagucaggaaaaagucuugaacuucgagccuuauggucugagcuuuuccucuucgggcuucaccgggcggcagagccccgcaggaauauccuuaggcucagacguuagugguaauucugccgaaacagggcucaaggagacuaacagccugaagcuggagggcaucaaaaagcuguggggaaaagaaggcuaccuaccaaagaaagaguccaagaccggggaugaaucaggagcucuccccgugccucaagagagcauuauggaaaauguggaccaggccaucacaaagaaggaucagucucagguacugacccaauccaaggaggagaaagaaaagcaguugcuggcaaguagcuuauuugucggucucggcucugaguccacuauuaaccugcuugggaaagcugacacggugucacauaaguuccgacgcaaaaguaagguuaaggaagccaaaagcggagagacaaccucgacucacaauaugaccugcuccucuuuuagcucacugaguaacguggcguacgaggaugacuauuacuccaauacauugcacgauaccggcgacaaggaacucaaaaaguucucucugacuagcgagcuacuggauuccgaaucacuuacagagcucccacuggucgaaaaauuuagcuauuguaguuugucuacgccgucccuguucgccaacaauaacauggagaucuuccaucccccucagagcaccgcugcaucgguggccaaggagucaucuuuagcuaguuccuuucucgaagagacuacagaauacauacacagcaaugccauggagguuugcaacaacgaaaccaucucugugagcuccuauaagauuuggaaagacgauugccugcuuaugguauggucagucacaaauaagaguggucuggaguugaaaagcgcagaccucgagaucuucccagcggaaaacuuuaaggugacugagcagcccggguguugccugccugugauggaagccgagucuaccaaauccuuccaauacucaguccagauugaaaagccauuuacggagggcaaucuaaccggauucaucaguuaucauaugauggauacacacagcgcucagcuggaguuuuccguuaaccuuucucuccuggacuucauaagacccuugaagauuucgagcgacgauuuuggcaaauuauggcugucauucgccaaugacgugaagcagaacguaaaaauguccgaaagucaagcagcucucccgucugcccugaagacucuucagcagaaacugagguugcauaucauugagaucauagggaaugaaggacuacuggcaugucaacuccugccuagcaucccaugccuuuuacacugucgggugcacgccgauguccuggcucucugguuucgcuccucaugcucuaccuugcccgacuaccugcucuaccagugucagaaggugauggaggguagcuga

SEQ ID NO: 52839 - RNA, 1362 nt, Artificial Sequence
  derived and/or modified sequence opt3 from AP4M1__Homo_sapiens__NP_004713
augaucagccaguucuuuauucuguccucuaagggcgacccccucauauacaaagauuucagaggggacucaggagguagggauguggccgaguuauuuuaucggaagcugaccggcuugccuggggacgaaaguccagucguuaugcaccaucacggacgccauuucauccacauucgacauagcggcuuauaccuggugguaacaacuuccgagaacgugucuccguuuucgcuacucgaacugcuuucacgucuggcuacguugcucggugauuauugcgggagccugggagagggcaccaucaguagaaaugucgcacugguguacgaacucuuagacgagguucuggauuauggcuacgugcaaacaacuuccaccgagaugcuuaggaacuucauucagacagaagccgucgugucuaaacccuuuagcuuguucgaccuguccucaguagggcuauuuggagcggagacccagcagaguaagguugcuccuagcucugccgcaucccggccagugcucucaagccgcagugaucaaucucagaaaaaugaagucuuccuggacgugguggagagacuuuccguccugaucgccagcaacgguucguugcucaagguugaugugcagggcgagauaaggcugaagucuuuucuucccuccgggucagaaaugcggaucggacugacugaggaguucuguguaggcaaaagugaacuccgcgguuaugggccuggcauucgaguggacgaagucagcuuucacuccucugugaaucuugaugaguucgagagccacagaauccugagguugcagccaccccaaggcgaacuaacaguuaugcgguaccagcugucagacgaccucccuaguccacugccguuccgucuuuuucccuccgugcagugggaucgcggcagcgggagacugcaggucuacuugaagcucaggugcgaccuguuaucuaaaucacaagcucugaacgugcggcuacaucucccucugccacgaggaguaguuagucuuagccaggaguuguccucucccgaacagaaggcagagcuggccgaaggugcucuccgcugggaucugccuagagugcaaggcgggucgcagcuuagcggacuguuccagauggacgucccaggacccccggguccucccucccacggguugucaaccagugccucuccacucggccugggaccugcgagcuuauccuuugagcugcccaggcauacguguucaggccuacaggugcgguuccuccgccuggcauuuagaccaugcgggaaugccaacccccacaaaugggucaggcaccuuagccauucugaugcuuaugugauucguaucuga

SEQ ID NO: 52840 - RNA, 435 nt, Artificial Sequence
  derived and/or modified sequence opt3 from AP4S1__Homo_sapiens__NP_001121598
augaucaaguucuuucugauggugaacaaacagggccaaaccagacucagcaaguacuaugagcacgucgacauuaauaaaaggacacuucuggaaacugagguuauaaaguccugcuugucucggucaaacgaacaguguaguuucaucgaguacaaagauuuuaaguuaauuuaucgccaguacgccgcucuguucaucgugguaggggugaaugacacggaaaacgagauggcaauuuaugaguuuauccauaauuucgucgaagugcuagaugaguacuuuagccgaguuuccgaacucgacauaauguucaaccuggauaaggugcacaucauucuugacgagaugguccugaauggaugcaucguggagaccaaccgugccagaauuuuggcgccccuccugauccuggauaaaaugucugaaucguga

SEQ ID NO: 52841 - RNA, 1473 nt, Artificial Sequence
  derived and/or modified sequence opt3 from AP5M1__Homo_sapiens__NP_060699
auggcccagagagcuguguggcugaucagccacgagcccggcaccccucucugcgggacagucagguucucccggcgcuacccaacuguugaaaagcgagcacguguguuuaacggagccucuuauguaccggugcccgaggacgguccuuuccuuaaagcgcuguuguuugaauuaagacugcuagaugacgauaaggacuucgucgagucaagggauaguuguagccggauuaauaaaacguccauauacggccuccugaucgggggagaagaacuuuggccagugguugcuuuucugaagaacgacaugauuuaugccugcgugcccuuggucgagcaaacccucucuccucgcccaccccugaucucggugucaggcguaagccaggguuucgaauuucuguucgggauucaggauuuucucuacaguggacagaaaaaugacuccgaguuaaacacaaagcugucucaacuuccugauuugcugcuacaggcauguccauucggcacucuccuggacgccaaucuucagaacagccuggauaauaccaacuuugcuuccguuacacagccgcaaaagcagcccgcauggaaaaccggcacuuauaaggggaaaccucaggugucaaucaguauaacagaaaaggucaaaagcaugcaguacgacaagcaaggaaucgccgauaccuggcaagugguggguacggucacuugcaagugugacuuggagggcauuaugccaaauguuaccaucucucucucccugcccacaaacgggucaccuuuacaggacauucuggugcauccaugcguaacuagccucgauagugcuauccuuaccucuuccagcauagacgccauggaugacucggcguucucuggacccuauaaauuuccguucacaccuccccuggaguccuucaauuuguguuuuuacaccucacaggugccagucccucccauucuaggcuucuaccagaugaaggaagaggaagugcagcugagaaucacgauuaaccucaaacugcacgagaguguuaagaauaacuuugaguucugcgaggcacauaucccauuuuauaauaggggucccaucacucaccuugaguacaaaaccagcuucgggcagcuggaaguguuucgggagaaguccuugcucauuuggauaaucggacaaaaauucccuaagucuauggaaauuagccugucaggcacagucacuuuuggcgccaagagucaugagaaacagccauucgauccgaucuguacaggggaaaccgcuuauuuaaagcugcacuuucgcauacuagacuacacgcucaccggaugcuaugccgaucagcacuccgugcagguauucgcaagcgguaaacccaagauuucugcucaucgaaaacugaucucaagugacuacuauaucuggaacagcaaggccccugcgccaguuacauacggcucccuuuugcuguga

SEQ ID NO: 52842 - RNA, 2424 nt, Artificial Sequence
  derived and/or modified sequence opt3 from AP5Z1__Homo_sapiens__NP_055670
auguucagcgccggcgcugagucccugcuccaccaggcaagagaaauccaagacgaggaacuuaagaaauuuugcucuaggauuuguaagcuguugcaggccgaggauuuagggcccgacacccuggauucacuacagcggcucuuucugauaaucagugcgacaaaauacagccgccgacuugaaaagacuugcguggaccuguugcaggcuacgcucggacugccugccuguccagagcaacugcagguccucugcgcagccauuuuacgugagauguccccgucugauucgcugucacuugcuugggaccauacccagaacagcagacaguugagucugguugcauccgugcuacucgcccaaggugauaggaaugaagagguacgggcugugggccaggggguccugcgcgcccuugaaucuagacagcccgagggaccuagccugaggcacuugcucccagugauggcgaaaguugugguccugucccccggcacauuacaggaggaccaagcaacucugcucucaaagcggcuuguggauuggcugcgcuaugccaguuugcagcagggucuaccucauagcgggggauuuuucucuaccccacgagcuagacaacccggcccuguaacagaaguugacggcgccguggcaaccgauuucuucacuguccuguccucagggcacagguuuacagacgaucaguggcucaacgugcaggcuuucagcaugcugcgggccuggcuucugcauaguggaccagaggguccgggcaccuuggacacggacgaucguucugaacaggagggguccacucucagcgugaucucggcgaccucuuccgccggacgccuguuacccccuagagaaaggcugcgggaggucgcauuugaguacugucaacgacuaauugaacagucaaaucgcagagcucucaggaagggcgacagugaucugcagaaagccugccuuguugaggcuguguugguacuggacgugcucugucggcaggaucccagcuuccuguaucgcucccuuucuugccugaaggccuugcacgguagaguccguggggacccagcaagcgugaggguucuccugccuuuagcccacuuuuuccugucacauggagaagcugcggcaguggauagugaggccgucuaccaacaccuauuuacacggaucccaguggaacaguuccauucccccaugcucgcuuucgaguuuauacaguucugucgagacaaccugcaccuuuuuagcggccacuugucuacucugagacucucauucccgaaucuguuuaaauucuuagccuggaacaguccuccccugaccagcgaguuuguagcacuuuugccagcccucguugaugcuggcacagcccuggaaaugcuacaugcacugcucgaccugccuugccuuaccgcgguguuggaucugcaguuaagguccgcucccgccgcaucugagcgcccacucugggacacgucgcugcgggcccccagcugucuugaggcuuucagagacccucaauuucaggggcuguuccaguauuugcucaggccaaaggccuccggagcaacugaacgccuggcuccgcuacaccagcugcuccaacccauggccgguugcgcgcgagucgcccagugcgcucaggcagugccuacacugcuucaagccuuuuucucagcugucacccagguggccgauggcaguuugaucaaucagcuggcauuacuccugcuugggcggucugacagccuguacccagcgcccggauaugccgcuggcguucauuccgugcuaucaagccaguuucucgcccuguguacuuugaaaccuucucugguagucgaauuagcacgugaucuccuggaguuccuugguuccgugaacgggcugugcaguagagcuagcuugguuacaucuguggucugggccauuggcgaguaccucuccgugaccuacgacaggcgcuguacgguagaacaaaucaauaaguucuuugaggcacuggaagcccuacuguucgaggugacccagugccggccaucagcugcgcuucccagauguccgccucagguugucacagugcucaugacuacccugacaaaguuggccaguaggagccaggaucugauuccacgagcaucguuacuccuguccaaaaugcgcacucuugcucacucucccgccaccagcucaacacauagugaggaaggagccgaggcuauccggaccagagcaacugaacuguugacgcuccugaagaugccuuccguggcccaauuuguccuaacacccucuaccgagguuugcagcccaagguaucaccgugacgcgaacacugcucugccucuugcccuccgcaccgugucccggcugguggaaagagaggcaggcuugaugcccggguga

SEQ ID NO: 52843 - RNA, 3585 nt, Artificial Sequence
  derived and/or modified sequence opt3 from APAF1__Homo_sapiens__NP_001151
auggacgccaaggcuagaaacugccugcuccagcacagggaggcacuugaaaaagauaucaagaccagcuacauuauggaccauaugauauccgauggcuuccugacaaucucugaggaagagaaagugcggaaugaacccacucaacagcagcgcgccgcgauguugauuaagaugauccugaaaaaggacaacgauucauaugucaguuuuuacaaugcucugcuacacgagggguauaaggaccucgccgcacugcuucaugaugggauuccuguugugagcuccucuucgguacgaacggugcugugugaggguggcgucccacagcguccggugguuuucgugaccaggaaaaaguuggucaacgccauccaacagaaacucucaaagcugaaaggggaacccggaugggugacaauacacggcauggcugguugcggaaagagcguacuggcagccgaggcuguuagagaccauagucucuuagaaggauguuuuccuggcggcgugcacugggucuccguggggaagcaggauaaaucuggacugcuuaugaaguugcagaaucugugcacucggcuagaccaagaugagagcuucucccagcgccucccacugaacaucgaggaagccaaagacagacuuaggauucugauguugcggaagcacccccgcucacuccugaucuuagaugacgugugggacaguuggguccugaaagcguuugauagccagugucagauucuccuuaccacacgagacaagucuguuaccgauuccgugauggguccuaaauacguagugccagucgagucaagccugggcaaggaaaagggguuggagauccuaagucuguucgugaauaugaaaaaggcagaccuccccgaacaagcccauucuauaauuaaagagugcaagggauccccucugguugugagccuuaucggcgcucuguugagagauuuuccaaacaggugggaguauuaccucaaacagcugcagaauaagcaauucaagcggauucguaaaucgucuuccuaugacuacgaagccuuagaugaggcaaugucaaucagugucgaaaugcugcgcgaggacaucaaggauuacuauacugaccuaagcauucuccagaaagaugugaagguaccgacaaaaguucuguguauacuuugggacauggaaaccgaggagguggaagacaucuugcaggaguuugucaacaaguccuuacucuucugcgauagaaaugguaagucuuuuagguacuaucugcacgaccuucagguggauuuccugacggagaaaaacuguagccaauugcaggaccuccauaagaaaauuaucacucaguuucagcgguaccaccaaccccacacccugucaccugaucaggaagacugcauguauugguacaauuucuuagcuuaucauauggccagugcgaagaugcacaaagaacugugugcccuaauguucucccucgauuggauaaaggcaaagacagagcuggucgggccagcucaucuuauucacgaguuuguggaauaccgacauaucuuggacgagaaagauugcgccguuagcgaaaacuuccaggaguuucugucucucaauggacaccuguuaggccgccagcccuucccuaacaucgugcaacugggccuuugcgagccagaaacuucagagguauaccagcaggcuaaguugcaggccaaacaagaagucgacaacgggaugcucuaucuggaguggauuaauaagaaaaacaucaccaaucuaaguagacuggugguuaggccccacacagaugcaguguaccaugccuguuuuagcgaagacggacagcggauugcuuccugcggugcggauaagacccuccaggucuucaaagcagagacgggcgagaagcugcuugaaauaaaggcccacgaggacgaaguguuguguugcgcuuuuucuacugacgaucgcuucaucgccacauguucgguagacaaaaaggugaaaauuuggaacagcaugaccggggagcugguucauacuuaugaugaacacuccgagcaagucaauugcugucacuuuacaaacucaagucaucacuuacuccuggcaaccggaucuagcgacugcuuccuuaagcugugggauuugaaucagaaagaguguagaaacacgauguuuggccauaccaauuccgugaaccacugcagguucucaccggacgauaagcuccuggccagcuguucugcugacgguacacuaaagcugugggaugccacuuccgcaaaugaacguaaaaguaucaacgugaagcaguuuuuccucaaucuggaggacccucaggaagauauggaggucaucguuaaaugcugcagcuggucugcggacggggcucggauuaugguggccgcaaagaacaaaauauuccuuuggaauaccgauucccgaucaaagguggccgacuguagaggccauuugaguuggguacacggagucauguuuagccccgacggcucguccuuccugacaucuagcgaugaccaaacuaucagguuaugggaaaccaagaaagugugcaagaacucagcuguuaugcucaaacaggagguggaugucguguuucaggagaacgaaguuauggugcuggccguagaccacauucgccggcuucagcugaucaaugggagaacaggacaaauugauuaccuaaccgaggcacaggucaguuguugcugucucuccccacaucugcaguauaucgcuuucggugacgaaaacggcgccauagagaucuuggagcuggugaauaacaggauuuuucagucucgcuuccaacacaagaaaacuguguggcauauccaguuuacggcggaugaaaagacauuaauuagcuccucagacgaugccgagauccaggucuggaauuggcaacucgacaagugcauauuccugcgagggcaccaggaaaccguuaaagauuuucggcuucugaagaacagccguuugcucaguuggucuuucgacggaacugugaaaguauggaauauuaucaccggcaacaaggagaaagacuuugugugucaucaggguacaguccuguccugcgauauuagccacgacgcuaccaaguucucgucaacuucugcagauaaaacagccaagaucuggaguuuugaccuacugcuuccucuccacgaacugagagggcauaauggcugugugaggugcuccgcuuucagcguugauucuacguugcuggccaccggagacgauaacggcgagauacgcaucuggaaugugagcaacggggaguuacuccaccugugugcaccccuuuccgaagagggagcggccacucaugguggcugggucacagaccugugcuucucaccagaugggaagauguugauuagugcuggaggcuacaucaaaugguggaaugugguuaccggugaaagcucucagacauuuuauacuaacgggaccaaucucaagaaaauucacgugucccccgacuucaagacguacgucaccguagauaaccugggcauccuauacauacugcaaacacuugaguga

SEQ ID NO: 52844 - RNA, 2514 nt, Artificial Sequence
  derived and/or modified sequence opt3 from APBA1__Homo_sapiens__XP_011516919
augaaccaccuggagggcagcgccgaaguggaggucaccgacgaagcugcagggggagagguuaaugaauccguggaggccgaucucgagcaucccgaaguagaggaagaacagcaacagccuccacagcagcaacacuacguggguagacaucagaggggccgggcgcuugaggaccugcgcgcucaguuggggcaggaagaggaggagcgaggagaaugcuuagcccguucugcaucaacagagaguggcuuccacaaccauacugauacggccgagggugacgucaucgcugcagccagagauggguaugacgcugaaagggcccaagauccggaggacgaaagcgcguacgcagugcaguaucggcccgaggccgaagaguacaccgagcaggcugaagccgagcacgcagaagcuacacaccgcagagcccugccuaaucaucuacacuuucauucccucgagcacgaagaggcgaugaacgccgcauauucuggauacguuuauacucacaggcuguuccaucggggcgaggaugaaccauacucggagcccuacgcugacuauggcgggcuucaggaacacguguacgaggagauuggagaugccccugaacuggacgcucgcgaugguuugcgacucuaugagcaagaaagagacgaggccgcagccuacaggcaggaagcucugggcgcgcggcugcaucacuaugacgagcguucagauggggagagcgacaguccagaaaaggaggcagaauuugcccccuacccucgcauggauuccuaugagcaggaagaggacauagaucaaaucgucgcugaggugaaacagucuaugagcucccagucacucgacaaggccgcagaagauaugccagaggccgaacaggacuuagagagaccgcccaccccugcuggaggcaggccagauagucccggucugcaagccccugcagggcagcagcgggcgguaggaccagcuggcggcggggaagccggacagcgauacagcaaagagaagcgcgacgcaauuucucuugccaucaaagauauuaaggaggcuaucgaagagguuaagacaagaaccauaaggucccccuacacuccggacgaaccuaaagagcccaucugggugaugcggcaagacauuucaccaacacgcgauugugacgaucagagaccuauggacggugauagccccaguccagggucuuccagccccuugggcgccgagucgucuuccaccucacugcauccuagugacccagucgaagcaagcacgaauaaggaguccaggaaaucucuagcuagcuucccgacuuauguggaagugcccggaccuugcgauccagaggaccucaucgauggcauuaucuuugccgcgaacuaccuggguucaacccagcuucugagugacaagacacccuccaaaaauguccguaugaugcaggcccaagaagcuguuagccggauaaagauggcacagaaguuggccaaaucucgaaagaaagcuccugagggggagucacagccaaugacugaaguggaucucuucauuaguacccagagaaucaagguacugaacgccgacacacaagagaccaugauggaucaccccuuaaggacgauuagcuauaucgcagacaucggcaauauugugguccugauggcgcgccggagaaugccgagguccaacucucaggaaaauguggaggccucgcacccuagccaggacggaaaacgccaauacaagaugauaugucauguuuuugaauccgaggaugcucagcucaucgcccagucaauuggccaggcauucaguguggcuuaucaagaguuucuucgagccaacgggaucaauccagaagaccugucucagaaagaguacagcgauuugcuaaacacucaggacauguauaaugaugaccugauacacuucuccaagucagaaaacugcaaggaugucuuuauugagaaacagaagggagaaauccucggugugguaaucguugagagcggcugggggucuauucugcccacagugaucauugcaaacaugaugcauggaggcccugccgagaaauccgguaaacuuaauauaggggaccaaaucaugaguauuaacggcaccagccuggucggauugccccucucuacuugucaguccaucaucaaaggccugaagaaucagucacgggugaaguuaaacauuguccguugcccaccugugacaaccguucugauaagaaggcccgaucuacgcuaccagcucggguucagugugcaaaauggaaucauuuguagccugaugcgggguggcaucgcugaaagagggggaguaagggucggccaccgaauuaucgagauaaacggucagucggugguugcgacgccacacgaaaagaucgugcauauucuuuccaaugccgucggggagauccacaugaagaccaugccggcagcuauguaccgcuugcugacagcccaggagcaaccuguguauauuuga

SEQ ID NO: 52845 - RNA, 2214 nt, Artificial Sequence
  derived and/or modified sequence opt3 from APBA2__Homo_sapiens__XP_006725606
auggcccacagaaagcuggagagcgugggcuccgggaugcucgaccauaggguccggcccggaccuguuccacacucucaggaaccggagucagaagauauggagcuuccccuggaagguuacgugccugagggcuuggaguuagcugcacugcgcccagaaagucccgccccugaggaacaagagugccauaaccacagcccagacggggauuccucuucggacuauguaaauaacaccucagaggaagaggauuacgacgaaggacuacccgaggaagaggagggcaucaccuauuacauucgauauuguccugaagaugacagcuaccucgaggguauggauugcaauggggaagaguaucuggcgcauagugcucacccaguggacacugaugaaugucaggaggccgucgaggaauggacggacuccgcaggaccgcacccccauggccacgaggccgaaggcucucaggauuacccugacgggcagcuuccaauacccgaggacgaaccuagcgugcuggaggcucaugaucaagaggaagacggacacuacugcgcauccaaagaggguuaucaggauuacuauccagaagaggccaacggcaauaccggggcuucacccuaccguuugagaaggggagacggcgaucucgaggaccaggaagaggauaucgaccagauuguugccgaaaucaagaugagucugagcaugacaucuauuacuuccgcgucagaggcaagcccggaacacgguccugagcccgggccagaggauaguguggaagccuguccucccaucaaggcuucuugcuccccaagccggcaugaggcccgccccaaaucgcugaaccucuuaccugaagcaaaacacccaggagacccgcaaagaggcuucaagcccaagaccaggacaccugaggaacggcugaaauggccacaugagcaggucuguaauggccuugagcagccccgcaagcagcaacgaucugauuugaacgggccuguggacaauaacaauauaccagaaaccaaaaagguagcuuccuuucccucauucguugccgugccgggaccuugcgagccagaagaccugaucgaugguauuaucuuugcggccaacuaucuaggcaguacucagcuccugagcgagagaaaucccuccaaaaacauuaggaugaugcaggcacaagaagcugucucucgggugaagaauagcgagggggacgcccagacacuuaccgagguggaucuguucaucucaacgcagcguauaaaggucuugaacgcugacacucaggaaaccaugauggaucacgcccuccgcacaauuaguuacaucgcagacauuggaaacaucguugugcugauggccagaaggcggaugccucgauccgcuagccaagauuguaucgagacuacccccggcgcgcaggaagguaaaaagcaguauaaaaugauuugccauguauuugagucugaggacgcacaguuaauagcccaaucaaucgggcaggcuuucaguguggccuaccaggaauuucugcgcgcaaauggcauuaacccagaggaucucagccagaaggaauacuccgacaucauaaauacacaagagauguauaacgaugaccuuauucacuucucuaauucggaaaacuguaaagagcugcaguuggagaagcacaaaggagaaauccuaggcgucgugguuguggagagcggguggggauccauccugccuaccgucauucucgccaauaugaugaacgguggccccgcugccagaucagggaagcugaguaucggagaucagauuaugucuauaaauggcacgagccuugugggucugccauuggcaacuugccaggggaucauuaagggccucaaaaaccaaacacagguaaagcugaauaucguuuccugcccgccugugaccacugucuuaaucaaaaggcccgaccugaaguaccagcuaggauuuucagugcaaaacggcauuauauguagccucaugcgcgggggaaucgcggaacgggguggcgucagaguggggcauaggauuaucgagauuaauggacagucuguuguggcuacagcccacgagaaaaucguacaggcacuguccaacagugucggcgaaauacauaugaagaccaugccagccgcuauguuccgucuuuugacgggucaggagacaccccuguauaucuga

SEQ ID NO: 52846 - RNA, 1728 nt, Artificial Sequence
  derived and/or modified sequence opt3 from APBA3__Homo_sapiens__NP_004877
auggacuuccccaccaucagcagauccccuucuggcccaccggccauggaucuggaggggcccagggacauucucgugccuucagaagaucuuacaccagacagucagugggaucccaugccuggagguccaggcagccugucccggauggaguuggacgaaucuucguuacaagagcugguccagcaguuugaagcucuacccggggaucucguuggaccuucaccaggcggugcaccgugcccccugcacauagccacugggcauggacuugcgagccaggagaucgcugacgcccacggccuguugagugcagaggccggccgcgaugaccuccuggggcugcuccauugugaagagugcccuccaucccaaacgggacccgaggaaccuuuagagccagcuccccgacugcuucagccgccugaagaucccgacgaggauucugacagcccagaauggguggagggugcauccgccgaacaggagggcucacguaguucuagcuccucaccugagcccugguuggaaaccguaccacuggugacacccgaggaaccuccagcuggggcccagagcccggagacucuagcgaguuaccccgcaccucaagaagucccaggacccugugaccacgaggaucuccuggacggcgugauuuucggugccagauaucuugggucuacccagcugguuuccgagaggaacccuccaacaagcacccggauggcucaggcccgcgaagcaauggauagagugaaggcucccgacggagagacucagccgaugacagaagucgauuuguuugugucgaccaaaaggaucaagguacucacggccgacucucaagaggcgaugauggaucaugcccugcacacuauuuccuacaccgcagacaucggcugcguuuuagugcugauggcucggcgccgacucgccagaaggccugcuccacaggaucacggccggcgucuuuauaaaaugcugugucaugucuucuacgccgaagacgcacaguugauagcccaagcuaucgggcaggcguuugcagccgcuuauucacaguuccuacgcgagaguggaauugaucccagccaggugggugugcacccuucccccggcgccugccaucugcacaauggggaccucgaccacuuuucuaacagcgauaauuguagagagguccaucuggaaaagaggcggggagagggccuugguguugcacugguggaaucaggguggggcaguuugcucccaacagccguaaucgcuaaccuguuacacggaggcccugccgagcgauccggggcacugagcauuggagaccgccuaacugcgaucaaugguaccucucucgugggccugccccuugcugccugccaagcagccgucagagagacaaaaucacagaccagugugacguugagcauaguucauuguccaccggugacuacagcuauuauccacaggccucaugcccgggaacagcugggguucugcgucgaggauggaauuaucuguucccuccugcgcggcgguaucgcagaaagagggggcauuagggugggacaccguauaaucgagauuaacggccagucuguaguugcuacuccccacgcccggaucauagaacuucugaccgaggcguacggggaggugcauauuaagacaaugccagccgcuaccuaucgauugcucacgggacaagaacagcccgucuaccuguga

SEQ ID NO: 52847 - RNA, 1473 nt, Artificial Sequence
  derived and/or modified sequence opt3 from APBB1__Homo_sapiens__NP_001244248
augagcgccauguucucccaggacuuuuuccuggcuaucauucuccaagauucuucagcagacaguuuuuggaaccccaaugccuucgagaccgauagcgaccuuccugcgggcuggaugagagugcaggauacauccgggacuuacuauuggcacauaccaacgggaaccacacagugggaaccgcccgguagggcuucuccuucgcagggcucaagcccacaagaggaaagucagcugacuuggaccggguuugcccauggagagggcuucgaagacggugaguuuuggaaggaugagcccuccgacgaagcaccuauggaguugggguuaaaagaaccagaggagggaacacugaccuuccccgcccagucucuaagcccugaaccacucccgcaggaggaagagaagcugcccccucggaacacuaauccaggcaucaaaugcuuugcuguccgcucccuuggcuggguugaaaugacagaggaggaacuggcacccgggcgaucaaguguggccguaaacaauuguauucgucaauugagcuaccacaagaacaaucuccaugauccuaugucuggagguuggggcgaggggaaagaccugcugcuccaguuagaagaugagacccugaaacuuguggaaccacagucccaggcuuugcugcacgcccaacccaucauuucaaucagagucuggggagugggcagggacagcggucgggagcgcgauuucgcguauguugcaagagacaagcuaacgcagaugcucaaaugccauguguuuaggugugaggccccggcuaagaacauagccaccagucugcacgaaaucugcucuaaaauuauggcagagcggcgcaaugcucgaugucuugucaacgggcuguccuuggaccacagcaagcucguggauguaccuuuccagguugaauuucccgccccaaagaaugagcuggugcaaaaguuccaggucuacuauuuaggaaacgugccuguggcgaagcccgucggcguugacgugaucaauggcgcccuggaaucgguacucucuuccucaaguagagagcaguggacuccaagccauguguccgucgcacccgcuacacuuacuauucugcaccagcaaaccgaggccguguugggggaaugcaggguucgguuccuaucuuuucuggcugugggacgugauguccauacauucgccuuuaucauggcagccgguccugcuagcuucuguugccacauguuuuggugugagccaaacgcggcaucacucagugaagccgugcaggcugccugcaugcugcgcuaccagaaaugucuugacgcaagaucccaggccagcaccucuugccugccggcucccccugccgagucaguagcaaggcggguuggcuggacggugcgacgcgggguccaaaguuuguggggaagccucaagccaaaaagacugggcgcgcacacucccuga

SEQ ID NO: 52848 - RNA, 2001 nt, Artificial Sequence
  derived and/or modified sequence opt3 from APBB1IP__Homo_sapiens__XP_006717514
augggcgagagcuccgaagacaucgaucagauguucucuacccugcucggggagauggaccuucugacacaaucauugggaguggauacuuuacccccuccagacccgaaucccccuagagccgaauuuaacuacagugucgguuucaaggaucugaacgagagccuaaaugcucucgaagaccaggaucuggacgcacuuauggccgaucugguugcggacauuuccgaggcugagcagaggacgauacaggcccaaaaagaaucuuugcagaaccagcaccauucggcaucacuccaggccagcaucuuuaguggcgcugcaucccugggguauggaaccaauguggccgcuacaggcauuucucaauacgaggaugaccugccacccccuccagccgaucccguacucgacuuaccucugccaccgcccccuccagaaccccuuagccaggaggaggaagaggcgcaggcaaaggccgacaaaaucaaguuggcucuggaaaaacuaaaggaggccaaggugaaaaagcucgucgugaaaguucacaugaacgauaauuccacuaagucacugaugguggacgaacggcagcuugcacgcgauguccuggacaacuuguucgagaaaacccauugcgauuguaauguggacuggugccucuaugagauuuacccugaacugcaaaucgagcgauuuuucgaagaucacgagaacguaguugaaguguuaagugacuggacacgugauaccgagaauaagauacuguuucucgagaaggaagagaaauaugcugucuucaagaacccacagaauuuuuaccuugacaacagagguaaaaaggaaagcaaagagacuaaugaaaagaugaacgccaaaaacaaggagucucuguuggaggaauccuucugugggacaucaaucauugugcccgagcuagaaggagcgcuguaucucaaggaggauggcaaaaagagcuggaaaaggcgguacuuucugcuucgcgccaguggcaucuacuaugugccgaaggggaaaaccaagacgucuagagaccuggcaugcuucauucaguuugagaaugucaacaucuacuauggaacucaacauaagaugaaauacaaggcuccuaccgacuauuguuucguuuugaaacacccccagauacagaaggaaucccaguacauuaaauaucucugcugugaugacacaaggacucugaaucaaugggugauggguauccggauugccaaguacggcaagaccuuauacgauaacuaucagcgcgcuguagccaaagcagggcuggccagccgauggacaaaucuaggaaccgugaacgcugcggcaccagcccagccuucgacgggccccaagacugguacaacccagccaaaugggcaaaucccccaggcuacucacucugucuccgccgugcuccaggaggcacagagacaugccgaaacaucaaaagacaagaaaccugcucugggaaaccaccaugauccagccguuccgagggcaccccacgcgccuaagaguagccuuccacccccuccacccgugcggcguuccucugacaccagcggcucaccggcuacgccuuugaaggccaaaggcaccgggggagguggccugccagcacccccugaugacuuccugcccccaccucccccaccgccuccccucgaugacccagagcuucccccuccacccccugauuuuauggaaccgccacccgacuucgucccuccacccccuccgaguuacgccgggaucgcuggauccgagcugcccccaccucccccaccucccccagccccggcacccgcucccgugccagauagcgcccgcccuccuccagcgguagccaagagacccccuguuccgccaaaaaggcaagagaaucccggccacccugguggggcuggcggaggcgaacaggacuuuaugucugacuugaugaaggcacuccagaaaaagcgggggaacgugucauga

SEQ ID NO: 52849 - RNA, 2277 nt, Artificial Sequence
  derived and/or modified sequence opt3 from APBB2__Homo_sapiens__NP_001159522
augagcgaggugcugcccgccgacuccggcgucgauacccucgcuguuuucauggcaucuucagggacaacugacgugacgaacagaaauaguccugccaccccaccgaacacacuuaaucugaggagcucccacaacgaauuguuaaaugcggagaucaagcauacugaaaccaaaaacucuacacccccuaagugccggaaaaaguacgcucugaccaauauucaggccgcaaugggacuaucggauccagccgcucaaccccuccuggguaacggcucagcaaauauaaaacuuguaaagaacggggagaaucagcugcgcaaggccgcugaacagggacagcaagacccuaacaaaaauuugagcccaacugccgugaucaacauuacaagugagaagcucgagggcaaagaaccccacccucaggauuccucuagcugugagauccugccaucccagccgcgacguaccaagucauuucugaauuauuacgcggaccucgaaacgagugcaagagaguuagagcagaacagggguaaccaucacgggacugccgaagagaaaagccaacccguccagggacaggcuucuaccauuaucggcaauggcgaucugcuuuugcagaagccuaaccggccacaauccucacccgaagacggacagguggccacaguuagcaguucuccugagacuaagaaagaucauccaaagaccggggcaaaaacagacugcgcucugcaccgcauacagaaucuagcccccuccgaugaagagagcucguggaccacgcucucucaagacuccgcgucaccgaguagcccugaugagacugacaucugguccgaccacucuuuccagacagaucccgaccugccaccugguuggaagagagugagcgauauugccggcaccuauuacuggcauauccccacugggacaacccagugggaaaggccagucucaauucccgcagaccuucagggaagucggaaaggcucccugagcucugugacgccuucaccaaccccggagaacgaaaagcaacccuggagugauuuugcuguauugaauggugggaaaaucaacagcgacauauggaaggaucuccacgccgcuacaguuaauccugacccaucccugaaggaguucgaaggagccacuuuacgcuaugcaucucugaaacuccgaaacgcuccccauccugaugacgaugacucguguagcauuaauuccgacccagaggccaagugcuuugcggugagaucacuuggcugggucgagauggcagaagaggaucuggcccccggcaaaaguucuguggcugugaacaauuguaucaggcaguugagcuacugcaagaacgacauucgggauaccgucgggaucuggggagaagguaaagacauguaucuaauccuggagaaugauaugcucucccugguugacccgauggaucguucagugcuucacagccagccuauuguaucuauacgcguguggggcgucgggagagacaacggaagggauuucgccuacguggcacgggacaaggauacacgaauccugaagugucacguuuuucgcugcgacacuccagccaaagcuauugccaccuccuugcaugaaaucuguaguaagauaauggcagagaggaaaaaugcgaaggcucucgccugcagcucucugcaggagagggcaaacgugaacuuagaugucccccugcaaguggacuucccuacacccaaaaccgagcuaguacagaaguuucacguucaguaccucggcaugcugccaguggacaagccugucgguauggauauucuuaauuccgccaucgaaaacuugaugacuucaaguaauaaagaagacuggcugagcgugaacaugaaugucgcugaugccacggugacaguuaucucggagaagaacgaggaagaggugcucguagaaugucggguccgcuuccuguccuuuaugggggugggcaaagacguucauaccuucgcauuuauuauggauacuggaaaucagagauucgagugccacguguucuggugcgaacccaacgcuggcaaugucucugaggccgugcaagcggccuguaugcuuagguaucagaagugccugguagcucguccaccgagccagaaagugcggccucccccacccccugcagacucaguuacccgaagagucacaaccaacgugaagagagggguguugagucucaucgauacucugaagcagaaacgcccagucacagagaugcccuga

SEQ ID NO: 52850 - RNA, 1482 nt, Artificial Sequence
  derived and/or modified sequence opt3 from APBB3__Homo_sapiens__NP_006042
augcugggcaaggacuacaugcucgccaucauucuugugaacugcgaugacgaucuguggggagaccacagcuuggaggucgaagcuggguuacccccugguuggagaaaaauacaugaugcagccggcaccuauuacuggcacguuccauccgggucuacacaguggcaaaggccgacuugggagcugggagacgcggaagaucccggcacggguaccgaggggaucuggggacuacggccuccaaagggccgcucauucaguagccucgaauccucucuggaccgaucaaauucgcuuagcugguauggcggggagaguuacauucaguccauggagcccggagcuaaauguuuugccgugcguucucuggguuggguagaagugccugaggaagauuuggcaccaggcaagagcuccaucgccgucaacaauugcauucagcagcucgcucaaacaagaucaaggagucagcccccugacggggcauggggagagggccagaacaugcugaugauccugaaaaaggaugccaugagccucgugaauccauuagaccauucucugauacacugucagccgcuuguucauauccggguguggggugucggguccucaaagggacgcgauagccccauuagugcuccugccagagacuucgcguuuguggcaucugacaaagauuccugcauguugaagugucacguauucugcugugacguuccagccaaagcuaucgccagcgcacugcacggccuaugcgcucaaauucucucggagaggguggaagucucuggcgaugccuccuguugcucacccgacccuaucaguccagaggaucugccccgccagguggaacuucuggacgcggugagccaggccgcacagaaguaugaggcuuuguacauggggacucucccggucaccaaagccaugggaauggauguucugaacgaagcuauagguacauuaaccgcccggggcgaccgaaaugcaugggugccuacuaugcuguccguaucugauagccucaugacagcccaucccauucaagcugaggcgucaaccgaggaggaaccacuuuggcaguguccugugagacuggucacguuuaucggggugggaagggacccccacacuuucggcuugauugcagaucuaggucggcagaguuuucaaugcgccgcuuucuggugccagccacaugccgggggccuguccgaagcaguucaggccgcuuguauggugcaguaucaaaagugccucgucgccagcgcagcgcguggaaaggcuuggggcgcccaggcacgcgccagacugaggcuuaaacggaccucuucaauggacagucccgggggaccucugccauugccgcuccugaaggguggcguagggggagcuggcgccacaccccgaaaacgcgguguguuuagcuucuuagacgcauuuagacugaagccuucccuacuccacaugccauga

SEQ ID NO: 52851 - RNA, 6984 nt, Artificial Sequence
  derived and/or modified sequence opt3 from APC2__Homo_sapiens__XP_005259532
augggccugcucgggcuucugagcuuguuacacuccgccuucuuuggagaccagacccugcaagagcugaagauggcuucuucaguggcccccuacgaacagcucgucagacagguugaggcccugaaagcggaaaacagucaucuuaggcaggagcugcgggauaauagcucccacuugucuaagcucgaaacagagacuucggguaugaaagaggugcugaagcaucugcaaggcaaacucgaacaggaggcucgcguauuagugucaagcgggcagacggaaguccuggagcagcuuaaggccuugcaaauggacaucaccagucuguauaaccuaaaguuccagccuccaacccucggaccggagcccgcggcccgaacuccugaaggcuccccagugcacgguucugggcccagcaaagauuccuuuggagagcugucacgugcuaccauucggcuucuggaagaguuggacagggaacggugcuuccuccugaaugagauagagaaggaagagaaagaaaaguuaugguacuauagucagcugcagggccucagcaaacgccuugaugagcugccucauguugaaacacaauuuucuaugcagauggacuugaucagacagcaacuagaguucgaggcacagcacauuaggucccugauggaggaacgguuuggcaccucagaugaaauggugcagcgcgcccagauccgagcuagcagacucgagcaaauugacaaggaacugcuugaggcccaggauaggguccagcagacugagccacaagcgcuguuggcagugaagaguguacccguugacgaagauccugagacagaagugccaacccacccggaggacgggacgccccagccuggaaacucuaaagucgaggugguguucuggcuccuguccauguuagccacucgggaucaggaagacaccgcucguacacugcuagccaugagcucgucuccagaguccugugucgcaaugcgcagaucagguugccucccccugcuuuugcagauccugcauggcacugaagcugccgccgggggcagggcgggcgcaccuggugcuccaggggccaaggacgcucggaugcgagccaaugcagcccuccacaacauaguuuuuagucaacccgaucagggacuggcucgcaaagagaugagagugcuucauguacuggaacagaucagggcguacugugagaccugcugggacugguugcaggcacgggauggcggcccggaagggggaggugccggcagcgcuccuauucccaucgaaccacaaauuugucaggccacaugcgcagugaugaagcucuccuucgacgaggaauaucgcagagccaugaaugagcuagggggauuacaggcugucgccgaacugcuacaaguggauuacgagaugcacaaaaugaccagggacccucucaaccuggcacuucgucgguaugcgggcaugacguugacuaaucugacauuuggugauguugcuaacaaggccacccucugugcacgaagagggugcauggaggccaucguggcucagcuggccucugacagcgaagaguuacaccaggucgugucaaguauacugaggaaucuuuccuggcgcgcagauauuaacagcaaaaagguauugcgggaagcuggcucuguuacugcccucgugcaguguguccugagagcgacaaaggagucaacccuaaaaagugugcugagcgcccucuggaaucuguccgcucauucuacggaaaacaaggcagccaucugccaagucgacggagcucuuggcuucuuggugucgacccugacauacaaaugucagagcaauuccuuagccauuaucgagucagggggagguauccucaggaacguuaguucucugguggcaacucgcgaggauuaccgacagguacuucgggaccacaacugccugcagaccuugcuccaacaucugacaagccacucccuaacuauugucucaaaugcgugcggcacccuguggaaccucagcgcccguucugcuagagaccaggaacugcuuugggauuugggggccgugggaaugcugaggaauuuaguucauuccaagcacaaaaugauagcaaugggcagugcugccgcacuccgcaaccugcuugcccaccggcccgcuaagcaucaggcggccgcaacagcugugagcccagguucuuguguccccucccuguaugugagaaagcagagggcccuagaggccgaacucgacgcucgacaccuggcacaagccuuggagcaucuggagaaacaggggccuccagcggcugaagccgcaaccaagaaaccguuacccccucuccgccaccuggauggccuugcccaggacuacgcuucagauaguggaugcuuugacgaugacgaugcaccaagcucgcuggccgcggcugccgcaacuggcgagcccgccuccccugcugccuugucucucuuccuggggagcccauuccuacaaggacaggcacuggcucggacgcccccgacaagaagggguggcaaggaagccgagaaagacaccucaggggaagcggccguagcagcuaaggccaaggcuaaacuugcacucgccguggcccguaucgaucagcugguugaggacauuagugcuuugcacacuuccucugaugacagcuuuucccugucaagcggagacccuggccaggaggcgccacgcgaaggucgggcacaaaguuguucucccugcagagggccugagggcggaaggcgagaagccggcucccgggcucaucccuuacuccgccugaaggccgcacacgccagccuuucgaaugauucacugaacucugggagugcuuccgacggauauuguccaagagagcauauguugccuugcccccucgcggcccuggcaagcaggcgggaagauccacgauguggccagccgagaccuucucgccuagaccuggaucuucccgguugccaggcugagccacccgccagggaggcaaccagcgccgacgcucguguccggacaaucaaacucuccccuaccuaccagcacgugccacuguuggaaggggccucaagagcgggagcagagcccuuagccggcccugguauaaguccgggcgcuaggaagcaagccuggcugccagcugaucaucucagcaaagugcccgaaaagcuggcagccgcuccucuuucugucgccuccaaggcacugcagaaauuggcggcccaggaggggccacuaucacugagucgcuguagcucccucucuucgcugagcucagcuggacgacccggcccuuccgaagggggagaccuugaugacagugauucuagcuuagagggccuggaggaagccgguccguccgaggcagaacucgacucaacuuggagagcucccggggccacaucuuugccaguugcaauuccugcaccccggaggaaucgcggacguggccuggguguggaggaugcuacgccaagcaguuccagcgagaacuaugugcaggaaaccccucucguacugucuagaugcucauccgucaguagccuuggcucguucgagucucccuccaucgcgagcucaaucccaagugaaccguguucugggcaaggauccggcacuauuagcccuucagagcugcccgacaguccagggcagacaaugcccccuagccgguccaagaccccacccuuggccccugcaccgcagggaccacccgaagcuacacaguuuucucuacaaugggagagcuacgugaaaagguuccuggacaucgccgauugccgcgagcgaugcagacucccuuccgaauuagacgccggcucaguucgguuuacuguggagaagcccgaugaaaauuucucuugugcaaguucgcugagcgcucuugcccugcacgagcacuauguccagcaggacguggaacucagguugcugccauccgcgugcccugagcgcggugggggagcuggcggugccggccuccauuuugcagggcacagaaggcgggaggaaggacccgccccaaccggcucucguccucgcggggcugcagaucaagagcuggaacuucuacgagagugucugggagccgcgguuccggcuagauugaggaaaguggccucagcauuaguacccggccggcgcgcccugccagucccuguguacaugcucgugcccgcuccagccccugcacaggaagacgauagcugcacggacuccgcugaggguacccccgucaacuucaguucugccgcgagccugucagaugagacacuucaggggccgccaagagaccagccuggaggccccgccggcaggcaacggccaacugggcgacccaccuccgcaagacaggcuaugggacaucgccacaaggccgguggcgcagggaggagugcugaacagagccggggagccggcaaaaaucgugccggucuggagcucccuuuggggagaccgcccucugcgccagcugauaaggacggauccaagccuggcaggacacgcggcgacggggcacugcagucacuaugucugacuacccccacggaagaggccguuuacugcuuuuauggaaacgauagcgacgaggaaccuccagcugccgcacccacaccuacccaucggcgaacuucggccauuccaagagcuuucacaagggagcgcccccaaggucggaaagaagcgccggccccuucuaaggcagcuccagccgcacccccuccagccagaacccagcccagucucauagcugaugagacuccgccuuguuacucccuuagcucauccgccucuagccugagugaacccgagccauccgagccucccgcggugcacccacguggcagggaacccgcaguaaccaaagacccugggccaggaggcggucgggauagcucuccgucaccccgcgccgcugaggaauuauugcagcgaugcaucaguuccgcccugccuagaaggcggccacccgugagcgggcuccgcagaaggaagccucgagcaacacggcuggacgagcguccagcugaaggaucuagagagcgcggcgaggaagccgcuggcucggauagggccucagaccuugauagcgucgaguggcgggcaauucaggaaggggcaaauuccaucgugacguggcugcaccaagccgcugccgcaaccagagaggcuaguucugaaagcgacuccauccucucauuuguuaguggauugucuguggguagcacucugcagcccccuaaacaucgcaagggcaggcaggccgagggggagaugggauccgcacgacggccggaaaagagaggcgccgcgucagucaaaacaagcgguucuccaaggucccccgcugggccugagaagccccgcggaacccagaaaacuacuccaggcgugccugccguuuuacguggccggaccgugauuuauguccccaguccagcaccgagagcccaaccuaaggggacgcccggaccaagggcuacaccccgcaaaguagccccuccaugucuagcacagcccgcugccccugcgaaggugccgagcccaggucagcaacgaucgcggucccugcacagacccgcuaagaccucugaacucgccacucuuucacagccuccaaggagcgcaacacccccugcccgccuggcuaaaacacccaguuccucuagcucacagacuuccccagcaagucagccguugccuagaaagcggcccccaguuacccaagccgcgggcgcccugccugggcccggagcuagcccagugccuaaaacacccgcaaggacgcuccuggccaagcagcauaaaacccagcguucuccgguccgaauaccauucaugcagcgcccugcuagacggggacccccaccccuugccagggcagugccugagccggguccacgcgggagagcuggaacugaggccggccccggcgcgagagggggaaggcucggucugguacgaguggccucagcauuguccagcggcucugaaaguucggaucguuccggguuuagacgccaacugacauucaucaaggagagcccuggauuacggaggagacgcucagaacuaucuagcgcugaguccgccgcaagugcaccccagggcgcuucaccacggaggggucgaccugcccugcccgcggucuuccucugcucuagcagaugugaggagcuucgggcugcaccaaggcaggggccugccccggcucgccagcgucccccagccgcaagaccuucccccggcgagcgaccagccaggcggaccacaagugaaagcccuucccgccugcccguuagagcuccggcggccaggccagagacagugaagcgguacgcaucuuugccucacauuucaguggcccgcagacccgacggagcugucccagcagcccccgcuagcgccgaugcggcacgaaggucguccgacggcgaaccucggccccugccacguguggccgcuccugggaccacguggcgcagaaucagggacgaggauguuccgcacauucuccggaguacucugcccgccaccgcacuuccauuaagaggaucuacaccugaagacgcucccgccgguccaccuccccgcaaaaccagcgaugcgguagugcaaacugaggaggucgccgcuccgaagacaaacucauccaccucuccuagucuggaaacacgagagccacccggcgccccugccgggggacagcucagcuugcugggcuccgacguggaugguccaucacuagcuaaagcacccaucagcgccccuuuuguucaugaagggcugggcguggcugucggaggcuucccagccucuaggcacgggagucccucccggagcgcaagagugccgccuuuuaauuauguacccucaccaauggucguggccgcgacuaccgacucugcugccgagaaggcacccgccacggcuuccgccacacuccuugaauga

SEQ ID NO: 52852 - RNA, 1545 nt, Artificial Sequence
  derived and/or modified sequence opt3 from APCDD1__Homo_sapiens__NP_694545
augagcuggcccagaaggcugcuccuucgguaccuguucccugccuuguuacugcacggccuaggggagggauccgcucuccugcauccagacucucgcucacacccgcgaagucuugaaaagagcgcauggcgugccuuuaaagagucccagugccaucacaugcugaagcauuugcacaacggugcgagaaucaccgugcaaaugcccccuacaauugaaggccacugggucucuacugggugugagguuaggucgggaccagaguucauaacgcggucauaucgcuuuuaccauaauaacaccuucaaagcauaucaguuuuacuauggcagcaauagaugcacaaaccccacuuacacccucaucauuagggguaagauccggcugcgccaggccaguuggauuauccgagggggaacagaagcagauuaucagcugcacaaugugcaaguaauaugucauaccgaggccguggcugaaaaacucggccagcaggucaacagaacuugcccuggcuucuuagcagacgggggaccaugggugcaggauguugccuacgaccuguggagggaggaaaaugguugugagugcacaaaggcugugaacuuugccaugcacgagcuucaauugauccgggucgaaaagcaguaccugcaccauaaucuagaucaccucguggaggaacuguuccuuggcgacauucauaccgaugcgacgcagcguauguuuuaucgccccuccucuuaccagccuccacugcaaaacgcuaaaaaucacgaccaugccuguaucgcuugcagaauuaucuauaggagcgaugagcaccacccgcccauauugccuccaaaggccgaccucacuauugggcugcauggagaauggguaucccagcggugugagguucgacccgagguguuauuccugacccgccacuuuaucuuccaugauaacaauaacacaugggaaggccacuacuaucacuacucagacccugucugcaaacauccaacuuuuaguauuuaugcaagagguagguacagccgcggggugcucucuucccgggugaugggaggcaccgaguucgucuucaagguuaaucacaugaaagugacacccauggaugcugccaccgcgucacuucugaacguauuuaacggcaaugaauguggggccgagggaagcuggcaaguggguauccagcaggacgucacgcauacuaacggcugcguggcauuggggaucaagcuaccgcacacagaauacgagauuuucaagauggagcaggacgcuagaggaagguaucugcucuuuaauggccagcguccuagugaugguucuucccccgaccggccagaaaaacgagccaccagcuaccaaaugccucugguucagugcgcuucgucuucccccagagccgaggaucuugcagaagacucagggaguagccuguauggcagggccccaggacgccauacuugguccuugcuccuggcugcguuagcaugucuggugccccuacuccacuggaacauacggagauga

SEQ ID NO: 52853 - RNA, 1539 nt, Artificial Sequence
  derived and/or modified sequence opt3 from APCDD1L__Homo_sapiens__NP_001291716
auggccgagaacagcggccccggggugagaccuccaggaugggaagcucagaucaauauuauauccaccaggcuggcacucgcccacacagcgccggcugccggugaggcaggcgggucuugccuucggugggaaccccauugucaacagccucugccagaccgcguccccucaacugccaucuugccuccacgauuaaacggacccuggauuaguacgggcugcgagguucguccugguccagaguuccugaccagagcuuacacauuuuauccgagcaggcuauuccgggcacaccaguuuuacuaugaagaucccuucuguggggagccugcccauucccuccuggugaagggaaaaguacgccuuagaagggcuucuugggugacucggggcgccaccgaagcggacuaccaucugcacaaggucggcaucguguuucacucgcgccgagcauugguugaugugacagggagacucaaucagaccagggccggacgggacugcgcucgucgccugccacccgccagagcauggcugccuggugcucucuaugaguuaaggucagcccgggcgcaaggcgauugucuggaagcccuuggguugacuaugcacgagcugagccuaguccgagugcagcgcagacuccagccacagcccagggcaaguccgcggcugguagaggaacuuuaccugggagacauucauacagauccugcugagcgcagacacuauaggcccaccggcuaccaacguccauugcaguccgcccuccaucacguucagccuugccccgcuuguggucugaucgcccggucugacgugcaccauccacccgucuuaccuccaccgcuggcacucccccuucaccugggaggguggugggugagcuccggcugcgaagugcgaccugccgucuuguuccuaacgagacuguuuacuuuccauggccacucaaggaguugggagggguacuaucaucacuuuagcgauccagcuugucgccagcccaccuucacaguuuacgcggcaggacgguauacuagagguaccccuucuacaagggugcgcggcgggaccgaacucguauuugaggugacgcgagcccacgucacuccaauggaccaagugacaaccgcuaugcugaacuucuccgagcccucaagcugcggaggcgccggugcauggaguauggggacugaacgggauguuacagccaccaauggcugucuuccgcugggaauacguuugccucauguggaguacgaacucuuuaaaauggagcaggacccacugggccagucuuuacuguucaucgggcaaagacccacggauggauccagcccugacacccccgaaaagaggccaacaucguaucaggcuccucuaguccucugccacggugaggcccccgacuucucucgcccaccgcagcaucggccuucccugcagaaacaccccucaacuggcgggcuucacauugcaccauuucccuugcugccucucgugcugggacuugcguuccugcauugguuguga

SEQ ID NO: 52854 - RNA, 8532 nt, Artificial Sequence
  derived and/or modified sequence opt3 from APC__Homo_sapiens__NP_001120982
auggccgcugcaagcuacgaccagcugcucaagcaaguggaggcccuuaaaauggaaaacuccaaucugagacaggaguuggaagauaacucuaaucacuuaaccaagcuggagacagaagcgucaaacaugaaagagguccuaaagcagcuccagggcaguaucgaggacgaagcuauggccagcuccgggcaaauugaucugcuugagaggcugaaagaauugaaucucgacucuucgaacuuccccggaguuaagcugcggucaaagaugagccugcgcaguuaugguucccgagagggcucugugagcucccguucaggggagugcaguccuguaccaaugggaagcuuuccgagaaggggcuucgugaaugguucucgggaauccacuggguaccucgaggaauuagagaaagaacgcucacugcuuuuggcagaucuggacaaggaggagaaagaaaaggauugguauuacgcccagcuacagaaccucacgaaaagaauagacagccugccccuuaccgagaauuuuagucugcagacagauaugacuaggcggcaauuggaauaugaggcucgccagauccgagucgcaauggaagagcagcucggaaccugucaggacauggagaagagagcccaaaggcggauugcucguauccagcagauugaaaaggauauccugcgcauaagacaauuacugcagucucaggccacagaggcggaaagguccagccagaacaaacaugagaccggcucgcacgacgcagaacggcaaaaugagggccagggggugggagagaucaacauggccacuucugguaauggccagggguccacaacccgaauggaucaugaaacggcuucaguucucaguagcuccucuacucacagcgccccucgcagacuuaccucacaucugggaacaaagguggagauggucuacaguuugcuauccaugcugggcacucacgacaaagacgauaugagcaggacccuccuggcaaugucuucaagucaggacagcugcauuuccaugcggcaaucugguugucuuccacuguugauccagcuccugcacgggaacgauaaggacucgguguuacugggaaauagccgcggcuccaaagaagcuagagccagggcgucagccgcacuacauaacauuauccacagucagcccgaugacaagcguggccggcgagagauaagaguacuccaucugcuugagcagauuagggcuuauugcgaaacauguugggaguggcaagaagcccacgagccugggauggaucaggacaaaaacccaaugcccgcuccuguugaacaccagaucugcccagccgugugugucuugaugaagcugucuuucgaugaggagcaucgccacgcaaugaaugaacucggaggucugcaggccauugcugagcuucugcaaguggacugcgaaauguacggcuugaccaacgaucauuacagcaucacgcuccggagauaugcggggauggcacugacuaauuuaacauuuggagacguggccaacaaggcuacccuguguuccaugaaaggcugcaugagggcccuagucgcacagcucaagucagagagcgaagaccugcagcaaguuaucgccucugugcuucgcaauuuguccuggcgagcugauguaaacaguaaaaagacucugcgggagguggguagcgucaaagcccucauggagugugcacuggaagugaagaaggagucuacauuaaaauccguucugucagcgcuuuggaauuugagugcucacugcaccgaaaacaaggccgacauuugcgcaguggauggggcccucgcuuuccuggucggcacgcuaaccuaccguagccagacaaauacucuggccauaaucgagucgggaggcgggauucucagaaacguguccucucugaucgcaaccaaugaagaccauaggcagauacuucgcgagaacaauuguuugcagacacuguuacaacaccucaaaagccacucacugacuauuguaaguaacgcuugcggaacccuuuggaaucuguccgcccggaacccgaaggaucaggaggcguugugggacaugggugccguuucuaugcucaaaaaccugauccauagcaagcacaagaugaucgcuaugggcuccgcagccgcucuaagaaaucugauggccaacaggcccgcaaaauauaaggaugcgaauauuaugucaccugggagcagucucccaucucugcaugugcgaaaacagaaggcccuugaagcugaguuggacgcccagcaccuguccgaaacauuugauaacaucgacaauuuaagccccaaagcaucgcaccgcucaaagcaacggcauaagcagucucucuacggagauuaugucuucgacaccaacagacacgaugacaauaggagugacaacuuuaauacuggcaacaugacggugcuguccccuuaccuuaauacaaccguccugccaagcucuagcuccucacgugguagucuagauagcucucgcuccgagaaagaccggucacucgagagagaaagggggauuggccugggaaacuaucaucccgcuacugagaauccgggcaccaguagcaagcgaggguugcagauauccacaaccgccgcacagaucgccaaagugauggaagagguuucugcuauucacacuucgcaagaagaucggagcucaggauccacaacggagcugcauugugugaccgacgagcgcaacgcguuaagaaggaguucugccgcacacacucacagcaauacauacaacuucaccaaguccgaaaacucaaaucggacaugcucuaugccuuacgcuaaacucgaguauaagcgaagcaguaacgauucccugaauagcguaucuucauccgacgguuacggcaaaagagggcagaugaagcccaguaucgaaagcuauucggaggaugacgaaucuaaguuuuguuccuacggacaguauccagccgaucuugcccauaaaauccacagcgcuaaccauauggacgauaaugacggcgagcuggauacuccuauuaacuacucauugaaguauagugacgagcaacucaauucuggucgccagucccccagccagaacgaaaggugggcacguccaaaacacauaaucgaggacgaaauuaagcagucagagcaacggcagaguagaaaucagagcaccacguaccccgucuacaccgaauccacagaugacaaacaucugaaguuccagccucacuuugggcaacaggagugcgugucuccauauaggagccgcggcgccaacggauccgagacuaaucgaguuggcucaaaccacgggaucaaucagaacgugucucagagucuaugucaagaagaugacuacgaggaugacaagccgaccaauuauucggaaagauacagcgaggaggaacagcaugaggaagaggaacggcccacaaacuauuccauuaaauacaacgaggagaagaggcacgucgaucagccuaucgacuauucucugaaauacgcgacugauauaccaucaagccagaagcaauccuucaguuucucuaaaagcucauccggacagaguagcaagaccgaacauaugucuuccucaagcgagaauacgucgacacccucuaguaacgcuaagcgccagaaucaacuucacccuuccagcgcccagucacguuccggccagccacagaaagcagccaccugcaaggugucuagcaucaaccaagaaacuauucagacauacuguguagaggacacccccaucugcuuuaguagauguuccagccucucuucacugaguuccgcugaagaugagauugguugcaaucagacuacccaggaggcagacagcgccaacacauugcaaaucgcggaaauaaaagagaagauugggacgcggucugcugaagacccggugucggagguuccugccgucucacagcacccaaggaccaaaagcucccgccugcagggaaguucuuuaagcuccgaaucagcacgacauaaggccguggaguucaguucuggcgcuaagagccccuccaaaucaggugcccagacuccuaagagccccccagagcacuaugugcaagaaacaccucucauguuuucuagaugcaccuccgucaguagccuggauucguucgagucccggucuaucgcaucaagcguucagagugaacccuguuccggcauggugucugggauuaucagcccaucagaccuuccggauuccccuggacagacaaugcccccaaguaggagcaaaacucccccuccacccccucaaaccgcucagacgaagcgcgaggugccgaaaaauaaggccccaacagcggagaaaagagaaucuggccccaagcaggccgcaguaaacgcugccguccagagggugcaaguucugccugacgcugauaccuugcuccauuuugcaacugagucaaccccagacggguucuccugcagcucuagucugucggcccuaucccuggaugaacccuuuauacagaaggacguggagcuucggaucaugccuccgguccaggaaaaugauaacggaaaugagacagagagcgaacagcccaaagagucaaacgaaaaucaagagaaggaagccgagaaaacuauugacucugagaaggaucuccuggacgauagcgacgacgaugacaucgaaauuuuggaggaauguaucauauccgcuaugccaaccaaaaguucacguaaggcgaagaaaccugcacagacagccucuaaguuacccccaccuguggcucgcaaacccagccagcugccaguuuacaagcuccugccgucccagaaccgacuucaaccucagaaacacgugaguuucacgcccggcgaugacaugccaagaguauauugcgucgaggguacccccauuaauuuuagcacugccacaucccugucugauuugaccaucgaaucaccuccaaacgagcuagcagccggggagggagugaggggcggugcucagagcggcgaauucgagaagcgggacacuauccccacagaagggcgcucgaccgaugaggcgcagggaggcaagacguccagugugacuauuccugagcuggacgauaauaaagccgaagagggggacauccucgcagaauguauuaacucugcuaugccgaagggaaaaagccauaagccauuuagagucaaaaagauaauggaucaaguucagcaggccucagcauccucuagugcccccaacaagaaucaacuggacggcaaaaagaaaaagccuaccagccccgugaaaccaaucccucagaacacagaguacaggacccggguacgaaagaaugcugauuccaagaacaaucuuaacgccgaaagaguguucucagacaauaaagacagcaagaaacagaacuuaaagaauaacucuaaagucuuuaaugauaagcugcccaacaaugaggaccgcgugagggguaguuucgcguucgauuccccacaccacuauacuccuauugaggggacaccguacugcuuuagccggaacgacucacucucuuccuuggauuucgacgaugacgauguugaccugucgcgugaaaaagcagagcucagaaaggccaaggaaaauaaagagagcgaagcuaaggugaccagucauacagagcugacuucuaaccagcaauccgccaacaaaacccaggcuaucgcaaagcagcccauuaauaggggacagccaaaaccuauccuucaaaagcagagcacguuuccccagucaaguaaggauauaccagaccgcggcgccgcuacagacgagaaacugcagaacuucgccaucgaaaauaccccugucuguuuuucccacaacagcucuuugucaagccuauccgauauugaccaagagaauaacaauaaggaaaacgagcccaucaaagaaacugagccgccagauucucagggugagccuaguaagccccaggcaucgggcuaugcgccaaaaagcuuccauguggaagacacccccguuugcuuuucccggaauucaucucugagcagucucuccauugauucagaggacgauuuacugcaagaauguaucucuagcgccaugccuaagaagaaaaagccgucccgacuuaaaggggacaacgagaagcacagucccagaaauaugggaggcauacugggggaggaucucacauuggaccugaaagauauucagaggccagacagcgaacacggacucucuccugauucagagaacuucgacuggaaggcuauccaggaaggcgccaauuccaucgugagcagucugcaucaggcagcugccgcagccugccuuucucgccaagcuuccucggacagcgauucaauucuaucccugaagucugguauaaguuuggggagccccuuucacuuaacuccugaccaggaggaaaaaccauucaccucaaacaagggaccccggauccugaaaccuggcgagaaguccacgcucgagacaaaaaagauugaaagcgagucuaaaggcaucaaggggggaaagaaagucuacaagagucugauuaccgguaaaguaagauccaauagcgaaaucucaggccagaugaagcagccacuucaagcgaacaugcccucuauaucgcgugggaggacuaugauccauauuccgggagugcggaacagcuccaguucuacaucaccuguuagcaaaaagggcccaccccugaagaccccugccuccaaaaguccaucugagggucagacugcaacaaccagcccccgcggggcuaagccguccgugaaaucagaacucagcccugucgcccgacagacgucucagaucggaggcuccaguaaggcccccucaagaagcggcucgagggauuccacuccaucucggccugcacaacagcccuugagucgcccaauucagagccccgggagaaauucaaucuccccuggaaggaacgguauaucuccaccgaauaaacugagccaacuaccccgaaccaguuccccuagcacagcuucuaccaagucauccggcagcgggaagaugaguuacacaucuccaggacggcagaugucacagcagaaccugacuaaacaaaccggccucuccaagaaugccagcucgauuccccguucugagagugcguccaaaggucuuaaccagaugaauaacgggaauggagcuaacaagaaaguggagcugagcagaaugucaucuacgaagagcuccggcagugaaucagaccgcagcgagaggccuguauuagugcggcaguccacauuuaucaaggaagccccaucucccacuuugagacgcaaacuggaggaaagugcaagcuucgagucccucucaccuucuucgaggccggccagcccaacccgaucccaggcucaaacacccguccugaguccuucucuucccgauaugagccugucaacccacuccagcguucaggcaggcggguggcggaagcucccaccuaauuugucucccacuaucgaguauaacgacggaagaccagccaaaaggcaugauauugcgcgcagucacuccgaaucaccgagccgucugccuaucaaucggucugguaccuggaagagagagcacucgaaacauuccaguagcuuacccagggugucaacauggcgccgaacgggcucuuccagcaguauacuaucagcuuccagcgaaucuagugagaaggccaaaagcgaggacgaaaagcacgugaacuccauuucugggacuaagcagucaaaagagaaucaggucagcgcaaagggaaccuggcggaaaaucaaggaaaacgaguuuuccccaacaaacucgaccucucaaacugugaguagcggcgccacaaauggugcugaaucaaaaacccugauuuaccagauggcccccgcaguuuccaagacggaggauguaugggugagaaucgaggacuguccuauaaacaauccaaggucugggcgcagccccacuggaaacacaccuccggucauugauuccgugagugaaaaggcuaauccaaacaucaaagacucaaaggacaaucaggccaaacagaacguuggcaauggcagcgugcccaugagaaccgucgggcucgagaaccggcuuaauucuuucauccaaguggaugcgccugaccagaagggaaccgaaauuaaaccaggucagaacaaucccguaccugucuccgagacuaacgaaaguagcaucguggagaggacacccuucucaucuuccucgagcaguaagcauuccucuccaucaggcaccguugccgcacgugugacaccguuuaauuauaacccuagcccccgaaaguccucugcugauagcacuagugcccgcccaucacaaauuccuacgcccgucaacaauaacaccaaaaagagagacuccaaaacagauagcacugagucuagugggacccaguccccaaagcggcacagcggaucauaccuggugacaucgguuuga

SEQ ID NO: 52855 - RNA, 672 nt, Artificial Sequence
  derived and/or modified sequence opt3 from APCS__Homo_sapiens__NP_001630
augaacaagccccugcucuggaucagcgugcuuaccucccuguuggaggccuucgcucacacagacuuaucuggcaaagucuuuguuuucccuagagaaucagugacugaucauguaaaucugauuacgccacuagagaagccgcuccagaacuuuacccugugcuucagggcauacagugaccuuagccgggccuauucccuguuuucuuacaauacacaagggcgcgauaacgaauugcucguguauaaagagcgagucggagaauacucgcuguauauaggucgucacaaggugacuucaaaaguuaucgagaaguuccccgcgccugugcauauuugugucagcugggagaguuccucuggcaucgcugaauuuuggauuaaugggaccccacuggugaagaaaggacucagacagggcuacuucguagaggcccagcccaagaucguuuuaggucaggaacaagacagcuaugggggaaaauuugauaggucccagucauucgugggcgagauaggcgaccuguacaugugggauaguguccuuccuccagagaacaucuugagcgcauaccaggggacaccccugccugccaauauucuagacuggcaggcucucaacuaugaaauccggggauacgugauuaucaagccacuggugugggucuga

SEQ ID NO: 52856 - RNA, 2199 nt, Artificial Sequence
  derived and/or modified sequence opt3 from APEH__Homo_sapiens__NP_001631
auggagagacaggugcugcucagcgaacccgaggaagccgcugcacuuuacaggggccugucccggcaaccugccuugucugcggcuugcuuagggccagaggucaccacacaguauggaggucaguaccgcacuguucacacggaauggacccagcgagaccuggagcguauggagaacaucagauucuguaggcaauaucuaguguuucaugauggcgacucaguaguguucgccgggccggcaggaaauagugucgaaacacggggcgagcuccugagccgcgaaucccccucugguacuaugaaggccgugcuuagaaaagcugggggaaccggcccuggcgaggagaagcaguuucuggaaguuugggagaaaaacaggaaguugaaaucguucaaucucucagcacuggaaaagcacgggccaguguacgaggaugacugcuuuggaugucugagcuggagucauuccgaaacacaccucuuauaugucgccgagaagaaacggcccaaggcugagucuuucuuucagaccaaagcccuggaugugagcgcguccgacgaugaaauugcacgccuuaagaaaccugaccaggccauaaagggugaucaauucguauuuuacgaggacuggggcgaaaacaugguuucaaagaguaucccaguguugugcguccuggauguggagagcgggaauauuucugugcuagaaggaguccccgagaacguuuccccuggccaggcuuucugggccccaggugacgcaggggugguauuugugggaugguggcaugagccguuccgacucggcaucagauuuuguacuaauaggcggucagcucuguauuacgucgaucuuauuggcgggaaaugcgaacuguugagcgacgacagucucgccgugucuagcccccgucuguccccugaucagugucgcaucguuuacuuacaguauccaucgcugauaccccaccaccaaugcucucagcucugucuuuacgacugguauacaaaggugaccuccgucgugguagauguugugccuagacagcugggagagaacuucucagguaucuacugcaguuugcuaccacugggcuguuggagcgcggacucccaaagggucguguucgauucugcccagcggagccgacaggaccucuuugcagucgauacucagguggggacgguuaccucacugacagcuggaggcagugguggguccuggaaacuucugacuauugaccaagauuugaugguggcccaguucagcacccccucucucccgccuacacugaagguaggcuuuuuacccucagcuggaaaagaacagaguguccugugggugagccuagaggaagccgagccaaucccugacauucauuggggcauccgcguucuccagcccccacccgagcaagaaaaugugcaguaugcagggcuggauuucgaggccauacuuuugcagccuggauccccaccggacaagacccagguccccauggugguaaugccucacgguggcccacauucuucguuugugacggcuuggaugcuguuccccgcgaugcucugcaaaaugggguuugcaguucugcuugucaacuacagaggaagcacuggcuucggucaagacuccauucugucauugccugggaaugugggccaccaggaugugaaggacguccaguuugccguugaacaggugcuccaagaggagcacuucgaugcuagucauguggcccugaugggaggcucucacgggggauuuaucagcugccauuuaauuggucaguauccagaaacauacagggcauguguagcccggaaccccgucaucaauaucgcuuccaugcugggcucaaccgacauuccggauuggugcgugguugaggccggguucccuuuuagcucugacugucuaccagaucucuccgugugggcagaaaugcuggacaagagucccauacgcuacaucccucaggucaaaacuccccuuuugcugaugcucggacaagaggauagaagggugccauucaagcagggcauggaauauuaccgugcgcugaaaacacggaacguuccugugcgauuacugcuuuaucccaagagcacccacgcuuugucugagguagaggucgaauccgacucauucaugaaugccgugcucuggcugagaacgcaucuagguaguuga

SEQ ID NO: 52857 - RNA, 957 nt, Artificial Sequence
  derived and/or modified sequence opt3 from APEX1__Homo_sapiens__XP_005267638
augcccaagagaggcaaaaagggggccguggcugaggacggagaugaacugaggaccgagccugaagccaaaaagagcaaaacagcagcgaagaagaacgacaaagaggcugccggugaaggcccagcacucuacgaggauccgcccgaccagaagacuuccccuucugggaaaccagccacgcuuaagaucugcucauggaaugucgauggacugcgggcuuggauuaaaaagaagggcuuggacuggguuaaagaggaagcacccgauauauuaugucugcaagagaccaagugcagugaaaacaaacuaccugccgagcuccaggagcugccaggucuuagccaccaguauugguccgcucccucugacaaggaaggguacucgggagugggccuguugucacgccaguguccucucaaaguaagcuauggcaucggggaugaggaacaugaccaagagggacgagugauugucgccgaguucgauaguuuugugcugguuacagcguacgugccaaaugcaggucguggccuggucagacucgaauauaggcagcggugggacgaggccuuccgcaaguuuuuaaaagggcuggcuuccagaaagccgcuuguguugugcggagaucugaacguagcccacgaagagaucgaccuaaggaaucccaagggcaacaaaaagaaugcagguuucacuccucaggaacggcagggguuuggagagcuccugcaagcuguuccacuugccgacucuuuccgccaucuguaccccaacaccccuuaugcguacacauuuuggaccuacaugaugaaugcccgaagcaaaaacgugggcuggagauuggauuauuuccuccugucccacucauuacugccagcacucugugacaguaagauuaggagcaaagcucuuggcucugaucauugccccaucacucuguacuuggcccuauga

SEQ ID NO: 52858 - RNA, 1557 nt, Artificial Sequence
  derived and/or modified sequence opt3 from APEX2__Homo_sapiens__NP_055296
augcugagaguggucagcuggaacaucaauggcauuaggcggccccuccagggcguugccaaccaagagccuuccaauugcgcugcaguggccguaggacgcauacuugacgaacuggaugcggacaucguguguuugcaggagaccaaggucacacgagaugcuuuaacugaaccacuggccauuguggaggguuacaacucuuauuucucauuuagucguaauagaagcggcuacuccgggguugcaacguucugcaaagacaacgccaccccgguggcugcagaagagggacuaucuggccucuuugccacacagaauggugaugucggguguuauggaaacauggacgaguucacucaggaagaacugagggcucuugauucggaaggccgggcccuguugacccaacacaagauccgcacaugggagggcaaagagaagacccucacucugauuaauguguacugcccccaugcggacccugggagaccagaaaggcugguauuuaaaaugcgguucuaucgccucuuacagauccgagcagaggcccugcuugcugccggaucacacguuauaaucuugggugaucugaacacagcacauagacccauugaccacugggaugcugugaaucuagaauguuuugaggaagacccuggcaggaaguggauggauagccuccugaguaaccuugggugccaguccgccucucaugucggaccauucaucgacagcuaccgguguuuucagcccaagcaagagggcgcguuuaccugcugguccgccgugacgggugcacgucaccugaauuaugggucacgcuuggacuacgugcucggagauagaacucuggucauugacaccuuccaggcuaguuucuuacugccugagguuaugggcagcgaucacuguccagugggcgccguacucucuguguccucagucccggcuaaacagugucccccucuuugcacaagguuucugccagaguucgccgggacucaguugaagauccuacgguuccuggugccccucgagcaaagcccuguucuggaacagaguacccuucagcauaacaaucaaacacgagugcagaccugccagaacaaagcacagguccgcucuacgagaccacaacccucccaggugggaagcucgaggggucagaagaaccugaaaucuuacuuucagccguccccuucaugcccccaagccaguccagacauagaguugccuagccucccccugauguccgcuuuaaugacuccaaagacacccgaagagaaggcgguagcaaaaguugugaagggccaggccaaaaccucugaggcuaaggaugaaaaagagcugcggacuagcuucuggaagucaguccuagccgggccucuccgcacaccacuguguggaggccacagagaaccgugcgugaugaggaccgucaaaaagcccgguccuaaucuugggcgucgguuuuauaugugugcacgaccaagagggcccccuacggacccaaguuccaggugcaacuucuuuuuguggagccgccccucuuga

SEQ ID NO: 52859 - RNA, 651 nt, Artificial Sequence
  derived and/or modified sequence opt3 from APH1B__Homo_sapiens__NP_001139118
augaccgccgcuguguucuuuggcugcgcauucaucgccuuugggcccgcgcuggcucucuacgucuucacaauugccacugagccucuuagaauaaucuuucugauugcaggagccuucuuuugguugguuagcuuacugaucuccucucuagugugguucauggcuaggguaauuaucgacaacaaggaugguccaacgcagaaauaucuccugauauuuggcgcauucgugucagucuacauccaagaaauguuucgguucgccuauuacaaacuucugaagaaggcuagugagggguugaaaagcauuaauccgggagaaaccgcccccuccaugcgccuccuggcguaugcauuuaugacacuggugaucauucucuuacacguuuucuggggcaucguguucuuugacgguugugagaagaagaaaugggggauacugcuuauugucuugcugacucaucuacucgugucugcccagaccuucaucucgucauacuauggaauuaaccuggcuagcgccuuuaucauccuuguacugaugggcacaugggcauucuuggcugccggcgggaguugccgaucccucaagcuguguuuacugugccaggauaaaaauuuucuccuuuacaaccagcguucuagauga

SEQ ID NO: 52860 - RNA, 1575 nt, Artificial Sequence
  derived and/or modified sequence opt3 from API5__Homo_sapiens__NP_001136402
augcccaccguggaggaacuguacagaaacuauggcauccucgccgacgcuacagagcaggucgggcaacacaaggaugcauaccagguuauucuugacggagugaaagguggcacuaaggagaaaaggcuggccgcgcaguucauaccuaaguuuuucaaacauuuuccagaguuggcugauagcgccaucaaugcacaguuagaccugugcgaagaugaggacguauccauucggcgccaagccaucaaggagcuaccgcaguucgcuacgggggaaaaccucccccgaguggcagauauucugacccagcuucugcagacagacgauucugccgaguuuaauuuggucaacaaugcucuccugucaaucuucaagauggacgccaaaggaacucugggcggucucuuuagucaaauauuacagggggaagauaucgugcgugagagagcgauuaaguuccugagcaccaaacuuaagacauugccugacgagguucugaccaaagaaguggaggaacuaauccucacugaguccaagaagguccuggaagaugugacaggagaggaguuuguacuuuucaugaaaauucugucuggcuugaagucgcuccagaccguuucaggcaggcagcaacugguggaauuagucgcagagcaggccgaccuggaacagacguuuaacccaagcgaccccgauuguguggaccggcuccuucaaugcacucgccaggcugugccucuguucaguaaaaauguccacuccaccagauuuguuacauauuucugugaacagguguugccaaaccuagggacucugaccacacccguagaaggacucgauauccagcuggaggugcuuaagcuguuggccgagaugucuagcuucugcggugacauggaaaaacucgagaccaaucugaggaaguuauuugauaaacugcuagaauacaugccucucccaccggaggaagcagagaacggcgagaaugcugggaacgaggaacccaagcugcaauucuccuaugucgaaugucuuuuguacucauuucaucagcugggacggaagcucccugacuuccugacggccaaacuuaaugcggagaagcugaaagauuuuaagauacgcuugcaguauuucgcccgaggccuccagguguacauuagacaacugagguuagcacugcaggguaaaacuggggaggcucuaaagacagaagagaacaagaucaaaguuguggcccucaagauuaccaauaacaucaacguccugaucaaagaccuuuuucacauuccacccaguuacaagagcacugugacauugucuuggaaaccuguacagaagguugaaauaggacagaagcgggcuuccgaggauaccacgucaggcagcccacccaaaaagaguucugccggcccgaaacgugacgcacgccaaaucuauaauccucccuccgggaaguacagcucgaaccugggaaauuucaacuaugaacagagaggugccuuuaggggcucucgagggggacggggcugggguacccgcgggaauagauccaggggccggcucuacuga

SEQ ID NO: 52861 - RNA, 729 nt, Artificial Sequence
  derived and/or modified sequence opt3 from APIP__Homo_sapiens__NP_057041
augagcggcugcgacgccagagagggggauuguugcuccaggcgguguggagcucaggacaaggaacacccccgcuaccugaucccugagcucugcaaacaauucuaucaucuugguugggugaccggcacagggggaggcauuucucugaagcacggugaugaaauauacaucgcaccaucagggguccagaaagagcguauucagccggaagacauguuuguuugugauaucaacgagaaggacauuaguggacccagcccuuccaaaaaguugaagaaaucucagugcacuccauuauucaugaaugccuauacgaugcgaggcgcgggcgcugugauccauacccacucgaaggccgcaguaauggccacacugcuauuucccgggagagaguucaaaauaacucaucaagaaaugaucaagggaauuaaaaaguguaccucagguggcuacuauagguacgaugacaugcucguggucccuaucauugagaacacaccagaagagaaggaucugaaagaccggauggcucacgcaaugaaugaguaucccgauagcugcgccgugcuuguucgcagacacgggguguacgucuggggagaaaccugggagaaggcuaaaacuaugugugaaugcuacgacuaucuguuugauaucgccgugaguaugaagaaaguaggcuuggacccuucccagcucccaguuggugagaacgggauaguguga

SEQ ID NO: 52862 - RNA, 234 nt, Artificial Sequence
  derived and/or modified sequence opt3 from APLN__Homo_sapiens__NP_059109
augaaccugagacucugcgugcaggcccuucuguuguuauggcugagccuaaccgcugucuguggcgggucccucaugccccugccugacggaaauggucuugaggauggcaacguuaggcaccuggugcaaccacgggggucucgcaauggaccgggccccuggcagggugggcgacguaaguucagaaggcagcggccucgcuugucacauaaaggaccaaugcccuuuuga

SEQ ID NO: 52863 - RNA, 1143 nt, Artificial Sequence
  derived and/or modified sequence opt3 from APLNR__Homo_sapiens__NP_005152
auggaggaaggcggggacuucgauaacuacuauggagccgacaaucagagcgagugcgaauacaccgauuggaaguccucuggugcucugauccccgcaauuuauaugcucguguuucuucugggcacaacugggaacggauuggucuuauggacgguuuucagaucaaguagggagaaacggcgcagcgccgacauauuuaucgcgucccuggcuguggccgaucuaaccuucguagugacacucccucugugggcaacuuacaccuaucgagacuacgauuggccauuuggcacauucuuuuguaaacuuucuucguaucugauuuucgucaauauguacgccucaguguuuugcuugaccggucucagcuucgaccguuaccuggcuaucguuagaccgguggcaaacgccaggcugcggcuccgcgucaguggggcuguggccacugcgguauuauggguucuggcagcccuuuuggcuaugcccgugaugguccugagaacaaccggagaucuagaaaauacgacuaaggugcaauguuauauggacuacuccaugguggccaccgucucuagcgagugggcaugggagguuggccucggcguguccucaacaacuguaggguuuguggucccuuucaccauuaugcugacaugcuacuuuuucaucgcucagaccauagccggacacuucaggaaggaacggaucgagggucuucgcaaacgaagaaggcuguugaguauuaucgugguucucguggucacguuugcgcuguguuggaugccauaucauuuagugaagacucuguauaugcucggcagccuucugcacuggcccugcgauuucgacuuguuucuaaugaacauuuucccuuacuguacaugcaucucuuauguaaauuccugucugaacccauuucucuacgccuucuuugauccccgguuccgucaggcaugcaccucaaugcuguguugcgggcagagccgcugcgcuggaacuagccauucuuccagcggcgaaaagucggccucuuacuccucaggucacagucaagggccuggaccaaauaugggcaaaggcggggagcagaugcaugagaagaguauaccguauucccaggaaacacuuguuguggacuga

SEQ ID NO: 52864 - RNA, 1956 nt, Artificial Sequence
  derived and/or modified sequence opt3 from APLP1__Homo_sapiens__NP_001019978
augggccccgccagcccugcugcaagagggcuguccaggcggccaggacagccgccccucccucuucuguugccauuacugcuacuccugcuucgcgcccaacccgcgaucgguucucuggcuggcgggucaccuggagccgcagaggccccaggcagugcucagguggcagguuugugcgggcgacucacccugcaccgugaccugagaacaggaaggugggaacccgauccucagcggagccgcagaugucucagggacccacagcgggucuuagaguacugccgccaaauguauccggaacugcagauugcccgaguugagcaggcuacucaggccauacccauggaaagaugguguggcggcuccaggucugggucgugcgcgcauccucaccaucaagugguaccauuccggugucuucccggagaguuugugucagaggcauugcuggucccugaagguugccguuuccuacaccaggagcgcauggaucagugugaaagcaguacgagaaggcaucaggaggcccaagaggcuugcuccucucagggccucauccugcacgggagcggaaugcuucugccauguggcuccgaccgguuucgagguguggaauacguuugcugucccccgccugggacccccgauccaucaggaacagccgugggcgacccuaguacucgcagcuggcccccaggcucuagagucgagggggcagaagaugaggaagaggaggaauccuucccccagccuguggacgauuauuuuguagagccaccgcaagcugaagaggaagaggagaccguucccccuccaucaagccacacauuggccguggucggaaaggugacccccacuccuaggccaacagacgguguggauauuuacuucggcaugcccggggaaaucagugagcaugaaggauuucuccgggcgaaaauggaccuggaggaacgcagaaugaggcagauuaacgaggucaugcgugagugggccauggcagauaaucagucuaagaacuuaccgaaagcugaccggcaggcccugaaugaacacuuccaauccauccuccagacccuugaggaacagguuagcggcgagcgacagagacugguggagacgcaugcuacuaggguaauagccuugaucaacgaccaacgccgggcagcccuagaagguuuucuggcugcgcuccaggcagauccuccacaggccgagagagugcugcuugcucugaggcgcuauuugcgagccgaacagaaggagcaacggcacacccuccgucacuaccagcaugucgcagccguggaccccgaaaaagcucagcagaugagauuccaaguucacacacauuuacaggugauugaggagagggucaaucagucgcuggggcugcuagaucaaaacccucaccucgcccaggaacugcgcccccagauccaggagcuuuugcauucugaacaccugggcccauccgagcucgaagcgccugcacccggaggcucaagugaggacaaagggggacugcaaccaccggauagcaaggacgcugauacuccuaugacccuucccaaggguuccacagagcaggacgccgcaucuccagaaaaggagaaaaugaauccccuggaacaguaugagcggaaggugaacgccagcguaccuagaggcuuuccauuccacucaagugaaauucagagggaugaguuggcucccgccgggaccggaguuucccgagaggcagugagcggccuccugaucaugggugcugggggcggaucuuuaauaguccugucaaugcuacuccugcgccggaaaaagccuuacggcgccauuagucaugggguggucgaaguggacccgaugcuuacguuggaggaacaacagcugagagagcuccagaggcacggauacgagaauccaacuuaucguuuucuggaggaacgccccuga

SEQ ID NO: 52865 - RNA, 2256 nt, Artificial Sequence
  derived and/or modified sequence opt3 from APLP2__Homo_sapiens__NP_001135748
auggccgcuaccggcacagcagccgcggcugccacugggagacugcuccuucuguuguuagugggacugacggcacccgcccuagcucucgcagguuacaucgaggcccuggcugccaacgcgggcaccggguucgcagucgccgaaccucagauugcuauguuuugcggaaaacuuaauaugcacguuaacauacaaacaggcaaaugggagccagacccgacugguaccaagagcuguuucgaaacaaaagaggaagugcugcaguauugccaggagauguaccccgaguugcagaucaccaauguaauggaagccaaccaaaggguguccauugauaauuggugucggcgcgacaagaaacagugcaagucucgauuugucacuccuuucaagugucucgugggggaguuuguuucagaugugcugcuggucccagaaaaaugccaguucuuucauaaggagcguauggaggugugugaaaaccaccagcauuggcacacaguaguuaaagaggcaugccucacccaaggaaugacguuauauaguuacggcaugcugcuucccuguggcguggaccaguuccaugggacugaauaugucugcuguccucagaccaagaucauuggaagcguguccaaagaggaagaggaggaagaugaggaagaggaagaggaggaagacgaggaagaggauuacgacguguauaagucugaauuuccaacagaggcugauuuggaggacuucacugaagccgcggucgaugaggacgaugaagacgaggaggaaggugaggaaguuguggaggacagagauuacuacuaugacaccuuuaagggcgaugacuacaaugaagagaaccccacagagccugggucggauggaaccaugucagacaaagaaaucacgcacgauguaaaggccgugugcagccaggaggcaaugacuggcccaugcagggcugucaugccgcggugguauuucgaccugaguaaagguaagugugugcgcuuuauauacgggggaugcggcggcaauagaaacaauuucgaauccgaggauuauuguauggccguuugcaaagcuaugauucccccuacaccacuacccaccaacgacguggaugucuacuucgaaacuucugccgacgacaaugagcacgcaagguuucaaaaggccaaagagcagcucgaaauccggcaucgcaaccgaauggauagagugaagaaggagugggaagaggcugaacugcaggcgaaaaaucuuccuaaggcagagaggcaaacacugauccagcacuuccaggccaugguaaaggcuuuggagaaggaagccgcaagcgagaaacagcaacucguugaaacccaucuggcccggguggaggcuauguuaaacgaccgucgcagaauggcccuggagaacuaucucgcagcgcuucaguccgauccacccaggccgcaccggauucugcaggcuuugcgacgcuacgucagagccgaaaauaaggacaggcuacacacgauccggcauuaccagcacgugcuggcagucgauccugagaaggccgcucaaaugaaaucacaggugaugacccaucuccacguuauagaggaacgcagaaaccagagucugagccuucuguauaaggugcccuacguagcccaggaaauucaagaggagaucgacgaauugcuccaggagcagagggcagauauggaccaguuuacagcuucuauuuccgaaacuccagucgaugugcguguuucaagcgaggaaagugaggagaucccucccuuccauccauuucaccccuucccugcccugccagaaaaugaggggucuggagugggugaacaagacggcggguuaaucggagcggaggaaaaagucauuaacuccaagaauaaaguggaugagaacaugguaauagacgagacccuggaugugaaggaaaugaucuuuaaugccgagcggguuggcggucuagaagaggagcgagaaagcgucgggccgcucagagaggacuucucgcugucuuccucagcucuuauuggcuugcuggugaucgcaguggccauagcuacagucauuguuaucagucucgugaugcugaggaagcgccaguauggaacuaucagccacggcauuguggaaguagaccccaugcuuaccccugaggaacggcaucugaacaaaaugcagaaucacggguacgagaacccaacauauaaguacuuggagcaaaugcagaucuga

SEQ ID NO: 52866 - RNA, 867 nt, Artificial Sequence
  derived and/or modified sequence opt3 from APOA1BP__Homo_sapiens__NP_658985
augagcagacugagggcccuccuuggccugggguuguuaguggcuggaucccgggucccccgcaucaagucucagaccauugcaugccgaucagguccuacaugguggggcccacaacgucugaacagugggggaagaugggacagcgagguuauggccuccacugugguaaaauaccuaucucaggaagaggcgcaggcuguggaucaggaacucuucaaugaguaucaauuuucggucgaccagcugauggaacuugccggccugucaugugcaacggccauagcuaaggcauacccgcccaccagcaugaguagguccccuccaacaguguugguuaucugcggucccgggaacaauggaggcgauggccucgugugugcccggcaccugaaacuguucggguaugagccuacuauuuacuauccaaagcgccccaacaaaccucucuuuaccgcuuuagucacacagugccagaagauggacaucccauuccugggagagaugccggccgaacccaugaccauugaugagcuuuacgaauuggugguagacgcgaucuuugguuucucuuuuaagggcgauguuagagagccuuuccauagcauacuguccgugcuaaaagggcucacugucccaaucgcaucaauugacauccccaguggaugggauguggagaagggcaaugccggugggauucaaccugaccugcuuaucagccugacagcucccaaaaagucugccacccaguuuacgggaagguaucacuacuugggcggccgguucgugccaccggcacucgagaaaaaguaccagcugaacuuaccucccuauccagauacugaaugugucuaccgccugcaguga

SEQ ID NO: 52867 - RNA, 303 nt, Artificial Sequence
  derived and/or modified sequence opt3 from APOA2__Homo_sapiens__NP_001634
augaagcugcucgccgcuaccgugcuucuguugacaaucugcagcuuagagggcgcacuggucagaaggcaggccaaagaacccuguguugagucccuagugucucaauacuuccagacuguaacggacuaugggaaggaucucauggaaaaagugaagucaccugagcugcaggcggaagcuaaaaguuacuuugaaaagagcaaggagcagcuuaccccacugauuaaaaaggccggaacagaguuggucaacuuccucuccuauuuuguggagcuggguacucaaccggcaacccaguga

SEQ ID NO: 52868 - RNA, 1191 nt, Artificial Sequence
  derived and/or modified sequence opt3 from APOA4__Homo_sapiens__NP_000473
auguuccugaaggccgugguccucacccuugcucugguugcaguggccggcgcgagagcugagguaagcgccgaccagguggcaacagucaugugggauuacuuuucccaauugucuaacaaugccaaagaagcuguggagcacuuacagaagucagaacugacucagcagcuaaacgcacucuuccaagacaaacugggggagguuaauacguaugccggagaucuucagaagaaacuggugcccuuugcuaccgaauugcaugagaggcucgccaaggacagugagaagcugaaagaagagaucgguaaggaacuggaggagcuccgggcgcgcuuacugccucacgcaaacgaagucagccagaaaauuggcgauaaucuucgagaguugcagcaacgucuggaaccauacgccgaccagcuaagaacacagguguccacucaggcugagcaacucaggcggcagcugaccccguaugcccagcgcauggaaagaguacuuagggagaacgcagauucucugcaggcuucguugcggccccaugccgacgagcucaaggcgaaaauagaucagaauguugaagaacugaaggggcgcuuaacaccuuacgccgacgaguucaaggugaaaaucgaucagaccgucgaggaacugcgaagaucacucgcaccauaugcucaggacacucaagagaaacuuaaccaccagcuggagggauugacauuucagaugaagaagaaugccgaggagcuaaaagcuaggauuagcgccagugcagaggaacugcggcagcgucucgcuccccuggccgaagaugugcgcggcaaccuuagagguaauaccgaggggcugcaaaaguccuuggcggagcucggaggccaucuggaccaacagguggaagaguucaggcggcgagucgaaccuuacggcgagaacuuuaauaaagcauuaguucagcaaauggagcagcugcgccagaagcuagggccacacgccggagacguggaaggucaccucucuuuccuggagaaggaucuuagagacaaaguaaacagcuuuuucuccacguuuaaggaaaaagagucacaggauaagacuuugagucugcccgaacucgagcaacagcaggagcaacagcaggaacagcaacaggaacaggugcagaugcuggcuccucuugaaagcuga

SEQ ID NO: 52869 - RNA, 1101 nt, Artificial Sequence
  derived and/or modified sequence opt3 from APOA5__Homo_sapiens__NP_001160070
auggccagcauggcugcagugcugaccugggcccucgcgcuucuguccgcuuucucugccacacaggcaagaaagggcuuuugggacuacuucucacaaacgaguggggauaaaggaagggucgagcagauccaccagcagaagauggcccgggaacccgcuacuuugaaagacagcuuagagcaagaucugaacaauaugaacaaguuucuagaaaaacuccgcccucuguccgguucugaggcaccacgacuuccgcaggaccccguuggcaugcguagacagcugcaggaagaguuggaggaagugaaggccaggcuccaaccuuauauggcugaggcccaugaacugguaggguggaaucuggagggacuccggcagcaguuaaagccauacaccauggaucugauggaacagguggcgcuucgcguccaagaauugcaggagcagcugagagugguuggcgaagacacaaaagcacaacuacucggugggguggaugaggccugggcucugcuucagggacugcagucgagggucgugcaccauacuggccgguucaaggaauuguuucaccccuaugccgagucacucguaagcggcauugggcgccauguucaggagcugcaccgaaguguggcaccucacgcuccagccucccccgcgagauuaucuaggugcguccaagugcugagccggaaacucacccuuaaggccaaagcacugcaugcucguauacagcagaacuuggaccagcuacgcgaggagcuguccagagccuucgcuggaacagguaccgaagagggcgccgggccugauccacaaaugcucucagaagaggugaggcagcggcugcaggcauuucgacaggacacuuaccuucaaaucgccgcuuucacacgcgcgauugaucaggagaccgaagagguccagcagcaacuggcaccgcccccuccaggacacagugccuuugcucccgaguuccagcagacggacagcggcaagguuuugucuaagcuccaagccagacuggaugacuuaugggaagacaucacucauucccugcacgaucagggucacucacaucuaggggacccuuga

SEQ ID NO: 52870 - RNA, 711 nt, Artificial Sequence
  derived and/or modified sequence opt3 from APOBEC1__Homo_sapiens__NP_001291495
augaccagcgagaagggccccuccacaggggacccuacucugagaaggcggaucgaaccaugggaguucgauguguuuuacgacccgcgcgaacuccgaaaagaggccugccuucuguaugaaauuaaguggggaaugucucguaaaauauggagaucaagugguaagaacacgaccaaucacgucgagguuaacuucaucaaaaaguuuacaagcgagagggauuuccaucccuccaugucuuguucgauuacuugguuuuugucauggagcccuugcugggaauguagucaggcuauccgggaguucuuaucccgccacccaggcgugacccugguaauuuacguggcaagacuauuuuggcauauggaccaacagaauaggcaggggcuccgggaucuggucaacucuggagugacaauccagauaaugcgcgccagcgaauauuaccacugcuggcgaaauuucguuaacuaucccccuggcgacgaggcgcauuggccacaauaucccccucuuuggaugaugcuguacgcuuuggagcuccacuguaucauucugucccugccaccgugccucaagaucucaagaagguggcagaaucacuuaaccuuuuuccggcugcaucuucagaacugucacuaccagacuauucccccucauaucuugcuggccacaggucuaauacacccaaguguggcauggcguuga

SEQ ID NO: 52871 - RNA, 675 nt, Artificial Sequence
  derived and/or modified sequence opt3 from APOBEC2__Homo_sapiens__NP_006780
auggcccagaaggaggaagcugcaguggccaccgaggcggcuagccaaaacggcgaagaccuggagaaucucgaugaccccgaaaaacuuaaggagcugaucgaguugccuccauucgaaauugucacaggggagagauuaccggccaacuuuuucaaauuucaguucaggaauguugaauacuccucuggacggaacaagacuuuucugugcuaugugguagaggcacaggguaaaggcggacaggugcaagccucacgcggguaccuagaggaugaacacgcugcagcccaugcugaggaagccuucuuuaauacgauacuccccgcguucgacccugcacugcgauauaacgucaccugguacgugaguagcuccccaugugccgcuugcgccgaucguaucauuaagacacuuucuaagacuaaaaaucugagauugcucauccugguuggcaggcuguuuaugugggaggaacccgagauucaggcagcucucaagaaauuaaaggaggccgguuguaaacugcggaucaugaagccucaggacuucgaauauguguggcagaacuuugucgagcaagaagagggggaaucgaaggcguuccagccaugggaggauauacaggagaauuuucuuuacuaugaagagaaauuggccgacauccugaaguga

SEQ ID NO: 52872 - RNA, 600 nt, Artificial Sequence
  derived and/or modified sequence opt3 from APOBEC3A_B__Homo_sapiens__XP_011545347
auggaggccagccccgcuuccggcccuagacaccugauggacccacauaucuucaccucuaacuuuaauaacgggauuggaaggcacaagacauaccucugcuaugaaguggagcggcuugauaaugguacuucagucaaaauggaccagcaucgcggcuuccugcacaaccaagcaaagaauuuguuauguggguuuuacggacgacaugccgaacugcguuuccuagaucucguuccgagucugcagcuugaccccgcgcagauauauagagugacgugguuuaucagcugguccccuugcuucucuuggggcugugcuggugagguaagggccuuucugcaggaaaacacccacgugcgguugcgcauuuucgcagccagaaucuacgauuaugacccacucuacaaagaggcucugcaaaugcugagggaugcaggggcccaggucucgauuaugacauaugacgaguuuaagcacugcugggauacuuucguggaccaucagggaugucccuuucagccuugggauggccucgacgaacacucacaggcuuuaagcggccggcugcgcgccauccuucaaaaucaggggaacuga

SEQ ID NO: 52873 - RNA, 1074 nt, Artificial Sequence
  derived and/or modified sequence opt3 from APOBEC3B__Homo_sapiens__NP_001257340
augaacccccagaucagaaauccuauggagaggauguaccgggacaccuucuaugauaacuuugaaaaugagccaauucuguacggccgcagcuauacauggcucugcuacgaagugaagauaaaacgagggcguuccaaccuucugugggacacuggagucuucagaggucaaguuuauuuuaagccgcaguaccacgccgagauguguuucuugucuugguuuugcggcaaucaguuacccgcuuauaaauguuuccagaucacgugguuugugucauggaccccuugcccagauuguguagcaaagcuggccgaguuccuaagugagcaucccaacgugacacucacuauuagcgcggcuaggcuguacuacuauugggagcgggacuaccgcagagcccuuugcaggcugucccaagcaggggcccgggucaaaaucauggauuaugaagaguuugcuuacuguugggaaaauuucguguauaacgagggacagcaguuuaugccuugguacaaguucgacgagaauuaugcauuuuugcaccgcacccucaaggaaauucugcgauaccugauggauccagacacauucaccuucaacuuuaauaacgauccccucguuuuaagaaggcggcagacuuaccugugcuaugagguggaacgucuugacaauggcacaugggucuugauggaucaacauauggguuuccuguguaacgagcuagacccugcccagaucuaccgcgugaccugguuuauaucuuggucgccaugcuucucaugggggugugcuggagaaguaagagccuuucuccaggagaauacgcacguuaggcugcggaucuucgcggcacgaauuuaugauuacgacccgcuuuauaaagaggcccugcagauguugcgcgacgcuggcgcccaagugagcaucaugacuuacgaugaauuugaguauugcugggacaccuucgucuacagacagggcugccccuuucagccuugggaugggcucgaagaacauagucaagcacuguccggaagguuacgggcuauucugcagaaccaggguaacuga

SEQ ID NO: 52874 - RNA, 573 nt, Artificial Sequence
  derived and/or modified sequence opt3 from APOBEC3C__Homo_sapiens__NP_055323
augaacccccagaucagaaauccuaugaaggccauguacccaggcaccuucuauuuucaauucaaaaaccugugggaggcuaaugacaggaacgaaacauggcucugcuuuacuguggaggggauuaagcggcgcagcgucguuuccuggaaaacgggaguguuccgaaaucagguagauucugaaacccacugucaugcagagcguugcuuucuuucaugguucugugacgauauacugaguccgaacacaaaguaccaggugacuugguauaccagcuggucccccugcccugacugugccggugaagucgcggaguuuuuggcuagacacucuaaugugaacuuaacaaucuucaccgccaggcuguacuauuuucaguacccaugcuaucaagagggccuacggucgcucucacaggaagggguugcaguggagauuauggauuacgaagacuucaaauacuguugggagaauuuugucuauaacgauaaugagcccuucaagccuuggaagggacugaaaacuaacuuucgccuucugaagagaagguugcgggaaagccuccaguga

SEQ ID NO: 52875 - RNA, 306 nt, Artificial Sequence
  derived and/or modified sequence opt3 from APOBEC3F__Homo_sapiens__NP_001006667
augaagccccacuucagaaacaccguggagaggauguaccgggacacauuuagcuauaauuucuacaaccgcccuauccugucccgacguaauacugucuggcucugcuaugaaguuaaaacgaagggcccaucuagaccgaggcuugaugccaaaauuuuucggggacaggugccccgcucauucauaagagcuccuuuucaaguacugaguagcccauucgggcagugugcacccccucaugguaccgcccaggugcaguggccaccccaauugacagcgggcagggagcaggggcggccuuga

SEQ ID NO: 52876 - RNA, 1155 nt, Artificial Sequence
  derived and/or modified sequence opt3 from APOBEC3G__Homo_sapiens__NP_068594
augaagccccacuucagaaacaccguggagaggauguaccgggacacauuuagcuauaauuucuacaaccgcccuauccugucccgacguaauacugucuggcucugcuaugaaguuaaaacgaagggcccaucuagaccgccccuugaugccaaaauuuuuaggggacagguguacucagagcugaaguaucauccugaaaugcgguucuuucacugguucaguaaauggcgcaaguugcauagagaccaagaguacgaaguaaccugguauauaagcugguccccauguacaaagugcacuagggauauggcuaccuuuuuagcagaggaccccaaagugacacugaccaucuucgucgcccggcuauacuacuuuugggauccugacuaucaggaggcgcuccgcucucugugucagaagcgagaugggccaagagcuacuaugaaaauuaugaacuacgacgaguuccagcacugcuggucgaaguuuguguauucacaaagggaacuuuucgaacccuggaauaaccugccuaaauacuauaucuugcuccauauuaugcugggugagauccugcggcacagcauggauccaccgacauuuaccuucaauuucaacaaugagcccuggguucguggccgccacgaaacguaccucuguuaugagguggaaagaaugcauaacgacacuugggucuuacugaaucagaggcggggguuucuuugcaaccaggccccucacaagcauggauucuuggagggccgacacgcagaacuguguuuucuagaugugauaccauucuggaagcucgaccuggaucaggacuaccgcguaaccugcuuuacaaguuggucccccuguuucucuugcgcccaagagauggcuaaauuuaucagcaagaauaaacacguuucccuuuguauuuucacugcaagaaucuacgacgaucaggguaggugccaggaggggcugcggaccuuggccgaagcuggagccaagauuucaaucaugacauauagugaguuuaaacauugcugggacaccuucguggaucaccagggcuguccuuuucaaccaugggacggccucgaugaacauagccaggaccugucugggcgcuuaagagcgauacugcagaaccaagagaauuga

SEQ ID NO: 52877 - RNA, 549 nt, Artificial Sequence
  derived and/or modified sequence opt3 from APOBEC3H__Homo_sapiens__NP_001159474
auggcccugcucaccgcugagacauucagacuucaguuuaacaauaagaggcggcugcgccgacccuacuauccucguaaagcauuguuaugcuaccaacugacuccacagaacggcagcacgccgaccagaggguauuucgaaaauaagaaaaagugucacgccgagaucugcuuuauuaacgaaauaaaauccaugggacuagacgagacacaguguuaccaggugacuugcuaucucaccuggucucccuguucaaguugcgcgugggaacuggucgauuucaucaaggcucaugaccaccuuaaucuggguauuuuugccagcagguuguacuaucauugguguaagccucaacagaaaggccuccggcugcugugcgggucccagguuccaguggagguaaugggauuccccgaguuugcagauuguugggaaaacuucguggaccacgagaagccucucucuuuuaauccauacaaaauguuagaggaacuggauaagaacucgcgcgccaucaaaagaaggcuugagcggauuaagucauga

SEQ ID NO: 52878 - RNA, 13692 nt, Artificial Sequence
  derived and/or modified sequence opt3 from APOB__Homo_sapiens__NP_000375
auggaucccccuagaccagcccugcucgcacuucuggcuuugccggccuuacugcugcuccugcuugcgggcgcuagggccgaggaagagaugcuggaaaacgugagcuugguaugccccaaggacgcaacccgguucaagcaccuccgcaaguacacauauaauuacgaggccgaauccucuucagggguuccuggaacugcugauagccgaagcgcaacgcguaucaacuguaaaguggagcuggagguaccacagcugugcuccuuuauucucaagaccucucaauguacauuaaaagaaguguaugguuucaaucccgagggaaaggcccugcuuaagaaaacuaagaacucggaagaguuugcugccgcgaugucaagauacgaguugaaacuggcaauaccugaagggaagcaggucuuccuuuauccagagaaagaugaacccaccuacauccucaauauuaagaggggaaucauuagcgcccugcuugugccuccagagacagaagaggcuaagcagguucuguuuuuggacaccguguauggcaacugcaguacucauuucacagucaaaacccggaaggguaauguggccacggagaucuccacugaacgcgaucucgggcagugugacagauuuaaaccgauaaggaccggaaucucuccccuggcauuaauuaagggcaugacacggccucugagcacucucaucuccucaagucaaagcugccaguacacccuugaugcuaaacgcaagcacguagccgaggcgauuuguaaagaacagcaucuguucuugccauuuucuuacaagaacaaguauggcaugguugcccaggugacacaaacccucaaacuggaggacacgcccaagaucaauucccgauucuuuggggaaggaacuaaaaagaugggucucgcauucgagucaacaaaaagcaccaguccuccaaagcaggcugaggccguccugaagacucuucaggaacugaaaaaguugacaauaucugagcagaacauucaaagagcuaaucucuuuaacaaacuggugaccgaauuaaggggccuguccgaugaggccgugacgagccuacucccccagcugaucgaagucucgucuccgauuacccuucaggcauugguucaaugcgggcagccucaguguuccacacacauccugcaguggcucaagcgggugcaugccaauccccugcuuaucgacguagugacuuaccuggucgcuuugauuccagagccuucagcgcaacagcuccgugagauauucaacauggcacgcgaucagagaaguagggccacccuguaugcuuuaagccacgccgugaauaacuaccacaaaacaaaccccacuggaacccaggaacugcuagacaucgcaaauuaucucauggagcaaauucaggaugacugcacaggcgacgaagauuacaccuaucugauccuucggguuauagguaacauggggcagacuauggagcaguugacgccagagcugaaguccucuauucucaagugugugcaaagcacaaaacccucacugaugauccagaaggccgcuauccaggccuuacgaaaaauggaaccuaaggacaaagaucaggagguccugcuucaaaccuucuuggacgaugcaaguccaggagacaagcgccucgcggcuuaccugaugcuaaugagauccccgagccaggccgauauuaauaagaucgugcagauucugcccugggaacaaaacgagcaggucaagaauuuuguugcaucucauauagccaacauccucaauucagaagaacuggacauucaggaucuuaagaaauuggugaaggaggcucugaaagaaagucaguuaccuacugucauggacuucaggaaguuuagccggaacuaccaacucuauaaauccgugucucugccaucgcuugaucccgccagcgcaaagaucgagggcaaucugaucuucgacccuaacaauuacuugccaaaggaauccaugcucaaaaccacacugaccgcuuuuggcuucgccucagcggaccuaauugagauagggcuggaaggaaaggguuuugagcccacucucgaggcccuguucggcaaacagggguuuuucccggauagugucaacaaggcucuuuauugggugaauggacagguuccugacggcgugucuaaaguauuggucgaucacuuugguuacacaaaggacgauaagcaugaacaggacauggugaacgggaucaugcugagcguugagaaauuaauuaaggaucucaaauccaaggaagugccagaggcacgcgccuaucugagaauccuuggcgaagaacugggauucgcuucacuacacgaccuccaacuguugggcaaacuguuacucaugggggccaggacgcugcagggcauuccccagaugaucggugaggucauacguaagggcagcaagaaugacuuuuuccuucacuacaucuucauggaaaacgcauuugagcugccuaccggggcgggauugcagcuccaaauuucuuccaguggcgugaucgcccccggugcuaaagccgggguaaagcuggaaguggcaaacaugcaggcugagcuaguugccaaaccaagcgucucuguggaguucgugacuaauaugggcauuaucauaccugacuuugcacgguccggaguccagaugaacacaaauuucuuucaugaaucaggccuggaggcccacguugcucuuaaggcggggaaacucaaguucauuauccccaguccaaagcgaccggugaaacuguugagcggagguaacacccugcauuuagugucgacaacuaagaccgaaguaauuccuccccucaucgagaauagacaauccuggucugucugcaaacagguguuuccaggccugaacuauugcacgagcggggccuacucaaaugcaaguuccaccgauucugcuagcuacuauccccuuacaggagacacuaggcuggaauuggagcuccgcccuaccggcgagauagaacaguacuccguuucagccacauaugagcugcagcgggaagauagagcccuaguggacacucugaaguucgucacccaagcugagggugcaaaacagacggaagccacaaugaccuuuaaguacaacaggcagagcaugacucuuaguucugaggugcagaucccagacuucgauguugaccucgggacaauucugcgcgugaaugaugaguccaccgaaggcaaaacuagcuaucgauugaccuuagacauccaaaacaagaagauuacagagguagcgcugaugggacaccucucgugugauacgaaagaagaacggaagaucaaaggcgucauaucaauuccccgucugcaggcugaagccagaucugagauccuugcacauuggaguccugccaagcuguugcuacagauggacuccagcgcuaccgcauacgggucuacugugagcaaaaggguggccuggcacuaugaugaggaaaagaucgaguuugaauggaauacaggaaccaacgucgacacaaagaaaaugacuuccaauuucccgguugaucugucagacuacccaaagagucuccacauguacgcgaaccgccugcuugaucaucgggugccccagaccgacaugacguuuagacacguaggcagcaaauuaauuguggcuaugucuuccuggcugcaaaaggccucagguagucucccuuauacacagaccuugcaggaucaucugaauagccucaaagaguucaaccugcagaacauggggcuuccagacuuccacauccccgagaaucuguuuuugaaguccgacggaagggucaaguacacucuaaacaaaaauucucugaagauugaaauaccucucccguucggcgguaaaucgagccgagauuuaaagaugcuggagaccgugcgcacacccgcacuucacuuuaaaucaguuggcuuccaucugccaucccgggaauuucaagugccuacuuucaccauccccaagcucuaucaguugcaggucccacugcucggggugcuggaccuuaguacaaacguuuacucuaaucuauauaacuggagcgccuccuacucaggaggcaauacgucuaccgaucacuuuagccugagagcuagguaucauaugaaggccgacaguguggucgauuuguuauccuacaacguacaagggagcggagagacuacauacgaccacaaaaauaccuucacucugucuugcgauggcucacuccgucauaaguuucuggacuccaacauuaaauucagucacguggaaaaacuugguaauaacccuguuagcaaagggcugcucaucuuugaugcaucgucuuccuggggaccccagaugagcgcuucagugcacuuggacaguaagaagaaacagcaucuguucgucaaggaggugaaaauugauggccaguuccgcguaucuuccuuuuaugccaaggguacauacggccuaagcugucaacgggacccaaauaccgggagacugaacggagagucaaaucucagguucaacaguagcuaucuucagggcacgaaccagaucacugggcgauacgaagacggaacccuguccuuaacaucuaccagcgauuugcaguccggcauaaucaaaaauacugcgucacugaaguaugagaacuacgaacucacacugaaaucugacaccaaugguaaguauaagaacuuugccacaaguaauaaaauggauaugacuuucucgaagcaaaacgcacuucugcggagcgaguaccaggcugacuacgaaucccuccgcuuuuucucuuugcugucagggagcuuaaauucccacggacuagagcugaacgccgauauucucggcaccgacaaaaucaauaguggugcucauaaggcaacgcuuagaauuggccaggaugggaucucuacaagcgccaccacuaaccugaaaugcucauugcuggugcucgagaaugaacugaacgccgagcuuggacucuccggcgcuaguaugaagcugaccacaaaugggagguuucgggaacacaacgcgaaguucagcuuggacggaaaagcagcccugacugaguuaucucuaggcuccgcuuaucaggccaugauacugggugucgauucaaagaauauuuuuaacuucaaaguuagccaagaagggcucaaacuuucgaaugacaugaugggaucuuacgcagagaugaaauuugaucauaccaacagucugaacaucgccggcuugucccuggacuucagcucaaagcucgauaauaucuauuccucugacaaguuuuacaaacagacggugaaccugcagcuucaaccguauagcuuagugacaacccugaauagugaccucaaguacaacgcuuuggaucugacuaauaacggcaaacuacgacuggagccucucaaacuucacgucgcggggaaucugaaaggagccuaucagaacaaugaaauuaagcacauauacgcaaucuccagcgcugccuugucugcaucauacaaggccgacacaguggcuaaaguucaggguguagaguucagucauagacugaacaccgauauugccggccucgcguccgcaaucgacaugagcacuaauuauaacucugauucgcugcacuucucaaauguguuucgcagcgucauggcccccuucacaaugaccauugacgcucauacgaacgggaauggaaaguuagcccuuuggggcgaacacacuggucagcuguacuccaaauuucuccuaaaggcugagccacuggcauucaccuuuagucacgauuauaaagggucuacaagccaucacuugguguccaggaagucaaucagugccgcucuggagcauaaaguuucugcccuccuuacccccgcagaacaaacaggaacuuggaagcugaagacccaguucaacaacaaugaguacagccaggacuuggaugcguauaacacgaaagacaagauaggcguggaacugacaggccguacucucgccgauuuaacccugcuugacuccccuaucaaagucccacugcuacucucagagcccauuaauaucauugaugcucuggaaaugcgggacgccguggagaagccucaggaguuuacaaucguagcauucgucaaauacgacaagaaccaagaugugcacagcauaaauuugccguuuuucgaaacccugcaggaguauuuugaaagaaacaggcagacuauuaucguugugcucgagaauguccagcgcaaccuuaagcauaucaauauugaccaauucgugcgaaaauacagagcugcccuggggaaguuaccacagcaggcaaacgauuaccuaaauucuuuuaacugggaacggcagguuucccacgccaaagagaaguugaccgcucucaccaagaaguauaggaucacggagaaugacauacaaauugcgcuggaugacgccaagaucaacuucaaugaaaaacuaagucagcuucagacuuacaugauucaauucgaucaguauaucaaggacagcuacgaucugcacgaccucaaaauagcaauugcuaacaucaucgaugagauuaucgaaaagcugaaaucguuggacgagcauuaucacauucgcgugaaccuggucaagaccauacaugaccuccaccuuuuuaucgaaaauauugauuucaacaaguccggaucuucaacagccagcuggauccagaauguggacaccaaauaccagauccguauucaaauacaggagaagcugcagcaguuaaaaagacacauccaaaacauugauauccagcaucuggccgguaaguugaaacagcacauugaggcaaucgacguacgggugcuccuggaucagcuaggcacuacaauaaguuuugaaaggaucaaugacguucuugagcaugucaagcacuucgugauuaaccugaucggggauuuugaaguggcugagaaaauuaaugccuuccgcgcgaagguccaugagcucaucgaacgauaugagguagaccaacagauacaggugcugauggauaaguugguugaauuagcucaccaauacaaacugaaggagaccauucagaaacucuccaacgugcuucagcaggucaagaucaaagacuacuuugaaaagcuggugggauucauugaugacgccguuaagaaacuaaaugagcugucuuuuaagacguucaucgaggaugugaacaaauuucucgacauguugauaaagaaauuaaagagcuucgacuaucaccaauuugucgaugaaacuaaugacaagaucagagaggugacacagcggcuuaacggcgaaauucaggcacuggagcucccccagaaagccgaagcucugaagcuguucuuggaggagaccaaagcaaccguagccguguaccuggaaucacuccaagauacuaagaucacacuuauuaucaauuggcugcaggaggcgcuauccagugcuagccuggcccauaugaaagcaaaguucagggaaacccucgaggacacacgcgauagaauguaucagauggacauacagcaagaauugcagagguaccugucucuuguuggucaggucuauucaacucuggugacguacauuuccgauugguggaccuuagccgcuaagaaccucacagacuuugccgagcaauauagcauccaggauugggcaaaacggaugaaggcucugguggagcagggguucacugucccugaaaucaaaaccauuuugggaacaaugcccgccuuugagguuucucugcaggcgcuccaaaaggccaccuuccagacuccagacuuuaucgugccucuuacggaucugcguauacccaguguacagauuaauuucaaagaccuaaagaacaucaagauuccaucgcgcuuuuccaccccugaguucacaauccugaacacuuuucacauaccgagcuucaccaucgacuuuguggagaugaaagucaagauuauccgaacaauugaucagaugcucaauucagaguugcaauggcccgugccagacaucuaccugagagauuuaaaaguugaagacauuccucuugcaaggaucacccugcccgauuuccggcucccagagauagcuauuccugaauuuaucauccccacucugaacuugaaugacuuccaggugccggaucugcauauuccagaguuccagcucccucacauaucucacacaaucgaaguccccacguuuggcaaacuuuacagcauucugaaaauccaguccccacuauucacccuggacgccaacgcagauauuggcaaugggacuacaagugcuaacgaggccggaaucgccgcgucaauaaccgcuaagggugagucuaaauuagaaguacucaauuuugacuuccaagcaaacgcccagcugagcaaucccaagaucaacccuuuggcucuuaaggaguccgugaaauuuaguagcaaguaucugcgcaccgaacauggcuccgagaugcuauucuuugggaaugccauugaaggaaaaucuaacacaguugcaucacugcacacugagaagaauacguuggagcugagcaacggcgugaucgucaaaauuaauaaccagcuaacccucgauucgaacacaaaguacuuccauaaacuuaauaucccgaaacuggacuuuuccagucaggccgauuuaagaaacgaaauaaagacucugcucaaagcuggucacauugcguggaccucuagcgggaagggaucauggaaaugggccugucccagguucuccgacgagggcacacaugaaucucaaaucaguuuuaccaucgagggcccacugacuagcuucggguuguccaauaagauuaacucaaagcaccuucgggugaaucagaaccuggucuaugaaagcggaucucucaauuuuaguaaacuggagauacagucccaaguggacagccagcacguuggucauucagugcuaacggcaaagggcauggcuuuguucggggagggaaaagccgaguucacaggccgacacgaugcacaucugaacgguaagguaaucgggacccucaaaaauucucuauuuuucuccgcccagccuuuugagauuacugcuucgaccaacaaugaaggaaaccugaaggugagauuccccuuacgccugacaggcaagaucgacuuucucaauaacuacgcccuguucuugagcccuagugcgcagcaagcaucuuggcaggucuccgccagguuuaaucaguauaaauacaaccagaacuucagcgcuggcaauaacgagaauauuauggaggcccacguugggaucaacggagaagcaaaucuugauuuucugaacauaccacucacuauccccgagaugcggcugccuuauaccauuaucacaacgccaccccuaaaggacuucucauuaugggaaaagacaggucugaaggaguuuuugaaaacuacaaagcaaaguuucgaucucuccgugaaagcucaguacaagaagaauaaacaucgucacagcauuaccaacccgcuggccguccuuugcgaauuuaucucucagucaauuaagagcuucgacagacacuucgagaaaaauaggaacaaugcucuggauuuugugacuaaguccuacaacgagacaaaaauaaaguucgacaaguauaaagccgaaaagucucaugaugagcucccucgcaccuuucagaucccaggcuacacgguacccgugguuaauguggaagucaguccuuucaccauugagaugucggcauuuggguauguguucccaaaagcggucagcaugcccuccuuuucaauccugggaucugacgugcggguuccgagcuacacauugauccuuccuagucuggaacuacccguacuccacgugccacgaaaccugaaguuaucccugccugauuucaaagaguuguguacuauuucacauauauuuauccccgccaugggcaauauuaccuaugacuucucuuuuaagagcuccgucaucacacucaacacuaacgcugagcuguucaaucaaagugauauuguggcccaccuucugaguucuucauccagcguuaucgacgcacuccaguacaaguuggaagguaccacaagacugaccaggaaacgcgggcuuaagcuggcuacugccuuaagucuaucuaacaaauucguggagggcucccacaauucgacggucagccucacaaccaagaacauggaagugucaguagcaacuaccacaaaagcccagauaccaauccugcggaugaauuuuaagcaagagcugaacggaaauacgaaguccaaacccaccgugucuaguagcauggaguucaaguaugacuuuaacucauccauguuguacagcacugcgaaaggcgcuguugaucauaagcucucucuggagagucuuacauccuacuucagcauugagucaucuaccaaaggggacgucaagggaucggugcugagcagagaauauuccgguacuaucgccagugaggcaaauacauacuuaaacucuaaaucaacccguagcuccgugaagcuccagggcacaaguaagauugaugacaucuggaaucuggaagucaaagagaacuuugccggggaggcuacuuugcagaggauauauucucuuugggaacacagcaccaagaaucaucugcagcuagagggacucuucuuuacgaacggcgaacacaccuccaaagccacacuggagcugucaccuuggcaaaugagcgcauugguucaggugcaugcuucucagccauccaguuuccacgauuuuccggaccucggucaggaaguagcccugaaugcgaacacuaagaaccagaagauucgguggaagaaugaggugcgcauccacucagggagcuuccagucgcaggucgagcuuuccaacgaucaggaaaaggcucaucuggacauugccggcucuuuagagggacaccuccgauuucugaaaaauaucauacuacccguguacgauaagaguuugugggacuuccugaaacuugauguuaccacaagcaucggcagaaggcaacaucuccgggugucaacugcauuugucuauaccaagaacccuaauggguacuccuucucuauuccagugaaaguacuggccgacaaguucaucauucccggacugaaguugaacgaccuuaauagcguucucgugaugccuacguuucacgucccauucacagaucugcaagugcccaguugcaaauuagacuuucgcgaaauccagauauauaagaaacugagaaccuccagcuucgcucuaaaccucccuacucugccggaggugaaguuuccagaagucgauguuuugacaaaauacucucagcccgaggacucacugauuccuuucuuugagaucaccgugcccgaaucccaacuuacuguaagccaguucacccucccaaagagugugucugaugguaucgcagcccuggacuuaaaugcggucgccaacaagauugcugauuuugagcugccuacaaucauagugcccgaacagacgauugagaucccaucaauuaaauucuccguuccggcaggcaucgugauaccuagcuuucaagccuugaccgcuagguucgaagucgacucgcccguguacaaugccacuuggucugcaagucucaagaacaaagcugauuauguagagacaguucuggacuccaccuguagcucaacugugcaguuucuugaguacgaacugaauguccuagggacacacaagaucgaggauggaacccucgccucuaaaacgaagggcacauucgcgcaucgagacuucagcgccgaauaugaggaggaugguaaguacgaagggcugcaggagugggaaggcaaagcacacuugaacauuaaguccccagcuuuuaccgaccugcaucuucgguaucagaaagacaagaaaggaaucaguacuucagccgcaagccccgccgugggcaccguugggauggauauggacgaggaugacgauuucuccaaguggaauuuuuacuauucuccucaaaguagcccagacaaaaagcucacaauuuucaagacugaacugcgugugagagaguccgaugaggaaacccagaucaaagucaacugggaggaagaggcugccucaggauuacugacaucuuugaaggacaaugugcccaaagcgacgggcguacucuacgauuacgugaacaaguaucacugggaacauacuggucugacccuucgcgaggucucgagcaaacugaggcggaaccuacagaauaacgcugaguggguuuaccagggggcaauuagacaaaucgacgauauagacgugcgcuuucagaaggccgcuuccggaacaaccggcacuuaucaggaauggaaggauaaagcccagaaucucuaccaagagcuguugacacaggaaggucaggcaaguuuccaaggccugaaggacaacgucuuugacgggcuugugaggguaacccaggaguuccacaugaaagugaagcacuuaaucgauucucugauugacuuucucaauuucccucgauuucaguucccgggaaaaccaggcaucuauacgcgggaggaacugugcacuauguuuauuagagagguugggaccgugcuaagccaggucuacucaaaggugcauaacggauccgaaauauuguucagcuacuuccaagaucugguuaucacacuccccuuugagcuuaggaagcacaaacugauugacgucaucucuauguaucgcgaacuccugaaggauuuaaguaaagaggcccaggagguguucaaggcuauucaguccuugaaaaccacugaagugcugcguaaucuucaggaccugcuccaauuuaucuuccagcugauagaggauaacaucaagcagcuaaaggaaaugaaauuuacauaccuuauuaauuauauccaggacgagauuaacaccaucuucucagauuacauaccuuauguauuuaagcugcucaaagaaaauuugugucugaacuuacauaaguucaaugaguuuauucaaaacgagcugcaggaagcgagccaggagcuccaacagauccaccaguacaucauggcccuucgggaagaguauuucgacccaucuauugucggcuggacagugaaauacuacgaacuggaggagaagauaguuucguugaucaaaaaucugcucguggcacuaaaggauuuucauuccgaauauauugucagugccagcaacuucacuucacagcugucuucccaaguggagcaguuucuucacagaaacauccaggaauaccugagcauucucaccgaccccgacgguaaggggaaagagaagaucgcugaauugagugcaacggcccaggagauaaucaaaucacaagcuauugccacaaagaaaaucauuuccgauuaucaccagcaguucagguacaagcugcaggacuucagcgaucaauuaucugacuauuacgagaaguuuaucgcggaaaguaaacgccugauagaucucagcauucagaauuaucauaccuuccuuaucuacauuacugagcuguugaagaaacugcaguccaccacaguuaugaacccuuacaugaagcucgcacccggagaacuaacuaucauccuguga

SEQ ID NO: 52879 - RNA, 3294 nt, Artificial Sequence
  derived and/or modified sequence opt3 from APOBR__Homo_sapiens__NP_061160
auggacuuccugagacucuaccuucccggccugcaccaggccuugagaggggcuuuagauucccugggaaccuuuguguccuaucuacucggugacgcagucccuacaguugagcgggaagcccaagcggcugaggaacugggcgugguagccguggggaagacuggaaaaaucgucgaggaagaggcacaggaggaucuugaaggccugcgcgguucucagaacgagggggccggacgauugcguggcccaggcgacgauagaaggcaugaaguggggucaagugcuguugagcagacguggggauggggugacggcagcucccacgggucucaagcagagcggcaggauucgggagccggcgaaaccgcuaaggccgcgcgcugccaggagccgucagcacaucucgaagccaggaaaaagagcaaagcugguaguggggccugucaggacagguccggacaagcacaggagcggcaggaaucucacgagcaggaggugaaucgcgaagaacgacugagaagcugggaacaagaggaagaggaggaagaggucagggcucgggaacccggcauggcccguggcgcggaguccgaauggacauggcauggggagacugagggaaaggccggugcagugggcccuaaggcugccggggauaaccgcgaaauggagcagggaguaagagaagcugacgccggcgagaccgaggaaccaggugcagagggggccggcaaaggagaagagguuguggucguggaaaaggcuugcgagucaacaagggcguggggcaccugggggcccggagcagagccugaagauugggguauucugggccgggaggaagcccgaacuacaccagggcgcgaggaagcuagagccauacucgacggagaggaggcaaggaccaucaguggcggugaagaggccgaaacggcuagcgggggcgaggaagccgagacugcaucuggaggcgaggaagcggggaccgcuuccggaggugaggaagccggcauugcaucagggggagaggccggcacagcuagcgguggggaggaagccggcacugcaaguggaggcgaggaagcugggaccgccucuggaggcgaugaggcguggacaaccuccgguaaagaagaggccgacuuacugggggugcggcagacggaguacggagcuguccccggcgaacgccuuuuggaggcaacugguaagguuugggugcuggaagaggaaggcgacgaggagagagaagccgagguaagcccuuucccaaaacaaccccaggugcuagggacagaaaggaccgaggaagcugccgagucgcagacugcaggacgugaggcggucggcgggcaggaagccggagagucuuuugaaggccaaguggaucuccgggguaaggaggcugagaugcgacaggaccuggggaucagagccgauagggcacgcauggaggagcuuguucaggcugaagaggcccaggaggaacggggauccucaagagaccccguggcagagcugccuagugauggcgaagccgaggguacagcugacuuggaagcgaccccagaggccaggcccgaagaggagcucacgggcgaagagagcgaagcagcucaaaccuccugugggcuguuaggagucgaguggggcgggcugacacacucugugacuaagggacagggcccugaacucauggguggggcccagaccccaacaaaacagcccgaggagcgcgaagccggagagguagaacuuaugggcguucuggcuuugagcaaggaggagcaagaacgaucacuagaggcagguccgcggcacgccggcagugugaaaccugaagcguccgaggcuuuccccggggccugggaaaaucguacuagaaaggauauggagaggggaaacacccaggaggacgcagccgauggcgaacagcgcgaggaagaggaaacagcugggggacagacccuggcagccgaggcggagggcgaccgggaaagcgagcucucugaagucccagaggcugguggggaaggacugacuacgcaagaugccggcugcggcacagaggagggggaagcaucagugagugagaaucaggaacuugacggaagcaccggugccgacgcuggcccuugucccucccugggggaggccuaugcaagagagacugaagaugaggaagcugaggccgacaggaccucucgacgcggauggcgguugcaggcggucgccgugggccucccagauagagaagacgcacaaacagguucgguugcugccgggauuaugggaggcgaugugguaccccauaucagcgcugcaggcgccggggaggcccuggagggagucuuaggucagggcugggacuccaaagaaaaggaggaagcugcggcaggggagcacgccggaggccaggaauuuggucuggaggggucagcugaggaagaggugaccggaaggggcagucagguugaagccuucgagucucgugaaggcgggccuuggggaggucgcguggaggcagaggaaagcgccggcgcugaggauuccugcgggcuagacccagcgggaucacaaacugcccgggcagaaggcaugggugcuauggucgaggccgggggacuccuggagaaauggacacuuuuggaagaggaagcagugggcuggcaggagagagaacagagggaggauagcgagggccgauguggggacuaccauccggaaggagaggccccgcggcugcucgaugcugaaggucugaugguaacgggcgggcgcagagccgaggcgaaggaaaccgagccugagucucuugaacacgugaggggacaggaggaacaaccaacucaccaggcacccgccgaggcugccccugaauccguuggcgaggcugagacagcagaagccauggguagugcucgagggggagccgcaaacagcuggucugaggcgccacugcccggcuccuugcucgacgucucagugccgcggaguagagugcaucugagccgcucguccucucagaggcguagccggccuucauuuagaaggaccccagccugggaacagcaagaggagcccccugcucccaauccaccugaagaggaauuaagugcccccgagcagcgcccacugcagcuagaggaaccgcucgagccuagcccccugcgacacgauggcacaccaguccccgcaagacggaggccucuugggcauggauucgguuuggcucacccaggcaugaugcaagaacugcaggcccgccucgggcgucccaagccucaguga

SEQ ID NO: 52880 - RNA, 252 nt, Artificial Sequence
  derived and/or modified sequence opt3 from APOC1__Homo_sapiens__NP_001636
augagacuguuccucagccuucccgugcuggucguuguguuguccaucguauuagagggcccugccccagcucaggggaccccggacgugucuucagcacuggauaagcuaaaagaauuuggaaacacacucgaggacaaggccagggaacugauuagucggauaaaacaaagcgagcuuuccgcgaagaugcgcgaaugguucucugagacuuuucagaaagucaaggagaagcugaaaaucgauucguga

SEQ ID NO: 52881 - RNA, 306 nt, Artificial Sequence
  derived and/or modified sequence opt3 from APOC2__Homo_sapiens__NP_000474
augggcaccagacugcuccccgcccuuuuccugguguuguuaguccugggguuugagguucagggaacacaacagccucagcaggacgaaaugccaagcccgacuuuccuaacgcaagugaaggagucccucucuucauacugggaaagugcuaaaaccgcagcccagaaccuguaugagaagacauaccuucccgcgguagaugaaaaacugagggacuuguauagcaaguccacugcugccaugucuaccuacacagguaucuuuaccgaucaggugcucucgguccugaaaggcgaggaguga

SEQ ID NO: 52882 - RNA, 300 nt, Artificial Sequence
  derived and/or modified sequence opt3 from APOC3__Homo_sapiens__NP_000031
augcagcccagagugcugcucgucguugcccuucuggcuuuguuagcaagcgccagggcguccgaggcugaagacgccucucugcuaucauucaugcaaggcuacaugaagcacgcaaccaaaacagccaaggaugcucucaguagcgugcaggagucccagguagcacagcaagcccgggggugggugacugacggauuuucuucgcugaaagauuauuggucaacggucaaggacaaauucagcgaauuuugggaucuugacccugaggugcgcccaaccagugcuguugccgcguga

SEQ ID NO: 52883 - RNA, 384 nt, Artificial Sequence
  derived and/or modified sequence opt3 from APOC4__Homo_sapiens__NP_001637
augagccugcucagaaacaggcuucaggcccugcccgcuuugugcuuaugugugcugguccuagcaugcaucggcgccugucaaccugaggcgcaggaagggacccucuccccaccgcccaagcugaaaaugucucgguggucacuuguucgcggacgaaugaaggagcuguuggaaacagugguaaaucguacuagagacgguuggcagugguucuggaguccuagcacguuuaggggcuucaugcagaccuacuaugaugaccaccuccgggaucuggggccacugacaaaggcuugguuucucgaguccaaagacucuuuacugaaaaagacucauucgcuuugcccccgcuugguguguggagauaaggaccaaggcuga

SEQ ID NO: 52884 - RNA, 570 nt, Artificial Sequence
  derived and/or modified sequence opt3 from APOD__Homo_sapiens__NP_001638
auggugaugcugcuccuucuguugagcgccuuagcuggccuguucggggcagccgagggacaggcguuucaccuagguaagugccccaacccuccaguccaagaaaauuucgacguuaacaaauaccucggcagaugguaugagaucgaaaagauuccgaccacauuugagaaugggagguguauacaggcuaacuacucccugauggaaaauggaaaaaucaaggugcuuaaccaggagcugcgggccgauggcacuguaaaucagauugagggugaagcaacgcccgugaacuugaccgagccugccaaacucgaagucaaguucucuugguuuaugccaucagcucccuauuggauccuggcaacagacuacgagaauuaugcccugguguacaguugcacuuguauuauccaacucuuccauguugauuuugcuuggauauuagcccgcaacccuaaucugccacccgagaccguggacagccuuaagaacaucuugacauccaauaacauugaugucaaaaagaugaccgugacugaccagguaaauugcccuaaacugucuuga

SEQ ID NO: 52885 - RNA, 1032 nt, Artificial Sequence
  derived and/or modified sequence opt3 from APOE__Homo_sapiens__NP_001289617
augagcuccggcgccucuagaaagucaugggaccccgggaacccuuggccaccggauuggcccaucaccggaaggaaaaugaaggugcugugggcugcacuccuugucacauuccuggccgguugccaggcgaaaguugagcaagcuguggaaacugagccugaaccagaguugcggcagcagacggaauggcagaguggccaacgcugggaguuagcccuggggcgauuuugggacuaccuacguuggguacagacccucagcgaacaggugcaggaggagcugcuuuccucucaagucacacaggaacugagagcauugauggaugagacuaugaaggagcucaaagccuauaagucggaacuggaggaacagcugacccccguggcugaggaaacaagggcacggcucucaaaggaguuacaggccgcucaagcccgccugggagcggacauggaggauguuuguggcagacuugugcaguacaggggugaaguccaggcaauguuggggcaaagcaccgaggaacugcgggugcgccuagccagucaccuccgaaaacugagaaagaggcuucugcgggacgcugaugacuugcagaaacgucucgccguauaucaggcaggagcucgcgagggcgccgaaagaggccuguccgcgauuagggagcgguuagggccucugguugagcagggacgagugcgcgccgcaacugucgguucucucgcuggccaaccacuucaggaaagagcccaggcuuggggagagaggcugcgggcccgcauggaagagauggggagcagaacaagggaucguuuggacgaagugaaggaacagguggcagagguccgggccaaacuagaggagcaagcucagcagauacgacugcaggcggaagcauuccaagccagacucaaguccugguuugagccccugguugaggauaugcagaggcagugggcuggccuuguggaaaagguacaggccgcaguggguaccucagccgcuccugucccaagugacaaucauuga

SEQ ID NO: 52886 - RNA, 981 nt, Artificial Sequence
  derived and/or modified sequence opt3 from APOF__Homo_sapiens__NP_001629
augaccggccugugcggguacagcgcccccgacaugagaggacucaggcuuaucaugauuccuguggagcuguuguuauguuaucugcuacuccacccagucgaugcuacauccuacgguaagcagacuaacguucugaugcauuucccgcuuucucuggaaucacaaacgcccaguagcgacccuuuguccugccaguuucuccacccaaaaucucugcccggcuucucgcauauggcaccucugccaaaguuucucgugucauuagcccugcggaaugcgcuugaggaagcugggugucaggccgauguaugggcauugcagcugcaacuauaucgccagggaggcgugaacgccacccagguccucauacagcaucugcgaggucuucaaaaagggcguagcacagagagaaaugugaguguugaagcucuggcauccgccuugcagcuccuggcuagggagcagcagucuacuggacgggugggccgcagcuuacccaccgaggacugcgaaaacgagaaggaacaagccguccacaaugugguacagcugcucccuggcguugggacauucuacaaccuuggaaccgcgcuguauuacgcaacucagaauuguuuggguaaagccagagagaggggccgggauggggcuaucgaccuaggauaugaucugcucaugacaauggccggcauguccggugggccaaugggacuggcaauuucagcugcccuuaagccggcgcugcgcaguggcgugcaacaguugauccaguacuaccaggaccaaaaggaugccaacauuagccagcccgagaccacgaaagaaggccuccgagcaaucucugacgucuccgaucuggaggaaacuaccacauuagcuucauuuauaagcgagguggugaguucugccccuuauugggggugggcuaucauuaaguccuacgaccuggauccaggagccgguagccuagaaaucuga

SEQ ID NO: 52887 - RNA, 1038 nt, Artificial Sequence
  derived and/or modified sequence opt3 from APOH__Homo_sapiens__NP_000033
augaucagccccgugcugauucucuucuccucuuuucuuugccacgucgccauagcuggcagaaccuguccuaagccagacgaucugccguucucaacaguugugcccuugaaaacuuuuuacgagccuggggaagagaucacguauaguugcaagccaggauacguaagcagggguggcaugcggaaauucauuugucccuuaaccgggcuguggccuaucaacacacuaaagugcacuccacgcgugugucccuuugcaggcauucucgaaaauggagccguccgauauaccacauucgaguacccuaacaccaucuccuuuucuugcaauacugguuucuaucugaacggggcggacucggcuaaauguacagaagagggaaaguggucaccagagcuuccggugugcgcccccauaaucuguccuccacccagcauuccuaccuuugcaacgcugcguguuuacaagccaagugccggcaauaacuccuuguauagagauacugcuguguucgaaugccucccccagcaugcaauguuuggcaaugacaccaucacauguacuacccacgggaacuggacaaaacugccggagugcagggaagucaagugcccuuuccccucucggccagauaauggauuugugaacuacccugccaaacccacccuguacuauaaggacaaagcuacguucgguugucaugauggcuacagccucgacgggccagaggagauugaaugcacuaaguuaggaaauugguccgccaugcccucauguaaggcgaguugcaaaguaccuguuaagaaagcaacaguggucuaucaaggcgagcgcgugaagauccaggaaaaauucaagaacgguaugcugcacggggauaaagugagcuuuuucuguaagaauaaggagaaaaagugcucuuacaccgaagacgcccaguguauagauggaacuauugaggucccaaaaugcuuuaaggagcauuccucacuugcuuucuggaaaacagacgccagcgauguuaagccguguuga

SEQ ID NO: 52888 - RNA, 1143 nt, Artificial Sequence
  derived and/or modified sequence opt3 from APOL1__Homo_sapiens__NP_001130013
auggagggcgccgcucugcucagagugagcguccuuugcaucuggguucagcaaaacgugcccuccgggaccgacacaggagauccucagucuaagccacugggugacugggcagccggcacuauggauccggaaucaaguauuuucauagaggacgcgaucaaauacuuuaaggaaaaaguaagcacgcagaauuuguuacugcuacucaccgauaacgaggcuuggaauggguucguggccgcagccgaacugcccaggaacgaggcugacgagcuucggaaggcacuggauaauuuggcccgccagaugauuaugaaagacaagaacuggcacgauaagggacaacaguaucgaaauugguuucucaaagaguucccucgucugaaguccgagcuggaagacaacaucagaaggcuccgggcuuuagccgauggcguccagaaagugcauaaggguacaacuauugcgaauguugugucugggucgcugucaaucagcaguggaauacuuaccuuggucggcaugggccuggcaccauuuacagaagggggaucccuagugcuccuggagcccgguauggaacuuggcaucaccgccgcucugacugggauuacaucuagcaccauggacuacggcaaaaagugguggacgcaggcccaagcacacgauuugguaaucaagucccucgacaaacugaaggagguucgcgaguucuuaggagagaacauuucaaauuuucugagucucgcugguaacacuuaucagcuuaccagagggaucggaaaagacauaagggcccugcggcgcgcgcgagccaauuugcagagcgugccucaugcaucugcuuccagaccaagggucacagaacccauuucagccgagagcggcgaacagguggaacgggugaacgagccuaguauccuagaaaugucucguggcgucaagcugacugauguugcuccaguguccuucuuucucguacuggacguggucuaccuuguguaugagagcaaacaucugcacgaaggggccaagucggagaccgcagaggaauugaaaaagguugcccaagagcucgaagagaagcugaauauuuuaaacaacaauuacaaaauccugcaggcugaucaggaacuauga

SEQ ID NO: 52889 - RNA, 1014 nt, Artificial Sequence
  derived and/or modified sequence opt3 from APOL2__Homo_sapiens__NP_663612
augaaccccgagagcuccaucuucauugaagacuaccugaaguauuuucaggaucaagugucuagagagaaucuccuucagcuguugaccgacgaugaagccuggaacggcuucgucgcugcagccgaguuaccuagggacgaagcggaugagcugcggaaagcucuaaauaagcucgccucacacaugguuaugaaagacaagaaccgccaugauaaagaccagcagcaccgacaaugguuucugaaggaguucccacgucuuaagagagaacuggaggaucauauaaggaaauugcgggcacucgccgaagagguggagcagguacaccgcgggacaacuaucgcuaauguggucaguaacagcgugggaacgaccuccgguauucugacacugcucggcuuagggcuggcaccguuuacugaaggaaucucuuucguucuuuuggacaccggcaugggucugggggccgcugccgcgguggcaggaauuacaugcucggucguggagcuaguaaauaagcucagagccagggcucaggcccggaaccuggaucagucaggcaccaauguugcaaaagugaugaaggaauuugucggcgggaacacucccaaugugcuuacacugguggacaacugguaccaagucacccagggaaucggucgcaauauacgagcuaucagaagggcccgggcgaacccucaguugggcgccuaugcaccacccccucauguuauugggcguaucagcgcugagggaggcgaacagguggagcgcguaguggaggguccagcccaagcuaugaguagagggacgaugauugucggagccgcaacuggcggcauccuccuguuacuggaugugguuucccucgccuacgaaucuaaacaccuucuggagggggcuaagagcgaauccgcggaggaauugaagaaaagggcacaggagcuagagggaaagcugaauuuccucaccaaaauacacgaaaugcugcagcccggucaagaccaguga

SEQ ID NO: 52890 - RNA, 1209 nt, Artificial Sequence
  derived and/or modified sequence opt3 from APOL3__Homo_sapiens__NP_663615
augggccuggggcagggaugggguugggaggccagcugcuucgcuugucucaucagauccugcugucaaguggucaccuuuacauuccccuuuggcuuccaggggauuucucagucacuugaaaacguuaguggauacuaugcagacgccaggcuggaggugggcagcacucaguugcggacggcggguuccugcucucacucguuuaagcgcucauucuuagagaaaaagcgauuuaccgaggaagcuacaaaauacuuccgugagagaguaagcccugugcaucugcaaauacuacucacuaauaacgaggccuggaagagguuugucaccgcagccgaacugccacgggaugaggcugacgcacuuuaugaagcccugaaaaaguugcgcacauacgcugccaucgaggaugaguaugugcagcagaaggacgaacaguucagagagugguuucucaaagaguucccgcaaguuaagaggaaaauucaggaaaguaucgaaaagcugcgggcgcuggcaaaugggauugaggaggugcaccgcggauguaccaucuccaacgucgugucuagcuccacuggcgccgcuucaggcauaaugagucucgccggguuaguacuggcacccuuuacagcuggaaccagccuugccuugacggcggccgguguuggccugggggcagcuucugccgugacuggaaucaccacauccauugucgaacauucauacacuagcagugcugaggccgaagcaucucgacuaaccgccacauccaucgauagacucaaaguguucaaggaggugaugagggacauuaccccuaaucugcuuagccuguugaacaauuauuacgaagcuacgcagacuaucggcucggagauacgggcgauucgucaggcacgcgccagagcuaggcucccagucacaaccuggcggaucucugccgguuccgggggacaagcagagcgaacuauugccggcacaacccgcgcuguuucaagaggcgccaggauccugagugcaacgaccagcgggaucuucuuagcgcuggaugugguaaaccucguguacgaauccaagcaccuucaugagggagcuaaaucugccagcgcagaagaacugcggcgccaggcccaggaauuggaggagaaucuaauggaacugacacaaauuuaucagagacucaaccccugccacacucacuga

SEQ ID NO: 52891 - RNA, 1047 nt, Artificial Sequence
  derived and/or modified sequence opt3 from APOL4__Homo_sapiens__NP_085146
augggcagcugggugcagcugaucaccuccgucgggguucaacagaaccaccccggauggacaguggccggucaguuccaggagaagaaaagauuuacugaagagguaauugaauacuuccaaaagaaagugucuccuguccaucucaagauacuucugacgucagacgaggcuuggaaaagguuugugcggguugcagaauugccacgcgaggaggccgaugcguuauaugaagcucugaagaaucuaaccccguacguggccaucgaggacaaggauaugcagcagaaagaacagcaauuccgagagugguuucucaaggaguucccccagauucguuggaaaauccaggaaaguauugagagacugagggucaucgcaaacgaaauagagaaggugcaccggggcugcguaaucgccaauguugugagcggguccacaggcauucuuucugucaucggagugaugcuggcuccuuuuacugcagguuugucgcucucaauuaccgccgcuggggugggacugggcaucgccagcgcgacagcaggcauagccaguuccauugucgaaaacaccuauacucgcucugcugagcugacagccagcagacucaccgcaacguccacugaccaguuagaggcucugagggauauccuucgggacauuaccccaaauguuuugucauucgcccuggauuuugacgaagcgacaaaaaugaucgccaacgaugugcauacucuacgccgaaguaaggcaaccguagggagaccccucaucgcuuggagguacgugccuauuaaugucguggagacacugcggacccguggagccccaacgcgcauaguuagaaagguggcuaggaaccuugguaaagccacuagcggcguccuggugguauuggacguugugaaucucguccaagauucucuggacuuacacaagggggcaaaauccgaaucagccgagagccugcggcagugggcucaggaacucgaggagaaccuuaaugaacugacacauauccaccaaaguuugaaggcgggauga

SEQ ID NO: 52892 - RNA, 1032 nt, Artificial Sequence
  derived and/or modified sequence opt3 from APOL6__Homo_sapiens__NP_085144
auggacaaccaggccgagagagaaagcgaggcuggcguggggcugcaaagggaugaagacgaugcaccccucugcgaggacgucgaacuucaggauggagaccuguccccugaggagaagaucuucuugcgggaauuuccacgcuuaaaagaggaucugaaggguaauauugacaaacuacgagcccucgcggaugacauagauaagacccacaaaaaguucacaaaggcuaacaugguugccacuucuacggcagugaucucaggcguaaugagucugcuugggcuggccuuggcuccggcaaccggaggcgguagccuccugcuguccacagccgggcagggacucgcuacugccgcgggcgugaccucuauugucucgggcacauuagaacguagcaaaaauaaggaggcacaggccagagcugaggacauccugcccaccuacgaucaagaagacagggaggacgaagaggaaaaagccgauuaugugacugcagcugggaagauuaucuacaaccuucggaauacauugaaauaugccaagaagaacguucgcgcguuuuggaaacugagagccaauccuaggcuagcaaacgcuaccaagcggcuccugacgacuggacaggugucaagucgcucccgaguccaggugcagaaagccuucgcugguaccacacuugccaugacuaagaaugcaagaguacugggcgggguuaugucugccuuuagcuugggauacgaccucgcuacccuguccaaagaguggaagcauuuaaaagagggcgcgaggacaaaguucgcagaggaacugcgggccaaggcucucgaacuugagcguaaacugaccgaauugacgcaacuauauaagucacugcagcagaaagugcgcaguagagccaggggugucgggaaggaucucacuggaacaugugagaccgaggcauacuggaaagaacugcgggagcacguguggauguggcuuuggcugugcguguguuugugcgucuguguuuaugugcaguuuacuuga

SEQ ID NO: 52893 - RNA, 840 nt, Artificial Sequence
  derived and/or modified sequence opt3 from APOLD1__Homo_sapiens__NP_001123887
auguucagagcccccugccacaggcugcgggcucgcggcacccgaaaggcacgugccggggcguggagaggauguacauuuccuugccucgguaaaggcauggagaggccagcugcccgggaaccgcaugggcccgacgcacuucgcagauuccagggacuguuguuagauaggcggggccgccugcacggucaagugcuacgacucagagaggucgccaggcggcuggaacgucuucgcagaaggagccugguugcuaacguggcaggguccucuuugucagccacuggagcucucgccgcgaucguaggccugagucugagcccugugacgcucggcaccuccuuacuggucucugcaguggggcuuggaguugccacagcugguggcgccgugacuauuaccucggacuugucacugauauuuuguaauagccgggagcuacgacgcguccaggaaaucgcagcuacaugccaggaucagaugagagagauucucaguugucuggaguucuuuuguagguggcaagggugcggagaccggcagcuucugcagugcggccgcaacgccuccaucgcguuguacaauucuguguauuucauuguauuuuucgguagcagaggguuucucaucccaaggcgugccgaaggagauaccaagguuucccaggcagugcugaaagcuaagauacaaaaauuagccgagucacuggaaaguuguacuggcgcucucgacgagcuuagcgagcagcuggaaucucggguccaguugugcacaaaguccucacgaggccaugaucuaaagaucagcgccgaccagagagcagggcuguucuuuuga

SEQ ID NO: 52894 - RNA, 351 nt, Artificial Sequence
  derived and/or modified sequence opt3 from APOM__Homo_sapiens__NP_001243098
auggccgcuggcagcgcacccaugcagcugcaccucagagccaccaucaggaugaaggacgggcuuugcgugccucggaaauggauuuaccaucugacagagggauccacugauuugcgcacggaaggucgaccagacaugaagaccgaguuauucucuucaaguuguccgggcgggauaaugcugaacgaaacaggacaaggcuaucagcguuuucuacucuacaauagaagcccccacccuccagagaaaugcgucgaagaguucaagucccugacuucuugucuugauucgaaagcguuucuguugacccccaggaaccaggaggcuugcgaacucucaaauaacuga

SEQ ID NO: 52895 - RNA, 597 nt, Artificial Sequence
  derived and/or modified sequence opt3 from APOO__Homo_sapiens__NP_077027
auguucaaggugauccagagaagcgucggccccgccucccugucucuccuuaccuuuaaaguuuacgcugcaccuaagaaagacucaccaccgaagaacagugugaaaguagaugagcugagcuuguauuccgugcccgaagggcaaucuaaguacgucgaggaagccaggucgcaguuagaggaaucaauuagccagcugcggcacuauugcgagccuuacacaacuuggugucaggagacguauagucaaaccaagccaaaaaugcagucccuagugcaguggggacucgacucuuacgauuaucugcagaaugcgcccccugguuucuuuccacgccuuggcguuauaggguucgcuggacugaucggcuugcuccuggcccgagguagcaagauuaaaaagcugguguaucccccuggguuuaugggacucgcagccuccuuauacuacccacaacaggcuaucgucuucgcacaggugucaggcgaacgucuguacgacuggggccuuagaggguauauuguaaucgaggauuuguggaaagaaaacuuucagaagccgggaaauguuaagaacagucccgguacaaaauga

SEQ ID NO: 52896 - RNA, 621 nt, Artificial Sequence
  derived and/or modified sequence opt3 from APOPT1__Homo_sapiens__NP_115750
augcugcccugcgccgcuggcgcaagagggaggggagccauggugguccuccgggcggguaagaaaaccuuccuuccuccacugugucgcgcuuuugccugccgaggcugucaguuggcaccggagcguggggccgaaagaagggacacagcucccagcggaguuucccgguucugcccuccacgcaagucuugucacgauuggaucggucccccugacaaauacucaaacuuaagaccagugcauuuuuauauucccgagaaugaaaguccucuggagcaaaagcuaaggaaacuccggcaggaaacucaggaguggaaccagcaauucugggcaaaucagaaccugacguuuagcaaggagaaggaagaguucauacacucccgccuuaaaaccaagggccugggguugcgaacagaaucuggacagaaagccacucucaaugcugaggagauggccgauuuuuacaaggaguuccugucgaaaaacuuucagaagcauauguauuacaauagagacugguauaagaggaacuucgcgaucaccuuuuucaugggcaaaguagcacuggaacggauuuggaauaagcucaaacaaaagcagaaaaagcguucaaacuga

SEQ ID NO: 52897 - RNA, 1758 nt, Artificial Sequence
  derived and/or modified sequence opt3 from APPBP2__Homo_sapiens__NP_006371
auggccgcuguggagcuggaauggauccccgagacccucuacaacacagcaauuagcgccgucguugacaauuauauaagauccaggcgggauauccgcucucuuccugaaaacauucaguucgacguguacuauaagcuguaccaacagggccgauugugccaguuagggucagaguuuugugaacuggagguauucgcgaaagugcuacgugcucucgauaagagacaccuccuucaucacugcuuucaggcccugauggaccauggagucaaaguggcaaguguuuuggccuauagcuucuccaggcgguguucuuacaucgcugagucggaugcagccgugaaggaaaaagcuauucaagucgguuuugugcucggcggguuccugucagacgccggaugguauagcgaugcggagaagguauuucugaguugccuccaguuauguacucugcacgacgaaaugcuucauugguuccgcgcaguugagugcugugugagauugcugcacgucaggaauggcaacugcaaguaccaccuaggugaggaaacguuuaaacucgcccagaccuacauggauaagcuguccaaacaugggcagcaagcuaauaaggccgcacuuuauggagagcugugugcuuugcuguucgccaaaucucacuacgacgaagcguauaaguggugcaucgaggccaugaaggaaauaacagcaggccugccagugaaaguggucguugauguguuacggcaggcuagcaaggccuguguagugaaacgcgaguuuaagaaagcugagcagcugaucaagcaugccgucuaccucgcacgagaccacuucggcuccaaacacccgaaguauucagauacucuucuggacuacggguuuuauuugcuaaacguggacaauauuugccagaguguugccaucuaccaagcugcgcuggauauuagacagagcguguucggagguaagaacauccaugucgcaaccgcccacgaagaccucgcuuacucuuccuaugugcaucaguacucaagcggcaaauucgauaaugcccuguuucacgcagagagggccauagggauuaucacacauauucuucccgaagaccaccuguugcucgcuaguucuaagcggguaaaagcccugaucuuagaggaaaucgcaauugauugccacaacaaggagaccgagcaacgucugcuacaggaagcgcaugaccuccaccuguccagccuucaguuggcuaaaaaggccuucggagaguuuaauguucagacugcaaagcauuauggcaaccugggucgccucuaccaaucgaugagaaaauucaaggaagccgaggaaaugcacauaaaagcuauccagauuaaggagcagcugcuugggcaggaggauuaugaaguggcccugucugucggacacuuggcaucccucuacaauuaugacaugaaccaauacgagaaugcugaaaaacuguacuuaaggucaaucgccauaggcaagaagcuguuuggcgagggguauaguggacuagaguacgauuaucggggucucauuaaacuguacaacagcaucggcaacuaugaaaagguguucgaguaccauaauguccuuuccaacuggaaucgauugcgcgacagacaguauucugugacagaugcgcuggaagacguuagcaccucaccucagaguacggaggaagugguacaguccuuucucaucagccaaaacgucgaggggccaucuuguuga

SEQ ID NO: 52898 - RNA, 2313 nt, Artificial Sequence
  derived and/or modified sequence opt3 from APP__Homo_sapiens__NP_000475
augcugcccggccucgcccuucuguuguuagcugcauggaccgccagagcgcuggaggugccuacagacgggaacgcuggacuacucgccgaaccacagaucgcaauguucugcgguaggcugaauaugcacaugaacguccaaaauggcaagugggauagcgacccguccgggacuaaaacguguauugauaccaaggagggaauacuucaguacugccaggaaguuuaucccgagcugcagaucacaaacgugguagaagccaaucaaccugugacuauucagaacugguguaaacggggccgcaagcagugcaaaacccauccacacuuugucauccccuaccgauguuuggugggugaguucguuucugacgcucuccuggugccugauaagugcaaguuucugcaucaggagcguauggacgucugugaaacacaccuccauuggcacaccguggcaaaagagacuugcucagaaaagaguacaaauuuacacgauuaugggaugcugcuuccauguggaauugacaaauucagaggcguagaguuuguuugcugucccuuggccgaggaaagcgauaacguggacuccgcugaugccgaggaagacgauucugacgucugguggggcggggcggacaccgauuacgcagacggaucggaggauaaggugguggaagucgccgaggaggaagagguugcugaaguggaggaagaggaggccgacgaugacgaagaugacgaggauggugacgaaguagaggaagaggcagaggaaccuuaugaggaagcuacggagaggacuaccucaaucgccacaacuaccacaaccacgacugagagcguggaagaggucgugcgggaaguuugcagugagcaagcggaaacaggcccaugccgcgccaugauauccagaugguacuucgaugugaccgaggggaaaugugcaccguuuuucuauggaggcugcggugggaauaggaacaauuuugacacugaggaauacuguauggcugucugcggaucugccaugagccagucccugcuaaagacaacccaggagccccucgcucgggacccugugaagcugccaacgaccgccgcaucaacacccgaugccguagacaaauaccuugaaacuccuggcgaugagaacgaacaugcucacuuccagaaggcgaaagagcgccuggaggcaaagcaucgagaaagaaugagucaaguuaugagggagugggaagaggccgaacggcaggcuaaaaauuugccaaaggccgacaaaaaggcagugauccagcacuuucaagagaaggucgagagccucgaacaggaggccgcuaacgaacgucagcagcugguggagacccacauggcccgcgucgaggcaauguuaaaugauagaaggcggcuggcgcucgaaaacuauauuacagcccuucaagcugugcccccgcgaccucgccauguuuucaacaugcugaaaaaguacgugagagcagagcagaaagacaggcagcacacuuugaagcauuuugaacacguacggauggucgaucccaaaaaggccgcucagauccgcucucaagugaugacccaucuaagaguuauuuaugagaggaugaaucagucccugucacuccuguacaacgugccagccgucgcagaagagauccaggacgagguggaugaacuucugcagaaggagcaaaauuauagcgacgauguauuggcuaacaugauaagugaaccucguauuucuuacggcaaugacgcccucaugcccucccugacagagaccaaaacuacgguggaauuacugccaguuaacggggaguucagccuagaugaccuccagcccuggcacucguucggagcggacucugucccugccaauacagagaacgaaguggagccaguggaugcucggccggcagccgaccgaggucugaccacuagacccggcuccgggcuuaccaauaucaagacagaagagauuucagaagucaaaauggaugcugaguuuaggcacgacaguggauaugagguucaucaccagaaguugguguucuuugccgaagaugugggcagcaacaaaggugcaaucaucgggcugaugguaggcggagucgugauugcgaccguuauagugaucacucucgucaugcugaagaagaaacaguacacauccauucaucacggcgugguugagguggacgccgcuguaacgccugaggaacgccaccuuucuaagaugcaacagaauggguacgagaacccaaccuauaaauucuuugaacagaugcaaaauuga

SEQ ID NO: 52899 - RNA, 2130 nt, Artificial Sequence
  derived and/or modified sequence opt3 from APPL1__Homo_sapiens__NP_036228
augcccggcaucgacaagcugccuauugaggaaacccucgaggauagcccacagacaagaucccuucuggggguguucgaagaggacgccacugcuauaucuaacuacaugaaucaauuguaucaggcaaugcacaggaucuacgaugcccagaacgaauuaucagcggcuacgcaucugaccaguaaacuacucaaggaguaugagaaacagcgguuuccgcugggaggugacgaugaagucaugagcuccacacuucaacaguucucuaagguuauugacgagcugucgucaugccacgccguguugagcacucagcucgcagaugccaugauguuucccaucacccaguucaaagaacgcgaccugaaggagauucugacacucaaggagguauuucaaaucgcuaguaaugaucaugacgcagccauaaaccgauacucccguuuaucuaaaaagagagaaaaugauaaagugaaguaugaggucaccgaagacguguacacuagcaggaaaaagcagcaccagacaaugaugcauuauuucugugcucugaacacccuucaguacaagaaaaagaucgccuugcuggagccucuacucggcuacaugcaagcgcagauuuccuuuuucaaaauggggucagaaaaucugaacgagcagcuugaggaauuucuggcaaauaucggaacgaguguucaaaacgugcggcgcgagauggauagcgacauugaaacuaugcagcagaccaucgaggacuuggaagucgccucugauccacucuaugugcccgacccugauccaacaaaguuccccguaaauagaaaccugacuaggaaagcuggcuacuuaaaugcccggaacaagaccggucugguuuccucaacaugggaccgccaguuuuauuucacccaagggggaaaucucaugagccaggcacgaggcgauguggcuggcgggcuugccauggacauagauaacugcagugucauggcgguggacugugaggauagaagguacugcuuucagauuacgucuuucgacgguaaaaaguccagcauccugcaggccgagucgaagaaagaucacgaagaguggauuuguacuaucaacaauaucucuaagcaaauuuauuuguccgaaaacccugaggaaacagcagcucgggugaaucagucagcccuagaggcugucaccccaaguccgagcuuccagcagcgucacgagucccugcgccccgccgcaggacaaucuagaccuccaacugccaggacaagcucaaguggcucccucgggagcgaaucuaccaaccuggcugcgcuuucacuggacaguuugguugcacccgacacgccuauacaguuugauaucauuagcccagugugcgaggaccagcccggacaggccaaggcuuucggccaaggugggcggcgaaccaauccguuuggagaauccggcggcucuacaaagucggagacugaggauagcauccuccaucagcuguucauaguacgcuuuuuaggguccauggaagugaaaucagacgaucacccugacgucguguacgagaccaugagacagauucuggccgcaagggccauccauaacaucuuccggaugacagaaagucaccuacucguuacuugugauugccugaaacuuauugacccccaaacccaggugacacgcuugaccuuuccacugccuugugucgugcucuaugcuacucaccaggagaauaagagacuguucggauuuguacuuaggacgucuagcggucguuccgaaucaaaccugagcucuguuugcuacaucuucgaguccaauaacgagggcgagaaaauuugugauagugugggguuggccaagcagauagcacuccaugcggaacuggaccggcgagcuagcgaaaaacaaaaggagaucgaaagagucaaagagaagcagcagaaggaguuaaauaaacagaagcaaauugaaaaagaucuggaggaacagucuaggcuaaucgccgcauccucacgccccaaccaggccaguagcgagggacaguuugugguccucucguccucucaaagcgaagagucagaccugggcgagggugggaagaaacgggaaagugaggcuuga

SEQ ID NO: 52900 - RNA, 2013 nt, Artificial Sequence
  derived and/or modified sequence opt3 from APPL2__Homo_sapiens__NP_001238833
augcccgccguggacaagcugcuccuugaggaagcucugcaggauagcccucaaaccagauccuuguuaucugucuucgaggaagacgcaggcacacugacugauuacacgaaccagcuacuccaggccaugcagaggguuuauggggcgcaaaaugagaugugccuggcuacccagcagcuuucaaaacagcuguuggccuacgaaaagcaaaacuuugcacucggaaaaggugacgaggaggugaucaguacacugcacuauuucagcaagguaguggaugaacugaaucucuuacauacugagcuggccaaacagcuugcugacaccauggucuugccaauuauacaguuucgggaaaaggaucugacagagguguccacccuaaaggaccucuucggccuggcaucuaacgauguuugucuuuuucuggagcacgacuugucgauggccaaauacucacgccucccgaagaaaaaggaaaaugagaaagugaagacugaagucgggaaggagguggcugccgcgcgacguaaacagcaucugagcaguuuacaauauuacugcgcacugaacgcccuccaguauagaaagcagauggcuaugauggaacccaugaucggauucgcccacggccaaauuaacuuuuucaaaaagggugcagagauguuuuccaaaaggauggauucuuuccuuagcuccguagcugacaugguucagucaauccagguggagcuggaagccgaggcggaaaagaugcgggucagucagcaagaguugcuaagcguggaugaaucuguguacacaccugacuccgacgucgccgcaccacagauuaaucgcaaucugauccagaaagcuggguaccucaaccugagaaauaagaccggacuuguuacgacuaccugggagaggcuguacuuuuucacacagggcggcaacuugaugugucaaccccggggagccguggcuggaggucucauacaggaucuggacaauugcucaguaauggccguggauugugaggaccgccgauauugcuuucagaucacuaccccuaacggcaagagcgggauuaucuuacaggcagaaaguagaaaagagaaugaagaguggauuugugccaucaacaacauaucuaggcaaauuuaucugacagauaauccagaagcugucgcgaucaagcuaaaccagaccgcacuccaggccgugacgcccauuacuuccuucgggaaaaagcaggagagcucgugcccuucucaaaaucugaaaaacuccgagauggaaaaugagaacgacaagaucguuccaaaggcuacagccucacuuccggaagcagaggaguugaucgcccccggcaccccuauucaguucgauauagugcugccagcuacugaauuucucgaccagaaucgggguagucgucgcacaaaccccuucggggagaccgaagaugagagcuuuccugaagccgaggacucccugcuucaacagauguucaucgucagauuucugggaucuauggcagugaaaacggauagcaccacagagguaauuuacgaagcgaugaggcagguuuuggcugcccgggcaauccauaauauauuccgaaugacugagucacaccucauggugaccagucagucccugcgcuuaauugacccacaaacacaggucagcagagccaacuuugaacugacuucugugacccaguucgcugcccaccaggagaauaagaggcuagucggcuuugugauccggguucccgaaucaacaggcgaggagagucucagcaccuauaucuucgaauccaacucugagggggagaaaauuuguuacgcaaucaaucugggaaaggaaauuauagaagugcaaaaagacccggaggcucuugcccaguugaugcugucgaucccucucacuaacgaugguaaguauguacuguuaaaugaccagcccgaugacgaugacggcaacccaaacgagcaucgcggggcggaaagcgaggccuga

SEQ ID NO: 52901 - RNA, 543 nt, Artificial Sequence
  derived and/or modified sequence opt3 from APRT__Homo_sapiens__NP_000476
auggccgacagcgagcugcagcucguggaacaaagaaucagguccuuccccgauuuuccuaccccaggcgucguuuuccgggacauuucuccggugcuuaaggaucccgcuucauuucgcgcagccauagggcuguuggcgcgacacuuaaaagcuacacauggaggucguaucgacuacauugccggccuggauaguagaggguuccuauuuggaccuagccucgcacaggagcugggccuugguugcguacugaucaggaagcgggggaaauugccaggacccacucucugggccuccuauucucuggaauacggcaaggcugagcuggaaauucagaaagacgcacucgagccuggccagcgcguggucgugguugaugacuuacuggccaccgggggaacgaugaacgcugccugugagcuuuuggguagacugcaagcggaagugcuagagugcgucucgcucguggaacugacaucacuuaagggcagggagaagcuggcaccaguacccuucuuuagcuugcuccaguaugaguga

SEQ ID NO: 52902 - RNA, 1071 nt, Artificial Sequence
  derived and/or modified sequence opt3 from APTX__Homo_sapiens__NP_001182177
augagcaacgugaaucuguccgucucugacuucuggagaguuaugaugagggugugcuggcucguacggcaggauucacgccaccaacgaauccgucuuccccaucuggaggccguggucauuggcagagggccugaaaccaagauaacagacaaaaaguguaguaggcaacaggugcaguugaaagcugagugcaacaagggauacguuaaagugaagcaggucggugugaauccaacuagcaucgauuccguaguuauuggcaaggaccaggaagugaaauuacagccggggcagguccugcacauggugaacgagcuauaucccuacaucguggaauuugaggaggaagcaaagaauccuggacucgagacgcaucggaaacgcaagagaucuggcaacucggauucaauugaaagggacgccgcgcaagaggcugaggccgguaccgggcuggaaccaggaagcaauaguggccaguguuccgucccccuuaaaaagggcaaggaugcaccuaucaaaaaggagucucuggggcacuggagccagggauugaaaauauccaugcaggacccaaagaugcaaguuuauaaagaugaacaggugguagugaucaaggacaaauaccccaaggcccgguaucauuggcucguccugccuuggacaucaauuaguagccugaaggcuguggcacgcgagcaccucgaauuacugaaacacaugcauacuguuggugagaaggugaucgucgauuucgccgggucuuccaaacuucgauuuagauugggcuaccacgcuauuccaucaaugagccaugugcaucugcacguaaucagucaggacuucgauucuccgugccuaaagaacaaaaagcacuggaacuccuuuaauaccgaguauuuccucgaaagccaagccguuauagagauggugcaggaagcgggaagggucacagugcgggacggcaugcccgagcugcuuaagcugccuuugcguugucacgaaugccagcagcuccugccaucgauuccccaauuaaaagagcaucugcgcaagcacuggacccaguga

SEQ ID NO: 52903 - RNA, 906 nt, Artificial Sequence
  derived and/or modified sequence opt3 from AQP10__Homo_sapiens__NP_536354
augguguucacccaggcccccgcugagaucaugggccaccugagaauuaggagccuccuugcacggcaaugccuggccgaauuuuugggggucuucguuuuaaugcugcuaacacagggagcgguggcucaggccguaacuuccggugagacgaagggcaacuuuuucaccauguuucucgcagggucucuggccgugacaauagcuaucuacgucggaggcaaugugucaggugcacaucuuaacccugccuucagucuggcuauguguauuguugggcgcuugccaugggugaaacucccgaucuauauucugguccagcugcucagcgccuuuugcgcguccggagcaacuuacguguuauaucacgacgcccugcaaaauuacaccggcggcaaccuuacaguaaccgggcccaaggaaacugcuucuaucuucgccacauauccugcaccauacuugucgcugaauaacggauuucuagaucagguucucgguaccggcaugcugauaguggggcuucuggcuaucuuggaccgacguaauaaaggaguccccgccggccucgagccugugguggucgguaugcugauuuuagcgcuggggcucucaaugggagccaacuguggcaucccacuuaaucccgcaagagaucugggcccuagguuguucacguauguugcuggguggggaccagaaguguuuagcgccgguaacggcuggugguggguaccgguggucgcuccccuagugggggccacuguuggaaccgcaacauaccagcugcucguggcccugcaucacccugagggcccagagcccgcucaggaccuugucagugcgcaacauaaggcauccgaacuggagacuccugccucugcucagauguuggaaugcaaacucuga

SEQ ID NO: 52904 - RNA, 561 nt, Artificial Sequence
  derived and/or modified sequence opt3 from AQP1__Homo_sapiens__NP_001171989
augcccggcgccagaccucugccacucgugcuugucccgcagaacacccuggcuuggaugcaauuggacgcaaaggcccccgcgcacccuaggccauuacagcugcuagggcggguuggacccgguagccgccagcucgcugauggcguaaauuccgggcagggacugggcaucgagauuauagguacacuucaacugguguugugcgugcucgccacuacggaccgacguagaagggaucucgggggaucugcaccucuggccaucggccugucagucgcuuuaggccaucugcuugcaauugacuacaccggguguggaaucaacccagcccggaguuucgguagcgcugugauuacacacaauuuuuccaaccauuggaucuucuggguuggccccuuuauagggggagccuuggcggugcugaucuaugauuucauucuagcaccuagaucuucggaccucacugaucgcgucaaaguguggaccucaggccagguagaagaguacgaccuggaugccgacgauaucaauagcaggguugaaaugaagccaaaauga

SEQ ID NO: 52905 - RNA, 816 nt, Artificial Sequence
  derived and/or modified sequence opt3 from AQP2__Homo_sapiens__NP_000477
augugggagcugagaagcaucgccuucuccagggcuguguuugcagaguuccucgccacccuucuguuugucuucuuuggcuuggggucugcguuaaacuggccccaggcucugccuucaguucuacaaauugccauggcauucggacucgguauaggcacacuggugcaggcccuugggcacaucaguggagcucauauuaauccagcaguaacuguggccugccuggucggcugucacgugagcguuuugcgggcugccuuuuacguggcggcacagcuccugggugccgucgcuggggccgcacugcuccaugagaucacgccggcugacauucgcggagauuuagccgugaacgcgcuguccaauucuaccacagccggccaggcaguaacuguugaacuuuucuugacccugcagcuagugcucugcaucuuugcuucgacagacgagcgacguggcgaaaaccccgggaccccugcccugucaauaggauucagcgucgcucuuggucaccuguugggcauccauuauacuggguguaguaugaauccagccagaucccucgcacccgccguggugacaggaaaguuugaugaccacugggucuucuggauuggcccucugguuggugcuaucuuagggucucugcucuacaacuaugugcuuuuuccacccgcgaaaagccuguccgagagguuggcaguacuaaagggacuggagccugauaccgacugggaagaacgggaagugcgcagaaggcaaucagucgagcuccacaguccacagagccugccgcggggcacgaaagccuga

SEQ ID NO: 52906 - RNA, 879 nt, Artificial Sequence
  derived and/or modified sequence opt3 from AQP3__Homo_sapiens__NP_004916
augggcagacagaaggagcugguguccaggugcggggaaaugcuccacauccgguaccgccuucugcgacaagccuuggcugaguguuuaggaacccugauucuagucauguucgguugcggcagcguugcacaggugguacucucucgugggacacauggaggcuuucugacuauaaaccuugccuucgguuuugcggugacgcuggggaucuugauugcuggacaggucucaggcgcccaccucaaucccgcagugaccuucgccauguguuuucuggcuagagaaccuuggaucaaacugccaauuuauacacucgcacagacuuuaggcgccuuccugggggcuggaaucguuuuuggucuuuacuaugacgccauauggcauuucgcggauaaccaauuguuugugaguggcccgaaugggaccgcaggaaucuucgccacauaccccagcggccaccuggacaugauuaacggguuuuucgaucaguuuaucgguaccgcuucccuaauugucugcgugcucgccaucguagacccuuauaauaacccaguucccaggggacuggaggcauucacugugggccuugucgugcuggugauaggcacaucuaugggguucaauucgggauacgcugucaacccugcccgggauuuugguccacgcuuguucaccgcgcucgccggcugggggucagcaguuuuuacgacuggacagcauugguggugggugcccauuguaagcccucuguuaggcaguaucgcugguguguucgucuaucagcugaugauugggugucaccucgaacaaccaccgcccuccaaugaggaggaaaacgugaaacuugcccacguuaagcauaaggagcagaucuga

SEQ ID NO: 52907 - RNA, 972 nt, Artificial Sequence
  derived and/or modified sequence opt3 from AQP4__Homo_sapiens__NP_001641
augagcgacagacccaccgccaggcgguggggcaagugcgggccucuguguacacgcgagaacaucaugguggcuuucaaaggagucuggacucaggcauuuuggaaggccguuacggcggaguuccucgcuaugcuuauuuuugugcuguuguccuuagguucuaccauaaauuggggcgggacagaaaaaccacugccgguagauauggugcuaaucucacucugcuucggacugaguauugccacuaugguccaauguuuuggccacaucagcggugggcauauuaaccccgcagugaccguugccauggugugcacacgaaagaucuccauagcuaaaucugucuucuacaucgcagcccagugucuuggagcuauuaucggcgccggcauucuguauuuggugaccccuccaucgguaguugggggacucggugugacuaugguccacggcaaucugacagcggggcauggacugcucguggaauuaaucauaaccuuucagcugguguucacgauuuuugcaucaugcgacagcaagcguacugaugucaccggcaguaucgcccuugcuauugguuucuccguugccaucgggcacuuguuugcaaucaacuacacaggagcuucuaugaaucccgccaggagcuucggcccugcggugauuaugggcaacugggagaaucauuggauauauuggguagggccaaucauuggagccgugcuggcugguggccuauacgaauaugucuuuugucccgacguggaguucaagagacgguucaaagaggcauuuuccaaggccgcucagcaaacuaaagggucauacauggaaguugaggauaaccgcagucagguggaaaccgacgaucucauccugaagccuggagucgugcacguaauagacguugauagaggcgaggagaaaaaggguaaggaccagagcggggaagugcuuucuuccgucuga

SEQ ID NO: 52908 - RNA, 798 nt, Artificial Sequence
  derived and/or modified sequence opt3 from AQP5__Homo_sapiens__NP_001642
augaagaaagaggugugcagcgucgccuuccugaaggcuguuuuugcagaguuccucgccacccuuaucuuuguguucuuuggccugggguccgcguugaaauggcccucugcuuuaccuacaauucugcagauagcccuagcauucggacucgccaucgguacucuggcucaagcacuuggcccaguaucagggggacacauuaacccggccaucacgcuggcuuugcucgugggcaaucagauuagucugcugagagccuuuuucuacgucgcggcacagcucgugggugccaucgcuggggccggaauauuauauggcguugcaccccugaacgcuaggggcaaucuugccgugaacgcguugaauaacaauaccacacaggggcaagccauggucguggagcugauccuaacuuuucagcucgcacuguguauuuucgcuagcaccgacucccggcgcacaucuccuguaggaucgccagcccuuucaaucggucugagcguuaccuugggccaucucguggggauuuacuuuacuggaugcaguaugaaccccgcucgauccuucggcccugccgucgugaugaaucguuuuucuccagcacacuggguguucugggucggucccaucguuggggccgugcuggcugcgauauuauauuucuaccugcucuuuccuaacagccuuucccugucagaaagaguagcaauuaucaagggaacauaugagccagaugaagacugggaggagcagagggaagaacggaaaaagaccauggaauugacgacucgcuga

SEQ ID NO: 52909 - RNA, 849 nt, Artificial Sequence
  derived and/or modified sequence opt3 from AQP6__Homo_sapiens__NP_001643
auggacgccguggagcccggcgggagaggaugggcuagcaugcuggcaugcaggcucuggaaggccaucucccgggcgcuuuucgcugaauuucuggccaccgguuuguacgucuucuuuggcguugggucugugaugcgcuggccuacagcauuaccaucaguacugcagauugccauaacuuucaaccuagugacggcuauggcaguccaagugaccuggaaagccaguggagcucacgccaauccggcgguuacacucgcauuucuggugggcagccauaucucccuuccccgagccgucgcuuauguggccgcacagcugguaggugcuacuguuggggccgcguugcucuacggagugaugccuggcgauauucgugagacccugggcaucaacgucgugagaaauucugugucgacagggcaggccgucgcaguugaacugcucuuaacccugcagcuuguguuguguguauucgcuucaacugacagcaggcaaacaaguggauccccagccaccaugauugguaucucuguggcucugggccaccuaauagggauccauuuuacgggaugcagcaugaaccccgcccgguccuucggcccugcaauuaucauugguaaguuuacuguccacuggguguucuggguugggccacucaugggagcccugcuugcuucacugaucuauaauuuuguguuguuccccgauaccaaaacacucgcgcagcgccuggcaauauuaacuggcaccgucgaggugggcacaggggccggagcuggugccgaaccucugaagaaagagagucagccaggcagcggggcaguagagauggaaucuguuuga

SEQ ID NO: 52910 - RNA, 1029 nt, Artificial Sequence
  derived and/or modified sequence opt3 from AQP7__Homo_sapiens__NP_001161
auggugcaggccagcggccacagaagguccacccgggggucuaagauggucucauggaguguuaucgcuaaaauucaagagauacugcagcgcaagauggugcgagaauuucucgcagaguuuaugagcacauacguaaugaugguguucggacuugguuccgucgcccauauggugcugaacaaaaaguauggcucuuacuuggggguuaauuuaggauuuggcuucggugugacuauggggguccacguggcgggacguaucucgggcgcucauaugaacgccgcaguaacguuugccaauugcgcucugggcagaguucccuggaggaaauucccuguguauguccuagggcaguuucucggaucauuccuggcagccgcuaccauuuacagccuuuucuauacagccauccugcacuucagugguggccaguugauggugacugggccaguggcgaccgcaggaauuuuugccacauaccucccggaccauaugacccuguggcggggcuuccugaacgaagccuggcucacugguauguuacaacugugucuuuuugccaucacagaucaggagaauaaccccgcauugccugggaccgaagcucuggucauaggaauccuaguugugauuaucggcguaucccucggcaugaauacgggguaugccauuaacccaucucgcgaccugcccccuagaaucuucacuuucauagcgggaugggguaaacagguguuuagcaauggcgagaacugguggugggucccagugguugcuccccuucugggggcauacuugggaggcauuaucuaccucguguucauugguuccaccaucccuagggagccacugaaguuagaagauucagucgcuuaugaggaccacgggaucacagugcugccgaagaugggcagucacgaacccacuauuagcccucucaccccaguaucuguuucccccgccaaucggucaagcgugcauccugcuccaccccuucacgagaguauggcccuggagcauuuuuga

SEQ ID NO: 52911 - RNA, 786 nt, Artificial Sequence
  derived and/or modified sequence opt3 from AQP8__Homo_sapiens__NP_001160
augagcggcgagaucgccaugugcgaacccgaguucgggaacgacaaggcuagagaaccuuccgugggagguagguggcgggucucuugguacgagcgcuuuguucagccaugucugguggaacuccuuggcucagcacuguucauuuuuauagggugcuugaguguaaucgagaauggaaccgauacaggcuuacugcaaccggcccuagcgcacggucucgcucuggggcuugugauugccacucugggaaacaucagcggcggccauuucaaucccgcagucuccuuggccgcuaugcucauugggggacugaaccuggugaugcucuuaccuuauuggguuucucagcugcuugguggcauguugggggcagcccuggcuaaagccgugucgccagaggaacgauuuuggaaugcgucaggagcagccuucgucacggugcaggagcagggccaaguagcuggugcccuaguugcagaaaucauacucaccacacugcuugcucuggccguguguaugggggcgaucaacgagaagacuaaaggacccuuggccccuuuuagcauuggcuucgcagucaccguggacauccucgcuggcgggccagugaguggagguugcaugaaucccgcccgugcuuuuggcccugccgucguugcaaaccacuggaauuuccauuggauuuacuggcuggggccauuacuggccggacuccuugugggccuguugaucagauguuuuauaggugaugggaagacaaggcuaauucugaaagcucgguga

SEQ ID NO: 52912 - RNA, 888 nt, Artificial Sequence
  derived and/or modified sequence opt3 from AQP9__Homo_sapiens__NP_066190
augcagcccgagggcgccgaaaaggggaaauccuucaagcaaagacuggugcucaaaagcucucuugcuaaggagacccugucagaauuuuugggaacauucaucuuaauuguccuggguugcggcuguguugcacaggccauacuaaguagggggcgguuuggaggcgugaucacuauuaacguagguuucagcauggcgguggcuauggccaucuacgucgcagggggaguguccggcggccacauuaauccugccguuucucucgcuaugugccuguuugggcgcaugaaaugguucaagcugccauuuuaugugggagcacaguuccugggugccuuugucggcgcugccacgguguucgggaucuacuaugacggauugaugucguuugcgggcgguaagcuccugauaguaggggagaacgcaaccgcccauaucuucgcuacauacccggcccccuaucugucacucgcaaaugcuuuugccgaucagguuguggcgacuaugauuuuacugaucauugucuucgccaucuucgacagccgaaaccuuggagcaccucguggcuuggaaccaauagcuauuggccugcuaaucauugugaucgccaguucccucgggcuuaauucuggaugugcuaugaaccccgccagagaucuuagcccuaggcuguuuaccgcauuggccgguuggggcuucgagguguuucgggcugggaauaacuucugguggaucccagucguuggaccccucgugggcgcgguaauuggugggcugauauacguguuagucaucgagauucaccauccugaaccagacuccguguuuaaaacagagcaaucagaagauaagccggagaaauaugagcugaguguuaucauguga

SEQ ID NO: 52913 - RNA, 561 nt, Artificial Sequence
  derived and/or modified sequence opt3 from ARAF__Homo_sapiens__NP_001243126
auggagcccccuagaggcccaccggccaacggggcugaacccagcagggcagugggaaccgucaagguuuaccugccuaauaaacagcggacagugguaacugugcgcgacgguauguccgucuaugauucucucgacaaggcccuuaaagugcgaggccugaaccaagauugcuguguuguguaccguuugaucaaggggagaaaaacggucaccgcgugggacacagcuauugccccauuagauggagaggaacugauaguggagguacuagaagacguuccccucacuaugcacaauuucgugaggaagaccuuuuucucacuggcauuuugcgauuucugucuuaaguuucuguuccauggcuuucggugccagacaugugguuauaaauuccaccagcauugcaguagcaaggucccuaccguguguguggacauguccacuaaccgccagcaauuuuaccacucuguccaggauuugucagggggaucgagacagcaugaggccccaagcaauaggccccucaacgagcugcugacaccucagggcccacgguga

SEQ ID NO: 52914 - RNA, 4353 nt, Artificial Sequence
  derived and/or modified sequence opt3 from ARAP1__Homo_sapiens__NP_001035207
auggccgaggcuggcgacgcagcccugagcguggcggaauggcucagagcccuucaccuggagcaguacaccggguuguucgaacaacauggauuagucugggcuacagagugccagggucuguccgauacuaggcuaauggacaugggcaugcuccugcccgggcaccggcgccgaauccuugcaggacuguugcgugcccauacgucuccugcuccagcaccgagacccaccccuaggccaguucccaugaagcggcacauuuuucgcucaccuccagugcccgccacaccuccagaaccgcuccccacuaccacagaggaugagggccugccugcugccccacccauaccuccaagaaggaguugucugcccccgaccugcuucacuacaccuagcaccgcggcacccgacccaguacucccucccuuaccagccaaacggcaucuggcugaacuuuccgugcccccugucccaccgcgcacgggucccccucgauugcuggugucucuaccaacuaaggaggaagagucgcuccugcccucacuuagcaguccuccacagccccaguccgaggaaccgcugucuaccuugccucaagggccaccccagccucccagcccaccucccuguccaccggagaucccucccaaaccaguuagacucuuucccgaguucgaugacuccgauuaugacgaggugccugaagagggaccaggcgcccccgcaagggucaugacaaagaaagaggaaccuccgccaucacgggugccccgugcuguacgcguugccagucuguuaagcgagggcgaagaacugucuggggaugaccagggagaugaagaggaggacgaucacgcguacgaaggugugccuaacggcggguggcacacuuccucacucagccuuagucugccaucuaccauugccgcaccccauccuauggacggaccgcccggcgguuccacaccagucaccccugugaucaaggcugggugguuggacaagaaucccccacagggaagcuauauuuaccagaaaagaugggugaggcuagauacggaccaucugcgguauuuugauucgaacaaggacgccuacucuaaacgauucaucuccgucgcuugcauaucacacguugccgcaaucggcgaucaaaaguuugaggugauuacuaauaaccgcacauucgccuuuagagcugaaagugacguagagaggaaagaauggaugcaggcgcuccagcaagcaauggccgagcagcgggcucgcgccagacugagcuccgcauaucuucugggcgugccugggucugagcagcccgauagggccggaaguuuggaacuccgugguuucaagaauaagcuguacgucgcugugguuggcgacaaagugcaauuauacaagaaccuggaggaauaucaccuagggaucggaauuaccuuuaucgauaugucagucggcaaugugaaagagguagaccggcgaaguuucgaucucacuacaccauacagaauauuuuccuucagcgccgacucugagcuggaaaaggagcaguggcuugaagcaaugcagggugcgauugcugaggccuugucaaccagugaaguugcagagaggaucugggccgcugccccgaaccgcuucugugcagacugcggggcuccucagcccgauugggccagcauuaaucuguguguggucaucugcaaacggugugcgggcgagcacagaggacucggcgccgggguguccaaggucaggucucugaaaauggaccgcaagguguggacggaaacccuuaucgagcuguuuuugcaacucggaaacggugcuggcaaucgauucugggcagccaacguuccacccucggaagcucugcagccuagcuccucaccaaguacacggcguugccauuuagaggccaaguauagagaagggaaauacaggcgcuaucacccccuguuuggaaaucaggaggagcuagauaaggcacucugugcggccgugacuaccacagaccuggcugaaacucaggcccuuuugggcugcggugcagggauuaacugcuucucuggcgauccugaggcuccgaccccacuggcccucgcagaacaagccggacagacacugcagauggaguuuuuacggaauaacagaaccacugaaguacccaggcuggacagcaugaaaccucuugagaagcauuacuccgucguguugcccacgguuucacacagcggcuuccucuauaaaacagcuucugcggggaagcugcuacaggaucgacgcgcccgggaggaauuuuccagaagguggugugugcugggagacgguguccucaguuacuucgagaacgaacgugcagugaccccaaauggcgagauacgcgcuagcgagaucguaugccuggccgugccucccccagauacucauggguuugaacacaccuucgagguuuacacagaaggagagcggcuuuauuuguuuggccuggaaucugccgagcaagcucacgagugggucaaguguauugcaaaagccuucgugccuccguuagcggaagaccuccuggcuagagauuuugagaggcuuggucgacugcccuacaaggccggguugucccuccagcgggcacaggaaggcugguucucacugaguggaagcgagcuacgcgccguguucccagaaggcccuugcgaggagccccugcagcucagaaaacugcaagaacuuucgauccagggggacuccgagaaccaggucuugguucugguggaaaggcggcgaaccuuauauauacaaggagagagacgccucgauuuuaugggcuggcugggugcuauucagaaggcagccgcgucuaugggggacacucuuagcgaacagcagcugggagacucagauaucccagugaucguauacaggugugucgacuauauuacacaaugcggccuaacgagugaggguaucuaccguaaauguggccagaccuccaagacucagcggcuccuggagucuuugagacaggaugcuaggagcgugcaucugaaggaaggggagcaacacguugacgauguguccucagccuuaaaacgcuuccuccgagaccugccugauggacuuuuuacaagagcacagcggcugaccugguuggaagccagcgagauugaggacgaagaggaaaaggucaguagguaucgcgagcuccuggugcgucuacccccgguuaauagagcuacagugaaagcccugauaucucaucuuuacugcguacaguguuucuccgauacuaaccagaugaauguccacaaccucgcaaucguguuuggcccaacccuguuccaaacggacgggcaggauuacaaggcuggacggguggucgaagacuugauuaaucacuauguugugguauuuagcguggaugaggaggaacugaggaaacagcgcgaggaaaucaccgccaucgucaagaugcgaguggcgggcacagccucggguacucaacaugcaggggacuucauuugcaccguuuacuuagaggaaaagaaagcugagacagagcagcacauaaaggugccugccucaaugacugcugaggaacucacccuggaaauccuugacagacggaacgucggaauuagggagaaagauuauuggacguguuuugaagugaaugagcgcgaggaagcagagagaccccugcauuucgccgaaaagguuuugccaauccuccacggccuggguacagacucucaucuaguggucaaaaagcaccaggccauggaggcuaugcugcuuuaccucgcgaguaggguaggcgauaccaaacacgggaugaugaaguuucgggaggaccguucccuguugggauuaggccugcccagcgggggauuccaugaucgcuauuuuauucucaacucuagcugccugcgacuuuacaaggaagugagaucccagaggccuuggucaggcgcaccggagacuagccaccggcccgaaaaagaguggccaaucaagagccugaaaguuuauuugggugugaagaaaaagcuacgcccucccacaugcuggggguucaccgucgugcaugaaacugagaagcacgagaaacaacagugguaccuguguugcgacacccagauggaacucagagagugguucgccacauuucuguucguacagcaugauggacuuguguggccuucugaaccauccagggucucacgggcuguucccgaggugcgauuaggcagugugagccugauaccucucagagguuccgaaaaugagaugcgcaggucugucgccgcauuuacggccgacccauugucgcugcuccggaacguguga

SEQ ID NO: 52915 - RNA, 4635 nt, Artificial Sequence
  derived and/or modified sequence opt3 from ARAP3__Homo_sapiens__NP_071926
auggccgcuccccaggaccuggauaucgcaguguggcucgccaccguccaccuugagcaauacgcggacacauucagaaggcauggccuggcuacugccggggcagcccggggauugggucacgaagaguuaaagcagcugggcauuagcgcuacggggcaucgcaaacgaauacuacgucuccugcagaccggaacagaagagggcucccuugauccuaagucugacucagcaauggaaccaaguccgagccccgccccucaggcucaaccacccaaaccuguuccaaagcccagaacuguguuuggugggcuguccggaccugccaccacacagaggccaggcuugucuccggcgcucggcgggcccggaguaucgcggucaccugagccaagcccccgcccuccaccccugccgaccaguuccucugagcagagcuccgcacugaacacuguggaaaugaugccuaauucaaucuauuucggucucgauaguagaggcagggcccaggcugcccaagacaaagcacccgauagcucucagauuuccgcuccaaccccugccuuacggcccacaacggggacuguccacaucauggacccaggaugccuguacuauggcgugcagcccguugguaccccuggggcgccagaucgccgagagucaagaggagugugucagggcagggccgaacaucggcuuagccgucaagacuuggaggcacgcgaggaugcuggcuacgccagucuggaacuaccgggggacucuacacuccugucccccacucuugagaccgaagagacaagcgaugaccugauuucgccuuaugcuucuuuuuccuucaccgccgacagauugacgccacuccugucaggaugguuagauaagcugaguccccaggguaacuacgucuuucagaggcgguucgugcaauuuaauggccgaagccucauguauuucggguccgacaaggauccuuuuccaaaaggaguaaucccccuuacugcaauagaaaugacacgcucuagcaaggacaacaaauuccagguuaucaccggccagagaguguuugucuucaggacugagucagaggcccagcgggauauguggugcaguacacugcaauccuguuugaaggaacagcgccuacugggucacccgagaccuccacagcccccuaggccccuccguaccgggaugcuggagcuucggggccacaaagcuaagguguuugcggcacugagcccaggagaauuggcccucuacaagucugagcaggcuuucucacugggcauugggaucugcuucauugaauuacaaggauguagugugcgagagacgaaaagcagauccuuugaccugcuaaccccucauaggugcuucucuuuuacagccgagucggguggcgcacgccagagcugggccgcugcccuccaggaagcagucacugagacccuguccgauuacgaaguugcggagaagaucuggucaaaucgggcuaacagacagugugccgacugcgggaguucuaggcccgauugggcagccgugaaucuuggaguagugauauguaaacaaugcgcuggccagcaccgcgccuuggguagcgggauuuccaagguccagucacugaaacucgacacaagcguguggucuaacgaaaucguucagcuguucauugugcuuggcaaugaucgagcaaaccgguuuugggcuggaacucugccaccgggcgagggguugcauccugacgccacccccggaccacguggugaguucaucuccagaaaguauaggcucggccuguuucgcaaaccccacccucaauacccagaccacagucaguuacugcaggcgcuaugugccgcugucgcacggcccaaucuccugaagaacaugacacaacuuuugugcguggaagccuucgagggggaagaaccuugguuuccgccagcucccgauggaagcugcccuggccugcucccaucugaccccuccccugguguauauaaugagguuguggucagagccaccuacucaggguuccuguauuguaguccggugagcaacaaggcaggccccucgccaccuaggcgaggacgcgaugcgcccccacgguuauggugcguccugggcgccgcucuugaaauguuugccuccgagaauagcccugaacccuugagccucauccagccacaggacauugugugucuggggguuucaccgccucccacugauccaggagacagauuccccuuuaguuucgagcuaauacuggcaggcgguaggauccagcauuucgggacggauggagcugacucccucgaagccuggacaucugcagugggcaaaugguuuagcccucuguccugccaccaacuuuuggguccaggccuguuacgucucgggcgccuguggcuucggucacccagccauaccgccccugcuccgggacugugguugaguggcuucgggcuccugagaggagaucaccuauuucuguguucugcgccaggccccgguccucccgccccagaggacaugguacaucucaggcgacugcaggagauuuccgucgugagcgcagcugauacuccugacaagaaagaacaccuuguuuugguggagaccgggcggacacuguacuuacagggagaaggccgccucgauuucaccgccuggaacgccgcuaucgguggcgcagccgggggaggcgggacuggacugcaggagcaacagaugucgagaggcgacauacccauuaucgucgacgcgugcaucucauuugugacacagcacggucuuaggcuggaagggguauaucggaagggaggcgcucgagccagaucucuacgccuccuggcagaguucaggcgugaugcccggagugugaaauugagaccaggugagcauuuuguugaagacgucacggauacccugaagagguucuuucgcgaguuagacgauccugugacuuccgcucgacuccugccgagauggcgggaagcagccgagcuuccccagaagaaccaaaggcuggaaaaauacaaggacgugauuggcuguuugccacgcgucaaucguagaacacucgcgacccugaucgggcaccuauaccggguucagaaaugcgcugcccugaaccagauguguacaaggaaucuugcacuccuguucgccccuagcguguuucaaacugauggacgcggcgagcaugaggugcgaguauugcaggaacugauugacggguauauaucugucuucgauaucgacagcgaucagguggcucagauugacuuagagguuucccucaucaccacguggaaggaugugcaacugucacaggccggagaccuuaucauggaagucuacauugagcagcagcugcccgacaacugcgugaccuugaaaguuaguccaacacucacugcagaggaacugaccaaucaagugcuagagaugagaggcacagcugccgguauggaucuguggguaacuuuugaaauacgggagcacggggaacuugagaggccucuccaccccaaggagaagguccuggaacaggcguugcaguggugucaguuaccggagccaugcagcgccucucugcuccugaaaaaggugccucuugcacaagcuggaugccuguucaccggcauccgcagagaaucccccagggugggcuugcuacggugucgugaggaaccaccccgccugcucgggucacgauuccaggagagauuuuuccugcuuaggggacggugcuuacugcucuugaaagagaagaaaaguagcaagccugaacgcgaguggccgcuggaaggugccaaggucuaucucggcauuagaaagaagcugaaacccccaacgccuuggggguuuacacuuauccuggagaagaugcauuuguaccuauccuguaccgacgaagaugagaugugggacuggacuacaucuauucugaaagcucagcacgaugaccagcaacccguugugcucaggcggcauucgagcucagauuuagcacgacagaaguucggaaccaugccucugcuuccaaucagaggcgacgauuccggugccacucugcucagugccaaccagaccuugcgcaggcugcacaaucggcguacacucucuauguuuuuccccaugaaaagcucccaagggucaguagaggaacaggaggaacuggaggagccuguguaugaggagccagucuacgaagaggugggagcuuuucccgaacuuauacaggacacgucuaccagcuucaguacuacaagagaguggaccguuaagccggagaacccucuaacaucccagaaaagccuggaucaaccauuuuugucuaaaucauccacuuuaggccaggaagagaggcccccugaaccacccccgggcccucccaguaagagcucgccacaggcgcgcgggucucuggaggaacagcuccugcaagagcuuuccagccugauccuccggaaaggagagaccacggcagguuugggcucaccuagucagcccucuuccccacagagccccucaccuacagggcugccaacccagacuccgggauuccccacccaaccuccaugcacaaguucucccccuuccucucagccacuaacuuga

SEQ ID NO: 52916 - RNA, 1191 nt, Artificial Sequence
  derived and/or modified sequence opt3 from ARC__Homo_sapiens__NP_056008
auggagcuggaccacagaaccagcggcgggcuccacgccuaccccggaccuagggguggccagguggcuaagccaaacgucauccuucaaauugggaaaugccgggcagaaaugcuggagcacguucgccgaacacaucgucacuuguuagccgaaguguccaagcagguagagagagaacugaaaggacuacauaggucugugggcaagcucgagucaaaucuggaugguuaugucccgaccagugacagccagcgguggaaaaaguccauaaaggcgugucuuugccgcugucaggagacgaucgcuaaccuggaaagaugggugaaaagggagaugcacguuuggcgggaaguguucuaccgcuuggagcgaugggccgauagacucgagucuaccgggggaaaguaucccgucggcucggaaucagcaaggcacacagugagcguaggcguugggggaccugagaguuacugccaugaagccgacgguuaugauuacacuguguccccauaugcuauuacucccccuccagcagccggcgagcugcccgggcaagaaccugcugaggcccagcaguaccagccaugggucccgggagaggacggccaacccucuccugguguggauacacagaucuuugaagacccacgggaguuccugagccaccucgaagaguacuuacgucaggucgggggauccgaagaguauuggcugucacagauucaaaaucauaugaacggccccgcgaaaaaguggugggaguuuaaacagggcagugugaagaauuggguugaguucaagaaagaauuucuucaguacagcgaagggaccuugucucgcgaggcaauccaaagagaacuggaucuaccucagaagcagggagagccacucgaccaguuccuguggaggaaacgggaucuuuaucaaacucuguacguggacgccgaugaggaagagauaauccaguauguaguggguacauugcagcccaagcucaaacgauuucugcgccacccguuaccuaagacccuggaacagcucauucaaagaggcauggagguccaggacgaccuugagcaggcugccgaacccgcagggccacaucugccuguggaggaugaagcugagacguugacucccgccccaaacuccgaaucaguugcgagcgacaggacccagcccgaguga

SEQ ID NO: 52917 - RNA, 1272 nt, Artificial Sequence
  derived and/or modified sequence opt3 from ARCN1__Homo_sapiens__NP_001135753
augauccccgaguacugcagagcccuggaagagaacgaaauuagcgagcacuguuucgaccucauauuugcuuucgaugaaaucguggcacuuggcuauagggagaaugucaaccuggcccagauucggaccuuuacagagauggacucccaugaagagaagguuuuccgcgcggugcgagaaacucaagagcgugaggcuaaagccgaaaugagaaggaaggcaaaagaguugcagcaggcccggcgcgaugcugaaagacaggggaagaaagcaccuggauuugguggcuucgggucuucagccguaaguggaggcagcacggcugccaugaucaccgagacaauuaucgaaacugacaagccaaagguggcgccggcacccgccaggccuuccgguccaucuaaggcuuuaaaacugggggccaaaggaaaggaggucgauaauuuuguggacaaacuaaagucggagggcgaaaccauaaugucaagcaguaugggcaagcggacauccgaggcaaccaaaaugcacgcucccccuaucaacauggaaucuguucauaugaagauugaggagaaaaucacucucacaugcgggcgcgauggaggucugcaaaauauggaacuucacggcaugauuaugcugcgaaucagcgacgauaaguacgggagaauaagguugcauguggagaacgaagacaaaaagggaguccagcuccagacccacccaaauguggauaaaaagcuguucacggccgagucccugauuggccucaagaaccccgaaaaaucauuuccuguaaauagugacguugguguguuaaaguggcggcugcagacuaccgaggaaucuuucaucccacuuacaauuaacuguuggccgucugaguccgggaauggaugcgaugucaacaucgaguaugaauugcaagaggacaaucuggaacuaaacgacguggugaucacuauuccccucccuucaggcgucggcgcgccaguuauaggggagaucgauggagaguaccgucacgacagccgcagaaauacccuggaauggugucuucccgugauugaugccaaaaacaagagugguucucuggaguuuuccaucgcaggccagccuaacgacuucuuuccaguacaggugagcuucgucucgaaaaagaauuauugcaacauacaggugacaaagguuacccaaguggaugggaauagccccgucagguucuccacggaaacuacauuuuugguggacaaauacgagauucucuga

SEQ ID NO: 52918 - RNA, 759 nt, Artificial Sequence
  derived and/or modified sequence opt3 from AREG__Homo_sapiens__NP_001648
augagagcuccccugcucccuccagccccggugguccuuagccuguugaucuuaggcuccgggcacuacgcagccggacuggaccuaaacgauaccuauucugguaagagggagcccuucucaggcgaccauagugcggauggguuugaaguuacaagccgguccgagaugucuucgggaucagaaauuagcccugugagugagaugccauccucuagcgaacccuccucaggcgcugacuacgauuauagugaggaguacgacaaugaaccucagauaccagguuauaucguagaugacagcgugcgcgucgagcaagugguuaaacccccucagaacaagacugaaucugagaauacguccgauaaaccaaagcgaaagaagaaagggggcaaaaacggaaagaaucguagaaacaggaaaaagaaaaauccgugcaacgccgaguuccagaauuuuuguauucacggcgaaugcaaguacaucgagcaucucgaagcagugaccuguaagugccagcaagaguauuucggggaacgguguggagagaaaucaaugaagacacacagcaugauugacaguucucuguccaaaaucgcccuugcugcaauagccgcuuuuaugagcgccgucauccugacugcgguggcaguaauuaccguucaguugcgcagacaguacgugaggaaguacgagggugaagccgaggaacggaaaaagcuccgccaggagaacggcaauguccaugcuaucgccuga

SEQ ID NO: 52919 - RNA, 546 nt, Artificial Sequence
  derived and/or modified sequence opt3 from ARF1__Homo_sapiens__NP_001019398
augggcaacaucuucgccaaucuguuuaagggacucuucgggaaaaaggagaugaggauucuuauggugggucuggacgcugcaggcaaaaccacaauauuguacaaguuaaaacugggggaaaucgucacuacgauucccaccaucggauuuaacguugagacaguggaauauaagaauauuagcuucacuguaugggaugugggcggucaggacaagaucagaccucuauggcggcacuacuuucaaaacacccaggggcucauauucgucguggauuccaaugaccgcgagcgaguuaacgaagcccgugaggagcugaugagaaugcuugcggaagaugagcugagggacgcuguguugcucgucuuugccaauaaacaggaucugccaaacgcaaugaaugccgcugaaaucacagacaagcugggacuccauucuuuacggcaccgcaacugguauauucaggcaaccugcgccacuucaggcgauggccuguacgaggggcuugacugguugaguaaucaacugagaaaccagaaauga

SEQ ID NO: 52920 - RNA, 546 nt, Artificial Sequence
  derived and/or modified sequence opt3 from ARF3__Homo_sapiens__NP_001650
augggcaacaucuucgggaaucuacucaagagccuuauugguaaaaaggagaugagaauacugauggugggauuggacgccgcuggcaaaacuacaaucuuauacaagcugaaacuaggggaaauugucacuacgauccccaccauuggauuuaacguugagacaguggaauauaagaauaucuccuucacuguaugggaugugggcggucaggacaagauaaggccucucuggcggcacuacuuucaaaacacccaggggcugaucuucgucguggauucuaaugaccgcgagcgaguuaacgaagcacgugaggagcuuaugagaaugcuggccgaagaugaguugagggacgcggugcuccuggucuuugcuaauaaacaggaucugccaaacgccaugaaugcagccgaaauuacagacaagcucggauuacauucacugcggcaccgcaacugguauauccaggcuaccugcgcaaccaguggcgauggccuuuacgagggguuggacuggcuggccaaucaacugaaaaacaagaaauga

SEQ ID NO: 52921 - RNA, 543 nt, Artificial Sequence
  derived and/or modified sequence opt3 from ARF4__Homo_sapiens__NP_001651
augggccugaccaucagcucccucuucucuagacuuuuugggaagaaacagaugaggauucugauggugggauuggacgccgcugguaagacaacuauauuauacaaacugaagcuaggcgagaucgucacgaccauucccacaaucggguucaacguugaaacuguggaguauaaaaauauuugcuuuaccguaugggaugugggaggccaagaccggauccgcccucucuggaagcacuacuuccagaacacacagggucugauauuugucguggauucaaaugaccgagaacguauccaggagguugcagaugaacuucaaaagaugcuguugguggacgagcucagagaugccguccugcuccuguucgcgaacaaacaggacuuaccaaaugcuauggccauuagugagaugaccgauaagcuggggcuucagagcuugaggaaccggacuugguaugugcaggcaacaugugccacccaaggaacgggccuguacgaaggccuagacuggcucuccaaugagcugucuaaacgcuga

SEQ ID NO: 52922 - RNA, 528 nt, Artificial Sequence
  derived and/or modified sequence opt3 from ARF6__Homo_sapiens__NP_001654
augggcaaggugcugagcaaaaucuucgggaacaaggagaugaggauucucaugcuuggacuggacgccgcugguaaaaccacaauauuguacaaguuaaaacugggccaguccgucacuacgauccccaccguuggguuuaauguggaaacaguaacuuauaagaacgugaaguucaaugucugggaugugggaggccaagacaaaauuagaccucuauggcggcacuacuauaccgguacacaggggcucaucuuuguuguggauugcgcagaccgcgaucgaauugacgaggcccgucaggaacugcauagaaucauaaacgauagggagaugcgggacgcgaucauucuuaucuucgcuaauaagcaggaucugccagacgccaugaaaccgcacgaaauucaagagaaguugggacucacccgcaucagagauaggaacugguacguccagcccucuugugcaacuucaggcgacggccuguaugaggggcugacauggcucaccaguaauuacaaaagcuga

SEQ ID NO: 52923 - RNA, 1212 nt, Artificial Sequence
  derived and/or modified sequence opt3 from ARFGAP1__Homo_sapiens__NP_001268411
auggccagccccagaaccaggaaggugcugaaagagguccggguucaggacgaaaacaaugugugcuucgaguguggcgcuuuuaacccucaauggguauccgugacauacgggaucuggauuugccucgaauguucuggacgccaccgaggucuuggcguccaucugucauucgugcguaguguuacuauggauaaguggaaagacauagaguuggaaaagaugaaagcagggggaaaugccaaguuuagagaguucuuagagagccaggaagauuaugacccaugcuggucccugcaggagaaguacaacucuagggcggcugcccuauuucgggauaaaguggucgcacucgccgaaggccgcgaguggucgcuggagucaagcccggcucagaauuggacgcccccucaaccaagaacccuucccaguauggugcacaggguauccggucagccucagucuguuacagcaagcuccgacaaggccuucgaagauuggcugaacgacgauuuggggucauaucagggagcucaaggcaaucgguacgugggcuuugggaacacuccacccccucagaaaaaggaggacgauuuccucaauaacgccaugaguagccuguauucuggaugguccucauuuaccacaggugcgagccgcuucgcaagugccgcuaaagaaggcgccaccaaguuugggucucaggcaucccagaaggcuagcgagcugggacauucgcucaaugaaaacgucuuaaaaccagcccaagagaaggugaaagagggcaagaucuucgacgaugugucuuccggugucucacagcuggcgaguaaaugucagcgaagacuuugcugucaccaaagccauugcuccgccgggcacuugggaagggcauuuuguccgguuucuuggcacgaagcucugugcggccagacuggccgggaggaacaggccagccuacugcccccuaagcaugugguaggggcucucgaggugugugcccguggaugcccacgcugccacgucccccauacaccugguaccgcagccgaauggccaggcagacuuugucugucaagggagagugugguucgggacgggggaacguccccgcccuucuuccgaggcaaacagcgcgcuccuuggacugcgcccagaagggcaaccgugauucggacagccgucuggacuaccagcaagacagcuaccuga

SEQ ID NO: 52924 - RNA, 1482 nt, Artificial Sequence
  derived and/or modified sequence opt3 from ARFGAP2__Homo_sapiens__NP_001229761
auggccgcugagcccaacaagaccgaaauccagacacuguucaaaagacucagggcagugccuacuaauaaggccugcuuugacuguggcgcgaaaaacccaagcugggcuuccauuacguacggggucuuccuuugcauagauuguucuggaguucaccggucacugggugugcauuugaguuuuauccgcagcaccgaguuagacuccaauuggaacugguuccaacugcgaugcaugcagguaggcgggaaugccaacgcaacagccuuuuuccgucagcacggauguacugcuaaugaugcaaacaccaaguauaauucuagagccgcucagauguacagggagaaaauucggcaacuaggcucggccgcgcucgcacgccaugguacagacccgcccgccugggaugcuccugccaccgaaccaucagggacucagcagcccgcaccuagcacagaaaguuccggacuggcucagccagagcacggccccaacaccgaccuucugggcacgucuccuaaggccagcuuggagcucaaguccucaaucauugggaaaaagaaaccagcggccgcaaagaaaggacugggugcuaagaagggccugggggcccaaaaagugaguagccagucuuuuuccgaaaucgagagacaggcucaggucgccgaaaagcucagggagcaacaggcagccgaugcuaaaaagcaggcggaggaaucaaugguggcaagcaugcgguuagccuaucaagagcugcagauagaccgcaaaaaggaagagaaaaaguugcagaaucuugaaggaaagaaacgagagcaggcugagagacugggcaugggucuaguuaguaggucuuccgugagccauucgguccucucugaaaugcaagugaucgagcaggaaacuccgguauccgccaagucaagucggagccagcuggaucuuuucgacgauguugggaccuuugcauccggacccccuaaauacaaggacaacccauucucucugggcgagagcuuuggcucacguugggauacagacgccgcuugggggauggaccgcguggaagagaaagagcccgaagucacuauuaguuccaucagaccuauuagcgagagggccaccaaucggcgagaaguggagucucgcucaaguggauuggaaagcuccgaggcaagacagaaguucgcgggugcuaaggccaucucuucggauauguuuuucggcagggagguggacgcagaauaugaggcccggagccgccuccaacagcuguccgggucaagugcuauaucuagcuccgauuuauucggagacauggauggcgcccacggugcagggucagucagccugggcaacguucucccaacagcugacauugcccaguuuaaacagggagugaagucuguagcgggcaaaauggccgugcuugcuaauggggucaugaacucccugcaagauagauacggaaguuauuga

SEQ ID NO: 52925 - RNA, 1419 nt, Artificial Sequence
  derived and/or modified sequence opt3 from ARFGAP3__Homo_sapiens__NP_001135765
augggcgaccccagcaagcaggauauccugaccauuuucaaaagacucagguccgugccuacaaacaaggucugcuuugacuguggggccaaaaauccaucuugggcuucaauaacuuacggaguuuuccuuugcaucgauuguagugguagccaccggucccugggcgugcauuugucuuuuauucgcucgacggaguuagacucaaacuggagcugguuccaacugcgaugcaugcagguagggggaaaugcaagugcccuauggcucgauuccuguguggucccgccccugucuccuccacccaaggaagaggacuuuuucgcgagccacguguccccugaaguuucagauaccgcuugggccagugcaaucgccgagccaagcucucuuacaucccgucccguggaaacuacccuggagaacaaugagggcggucaggaacaggggccuucagucgagggauugaacgugccaacaaaagcuacccucgaaguaagcaguauuaucaagaagaaaccgaaucaagcaaagaaaggccugggcgccaagaaagggucucugggagcucagaagcucgccaacacuugcuuuaaugagauagagaagcaggcgcaggcagccgacaaaaugaaggaacaagaggauuuagcuaaaguuguguccaaggaagagagcaucgucucgucucugagacuugccuauaaagacuuggaaauucagaugaagaaagaugagaagaugaacaucuccgguaagaaaaauguggacucagauaggcugggcaugggguucggaaacugucggagugugauuagccauuccgucacaucugacaugcagaccaucgagcaggaaagccccauaauggcaaagccucgcaaaaaguacaaugacgauucagacgauaguuauuuuacguccaguucuucauacuucgacgagccaguugaacuaagaaguagcuccuuuucuucgugggaugacagcuccgauucauauuggaaaaaggagacuagcaaggacaccgaaacagugcucaaaacuaccggcuacucugauaggcccacagcucggcgcaagccugacuaugagccaguagagaacaccgaugaagcccagaaaaaguucgguaaugugaaagcgauuagcuccgacauguacuuugggcgacaaucacaggccgacuacgagacgagagcaaggcuggaacggcuuagcgcuucuuccaguaucagcucugccgaucuguucgaggaaccccguaagcaaccggcuggaaacuauuccuugucaaguguccucccuaacgcccccgacauggcacaguucaagcagggcgugcgcagcguugccggcaaacugucgguguuugcuaauggggucgugacuuccauucaggauagauacggaucuuga

SEQ ID NO: 52926 - RNA, 5550 nt, Artificial Sequence
  derived and/or modified sequence opt3 from ARFGEF1__Homo_sapiens__NP_006412
auguacgaaggcaagaaaaccaagaacauguuccugacuagagcccucgagaaaauccuugcugacaaggaagugaaaaaggcacaccauagccagcugaggaaggccugcgaagucgcguuggaggaaauuaaagcugagacugagaagcaaucucccccucacggggaagccaaagcaggguccucaacguuaccaccgguuaagaguaaaaccaauuucauagaggccgauaaguauuuccugcccuuugaacuagcuugucagagcaagugcccucggaucguguccacaucucucgacugucugcagaaacuuauugcauacggucaucugacuggcaacgccccagauucgaccacacccgggaagaaauugaucgaccgcauuaucgagaccauaugcggauguuuccagggcccucagacugaugaggguguacagcuccagaucauuaaggcucugcugacagccgugaccucacagcacaucgaaauucaugaggggacgguccuccaagcggugcgaacuugcuauaauaucuacuuagcaagcaaaaaccugauaaaucagaccacagccaaggcuacucuuacccagauguugaacguuauuuuugcccguauggaaaaucaggcacugcaagaggcuaaacagauggaaaaggagagacacaggcagcaccaucaccuacuccaaaguccagugucccaucacgagcccgaaucuccucagcugcgguaucuuccaccgcagacagucgaccacaucagccaggagcaugaaggagaucuggacuugcacaccaacgauguggacaagucccuccaagaugacacggagcccgaaaauggcucagauauuaguagcgccgagaacgagcagacugaagcggaccaggccacagcagcugagacccugucuaaaaaugaaguauuauacgacggcgagaaccaugauugugaagagaagccucaggacaucguucaaaauaucguggaggaaauggucaacauuguggugggggauaugggagaggguacuacaauaaaugccuccgcugacggcaacaucgggaccauugaagauggaucagacagcgagaacauccaggccaauggcauaccagguacgcccauuagugucgcauauaccccuucucugccagaugaccgccucuccguuagcucgaacgauacacaggagucuggaaauuccucaggacccaguccgggcgccaaauucagccacauccuucagaaggacgcuuuucugguguucagauccuugugcaaacuaucuaugaagccucugagcgauggacccccagacccuaagucacaugaacucaggaguaaaauccugucccuucaacuguugcucagcauucugcagaacgcggggcccaucuuucggacuaaugagauguucauuaacgcaauaaagcaguacuuauguguagcccugucuaaaaauggagugucaagugucccagaaguguuugagcuaagccucuccaucuuccugacccuuuugucuaacuuuaagacacaccugaaaaugcagauugaaguuuucuucaaggagaucuuucucuacauccuggagacuucgaccagcuccuucgaccacaaguggauggugauucaaacacuuacccgcauaugcgcugaugcccagucagucguggacaucuauguaaauuacgauugugaccugaacgcagccaauauuuuugaacgauugguuaacgaucucaguaaaaucgcucaggguagaggcucucaagagcuggggaugagcaaugugcaggaauuaucccugaggaagaaaggacuagagugccucgucucaauucugaagugcaugguggaauggagcaaagaccaguaugucaaccccaauucucagacuacgcuuggccaagagaagccuuccgagcaggaaaugagugagaucaagcauccagaaacaauaaaccgguacgguagcuugaacucucuggaguccaccucaaguagcgggaucggcucguauuccacucagaugucuggaaccgauaauccggaacaguucgaggugcucaaacaacagaaggagauuaucgaacagggcauugaccuguuuaacaaaaagcccaaacgugggauccaguacuuacaagagcagggaaugcuggguacaaccccugaagauauagcccaguuccuucaccaagaggagcgcuuggacagcacucagguuggcgaauuucucggggauaaugacaaguucaacaaagaggugauguaugcauacguagaucagcaugacuuuucaggaaaggacuucgucagugcgcugagaauguuucuagaaggcuucaggcugccaggugaggcucagaagauugaucggcucauggaaaaauuugccgcacgauaccuggaguguaaucaagggcagacacuuuucgccuccgcugacacggccuauguguuggcauacucuaucauuaugcugaccacugauuuacacagcccccagguuaagaacaaaaugacaaaggagcaguauaucaaaaugaaucgcggcauaaacgacuccaaggaucucccugaagaguaccugucagcuaucuauaaugaaauugccggaaagaaaaucagcaugaaggagaccaaagaacuuacaauuccaacuaagaguucuaaacaaaacguggcguccgagaagcagagaaggcuguuguacaaucucgagauggaacagauggccaagaccgcuaaagcacugauggaggccgucagccacgugcaggcucccuucacgucggccacccaucuagaacacguacggccgauguuuaagcuggcauggacaccuuuccucgcggccuuuucagugggccugcaagacugcgaugacacugagguugcuucucuuuguuuggaagggauccgcugcgccauaagaauugcauguaucuucaguauccagcuggagagggaugcuuauguccaggccuuagcacguuuuacccuccugacaguguccagcggaauuacugagaugaaacagaagaacaucgacaccauuaaaacgcuuauaacaguggcccauaccgaugguaauuaccugggcaacucuuggcacgaaauccuaaagugcauuagccaacucgagcuggcucaguugaucgggacuggagucaagccacgguacauuuccggcacaguucgagguagagaagggucacugaccggcacuaaagaccaggcgcccgaugaguucgugggauuaggccucguagggggcaauguggacuggaagcaaaucgccaguauacaggagagcaucggcgaaaccucuucccagucagucgugguugcaguggacaggauuuuuacagguaguacgcgccuggaugggaacgcuaucgucgacuucgugcgguggcuuugugccguuagcauggaugagcuguuguccaccacucauccuagaauguuuucucuccagaaaauuguggaaaucucguauuacaacaugggaaggauacgccugcaauggagccgaauuugggagguaaucggcgaccacuucaauaaggucgguugcaaccccaaugaagauguggccaucuuugcuguggacucacuacggcagcuguccaugaaauuccuugagaagggcgagcucgcaaacuuucguuuccagaaagauuuccugagaccauuugaacacauuaugaagaggaaucgcaguccuacaauacgggacauggucguuagauguaucgcccagauggugaacucucaagcggcuaauauuaggagcggguggaagaacaucuucuccguauuucauuuggccgcaucagaucaggacgagucuauuguggaacuggccuuccagaccacaggacacaucgucacuuuaguguuugagaaacauuuccccgcuaccauagauagcuuucaggacgcaguuaagugccucagugaauuugccuguaaugcggcuuuuccagacacguccauggaggccauccgacugauucgccacugcgcaaaauaugugagcgaucggccgcaagccuucaaggaguacacaucugacgauaugaacgucgcuccugaagacagaguguggguuaggggcugguuucccauccuuuucgagcugucaugcauuaucaaucguuguaaauuggaugugcgcacccgggggcucacugucauguucgaaauaaugaagaccuauggacauacauacgagaagcacugguggcaggaccuguuuagaauuguauucaggaucuuugauaacaugaaacuaccagaacagcaaacugagaaggccgaguggaugaccacaacgugcaaucacgcacuguaugcuaucugugacguguucacccaguaccuugaaguucucuccgaugugcuguuggacgauauuuuugcccaguuauacuggugcguccagcaagacaacgagcagcuggcgcgaaguggcacuaauugucucgaaaacgugguaauccugaacggugagaaauucacacuugagauaugggauaagaccugcaauuguacucuggacauuuuuaaaacaaccaucccccaugccuugcuaacguggcggccuaacagcggggaaacugcaccacccccuccgucgccagugucugagaagccccuggacaccauuucccaaaagagcgucgauauccacgacucaauacagccucgcaguguugauaauagaccacaagcuccccucgugucugccuccgcugugaacgaagaggucagcaaaauuaagucaacagcaaaauucccugaacagaagcuguuugccgcccuuuuaaucaaaugcgugguucagcuggagcucauccagaccauugacaauaucguauucuuuccggcuacaaguaagaaggaggaugcggaaaacuuggcagccgcucaaagggacgccguggauuucgacguccggguggauacacaggaccagggaauguaucgauuucugaccagccagcaacucuucaaacugcuugauugucuguuggagucccauagauucgcaaaggccuuuaauucuaacaaugaacagcgcacagcucuauggaaagcgggcuucaaggguaaaagcaagcccaaccugcucaagcaggagacuuccucauuagccugcggccugaggauucuuuuucguauguacauggacgaaucucggguuagugcaugggaggaggugcaacagagacugcucaaugucuguucggaggcuuugagcuauuuccugacccucacguccgagucucacagggaagccuggacaaaccugcuucuacuguuuuugaccaaaguguuaaagauaucagauaaucgcuucaaagcacacgccagcuuuuacuauccacugcucugcgagaucaugcaguucgaccugauuccugaacuucgagcuguacugagacgguuuuuccucaggaucggggucguguuucagaucucccaacccccagagcaggaguugggaauuaacaagcaguga

SEQ ID NO: 52927 - RNA, 5358 nt, Artificial Sequence
  derived and/or modified sequence opt3 from ARFGEF2__Homo_sapiens__NP_006411
augcaggagagccaaaccaaguccauguucgugucuagagcccuggaaaaaauccucgcugacaaggaggucaaaaggccccagcacucacagcuucggcgcgcaugccagguugcccuggaugaaauuaaggcggagauagaaaaacaacgauugggcacagcugccccuccaaaggcaaacuuuaucgaggccgacaaguacuucuuaccguuugagcuggcuugucagaguaaaagcccccgugugguauccacuucucuagauugccuccagaagcugauugcauaugggcauaucacgggaaaugccccugacucgggugcuccaggcaaaagacuuauugauaggaucguggaaaccauauguucaugcuuccaggggccccaaacagacgagggaguccagcugcagaucauuaaggccuugcucacugcggugaccagcccucacaucgaaauucaugagggcacaauccugcagaccguucggacuuguuacaacauauaucuggcaaguaaaaaucucauuaaccaaacaaccgccaaggcuacguuaacucagaugcugaaugugaucuuuacccgcauggagaaccagguccuucaagaagccagagaguuggaaaagccaauucaguccaaaccccagucuccugugauccaggcagcugccguaagcccaaaguucguuaggcugaaacacucccaagcgcagucaaagccgacaacucccgagaaaaccgaucuaacaaauggugaacaugcccggagugacagcgggaaggugucuaccgagaacggagaugcaccucgcgagcgaggcuccucacucagcggcacggacgauggggcucaggaagucgugaaagacauccuggaggauguggucacuagugccauuaaggaagcugccgagaagcacggacuuacagaaccagagagaguucugggugaguuggaaugccaggagugugcaauacccccuggcguggacgaaaauucucaaaccaacgggaucgccgacgauaggcagucccucagcucggcugacaaucuggagucugaugcgcagggacaccagguagcagcccgguuuucccauguguuacaaaaagacgcuuuccuggucuuucguucacucugcaagcuuaguaugaaaccacugggcgaaggucccccggauccuaagagccacgaguugcgcuccaaagugguuucucuacagcugcuccugagcgugcuucagaacgccgggcccgucuucagaacucaugagauguuuauuaaugcaaucaagcaguaccuguguguggccuugucaaagaacggaguaaguuccguuccagacguguucgaacucagccuggcuauauuuuuaacacugcuaucuaauuucaaaaugcaccucaagaugcaaauugaggucuucuuuaaagaaaucuuccugaacauccuugagaccucaacgaguagcuuugagcacagguggauggugauucagaccuugacacggaucugcgccgaugcacagugugucguggacauuuauguuaacuacgauugcgaccugaaugcggcuaacauauucgaacgacucgugaaugaucuguccaagaucgcccaaggccgcucuggccaugagcuugggaugacuccucugcaggaauugucgcucagaaaaaagggacuggagugcuuaguaagcauucugaaguguauggucgaaugguccaaagaccuauaugugaaccccaaucaccagaccucacucggucaggagaggcugacagaccaagagaucggcgaugggaagggacuugacauggcacggcgcugcaguguuacuucuauggaaagcaccguguccucaggcacacagaccacuguccaggaugacccagagcaguuugaagugaucaaacaacagaaggagauuauagaacaugguaucgaguuguucaacaaaaagcccaagagagggauucaguuucugcaggagcaaggcaugcucggaacgagcguagaagauaucgcccaguuccugcaccaggaggaaagguuagacucuacacaagugggcgauuuucugggggacuccgcucguuucaauaaagagguuauguacgccuacgucgaucagcuugacuuuugugaaaaggaguucgugagugcauugcggaccuuucucgagggauuccgacugccuggugaagcucagaaaauugauagacuaauggagaaguucgccgcgagguauaucgaaugcaaccagggccaaacucuguuugccagcgcugacaccgcauacgugcucgccuauucuauaaucaugcugacaaccgaucuucauuccccacaggucaaaaauaagaugacuaaagagcaguacauuaagaugaaccgcgggaucaaugacucaaaggacuugccggaggaauaucugaguagcauuuacgaggaaaucgagggaaaaaagauagcuaugaaagaaacaaaggaguuaacgauugccaccaaaucgacuaagcagaacguugcauccgagaagcaacggagacuccuguauaaucuugaaauggagcagauggcgaaaacagccaaggcucugauggaagccgugucucacgcaaaagcucccuucaccagcgccacacacuuggaucaugugaggccuauguuuaagcucguauggacuccacugcuagcagccuacucaaucggccugcagaacugugacgauaccgaggucgcuagucucugccuggaagguauucgcugugcgauccgaauagccugcaucuucgggaugcagcuugagcgggacgcauacgugcaagcuuuggcccguuuuucccuguuaacggccucuagcuccauuaccgagaugaaacagaagaauaucgauacaauuaagacucucaucaccguugcucacacagacggcaacuaucugggaaacucauggcaugaaauacuuaaauguauuagccagcuggagcuagcacagcucaucggcacuggggugaagaccagauaccugaguggaucugguagggaacgcgagggcuccuugaaagggcacacgcuggccggagaagaguucaugggcuuaggucucgggaaucuggucagcggcggaguggauaagcggcaaauggcgucguuucaggagucaguuggcgaaacaucuagucaguccgugguagucgcuguggacagaaucuucaccgggagcacuaggcuugauggaaacgccauuguggacuuuguccgauggcugugcgcaguuucuauggaugaguuggccagcccccaccauccucgcauguucucccuccaaaaaaucguggaaauuucauauuacaauaugaaccggauaagacugcaguggaguaggaucuggcacguaauuggcgaccauuuuaauaagguggguuguaacccaaaugaggaugucgcuaucuucgcaguggacagccuacgucagcugucuaugaaguuucuugagaaaggggaacucgccaacuuccgcuuccagaaggacuuucugcggcccuucgagcacauuaugaaaaagaauagauccccgacaaucagggauauggcgauacgaugcaucgcucaaaugguuaacucacaggccgcaaauauucggaguggauggaaaaacaucuuugccguguuccaucaggcugccagcgaccacgauggcaauauugucgaauuggcauuucagaccacuugccacaucgugaccacaauauuccaacaucacuuuccugcugccauugacuccuuccaggaugcgguuaagugucugucugaguuugccugcaacgcagcuuucccagacacgucgauggaagccauccgcuuaaucagauuuugugguaaauaugugagcgagaggccccggguccuccaggaguacaccucagaugacaugaauguagcuccuggcgaucgaguguggguuagagggugguuccccauucuguucgaacuuuccugcauaaucaaccgcuguaagcuggacgugaggacucguggauugacagucauguuugagauuaugaagaguuauggccauaccuucgaaaaacacugguggcaggaucucuuucggaucguguucagaauuuuugacaacaugaagcugccagagcaacuaucugaaaaaagcgaguggaugacaacuaccugcaaucaugcacuguacgccaucugugacguauucacgcaguuuuacgaggcccuuaacgaagugcuccuguccgaugucuucgcucaguugcaauggugcguuaagcaggacaaugagcaguuagcgaggucagggacaaacugucuggaaaaucucgugauaucuaacggagagaaauuuagcccugaagugugggaugagaccugcaauuguaugcuggacaucuucaagacuaccauuccccacguccuucugacauggcgcccagugggcauggaggaagauaguuccgagaagcacuuggacguugaucuagaccgacagagccugucuucaaucgauaaaaacccguccgaaagaggucaaagucagcucagcaauccuacugacgauucguggaaggggcggcccuaugcaaaccagaaacuguuugccucucuuuuaauuaagugcguagugcagcuggagcucauccaaaccauagacaauauugucuucuacccagcuacauccaaaaaggaggaugccgaacauaugguggcagcccagcaggacacguuggacgcugauauccacaucgagaccgaagaccagggaauguauaaguacaugagcucacaacaucuguuuaaacuccuggauugccuucaggagagucacucuuucuccaaggcguucaacagcaauuaugaacagaggacuguucuguggcgcgccggcuuuaaagguaagucaaaacccaacuugcuaaagcaggagacaaguagccuggcauguugccuccguauuuuauucagaauguacguggacgagaaucggagggauuccugggaagagauccaacagcgccugcuuaccgucuguucugaagcucuggccuauuuuauaacugugaacagcgagucccaccgagaagcauggacaucacucuugcugcuccugcuuaccaagacgcuaaaaauuaacgacgagaaguucaaagcccaugcuucuauguacuacccuuaucugugcgagaucaugcaguuugauuugauuccagaauuaagagccguacugcggaaguucuuucucaggaucggcgucguguacaaaauauggauucccgaggaaccuagucaaguuccggcggcacugucgccagugugguga

SEQ ID NO: 52928 - RNA, 6534 nt, Artificial Sequence
  derived and/or modified sequence opt3 from ARFGEF3__Homo_sapiens__NP_065073
auggaggaaauccugagaaagcuccagaaggaggccuccggcuccaaguacaaagcuauuaaggaaucuugcaccugggcacuugagacacuagguggguuggacacuaucgugaaaauacccccucacgucuuaagggaaaagugucugcugccacuccaacuggcccuugagucaaagaacguuaaacuggcgcagcaugcuuuggccgggaugcagaagcuccugagugaggaacgguucgugagcauggagacggauuccgacgaaaaacagcugcucaaucaaauuuuaaacgcaguaaaggugaccccgucucugaaugaggaucuucaggucgaggugaugaaaguuuugcugugcaucacauauacucccaccuuugaccuaaacggcucggccgugcucaagauugcugaagucuguaucgagacauacauaucaagcugccaccagcgcaguaucaauaccgcagugcgagccacucugucccagaugcuuucugaucugacauugcaacuccgucagagacaggaaaacaccauuaucgagaauccugacguaccacaggauuucgggaaccaaggaagcacgguugaaucccugugugacgauguggucucaguguuaacugugcugugcgagaagcuccaggcugccauuaaugacagucagcaacuucagcuguuguaucuagaguguauccugagcguccucucuuccucaagcaguucuaugcaucugcacaggcgguuuaccgaucuuauauggaaaaaccugugccccgcguugauuguuauccucggcaauccuauucaugacaagacaaucacuuccgcacacaccagcucgacaucuaccucccuggaaucagauagugccagcccagguguguccgaccacgggcgcggaucuggcuguagcugcacggcucccgccuuaucaggcccuguagcaagaacuaucuacuauauugcugccgagcuggugaggcuagucgggaguguggacuccaugaaaccaguucuccagagccuguaccaucgggugcuuuuguauccgcccccucagcaccgcgucgaagcgauaaagaucaugaaagagauucugggaucuccacaacgacucugugaucuggccggucccucaaguacagaaagcgaguccagaaagaggucuaucucgaaacguaagagccaucuugaccuguugaagcucauaauggauggcaugaccgaggcaugcauuaaagggggaaucgaggcuugcuacgccgcuguguccuguguaugcacucuguuaggcgcccuggacgagcuaucacaggguaaggggcucagugaaggacagguucagcugcuuuugcugcggcucgaggaacugaaagauggcgcagaguggucucgcgacagcauggagaucaacgaagccgauuucagauggcaaaggcggguguuauccucagagcacacaccuugggaaagcggcaaugagcgaucucuggacauuuccaucagugucaccacggauaccgggcagacaacucuugagggagaauugggucagaccacaccagaggaccacagcggcaaccauaaaaauucucucaaaucccccgcuauuccggaagggaaggagacucugucaaaggugcuagaaaccgaggcggucgaucagccugacgugguucaacgcagucacacagugcccuacccagacauaaccaacuuucugagcguagauuguagaacuaggucguauggaucccgguacucugagagcaacuucucagucgacgaucaggaccucagucgcacggaauuugauuccugcgaccaguauucuauggcagccgagaaagauagcggcagauccgacgugucagauaucgguagcgacaauuguagucuggcugaugaagaacaaacaccuagggacugccuugggcaucguucuuugcggaccgccgcacuguccuuaaagcuccugaaaaaccaagaagccgaucagcacagcgcucgacuuuucauucagucgcuggagggcuugcuccccagacugcuaucacugucuaauguugaggaaguggacacugcccuccaaaacuuugcaaguaccuucuguuccggaaugaugcauagcccaggcuuugacggaaauucuagccuguccuuccagaugcuuaugaacgcggauucauuguacacagcugcccacugcgcacuguuacucaaucugaaacuuagucacggagacuauuacaggaaacgccccacccuggccccuggugucaugaaggauuuuaugaaacaggugcagacuagcggcguacuaaugguguucucucaggcuuggaucgaggaacucuaucaucagguucuggaccggaacauguugggggaggccggauacuggggcuccccagaagauaauucacugccguuaaucacaaugcucacggacauugauggucuggagaguagcgcaauagggggccagcuuauggcuuccgccgcgaccgagucucccuucgcccagucgagaaggaucgacgauagcacugucgcuggaguggcauuugcccgcuacauucuggugggcuguuggaaaaacuugaucgacacacucucaaccccucugacagggcgaauggcuggauccaguaagggucuagccuucauucugggcgcagaagggaucaaagagcaaaaucagaaggaacgggaugcgauaugcaugucucuugacggacuccguaaagccgcuagacugagcugugccuugggcgucgcagcuaacugcgccuccgcacuggcccagauggcugcggccucaugcguucaggaggagaaggaagagagggaagcacaagagccaucugaugcuaucacucaggugaaguuaaaaguggaacagaagcucgagcaaauugguaaaguacagggggucuggcugcacaccgcccaugugcuuuguauggaggccauccugagcguuggcuuggaaaugggaagucacaaucccgacugcuggccucacguguuucgcgucugugaguaugugggcacgcucgaacauaaccacuucuccgacggggcuagccagccaccccugaccauuucucagccgcaaaaggcaacaggaucagccggccuacugggugauccugagugcgaaggguccccacccgagcauaguccugagcagggacggagccuuucgacugcgcccguugugcagccacucucuauccaggaccugguaagagaaggcuccaggggucgagcuagcgauuuucgcggcgggucauugaugaguggaucuuccgccgcaaaagucguguuaacccugagcacacaagccgaccggcuauucgaggaugcuacugacaagcugaaucuuauggcacugggcggguuuuuguaccagcucaagaaggccucacagagucagcuguuccacagcgugaccgauacggucgacuauucccucgcgaugccuggagaaguuaagucuacacaagauagaaaaagcgcucugcaucuuuuuagguuaggcaacgccaugcugcguauagugcgcuccaaggcacggccccucuugcacguaaugagauguuggucacugguggccccacaccucgucgaggcugccugccauaaagaaaggcacgugucucagaaggcaguuaguuucauucaugacauccugaccgaggugcuuacugauuggaacgagccgccucacuuucauuucaaugaagcucuguuucgacccuucgagcggauuaugcaguuggaacuaugugacgaggacguccaggaucaagugguuacaucgaucggugagcugguggaagucugcagcacccagauacaguccggguggcgcccacucuucucugccuuagagacuguacacggaggcaacaaaucagaaaugaaggaguaccuggugggugacuauagcaugggcaaggggcaagcgcccguuuuugauguguucgaagccuuucuuaauaccgacaacauccaggucuucgcaaaugcugccacauccuacauuaugugucugaugaaauuugugaagggacucggcgagguagauugcaaagagaucggggacugugcuccugcaccaggagcccccaguacggauuugugccugccugcccucgacuaucugagaaggugcucucagcuucuagcuaagauuuacaaaaugccgcugaagccaaucuucuugagcggccgguuagcgggucugccccgaagacuccaggaacaaucagcauccagugaggaugggauagaaagcgugcugucugacuuugaugacgauaccggacuuauugaggucuggaucauccugcucgaacaguugacugccgcuguuuccaacuguccucgccagcaccagccacccacacuggaccuacuguucgagcuccuuagggacgugaccaagacaccuggcccggguuuuggcauuuacgccgugguccaucuguuauugcccgugaugucaguuuggcugcgucggagccacaaagaucauucguauugggacauggcaucugccaauuucaagcacgcuaucgggcucaguugcgagcugguaguggaacacauucaauccuuucuucauagcgauauaagauacgagucaaugaucaacacuaugcugaaagaccucuucgaauugcuggucgcguguguggccaagccaaccgagacgauuuccaggguuggaugcucuuguauccgcuauguguuagucacagcaggcccuguguuuaccgaagagauguggcgacuagcuugcugugcccugcaggaugcauucagcgccacucucaaacccguaaaggaccuucuggggugcuuccacaguggaaccgaguccuuuagcggcgaagguugucaggucagaguggcugccccaucuucaaguccuuccgcggaggcagaauacuggcggauuagggccauggcucagcaaguuuucauguuggauacacagugcagccccaagacuccaaauaacuuugaccaugcccagucuugucaacugaucauagagcucccgccugaugagaaacccaaugggcacaccaagaaaucggugucauuccgcgaaaucgucgugagccugcuuucccaucagguucuccugcagaacuuguaugacauucuguuagaggaauuugugaagggaccaagucccggcgaggagaagacaauccaggucccugaggcuaagcuagcaggcuuccugcguuacauuucuaugcaaaaucucgccgugaucuuugaucuucuguuggacagcuauagaacggcucgggaguucgauaccuccccagggcugaaaugccuccugaagaagguaucaggaauagguggcgccgcaaaccuuuacaggcagagugcgaugucuuuuaauauuuacuuccacgccuuagugugcgcuguucugacuaaccaggaaacaaucaccgccgagcaggucaaaaaggugcucuuugaagacgacgagcgcagcacugauuccucacaacaguguagcucugaagacgaggauaucuucgaggaaacagcacaggugagucccccucgagggaaagagaagagacaguggcgggcuaggaugccguugcugagcguccaaccaguaagcaacgccgacuggguguggcuaguuaaacgccugcacaagcucugcauggaacuuuguaauaacuauauucagaugcaucuggauuuggagaauugcauggaagaacccccuauauucaagggagaccccuuuuucauccugccaucguuucaguccgagucuucaaccccuagcacgggcgguuucagugggaaagaaacucccuccgaggaugacagaucucagagcagggaacacaugggagagucacucucccugaaggcaggcggcggggauuuacuucugccaccuaguccgaaaguggagaagaaagaccccagccggaagaaggaauggugggagaacgccggaaauaaaauuuacaccauggcugcggauaagacaaucucuaaacucaugaccgaauauaagaaacguaagcaacagcauaaccuaucagccuuuccaaaggaggucaaaguggaaaagaaaggugagccucugggcccccgcgggcaggacuccccauugcugcaacgaccucagcaccucauggaccagggacagaugagacacagcuucucugcaggccccgagcuucugaggcaagauaagcggccgcgcagugguucgacuggguccagcuugucaguuucugugagagacgcugaagcccagauucaggccuggacaaauaugguccugaccgugcucaaccagauccaaauauuaccagaucagacauuuacugcacugcagccugcuguauuccccuguaucagccagcuuaccugccaugugacggacauuaggguucggcaagccguccgagaguggcugggaagagugggccgcguguacgauaucauugucuga

SEQ ID NO: 52929 - RNA, 1122 nt, Artificial Sequence
  derived and/or modified sequence opt3 from ARFIP1__Homo_sapiens__NP_001020766
auggcccaggagagccccaagaacuccgcugcagaaaucccugugaccucuaauggcgaggucgacgauucaagagaacacaguuucaacagggaccugaaacauagccucccauccgggcuuggacugucugagacacaaauuacuucgcacgguuuugauaauacgaaggaaggcguuauagaggccggggcguuccagggaucaccggcucccccuuugccaagcgugaugagucccucccggguagccgcaucucgcuuagcccagcagggcagcgaccugaucgugccugcuggugggcaacgaacccagacaaaauccggaccagucauucuagcagaugagaucaagaaccccgccauggaaaaacucgagcuggugcguaaguggucacuuaauacuuacaagugcaccagacagauuaucagugaaaaacugggcaggggcagccggacaguugacuuggagcucgaggcucagauagauauccugcgcgacaacaagaaaaaguaugaaaauauucugaaacucgcccaaaccuuaucuacucagcuguuucagauggugcauacacagagacaacuuggggaugcguucgcagacuugucccugaagucacuagagcuccacgaagaguuuggauacaacgccgauacccagaagcugcuugcuaaaaauggugaaacgcuguugggcgccaucaacuucuuuauugcaagcgucaauacucucgugaacaagaccaucgaggacacacugaugacuguaaaacaguaugagagugcuaggauagaauacgaugccuaucggaccgacuuagaggaacugaaucucgggccucgcgacgcgaacacacuuccaaagauugagcaaucucagcaucuguuccaggcccacaaagaaaaguacgauaaaaugcgaaaugacguuuccgugaaguugaaguuucuagaggagaacaaagucaaggugcugcacaaccagcucgugcuguuccauaaugcaaucgcugccuauuuugcuggaaaccaaaaacagcuugaacagacccugaagcaguuccacauuaaauugaagacgccgggcgucgaugcccccagcuggcucgaggaacaauga

SEQ ID NO: 52930 - RNA, 522 nt, Artificial Sequence
  derived and/or modified sequence opt3 from ARFRP1__Homo_sapiens__NP_001128230
auguacacccugcucagcggccuuuauaaguacauguuccagaaagacgaguauugcauccugauuuugggguuagauaacgccggaaagacaacuuuucuggaacaauccaaaacgagauucaauaagaacuacaaagguaugucucuaucaaagauaaccacaacugugggccucaauaucgggaccgucgacguuggaaaggcuaggcugauguuuugggaucuuggcggucaggaggaacugcagaguuugugggacaaauauuacgcagagugucacggggugauuuauguaaucgauagcacagacgaggaacggcucgccgaguccaagcaggcguucgaaaaaguggucaccucugaggcucugugcggagugcccguucuggugcucgccaacaagcaagaugucgaaacuuguuuaucgauuccugacaucaaaacagcauuuucagauugcaccagcaagauaggccgccgagacugucugacgcaggccugcagugcucuuacuggcuga

SEQ ID NO: 52931 - RNA, 969 nt, Artificial Sequence
  derived and/or modified sequence opt3 from ARG1__Homo_sapiens__NP_000036
augagcgccaaguccagaaccaucggcauuauaggggcucccuucucuaaaggacagccuagggguggcguggaggaagggccaacaguccugcggaaggcaggacuccuugagaaacugaaggaacaagagugcgacguuaaagauuacggcgacuugccguuugccgauauccccaacgacucaccuuuccagauugugaagaauccacgcaguguagguaaggcgagcgaacaguuagcugggaaaguggccgaggucaagaaaaacggacgaaucucccuggugcuaggcggcgaucacucucucgcaauugggucgaucucaggacaugcccguguucaccccgaccugggugugauaugggucgaugcucauacugacaucaauacgccucuuaccacaacuagcggcaaccugcacgggcagccaguguccuuuuugcucaaggagcugaaaggaaagauucccgauguaccuggcuucaguuggguuaccccauguaucucugcaaaggacauuguguauaucggucugagagaugucgacccgggggaacauuacauacucaaaacauuaggaauuaaguauuuuagcaugaccgagguggauaggcugggcaucggcaaagugauggaagagacucuuuccuacuugcuggggcggaagaaacgccccauucaccuaucauucgacgucgacggacucgauccuaguuuuacaccagccaccgguacgcccguugugggcgggcugacuuauagagagggacuuuacaucaccgaagagaucuauaagacaggccuguugagcggucucgacauuauggaaguaaauccuucucuggggaaaacuccagaggaagugaccaggacagucaacaccgcuguggccauaacguuagcgugcuucggccuggcacgggagggaaaucacaagcccaucgauuaccucaacccgccuaaguga

SEQ ID NO: 52932 - RNA, 822 nt, Artificial Sequence
  derived and/or modified sequence opt3 from ARGLU1__Homo_sapiens__NP_060481
augggcagaagcaggucccggucuucaagucgcagcaagcacaccaaauccucuaagcauaacaaaaagcgaucgcguucaagaagcaggagucgggacaaagagcgcgugagaaagagguccaagucucgggaaagcaaacgcaaucgaagaagggagucccggucacguagucgcagcacaaacacugccgucucuagaagggaacgggaucgagagcgcgcuuccucacccccugacagaaucgauauuuucgggaggacgguuagcaagcggaguucucuggacgaaaaacagaagcgcgaggaggaagagaaaaaggcagaauuugagagacaaaggaagauacgucagcaggagaucgaagagaaacucauugaagaggaaaccgcccggcgaguggaggagcuuguagcgaagagaguggaagaggaacuggagaaaaggaaggaugaaaucgagcgcgaggucuugcggagaguggaagaggcuaaaaggauuauggaaaagcaguuacuggaggaacuagagcgccaacgacaggccgagcucgcagcccagaaagcucgggaagaggaagaacgugcaaagagagaggaacuggagaggauccuugaagagaauaaccgcaagauagccgaagcucaggccaaacuggcggaggagcaauugcggaucguugaggagcagagaaagauucacgaagagaggaugaaacucgaacaggagcgacagcgccaacagaaggaggaacagaaaaucauucugggaaaggguaagucccggccaaaacugagcuucucgcucaagacacaagacuga

SEQ ID NO: 52933 - RNA, 2361 nt, Artificial Sequence
  derived and/or modified sequence opt3 from ARHGAP10__Homo_sapiens__NP_078881
augggccugcagccccucgaguucagcgacugcuaccuugauuccccuugguuuagagaaaggauccgggcccacgaggcugaacuggagcgcaccaacaaguucauuaaagaauugauaaaggacgggaaaaauuuaaucgcagccacaaagucucugucaguggcgcaacgaaaauuugcucauagucuacgugauuucaaguuugaguucauuggagacgccgucacugaugacgagagauguaucgaugcaagccucagggaauuuuccaacuuccugaagaaucuugaggaacagcgggagauuauggcccugucuguuacggagaccuugaucaaaccacucgaaaaguuucgcaaagagcagcugggugcugugaaggaagagaaaaagaaguucgacaaagaaacagagaagaacuauucgcugauagauaaacaccucaauuuaucagcaaagaaaaaggacagccaucugcaggaggccgauauccaaguagaacagaacagacagcacuuuuacgagcuuaguuuggaauaugugugcaaacugcaggagauucaagaaaggaagaaguucgaguuugucgagccgaugcuauccuucuuccagggcauguuuacuuucuaccaucaggggcacgaacucgcuaaagacuuuaaucacuauaagauggagcugcagaucaacauucaaaauacccggaaccgcuucgaaggaacacgaucugagguggaggagcuuaugaauaaaaucagacagaaccccaaggaucauaaaagggccagccaguuuaccgcggagggcuaccuguauguucaagaaaagcggccugcaccauucgguuccucaugggugaagcacuacuguauguaccguaaagccgcuaagaaauuuaauaugauacccuucgagcaucgcagugggggaaaguugggcgacggcgaagucuuuuuccucaaagagugcacuaagagacacacagacagcauugauaggcgguuuuguuucgacaucgaggccgcagaucgaccuggggugucucugaccaugcaggcuuuuuccgaagaggaacgcaagcagugguuagaggcccugggagguaaagaagcgcucucacacagcuucaacacggccauuaucccaagacccgagggcaaugcacagcuugacaagaugggguucacuaucauuaggaaaugcauaagugcuguagagacccggggaaucaacgaucaaggccuguaucgcguugugggugucucuuccaaggugcagagauugcuaagcaugcugauggacgugaaaacauguaacgaagucgaucucgaaaauucggccgacugggaaguuaagacuauuaccucugcucugaagcaguaccuuaggucccugccugagccauugaugacauaugaacuccauggggauuuuaucgugccggccaaaucaggaagucccgagagccguguaaacgcaauacacuuccuggugcauaaguuaccugagaaaaauaaggaaaugcuggacauucuagucaaacaccucaccaacguguccaaucauucuaagcagaaccugaugacgguugccaaucuuggcguggucuuuggcccaacuuugaugcggccccaagaggaaacaguggcugcgcugauggaucucaaauuccagaacaucguaguugagauccugauugaaaaucacgagaagaucuuucgaaccccuccagacacuacauuccccgagccgaccugccuuagcgcaucaccucccaacgccccaccuagacagaguaagaggcaggggcaacgcacgaaacggcccguggcugucuacaaucuguguuuggaacucgaggacggagauaacccauaucccuccaaggaagacaccccuacaagcucucuggauucauuaaguagcccauccccggugacuaccgccguccccgguccuccaggccccgacaaaaaucaucugcuagcagaugggggaucuuuuggcgacugggccucgacaauuccuggucagacuagaagcuccauggugcaguggcucaacccacagucacccaccacaaccaguucuaauagcgcuguuacuccgcuguccccugggucaagcccauuccccuuuucuccucccgccacgguggcagauaagccaccugaguccauaaggagucgcaaagcgcgagcuguauaccccugcgaggccgaacacagcucugagcuuuccuucgaaaucggcgcaauuuuugaggacguccaaacaucacgggaaccaggaugguuggagggcacccugaacgggaagcguggacucaucccgcagaacuaugugaagcuguuauga

SEQ ID NO: 52934 - RNA, 2505 nt, Artificial Sequence
  derived and/or modified sequence opt3 from ARHGAP11A__Homo_sapiens__NP_001273408
auggacagcuccaaccuggccgugaucuucgcucccaaucuccuucagaccucugagggccacgaaaagaugucaaguaacacagagaaaaagcugagauugcaagcagccgucguucagacuuuaauugauuacgcgagcgacauagggagggugccugauuuuauccuggagaaaauuccagcuaugcuaggaaucgacggucucugcgccacgccgucccuggaaggcuucgaagagggggaguaugaaacccccggagaguacaagcggaaacgccgacagucuguaggcgauuuugugucgggugcacuuaauaaguucaagccuaaccguacaccaucaauuacuccccaggaagagagaaucgcccaacugagcgagaguccugucauauugaccccaaaugcuaaaaggacacuccccguggacuccucucauggguuuagcuccaagaaacggaagucaaucaaacacaacuucaauuuugaacugcugccuaguaaccucuucaauagcucuagcaccccaguuucagugcauauugauacuagcagugagggaucuucccagagcucguuaucuccgguccugaucggcggcaaccaccuuauuacagcaggggugccccgcagauccaagaggaucgccggaaagaaaguaugucggguugaaucagguaaggcuggcugcuuuaguccuaaaauaagccauaaggagaaagugcgccgauccuugagacugaaguucaaucuagggaaaaacggaagggaagucaauggcuguucuggugugaaccgguaugagagcgugggguggcgucucgccaaucagcagucacugaagaaccgcauugagagugucaagaccggacuucuguuuuccccagacguugaugaaaaauugcccaagaaaggcagcgagaagaucucuaaaucagaagagacgcuccugacuccugaaagauuagugggcaccaacuacaggaugaguuggacagggccaaauaacagcuccuuccaagagguagacgcgaaugaggcaucuucgaugguggaaaaccuggaggucgaaaauagccucgagcccgauauuaugguggaaaaguccccggccacuucaugcgagcuuaccccuaguaaccugaauaacaagcacaauucuaacaucacaagcucccccuugucaggagacgagaauaacaugaccaaagaaacgcuaguuaaggugcagaaggcuuuuagcgagucugguuccaaucugcacgcccucaugaaccagcggcagaguagcgucacuaaugugggcaagguaaaacugacagaaccaucuuaucuugaggauuccccugaggaaaaccuguucgagaccaacgacuugacuaucguugaaucaaaggagaaguacgaacaucacacagggaaaggagagaaguguuucagugagcgagacuuuagcccccuccaaacccagacguucaaucgcgaaaccacaauuaaaugcuauucgacucagaugaagauggagcaugaaaaagauauacacuccaacaugccaaaggacuaccugucuaagcaagaguuuagcucagaugaagagaucaaaaagcagcagagucccaaagacaaguuaaauaacaaacugaaggagaaugaaaacaugauggagggcaaucuaccuaaaugugcagcucacuccaaggaugaagccagaucuagcuucucccagcaaucaaccugcguggucacaaaccucagcaagccaaggccgaugcggauugcgaaacagcagagucuggagacuugugaaaagaccgugucugaguccagccagaugacagagcaucgcaaagucucggaccacauccaaugguuuaauaaacuuucauugaacgaacccaauagaauaaaagugaagucuccucugaaguuccagaggaccccaguucgucagagugugcggcgaauuaacucccuccuggaguacagcagacagcccacuggucauaaacuugccucucugggggauacggcaagcccuuugguaaaguccgucucaugcgacggcgcucucaguagcuguaucgaaucugccuccaaagauucaagugugagcugcaucaaguccggaccaaaagagcaaaagucuaugucgugcgaggaaagcaauauuggcgcuaucucaaaguccaguauggagcugcccucuaaauccuuuuuaaagaugaggaaacacccggacuccguuaacgccucacugcgcucuacaaccguguauaagcagaaaauucuaagcgaugggcaggucaaggugccucucgacgaccugacuaaucaugauauaguaaagccagugguuaacaacaauaugggaaucaguuccgguauuaacaaucggguccuuagaaggcccagcgaacgcggccgagcaugguacaaagggucuccuaagcaccccaucggaaaaacccaguugcugccaacaucaaagccuguggaccucuga

SEQ ID NO: 52935 - RNA, 804 nt, Artificial Sequence
  derived and/or modified sequence opt3 from ARHGAP11B__Homo_sapiens__NP_001034930
augugggaccagagacuggugaagcucgcccuucugcaacacuugagggcuuucuacggcaucaaagucaaggggguucggggacagugcgaucgccgacgucaugagaccgcagccacagaaauugguggcaaaauauuuggggugcccuucaacgcguuaccucacagcgcuguaccagaguauggacauaucccguccuuucugguggacgccuguacuucucuagaggaacacauucauacggaaggccucuucagaaagucagguagugucaucaggcugaaagcacuuaagaauaagguggaucacggggagggaugccugagcuccgcucccccuugugacauugccggcuugcucaaacaguuuuuccgggagcugccagaacccauccugccugcagaucuccacgaggccuuacugaaggcucagcaacuuggcaccgaagagaaaaacaaggccauauugcugcuaucuugccuccuggcggaccauacaguucacgugcuucgcuacuuuuucaauuuucugagaaacgucucguugaggucaagcgagaauaaaauggauaguuccaaccucgcagugaucuucgccccaaaucuguuacagacuucugaagggcaugagaagaugagcuccaacgcugaaaagaaaggaguauaucagacccugucauggaagcgguaccagcccuguuggguucucauggugaguguccuucugcaccacuggaaagccuugaagaaagugaauaugaagcuacuggugaacauucgcgagcgagaagacaaugucuga

SEQ ID NO: 52936 - RNA, 1428 nt, Artificial Sequence
  derived and/or modified sequence opt3 from ARHGAP15__Homo_sapiens__NP_060930
augcagaaaagcaccaacuccgacacaucuguggagacucucaauucaacgagacaaggcaccggggccguccagaugaggaucaaaaacgcuaauagucaccaugaucggcugagccaguccaagucuaugauucuuacagacguuggaaaagugacugaacccauaucgcgccaccgacguaaccauucacagcacauccugaaggauguaauuccuccauuggagcaauuaaugguggaaaaagaggguuaccugcagaaggcaaagaucgccgacggcgggaaaaagcuaagaaagaauuggagcaccaguuggauuguccucuccucuaggcggaucgaguucuauaaggaaagcaaacagcaggcgcuguccaacaugaagacaggacauaagccggagucaguggaucuuugcggcgcucacauagaaugggccaaagagaagaguagccgcaaaaauguuuuucaaaucaccacugugucugguaacgaguuccuguugcaguccgacauugauuuuaucauucucgacugguuccacgcaaucaagaaugccauagauagacugcccaaagacucaagcuguccuaguaggaaccuggaacucuuuaagauucagcggucuuccagcacagaguuacugucgcauuacgauucugacaucaaagaacagaagccagagcaccgcaagucccuuauguuccgauugcaucacucagcuagugauaccagcgacaaaaauagagucaaguccaggcugaaaaaguuuauuacgcggcgucccucucuaaaaacucuccaagaaaaggggcugaucaaggaccagaucuucggaagccaccuucauaaagugugcgagcgcgaaaacucaaccguaccuugguuuguuaagcaguguauugaggcaguggagaaaagaggccuggaugucgacggcauauauagggugagugggaauuuggccacaauccaaaagcuccgguucauugugaaccaggaagagaaacugaauuuagaugacucccagugggaagauauccacgucguuacuggagcucugaagauguuuuuccgagagcucccagaaccccuuuuuccuuacagcuucuucgagcaguuuguggaggccauaaagaaacaagacaacaacacccgcauugaagcgguaaagucucuggugcagaaauugccaccgcccaauagagauacaaugaagguccuauucggucaucugaccaaaaucguggcaaaggccucaaagaaccucaugaguacgcagagccugggcaucguuuuugggccuacucuucugagggcugagaaugaaacaggaaacauggccauucacaugguguaucagaaucaaaucgcagaguugaugcucuccgaauacucuaaaauuuucggcucggaggaggacuga

SEQ ID NO: 52937 - RNA, 1992 nt, Artificial Sequence
  derived and/or modified sequence opt3 from ARHGAP18__Homo_sapiens__NP_277050
augagcuggcuguccucuucacagggcgugguccucaccgccuaccaccccagugggaaggaccaaacaguuggaaacagccaugcuaaagccggugaggaagcaacuuccucuagaagguauggccaguacacgaugaaucaggagucgaccacaaucaaggugauggaaaaaccuccauucgaucggucaauuagccaggacagucuugaugagcuguccauggaagacuauuggauagaguuggagaacaucaagaaaucuagcgaaaauucccaagaggaucaggaaguaguggucgugaaggagccggacgagggggaauuagaggaagaguggcugaaggaagcgggacuaucaaaccucuuuggcgagagugcuggugauccccaggagagcauuguuuuccugucuacucuuacccgcacacaggccgcagccgugcaaaaacgagucgaaaccgugucccagacucugcguaagaaaaauaagcaguaccagaucccugacguaagagauauuuuugcucaacagagggagucaaaagaaacagcaccagggggaaccgagagccagaguuugcggacgaacgaaaauaaguaucaaggccgcgacgaugaggccucuaaccucguuggcgaggaaaagcugauacccccugaggaaacuccagcucccgagaccgacaucaaucuggaaguguccuucgccgagcaggcgcucaaccagaaagagagcucgaaggagaaaauccagaagucuaaaggggaugacgcaacauuaccuuccuuuagacugccaaaggacaaaacuggaaccacaaggauuggugaucuugccccgcaagacaugaagaaggucugccacuuggcucugaucgaacuaaccgcccucuacgaugugcugggcauugaacuuaaacagcagaaggcagugaaaaucaagacgaaagacucagggcuguucuguguccccuugacugcucuccuggagcaggaucaacggaagguuccuggaaugcgcauaccauuaauuuuucagaagcugaucagucgaauugaggaaagaggccucgagacagaaggucuucugaggauccccggggccgcgauccggauuaaaaauuugugccaggagcuagaagccaaguucuaugagggaaccuuuaacugggagagcgugaaacagcaugacgcagcuucccugcucaagcuguucauacgugaacuuccucaaccacuguugucuguagaguaccucaaagccuuucaggcugugcagaaucugcccacuaagaagcagcaauuacaggcccugaaccuacucgucauccugcuuccggaugcaaaucgcgacacauugaaagcccugcucgaauuucugcagagagugauugauaacaaggagaaaaacaagaugaccguuaugaauguggcuauggucauggcgccuaaccuuuucaugugucacgcacugggcuugaaaagcucagaacaaagggaguucgugauggccgcuggcacggccaauaccaugcaucuccugaucaaguaccagaaguuacuguggacaauacccaaauucauuguaaaccagguucggaagcagaauacugagaaccacaaaaaggacaaacgagcaaugaagaaacuacucaagaagauggccuaugaucgcgaaaaauacgagaagcaagacaaaaguaccaaugacgcugaugugccacagggggucaucagagugcaggccccucaccuguccaaggucagcauggcaauccagcuuacagaagaguugaaagcgucugacgugcuggcuagguuucucucacaagaaaguggaguugcccagacucugaagaagggugagguguucuuauaugagauuggcgggaacaucggagaacggugccuggaugacgauaccuacaugaaagaccuuuaucaguugaaucccaacgcagaguggguaauuaagagcaaaccacucuga

SEQ ID NO: 52938 - RNA, 1320 nt, Artificial Sequence
  derived and/or modified sequence opt3 from ARHGAP1__Homo_sapiens__XP_011518397
auggacccccugagcgagcuccaggaugaccuuacccuggaugacacauccgaagccuugaaccaauuaaagcuggcuucuaucgaugagaaaaauuggccuucagacgaaaugccagauuucccgaagagugacgauagcaaauccucuucgcccgagcuagugacucaccucaagugggacgauccuuacuaugacauugcaagacaucagauagucgaaguugccggcgaugacaaauacgggaggaagaucauuguguuuucagcgugccggaugccacccagccaccagcuggaccauaguaaacuucugggauauuugaaacacacgcucgaucaguacguagaguccgacuauacccugcuguaccuccaucacgguuuaacaucugauaacaagccuagccuguccuggcuucgcgacgcuuaucgagaguucgaucguaaauacaagaaaaauaucaaggccuuguacauugugcacccaacuauguuuaucaagacccugcuaauacucuucaaaccccugaucucauuuaaguucggccaaaagaucuuuuaugucaacuaccuuagugaacugagcgagcaugugaaguuggaacagcucgggauuccuagacagguucugaaauaugacgauuucuuaaagucuacacagaaauccccagcaaccgccccgaagcccaugccuccaaggcccccucugccaaaucaacaguuuggagugucacuccagcaccuucaggagaagaaccccgagcaagaaccgauuccuaucguccugcgggagacuguggcuuacuugcaggcacaugcccuaacaaccgaaggcauauuccgcagaagcgcuaauacgcagguaguuagggaggugcaacagaaauauaacaugggucugcccgucgacuuugaucaguacaaugaacuccaucugccagccgugauucuuaagacuuuccugcgggaguugccugagccccuccugaccuuugacuuauauccacacguggucggguuccugaacaucgaugaaagucagcgcguucccgcgacacuacaagugcuccagacucugccugaggaaaauuaccagguacuucgauucuugaccgcauuucuggugcagauuucugcccacuccgaccaaaacaaaaugacaaauaccaaccucgcugucguguucggaccaaaucugcuuugggccaaggacgcagcuaucacgcugaaagccaucaacccgauuaacacuuuuacaaaguucuugcucgaucaccagggcgagcuguuucccagcccugacccaucgggcuuauga

SEQ ID NO: 52939 - RNA, 3507 nt, Artificial Sequence
  derived and/or modified sequence opt3 from ARHGAP20__Homo_sapiens__NP_001245344
augagcgccagagagaggcagcccgcucugaagaaaaagaugaaaacccucgcagaacggcgccgauccgccccuucucuuauccuggacaaggcguugcaaaaacguccaacaacuagagauucaccgagugcuagcguggacacgugcaccuucuuauccucucuggucuguucgaacaggacacuacucauugauggccgggccgagcugaagcgcgggcuucagagacaggaaaggcaccuguuuuuguucaaugaccucuuuguuguggcaaagauaaaauacaacaauaacuucaagaucaaaaauaagauuaaacugacugauauguggaccgccucaugcguagacgaggugggagaagguaacacaaaugcuaugaagucauuuguccugggcuggcccaccgugaacuucguugcaacuuuuaguuccccugagcagaaggauaaauggcucucuuuacugcaacgguauaucaaucuugagaaggaaaaagacuacccaaagagcauucccuugaaaaucuucgccaaggauauagggaacugugcuuauuccaaaacaaucaccgugaugaauagcgacacggccaacgaggucauuaauaugagucugccuaugcuaggaaucacuggcagcgaacgcgauuaccagcucugggugaacucugguaaggaggaggcgccauauccccugauugggcaugaauacccuuauggaaucaagaugucccaccuucgagacucagcacuguugaccccaggcagcaaagauaguacaacuccguuuaaucuccaggagcccuuccugauggaacaguuaccuagagagaugcaaugccaguuuauacugaagccaucuaggcucgccgcugcccagcagcuuuccgacagcggccauaaaaccuucaagcggcgucgcucgauuaucaacugggcauuuuggagagggucuuccacacaccuggacaacuugcccucaaguccuaccagcccaaugcccggacaacuauucgguauuucccugccgaauaucugugaaaacgauaaucucccuaaacccguacuggacaugcuuuucuuucugaaccagaagggcccauugacgaaggggaucuucaggcagucugcuaauguuaaaagcugccgggagcucaaggagaaacugaacucaggaguggaaguccauuuagauugugagaguauuuuugugauagccuccgugcugaaggacuuccuacgaaauaucccuggcagcauuuucucuucagaucucuacgaccacugggucaguguuauggaucaagguaacgacgaagagaaaaucaauacugugcagcgccugcuugaucaguugcccagagcgaacguagugcugcucagguaccuguucgggguccuucacaauauagaacagcauagcuccucuaaccaaaugacagccuuuaaucuggcagugugcguugcuccaucgauuuuguggcccccugccagcuccucaccagagcucgagaacgaauuuaccaagaaggugagucuguuaauccaguuucugaucgagaauugucuacggauuuucggagaagagaucacuucucucuuucgcgaagucagcgugagaugcgacacaagggagaacgcuuccgauauuucauguuuccagcugaacgacagcucuuaugacucccuugagaaugaauugaacgaggauguagacgccccgugcagugaucugguuaaaaagcucggccagggcagccguucuauggacuccgugcugaccuuaucagauuacgaccuggaucaacccgaagucgaggggcuuuugacgcucagugacuuugaucuggcacacagcaaagacgaggaugugcagaugaagcggccucuagaaucgaaaccagucaauauacugguguauaccaagaucccccuccgagaccaugccagagcuccuuccgcgaugugcacaccaucuuaccugagcacugcagccgcuaacgccgcaaagucacuuaggcgccaccggagauguagugagcccuccauugauuauuuggacucuaaacugagcuacuuaagggaguucuaucagaagaaacuccgcaaguccucaugcgacgccauccugagccagaaagaugaagacuaccuuaagcaaaaucagccgcugcaggaagagggaaaaaccuguuucaagcagaguuugguuacagguacugaugugucuaagaaaaacgcuaccacacaaaauaccaagaaaaagucccucagcggcucggaggggaaccacguaaaacuguuuccuaagucaaagccagucgccaucucuguggcaaguuacucccccaugagcucucaggaccauagcaaaaaucagccuuucgauguuaacacuuccggauauucacccccacacacggcggacgcucuaaagggcccucgaacacaucggcguugcagugaacccaauauugaggaucaaaacagaaaacugaccuaccucagggguauauauagcaagaaacagcacaagacuucuugugaagccgggcugcuucauggcgaggaagacuacuugaagcgccacaaaucccugcagauggagggacagaaguuaaucaaucaaucacucgugaugggcauugaggucgggaaaaguagcgcaaccaaccagaauacagaaaaggugcugccaccgcggcuuaaccugugcccuagaaccuccuauucuucgcuaagcucacccggaacuuccccaagugguucuagcguauccucacaggauucugccuuuagccagaucagugagcacuccguguucacacccacggaaaccagcucuccuauugacuguacuuuucaagcucagaggaaacgagaggaucucucaccagacuucuccaacgccagucauguuagcggcaugcccgggccuucgucuggacaggcaugcucccgcccggcuuacacaaagaaggauaccauggaauggcacagccagaugcauucagucacacugcacccaaguacuugguugcggaauggcguggccucucugaaaaacugguccuuaaagaaaaaggcgaaagccgcuagacccgaggaggaaaagaucgcaagcccuaaagguccacucgagcccccuccgcacgccucaggggugcccgaagcuaauagucugcaagaggagcagaaggaccuuccacugagggccgcagaaggcuugagcccuguccaguccgcgcaacguuguucuagcucccccuuucaggacucagagcgccauugcucuaguccauucucgcucguugaaagccggcugaagcuauguaugaaaucccacgaggaaauagagccuggaucucagucaagcuccggcagucugcccugggagagagccucugcuagcucauggacccuugaagaugccacguccccagacagugggccgaccguggugugcgauaucgaggacagguaucucacaaaggauauuuga

SEQ ID NO: 52940 - RNA, 5877 nt, Artificial Sequence
  derived and/or modified sequence opt3 from ARHGAP21__Homo_sapiens__XP_005252599
augauggccaccagaaggacaggccugagcgagggggacggagauaagcucaaagcuugcgaaguguccaagaacaaagacgguaaggagcagucugaaacugucucacuuagugaggaugaaacguucagcuggcccggcccuaaaaccguuacacugaagcggacuucccaaggguuuggauucaccuugcgccacuuuaucguguacccaccggagucugcaauucaguucucguauaaggacgaggaaaauggcaaccgaggugggaaacagcguaauagauuagagcccauggauacaauauuuguaaagcaggugaaagaaggaggcccugccuucgaggcgggccuguguaccggggacaggaucauuaaggucaacggagagucagugaucgguaaaacuuacagccaaguuauugcucuaauccagaauagugauacaacccucgaacuguccgugaugccaaaggacgaggauauacuucagguccugcaguuuacgaaggacgugacugccuuggcauauucucaagaugccuaccucaaaggcaacgaagcuuauagcgggaaugcacggaacauccccgagccuccacccauuugcuacccuuggcugccauccgccccgucagcuauggcccagcccguagaaaucaguccuccagacagcucucuguccaagcagcagaccucaacacccguucucacucaaccuggacgcgcguauagaauggagauucaggugccacccagcccgaccgaugucgcaaaaaguaauacagccgugugugugugcaacgagucugucaggaccguuaucgugccuuccgaaaagguaguggacuuacugagcaaucggaacaaucauacgggccccucgcaccgcacugaggaaguccgauacggugugucugagcagacaucccuuaaaaccguuucaagaacuacaaguccaccuuugagcauacccaccacgcaucugauucaccaaccagcuggguccaggucucuagaacccagcggaauccuccugaagucaggcaacuacaguggccauuccgacgggauuagcucuucacggagucaggccguggaggcaccuagcgucuccgugaaucacuauucuccaaacucgcaccagcauaucgauuggaaaaacuacaagaccuauaaggaguacaucgacaaucgucgccuucacauuggauguagaacaauacaggaaaggcuggauagcuugcgggcugccucccaaucaacuaccgacuauaaccagguaguuccgaaucgaacaacucuccagggucgcagaaggaguaccucucaugaucgggugccccagagcguccaaauccgccagagauccgugucacaggagaggcuggaagacagcgucuuaaugaaauacugcccucguucugcgucccagggcgcccugacaaguccaagcgugucuuucuccaaccaccggacccgaucaugggauuauauugaggggcaagacgaaacucucgagaauguuaacaguggaacgcccaucccugauagcaauggcgagaagaaacagacauacaaguggucggguuuuaccgaacaggacgauagaagggggauaugugagcgcccacggcagcaagaaauucacaaauccuucagaggcucuaacuuuacuguggcacccagcguagucaauucagacaacaggcgcaugaguggacgaggcgugggguccguuucucaguucaagaagaucccgccugaccuuaaaacccugcagagcaaucggaacuuucaaacaaccugcggaauguccuugccacgugguaucucacaggauagaagcccccuagugaaggucaggaguaauucucugaaagcuccuuccacucaugugacaaagcccagcuucucgcagaaaucauucguaucuauuaaggaccagcgcccagugaaccaccuccaucaaaauagucugcuuaaccagcagacguggguucggaccgauuccgccccugaccagcaagucgagacuggcaagagccccucucugagcggggcuuccgccaaaccagcaccgcagucaagugagaacgccggaacaagcgauuuggaacucccugugucucagagaaaucaggaccuguccuuacaagaggcugaaaccgagcagucagauacacuggacaacaaggaagcggugauccuaagggagaaacccccaaguggccgacagacuccccaaccucuccgccaccagagcuacauucuggcagucaaugaucaggagaccgguuccgacacgaccuguuggcuuccaaacgaugcccggagagaaguucauauaaagaggauggaggaacguaaagcuucuucgacaagccccccuggggacucauuggccuccaucccguuuauugaugagccaacuagucccucuaucgaccacgacaucgcacacauuccugccagcgcugugauauccgccucaaccucucaggugccaagcaucgcaacaguacccccuugccugacuaccagugcgccgcucauucgccggcaacugucccaugaucacgaaagcgucggccccccaucucuugacgcucagccuaauucaaagacggagagauccaagaguuaugaugagggacuggacgauuacagggaagacgccaaauugagcuucaagcaugugucgucucucaaaggcaucaagauugcagauucccagaaaagcucagaggacagugggucucgaaaggauuccagcucagaaguuuuuagugacgccgcuaaagagggauggcugcacuuccggcccuuagugacagauaaggguaagcgcgucggcgggagcaucagaccauggaaacagauguaugugguucugaggggacacucccuauaccucuauaaggacaaacgggaacaaaccacuccuucugaggaggaacagcccauaagcgugaacgccugucugaucgauauuuccuacucagagacaaagcgaaaaaauguauuuagacuuaccacuucugacugcgaaugcuuguuccaggcagaggaccgcgaugacaugcuggcuuggaucaagaccauucaggagaguucgaaccucaaugaagaggauacaggcgucacgaacagggaccugaucagccgucggauaaaggaauauaauaacuuaauguccaaagccgagcaacugccaaagaccccgagacagucucuuucaauuaggcagacuuugcucggugcgaaaagcgaaccuaagacacaguccccccauaguccaaaagaggagucugaacgcaagcugcuaagcaaggaugacaccucacccccuaaagauaaggggacauggcgaaaaggcaucccauccauuaugagaaagacuuuugagaaaaagcccaccgccacgggaacauucggcgugcggcuggacgauuguccuccggcucacaccaauagguacaucccacucauaguggacaucugcuguaagcuggucgaagagcgcgggcuugaauacacuggaauuuaucguguucccggcaacaaugcagccaucaguagcaugcaagaggaguugaacaaagguauggcugauauugacauccaggacgauaaguggagagaccugaacgugauaucuuccuuacucaaaucauuuuuccggaagcugccugaaccccuuuuuaccaaugauaaauacgccgacuucauugaggcaaacaggaaggaagauccacuggaccgcuugaaaacacucaagcgacugauccaugaucuaccugagcaccauuaugaaacucugaaguuucucagcgcgcaccugaaaaccguagccgagaauucggagaagaacaaaauggaacccagaaaucuugcuaucguguucgggccaacauugguccggacgucugaggacaacaugacccacauggugacucauaugccugaucaguacaagauuguugaaacacugauccaacaccaugacugguucuuuaccgaggagggagccgaagagccguuaacuacagugcaggaagagaguaccgucgauucccagcccgugccaaauauugaccaccuccugacgaacauaggcaggacugguguuagcccuggcgaugugucagacuccgcaaccucugacagcacaaaaaguaagggguccuggggaagcggcaaggaucaguauucucgcgaacuucuggucucaaguaucuucgcugccgcauccagaaaaaggaagaaacccaaggagaaagcccaaccaagcucuucggaggacgaacuagauaauguauuuuucaagaaggagaacguggaacagugccauaaugacaccaaagaggaaucaaagaaagagagcgagacucucgggcggaagcagaaaauuaucauugcuaaggaaaacuccacacguaaggauccuaguaccacaaaagacgagaagaucucucugggaaaagaaagcacucccuccgaggaaccgucaccaccucacaauaguaagcacaacaaaucucccaccuugagcugucgcuuugcgauacugaaggaguccccacgaucauuacucgcccagaagagcucucaucuggaggaaacgggcuccgauagugguacacuucugagcaccucgucccaagcaucuuuggcuagauucucaaugaaaaagagcacuagucccgagaccaaacacuccgaauuucucgccaauguuucuacaaucacuagcgacuacucaaccacguccagugccacauaucugaccagccuagauucuucaaggcuguccccugaggugcagagcgucgcugagucuaagggggacgaagcagaugacgagcggagugaacuuauuucggagggacgcccgguggaaacugauuccgagagcgaguuccccguauuuccaacagcccucaccucagaaagacuguucaggggcaaauugcaggaggugacuaagucuagccggcgaaacuccgaagguagugagcugucaugcacagaaggcucuuuaaccagcucccucgacaguagacgccagcuguuuagcucccauaaacuuaucgagugugacacgcugucuaggaagaagucagcgcgguucaaaagcgauucgggguccuugggagacgcuaagaacgagaaagaagccccuagucucacuaaggucuuugauguuaugaaaaagggcaagucuaccgggagccugcuaacacccacccguggagagucagaaaaacaagagccuacauggaagacuaaaauugcagacagacugaagcuuaggccacgcgcccccgcugaugacauguucggcguggguaaucacaaagugaacgcagaaaccgccaagcggaaguccauccgaagaaggcacacgcucgggggacaucgcgaugcgacagagauaucuguccugaauuucuggaaagugcacgagcagaguggcgaacgggagagcgaauuguccgcuguuaacagauuaaagccuaaaugcucagcccaggaccugagcauuucugauuggcucgcacgugagaggcugcggacuaguaccuccgaccuuagccgcggugagaucggcgauccacaaacagaaaaucccucaacccgagagaucgccacuaccgacacaccgcugucuuugcauuguaacacgggguccucgagcaguacucuagcuucuaccaauagaccucugcucuccauuccaccccagagcccugaccagauaaacggagaaucauuucagaauguaaguaagaacgccuccagcgcagcuaaugcccaaccacacaaacugucugagacacccggcucaaaggcggaauuccauccgugccuuuga

SEQ ID NO: 52941 - RNA, 2145 nt, Artificial Sequence
  derived and/or modified sequence opt3 from ARHGAP22__Homo_sapiens__NP_001242953
augcugagccccaagaucagacaggccaggcgggcucgcuccaaaucucucgugaugggcgagcaaucacgaaguccugggcguaugccaugcccgcacagacuuggacccguccugaaggcagguugguugaaaaagcagaggagcauuaugaaaaacuggcagcagcggugguucguuuuacgcggcgaccaacuguuuuacuauaaggauaaggacgaaauaaaaccucagggguucaucucccuacagggaacccaggugacagagcucccacccggcccugaagauccagguaagcaucuguuugagauuucucccgggggagccggcgaaagagagaaaguaccugcgaauccagaggcccuucuguugauggcuucgucacaaagggacauggaagauugggugcaggcaauccggcgcgucauuugggccccgcucggcgggggaacugcucgaagaagccacgcacauccccuggagccucugccacccgguaucuucggccagaggcucgaagagacggugcaccaugagcggaaguacgggccucguuuagccccacugcuuguugaacaguguguggacuuuauacgcgagagaggauugaccgaagagggccuguucaggaugcccggucaagcuaaccuaguccgggaucuccaggacaguuuugauugcggggaaaaaccgcuguucgacuccacaacugaugugcacaccguagccucucuucugaaguuguaucuccgagagcugccugagcccguugugccauuugcgcgcuacgaagacuucuuaagcugugcacagcugcucacaaaggaugagggagaaggcacccuugagcuggccaaacaagucuccaauuugccucaggcuaacuauaaucuacugagauacaucugcaaguuucucgacgaagugcaggccuauucaaacgugaauaaaaugaguguccagaaccuggcaacuguuuucggccccaauauucuuaggccacaaguggaggaccccguaacaaucauggaggggaccagccuggugcagcacuugaugacgguccucauucggaagcauucucagcuguuuacugcuccugugccagaaggaccgaccaguccccgcgguggcuuacagugugccguuggguggggaucagaggaagugacaagagauagccaaggcgagccuggugggccaggccugcccgcgcacaggacuuccucucuagacggagccgcagucgcugugcucucccguaccgccccuacaggcccagggagccggugcucgcccggaaagaagguacagacccugccgucuuggaaauccucauuccgacagccuagaagucuuagcgguuccccaaagggcgggggaucuagcuuggaaguucccaucauaucaaguggcgguaacuggcugaugaaugggcucuccagccugaggggccaucgccgggcuucuucaggagauagacuuaaggacaguggcagcgugcagaggcuguccacguacgauaacgucccugcccccggguuggugccagguauuccuucugucgcaucgauggccuggagcggagcuuccucaagugagucuagcgugggcgggucccucucaagcuguacugcgugccgcgcaucugacuccagugcccgaagcucucugcacacagauugggcuuuagagcccuccccacugccgucaaguagcgaagacccuaaaucgcuagaucucgaccacuccauggaugaggccggagcaggcgccucuaauagcgaacccucagagccagacagucccacccgggagcaugcucguagauccgaagcccugcaaggucuuguuacugaguugagggcagaacugugucgccagcggacagaguacgaaagaucugugaagaggaucgaggaggggagcgcggaccuccgaaaacgcaugucccggcuggaagaggaauuagaucaggagaagaaaaaguauauuaugcuggaaaucaaacuuagaaacucagagagggcucgugaggacgccgaacgccggaaucaguugcuccaaagagagauggaagaguucuuuagcacccugggcagucuaacgguaggagcaaaaggcgccagggcuccuaaguga

SEQ ID NO: 52942 - RNA, 4476 nt, Artificial Sequence
  derived and/or modified sequence opt3 from ARHGAP23__Homo_sapiens__NP_001186346
augaacggcguggccuucugccuggucgggauucccccuagaccagagccgaggcccccucagcucccacuuggaccccgggacgguuguagcccucgccgaccauuucccuggcaaggcccucguacccuguuguuauacaaguccccacaggauggguucggauuuacacugagacacuucaucguuuauccgcccgaaucugcugugcauugcucacuaaaagaggaagagaauggcgguaggggcggaggcccuaguccacgguaccgccucgaacccauggacacuauauuuguaaagaacgugaaagaggauggcccugcacacagagccgggcugaggacgggagaccggcuugucaaggugaauggugagagcguuaucggcaaaaccuauucccaggugauugcgcugauccagaacucugaugacacauuggaacucucgauuaugccaaaggaugaggacauccugcaacuggcuuacucacaggaugccuaucucaaggggaaugaacccuacagcggagaggcacgcaguauaccggagccucccccaaucuguuauccucgaaaaacuuacgcucccccagcuagagcauccaccagggccacaaugguccccgaaccuaccucugcuuuaccaagcgacccgcggucccccgccgcguggucagauccuggccugcgugugccacccgcagcccgcgcucaucuugacaacaguagcuuggguaugucucagccuagaccaucccccggggccuucccgcaccugucaagcgagccuaggacuccacgggcauuucccgaaccuggaagucgaguacccccaucucgccuagagugccagcaagcucucucccauuggcugagcaaucagguuccuagaagggccggcgaacggcgcugucccgcgauggccccaagagcaaggucggcuucucaggaucgucuugaggagguggccgcuccgcggccuuggcccugcuccacaucacaggacgcccugagucaauugggccaggaaggguggcaccgagcaagaagcgacgauuaccucuccagggccacccgcucugcugaggcgcugggaccaggugcauuagucagcccccgguucgaaagauguggcugggccucacagaggaguuccgcucgcacgccugccugcccaacucgagaccugcccgggccucaagcaccgccacccagcggacuccagggccuugaugaccuggguuauauuggguaccggucuuauucaccuaguuuucagcguagaaccggcuugcuacacgcccugagcuucagggauuccccauuuggaggccuccccacauucaaccuggcucagucuccugccucguuuccgcccgaggcaagcgaaccaccucgcguggugcggcccgagccauccacuagagcgcuugagccucccgcugaagaccgaggggaugaggucguucugaggcaaaagccaccgaccggacgcaaagugcaguugaccccugcccggcagaugaaucucgguuucggcgacgaaucacccgagccagaagcaagugggagaggagagaggcugggccguaagguagcccccuuagcuacaacggaggauucucuggccagcaucccuuucauugacgaaccaacuucccccucaaucgaucuacaggcaaaacaugugccugcuagcgccgucgugucuuccgcgaugaacagugccccgguucucgguacaagcccaucuucccccaccuuuacuuucacacuggggcgccacuacucacaagacuguaguagcauaaaggcuggccggagaucguccuaucuuuuggcaauuaccacggagaggucuaagagcugcgacgauggacugaauaccuuucgagacgaaggccgggugcuccgcagacugccuaacaggauccccucacuucggaugcugcgaaguuucuuuacagauggguccuuggacucuuggggaacuagcgaggaugccgacgcuccauccaaaagacauucaaccagcgaucucagugacgccacauucucugauauucgcagggaggguuggcuguacuauaagcagaucuuaacuaaaaagggcaaaaaggcaggguccggacugcgucaguggaaacgggucuacgcggcccuaagagcuaggagccucucgcugucaaaggaacgccgagagccuggccccgccgcagcuggugccgcagccgcuggggcgggcgaagacgaggccgcaccaguguguaucggaucuugccuuguagauauuaguuacuccgaaaccaagagacggcacguuuuuagguugacaaccgcugacuucugcgaguaucuguuucaggccgaggaucgcgacgacaugcucggcuggauacgugccaucagagaaaauagccgggcugagggggaagauccuggaugugcaaaccaagcccugauuucuaaaaaguuaaaugacuacaggaaagugagccacuccucaggcccgaaggcggauaguagccccaaagguucucgcgggcugggaggccuuaaguccgaguucuugaagcagucagcugcccgaggucucagaacucaggaccugccagcaggcaguaaagaugacagcgccgcugcaccuaagacgcccugggggaucaacauaauuaaaaagaacaaaaaggccgcgccacgggcuuuuggagucaggcuagaagagugccagccugccacagagaaucaacgcgugccccugaucgucgcagccuguugcagaaucguggaagcuaggggccucgaguccaccgggauuuaucggguuccgggaaacaaugccgugguaucuucgcugcaggaacagcuuaaccguggcccaggugauaucaauuugcaagacgagcgcuggcaggaucugaacgucauuagcucauuacucaaguccuucuuucgaaaacugccugaaccccuuuucacugacgauaaguacaaugacuucauagaggcaaacagaaucgaggaugcuagggaacggaugcgcacccugagaaaauugauuagggaccucccagggcauuauuacgagacacugaaguuucuagugggacaccugaaaaccaucgccgaccauagugaaaagaauaagauggagccccggaaccucgcgcugguuuucggcccuacucuugugcgaacaucugaggauaauaugacggacauggucacccacaugccggauagauauaaaaucguggaaacuuugauucagcauagcgacugguuuuucuccgaugaggaagacaagggugagcgcacacccguaggcgauaaagaaccacaggccgugccuaacauagaguaccuguuacccaauaucgggaggaccguuccuccaggagaccccggcucagauucuacaacuuguagcagugcaaaguccaaagggagcugggcuccuaagaaagagccauacgcccgggaaaugcucgcuauuucuuuuaucucagcagucaaccguaagagaaagaaaaggcgcgaggcccggggacugggcuccaguaccgacgaugacagcgaacaagaggcccacaagcccggugcuggggcgacggcaccgggaacccaggaacgaccucagggcccacuucccggugccguggcuccugaggccccaggcagacugucgcccccggcagccccugaggaaaggcccgcugcggacacacgcucuauuguguccggguauagcacucuaucaaccauggaucggagugucugcucuggagccuccggcagacgugcaggggcuggagacgaggccgaugacgaaaggagcgagcucucacacguugaaacagauacugagggcgcagccggugcugggccaggaggccggcugacccgccgaccuaguuucagcucccaucacuugaugcccugugacacgcuggccagaaggcgguuagcgcgcggcagaccagauggggagggagcagguaggggcgggccccgagccccugaaccaccgggaucugcuagcuccucaucucaggagagucuccggcccccugccgcugcacuggccucgcguccaagcagaauggaagcccuucgccugagguugcggggcacagccgacgauaugcucgcagugagacugcgcaggccccuauccccugagacccgacggagaaggucuucauggcgccgucauacugugguaguccaaagcccacugacagaccuuaauuuuaacgaguggaaagaacucggugggggagggcccccugagccggcgggcgcccgggcucacuccgauaacaaggacagugggcugucuagcuuggaaucaaccaaagccagagcaccauccagugcugccagccagcccccugcacccggagauacugguucucugcagucccagccaccuaggcgcucagccgcuagccgauuacaccaaugccucuga

SEQ ID NO: 52943 - RNA, 1968 nt, Artificial Sequence
  derived and/or modified sequence opt3 from ARHGAP24__Homo_sapiens__NP_112595
augcccgaggacagaaacagcggcgggugcccugccggagcucuggcauccaccccauucaucccgaagacaacuuacaggcggauuaaacgcuguuuuucuuuccgaaaggguauauuuggccagaaacucgaagauacggugcguuaugagaagagauacgggaauaggcuugcccccaugcuggucgaacaaugcguugacuucauccggcagcgcggauugaaagaggaaggcuuauuuagacugccuggucaggcgaaccuagugaaggagcuccaggaugcuuucgacuguggggagaagccaucauuugauaguaauaccgacguacacacaguggccagccugcuuaaacuguauuugagggaacuccccgagccugucauuccauacgcaaaguaugaagauuuccuguccugcgccaaacugcucucuaaggaggaggaagcuggagugaaagaguuagcaaagcaaguuaagucgcugcccguggucaacuacaaucuuuugaaauauaucugucgguuucuggacgaagugcagucauacagcggcguaaacaagaugaguguucagaaucuagccacuguguucggcccuaacauucuccgcccaaaagucgaggauccgcugaccaucauggaagggacaguggugguccagcaacuuauguccguuaugauaucuaagcaugacugccuguuucccaaagaugcugaguugcagagcaagccucaggacggaguguccaauaacaaugagauccagaaaaaggccaccaugggucaacuccagaacaaggaaaauaacaauacuaaagauucaccaagucgacaguguagcugggacaagucugagucaccccaaagauccagcaugaacaacggcaguccuacagcgcugucuggguccaaaaccaauagcccaaagaacucgguacacaaauuagacgugucuaggucacccccgcugauggucaagaagaauccugcauucaacaaaggauccggcauugugacgaaugguaguuuuagcuccucuaacgccgaagggcucgagaagacucagaccacacccaauggaagccuucaggcucggcguucaaguucccugaaaguuagcggcacuaagaugggcacccauucugugcagaacgggacaguccgcaugggaauccuaaauucagauaccuuggguaacccaacgaaugugagaaacaugaguuggcugccuaauggcuacguaacucucagggacaacaaacaaaaggaacaggccggggagcugggacagcacaaucggcuuagcacauaugauaacguucaucagcaauucuccaugaugaaccuggacgauaagcagucuauugacucggcaaccuggagcacuuccucaugcgagaucaguuugcccgaaaauucuaacagcugucgauccucaacaaccacgugcccagagcaggauuucuuuggcgguaauuucgaagaccccgugcucgaugggccuccacaggacgaucugagccacccgcgcgacuacgagucuaaauccgaccacagaagugucggcggaaggagcucucgggcuaccuccucaagugauaacagcgaaacauuugugggcaauucguccucuaaccauagcgccuuacacucacuggucaguucccuaaagcaagagaugacuaaacagaagauagaguaugaaucucgcauuaaaagccucgagcagagaaaucugacccuugaaacagagaugauguccuugcaugacgagcuggaucaggaaaggaagaaguucacuaugaucgagauuaaaaugcguaacgcggaacgggccaaggaggacgcagaaaaacgaaaugauaugcuccaaaaggagauggagcaguuuuucucaaccuuuggggaacugacaguggagcccagaaggaccgaacgcggaaacacuaucuggauccaguga

SEQ ID NO: 52944 - RNA, 1941 nt, Artificial Sequence
  derived and/or modified sequence opt3 from ARHGAP25__Homo_sapiens__NP_001007232
augagccugaagcuccccagaaacugggacuucaaucuuaaaguggaggccgcuaagaucgcaaggucccggucugucaugaccggcgaacagauggccgcguuucacccuucaaguacaccaaacccgcuggagcgccccauuaaaauggggugguugaagaaacaacgaagcauaguuaagaauuggcagcagcguuacuucguguuaagagcucagcaacuguauuacuauaaggaugaagaggacacuaaaccucagggaugcauguaccuaccagguuguacgaucaaggaaauugccaccaaccccgaggaggcaggcaaauuuguauucgaaaucauuccugccuccugggaucagaauaggauggggcaggacucuuaugugcucauggcuucgucacaagcagagauggaagagugggucaaguuucugcggcgcguggccggaacaccaugcggcgcuguuuucggucagagacuugaugagacuguggccuacgaacagaaauuugggccccaucuggucccuaucuugguggagaagugugcggaauuuauacucgagcacggaaggaacgaagagggcaucuuucggcugccaggccaggacaaucugguaaagcaacuccgcgaugcauucgacgccggggagcgaccgagcuuugauagagacaccgauguucauacaguggcuaguuuacugaaacuuuauuugagggaccugcccgaaccugucgugccauggucccaguacgagggauuccuacucugcggucagcugaccaacgccgaugaagcaaaggcucaacaggagcuuaugaaacagcugucuauuuugccccgggacaauuacagccuccuguccuauaucugucguuucuuacacgaaauucagcugaacugcgccgugaauaagaugucagucgacaaccucgcgacuguuaucggcgugaaucuuauacgcaguaaaguagaggauccugccgugauuaugagagggacaccacaaauccagagggucaugaccaugaugauucgggaccaugaggugcuguuccccaagagcaaagauaucccguugucuccucccgcacagaagaacgacccaaagaaagcuccuguugcccgauccucagugggaugggaugcuacggaagaccuacgcaucagcagaacugauaguuucucuuccaugaccagcgacucggauacaacuucucccaccggccagcaaccauccgacgccuuucccgaggauucaaguaaggucccuagggaaaaaccaggugacuggaagaugcagagccggaaacgcacacagacccugccgaauagaaaguguuuccucacguccgcauuucagggggccaacucuagcaagauggagauuuucaaaaacgaauuuuggucacccaguuccgaggcuaaggcgggagagggccacaggcguacuaugagccaagaccugcggcagcuuucugauucacagcgaacaaguaccuacgacaaugugccuagccugccaggcucccccggggaagaggcaucugccuugucgagccaggcuugcgauuccaaaggagacacucucgccucaccuaacagugaaacagguccaggcaagaaaaauucuggggaggaggaaauagauagccugcaaagaaugguacaggaguuaaggaaggaaaucgagacccagaagcaaauguaugaagaacagauuaaaaaccuggagaaggaaaauuacgacguuugggcaaaagugguccgccuaaacgaggaacucgagaaggagaaaaagaaguccgccgcucuggagaucucacuucggaauauggagagaagcagggaagauguggagaaacgcaacaaggccuuggaagaggaagucaaagaguucgugaagucuaugaaagagcccaagacggaagcauga

SEQ ID NO: 52945 - RNA, 2280 nt, Artificial Sequence
  derived and/or modified sequence opt3 from ARHGAP26__Homo_sapiens__NP_001129080
augggccugcccgcccucgaguucagcgacugcugucuugauuccccucacuuuagagaaacccugaagucucaugaggcugaauuggacaaaacaaacaaguucaucaaagaguuaauuaaggaugggaaaucacugauaagugcacuaaagaaucucagcuccgccaagaggaaauuugcggacucucugaacgaguucaaguuucagugcaucggagaugcugaaacugacgaugagauguguauugcccggucgcuucaagaguucgcaacggugcugcgcaauuuggaagacgaacgaauccguaugauugagaacgccucagagguccucaucaccccacuggaaaaauuuagaaaggagcagauaggugcugcaaaagaagccaagaagaaauacgauaaggagacagaaaaauauugcggcauccuggagaagcaccucaauuuaagcaguaaaaagaaagagucccagcugcaggaagcugacucucaaguugaucuugugaggcagcauuucuacgaggugagcuuggaauauguauuuaagguccaggaggugcaggaacggaagauguucgaguuuguugagccgcugcuagccuuccuccaagggcuguuuacuuucuaccaccauggauaugaacuugcgaaagacuucggcgauuuuaagacccagcugacaauuuccauccagaacacccgcaauagauucgaggguacuaggucagaaguggagaguuugaugaaaaagaugaaagaaaacccccucgagcacaagacaauuagcccuuacaccauggagggguaucuguacguccaggaaaagcggcacuuuggaacgucuugggugaaacauuacuguacuuaucaacgcgacuccaagcagaucaccaugguaccauucgaccagaaaucaggcggcaaagggggagaggaugaaagcguuauauuaaagaguugcacacgaagaaagacugacucuauugagaagagguuuuguuucgauguggaggcagucgaccggcccggugugaucaccaugcaagcccuguccgaagaggaucgucgccucuggauggaagcuauggacggcagagagccuguguacaauagcaacaaagauucgcagucugaagggacagcccagcuugacuccauuggauuuucaaucaucaggaagugcauucacgcagucgagacccggggcauaaaugagcagggucuguaucgaaucguuggggugaacagucgcguacaaaaauugcuaagcgugcugauggauccaaagacggcuuccgaaacugagacagacauuugugccgaaugggagaucaaaaccauaacuucugcgcucaagacauaccugagaaugcuucccggaccucugaugauguaucaguuccagaggagcuuuauuaaggccgcaaaauuggaaaaucaggagucacgggucagugagauccauucccucgugcaccgccugccagaaaagaacagacaaauguuacagcugcuaaugaaucaccucgcuaacguugccaacaaucauaaacagaaccugaugaccguggcuaaucuuggcgucguguucggcccgacguugcugaggccccaggaggaaaccguagccgcaaucauggauauuaaguuucaaaacaucguuauugagauacucaucgaaaaucacgagaaaauuuucaacacagugccugacaugccacugacuaaugcccagcuucaucugagccguaagaaaucuucagacaguaagcccccuagcugcuccgagcggccauugacccucuuucacacaguccagucuacugaaaagcaggagcaacgaaacucgaucaucaauagcucccuggaaucagugaguucuaaccccaauagcauuuuaaacuccucaagcucucugcagccgaauaugaacuccagugauccugaccuagcugucgugaaacccaccagaccaaauagccucccucccaacccaucucccacauccccucugucaccaaguuggccgauguucagcgcgcccucguccccuaugccaaccucuagcacuucaagugauuccucucccguuagcacgccuuucaggaaggcaaaagcccuuuacgcuuguaaggccgagcaugacuccgaguugucauuuacagcagggaccguguucgauaacguacacccaagccaggaacccggauggcuggaggguacucucaauggcaaaaccgggcugauaccggaaaacuaugucgaguuuuuauga

SEQ ID NO: 52946 - RNA, 792 nt, Artificial Sequence
  derived and/or modified sequence opt3 from ARHGAP27__Homo_sapiens__NP_777579
auggccgcugacguggucggcgauguuuacgugcugguagagcaccccuucgaauauaccgggaaggacggaagaaggguggcaauccggccuaacgagcgcuaccgacuccuucguagaagcacagaacauugguggcacgucaggcgggagccagguggccgcccguuuuaucugcccgcccaguacgugagagaauugccugcguuagggaauccagcugccgcagcucccccuggaccacaucccuccccugccgcaccagagccgcuggccuaugauuacagguucguuucugcugccgcgacugcaggccccgacggugccccugaggaaucagggggacgggcuaguagccuaugcggcccagcccaacgcggcgcagcuacgcagcgauccucucucgcccccgggcugccugcgugucuuuaucugagaccagccgcacccgugaggccggcucagucguugaacgaucucgccugcgcugccgucucaccucccgcaggacugcuggguagcaguggcuccuuuaaagccuguucuguggcugggagcuggguaugcccacggccucucgcgcguuccgacucagagaauguuuacgaagugauucaggauuuacacgugcccccacccgaggagagugcagaacaagucccuccacgcgcccugggaagaggcgguggguggagggcucgggaccgagcccgcaccgagccgggaagaaaggaaacaaggagcgcacagcggcgcgccagaaggcccccucuuucugaggauuucggcuga

SEQ ID NO: 52947 - RNA, 1713 nt, Artificial Sequence
  derived and/or modified sequence opt3 from ARHGAP28__Homo_sapiens__NP_001010000
augagaaagaaagacaagcagagcaucagggaugugcgggacauuuucggcgucuccgagucucccccucgcgauaccugcgggaaccacacaaaucaacuggacggaacuaaagaggaacgagaacucccacguguuauaaagacgucagguaguaugccggaugacgccagccuuaacuccaccacacugucugaugcuucgcaggacaaagagggcucauuugcagugcccagaagcgauaguguagccaucuuggaaacuauuccuguguuaccaguccauuccaaugggucucccgagccuggacagccagugcagaacgcgaucagcgacgaugacuuccuggagaagaauauucccccugaagcugaggaacuauccuuugagguuucauacagugagauggugaccgaagcccucaagaggaacaaacugaagaaaagcgagaucaagaaagaagauuauguccuuacaaaguucaaugugcaaaagacccgguuuggccugacugaggccggugacuugucugcagaagacaugaaaaagauacgccaccucucccugaucgagcugacagcuuucuuugaugcauucgggauucagcucaaaagaaacaagaccgagaaaguaaagggaagggacaauggcaucuuuggcguuccauuaacggugcugcuugauggggaccggaaaaaggauccgggagucaaggugcccuuggugcugcagaaauucuuugaaaaggucgaggaaucaggucuagagagcgaaggcauuuuccgccucaguggguguacugccaaaguuaagcaguaccgagaggagcuggacgcuaaauuuaacgccgauaaguucaagugggacaaaaugugccauagagaagcggcagugaugcuuaaggccuucuuuagggagcugccuaccucuuuguucccaguagaauauauccccgcuuuuauaucccucauggagcggggaccucacgugaaaguccaauuccaggcccugcauuuaauggugauggcacugccagaugcuaaucgugacgccgcgcaggcccucaugacauuuuucaacaagguuauugcaaaugaaagcaaaaaccgcaugucgcuuuggaauaucucuacugugauggcucccaaccuguuuuucuccagaucaaagcacagugauuacgaggaguugcuacuggccaacaccgcugcccacauuaucaggcucaugcugaaguaucagaaaauccuuuggaaggucccgagcuuucugauuacacaagugcggcgaaugaaugaagcaaccauguugcucaaaaagcagcugccuuccguacgcaaauuacugagaaggaagacgcuagagcgggaaacugccucucccaagacaagcaaaguucuccagaagucaccaagugcucgcagaauguccgacgugccugagggcgucauaagggugcaugcgccccugcuuagcaaagucucuauggcaauccaauugaacaaucagaccaaggccaaagacauucuggcuaaguuccaguacgagaacucacacgguaguagcgaauguaucaaaauacagaaucaacgucucuaugagauugggggaaacaucggcgaacauugccuggauccagacgccuacauccuugauguguaccggauuaauccccaggcagaguggguuaucaagccucagcaguccucuuga

SEQ ID NO: 52948 - RNA, 3306 nt, Artificial Sequence
  derived and/or modified sequence opt3 from ARHGAP30__Homo_sapiens__NP_001020769
augaaaagcagacagaagggcaagaaaaagggguccgccaaagagaggguguucggaugcgaccugcaagaacaccuccagcauucuggucaggaggucccccagguucuuaagucaugugcugaauuuguggaggaauacggcguaguggaugggaucuaucggcugaguggagucagcuccaacauucaaaaguugcgccaggaguucgagucugaacgaaaaccugacuuacguagagauguguaccugcaggacauacacugcguuucgucacuauguaaggcauauuuuagggagcucccagauccgcugcuuaccuaccggcuguaugacaaauucgccgaagcggugggcguccaguuggagcccgagcgccucgugaagauccuggaaguacugagagagcucccuguuccaaauuacaggacauuagaauuucugaugcggcaucuugugcacauggcuagcuucagugcccaaacuaacaugcaugcacgcaauuuggccauugucugggcucccaaccugcuacgauccaaagauaucgaggcaucugguuuuaaugggacggccgcuuucauggaagugagagugcagagcauugucguugaguuuauccucacccacguggaccagcuguucggaggcgccgcgcuuuccggcggggagguagaaucaggauggaggagucugccugguacacgggcaagcggcucuccagaggauuugaugccccguccucucccauaucaccuuccguccauauuacaggccggggacggacccccucaaaugcgcccauaccauacuaucauugaaaucgcugagcacaagagaaagggcucacugaaagugaggaaguggcggagcauuuuuaaccucggucgaagugggcaugaaaccaaacgcaagcugcccagaggagccgaggauagggaggacaaaucuaauaagggcacacugcggccugcaaaauccauggauagcuugucggcugccgcgggcgccucugacgaaccagaggggcuagucggacccuccucaccgcgcccuaguccccugcucccagaaagccuggagaacgacuccaucgaagcagcugagggugagcaggaaccugaggccgaagcucuuggcgggaccaauucugagcccggaacuccaagagccggcaggagcgcaauacgugccggugggucaagucgggcugagcgaugcgcgggcgugcacauuuccgaucccuacaacguuaaucugccuuugcacaucacaagcauucucucugugccaccgaacaucaucucaaaugucagucuggcaagauuaaccaggggacuggaaugucccgcccuacagcaucgcccuagcccagcuuccggccccgggccuggaccaggucucggccccgggccgccugacgagaagcuggaagccucuccagcaucgagcccccuugccgauuccggaccugacgauuuggcucccgcccuggaggacucacucagucaagaagugcaggauucuuucagcuuucuggaggacuccucaagcucugagccagaauggguaggcgcagaggauggugaaguugcgcaggcugaggccgcaggggccgcuuucuccccuggcgaagacgaucccggaaugggcuaucuugaggagcuguugggggugggaccacaggucgaagaguucaguguggaaccgccucucgacgaccugagcuuagaugaggcccaauuuguccuggcacccucuugcuguucccuagacucagcugguccacggcccgaaguggaggaggaaaacggcgaggaaguuuuccucagugccuacgaugaccugagcccucuuuuggggccaaagcccccuauuuggaaaggaucgggcucccuggagggugaggcggccgggugcggcagacaggcucucggacagggcggggaggagcaggcauguugggaagugggagaggauaagcaagccgaaccgggcgguaggcuggacauacgcgaggaggcugaagggucuccagagacgaaaguagaagccggaaaggcaagcgaggaucgaggcgaagcggguggcucacaggagacuaaaguccgguuacgugaggggaguagagaagagaccgaagccaaggaggaaaaguccaaaggacagaagaaagcugacucuauggaggccaagggcguggaggaacccgggggagaugaguauacagacgaaaaagagaaggagaucgaaagggaggaagaugagcagcgcgaagaggcacaaguugaggcuggccgggaccuggaacagggugcccaggaggaucagguggcagaagagaagugggaagucgugcaaaaacaggaggccgaggggguaagagaagacgaggacaagggacagagggaaaaaggcuaccacgaggcucgaaaggaucaaggugacggcgaagauagccgcuccccugaggcggccacugaagggggagcaggcgaagugucaaaagagcgggaaagcggggacggagaggcugagggcgaucagagagccgguggguauuaccuugaagaggacaccuugagugaaggaucuggcguugccucccucgaggucgauugcgcuaaggaagguaauccacauagcucggagauggaggaaguggcaccccagccuccgcagcccgaggaaauggagccagaaggccaaccuucacccgacgggugucugugcccaugcucucuaggacugggcggggugggaaugaggcucgccaguacacugguccagguucagcagguccguuccgugccuguagugcccccaaagccgcaauuugcgaaaaugccuagcgcuauguguucuaagauucacguggcccccgcaaacccaugcccccgcccuggccggcuugaugguaccccaggggagagagccuggggaagcagggcuucccgaucaaguuggcggaacggcggcagcuugucuuucgacgcagccguugcgcuggcucgcgauagacagaggacggaggcccagggggugcggcgaacucagacauguaccgaaggaggugacuauugcuuaauccccagaacuuccccuuguucaaugauaagugcacauagcccgcgcccacucuccugccuggagcuucccucugaaggcgccgaggggucgggaagcaggucacgucuguccuugccuccccgggaaccacaagucccugauccccuccugaguucucagagaaggagcuacgcuuuugagacacaggccaauccaggcaaaggugaggggcuauga

SEQ ID NO: 52949 - RNA, 4335 nt, Artificial Sequence
  derived and/or modified sequence opt3 from ARHGAP31__Homo_sapiens__NP_065805
augaagaacaaaggcgccaagcagaaacugaagagaaaaggggcugcaagcgccuucggaugcgaccucaccgaguaccuugaauccucuggucaagaugugcccuauguccugaagucaugugcggaguuuaucgaaacacacggcauuguugacgggauauacagguugaguggagugacuagcaauauccagcgguuacgccaggaguucggcuccgaucagugcccugaccugacgcgagaaguauaucuacaagauauucauuguguggguucucucugcaagcuguacuuucgugagcuuccaaacccgcuguugaccuaugagcucuacgaaaaauucacagaggcugucucgcacugucccgaagaggggcagcuggccagaauccagaaugugauucaggagcugccuccaucacauuauaggacucucgaauacuuaauccggcaccuggcacauauagccagcuuuaguuccaagaccaacaugcacgcucgcaaucuugcauugguuugggcccccaaccugcuaagaucuaaagagaucgaagcuacaggaugcaauggcgacgccgcguuccucgcagugaggguccaacaggugguaauugaguuuauccugaaccacguugaucagauuuucaauaacggcgccccugggagccuugaaaaugacgagaaccggccaaucaugaagucccugaccuugcccgcucucucacugccuaugaaauuagugagucuggaggaagcccaggcacgcagccucgcuacuaaucauccagcccgaaaggagagaagggaaaacucucuuccggagauagucccaccuaugggaacacuguuucacaccguguuggaacuaccagauaauaagcggaaacuguccucaaagagcaaaaaguggaaaaguauuuucaaccucggucguucuggcuccgacagcaagucgaaacugucucgcaacggguccguguuugucagaggacaaaggcuuucaguugagaaggcgacgauccggcccgccaagaguauggauagccuguguuccgugccuguagagggcaaagaaacuaaggguaauuucaaccgaaccgugacaacugggggauuuuucauuccagcaaccaaaaugcauucuacaggcaccggcagcucaugcgacuugacgaagcaggagggggaauggggacaggaggguaugcccccgggcgcugaagggggauucgaugucaguuccgaccgcagccaccuccaaggcgcccaggcuagaccucccccagagcagcugaaaguguuuaggccuguugaggaccccgaaucugagcagacugccccaaagauguuagguauguucuacacaucaaaugauagucccagcaaguccguguuuaccucuucgcuguuccaaauggaaccuagcccacggaaccagcgcaaagcacuaaauaucuccgagccguuugccgucucagugccccucagaguaagugcuguuaucucuacuaacagcacaccuuguaggaccccacccaaggagcugcagucccuuucaagccuugaagaguucucuuuucacggguccgaaaguggcggauggccugaggaagagaaaccacugggcgcggagacgagcgcagccucugugcccaagaaagcugggcucgaagacgccaaggcagucccggaggccccuggaaccguggaaugcuccaagggucugucacaggagccaggcgcucaucuugaagagaaaaagacacccgagaguagccugucgucccaacacuugaaugaacucgagaaacguccuaaccccgaaaaggucguggaggaagggcgggaggccggagagauggaaucuagcacucugcaggagucaccacgagcaagagcggaagcuguuuuacugcaugagauggaugaggacgaucuagccaaugcacucauuuggccugaaauacagcaggagcugaaaaucauugaaagugaggaggaacuuuccucuuugcccccaccggcccugaagaccagcccuauccaacccauacucgaguccucacugggcccauucauucccagcgaaccuccagguaguuuacccugugggucuuuuccugcuccgguguccacaccacuggagguauggacuagggaccccgccaaccagagcacccagggcgcaucgacagcugccucacgcgaaaagccugagccagaacagggacuucaccccgauuuggcgucucucgccccucuggagaucgucccguucgagaaagcuaguccccaagcaaccguggaaguuggcgggccaggaaaucuauccccuccccugcccccugcucccccaccgccuacuccccucgaggaaagcacgccagugcugcuuucuaaggguggccccgagcgggaagacagcuccagaaaauugaggacagaucuguauaucgaccaguuaaagucacaggauaguccugagauuagcucucucugccaaggggaggaagccaccccacgccauuccgacaaacagaacucaaagaaugccgcaagugagggaaaaggcugcgguuuucccagcccuacucgagaagucgagaucgugucccaggaggaagaggacguaacccacucugugcaggaaccgucggauugugacgaggaugacacaguuaccgauauugcgcaacacgggcuggaaauggucgagccaugggaggaaccccagugggugacuagcccucuucauucacccacacugaaggacgcccacaaggcucaggugcagggcuugcaaggacaucagcucgagaaacggcugucccaccguccaagucuaagacagucucacagccuggauuccaagccuacggucaaaucacaguggacccucgaaguucccucuagcaguuccugcgccaaccuggagacugaaaggaauagcgacccacuucaaccucaggcaccgcgccgggagauaacaggcugggaugagaaggcuuugagaucuuucagggaauuuucagggcugaaaggagccgaggcacccccaaaccagaagggcccuuccggugugcaacccaacccagccgaaaccaguccuaucagcuuagcugaggggaaggaacucggaacacaucugggccacucgucuccccagauucgacaggguggcgugccggggccagaguccagcaaagagucaaguccuucuguacaggacuccacuagccccggagaacauccagcgaaguugcaacugaaaucaaccgagugugggcccccuaagggcaaaaaucgcccgaguagccuaaaccucgaucccgccaucccaaucgcagaccuguucugguucgaaaaugucgcuuccuuuucuagcccuggaaugcaaguguccgagcccggcgauccuaagguuacguggaugaccucaucuuacugcaaggccgacccauggcggguguauagucaggacccccaggauuuggacauugucgcccacgcucugacagguagaaggaacucggcaccugugagcguuuccgccgugcguacuucuuucaugguaaaaaugugucaggcgcgcgcugucccagugauacccccgaagauccaguacacccagauuccucagccauuacccucacaaagcuccggggagaauggagugcagccucucgaacggagucaggagggcccaucuagcacaucagguacuacccagaaacccgccaaggaugacuccccgaguagccuggaaucuuccaaagaggaaaagccuaagcaagaucccggcgcaaucaaaucaagcccagucgacgccacggcuccuugcaugugugaggggcccacacuuucgccagagcccggaucuaguaaccuguuguccacccaggaugcaguugugcagugcagaaagaggaugagcgaaacugagccuucaggcgacaaucuccuguccucuaaacuagaacgaccaagcgggggaaguaagccguuucaucggucccgccccggcagaccucaaagccugauucuuuucucuccacccuuuccuaucauggaucaccucccacccucaaguacaguaaccgacuccaaagugcuguugagcccuauaaggucuccgacucagaccgucucgccaggucuguuauguggggagcucgccgaaaacacaugggugacgcccgagggaguuacccugcggaauaagaugacuaucccuaaaaacggccagcgacuugagacaucaaccagcugcuucuaucagccccaaagacgcuccgugauucuggaugguaggaguggccgucagaucgaauga

SEQ ID NO: 52950 - RNA, 6264 nt, Artificial Sequence
  derived and/or modified sequence opt3 from ARHGAP32__Homo_sapiens__NP_001136157
auggaaaccgaaagcgaguccucuacucugggcgacgauucaguguucuggcucgaaagugaggucaucauucagguuacugacugcgaagaggaggaacgggaggaaaaguuuaggaagaugaagaguuccgugcacucugaggaggaugacuucguacccgaacuucaccggaacgugcacccucgcgagcgaccagauugggaagagacgcugucggccauggcucguggggcagacgucccggaaauacccggagauuugaccuuaaagacuugugguucaacugccagcaugaaggugaagcacguuaagaagcugccuuuuaccaaaggccacuucccaaagauggcggagugcgcucauuuucacuacgagaauguggaauuugggaguauccaacuaucccucucugaggaacagaacgaggucaugaaaaauggaugugaaagcaaggagcugguguaucuuguacagauugccugccagggcaaauccuggaucguuaagagaucauacgaggacuuuagggugcuggauaagcacuugcaucucuguauuuaugaccggcgcuucagucaacugagcgaacugcccagaucugauacacucaaagacuccccugagucagucacccagauguuaauggcauaccugagcaggcuuagugccaucgcugguaacaagauaaauugcgggccagcauugacuuggauggaaaucgauaacaaaggaaaucaucugcuagugcaugaggaaucuuccauuaacacacccgccgugggcgcugcccacgucaucaagcgguauaccgcgcgcgcaccugacgagcucacgcuggagguuggcgacauugugagcguaaucgauaugccaccgaaagugcuuucgacuugguggcgagggaagcacggauuucaggucggucuguuccccggccauuguguggaauugauaaaucagaaaguuccucaaucugugaccaacuccgucccaaagcccgugucaaagaaacacgggaagcucauuacauuucugagaacuuucaugaaaaguaggccuaccaagcagaaauuaaagcagcggggaauccugaaggagcguguauuuggcugcgaccucggugaacaucuucugaauagcggguucgagguuccacagguguugcaauccuguacagccuucauugagcgcuacggaaucgucgauggcaucuauagacuaucuggcguggcuagcaacauucagaggcugcggcacgaauuugacucagagcauguccccgaucucaccaaagaaccguacgugcaggacauacacaguguugggucccugugcaaacuuuacuuccgagagcugccuaaucccuugcucacguaucaacuguacgaaaaauuuagcgaugccgugucugcagcuacugacgaggagcgcuuaaucaagauucacgauguaauccagcagcugccaccuccccauuauagaacacuagaguuccucaugaggcaccugucacuuuuggccgacuacuguaguauaaccaacaugcaugcgaaaaaucuggccauugucugggcaccaaaccuccugcggagcaagcagaucgaguccgcuugcuuuucuggaacugccgcuuucauggaagugcgcauccaaucgguuguggucgaguuuauucuuaaccacguggauguacuguucagcgguagaaucuccauggccaugcaggaaggcgcagccucauugaguaggcccaagucucuccuggugagcuccccuucaacaaaauuacugacccuagaggaggcucaggcgcguacgcaggcacaaguuaauagcccaauugucaccgaaaacaaguauauagaggugggggaaggaccggccgcucuccagggcaaauuucacacaaucauugaguucccccuggaacggaagcgaccucagaauaaaaugaagaagucuccaguggguuccuggaggagcuucuucaaccuugggaaaaguucuuccgucucaaagagaaaauugcagcgcaaugagagugagcccagcgaaaugaaggccauggcacugaaaggcggacgggccgagggcacucucagaucggcuaaguccgaagagucucugaccagcuuacaugccguugacggggacucaaaacuguuuaggccucgccgaccacggaguuccucugaugcacuuagcgcguccuucaacggagagauguuggguaaucguugcaacucauacgacaaucucccccacgauaacgaaagcgaggaagagggcgggcugcuacauaucccggcucugaugaguccucacucugccgaagacguggaucucuccccacccgacaucggaguggcaagccuggauuucgacccuaugucguuucaauguucacccccaaaggccgagucugagugccuugaaaguggcgcuuccuucuuggauagcccugguuauucuaaggacaaacccagcgccaauaagaaagaugcagagacaggguccucacagugucagacuccaggcaguaccgcuagcucugaaccgguauccccucugcaggagaaguuaucacccuuuuucacacucgaccugaguccaaccgaagauaaaagcuccaagcccucuucguuuacugagaaggucguguacgccuucagcccuaaaauuggaagaaaacuuucaaaauccccaaguaugucuauaagcgagcccaucuccguuacgcugccuccgagggugucagaagucauuggcacagugucuaacaccacugcgcaaaaugccagcaguuccaccugggacaagugcguugaggaacgcgacgcuacaaaccggagcccaacccagaucgugaaaaugaagacuaaugagacaguagcacaggaagccuacgagucugagguccaacccuuggaucagguggcugccgaagagguggaacucccugggaaggaggaccagucagucuccaguagccagucgaaagcaguugcgucuggacaaacgcagaccggugccgugacucaugauccaccccaggacuccguaccugugagcucagucagucugauuccgcccccaccucccccaaagaacguggcuagaaugcuagcccuggcacucgcugagucugcccagcaagcauccacacagagccugaaaaggccuggcaccucacaggccggguauacaaacuacggagauaucgcuguugcgacuaccgaagacaaucuuaguagcuccuauucugccguggcauuggauaaggcuuacuuucagacggaccgacccgccgagcaauuccaucugcagaacaaugccccaggcaacugugaucacccguuaccugaaaccacagcuacuggugaccccacccauagcaauacaacugaguccggggaacagcaccaucaagucgaucucaccggcaaccagccacaccaggcauaucugucaggagaccccgagaaagcccgcauaacgucugugccucuugauagugagaagucggacgaccauguuagcuuuccagaagaucaguccggcaaaaauucuaugcccacagugucauuccuggaccaagaucagagcccuccgcgguuuuacuccggggaccagccacccaguuaucuaggagcgucugucgauaaacuccaccacccucuggaguucgcugacaagagccccaccccaccuaacuugcccucagauaaaaucuacccaccuuccggcaguccggaagagaauacuagcacagccaccaugacuuacaugaccacaacgcccgcaaccgcccagaugucuacuaaggaggcuuccugggacguagcagagcaaccaacaaccgccgauuuugcggcugccacacugcagagaacucauaggaccaaccguccuuuacccccaccucccucacagcgcagcgcagagcagccgccagugguuggucaagugcaggccgcuacgaauauugggcucaacaauucgcacaaaguccagggagugguaccugugcccgaacggccacccgagccuagagccauggacgauccggcaucugcuuucaucagugacuccggcgccgcggccgcacagugccccauggcuacagccguccaaccaggucugccugaaaagguuagggacggcgcucgagugccccuucugcauuugcgggcagagagcgugccugcccacccauguggguuccccgccccucucccacccacccgcaugauggaaucaaaaaugauugcugcgauccacuccucuagcgcagaugccacaagcuccagcaacuaucauucuuuugucaccgcuucaaguacauccguggacgaugcccugccgcuaccucugccaguuccccagccuaagcacgcaagccagaagacuguauacucuucguucgccagaccagacgugaccacagagcccuuuggaccggauaauugccuucauuucaacaugacgccuaacugucaauauaggccccagucagucccaccucaccauaauaaacucgagcagcaccagguguacggcgcucggagcgaacccccagcguccauggggcugcgauauaacaccuacguugcccccggaagaaaugcaaguggccaccauucuaagccuugcagccgcguggaguaugucuccucauugaguucuagcgugaggaacacuuguuacccagaagacauaccgcccuacccuacaauucgucggguacaaucccugcacgcuccacccucaagcaugaucagaucugucccuauuuccaggaccgaggugccacccgaugacgagccugccuauugcccgcgcccauuauaccaguauaaacccuaccagaguagccaggcacgaucggauuaucauguuacucaacuccagccuuacuuugaaaaugguagagugcacuaucgguacucccccuacucuucaagcaguuccucuuauuacagcccagacggggcccugugcgaugucgacgcuuauggaacagugcagcuuaggccucugcaccgcuugcccaaccgugauuucgccuuuuacaauccaagacuccagggcaagucacuguauuccuacgcgggucuagcaccgcggccuagggccaacguuaccggcuauuucagucccaaugaccauaacguggucagcaugccacccgcugccgacgugaaacacacguacacuucuugggaucuggaggacauggaaaaguaccgcaugcaaucaauccgaagagagucccgggcuaggcagaagguaaaagggccugugaugagccaguaugauaauaugaccccagcaguucaagacgaucuuggaggcauauacgucauccaucuccgcucuaagagugaccccgggaaaacaggacuguugucgguggccgaaggcaaggaguccagacacgcugccaaagcaauuagcccugagggugaagauagguuuuaucggcgucauccggaggcggaaauggaccgcgcccaccaccaugggggacacggcucaacccagccagagaagcccucuuuaccucagaagcagagcucccugcgaaguagaaaacucccagauauggguuguucacugcccgaacauagggcucaccaagaggccucucaccggcaguucugcgagagcaagaacggcccucccuacccacagggggcaggacagcuugacuauggcuccaaagggaucccggauacaagugaaccugugagcuaccauaauuccggagucaaguaugcugccucuggccaagagucacugcgcuugaaccacaaagaaguaagacuaagcaaggagauggaaaggcccugggugcggcagccaucggcaccugagaagcauucccgagacuguuacaaagaggaagaacaccugacacagaguauuguucccccaccuaagcccgaaagaucucauagccucaaacugcaccacacccagaauguggagcgcgauccgucaguccuuuaccaauaucagccacaugguaagaggcaguccucugugacaguugugagucaguacgacaacuuagaggacuaucacagccugccucaacaucagagaggggucuuuggaggcggcgggaugggaacuuacgugcccccagguuucccccacccucagucccguaccuaugccacggcucucggccaaggggcguucuugccggccgaacugucacuccagcauccagagacacagauccacgcagaauga

SEQ ID NO: 52951 - RNA, 4500 nt, Artificial Sequence
  derived and/or modified sequence opt3 from ARHGAP35__Homo_sapiens__NP_004482
augaugauggccagaaagcaggacgugaggauccccaccuacaacauuagcgucguuggccuguccgggacagagaaagaaaagggacaaugcgguauaggcaaaucuugucucugcaaucgguucgugcgcccuucagcugaugaguuucaccuugaccauacuaguguacugagcacguccgauuucgggggacgaguggucaacaaugaccacuuuuuguauuggggcgaagugucucguucguuagaggauuguguugaaugcaagaugcauaucguggagcagaccgaguucauugacgaucagacauuucagccacacagaucaacugcacugcaaccguacaucaaaagggccgcggcuaccaagcuagccagcgcagaaaagcucauguauuucuguacagaccagcugggucuugagcaggauuuugaacagaaacaaaugcccgacgggaagcuguuggucgauggauuccuccugggcauugacgugagucggggcaugaaccgcaauuuugaugaccagcugaaauucguauccaaccucuacaaucaguuagccaagaccaaaaagccuaucguugugguccugacuaagugcgacgaggggguggagagauauauaagggaugcucauacauuugcacuuucuaaaaagaacuugcagguggucgaaaccagcgcccgguccaauguuaacguggaccuggcuuucucaacgcuaguacaacucaucgauaaaagucgcggaaagacuaaaauuaucccauacuuugaggcccugaagcagcagagccaacagauugcgaccgcaaaagacaaguaugaauggcuugugucucgaaucgucaagaaucacaacgagaauuggcuguccgugucaagaaaaaugcaggccagccccgaauaccaggauuacguuuauuuggaggguacacaaaaggcuaaaaagcucuuccugcagcacauacauagguuaaaacacgagcauauugaacggcgucgcaagcuguaccucgccgcacuuccucuggcuuucgaggccuugaucccaaaccuagacgaaauugaucaccugaguuguaucaaggcgaaaaagcuccuggagacuaaacccgaauuucuuaagugguucgugguccuggaggagaccccuugggacgccacaucucacaucgauaauauggaaaacgagagaauuccauuugacuugauggauaccgugccggcagaacagcucuaugaggcucaucuggaaaaauuaaggaacgagcggaagcgaguagagaugcgcagagccuucaaggaaaaucuggagacgucccccuuuauaacuccuggcaaaccaugggaagaggcuaggagcuucaucaugaacgaggacuuuuaccaguggcuagaagagucgguuuauauggacauuuacgggaagcaccaaaaacagaucauagauaaggccaaagaagaguuccaggaacuccugcuugaguauucugaguuguuuuacgaacuggagcucgacgcaaagcccuccaaggaaaaaaugggagugauucaggauguccugggcgaggaacaacgguucaaggcccuucagaaacugcaggcugagcgcgacgcguugauccucaagcauauccacuuuguguaccauccuacaaaagagaccugcccaucaugucccgcaugcgucgaugccaagauugaacaccugaucaguagcagauucauuaggccguccgaccguaaucagaaaaacucuuuaagcgauccuaauauagaccggaucaaccuggugauucuagguaaggaugggcucgcucgagagcuggccaaugaaaucagagcacuuuguacuaacgacgauaaguauguuaucgacggaaaaauguacgaguugucacugaggcccauugaaggcaaugugcgccucccaguaaacaguuuucaaacaccuaccuuccagccccacggcugccugugcuuauauaauuccaaggagagccugucuuacgucguggagucaauagaaaaaagucgggagagcacgcuugggagaagggauaaccauuugguucaccucccacugacccuaauccuggugaauaagcgcggagacacauccggugaaacucuccauucucugauucagcaaggccagcagaucgccucgaaacuucagugugucuucuuggaccccgcuagcgccgggauuggauauggccgaaacaucaaugagaagcaaauaucccaggugcugaaggguuuacucgauucaaaacggaaccugaaccuuguaaguucuaccgcaagcaucaaggaccuggcggauguggacuugcguauuguuaugugccucauguguggggauccuuuuuccgcugacgauauccuguucccaguccuacagucacagacaugcaaaagcucucacuguggcuccaauaacagugugcugcucgagcugccgauuggacuucacaagaaaagaaucgaauugagcgugcugucuuaccauuccucauuuaguauaaggaagagccgcuuaguccacggcuauauuguuuucuacucggccaagcggaaagcaucccucgccaugcugagagcuuuucuuugcgaggugcaagacaucauucccauccagcugguggcccuaacugauggggcaguagacguccucgauaaugaccugucuagggaacaguugaccgagggagaagagauagcucaggagaucgauggucgauucacaagcauuccuuguucacaaccacagcauaagcuggaaaucuuucaccccuucuuuaaagacgugguugagaagaaaaacauuaucgaagccacccauauguacgacaaugcggccgaggcuugcaguacuacggaagagguguucaacuccccucgcgcaggcucuccauuauguaauagcaaccuccaggauuccgaggaagacauagagcccucauauagccuguuucgggaagauacaagucuuccgucucuguccaaggaccacagcaaguugucgauggagcucgaagggaaugauggacugucauucauuaugucuaacuuugagaguaaacuaaauaacaaggucccuccacccgugaaaccuaagcccccaguucacuucgagaucaccaaaggcgaccuguccuaccuugaucaaggucauagagacgggcagaggaagagcgugucuagcuccccuuggcucccccaggauggcuucgacccaucagauuaugccgaaccgauggacgcuguagucaaaccucguaaugaggaagagaacaucuacagugugccccacgacagcacucagggaaagauuaucaccauucgcaauauaaacaaggcccaaucuaacggcuccgggaauggaucagauagugagauggacacaagcucccuggaacgggguagaaaagugucuaucgucucgaagccaguuuuguauaggacccgaugcacucggcugggccgcuuugcaagcuacagaacaucauucuccguggggagugaugacgaguuaggacccauuaggaaaaaggaagaggaucaggcgucucagggcuauaaaggugacaacgccguaaucccuuacgaaacggaugaggacccacggcgaagaaauauucuccgcagccugaggcguaacaccaagaagcccaaaccuaagccgcggccauccaucacuaaagcuacaugggagucaaauuacuuuggggugccccuuaccacagucgugacuccugaaaagccaauacccaucuucauugagagauguaucgaauauauugaggccaccggccugucuacggaaggaaucuacaggguuagcggcaacaaaagugagauggaguccuugcagcgccaauuugaucaggaccauaaucucgaucuggcagaaaaggacuucaccgugaacacagucgcuggggccaugaagagcuuuuucucugagcuaccugauccgcuggugcccuauaauaugcagauagaccuuguugaagcacacaaaauuaacgaccgagagcagaagcuccaugcccugaaagaaguguugaagaaauuuccaaaggagaaucacgaggucuucaaguacguaaucucacacuuaaacaaagugucccauaauaacaagguuaaucugaugacuagugaaaaccucagcaucugcuuuuggccuacccugaugagacccgauuucucgacaauggacgcucuuacugcgacccggacguaucaaacaauuauagagcuguucauccagcagugcccauuuuucuuuuacaacaggccuauuaccgaacccccaggagcccgcccgucuuccccuagcgcaguggcuucaacuguccccuucuugacaaguaccccagugacuucucagcccuccccuccacaaagccccccuccgaccccacagucacccaugcagccucuacugcccagucaacuccaggccgagcacacacuguga

SEQ ID NO: 52952 - RNA, 2625 nt, Artificial Sequence
  derived and/or modified sequence opt3 from ARHGAP42__Homo_sapiens__NP_689645
augggccugcccacccucgaguucagcgacuccuaccuugauucuccugacuuuagagaaaggcugcagugccacgagaucgaauuggagcggacaaacaaguucauuaaagaauuaauaaaggaugggucacugcuaaucggagcccuccgcaaucugaguauggcugugcaaaaauuuagccagucccuucaggacuuccaguuugaguguauuggugaugcagagacugacgaugaaaucucuauugcccaaucgcugaaggaguucgcgcgauugcucaucgcugucgaagaggagcguagaaggcugauacagaacgccaaugacguucugaucgcaccacucgaaaaauuucggaaggagcagauuggcgccgcuaaggaugggaaaaagaaauucgacaaggaaucagagaaauauuacagcaucuuagaaaagcaucugaaccuuagugcaaagaaaaaggagucccacuugcaggaggccgauacgcaaauugaccgcgaacaucagaauuuuuaugaggcuucucuggaauacguguucaaaauccaggagguacaggaaaagaaaaaguuugaguucguggagccgcuacucagcuuucugcaaggacuuuucaccuucuaucacgaaggcuacgagcuggcccaggaauuugcgcccuauaaacagcaauugcaguucaaccuccagaauacaagaaacaauuuugaguccacuaggcaggaagucgagcggcugaugcaacgcaugaagucagcaaaccaggauuaccgaccuccaagucaguggaccauggaggguuacuuauaugugcaggaaaagagaccccugggguucacauggauaaaacauuacugcaccuaugacaagggaagcaaaacuuuuacaaugucuguuuccgagaugaagucaagcggcaaaaugaauggccucgugaccaguucuccugaaauguucaaacuuaaguccuguauuaggcggaaaacggacagcaucgauaagcguuuuugcuucgacauugaggucguggagcgccacgggaucaucacucugcaagccuuuucggaagcuaacagaaaauuguggcuagaggccauggauggaaaggaaccaauuuacacccugcccgcaauaaucucuaaaaaggaggaaauguaucucaaugaggcugguuucaacuuuguaaggaaguguauucaggccguugagacacggggcaucacuauacuggggcuuuaccgaauuggaggcgugaauagcaaaguccagaagcugaugaacaccacauucucaccuaaaaguccaccggacaucgauaucgacauugaauugugggauaacaagaccaucacgagcggucucaaaaauuaucugcgcugcuuagcggagccccugaugacuuacaagcuacacaaggacuuuauuauagccgugaaauccgaugaccagaacuacagaguggaagcaguccaugcucucguucacaagcugccugagaaaaauagggaaaugcuugauaucuugauuaagcaucuggugaaaguaucucuccacagccaacagaaccugaugacagugucaaaucuuggggucaucuucggaccaacccugaugcgggcccaggaggagacuguggcugccaugaugaacaucaaguuccagaauauuguuguggaaauauugaucgagcacuaugaaaagauuuuucauacagcacccgacccuaguaucccacucccccaaccgcagucccgcagcggcucuagaaggacccgugccauuugucugucaacgggcagucggaagccucgagggagauacacccccugcuuagcugagccagacagcgauuccuauucuucgagcccugacuccacacccaugggaucaaucgaaagucugucuagccacuccucagagcagaacagcacuaccaagucugcguccugucaaccaagggagaaaagugguggcauacccuggaucgcaacaccuuccucuuccaaugggcagaagucacuaggacucuggacuaccaguccagaaagcucgucccgcgaggaugccacaaaaaccgacgcugaaucugauugccagagcgucgccucagugacuuccccgggcgacguaagucccccuauugaucugguuaagaaagagccauacggucuuucuggguugaagcgggcaagcgccuccucacugagaagcaucagugcugccgagggcaacaagucuuauuccggaagcauucagucgcucacgucagugggcucuaaagaaacacccaaggcaaguccuaauccagaccugcccccgaaaauguguaggcgcuuacgacuggauaccgcguccagcaacggguaccaacggccuggaucugucguggcugccaaggcacagcuuuucgagaaugucgguagcccaaaacccguguccucaggccgucaggccaaggcuauguauaguugcaaggccgaacauagccacgaguugucuuuuccucagggggcaaucuucuccaacguuuaccccucaguggaaccaggauggcucaaagcuacuuacgagggcaagaccggucugguaccugagaauuaugucguguuucuauga

SEQ ID NO: 52953 - RNA, 2961 nt, Artificial Sequence
  derived and/or modified sequence opt3 from ARHGAP4__Homo_sapiens__NP_001158213
auggccgcucacggcaagcugagaagggagcgggggcuccaggcagaauacgagacccaagugaaagaaaugcgcuggcagcuuagcgagcagcugcgaugcuuggaauuacagggagagcugcguagagagcuacuccaagaacuggccgaguucaugaggcggcgcgcggaagucgagcuugaguauuccagaggucuggaaaaguuggcugagagguuuucuucacggggcgggcgccucggaaguagccgagaacaucaguccuucagaaaagagcccucucugcugucgccucuccacuguugggccguuuuacugcagcauacaaggcagcaaucacgggaaagcgcagcccuuagugagguguuggcuggcccacuggcacagcgucuaucccacaucgccgaggacguaggucgccucgugaagaaaucuagagaucuggaacagcagcuucaagacgagcuguuggaagucgugagcgagcuccagacugcuaagaagacguaccaggccuaucauauggaauccguuaacgcggaggcaaaacugagggaggccgaacggcaagaggaaaagcgagcugggcgcucagugccgaccacaacugccggagcaaccgaggcuggccccuuaagaaaaaguagccugaagaaaggcgggaggcucgucgaaaagcuguggccuccacagcggcccguggccgcgucuuccugcgccccuguauguuggcugcaggcaggauuuuugguucacccacccugguggggugcuaugugcgccccuucaacacaccagcgccaagcuaaguucauggagcauaaacuaaaguguaccaaagccagaaaugaguaccugcucagccuggcaagugugaacgccgcugucucuaauuauuaccuucacgaugugcuggacuugauggauugcugugacacuggcuuucaucucgcgcugggacagguguuaagguccuauacagcagccgaaagccguacccaggcuucgcagguccaagggcugggcucucuagaggaagccguugaggcacucgauccaccgggugacaaggccaaagugcuggagguacacgcuacgguguucugucccccucuucgguuugauuaccacccacaugacggggaugaagucgccgagauuugcguggaaauggaguugcgagacgaaauacugcccagagcacagaacauccaguccaggcucgaucgccagacuauugagaccgaggaaguuaauaagacacugaaagcgacucuucaagcucuguuggagguggucgccucagacgacggagaugugcucgacaguuuccagaccagcccuuccacagaaucucuuaagagcaccucaagugauccaggcucccggcaggcaggcagaaggcgcgggcagcaacaggagacggaaacuuuuuacuuaacaaagcugcaggaguaucuaagcggacgaucuauccucgccaaacugcaagcuaagcacgagaaacuucaggaagccuugcagcggggugacaaggaggaacaggagguaucauggacccaauacacucagcguaaauuccagaagaguagacagcccaggccgagcucccaauauaaccagcgccuguuuggcggggauauggaaaaguucauucagucuucgggacagccuguuccccucguggucgagagcugcauccgguuuauaaaucugaacggcuuacaacaugaggguaucuucagaguguccggggcacagcugagggucucagaaauucgagacgcuuucgagcgcggcgaagauccacuuguggagggauguacagcccacgacuuggauaguguugcgggcgugcucaaacuguacuuucggucucuagagccuccccuguucccacccgaccucuuuggggaacugcuugccagcuccgaguuggaagcuaccgcagagagaguagaacaugucucaaggcuguuauggcgucucccugccccagugcugguugugcuucgcuaucuguucacguuuuugaaucaccucgcucaguacagcgaugagaacaugauggacccguauaaucuggccgucugcuucggacccacccuacugccugugccagcaggucaagaccccguagcgcuccagggccgggugaaccagcugguucagacacuuaucguccaaccugauagaguguuuccacccuugacuucucugccggggccuguguacgagaagugcauggccccacccuccgcuaguuguuuaggagacgcccagcucgaaagccugggcgcagauaaugagccugaacuugaggcugaaaugcccgcccaggaggacgaucuggagggugucguugaagcaguggccugcuucgcuuacaccgggaggacagcgcaggagcuaucuuuucgacggggcgacgugcuccgccugcacgaaagagccuccucagauugguggaggggagagcauaacggcaugcggggguugauuccacacaaauauaucacucugccugcaggaaccgaaaagcaaguagucggugcuggcuuacagacagccggggagaguggaagcucgcccgagggccuccuggccuccgaacuugugcaucgaccagagccguguaccucuccugaagcuaugggucccagcgggcacagaaggcgcugccugguuccagcaucacccgagcagcacguggaggucgacaaagccguggcgcagaauauggauaguguuuucaaggaauugcucggcaagacuuccgugcgucaaggacugggcccugcuucuacgacaagcccaucccccgggccucggucaccgaaagccccacccagcaguagacuaggaaggaacaagggcuuuucucgcgguccuggggcaccagccucccccagcgcuucgcauccucagggacuggacaccacuccgaaaccccacuga

SEQ ID NO: 52954 - RNA, 4506 nt, Artificial Sequence
  derived and/or modified sequence opt3 from ARHGAP5__Homo_sapiens__NP_001164
augauggccaagaacaaagagcccagaccuccaagcuacaccaucuccauugugggccugucugggacagaaaaggacaaaggaaauugcggugucggcaagucaugucucugcaacagguucguucggaguaaagcugaugaguauuacccggaacacacuagcgugcuuuccacgauagacuuugggggacgcguagugaauaacgaucauuuccuguauuggggcgacaucauucaaaauucugaggauggugucgaauguaagauccacgugauugagcagaccgaguuuaucgacgaucagacauucuugccccaucgaucgacuaacuuacagccuuacauaaagcgugcagccgcgucaaaacugcagagcgcugaaaagcuaauguauaucugcaccgaccaacucgggcuggagcaggauuuugaacagaaacagaugccagagggaaaacuuaauguugacggcuuccuguuguguauugaugugagucaaggcugcaacagaaaauuugacgaucagcucaaguucgucaauaaccuguuugugcagcuguccaagucuaaaaagcccguaaucauugccgcaacaaaaugugacgagugcguugaccacuaccucagggaagugcaggccuucgcuagcaauaagaaaaacuuacuggucguggagaccuccgcacgguuuaaugugaacaucgaaacuuguuucacagcccuuguccaaauguuggauaagacccgcucaaaaccuaagauaauuccauaucuggacgcuuacaagacgcagagacagcuaguugugacugccaccgauaaauuugagaagcucguacaaacagugagggacuaccaugcgacuuggaaaaccgucaguaauaagcugaaaaaccaccccgauuaugaagaguacaucaaccuugaggggacacggaaggcacgcaauaccuucagcaagcacauugaacagcugaaacaggagcauauccgaaagagaagggaagaguauaucaacacguugccucgggccuucaauacucuccugccaaacuuagaagagauugagcaccugaauuggucugaagcucucaaacuuauggagaagcgugccgacuuucagcugugcuucgugguuuuggaaaagacaccgugggaugagaccgaccauauagauaagaucaacgaccgccgcauucccuuugaucuacuguccacucucgaagcagagaagguguaccaaaaucacguccagcaccugaucucagagaaaaggcggguggaaaugaaggagaaauucaagaaaacacuugaaaagauacaguuuauuagcccuggacagccaugggaggagguaauguguuucguuauggaagacgaggcuuauaaguacaucaccgaagccgacaguaaagagguguauggucgacaucaacgcgaaaucgucgagaaggcgaaagaggaauuucaggagaugcuguucgaacacucugaguuguuuuacgaucucgaccugaacgccacgcccuccagcgauaagaugucggaaauucauaccguguuaucugaggagccuagauacaaagcacugcagaagcuagcuccagacagggaaucccuccugcuuaaacacaucggcuucgucuaucaucccacaaaggagacuugcuugucagggcagaauugcaccgauauuaagguggaacaacugcucgccaguagccugcuucagcuggaccacggacgguugcgccucuaccacgauuccacaaacauagacaaaguuaaucuguuuaucuuaggcaaggauggucuggcucaggagcuagccaacgaaauuagaacucagucuaccgacgaugaguaugcacucgacgggaaaaucuacgagcuggaucuuaggccgguggacgccaagagcccuuauuucuugucacaacuguggacagcugcguuuaaaccccauggauguuucugcguauucaauaguaucgaaucccucagcuuuauuggcgaguucauaggcaagauccguaccgaagcaucucagauucggaaggacaaauacauggccaaccugccauuuacuuuaauccuggcuaaucagcgagauucaauuaguaagaaccuuccuaucuugagacaccaagggcagcagcucgccaacaaacugcagugucccuucgucgacgugccagcaggaacguaucccaggaaguuuaaugagacacaaauaaaacaggcccuacgcgguguucuggagagcgugaagcauaaccucgaugucguguccccuaucccagcuaauaaggaccugucugaagccgaucuucggauuguaaugugcgcaauguguggcgacccguucucgguggauuugauccugagccccuuuuuagacucccacucaugcagugcggcucaggccgggcagaacaauucucucaugcuggauaaaauuaucggagagaagagaaggcgcauacaaauuaccauccuuagcuaccacuccucaauuggcguucgaaaagacgaacugguccaugguuacaucuugguguauagcgcaaagcggaaagccucuauggggaugcuccgugcuuuccuguccgaggugcaggauacuauaccuguccagcuaguugccgugaccgacagucaggcagacuuuuucgaaaacgaggcuaucaaggagcugaugacagaaggcgagcacauugccaccgaaaucacugcgaaguuuacagcccucuacagccugucucaauaucauagacagacggagguguucaccuuguuuuucuccgauguacuugaaaagaagaauaugauugagaacucauaccugagugacaauacuagggagagcacacaccagucggaagaugucuucuuaccaucccccagagacuguuuuccuuauaacaauuacccagauucugacgaugacaccgaggcucccccgccuuauagcccaaucggagaugacgugcaacuccugcccacaccuucagaucggaguagauacaggcuugaccuggaaggcaacgaguaccccauacauuccacuccaaauugccacgaucacgaacgaaaccauaaaguuccucccccaauuaagccgaaaccugugguccccaagaccaaugugaaaaagcuagacccaaaccuccugaagacgaucgaggcagggaucgguaaaaacccccgcaagcagaccucucggguuccuuuggcccacccagaggacauggaucccagcgacaauuaugcugaaccuauugauacaaucuucaaacagaagggauacuccgacgagauuuaugugguaccggaugacucacagaacagaauaaaaaucaggaauagcuuugucaacaauacucaaggcgaugaagagaacggguucagugaccguaccucuaagucccauggagagcgccggccaagcaaguacaaauauaagucgaaaacacuguuuucaaaggccaaaucuuacuauagaaggacucacagugaugcauccgacgaugaagcguucaccacgagcaagacaaagcgaaaaggccggcaucgcgguucugaggaagaccccuuacucagcccuguggagaccuggaaagggggcauugauaauccagccaucacuuccgaccaggaacuggacgauaaaaagaugaaaaagaagacacacaaagugaaggaggacaaaaagaaaaagaagaccaaaaacuuuaaucccccuacuagaaggaacugggagucaaauuacuucggaaugccgcuucaggaucuggucaccgcugaaaagcccauuccauuguuuguugagaaauguguggaguucaucgaagacacaggccucugcacggaagggcuguaccggguaaguggaaacaagaccgaucaggacaauauacaaaaacaguuugaucaggaccacaacaucaaucuagugagcauggaggucacugugaacgccguugcuggugcacugaaggccuucuucgcagaucuuccugacccccucauuccauauucucugcauccugaguugcuggaagccgcuaaaauccccgauaagacagagcgauuacacgcgcucaaggaaauugugaaaaaguuucauccagucaacuacgacguguucagauauguuaucacccaccugaaucgcgugucccagcaacacaaaauaaaccuuaugacagccgauaaucugucaauuuguuuuuggccgacuuugaugaggccugacuucgagaaccgugaauuucucaguaccacgaagauccaucagagcgucguagagacauucauccagcagugccaauuuuucuuuuacaauggcgagauuguggaaaccacuaacauaguugcacccccacccccuuccaauccagggcagcugguggagcccauggucccucuacagcugccgccaccccuucaaccucagcucauccagccccagcugcaaaccgacccauugggaauuaucuga

SEQ ID NO: 52955 - RNA, 2385 nt, Artificial Sequence
  derived and/or modified sequence opt3 from ARHGAP6__Homo_sapiens__NP_001274171
augggccaccccguguacagaggggagaagccucagcugcauuaugccggagacuucaccuggaacagcauguccgguaggucuguccggcuccgcucaguuccaauccaaagucuuagcgaacuggagcgagcucguuugcaggaaguggcauuuuaccaguuacagcaagauugcgaccuguccugucagauuacaauaccgaaagauggccagaagcggaaaaagucucuaaggaaaaagcucgacucgcuggggaaggagaaaaauaaggauaaagaguucaucccccaggccuuuggaaugccucuuucacaaguaauugcgaacgaccgggcuuauaagcugaaacaggauuugcagcgcgacgaacagaaggaugccagcgacuucguggcaagucuccugccauuuggcaauaagagacaaaacaaagagcuguccucuagcaauuccucacucaguagcacuucugaaacgcccaacgaguccaccucaccuaauacaccagaacccgccccuagggcucggcgccgaggugcaaugagcgucgauaguaucacugacuuagaugacaaccagucuagacugcuugaggccuugcagcugucccuaccagcugaggcccaaagcaagaaagaaaaggcgagggacaaaaagcucucgcugaauccgauuuacagacaggugccccgucuuguugauucuugcugucagcaccuggagaaacauggguugcagaccgugggaaucuuccgcgucggcuccucaaagaagagagugaggcaacuccgggaagaguuugaccgaggcauagauguaagucuggaagaggagcacagcguucaugacguggcagccuuacugaaagaguuccuccgcgauaugccugacccacuucugacaagagaauuguauaccgcuuuuaucaacacucuacugcucgaacccgaggaacagcuggggacacuucagcuguugauuuaccuccugccuccaugcaauugugauaccuuacacaggcugcuacaguuccucuccaucgucgcccggcacgcagacgauaacauuucuaaggacggacaagaggugacggguaauaaaaugacuagccugaaccuugcuaccaucuuuggccccaauuugcugcauaagcagaaaucaagugauaaggaguucuccgugcagagcucugcccgcgcggaagagucaacagccauaauugcagucguucagaagaugaucgaaaacuaugaggcucucuuuauggugccgccugaccugcaaaacgaaguacuuauuagucuguuggagacugaccccgauguggucgacuaccuccugagaaggaaagccagccaguccucuucgccagauauguuacagagcgagguguccuucucaguugggggacgucacaguucuaccgacagcaauaaggcuuccucaggcgauaucagcccuuacgacaacaauucucccgugcuguccgaacggagucuacucgccaugcaggaggaugcagccccaggugggagcgaaaaacuguaucgaguccccggacaauucaugcuugugggccauuugucuuccucaaagaguagagagagcucgccuggcccaaggcuggggaaagaccucuccgaggaaccguuugauaucuggggaacauggcacucuaccuuaaagagcgguucaaaggaccccggcaugacggggaguuccggagauauuuucgagucuagcucccugcgcgcuggcccuugcucacugagccaggguaaccuuaguccaaauuggccccgguggcaggggucuccugcggaauuggacuccgauacucaaggcgcaagaaggacacaggccgcugccccagcaaccgagggacgcgcccaccccgcuguaagccgagccuguucgacuccgcauguucagguggcaggcaaagcggaacggccuacagcucguucagagcaguaccucacccugucuggggcccacgaccuaagugaguccgaacuggacgucgcaggacuccaaagcagagccacgccacagugccagaggccccaugguucuggccgcgaugacaagcggccucccccaccuuaucccgggccaggaaaaccggcugccgcagcugccuggauacagggcccucccgaggguguggaaaccccaacagaucaagggggccaggcggccgagagagaacagcaggucacucaaaagaaacugagcuccgcuaacucacuucccgcaggagagcaggacaguccuagguugggcgaugccggguggcuggacuggcagcgagagcgcuggcaaaucugggaauuacucagcaccgauaauccagacgcucugcccgagacacuuguguga

SEQ ID NO: 52956 - RNA, 1644 nt, Artificial Sequence
  derived and/or modified sequence opt3 from ARHGAP9__Homo_sapiens__NP_001073625
augagcgagcccccuguguacugcaaccuggucgaccucagaagguguccacgguccccgcccccuggcccagccugcccccuucugcagcgcuuggaugcuugggaacaacacuuagacccuaauucugggcgauguuucuauaucaacucacugaccggaugcaagaguuggaaaccaccccguagaagcagguccgagacaaauccugguucuauggaaggcacucagacgcuaaagcggaacaaugauguucuccagccacaggcaaaaggguuucgcucggacaccggaacaccggagccccuggauccucaaggcucacuuagccugagucagagaacuucccaguuggacccacccgcccuccaggcgccuaggccacugccccaacugcucgaugacccgcaugaaguggagaagucugguuuacugaacaugaccaaaauugcucaagggggacggaaacuucgcaagaauuggggcccuagcuggguaguguugacaggcaacucccuggucuucuaccgagagcccccaccuaccgcccccucaaguggguggggaccagcagguagcagacccgaaucuuccguggaucuaaggggcgccgcucucgcacacgggcggcaucugucaagccgucgcaauguucuucacauaagaacuaucccuggacaugaguuucuguugcagagugaccacgaaacagagcucagggccuggcaccgggcucugcgaaccgugauugagcgcuuagauagagaaaacccacuggagcucaggcuuucuggcuccgguccggccgaacugagcgcgggggaggacgaagaggaggaaucggaguuggucucuaagccccuacugcggcucuccucacgcagaaguagcaucaggggaccugaaggcacggagcagaaucgugugcggaacaagcugaaacgacuuauugcaaagagaccaccccugcaguccuugcaggaaaggggccuccugcgcgaucagguauucgggugucaauuagagucucugugccagcgggagggagacacuguuccuagcuuucuaagacucuguaucgccgcuguggacaaaaggggucuggaugucgacggcauauaucgcgugucagggaaucuugccgugguccagaaguugcgauuccugguugaucgggaacgugcagugaccagugacggaagauacguauuuccagagcagcccggccaagaagguaggcucgaucuggacuccacagagugggaugacauccauguggucacuggggcucuuaagcuguucuugcgcgaacucccgcagccucuggugccacccuuacugcuaccucacuuucgggccgcgcucgcccugagcgagucugagcagugccuuucacagauucaagaauugaucggcaguaugcccaaaccaaaccaugauacccugagauaucuccuggagcacuuauguaggguuauugcacacagcgacaagaaucgaaugacaccucauaaccugggaaucguguucggccccacccuuuuucgcccagaacaggagacguccgauccggcugcccacgcuuuguacccugggcagcucguccagcugaugcuaacuaacuucacaucucuguuucccuga

SEQ ID NO: 52957 - RNA, 1014 nt, Artificial Sequence
  derived and/or modified sequence opt3 from ARHGDIA__Homo_sapiens__NP_001288171
auggccgagcaggaacccaccgcugagcaacuggcacagaucgccgcggaaaacgaggaagacgagcacagcgugaauuacaagccuccagcucagaaauccauucaggagauacaagaacucgauaaggacgaugagucucuuagaaaauauaaggaagcccuguugggcagggucgcaguuucagccgacccgaacgugcccaauguaguggucacaggguuaacucuggugugcaguagcgcuccuggaccacuagagcucgaucugacgggugaccuugaguccuucaaaaagcagucuuuuguucugaaggaaggcguggaguaccggaucaaaauuucguuccgcgucaaccgagaaaucgugucagggaugaaguauauucagcauaccuaccguaaaggaguaaagaucgauaaaacagacuauaugacuaccacaagacccaccacuuguccuggcagcgguauaaguccauccaggcggacagggcgcaccgagcccucucagagaagggcaggacaaacggauggccggacuaccgaccgccgaaugugcccuccacagccguugcccagcccuuaccaguccgccgauagaccaucaguuccccucccuccauggagugcuagccuggccuggcugaauagggugcccccgacaccucucuuaucucccccaccucccacuggcccagcguccucagucagcugucugguggcagccagugcuugcgccgugggggaacggggacguucucaggcauccgcugcccuuagcguucccccucgcuuuuauuugccagucaccccggaggcguggcugcaagagggugccgaacagcccuucucgagaccuaggggcuguccauggacaugcgcaucugcugcccccgggugguccuggggagugggcuguaccgcuucaugggguccugggcggccacccgccccgcuacucccuggacagccacccugccgaugucgcaguagacugacgaugaugccuuga

SEQ ID NO: 52958 - RNA, 606 nt, Artificial Sequence
  derived and/or modified sequence opt3 from ARHGDIB__Homo_sapiens__XP_011518968
augaccgagaaggcccccgaaccucacguggaggaagacgaugacgaugagcuggacagcaaacucaacuacaagccaccgccccagaaaucccuuaaggaacugcaagagauggauaaagacgaugagucuuugaucaaguauaagaaaacauuacugggcgacgggccugucguuacugauccaaaggcucccaaugugguagugacgagacuaacccucgucugcgaaucagcaccuggaccaauuacaauggaccugacuggugaucuugaggcccugaaaaaggaaaccauaguguugaaagagggcagugaguacaggguuaagauccauuucaaggugaaccgggacauugucagcgggcucaaauaugugcagcacacauaccgcaccggaguaaagguugauaaagcgacuuuuauggugggcuccuaugguccccgaccugaagaguacgaauuucugacaccagucgaggaagcuccgaaggggaugcuggcccguggaaccuaucauaauaaaucuuucuucacggacgacgauaagcaggaccaccucucgugggaguggaacuuaucaaucaaaaaggaguggacugaauga

SEQ ID NO: 52959 - RNA, 4035 nt, Artificial Sequence
  derived and/or modified sequence opt3 from ARHGEF10__Homo_sapiens__NP_055444
auggaccagagagagccccugccuccagccccggcugaaaacgagaugaaguacgauaccaauaacaaugaagaggaagagggcgagcaauucgacuuugauagcggggacgaaauccccgaggcagauaggcaggccccuuccgcgccagaaacaggaggugcuggcgccucugaggcacccgccccuacugggggagaggacggcgcuggugcagaaacgaccccaguggccgagcccacaaaacucguccuuccuaugaagguuaacccauauucagugauugauauaacuccguuccaggaagaccagcccccuaccccaguacccagugcugaggaagagaauguggggcugcacgucccuugcggauacuuggugccaguucccuguggcuaugccgugccgagcaacuuaccucugcuacuccccgcguacuccucuccagucaucauuugcgcaacaucgcuggaugaggaagagaccccugaagugacugaggaccggcaacccaauucacuuagcagugaagaaccacccacauccgaggaucagguaggccgcgaagacucugcccuggcucgaugggccgcagauccugcuaacaccgccuggauggagaauccagaagaggcgaucuaugacgacguuccgcgugaaaacagcgauuccgagcccgacgagaugauuuacgaugacguggaaaauggggaugagggagguaacucaaguuuggaauauggcuggaguucuuccgaguuugagucauacgaggagcagagcgacagugaauguaaaaaugggaucccuagaucuuuccucagguccaaccauaagaaacagcugagccacgaucugacgcggcucaaggagcauuacgaaaagaaaaugcgcgacuuaauggccucgacugucggagugguggagauacaacagcugagacagaagcacgagcuuaaaaugcagaaguuggucaaagcagcuaaggauggcaccaaggacggucuggaaaggacacgggccgcuguuaaacgcgggcgaucuuuuaucagaacuaagucccuaauugcccaagaucauaggucaagucucgaggaggaacagaaucuguucaucgacguggacugcaaacacccagaagcaauucuuacccccaugccugagggacugagccagcaacagguagugcggcguuauaucuugggcuccgucguggauucugagaagaacuacguugacgcccucaaacgcauacuggaacaguaugagaagccauuaagcgaaauggagcccaaagugcugucagaaagaaagcucaagacagucuuuuacagggugaaagagauucuucagugucacagucuguuccaaaucgcuuuggcgucccggguaagcgagugggauucuguugaaaugauuggcgacguguuugucgcaucauucaguaagagcauggugcuagaugccuauuccgaguacgucaacaauuuuucuaccgcuguggccguucugaaaaagacgugcgcaacuaaaccggccuuccucgaauuucugaagcaggagcaggaggcuucgccugaccgaacaacccuuuauagccugaugaugaagccaauccagcgcuucccccaauucaucuugcuccugcaggauaugcugaaaaacacuuccaaggggcauccugacagauuaccccuacagauggcccucacagaacuggagacccuugcagaaaaauugaaugagaggaagcgggaugcggaccagcgcugugaagugaaacaaauugcuaaggccauaaacgagagauaccugaauaagcuccugucaaguggaucuagguaccuuauccguagcgaugacaugauugagacgguauauaacgaucggggugaaaucgucaaaaccaaggagcgaagaguguuuaugcugaaugacguuuugaugugcgcaacaguguccucaaggccaagccacgacucucgcgucauguccagucagcgguaccuccugaaauggagcgugccuuuaggccauguagaugccauagaauaugggucuuccgcuggaacuggcgagcacucaagacaccuggccgugcaucccccagaaagucuagcaguugucgcuaacgccaagccgaauaaaguguacauggguccugggcagcucuaucaggaccugcaaaaccuuuugcacgaucugaaugugauuggccagaucacccagcucaucggaaaccugaagggcaauuaccaaaacuuaaaucagagcgucgcgcaugacuggacaucggggcugcagaggcuuauuuugaagaaagaggaugagauccgcgccgcugacuguugccggauucagcuccaacugcccggaaagcaggauaaauccggucgaccaacuuucuuuaccgcaguuuucaacacauuuacccccgccauaaaggaaucuugggugaacagccuacagauggcuaaacuggcccucgaggaagagaaucacaugggcugguucuguguggaagacgaugggaaccauaucaagaaagagaagcacccucugcuuguaggacacaugccagucaugguggcaaagcagcaagaguuuaaaauugaaugcgcggccuauaaucccgagccuuacuugaacaaugaaucacagccggacaguuucuccacugcucauggcuuucuguggaucgguucuugcacgcaccagauggggcagaucgccauuguuagcuuccaaaacuccacaccaaaggugauagaguguuuuaaugucgagucacguaucuuaugcaugcucuacgugcccguugaagagaaaagaagggaaccuggcgcaccacccgauccugagaccccggcugugcgcgccagcgacguacccacuauuugugucggaaccgaagagggcaguaucucuauuuauaaguccagccaggggucgaaaaaggugcggcugcagcauuucuuuacaccagagaagucaaccgugaugucucuugcaugcacuagccaaucccuguacgccggauuggucaacggugcuguugcgagcuaugccagagcaccugauggcucuugggacagcgaaccccagaaagugaucaagcucgggguacugccagugaggucccuacugaugauggaggacacacucugggcugccucaggaggccaggucuucauaaucaguguggaaacgcacgccguugagggucagcuggaagcucaccaagaggaggggauggugauuagccauauggcagucucuggcgugggaaucuggauugccuucaccuccggcucaacucuucgauuguuucacacagaaacccugaaacauuuacaggauaucaauauagcgacaccuguucacaacaugcuccccgggcaucagcgccugagugugacuagccuucuggucugucacggacuacucaugguaggcaccucccuggguguguugguugcucugccagugccgcgguuacaggggauuccuaaggucacgggaagaggcauggugucuuaccacgcccauaauucgcccguaaaauucaucgugcucgcaaccgcccugcacgagaaggacaaggauaaaagcagggacucacuugcuccaggucccgaaccucaagaugaggaccagaaggaugcacugccauccggcggggccggaaguucuuugagccagggcgaccccgaugcggcuauuuggcucggggacucccugggaucaaugacacagaaaucugaucuaagcaguuccagcggcucucugucacuuucccaugguaguagcucgcucgaacaccguucugaggacuccacuaucuaugaccuguugaaggauccugucagccugcgcucaaaagcccggagagcaaagaaggccaaagcuaguucugccuuaguugugugcgggggacaaggccauaggcgagugcaccggaaggcacgccagccgcaccaggaggaacucgcuccaaccgucaugguguggcagauaccccugcuuaacaucuga

SEQ ID NO: 52960 - RNA, 3726 nt, Artificial Sequence
  derived and/or modified sequence opt3 from ARHGEF10L__Homo_sapiens__XP_011539993
auggccagcuccaaucccccuccacagccggcuaucggcgaccaacuggugcccggggucccuggaccaucuucagaggcagaagaugaccccggugaggccuucgaauuugaugacagugaugacgaggaagauaccagcgcggcucucggcguuccuucccuugccccagagagagacacagaucccccucugauucacuuggacucuauaccagugacugauccggaccccgcagccgcuccuccagggacgggaguacccgcaugggugucgaacggcgaugccgcugacgccgcguucucaggugcaaggcauagcaguuggaagcggaaauccucucgccgaaucgaccguuuuaccuucccugccuuagaggaagaugucauuuacgacgaugugccaugcgagagccccgacgcucaccagccggccggggcagaaagaaaccugcuauaugaggaugcucauagggccggagcgccucggcaggccgaggaccucggcugguccucaagugaauuugagagcuacucugaagauuccggcgaggaagcaaagcccgagguugagguggaaccagcuaaacaccgcgucucauuccagccuaagaugacacaacugaugaaagccgcuaagagcgggacuaaggacggacuugagaaaaccagaauggccgugaugaggaagguaaguuuucugcaucggaaagauguuuugggugacucugaagaggaagauaugggccuccuggagguguccgucagcgacaucaagcccccagcacccgagcuggggccuaugccagaaggacucucgccgcaacagguggugcgccgacacauuuuaggcucuaucguccaguccgaggguucauauguugaaagucugaaaagaauacuucaggacuacaggaaucccuugauggagauggaaccuaaggcccugagcgcucggaagugucaggugguauucuuucgugugaaagagauccuacacugccauuccauguuccagauugcgcucucuagccgcgucgcagagugggauucaacagaaaagaucggggaccuguuuguggccaguuucuccaaaagcaugguucuugauguguauucugacuacgucaacaauuuuaccucagcuaugaguauuaucaagaaagccugucugacuaagccagcauucuuggaguuccucaaaagacgccaggugugcagccccgaucggguaacacuguauggauuaaugguuaagccuauacaacgauuuccacaguucauucugcuccuucaggacaugcugaagaacacccccaggggccacccggauagauugucccuacaacuggcccucacggaacuggagacucuugcugagaaacugaaugaacagaagagguuggccgaccagguggcagagauccagcaacucaccaaaucugucucggaucggagcucccugaacaaguuacugacaucaggccagcgccagcuacuccugugugaaacucuuaccgagacaguguacggggacagaggacaguugauuaaaaguaaggaaaggcgugucuuucugcucaaugauaugcuggugugcgcgaacaucaauuucaagccugcuaaccaucggggucaacuugagaucucuagccugguuccauugggccccaaauacgugguaaaguggaauaccgcccucccucagguccaggugguugagguggggcaggacggaggcacguaugauaaagacaacguccugauucaacacuccggugcaaagaaagccucagcuagcgggcaggcccagaauaagguguacuuaggacccccacgacuguuucaggaacuacaagaccuccagaaggaucuggcaguaguggagcagauaacucuuuugaucucuacacugcacggcaccuaucaaaaccucaacaugacuguugcucaggacuggugucuggccuuacagagacugaugagggucaaagaagaggaaauucauuccgcgaauaagugccgccuucgguugcuccugccuggcaaacccgauaagagugggagaccaaucagcuucauggugguguuuauaacaccgaacccucuaucuaaaauuuccugggucaauaggcugcaccucgccaagaucggacugcgcgaggagaaccagcccgguuggcuuuguccagacgaagauaagaaaucaaaggcucccuucuggugcccuaucuuggcauguugcauuccagccuuuaguagccgagcucugucguuacaacucggcgcccugguucauucccccgugaauugcccucuucugggguucucugcagugagcaccucauugccgcagggauaccucuggguaggcggugggcaggagggcgcgggaggccaggucgaaaucuuuagucugaaccggccaaguccccguacggugaaaucuuucccucuagccgcuccaguucuguguauggaguauauucccgaacucgaggaggaagccgagagcagagacgaauccccuaccguggcagauccgucagcuacaguccaccccacuauaugccuggggcuucaagacggaagcaucuugcuguacaguucuguggauaccgguacacaguguuuaguuuccugcaggagcccaggccuccagccugugcugugucuucgccauucgcccuuucaucugcuagccgggcuccaggacggaacucuggcagccuauccacggaccucaggcgguguauugugggaucuggagucuccucccgucugcuuaacaguggggccaggcccggugagaacccuccugagucuugaggacgcugucugggcguccuguggaccuaggguuacugugcuggaagccacgacauugcaaccccagcagagcuucgaggcacaccaagaugaagcuguaucugugacccacauggucaaggccggcagcgggguguggauggccuucuccucaggaacuuccauucgacucuuucacaccgagacacuggaacaucuacaggagaucaauaucgcuacccgcacuacauuccugcuuccaggccagaaacaccucugcguuacgagccuguugauuugucagggucuguuauggguggggaccgaccaaggagucauagugcuccugcccguuccucggcuugagggcaucccaaagauuacugguaaaggcauggugucucugaacgggcacugcggacccgucgcauuuuuggccguagcgacauccauccucgcuccugacauucugagaucagaucaggaagaggccgaaggcccgagggcagaggaagacaagccagaugggcaggcccaugagcccaugccugacagucacgugggacgugagcuaacccgcaagaaaggcauccugcuucaguaccggcucagaagcacagcucaucugcccgguccauuguuauccaugagggaaccugcacccgccgauggggcggcucuggagcacucugaagaggacggaucgauauacgaaauggccgaugacccagauaucuggguucgaagccggccuugugcacgcgacgcccauagaaaggagauuugcucaguggcuaucauuuccggcggucaaggcuauaggaauuucgggagugcccucggaucuagcggccggcaggcaccgugcggggagacugauuccacccugcuuaucuggcaggucccccugauguuguga

SEQ ID NO: 52961 - RNA, 4569 nt, Artificial Sequence
  derived and/or modified sequence opt3 from ARHGEF11__Homo_sapiens__NP_055599
augagcgugagacugccccaguccaucgacaggcucucuucacuuaguagccugggcgauuccgccccugagcggaagucuccaucgcaccaucgccaaccgucagacgcuagcgaaaccacaggguugguccagcgaugcguuauuauacagaaagaucagcacggauucgguuuuacugugaguggcgaccguaucguauuagugcaauccgucagacccgggggagcagccaugaaggcgggcgugaaagagggugauaggauuaucaagguuaacgggacgauggugaccaauucuagccaucuggaagucgugaaacuaauuaaguccggagcuuacguagcccucacacugcuuggcucaaguccuagcucuaugggcaucuccgggcugcagcaggacccaucacccgcaggagccccucggauaacuagcguuaucccaagucccccuccaccgcccccuuugccacccccucagcgcauuaccgguccaaagccccuccaagauccggaggugcagaaacacgcuacacagauccugagaaacaugcugaggcaggaagagaaggagcuccaagacauuuuaccucuguauggcgauaccucucagcggcccuccgaagggcgccuuagcuuggacucgcaggagggagauucuggccuggacuccgguacugaacgauucccaucacuaagugagagccucaugaauagaaacuccguccugucugauccugggcuugacagccccaggacaucaccagugaucauggcacggguggcccaacaucaccgucgccagggaagugacgcugccguccccuccaccggcgaucagggcguugaccagagcccuaaaccacugauaauugggccggaggaagauuacgaccccggauauuuuaauaacgagucugauaucauuuuccaagacuuggaaaagcucaaaucaagaccugcgcaccuggguguguuuuuaagguacaucuucagucaggcagauccaagcccccugcucuuuuaucuuugugccgagguauaccagcaggcuuccccuaaggacucucggucgcugggcaaggauaucuggaauauuuucuuggagaaaaacgccccacuacgagugaagauacccgagaugcugcaagcagagaucgacagccgccucagaaauuccgaagaugcuaggggaguccugugcgaggcccaggaagcggccaugccggagauucaggaacagauccaugacuaucggacgaaacgcacucuuggacugggcucauuguacggugagaacgaccuccuggauuuagacggggauccucugagagagaggcaaguggcagaaaagcagcuagcugcccucggcgacauacugaguaaauacgaggaagaucguucugcuccaauggacuuugcccuuaauaccuauaugagccacgcagggauucgguugcgagaggccagacccuccaacacagcugaaaaggcgcagucagcaccugauaaagacaaguggcugcccuucuuuccaaagacuaaaaagagcucuaauuccaaaaaggagaaagaugcccucgaggacaagaagaggaacccuauccugaaauacaucggcaagcccaaaaguagcucucaguccaccuuccauauuccacuuucaccgguugaagugaagccugggaauguccgcaacaucauucaacacuuugagaacaaucagcaguaugaugcucccgaaccaggaacacaacggcugaguaccgguagcuuccccgaggacuugcucgagucggauuccucuagaagcgaaauaaggcugggccgcucagagaguuuaaaagggcgagaagagaugaagcggucccguaaggccgaaaacgugccuagaucuaggagcgacguagacauggaugcagccgcugaggccacgcgccugcaccaguccgcaucaagcaguacuucuucccuaagcacacggucgcucgagaauccaacucccccuuucaccccgaaaaugggaagaaggucaaucgaaucuccaagucugggcuuuuguacagacacccuuuugccccaucugcucgaggaugaccugggucaguuauccgaucuggaaccugagccagacgcgcagaacuggcaacacacgguugggaaggauguggucgcuggccuuacccagcgagaaauugaccgccaggaggugaucaaugaguuguucgucacagaagccagccaucuccggacucugagagugcuagaucugaucuuuuaccagaggaugaaaaaggagaaccucaugccccgugaggaacuggcacgccuuuucccuaauuugccggaacugauugagauacacaacucuuggugcgaggccaugaaaaaguuacgggaagagggacccaucauuaaggaaaucagcgaccucaugcuggcuagauuugauggcccagccagggaggagcuucaacagguugcagcucaguucuguuccuaucagucaauugcccuggaauugaucaaaaccaagcaacgaaaagagagucgguuucaacucuucaugcaggaagcggagagccauccucagugccgcagacugcagcuaagggaccugauaaucucugaaaugcagcggcucacaaaguacccccugcuuuuggaguccauuaucaaacacacugaagggggaaccucagaacacgagaagcugugucgagccagagaucagugccgcgaaauuuuaaaauaugugaaugaggcuguaaagcaaacagaaaacaggcaucgucucgaggguuaccagaagcggcuggacgcaaccgcccuugagagagcuaguaauccacuggccgcagaauuuaaaagccuagaccucacuacgaggaagaugauccacgagggcccucugacauggcgcauauccaaagauaagaccuuggaccugcaugucuuacuccuggaagaucuucugguguugcuccagaaacaggacgagaagcugcuacugaagugucacucuaaaacugcgguugggucgagcgauucaaagcaaaccuucucccccgugcuuaaacucaacgccguccugauucgaaguguggcuacagacaagagagccuuuuucaucauuugcaccucuaaauugggaccaccgcagaucuacgaacugguagcauuaacuagcuccgauaagaauacauggauggagcuccuggaggaagcugugcggaacgccacgaggcacccuggcgcagcccccaugccaguucaucccccuccacccgguccucgcgagccggcucagcaggggccaacccccucacgugucgaacuugacgauucugacguguuucacggcgagccugagcccgaggaacugccaggaggcacugggagccaacagagagugcagggaaagcaucaggucuugcucgaagauccugagcaagaaggcagugcggaggaggaggaacuggguguucuacccuguccauccacaagccuggacggggaaaaucggggaauaaggacccgcaacccuauccaccuugccuucccgggcccccucuucauggagggucuggcagacucugcuuuggaagauguggagaacuuacgacaucugauucucuggucacugcuuccaggccacacaauggagacucaggccgcccaggaaccugaggacgaucugacccccacgccauccgugaucaguguaaccagccacccuugggaccccgggucgccgggacaagcuccaccuggcggggaaggagauaauacacaguuggcaggccuagagggugaaagacccgagcaggaggacauggggcugugcucucucgaacaucugccaccccggacuaggaacuccggaauuugggagagcccugaacuugaucgcaauuuagccgaggacgcgucaaguaccgaggcugccggcgguuauaaagucgugagaaaggcagaaguugccggcucuaaaguggucccggcucugcccgaguccgggcagagcgaaccaggaccucccgagguggaaggcgggacaaaggcaacuggaaacugcuuuuacguuucaaugccuaguggcccacccgauagcuccaccgaccacucugaggccccuaugagcccaccccaaccggauucccucccugcgggucagacggagccacagccccaguugcaagggggaaaugacgauccuaggcggccaucacguucucccccgagucuggcucuccgcgacgugggcaugaucuuccauacaauagaacagcugacccuuaaacugaaccgauugaaggacauggagcuagcccacagagaacugcucaagucguuagguggcgagagcuccgggggaacuacaccuguaggcucuuuucauaccgaagcagccagguggacugaugggucacugucucccccagcuaaagagccucuugccuccgacagucggaauagccacgagcugggacccuguccagaagauggcagcgacgcaccccucgaggauucaaccgcugacgccgcggccuccccugguccauga

SEQ ID NO: 52962 - RNA, 4578 nt, Artificial Sequence
  derived and/or modified sequence opt3 from ARHGEF12__Homo_sapiens__NP_001185594
augagcggcacccaguccacaaucacugacagauucccccugaagaaaccuauuaggcacgggucuauacucaaccgggagucaccaacggauaagaaacaaaagguggaacgcaucgccagucaugacuuugauccgaccggacuuguccagcgaugcguuauuauccagaaagacgauaaugguuucggccugacagugagcggggacaaccccguauuugugcaguccgucaaggaggauggagcugcaaugcgugccggcgugcaaacuggugacagaauuaucaagguuaaugggaccuuggugacacacucuaaccauuuagaagucgugaaacugauaaagucgggaucauacguagcgcuaaccguucagggcaggccuccaggcagcccccagaucccucucgcugauagugagguggaaccauccgucauugggcacaugucucccaucaugacuagcccucauuccccaggagccucagguaauauggagcggauuacaaguccggugcugaugggcgaggaaaacaaugugguccacaaccagaaaguugagauccuucgcaagaugcugcaaaaagaacaggagagauugcagcuccugcaggaggacuauaauaggacccccgcacaacggcugcucaaggaaauacaggaggccaagaaacacauuccucaguuacaagaacagcugagcaaggcuacggggucugcacaggauggagccgugguaacuccaucccgcccccuuggcgacaccuugacagugucagaggcugaaacugauccuggugacguccuggggcgaaccgacuguagcaguggagaugccucuagaccauccagcgacaacgcggauucgcccaaaucuggcccgaaggagaggaucuaccuagaggaaaauccugagaaauccgaaacaauucaggacaccgauacgcaaucacucgugggcagucccagcacucggaucgcaccacauaucauuggggccgaggacgaugacuucggaacagaacacgagcagauaaacggucagugcuccuguuuucagucuaucgagcugcuuaagagccguccugcucaucuggccguuuucuugcaccacguggucucacaauuugaucccgcaacccuccugugcuauuuauacagugaccuguauaaacauacuaauuccaaggaaacacgcagaauuuuccucgaguuucaccaguucuuucuugauaggagcgcucaucugaaggugucuguaccagacgaaaugucagccgacuuggagaaacggcgacccgaacuaaucccugaggaucugcaccgccauuacauacagaccaugcaggagagaguucacccagaagugcaaaggcaccucgaggacuuccggcagaagcgcaguaugggccugacgcuugcggaaagcgagcugaccaaauuggaugccgagagagacaaggauaggcucacacuggaaaaagagcguacuugugcagaacagauugucgcuaagaucgaggaaguguuaaugaccgcccaggcugucgaggaggacaaguccucuacaaugcaauaugugauccugauguacaugaaacaucuagggguuaaggugaaagaaccgcggaaccucgagcacaagcgaggaagaauuggcuuucugcccaaaaucaagcagucgaugaagaaagauaaggaaggugaggaaaaagggaagaggcgcggcuucccuagcauucuuggaccaccccggagaccuuccaggcaugacaauucagccauaggccgcgcaauggaguugcagaaagcccgacacccaaagcaccugaguacucccucuagcguauccccggagccucaagauucagcuaagcuccggcagagcgggcuggcgaacgaaggaaccgacgcagguuaccuuccagccaacucuauguccagugucgcuagcggcgccucuuucucccaggaagggggaaaagaaaaugauacaggcucaaaacaggugggugagaccagugcacccggggacacucuggauggcacgccucguacauugaacaccguuuuugacuuucccccaccuccccucgaccaagugcaggaagaggagugcgaagucgagagagugacugaacauggaaccccaaaaccguuuaggaaguucgauagcguagccuuuggcgagucgcaguccgaggacgaacaguucgagaaugaucuggaaacagacccucccaacuggcaacaguuagugucucgcgagguucugcuagggcucaaaccaugugaaaucaagcggcaggaggucauuaaugagcuguuuuauaccgaaagagcucacgugaggacucuuaaaguguuggaucaggucuucuaccaacgaguuagccgcgagggaauccugucacccagugaacuccggaagaucuuuuccaaccuggaggacauuuuacagcugcauauaggucuuaaugaacagaugaaggccgugagaaaaaggaacgagacaucugugaucgaucaaauuggcgaggacuugcucacgugguucagcgggccuggagaagagaagcugaaacacgcagcggcuaccuuuugcuccaaucagccauucgcccuagaaaugaucaagucacgucagaaaaaggauagccgcuuucagacuuucguacaagacgcagagaguaacccccugugucggagacuccagcugaaggauauuaucccuacacagaugcagaggcuuaccaaauauccguugcuguuagacaauauagccaaguacacagaauggccaacugagcgagagaaagucaagaaagcugccgaucauugccggcaaauccucaacuaugugaaucaggcaguuaaggaagcugagaacaagcagcgccuggaagacuaccagagaaggcuugacaccucuucccugaaauugagcgaguaucccaauguggaggaacuccggaaccuggaucuaacgaagcgaaaaaugauucacgagggcccucuggucuggaaggugaacagagacaaaaccaucgaucucuacacacugcuuuuggaagacauucugguuuuacuccaaaagcaggaugaccgccuggugcuuaggugucacucgaagauccuggccucaacugcggauucuaaacauaccuucaguccaguaauaaagcuauccacaguccucgugcgucagguggccacugacaauaaagcucuguuugucauuagcaugucugauaacggugcacagaucuacgaguugguugcccaaaccgugagcgaaaagacgguauggcaggaccugauuugccggauggcugccuccgugaaagagcagucaacaaagcccaucccuuuaccgcaaaguacccccggggagggcgauaaugacgaagaggacccaagcaaacucaaggaggagcagcacggaauaucugucacuggccugcaguccccugauagagaccuugggcuggaaucaacauugaucaguagcaagccccagucccauucucucucgaccagcggaaaaucagaggugagggaucuguucguugcagagcgccaauuugcgaaggaacagcacacugacggcacccuaaaagaggugggugaagauuaucagauugccaucccagacucccaucugccugucagugaggaacgaugggcucuugaugcccucagaaaccugggguugcugaagcaguuacucgugcaacagcugggacuuacagagaaaucuguucaggaggacuggcagcacuucccccgguacaggacggcaagccaaggcccacagaccgauuccgugauucaaaauucagaaaacaucaaggcuuaucacucuggugagggccauaugccguuucgcacugggacaggagacauagcaaccugcuacagcccucguacaaguacugaauccuucgcccccagagauagcgucggccuggccccacaggacucucaggcuucaaauauuuugguaauggaucacaugaucaugacccccgagaugccuacgauggagccagaagggggacucgacgacuccggcgagcauuucuucgaugcgcgggaagcccacagugacgagaaccccagcgaaggugauggggcagugaauaaggaggagaaagacguuaaccugaggaucucgggaaauuaucuaauucuggauggcuacgacccugugcaggaaucuuccacagaugaggaagucgcuagcucacuuacccuccagccgaugacugguaucccagccguggagaguacccaccaacagcagcauucuccccagaacacacacuccgacggcgccauuagcccuuuuacucccgaguuccugguacaacagcgcuggggagcuauggaauauucauguuuugagauacagaguccaagcuccugcgcagauucucagagccaaaucauggaauacauucauaagaucgaggccgacuuggaacacuuaaagaagguggaggaauccuacaccauucugugucagcgacucgcggggucagcucugacagauaaacauucugacaagaguuga

SEQ ID NO: 52963 - RNA, 2526 nt, Artificial Sequence
  derived and/or modified sequence opt3 from ARHGEF15__Homo_sapiens__NP_776089
augagcgcccagucccugcccgcugcaaccccuccaacacaaaagccgcccagaaucauuaggccucggccacccucucgcucacgagccgcgcagaguccuggcccaccccacaacgggagcuccccucaggagcucccacguaauucuaacgacgcuccgacucccaugugcacgccuauauucugggaaccacccgccgcaucgcuuaaaccuccagcccuguugcccccgucagcuagcagagcaaguuuagauucccagaccucuccugacagccccuccucaacaccaacuccuagucccgugagcaggcggucugccuccccagagcccgcuccucgcucaccagucccgcccccuaagccaagcggaagucccuguaccccucugcuaccaauggccgguguucucgcgcaaaauggcucugcauccgcccccgggacagugagaaggcuggcuggacgguuugaaggcggugccgaggggcgcgcacaggaugcugacgccccggaaccuggacuucaggcgcgagccgauguaaacggcgagagagaggcaccacugaccggcagcgggucgcaggaaaauggagcucccgacgccgguuuggcuugcccucccuguugcccaugugugugccauacuacaaggccuggccucgagcugcgguggguccccguugggggauacgaagaggugccacgugugccgcgcagagccucuccucugaggaccucccggucacgaccccacccacccaguaucggccauccugcagucgugcucacgagcuaucgcuccacugccgagagaaaauuacugccacuuuugaagcccccuaaaccgaccaggguacggcaagaugcuacaauuuucggugacccaccccagccugaucuggaccuacucucugaagaugggauccagacuggagacagcccagaugaggcgccccagaacaccccuccggcaacaguugaaggccgcgaggaagagggccuggaggugcuuaaggaacaaaauugggagcugcccuugcaggacgaaccacucuaccagaccuauagagccgcuguccugucagaggaauuauggggagugggggaggacgguaguccuucccccgccaacgcaggcgaugccccaacguuuccuaggcccccagggccgcguaauacucuguggcaagagcucccugcugugcaggccagcggacuucuggacacauugucuccccaggaacggcgaaugcaggagucacuauucgaagucguuaccagugaggcaagcuaccugagaucccucaggcugcuuacugauacauuugugcugucucaagcguugcgcgacacccucacgccacgggaucaccauacccuguucucgaacguacagagagugcagggcgucagcgaaagguuuuuagcuacacugcuaucccgcgugcgaucaaguccccacauuucugaccucugugauguugugcacgcccaugcagucgguccuuucagcguguauguagacuacguucggaaucagcaauaucaggaggagacuuacucccgucugauggauaccaacgugagauuuucagccgaacuuaggcgcuugcagagccugccaaagugcgagcggcucccccugccuucuuuccuucuguugccguuucagagaaucacaaggcuccgaaugcuguuacaaaauauacugcgccagacugaagagggguccagucggcaggagaacgcucagaaagcccuaggcgcagucagcaagaucauugaaagauguucugcugaggugggaaggaugaaacaaaccgaggaacucauccgucugacacagcgccuucgguuccacaaggucaaagccuugccacugguguccuggucaagaaggcucgaauuucagggcgagcugaccgaguuagggugccgacggggagguguucuguucgcgagucgccccagauucacuccucuuuguuugcuccuguuuagcgaccuacugcucauuacgcaacccaagucgggccagaggcuucaggugcuggauuacgcccaucgguccuugguacaggcucaacaggucccagacccuucugggcccccaacauuccgacugagcuuacucucaaaucaccagggaagaccuacccaccgccugcuucaggcaaguucccugucugacaugcaaaggugguugggcgccuuuccgacucccgguccacucccuugcagccccgauaccaucuaugaagacugcgauuguucccaggagcugugcucagaaagcagugcuccagccaagacagaggggcguucucuagaaucccgggcagcgccuaaacaucugcacaagacccccgagggcuggcucaaaggacugccgggcgccuucccagcucagcuugugugugagguuacuggggaacaugagagaaggcgccacuugcgacagaaccaaagacuguuagaagccgugggaagcucgucagguacaccuaacgcacccccacccuga

SEQ ID NO: 52964 - RNA, 2295 nt, Artificial Sequence
  derived and/or modified sequence opt3 from ARHGEF16__Homo_sapiens__XP_011539555
auggcccagagacacagcgacuccucucuggaggaaaagcuccuuggccauagguuccacucagagcugcgguuggaugcugggggaaaccccgcaagugguuuaccuauggugcgcggcagcccacgaguccgugacgaugccgcguuucaaccgcagguucccgcuccuccacagcccagaccuccagggcaugaagaacccuggccuaucgugcuguccaccgaaucuccagccgcacuaaaacucggaacacagcaacugauuccgaagucgcuugccguagcuucaaaagcaaagacucccgccaggcaccagagcuucggcgcugccgugcugagucgggaggcggcacgcagagacccuaaauugcucccagcccccuccuuuucucuggaugacauggaugucgacaaggauccuggugggaugcugaggcggaaucuccgcaaccagagcuaccgagcugccaugaagggauuaggcaaaccaggcgggcagggagacgcaauacaacugucccccaaacuucaggcuuuggccgaggaaccgucacagccucauacgagaagucccgcgaaaaauaagaaaacccuggguaggaagcggggccacaaggggagcuucaaagaugacccacagcuauaucaagagauccaggaacguggacucaacacaucucaggaguccgaugacgacauucuggaugagucaagcaguccugaaggcacucaaaagguggacgccaccaucguugugaaaucuuaccgccccgcacaggucacauggucccagcuuccagaggugguagaacuggguauuuuggaucagcucagcaccgaggaaagaaagaggcaagaggcuauguuugagauccugacuucggaguucucuuaucagcacuccuuaucaauacugguugaggaauuucuccagaguaaagagcuucgggccacagugacccagauggaacaucaccaucuguucagcaauaucuuggacguccuaggggcuucccaacgaugccugguggccggacccgagcucuggcugcagggccuugagguggaacgccuggauaugcaguugcagccuuguacgggcgaggcauggcuccugagaggguggcaagcccagucuggaccagucagcagggguggcgggacuccggcucacuuacacgcgggauuuuucgaagaccuggagcagcggcauaaggcacagguucuaguggaagauauuucagacauccucgaggagcacgccgaaaaacauuuucaccccuacauugcuuauugcaguaacgagguauaccaacagcgcacccugcagaaacuuaucuccagcaaugccgcauucagagaagccuugagggagauagagcgucggccugcuuguggcggucugccaaugcucucuuuucugauucuucccaugcaacgagugacaagacugccuuugcucauggauacucugugcuuaaagacccaggggcauucagaaagguauaaagccgcaagucgcgcgcugaaggcuaucagcaagcuaguccggcaguguaacgagggcgcccacagaauggaaaggauggagcagauguacacacuccacacccaacuggacuucuccaaggugaaaucucuuccauugauuucggcaagccgcuggcugcucaagcgaggagaacuguucuuaguugaggagacgggccuguuucggaagaucgccucccgucccacuugcuaccuuuucuuguuuaaugaugugcucgucgugacaaagaagaaaucagaagagaguuauaugguacaggacuacgcucagaugaaccauauccagguugaaaagauugagccgucugaacugccucuaccagggggagguaauagaagcuccucagugccccacccuuuccaagucacccugcucaggaacagcgagggccgccaggagcagcugcuuuugucuuccgacagugccagcgaucgggcaagauggauaguggcucugacucauucugaaaggcaguggcaaggguuauccucaaaaggagaccucccccaggucgagaucacaaaggccuuuuucgcgaagcaggccgaugaagugacccugcaacaggcugacguugugcuuguacugcagcaggaggauggcugguuguauggugaacgacuccgcgacggggagacgggcugguuuccagaggauuucgcacgguuuauuaccaguagagucgccguggaaggaaauguuaggcguauggagcgccugcggguggaaacagacgucuga

SEQ ID NO: 52965 - RNA, 6192 nt, Artificial Sequence
  derived and/or modified sequence opt3 from ARHGEF17__Homo_sapiens__NP_055601
auggccgacggcgcucccagaccucagcuguacaggagcguguccuucaagcuccuugagcgguggucugggggaccaggucugcgcgaagaggauaccgacacaccgggcuugcgacguagagcaucaugcaggcccacuacggccgcgcgggggcaaccuagucgcagagucagcaaauuagcuuccggaccacuggccgcacccgcccagccuaggccacuacggucucucucgcccucaguucgccagcugagccgaagauuugaugcuccuaggcuugacgauggcagugcagguacccgggacgggggagugcugccagccgcugccgaagaggcggcagaaggcccggcccguggcgcuuggcccuccguaacagagaugcgcaaguuguucgggggaccugguucuagaaggccaagcgccgauuccgagucacccggcacuccuaguccagacggggcagcuugggaacccccggcccgggagagccgacagccucccaccccaccuccccgcacauguuuuccacucgcgggacugagaucugccaggccccugaccggcccugaaacugagggucggcuccgcagaccacaacagcagcaggagagggcacaacguccggcugauggguuacacuccuggcauaucuucucacagccccaggccggagcucgggccagcugcaguucuuccagcauugcagccucguauccugugucucgauccagagcugcgucaaguagcgaagaggaagaggaaggcccaccccagcugccuggcgcacaauccccagccuaccacgggggacauucuagcgguucagacgaugacagggauggcgaggggggacaccgcuggggcggucggcccgggcuuagaccgggcaguuccuugcuggaccaggacuguaggccugauagcgacggacuaaaccucucuucaaugaauagugcuggcgucagcggguccccagagcccccuacaucuccccgcgccccacgagaagagggacugcgggaaugggguucgggcagcccucccugcgugccagggccgcaggagggacuucguccuauguccgauucaguuggcggugcauuuagaguggccaaagucaguuuccccucuuaucuggcuagcccagccggguccaggggcucaagccgcuacucuuccaccgaaacguugaaggacgaugaccucuggaguagccggggaucuggcggguggggaguguauagaucccccucauuuggugcaggcgaggggcuguuaaggagucaagcgcgaacucgcgcuaaaggaccuggcgguaccagccgggcccugagagaugggggcuucgagccagaaaagucgaggcagcguaagucccucucuaaccccgacauagcaagcgagacacuuacucuguugucauuucuacgcagugaucuguccgaacuccggguaagaaaaccuggaggcucuagcggggacaggggauccaauccgcuggauggccgagacucaccaagcgccggugggcccguuggacagcuugagccuaucccaauucccgcuccugccaguccgggcacccggcccacacugaaggacuugaccgcaacgcuccgcagagcuaaaucuuucacuuguuccgaaaagccaauggccaggcggcugccucgaacaagcgcguuaaaaucgucaucuagugagcugcuacucaccggucccggcgccgaggaagauccacugccucuuaucgugcaggaccaauacguccaggaggcuagacagguguuugaaaagauucagcgcaugggggcacaacaggaugacggauccgaugcccccccaggcagcccggacugggcuggggaugugacuaggggacagcguucucaggaggaguugagcggcccugaauccucacugacagacgaggguaucggggccgaucccgaaccacccgucgcagcguucugcggacucggcaccacggguauguggcggccucugaguagcucuuccgcccaaaccaaccaucacggcccagggacagaggacucacuuggaggcugggcucugguuagucccgaaacuccuccgaccccaggggccuugagaaggcgccgaaaggugcccccuagcggauccggcgguucugagcucucgaauggggaggcaggagaagcuuauagaagccugucagaucccauaccacagcggcacagggccgcaacauccgaggaaccuacuggcuuuaguguagacucuaacuuacuggguagccuaucccccaaaaccggccucccagccacaucagcuauggaugaggggcugaccucuggacauagcgacuggagugugggcuccgaagagagcaagggguaccaggaggucauccagucuauugugcaaggaccuggcacucuuggucgcguuguggacgaucguaucgcggggaaagccccgaagaaaaagucauuguccgaccccaguagacggggagaacuggcaggcccaggcuucgaggggccuggaggugaacccauuagggaggucgaaccaaugcucccucccagcucgucugagccgauccugguggagcagcgcgcugaaccagaggaaccuggcgccacgcgauccagagcccagagcgagcgggcuuuacccgaggcacugccacccccugccacagcgcacaggaauuuccaucuugauccgaaauuggcugacauacucucaccccgccugauuagaagggggaguaagaagcggccagcccguucuucccaccaagaacuacgccgagaugagggaagccaggaccagaccggcucacugaguagagcaaggccuagcucccggcacguacgccaugccucuguucccgcuacuuuuaugccuaucguggucccagaacccccuaccagcguggguccacccgucgcagugccggagccuauuggguucccaacaagagcccaccccacccuccaggcgccuucccuggaagauguuacuaaacaauacaugcuuaacuugcauucaggagaggugccagcucccguaccggucgacaugccuugucugcccuuagccgcaccaccuucugccgaggcuaagcccccagaagccgcaaggcccgcugaugagccuacaccagccaguaaaugcuguucgaagccgcagguggacaugcggaaacacguugcgaugacgcuccuggauaccgaacagagcuauguggagucccuucgaacucugaugcagggcuacaugcaacccuugaagcagccugaaaauucuguccucugcgacccaucacugguggaugagaucuuugaccagauccccgagcuacuggaacaucacgagcaguuccucgaacaaguaagacacuguaugcagacauggcaugcccagcaaaaggugggcgcacugcuuguucagagcuuuuccaaagacgucuuggugaacauuuauagugcuuacauagauaauuuccugaacgccaaggacgcugugcgcgucgcaaaagaggccaggccugccuuuuuaaaguuccucgaacagucuaugcgggagaauaaagagaagcaggcucugagcgaucuuaugaucaagccaguucaacguauucccagauaugaacugcuagugaaagaccuccugaagcacaccccugaggaucauccggaccacccauugcuguuagaagcgcagaggaacaucaaacagguggcagagcgcauaaauaaggggguacggucagccgaggaagcugagcgacacgccagaguccuccaggaaauugaggcacauaucgaaggaauggaggaucugcaagccccccuuaggcgcuuucugcggcaggagauggugaucgaaguuaaagcuauugguggcaagaaggacagauccuuguuccucuuuacagaucugaucgugugcacuacccuaaaacguaagagugggagccugaggcggucuuccaugucacuuuacacggcggccagcgucauugacaccgcaucgaaauauaagaugcucuggaaacugccuuuggaggaugcugacauaaucaagggagccucucaggcaacaaaccgcgaaaacauucagaaagccaucagucgacuggacgaggauuuaacuacccucggccaaauguccaagcugagcgaaucacuugguuucccccaccagucccuggacgaugcuuugagagaccucucugccgcgaugcauagggaucugagcgagaagcaggcacuaugcuacgcccugaguuuuccaccuacaaaacuugagcucugugcuacucggcccgaagggaccgacuccuacaucuucgaguucccacacccggaugcccgccugggauuugaacaggcuuucgacgaggcaaagagaaaauuggccagcucuaagucaugcuuagauccugaauuucugaaagcuauucccauaaugaagacgaggaguggcaugcaauucuccugugccgcaccaacacucaauagcugccccgagccuucuccagagguguggguuuguaacucggacggcuauguggggcagguaugccugcuuucacugcgagcggaacccgaugucgaggccuguaucgcugugugcagcgcccggauuuuguguaucggagcagugccuggucuacagccgcguugccauagagaaccacccccuucccugcgcaguccacccgagaccgcuccugagcccgccggcccagaacucgacgucgaggcagccgcugaugaagaggcggccacucuggcagaaccggggccucaacccugucuucacauuucuaucgcuggaagcggcuuagagaugacaccaggucugggggagggagacccuaggcccgaacucguuccauuugacuccgauucagacgaugagaguucuccuagccccuccggcaccuugcagucacaggccagccggucuacuauauccaguagcuucggcaaugaagagaccccgucguccaaggaagccacagcagagacgaccucuucagaggaagagcaggaaccaggguuucugccucucagcggaaguuucggucccggcgggccaugcggaacuucccccauggacggcagagcucugcgcaggucuagccacgguucauuuacacgagggucccuugaggaucuguugaguguggacccugaagccuaccaaagcucuguauggcuaggaaccgaggauggcugcgugcaugucuaucagucauccgacagcauccgggauagaaggaacucuaugaaacugcagcacgcggcuagugugacauguauucucuacuuaaauaaccagguuuucgugucgcuggccaauggcgagcuugucguguaucaacgcgaagcagggcauuuuugggacccgcagaacuucaaguccguuacucugggaacccaggguagcccaaucacgaaaauggugucagucggcgggcgucucuggugcggaugucagaaucggguauuggugcugucucccgauacacuccaacuggagcacauguuuuacguuggccaggacagcuccagaugcguggccuguauggucgauaguucacuugguguguggguaacccuaaaggggucugcucaugugugccuguaucacccugacacuuucgaacaguuggcagaggucgacguuacccccccagugcacaggauguuagccggcagcgaugcgauuauccgccaacauaaagcugccugucugcgaauaacagcacuccuggugugcgaggaacuucugugggucggaacuuccgccggcgugguucucaccaugccuacaagucccgggacgguaagcuguccacgggcuccuuuguccccgaccggacugggucagggccacacugggcaugugagauuccuagccgcaguccagcugcccgacggauuuaaccuccuuugcccaacaccucccccaccucccgauaccggcccggagaagcugccaucuuuagaacacagggacucaccuuggcaccgcggucccgcuccagccagacccaagauguuggugauuagcgggggcgauggauacgaggacuuccggcugucguccggcgggggaaguucuagcgaaacuguugguagggaugacucaacaaaucaucuccugcuuuggcguguguga

SEQ ID NO: 52966 - RNA, 2640 nt, Artificial Sequence
  derived and/or modified sequence opt3 from ARHGEF1__Homo_sapiens__NP_945328
auggaggacuucgccagaggcgcugcaagccccgggccuuccaggccaggacuggugccggucucuaucauuggugccgaagaugaggacuuugaaaacgagcucgaaaccaauucagaggagcagaacagucaauuccagagccuugaacagguuaagcggcgccccgcgcaccugauggcuuuguuacagcauguggcccugcaauuugagccuggcccccuaguacuccgagugccagucccuccaaauguggcauucgaacuggaucguacaagagccgaccuuauauccgaggauguucagaggcgguuugugcaggaggucgugcagucucaacagguagcuguugggcgccagcuggaagacuucagaucgaaaagguugaugggaaugacucccugggagcaggaacucgcacaacuggaggccugggugggccgggaucgcgcuucauacgaagcccgagagagacacgucgcggagaggcugcucaugcauuuagaagagaugcagcacacgaucagcaccgacgaagagaagagugcagccguggugaacgcuauuggucuguauaugcggcaucuugggguccguacaaaauccggagauaagaaaucuggccgcaauuucuucagaaagaagguuaugggcaacaggcggagcgacgaaccugccaaaacuaagaaaggguuguccucaauccuggaugcagcucgauggaaucgcggagagccacaggugccggacuuuagacaccuaaaggccgagguagaugcggaaaaacccggugccaccgacaggaagggcggggugggaaugccuagucgggaccgcaacauuggcgcaccaggucaagauacacccggggucagccuccacccucugucucuugacuccccagauagagagcccggagcugacgccccgcuggaauugggcgauucaagcccucagggccccaugagucucgagucucuggcuccaccugaauccaccgacgagggggccgagacugaaagccccgagccaggagaugaaggugagcccggcaggucgggguuagagcuggaaccugaggaaccaccgggauggcgugagcucgugcccccugacacacuucauucucugccaaagucccagguuaaacggcaggaagugaucucagaguugcuagucaccgaggcagcccacgugcgaaugcugagaguacuccaugaucuguucuuucaacccauggcugaaugccuuuucuuuccucuggaggaauugcagaauauauucccaagucucgacgagcugaucgaaguucacagcuuauuccuggauaggcuaaugaagcgccggcaggaguccggcuaccucauugaggaaaucggugacgugcugcuugcgagauuugacggggcagagggcucuugguuccagaaaauuagcucaagguuuuguagucgccaauccuucgccuuggaacagcugaaggcuaaacagcgaaaggauccccgguuuugcgccuucguccaggaggcagaaagccguccgagauguaggcgccuccaacugaaagacaugaucccuacggagaugcagcggcuuacuaaguauccacuguugcuccagucuauaggacagaacaccgaggaacccacagagagagaaaagguggagcuggccgcugagugcuguagggaaauuuuacaccaugucaaucaagccgugcgagauauggaggaccugcuacgccucaaagauuaccagcggagacuggaccuuucacacuugaggcagaguagcgauccuaugcuguccgaauuuaagaaccucgacaucacuaaaaagaaacugguucaugagggccccuuaaccuggcgugugacaaaggauaaggcaguagaaguccacgugcugcuuuuggacgaucuccugcuacugcuccaacgccaggacgagcggcugcuuuugaaaucucauucgagaacccugacgccaacuccugaugggaagacaauguuaaggcccguucuccgacugaccagcgcgaugacucgggagguggcuacagaccacaaagccuucuauguccuuuuuaccugggaccaggaagcacagauuuacgagcugguggcccaaacgguauccgaacgcaagaauuggugcgcuuugaucaccgagacagccggaucacucaaagugccagcaccggcuaguagaccuaagcccaggccaucucccagcuccacucgggaaccucugcuaucaagcucugagaacgguaauggcgggcgagagaccuccccagccgaugcgagaacagaacgcauccugagugaccuccugcccuucuguaggccuggaccggagggccagcuugccgcuacugcauugcguaagguucugagcuuaaaacagcuccuguuuccagccgaagaggauaacggugcugggcccccucgggacggcgauggagucccaggcgggggaccccuuucuccugccagaacccaggaaauucaagagaaccugcuaucccucgaggaaacaaugaagcagcuggaggaauuggaggaggaauuuugcaggcugcgcccguuacucucacagcuggguggcaauagugugccccagccaggguguaccuga

SEQ ID NO: 52967 - RNA, 1860 nt, Artificial Sequence
  derived and/or modified sequence opt3 from ARHGEF25__Homo_sapiens__NP_001104740
augaagcccccugacagaccagccccgggcaggaccgaucggauccugggggugaugggagguaugcuccgcgcuugcgcacuucccggccaggaggggccuccacgacguagcccccugggauuggucggcacagaaccugaguccgaaagaacugagggugaccacaggcgggaucgcgaacaugagguuuuagccggggcgcugcaaccagagucuuacucaauugcuggaagugaaggcagcauauccgccucugcagccucgggccuagcugcacccucagggccuagcaguggacucuccucugguccauguagcccggggcccccuggcccaguguccggacugagaagguggcuugaccacucaaaacauugccugaguguagagacggaagccgauagcggccaggcuggucccuaugagaacuggauguuggagccugcccucgcgaccggggaagaacugccagaacugacacucuuaacuacccugcuugagggacccggcgacaagacacagccgccugaagaggagaccuugucucaggcacccgaauccgaggaggagcagaaaaagaaagcccuggaacggucaauguacgugcuaagcgagcucgucgagacugaaaagauguauguggaugaccugggccaaaucguugagggguacauggcuacaauggccgcacagggagugccagaaagucuucgcggucgagauagaauugucuucggcaauauccagcaaauuuaugaguggcacagggacuacuuucugcaggaauugcagcggugucucaaggauccugacuggcuggcucaguuauucaucaaacaugagcgucgccugcacauguaugugguauacugccaaaacaagcccaaaucugagcacguuguguccgaauuuggggauagcuacuucgaggaacucagacagcagcuuggacauaggcugcaauugaaugaccuacugauaaagccaguccagcggaucaugaaauaucagcuccugcuuaaggacuuucugaaguacuauaaccgagccggcauggauaccgcggacuuggagcaggccguggaggugauguguuucguccccaaacgcugcaaugauaugaugacgcucgguagacugaggggguuugaaggcaaguuaacugcacaaggaaaacugcuaggccaggacaccuucuggguuacagagccugaagcugggggacuccugucgucucggggucgcgagagaaggguguuucuuuucgaacagauuaucaucuuuuccgaggccuugggcgggggaguacguggcgguacucagccaggguacguguauaagaacucaauuaaagucaguugucugggccucgagggaaaucugcaaggcgauccgugccgguucgcucuuaccagccgagggcccgaaggagguauacagagauacgugcugcaggccgcagacccugccauuucccaggcuuggaucaagcacguugcgcaaauuuuggagucucagagggauuuucucaacgcacugcagagcccaaucgaauaucagcgccgggagucacaaacaaauaguuuaggcagacccagggggccuggagugggcuccccaggucgcauccgacugggggaccaggcccagggcagcacccauacgcccauuaacggaucucuaccgucacuccugcuuaguccuaaaggcgaagucgcucgggccuugcugccacucgauaagcaagcacugggggacauaccccaggccccucacgauagcccacccguguccccuacucccaagacaccaccgugucaggcucguuuagccaaacuggacgaggacgagcuuuga

SEQ ID NO: 52968 - RNA, 2376 nt, Artificial Sequence
  derived and/or modified sequence opt3 from ARHGEF26__Homo_sapiens__NP_001238892
auggacggcgagagcgaaguggauuucuccucuaacucaaucacaccccuguggcgcaggcggaguauuccucagccacaccaaguccucgggcgcagcaagccgcgaccccaguccuaccagucuccuaauggacuucugauaaccgacuuuccaguugaggaugguggcacuuuguuagccgcucagauccccgcacaagugccuacggccucggacucacguaccguacauagaagcccacugcuacucggggcgcagaggcgggcuguggccaacggaggcacagcaagucccgaauaucgcgccgcuuccccuagacugaggcggccaaaaucuccgaaacuucccaaggcagucccuggugggagcccaaagucccccgccaauggagcugugacucugccugccccacccccgccucccguuuugcgcccaccucgaacccccaacgcgccagcacccugcacaccugaggaagaucucaccggccugacugccucaccagugccgagucccacagcuaauggccuggccgcaaacaaugacagcccugggucuggaucccagucagguagaaaagcuaaggauccagagaggggccucuuccccgggccucaaaagagcaguucugagcagaaauuaccacugcagcggcuucccucccaggaaaacgaguugcuggaaaauccgagcgucgugcuaucgaccaacucuccugccgcgcucaagguaggaaaacagcaaauuaucccaaagucccuggccucagagauuaaaaucaguaagagcaauaaccagaauguugagccccacaagcgucuucugaaagugcgcuccauggucgaaggcuugggugggccucucggacaugcaggcgaggaaucugagguggacaacgauguggacagccccggcucacugagaaggggguuacggaguacguccuaccgacgcgcugucguuagcggauuugauuucgacucuccaacuucaaguaagaaaaagaauagaaugagccagccugugcugaaaguagugauggaagauaaggagaaauuuuccucucucgguaggauaaagaagaaaaugcuuaagggccaagggaccuucgacggagaggaaaacgccguccuguaucagaacuacaaagagaaggcuuuggacaucgauucggacgaagagagcgaacccaaagagcagaaguccgaugagaagauugugauccaccauaaaccacuacggucaacauggagucagcugucugccguuaagcgcaaaggccucagccaaacugugucccaggaagagagaaagaggcaggaagcaauuuuugaggucaucucaagcgaacacucuuaucugcuuucccuggagauauugauucguauguucaaaaauaguaaggagcucagcgacaccaugacaaagaccgaacggcaccaucuguuuucuaacaucacggaugugugugaggccuccaaaaaguucuuuauugaauuagaggcucgacaccagaauaacaucuucaucgacgauauuucagacauaguagagaaacauacugcgaguacauuugauccguacguuaaguauugcaccaaugaaguguaccaacagagaacucugcagaaacuacucgcaacaaacccuagcuucaaggagguccugucgaggaucgaaucccacgaggacugucgcaaucuucccaugauuucuuucuugauccugccaaugcagcgggugaccagacucccccugcuuauggauacgauaugccaaaagaccccuaaagacagcccaaaguacgaagucuguaaaagggcccugaaggaggugucaaaauugguucgccucugcaacgagggugcucgaaagauggaacggacagagaugauguauacuauuaauagucagcuggaauuuaaaaucaagcccuucccuuuaguguccucuagccguuggcugguaaagagaggggagcuaaccgccuacgucgaagacacagugcucuuuuccaggcgcacuucaaaacagcagguuuauuucuuucuguucaacgaugugcuuaucauuaccaagaaaaagagcgaggagaguuacaaugucaacgacuauucuuugcgggaucaacugcucguggaauccugugacaaugaggaacugaacagcucgccgggcaaaaauucaucuacaauguuauacaguagacaguccagcgcaucucaccuguuuacccuuacuguauugagcaaccaugccaacgagaagguggaaaugcuccugggagcugagacgcaguccgagagggcccgauggaucacagcacuaggccacucaagugggaagccacccgcggauagaaccugcggauga

SEQ ID NO: 52969 - RNA, 5196 nt, Artificial Sequence
  derived and/or modified sequence opt3 from ARHGEF28__Homo_sapiens__NP_001073948
auggagcugagcugcuccgaagcaccccucuacggccagaugaugaucuaugcuaaguucgacaaaaacguguaccuuccugaggaugcagaauuuuauuucaccuacgacgggucucaccaaaggcaugucaugauugccgagaggauagaagauaauguucugcagucaagugugccaggacacgguuugcaggagacaguaacugugagcgucuguuuaugcuccgagggcuauucuccggugacgauggggucgggaucaguuaccuacguggacaacauggcgugucggcuggcucgccuacucgucacacaggccaaucgacugacugcaugcagccaucaaacccuucugacacccuuugccuugaccgcuggcgcacucccugcccuggaugaggaacuggugcucgcuuuaacucaccuggaacuuccauuggaguggacaguacuggguaguuccucucuagagguuagcucccaucgugaaucacuccugcaccuugccaugagaugggggcuggcgaaguugagucaguucuuucucugucugcccggaggcgugcaggcauuagcccugccuaacgaggaaggcgcuaccccacucgaccuugcccugagggaggggcacagcaaguuggucgaagaugugacgaauuuccagggacgguggucucccuccuuuucacgcgugcaacuaagcgaggaggcaagucugcauuauauccacucuuccgaaacucucacccugacacuuaaccauacugcugagcaccuguuggaagccgacauuaaacucuucagaaaauacuuuugggauagggcguuccuggucaaggccuuugagccugaagcacggccagaggagcgcaccgcuaugccgagcucgggugccgaaacagaggaagagaucaaaaauucuguuuccucacgaagugcugccgaaaaagaggacauuaagagaguaaagagcuuaguggugcagcacaacgagcaugaagaucagcacucccuggaccuagauaggucuuucgacauccucaagaaaagcaagcccccuucaacccugcuugcagccggccgguugagugacaugcugaaugggggagaugaggucuacgcuaacugcauggugauagaccagguuggcgaucucgacaucuccuauauuaauaucgaagguauuacggcgacuacaagcccagagucucguggguguacccuguggccccaaucaaguaagcauacucuuccuacagagaccagcccauccguguacccccugucugaaaacgucgagggaacggcacacaccgaagcccagcagucguuuaugagcccguccucaaguugcgcuucuaauuugaaccucagcuucggcuggcauggcuucgagaaagaacaaucccaccugaagaaacgcucaagcucuuuagaugcccuggacgcagauuccgagggggagggacacagugaaccuagccauaucuguuauacacccgguucucaguccucaaguagaacuggcauaccaagcggggacgagcuagauucguuugaaaccaauacagagccugacuucaacauuuccagggccgaaucucucccccugagcucaaaccuucagaguaaggaguccuugcugucuggagugcggagccgauccuacucaugcagcaguccaaaaaucucucucggcaagacucgccugguaagagaguuaaccguuuguuccagcucggaggaacagagggcuuauucacugucugaacccccucgggagaaucgcauucaagaagaggagugggauaaauacaucaucccagccaagagugaauccgagaaguauaaagugagcagaacauuuucuuuccuuaugaacaggaugaccagcccgcguaauaaguccaaaacuaagucaaaagacgcaaaggacaaggaaaaauugaaccggcaccaguuugcgcccgguacguucagugggguccuccagugccuggugugcgauaagacacuacugggcaaagagagccuccaguguucuaauugcaacgcuaauguccauaagggauguaaagacgccgccccugcaugcaccaagaaguuucaagagaaauacaacaagaauaaaccacagacuauucugggcaacuccucauuccgagauauaccccagccugggcuuaguuugcacccaagcuccucugugcccguuggacugccgaccgguagaagggaaacagugggccagguacacccuuuaucgcgcagcgucccagggaccacucucgagucauuucggagauccgcuacaagucuggaaucugagagcgaccauaauuccuguaggucacgcucucacagcgaugaacuucugcaaaguaugggauccagccccucuacggagucauucaucauggaggacgugguugauuccaguuuguggagcgaccucucgucugaugcccaggaauuugaggcagaauccuggagccugguggucgacccuucauucugcaaccgacaggagaaggaugugauuaaacggcaggacguaaucuuugaacuaaugcaaaccgagaugcaucacauacagacucuguucauuaugagugagaucuuccguaagggcaugaaggaggaacuccagcuggaucauucuacaguggacaaaaucuuucccugucuugacgaauugcuggagauucacagacacuucuuuuacuccaugaaggaaaggcgccaagagagcugcgcugguucagaucggaauuucguuaucgacagaauuggggauauauuaguccagcaguuuagugaggaaaacgccagcaaaaugaagaaaaucuauggcgaguucuguugccaucacaaggaagcggugaaucucuuuaaagagcugcagcaaaacaagaaguuccagaacuuuauuaaacuuagaaauuccaaccugcuagcccgacgccggggaaucccagaguguauccuccuggugacccagagaauuacaaaguacccugucuugguugaaaggauacugcaguauacuaaagagcguaccgaggaacauaaggacuuacgcaaagcucucugccugaucaaggauaugauugcaacgguggaccuuaaggugaaugaauacgagaaaaaccaaaaguggcuggagaucuugaauaaaauugaaaacaagaccuauacaaaacucaagaauggccacguauuccggaagcaggcccugaugucugaggaaagaacucuacuguacgaugggcuugucuauuggaaaaccgcuacaggaagguuuaaggacauccucgcccuguugcugacugauguguuacucuuccugcaggagaaagaccagaaguacauauuugcagcgguugaucaaaaacccagcgugaucucccuucagaagcugauugcccgagaagucgcuaacgaggagcgggguauguucuugaucucagccucuagugcaggcccagaaauguacgagauucauaccaauucgaaggaggaacgcaacaauuggaugagaaggauccagcaagcuguggaaagcugcccggaggagaaagggggacggacguccgaaucugacgaggauaagcgaaaagccgaagcaagaguugccaagauacagcagugucaggagauucucacaaaccaagaccagcagaucugcgcuuaucuggaggaaaaacuacacauuuacgcggagcugggcgaacuuucagguuucgaggacgugcaccucgaaccucaucuguugaucaagcccgauccaggggagcccccucaggccgccagcuuacuggcugccgcccucaaagaggcugaaucccugcaaguagcagucaaggccagucagaugggcgcggugucucagagcugugaggacucaugcggagauuccgugcuugcugacacccugaguagccacgaugucccaggcucucccacugccuccuugguuacagggggacgcgaaggcagggguuguucagacguggauccugggauacagggaguagugaccgaccuagcagucagcgaugccggcgagaagguggaaugccguaauuuuccggguucgucucaaagugagaucauucaggcuauccagaaccugacucggcuccuguauucccuucaggcagccuuaaccauucaagacagccauaucgagauacacagacugguucuccagcagcaagaaggcuugucacuggggcacuccauucucaggggaggcccacugcaggaucagaaaucucgcgacgcggaccgacagcaugaggaacuugcuaaugugcaccaacugcagcaucaguugcagcaagagcagagacgguggcuaaggcgcugugaacagcagcaacgugcccaggcaacaagagagagcuggcugcaggagcgggaaagggagugccaaagucaggaggaacucuuacugcgcucccgaggggagcuugaucugcagcuccaggaauaccaacacagcuuggagagacugcgggaaggacagaggcucgucgagcgcgaacaggccagaaugagggcucagcaaucucugcuuggccauuggaagcacggucggcagcguucacuacccgccgugcuguugccugggggaccagagguuauggaguuaaaccgcagugaaucccugugucacgagaacagcuucuuuaucaaugaagcacucgugcagaugucuuucaacacguuuaauaaacugaaccccucggucauccaucaggacgcuaccuauccuacuacacaaucacacagcgaucuuguacgaaccuccgagcaucagguggaccugaagguugauccgagucagcccucuaaugugagccacaaacucuggacagccgcgggcuccggucaccagauuuugccauuccaugaaucaaguaaggacucuugcaagaacggcagcuccaugacuaaauguucaugcacccugacgagcccucccgggcuauggacaggaaccacuucuacccugaaggaucucgacacaucccacacugagaguccaaccccucaugauagcaauucgcacagaccccaacuucaggccuuuaucacagaggcaaaacugaacuuaccaacgaggaccaugacucggcaggacggcgaaacaggggauggagcuaaggagaauauugucuacuuguga

SEQ ID NO: 52970 - RNA, 2961 nt, Artificial Sequence
  derived and/or modified sequence opt3 from ARHGEF2__Homo_sapiens__NP_001155855
augagcagaaucgagucccugaccagggcccggauugaccgcucucgagaacucgcuucaaagacacgugagaaagaaaagaugaaagaggcaaaggaugccagauacacuaacggccaccuuuucacgaccauaagugugagcgggaugacaaugugcuaugcguguaauaaauccaucacugcuaaggaagcccugauuugccccaccuguaacgucacaauccauaauaggugcaaggacaccuuggcaaacuguacuaaaguuaagcagaaacaacagaaggccgcuuuacugaaaaauaacacagcacuacagucugugucgcuccggucaaagaccacgauucgcgagagaccuagcagugccaucuacccauccgauucuuuuaggcagagccugcuuggaucccggcgcggucgaucaagucugagcuuggcuaagucuguauccacuaccaauauagccggccacuucaacgacgagucaccgcucgggcugagaaggauccugagccaaaguacagauucucucaauaugcggaaccguacuuuauccguggaaagccugauugacgaggcggaagucaucuauucggagcuuaugucugauuuugagauggacgaaaaagauuucgcagccgacuccuggucauuggcuguggauaguagcuuucugcagcagcauaagaaagagguuaugaagcagcaagacgugauuuacgaacuaauccagaccgagcuccaccauguccgcacacugaaaauaaugaccagacuuuucaggacgggaaugcuggaagaguugcaccucgagcccggcgugguacagggucuguuuccuugcguugaugaauuauccgacauucacacucgguuccugucucagcuccuugagcgacgcagacaagcccuguguccagggagcacaaggaauuuugugauccaucgguugggagaccuacugauuucacaguucaguggccccuccgcagaacagaugugcaagaccuauagcgaguuuuguucucgccacucaaaagcucucaagcuguacaaggaacuuuaugccagagauaaaagguuccaacaguuuauccguaaggucacucggccugcggugcugaaacgacauggcgugcaggagugcaucuugcucgucacacagagaauuaccaaguacccacuguuaauaaguaggauccugcaacacagccacgggauugaggaggaacgccaggaccuaacgaccgcccucggacugguuaaagaacuuuuguccaacguggaugaggguaucuaccagcuggaaaagggcgcacggcuccaggagauauauaauagaauggaccccagggcucaaacaccuguaccagggaagggaccguucggccgcgaggaacugcuucgacggaaacugauucaugaugguuguuugcucuggaagacugccaccgggcguuucaaagacgugcuggucuuacugaugacagaugugcuaguuuuucuccaggagaaggaccagaaauacaucuuccccacucuggauaagccuucuguggucucgcuucagaacuugaucgugagagacauugcuaaucaagaaaagggaauguuucugaucagcgccgcaccacccgagauguaugagguacacaccgccuccagggaugaccgcucaacauggauucggguuauacagcagagugugagaaccugcccuucuagggaagacuucccacucaucgagacugaagaugaggcuuaccugcgacgcauuaaaauggaauuacagcaaaaggaccgggcgcuggucgagcuuuugagagagaaagugggccucuuugcagaaaugacgcauuuccaggccgaggaagauggcgggagcggaauggcucugcccacacuaccgaggggucuguuucguuccgagucacucgaaagcccucgcggcgagcggcugcuucaggacgccaucagagaggucgaaggguugaaggaucuguuagugggacccggcguugagcuccugcuuaccccaagggaaccugcacugcccuuggagccagacucuggugggaacacuucccccggcgugaccgccaacggagaagcucgaacauucaauggcaguaucgagcucugccgggccgauagcgacucuucccaacgcgauagaaacgggaaucagcugaggucaccucaggaggaagcacuacagcggcugguaaaccucuauggacugcuucacgguuugcaagcggcugucgcccagcaggacacccugauggaggcacgauuuccagaaggcccggagagacgcgagaaauuauguagggccaauagucgugauggggaagcuggacgggccggcgcagcucccguggccccugagaagcaggcgacugaacucgcccugcuucaaagacagcaugcucugcuacaggaggaacucaggcgcugccgaagacugggugaggagcgggcaacagaagccgggagcuuggaggcuaggcugcgcgaaucggagcaggcccgugcauuacucgaaagagaggcggaggaagcccggaggcaacuggcugcccuuggccagacggagccacugcccgcagaagcuccuugggcccgccgaccaguugaccccagacggagguccuugccggcaggagaugcccucuaccugucuuucaacccuccacagcccagccgcggcaccgacagacuagaccugccugugacuacaaggucaguccaccggaauuuugaggaucgugaacgccaagagcuugggagucccgaggaacgacuccaggacuccucugauccagacaccggaagcgaggaagaggguuccucaagacugagcccuccccacaguccaagggauuucacacggaugcaggacauuccggaggaaacugagucucgcgauggcgaagcuguggcguccgagagcuga

SEQ ID NO: 52971 - RNA, 2334 nt, Artificial Sequence
  derived and/or modified sequence opt3 from ARHGEF38__Homo_sapiens__NP_001229658
auggagcccaaggaagccaccggcaaagagaacauggugacaaagaaaaagaaucuggcuuuccucagaagcaggcuuuacaugcuggaacggcgcaaaacugacacggucguugaguccucugugucaggggaucacaguggaaccuugcgacguagccaguccgacagaacagaauauaaccaaaaguuacaggagaagaugacuccucagggugagugcucuguagcagaaacccugacaccagaggaagaacaucacaugaaaaggaugauggccaagcgggagaaaaucauuaaggaacuaauacagaccgagaaagauuaccucaaugaccuggaacuuugugugcgcgaggucgugcaaccgcugagaaacaagaagacugauagguuggacguugauucgcucuuuucaaauaucgaaagcgugcaucagauuagugcgaaacugcugucccucuuagaggaggcuacaaccgacgucgaacccgccaugcaagugaucggcgagguauuccugcagauuaaggggccucuugaagauaucuauaaaauauacugcuaucaccaugacgaggcacacucuaucuuggaaagcuacgagaaggaggaggagcugaaagaacaccuaucccauuguauucaaucacucaagaaaaucuauaugcaggagggaaagccaaaccugcuugauaugggcagucugaugauuaagcccauccagcggguuaugaaauacccuuugcuccugugcgaauuacgcaauagcacgccacccucucacccugacuaccgagcccuggaugacgcuuuugcagccgugaaggacauaaacgucaauauuaacgagcucaaaagaaggaaggaucuugugcugaaauauaagaagaaugacgaggaugaauccuugaaagacaagcuaucaaaacugaacauccauagcauuaguaagaaaucuaagcgggugacuaaucaccucaagauccugacccguggugagucccaggucaaagauaacacauucaaucgcgaagagaaacuuuuuagagcucuggagaaaacuguuagguugugugugaagaacaucagccucugccugcaacacauucaggacgccaugccauuagcgcugcagucgguaauggaucuacaagaaauaucuuacaacaaagacgaugagauggacuauuccgaaacccucucaaaugcacugaacaguugucaugauuucgccagccaccuucagcgguugauccugacaccgcucuccgcucugcuuucucuguuucccgggccucauaaguugauucagaagcgauacgacaaacuccuggacugcaauagcuauuuacagcgcucaaccggagaggaaagugaucuggccaagaaagaguacgaggcacuaaacgcucaacucguggaggaacugcaggccuucaaucaggcggccagaaagauccuuuugaacugucugugcuccuuuauaacgcuccugagggacuuaaugcuggucgcacagcaggcuuauagcacucuugugccaaugcccuugcucguuucuucaauuagugaaauccagaaucaggugcuggaggaaauccagaaccuaaauugugucaaagagaacagcgccacauucauugagcggaagcuguccuuugaaaagaagaagccugugcaaauccucccagagaugccccaccagaccgauauucaucgcucuaaacugcuuucgacuuacagcgcugaagaguuguaccaggccaagagaaaaugcaaugcaacacaggaauaugacauaaaccuguuagagggcgaucucguagccguuaucgagcaaaaggacccgcugggcuccaccucaagguggcuuguggauacggggaaugucaaaggauacguguauaguucuuuccugaagccuuacaaccccgcuaagaugcagaaagucgacgcggaaaaucguuuuugcgaugacgauuucgagaacauuagcuuguucguguccucacggccagcaagcgacucuguuaccgguacauccgaaaguagcaucggcgauucuuccucaagucucagcgggacuuguggaaaguuugagaccaacggcacagacguggacucguuccaggagguagaugaacaaaucuuuuaugccguccacgcuuuccaggcccgauccgaccacgagcugucucuacaggaauaccagagagugcauauucugagguuuugcgaucucagcgguaauaaagagugguggcuggcagaagcccaagggcagaagggauauguuccugcuaacuaccuuggcaaaaugacuuacgccuga

SEQ ID NO: 52972 - RNA, 1677 nt, Artificial Sequence
  derived and/or modified sequence opt3 from ARHGEF3__Homo_sapiens__NP_001122087
auggacagcuccaccgccaugaaccagugcucuuguagaggcauggaggaaaauaaggagaggcccaaacggcaacgccagaacaauuucccuauguuuccaucaccgaaggcuuggaacuuccgagggcguaaaagaaagcagaguacacaggaugaagacgcagugagccugugcucccucgauaucucugagcccucgaauaaaagggucaagccucuuucacggguuacuagccuggccaacuugauuccacccgugaaggcgacgccuuuaaaacgcuuuagucaaacccugcagagauccauaucuuucaggagcgaaucccggccagacauccuagcuccccgcccuuggucacgaaaugccgcaccaaguagcacaaagagaagggauucuaaacucugguccgagacuuuugacguaugugugaaccagaugcugaccucaaaggagauuaaacggcaggaagccaucuucgagcuuagccaaggagaagaggaucugauugaggacuugaagcucgcuaagaaagcauaccacgauccgaugcugaagcugaguaucaugacagaacaggagcucaaucagauauuugguaccuuagacucucugaucccccuucaugaagaguugcugucccagcuacgugauguccgcaaaccugacggcagcacugaacacguggggccaauucucguuggauggcugcccugccuuucgucuuaugauuccuacuguucaaaccaaguggccgcuaaggcccuguuggaccauaaaaagcaggaccacagaguccaggauuuccuccaaaggugccuggagaguccuuuuagccggaaauuagaccuguggaauuuccucgauaucccacgaucccgccuugugaaguauccccuguugcuaagagagauucugaggcauacaccgaacgacaauccugaucagcagcaccucgaagaggcgaucaacauaauucagggcaucguagcagaaauuaauaccaagacgggugagucugaaugucgguacuauaaagagcgccugcuuuaccuggaggaagggcaaaaggacagcuugaucgauucaaguagaguucucugcugucacggagagcugaaaaacaacaggggcgugaaguuacaugucuuucuguuccaggaagugcuagugaucacucgugccgucacccacaaugagcagcucugcuaucagcuguaccggcaacccauuccaguuaaagaccuuuugcuggaagaucuccaggacggcgaggugcgauuagggggaucccuuagaggugcuuuuagcaacaaugagaggauaaagaacuucuuccgcguaucuuuuaagaauggcucacagagucagacacauagccugcaagccaacgauacuuucaauaaacagcagugguugaacuguauccggcaggcaaaggaaaccgugcucugcgcugccgggcaagcgggaguccuggacuccgagggcucuuuucugaauccuacaaccgguucgagagaacugcagggggagacgaaacuagagcagauggaccaaagcgauuccgaaucagacugcaguauggauacuucugaggugagccucgacugugaaaggauggagcagacagauuccucaugcggaaacagccgccacggcgaaucuaauguuuga

SEQ ID NO: 52973 - RNA, 2073 nt, Artificial Sequence
  derived and/or modified sequence opt3 from ARHGEF4__Homo_sapiens__NP_056135
augcccugggaggaaccugccggcgagaagccaagcugcucccacucucagaaggcuuuccauauggaaccggcacaaaaacccuguuuuaccacagacauggugacuugggcccugcucugcaucucagcggagacggucagaggggaagcuccuagucagccaaggggaauaccccaccggagcccuguuuccguggaugaccuuuggcuggagaaaacccagcgcaagaaauugcagaagcaagcccauguagagcgacguuuacacauaggugcagugcauaaggauggcgucaaauguuggagaaagacaaucauuacuucuccagaaucgcugaaccuacccaggcggucacacccucucagccagagugccccaaccgggcugaaucacaugggauggccggagcauacacccggcaccgcuaugccugacggugcacuugauacugccgugugcgcugacgaaguuggguccgaggaggaucuguacgacgauuugcacucuagcucccaucacuauucacacccaggaggcggcggggaacagcucgccaucaacgagcugauuagugacggaagcguggucugugcggaagcacugugggaucaugugacaauggacgaucaggagcucgguuucaaagccggcgacguaaucgaaguuauggacgcuaccaaucgcgagugguggugggggagaguggccgauggagagggcugguuucccgcaucuuucgucagguuacgggugaaccaagacgaaccugcugaugacgaugccccacuggcggguaauuccggggccgaggacggaggcgcagaagcucagucaagcaaggaucagaugcgcacgaacgugauaaaugagauccuuaguacugaacgagacuacauuaaacacuugagagauaucugcgagggcuaugucaggcagugucggaagcgugccgacauguuuucugaggaacaacugcgcaccauuuucgggaacaucgaggauauauacagaugccagaaggcuuuuguuaaagcccuagaacagagguucaaucgggagcgaccccaucucuccgaacugggagcauguuuucuugagcaccaagccgacuuccagauuuauagcgaguacugcaacaaucauccgaacgcuuguguggaacugucgcgcuugacaaagcucucuaaauauguauacuuuuucgaggcgugcagacuguuacagaagaugaucgacauuucccuggaugguuuucuccuuacuccugugcagaaaaucugcaaguacccccugcaauuggcagaacuacugaaauauacccacccacagcacagggacuucaaggaugucgaggccgcucuccaugccaugaagaauguggcacagcugaucaacgagcggaaacgcagacuugaaaauauugacaagauagcccaguggcaaucaaguaucgaggauugggaaggcgaggaccuguugguuaggagcuccgaacucauuuacucuggggagcugacacgugugacccagccucaggcuaaaagccagcaacggauguucuuuuuauucgaucaccagcugaucuauuguaagaaagaccuacuccgaagagauguccuguacuauaagggaaggcuugacauggauggcuuggaggugguagaccuggaagaugguaaggaccgcgaccuccauguuucaauuaaaaacgccuuucggcugcacagaggggcaacgggcgauagucaccuucugugcacuaggaagcccgagcagaaacagcgcugguugaaggcguucgcucgagaacgggagcaagugcagcucgaccaggaaacaggauuuuccauuaccgagcugcaacguaaacaggccauguuaaacgcaagcaagcagcaggucacuggcaagccaaaagccguggggagacccuguuaccugacaaggcaaaagcauccugcucuaccaucuaaucgcccgcagcagcagguccucgugcuggccgagccccggagaaaaccuucaaccuucuggcacaguaucagcaggcuugcaccauuucgaaaguga

SEQ ID NO: 52974 - RNA, 4794 nt, Artificial Sequence
  derived and/or modified sequence opt3 from ARHGEF5__Homo_sapiens__NP_005426
auggaggccgaagaggcucagagaggcgcaagucccccuaucuccgccauugaagaguucucuauaaucccagaagcgccgaugaggucaagucaagugagcgcucuggggcucgaggcccaggaggacgaagaucccuccuacaaguggcgggaggaacaccgccuuucugcaacccagcagucggagcugcgagacgucugcgauuaugccauugagacaaugccuucauuuccaaaagaaggaagcgcugacguugagcccaaccaagaaaguuugguggcagaggccugugauacuccugaacauugggaggcuguaccacaguccuuagccggucgucaggcgagaacgcuggcacccccugagcuaugggccugcccaauccagucugaacaccucgacauggcuccguucagcuccgaucugggcucagaggaagaggaaguggaguuuuggcccgggcuuaccagucugacauugggaagcggccaagccgaggaagaggaagagacuucuuccgacaauucaggucagaccagguacuauagcccuugugaggagcauccagcagagacaaaccagaaugaagggagugagucuggaaccauucggcagggcgaggaacugcccccugaggaacuccaagagucccagggccugcuccacccacaggaaguccaaguguuagaggaacaggggcagcaggaggcuggauuccgcggugagggcacucugagagaagauguuugcgccgacgggcuuuugggagaggaacaaaugaucgaacaggugaacgaugaaaagggcgagcagaaacagaagcaagagcagguccaggacgugaugcuggguaggcagggggaacggaugggacuaacaggcgagcccgaaggccucaaugauggggagugggaacaagaggacauggagcgcaaagcgcagggacaggguggcccggaacagggggaggaacgaaagagagagcugcaaguaccugaggaaaacagggccgacagccaggaugagaagucgcagaccuuucuuggaaaaucugaagagguuacgggcaagcaagaagaccaugguauaaaagagaagggggugcccgucuccggccaggaggcaaaagaaccagagucaugggauggaggccggcugggggcugugggacgugcccgcaguagagaagaggaaaaugagcaccacgguccuagcaugcccgcuuugaucgccccagaggacuccccucauugugaucucuuccccggcgcaucuuaccugaugacucagauuccagggacccagacagaaagcagggccgaggaauuaucaccggcugcgcugagucccucccucgagccuauccggugcagccaccaaccaauuucucuucugggaucauuuuugacugaagagagucccgacaaggagaucgaucagaacagccagcaggaagagucccgacuacgcaagggcaccgugucuucgcaagguacagaagucguuuucgcaagcgccuccgugaccccuccaagaacgcccgacucagcuccgccuaguccagccgaggcauaucccauaacuccugccucuguaagcgcuaggcccccaguggccuuuccucggcgcgagacauccugugcagcgagagcucccgaaaccgccucagcaccacugagcauggaugacccgucuccuugcgggacuuccgagaugugucccgccgcucucuacggcuucccaaguacaggaaccucucccccuaggccacccgccaauucuacgggcaccguccagcaucugcguuccgauucauuuccugggagucaccggacagaacagacuccggaccuugugggaaugcuguugagcuauucgcacuccgagcucccacagcgacccccuaaaccagcaauuuacucuagcguuacccccagaagggaccgccggucagguagagauuacaguacaguguccgcuucuccuacugcccugagcaccuuaaagcaagacucccaggaaucaaucagcaaccuggagaggccgaguucucccccauccauucagccuugggucagcccccauaauccagcguucgccacagagucgccugcuuauggcucaucucccaguuuuguguccauggaagauguacgcauccacgagccacuaccgccucccccaccccaacgacgggacacccauccuagcguuguggaaacugaugggcacgcacgugucguggucccaacgcucaaacagcauucucaucccccuccgcuggcccuuggaagcggcuugcacgcuccacacaaggguccccugccucaggccuccgaccccgcaguggcgagacagcacaggccacucccuucaacacccgauaguagccaucacgcccaagcuaccccacgcuggcgguacaacaaaccucugccgcccacuccagaccuuccucagccccaucugccaccuaucucugcccccggguccucaagaauuuauaggccguugccaccucuccccauaaucgauccacccaccgagccuccgccccugccaccuaagagucgaggccgcagccgguccacaagaggaggccacaugaacucugggggacacgcaaaaaccaggcccgcuugccaggacuggacuguuccuuuaccagccucggcaggccguacaagcuggcccccugccacggcucgcucaaccgaauccuucacuagcacaucucggagcaaguccgaggugucaccagguauggcguucucuaauaugaccaauuuucugugucccagcaguccgacaacuccuuggaccccagagcuacaggggcccacguccaaggaugaagccggaguaagcgagcauccugaagcaccagcuagagagccccucaggcgaaccacaccgcaacagggcgccucugguccuggccggucacccgucgggcaggcccgccagccagaaaaaccuucccaucugcaccuugagaaggcuaguagcuggccccacagaagggacucgggacggccacccggcgauucuuccgggcaagcaguggccccuagcgagggagcgaacaaacacaagggcuggucacgacaggguuugagacgcccaaguauucugccggaagggucuuccgacagcaggggacccgcuguugagaaacauccuggcccaucagacacuguggucuuccgugaaaagaagcccaaagaggugauggguggcuuuagucggagaugcagcaagcucaucaacuccucucagcuguuauaccaggaguauagcgauguagugcugaauaaagaaauacaaucccagcagaggcuugagucauugucugaaaccccugggccaaguucgccccgccaaccucgaaaggcccucguuagcuccgagucuuaccugcagagacuaucaauggcaagcuccggaagucuguggcaggaaauuccggucgugcggaacucuacagugcuccugagcaugacucacgaggaccagaaacuucaagaggucaaguucgaauugaucguuucagaggccuccuaucugaggaguuuaaauaucgcuguggaucauuuucagcucagcaccucucugcgcgcaacgcuuuccaaccaggaacaccaguggcuguucucacguuugcaagacgugagagauguaagcgccacauuucucucggaccuggaggaaaauuucgagaacaauauuuuuagcuuccaggucugcgaugugguucuaaaccaugcgccagacuuucggaggguguaccugcccuacgucaccaaucagacuuaucaggagcgcacauuccaaagucucaugaacuccaauagcaacuuucgagaagugcuggagaaacuugaaucagauccuguuugucagagauugucccugaaaucuuucuuaauccuccccuuccagcggauuaccaggcugaaacuucugcuacaaaauauacucaagcgcacucagccaggcagcagugaggaagcugaggccaccaaggcacaccacgcccuggagcaguugaucagagacugcaacaauaacgugcaguccaugaggcggacagaggaacugauuuacuuaagccaaaagaucgaauuugaguguaagaucuucccucucauuucucagucacguuggcugguaaagaguggggagcuuacggcucuggaauuuuccgccagccccggauugcgccgaaaacucaacaccagaccaguccaucugcaccuauucaaugauugccugcuucucucuaggccgcgggagggcucgcgcuuucugguguucgaccaugcaccuuuuucaagcauaagaggugaaaagugugagaugaaauugcacgggccccacaagaaccuguucagguuauuucuccggcagaauacucagggagcucaagccgaguuccuguuucgaacagaaacccaguccgagaaacuuagauggaucagugcgcuggccaugccacgcgaagaguuggaucuccuggaaugcuauaacucuccccaggugcagugucuaagggcauacaagccucgggagaaugacgaacuggcucuugagaaagccgacgucguuauggugacacaacagagcuccgauggcuggcucgaggguguacgucugucagacggcgaaagagggugguucccagugcagcaggucgaguuuauuaguaaccccgaagugagggcucaaaauuugaaggaggcacaucgcguuaagacugccaaauuacagcugguggaacagcaagccuga

SEQ ID NO: 52975 - RNA, 2331 nt, Artificial Sequence
  derived and/or modified sequence opt3 from ARHGEF6__Homo_sapiens__NP_004831
augaaccccgaggaacagaucgugaccuggcugauuagccucggcguccuugaguccccuaagaaaacaauaugcgacccagaagaguuccugaagucuucauugaaaaaugggguuguguuauguaagcugaucaacaggcuaaugccgggaaguguagaaaaauuuugccucgauccccaaacugaggccgacuguauuaauaacaucaaugauuuccugaaggguugcgcuacgcuucagguggagauuuuugacccugaugaccuguacagcggcgucaacuucuccaagguguugucuacccuccuggcaguuaauaaagccacagaagaucagcugucggagaggccaugugggcggucaagcagucucuccgcggcuaacacuucucagaccaauccccaaggagccgugagcuccacagucucaggcuuacagcgccagaguaagaccguggaaaugacugagaacgguagccaccagcugaucguaaaagcacgauuuaauuucaagcaaacaaacgaggacgaacuuucuguuugcaaaggggauauaaucuaugugacccgugucgaggaaggaggcuggugggagggcacguugaaugggagaacuggaugguuuccuuccaacuacgugagggaaauuaagucaagcgagcggccacugagucccaaggccgugaaagguuucgagaccgcuccucuaacaaagaauuauuacacugucguucuccagaacauccuggacaccgaaaaagaguaugcaaaggaacuucagucucuguuggugacauaccuccgcccacugcaguccaacaauaacuuaagcaccguagaggugacgucgcugcucggcaauuuugaagaggucuguacuuuccaacagacacuuugccaggcccuggaggaauguucuaaauuuccggagaaccaacauaagguugggggaugcuugcuaucccugaugccccacuucaaaucaauguaucucgcuuacugugccaaucauccuagugcggugaacgugcugacccagcacagcgaugaacuugagcaguuuauggaaaaucagggcgcauccucuccagguauucugaucuugacuacaaaccucagcaagcccuucaugagacuggagaaguacgucaccuuacugcaagagcuagaaaggcauauggaggacacgcacccugaucaccaggacauacucaaagccauuguggcuuucaagacccugauggggcagugccaggaccuucggaaacgcaagcaauuggaacugcagauccucucagagccaauucaggccugggagggagaagauaucaaaaaucugggcaacguaaucuuuaugagucagguuauggugcaauauggcgcaugcgaggaaaaggaggaacgauaccuuaugcuguucuccaaugucuugauuaugcucagcgcuucucccagaaugucaggguuuauauaucagggaaagaucccgauugccgguacaguggucacuaggcuggacgagaucgagggcaacgauuguaccuucgaaauaacagggaauacuguggagcggauuguugugcauugcaacaauaaccaggacuuucaggaaugguuagagcaacugaaccgucuaauccgcggaccugcgaguuguagcucccucucuaaaaccucgagcuccucaugcagugcccacucuagcuucuccucaacaggccagcccagagguccacuggaaccuccccagaucauuaagccauggagccuuucuuguuugaggcccgcaccuccacugcggccguccgcugcccucggguacaaagagcgaaugaguuauauccugaaggagagcucuaaaucccccaagaccaugaagaaauuuuuacauaagcgcaaaacugaaagaaagccuucagaggaagaguacguaauuaggaaaaguacggcugcccuggaagaggaugcacaaauacuuaaggucaucgaggccuauugcacaagcgcuaauuuccagcagggccacggaucguccacccggaaggacucuauuccacagguguugcuccccgaagaggaaaaacugaucaucgaggagacucgcagcaacggccaaaccauuauggaagagaagagucuaguugauacaguguacgcgcugaaagacgaagucagagagcucaagcaggaaaauaaaaggaugaagcagugucuggaggaggaacuuaaaucacgucgggauuuggagaagcuggugcgaagauuacucaagcagaccgacgaaugcauaagaggggaguccucuagcaaaacuuccauccugccuuga

SEQ ID NO: 52976 - RNA, 2412 nt, Artificial Sequence
  derived and/or modified sequence opt3 from ARHGEF7__Homo_sapiens__NP_001106983
augaacagcgccgagcagaccgugacauggcugaucacucucggcguccuugaaucccccaagaaaacgauuucugacccugagggguuccugcaagccucauugaaggauggaguuguguuaugcagacugcuagaaaggcuccugccagguaccauagagaaaguauacccggaaccccggagugagagcgagugucuuuccaauauccgcgaauuucugcgaggcugcggggcaucuuugcgucucgagcugcuguucccuccaucgcagcccccucagcaccucgugacaacuauuuuacugucagccagcaccuuugacgcgaacgaucuuuaucagggacaaaauuucaacaaggucuugaguucccuggugacacuaaauaaaguuaccgcugacaucggccucgguucugauagcgugugugccagaccauccucacauaggauuaagaguuuugacagccuggggucucagucccuucacacucggacaucaaagcuguuccagggacaguaccgcagcuuggauaugaccgacaacaguaauaaccaacucgucgugagagcaaaauuuaauuuccagcagacgaacgaagaugagcugucuuuuuccaagggcgacguaauccauguuacuaggguggaggaaggcggguggugggagggaaccuuaaauggucggacaggcugguuccccagcaacuauguccgcgaagugaaagccucggagaagccugugucuccaaaauccgggacucugaagucaccgcccaagggauuugauaccacagcuauaaauaaaaguuacuauaacgucguucuccagaauauccuugaaaccgagaacgaguacagcaaggaacugcaaacgguguuguccacuuaucuacgaccucugcagacaucugagaaacucagcucagcaaacauuaguuaccugaugggcaaucuugaagagaucugcuccuuccagcaaaugcugguacagagcuuggaagaguguaccaagcucccagaggcccagcagagagugggugggugcuuucugaacuuaaugccccaaaugaaaacucuguaccuaacauauugugcuaaucacccuucugccgucaacgugcucaccgaacauucagaggaacugggagaguucauggaaacgaagggcgcgaguagcccaggcauucuuguuuugaccacagggcuguccaaacccuucaugaggcucgacaaguacccgacucugcuuaaggagcuggagcggcacauggaagauuaucacaccgaccgucaggacauccagaaaucuauggcagccuuuaagaauuugucggcucagugccaagaggugcgcaaaagaaaggaacucgagcugcagauauuaacagaggccauuaggaacugggaaggagaugacaucaaaacucuggguaaugucaccuacaugagccaggugcuaauucagugugcaggcuccgaggaaaagaacgagcgguaucuccugcuuuucccuaauguauugcugaugcucucagcuaguccccgaaugucuggguuuaucuaccaaggaaagcugccaacaaccggcaugacuaucacgaaauuagaagauagcgagaaccaucgcaaugccuucgagauuuccgguucaaugauagaaagaauccugguuagcugcaacaaucagcaggaccuucaggaguggguggaacacuugcaaaagcagacaaaagucaccucuguggggaacccuacuauuaagccccauuccgucccaagucacacccuccccagccacccugugacaccaucuuccaaacaugcggauucaaagccggcuccccugaccccugcauaucacacucuaccacaucccagucaccauggcacaccucacacgaccaucaauuggggaccacuggagcccccgaagacuccuaaaccauggagccucucgugucugaggcccgcuccuccccuucggccauccgccgcuuugugcuacaaggaagaccugucuaaaagcccuaagacaaugaaaaaguuacuccccaagcgcaaaccagagagaaagccgucagaugaggaauuugccaguaggaaauccaccgcagcccuggaggaagacgcucagauacuuaagguuauugaggcguacugcacaucugcaaaaacucgucaaacccugaacagcacguggcagggcaccgauuugaugcacaaccaugugcucgccgacgaugaccagccuucccuggacucacuagggcggcgaagcagucugucuagacucgaacccuccgaucugagcgaggacucggauuaugacucaaucuggacagcucacucuuacaggaugggaaguacuucccgcaagagcuguugcucuuauaucagccaucagaauuga

SEQ ID NO: 52977 - RNA, 1392 nt, Artificial Sequence
  derived and/or modified sequence opt3 from ARHGEF9__Homo_sapiens__NP_001166950
augcaguggaucagaggcgggagcggaaugcugugggugaaccaagaggacgaagucgaggaaggucccuccgauguucagaauggccaccucgacccuaacucugauugccuuugucuggggaggccauugcagaaucgggaccagaugcgcgccaacgugauuaaugagauaaugucaaccgaacgacauuacaucaagcacuuaaaagauauuugcgagggauaucugaagcaaugucguaaaagaagggacauguucagugaugagcagcuaaagguaaucuuuggcaacauugaagacaucuaccgguuccagauggguuuugugcgcgaucucgagaaacaguauaauaacgacgauccgcaucugagcgaaauagggcccugcuuccuugagcaccaagacggauuuuggaucuacuccgaguauuguaauaaccaucuggaugcuugcauggaauugucuaagcucaugaaggacucgagauaccagcacuucuuugaggcauguaggcugcugcagcagaugauugacaucgccauugauggcuuccucuuaacaccuguccagaaaaucugcaaguauccacugcaacuugcggaauugcugaaauacacugcucaggaccacucagauuaccgguauguggccgcagcccuagcuguuaugcgcaaugugacgcaacagauaaacgagcgaaagagaaggcucgaaaauauugacaaaaucgcacaguggcaggccagcguccuggauugggagggcgaggacauucuugaucggaguuccgaacugaucuacaccggggagauggcuuggaucuaucaacccuacggacguaaccagcagcgcguguuuuucuuguuugaccaucagaugguacucuguaagaaggaucugauuagaagggacauauuauauuacaaaggucggaucgauauggacaaguaugaaguuguggacauugaggauggccgagacgaugacuucaaugucucuaugaaaaacgccuuuaagcugcacaacaaagaaacagaggagauccaucucuucuucgcgaagaaacuugaagagaagauacgcuggcugagagcauuuagggaggaacggaagauggugcaagaagaugagaaaauuggguucgagaucagcgaaaaucagaagcgccaggccgcuaugacugugagaaaagucccuaagcagaaaggaguuaacuccgccaggucagugccacccaguuacccuccaccgcaagaccccuugaaucacggccaguaccuaguaccugaugguaucgcacagagccagguguuugaguucaccgaaccaaagcguucucaaucccccuuuuggcagaacuucucacggcugacaccuuuuaagaaauga

SEQ ID NO: 52978 - RNA, 2763 nt, Artificial Sequence
  derived and/or modified sequence opt3 from AR__Homo_sapiens__NP_000035
auggaggugcagcugggccucgggagagucuaccccaggccuccaagcaagaccuaucggggagccuuccaaaaccuuuuucaguccguucgcgaagugauccagaauccggguccccgacacccugaggcugcaucugccgcgccacccggcgcuucacuguuguuacugcagcaacagcagcagcaacagcagcagcaacagcagcaacagcagcagcaacagcagcagcaacagcaggaaacaaguccucgucagcaacagcagcagcaaggggaggacggaagcccacaggcccauagaaggggccccacugguuaccuaguacucgaugaggaacagcaaccuucccagccacagucugcacuggagugccacccggaacgggggugugugcccgagccuggagccgcugucgcagccucgaaaggccuuccacagcaacugcccgcuccuccagacgaagaugacucagccgcgcccagcacguugagucuccugggcccgaccuucccugggcuguccucuugcagcgcagaucucaaggacauuuuauccgaggccucaacaaugcagcugcuucagcagcaacagcaggaggcugugagugaaggaagcagcuccggucgcgccagagaggcaucaggcgcucccacuagcaguaaagauaacuaucuugggggaaccucuacaauauccgacaaugccaaggaacuguguaaagcgguuagcgugucgaugggccuaggugucgaggcccucgaacaucugucuccaggggagcagcuuaggggagauugcauguacgcaccucuguugggcgugcccccagcuguacggcccaccccuugugccccacucgcugagugcaagggcucccuguuagacgauucagccgggaagaguacugaagacacagcagaguauagcccguuuaaaggagguuacaccaagggccuggaaggggagucccucggauguucuggcagcgccgcugcggguucaagugggacgcuugaacugcccuccacuuugagccuauauaaaucuggcgcacuggaugaggccgcugccuaccaaucacgcgacuacuauaacuucccucucgcacuggccggaccacccccuccacccccgccuccacacccccaugcucgaaucaaguuggagaauccucuggacuacggcagugccugggcagcggcugccgcacagugcagauauggggauuuggccagccuccacggagcuggugccgcaggccccggguccggaucuccaucggcugccgcgagcuccucauggcacacccuguuuacagccgaagagggccaguuauacgguccuugugggggcggaggcgggggagguggcgggggaggcggugggggcggaggcgggggaggcggugggggaggcgaagcuggugcaguugcccccuauggcuacacuaggccaccgcaagggcuggcuggacaggagagugacuucaccgccccugaugugugguaucccggcgggauggucucucgggugccauaccccagcccuacaugcgugaaauccgaaaugggaccauggauggacucauacagcggccccuauggugauaugcgucuagagaccgcacgcgaccauguccucccuauugauuacuauuuuccgccacagaagacgugucugaucugcggggacgaggcgucuggaugccacuacggcgcccuuacuugugguuccugcaagguuuucuuuaaaagagcugccgaaggcaagcagaaauauuugugugcaaguaggaacgauugcacaauugacaaguuccggcgaaagaauugucccagcugccgccugagaaaguguuacgaggcugggaugacccucggagccaggaaacugaagaaacuuggcaaccugaaauugcaagaagagggggaggcaucuuccacuacaucaccuaccgaagagacgacccagaagcucacagugagucauaucgaaggauaugagugccagccaauauuucugaauguauuagaagccaucgagcccggcguggucugugcuggucacgauaacaaucagccugacagcuucgcggcccugcuaucgucccucaacgagcugggggaacggcaacuugugcacguugugaaaugggcaaaggcuuugccgggauuucgcaaucugcaugucgacgaucagauggccgugauucaguacucuuggaugggccucaugguauucgccauggguuggagaucuuucacuaacguuaauucaaggaugcuguacuuugcucccgacuuaguguucaacgaguaucguaugcacaaaagucggauguacucccagugcguccgaaugagacaucugucucaagaauuuggcuggcuucagaucaccccacaggaguucuuguguaugaaggcacuccugcuauuuagcauuaucccuguggaugggcugaagaaccagaaauucuuugacgaacucaggaugaauuauauaaaggagcuggaucgcauuaucgccugcaaacggaagaaccccacauccugcucaagaagguucuaccaacuuacuaaauugcuggacagcguccagccaauugcgcgcgaguuacaccaguuuaccuucgaucuccugaucaagagucauauggugucuguugacuuuccugaaaugauggcugagaucauuuccgugcaaguacccaagauacuuagcggaaaagucaagccaaucuauuuccacacacaguga

SEQ ID NO: 52979 - RNA, 6711 nt, Artificial Sequence
  derived and/or modified sequence opt3 from ARID1B__Homo_sapiens__NP_059989
auggcccacaacgcuggcgcagccgcggcugccgggacccauagcgcaaaguccggagguucugaggccgcucugaaagaaggcgggucagcagccgcucucaguagcuccucuucgucaagcgccgcggcagccgcugccaguuccucuagcuccucaggacccggcagugcaauggagacaggucuucugccuaaucacaaguugaaaacugugggggaagcuccagccgcgccgccccaucagcaacaccaucaccaccaucacgcccaucaccaccaucaccaugcacaccauuuacaccaccaucacgcucugcagcagcagcuaaaccaauuccagcagcagcaacagcagcagcaacagcagcaacagcagcagcaacagcagcagcauccuaucagcaauaacaauucucucggaggcgccggcgggggagcuccacaacccgguccugacauggagcagccacagcacggcggggccaaggauuccgcagccggaggccaggcugaccccccugguccaccgcugcuuucaaaacccggggaugaagacgaugcgccuccaaagaugggagagcccgcaggcggcagauacgagcacccugggcugggagccuuggguacgcaacagccacccgucgcuguuccgggcgggggaggcgguccugccgcagugcccgaauuuaacaauuauuacgggagcgccgcuccagccaguggcggaccuggcgggagggcaggacccugcuucgaccagcaugguggccagcaaucuccagggaugggaaugaugcacuccgcgagcgcugccgcagccggcgcucccgguucgauggauccucuccagaacucucaugagggguauccaaauucccaguguaaccacuacccgggcuauucacggcccggagccggcgggggagguggcgggggaggcggugggggcggaggcagugggggaggcggugggggaggcggugcaggcgcugggggagccggcgcgggggccguagcugcagccgcugccgcagcggccgcugccgcaggaggcggugggggaggcgguuacggcgggagcuccgcuggauauggcgugcugucuagcccucgccaacaggggggaggcaugaugauggguccagggggaggcggugccgcaucacugaguaaggccgcugcgggcuccgccgcagggggauuucagcgauucgcuggccagaaucaacaucccagcggggccaccccuacacucaaccaguuacugacuucuccaucacccaugaugcguaguuacggaggcagcuacccggaauauuccucuccuucggccccacccccucccccaagccagccucagucccaagcugcagccgcgggugcugccgcagggggacagcaggccgcugcaggcaugggccuugggaaagacaugggagcccaguacgcggcugccucacccgcaugggccgcugcccaacagagaagucacccagcaaugucuccggguaccccuggccccacaauggggaggagccagggauccccaauggaucccauggucaugaagcggccucaauuguauggcauggguucaaauccacacagccagccccagcagucuuccccuuacccggggggaaguuauggcccacccggcccucaacgcuacccaauugggauacagggaagaacccccggugcuauggccggcaugcaguauccucagcaacagaugccgccccaguacgggcagcaaggagugagcggcuacugccagcagggucagcaaccauauuacucucagcagccucaacccccacaucugccuccccaggcgcaguaucuaccaucccagucacaacagagguaccagccgcagcaagacaugagucaggagggguauggaacucggagccagccuccccucgccccaggcaaacccaaccacgaggaucugaaucuuauccagcaagaacgcccuucgucccugccagacuugucuggcagcauugaugaccuccccacagggaccgaggcaacgcugucaagugcuguuuccgccucuggaagcacuuccucacagggugaccagagcaacccugcucaaaguccguuuucuccacaugcauccccccacuuaagcucgaucccuggcgggcccucaccaucuccugugggaagucccgucggcuccaaccagagccgaucugguccaauuagcccugccuccaucccggggucacagaugcccccacagccucccggaagucaaagcgaaucuuccucacauccagcccugagucagagcccuaugccccaggagagaggcuucauggcuggcacccagaggaauccgcaaauggcgcaguacgggccacagcagacaggaccuuccaugucuccccacccaucgcccgguggccaaaugcacgcagggauaagcucauuucagcaguccaacaguucuggaacuuauggcccucagaugagccaauacgguccgcaggggaauuacucccggcccccagccuauucaggagugccuucugcuagcuacaguggccccggcccugggaugggaaucuccgccaacaaucagaugcauggucaaggcccaagccagcccuguggggcaguaccucucggacguaugccaucugccggcaugcagaaccgccccuucccggguaauaugucauccaugaccccuaguagcccagggaugucgcagcaaggcggacccggcauggggccuccaaugcccacaguuaacagaaaggcucaggaagcggccgcagcugugaugcaggccgcagccaauucugcucaguccaggcaaggaagcuuuccggguaugaaccagucaggccuuauggccaguucuuccccuuauagccagcccaugaauaacucaaguagccugaugaauacccaggcgccaccuuacuccauggcacccgccauggucaacucuagcgcugccuccgugggguuggcugauaugaugucaccaggagagucuaaacuaccccugccucucaaggcagacggcaaggaggaagguacgccacaaccggagaguaaaucgaagaaaagcuccucuucaacuacaaccggggaaaagauuacuaaaguguaugagcugggcaaugaacccgagcggaagcuuugggucgaucgauaccugacauucauggaggaacgcggaagcccuguuuccaguuugccagccgugggcaaaaagccccucgaccuguuuagauuauauguaugcgugaaggagaucgggggacuggcucaggucaacaaaaacaagaaauggagggaacuagccaccaaucucaacguggguacgucuagcucagcagcguccagucugaagaaacaguacauucaauaccuuuucgccuuugaguguaagaucgaacggggcgaggagccuccacccgaaguuuucagcaccggggauacaaagaaacagccuaaguugcagccgccaucucccgcuaauuccggaucacugcagggcccucaaacuccccagagcaccgguucgaacucuauggccgaggugccaggggaccucaaaccucccacaccagcaaguacuccgcacggccagaugaccccuaugcagggaggccgcuccagcacaauaucaguccaugaucccuucuccgacgugucugauagcaguuuuccaaagagaaauuccaugacccccaacgcuccuuaucaacaggggaugagcaugccagacguaaugggaaggaugcccuacgaaccuaauaaagauccguucggcgguaugcguaagguuccagggucuucagagcccuuuaugacucagggacagaugccuaacaguuccaugcaagacauguauaaucagagcccaucuggcgccaugucgaaccuggguaugggccagcggcaacaguuccccuacggggcaucauaugaccgaagacacgagccuuacggacagcaguaucccggccaagggccaccgagcggacagccucccuacggcggucaccagccagggcuuuacccucagcaacccaauuauaagaggcauauggauggaauguacggcccaccugccaaacgccacgaaggugacauguauaacaugcaguacuccagucagcagcaagagauguauaaucaguacggcgggucuuauagcggacccgaucggagaccgauucagggccaguacccauacccuuauuccagggaacgcaugcaagggcccggacagauccagacgcauggcauuccaccccaaaugaugggugggccucugcagucaaguucuagcgagggaccgcagcagaacaugugggcugcgcgaaaugacaugccauaccccuaucaaaaccggcagggcccuggcgggcccacacaggccccaccuuaccccggaaugaaccguaccgaugacaugauggugccagaucagagaaucaaucacgaaucccaauggccuucacaugucagccagaggcagccguauaugucuuccagugcaagcaugcagcccaucacucgcccaccucaacccucguaccagaccccaccuuccuugcccaaccacauuucucgggcuccgucaccagccagcuuucagagaagucucgagaauaggauguccccuucuaagagccccuuccugccaucaaugaaaaugcaaaaggugaugcccacagucccuaccucccaggugacuggucccccaccucagccgcccccaauacgacgcgagaucacauuuccucccggcaguguugaagccagccagccaguguuaaaacaacggagaaagauuacgucuaaggacaucguaaccccugaggcauggagggucaugaugucacugaaauccgggcuacucgcugaaagcacuugggcccuggauacaauaaacauucuuuuguaugacgauucuaccguggcgacauucaaucugagucagcucucgggauuucuggaguuacugguugaauacuuccguaagugccuuaucgacaucuuuggcauuuugauggaguacgaggugggugaucccucccagaaagcucucgaccacaacgccgcacgcaaggacgauagccagucacuggccgacgauucugggaaagaagaggaagacgcugaguguaucgaugacgaugaagaggacgaggaagaugaggaagaggacagcgagaagacugaauccgaugagaaaaguucaauugcacuaaccgccccggacgcggcugccgauccuaaggaaaagccaaaacaagcaucuaaguucgacaaacugcccauaaagaucgucaaaaagaauaaccucuuugugguagaccggagcgauaagcugggaagagugcaggaguucaauuccggccuuuugcauuggcagcugggcgggggagacacgaccgaacacauucagacacauuucgagaguaaaauggagaucccuccaaggcgacggcccccuccacccuuaagcuccgccggucgcaagaaagaacaagagggcaagggggauucugaagagcagcaggaaaaaucaaucauugcuacuauagacgauguucucagcgccagaccgggagcacugccugaggacgcuaaccccggcccacagaccgagucguccaaguuucccuucgguauccaacaggccaagagucacaggaauauuaaacuucuggaagaugagccucggucucgagacgaaacaccauugugcacuaucgcgcacuggcaggauagccucgccaagagauguauuugcgucucaaacaucgugcgcucccugucuuuugugcccgggaaugacgcagagaugaguaaacauccuggacuaguccugauacucggcaagcugauccuuuugcaccaugaacacccagagaggaaacgugcuccgcaaaccuaugagaaggaagaggaugaagacaagggcguugccuguagcaaagacgagugguggugggauugccuggagguguuacgggacaacacgcucgugacacuggcaaauauuuccgggcagcuugaucugucagcuuacaccgaaagcaucugccuacccauucucgacggacuguugcauuggaugguauguccuucugccgaggcccaggauccauuccccacugucgguccuaacagugugcuguccccacagagauuaguucucgaaacacugugcaagcuuagcauccaagacaacaauguggaucugauauuggcgacccccccguuuucaaggcaggagaaauucuaugcuacucucguccgcuacgugggcgaccgaaagaacccuguuuguagagaaaugucuauggcacugcuauccaaucuggcccagggggaugcucuugccgcacgggccauugcugugcagaaaggaucgaucggcaaccucauuagcuuucuggaggacgguguaaccauggcgcaauaucagcagagucagcacaauuugaugcacaugcaaccacccccucuggagcccccaucugucgauaugaugugcagggccgcaaaggcuuuacucgccauggcacgcguggacgaaaaccguuccgaguuccugcuucaugaagggagacuguuggauaucagcauaucagccgugcucaauagucuggucgcuuccguuaucugugacgugcuauuucagauuggacagcuguga

SEQ ID NO: 52980 - RNA, 5508 nt, Artificial Sequence
  derived and/or modified sequence opt3 from ARID2__Homo_sapiens__NP_689854
auggccaacagcaccggcaaggcucccccugacgagagaaggaaagggcuggccuuccucgaugaacuucggcaguuucaccauucccgcggaucuccauucaagaaaaucccggccguggguggcaaggagcuggacuugcacggguuauacacacgagucacuacgcugggaggcuuugcgaaaguuucagaaaagaaucaauggggugagauuguggaagaguucaacuuuccccguaguugcagcaaugcugccuucgcauuaaagcaguauuaccucagauaucuggagaaauacgaaaagguacaucacuuuggggaggaugacgaugaagugccuccaggaaaccccaaaccucagcuuccaauaggcgccauccccuccucuuauaauuaccagcaacauucggucucagacuaucugaggcagagcuacggcuugaguauggauuucaacuccccuaaugacuacaacaagcucgugcugucucugcucagcggguuaccaaaugagguugauuuugcuauuaacguguguacccugcuuuccaaugagucaaaacacgucaugcaguuggaaaaggacccgaagaucauuacacugcuacucgcaaacgccggaguguucgaugacacucuggguaguuuuagcaccguauucggcgaggaauggaaagagaagacagaucgggacuuuguuaaauucuggaaggacaucguggaugacaaugaaguccgcgaucuuauaucugacagaaacaaaucccacgaggggaccucaggagaguggaucugggaaagccuguuccaucccccuaggaaguugggcauuaaugauaucgagggucagcgggugcuccaaauugcugugauccugcgcaacuuaaguuuugaagaggggaacgucaaacugcucgccgcgaaucgaacuugccuuagauuccuguugcuaucugcacacucccauuuuauaagccugaggcagcucggacuggacacacuuggcaacauugccgcugaacuguugcucgauccaguugacuucaagaccacgcaccugauguuucacacugugaccaaguguuuaaugucgcgggaucguuuccugaaaaugcgcggcauggagauccuagggaaucucugcaaggccgaggacaacggaguacugauuugugaauauguggaucaggacucuuacagagagaucaucugccaucuuacauugcccgacguccugcucgugauuuccacucuggaaguucuuuauaugcugaccgagaugggugauguggcauguacaaaaauagcuaaggucgaaaaaucaaucgacauguuggugugccucguaaguauggauauucagauguuuggcccugacgcccuggcggccguuaaguuaaucgagcacccaagcuccucucaucaaaugcugagcgagauaaggccccaggcaauugaacaggugcaaacccagacgcacgucgcuucagccccggcuagucgggccguggucgcacagcauguggccccucccccagggaucguugagaucgauuccgaaaaguucgcuugucaguggcuaaaugcgcacuuugaggugaacccugacugcagcguaucucgagcagagauguacucagaauaucucaguacuuguagcaaacuggcccgcggaggcauucuuacauccaccgguuucuacaagugcuugagaacugucuuucccaaucacacagugaaaaggguugaggauucuucgagcaacgggcaagcucauauccacguggucggcgugaagcggcgcgccauuccacugcccauacagauguauuaccagcagcaaccuguauccaccucagugguuagagucgacagugugccagaugugucuccggcacccagcccugccggaaucccacauggcucccagacgauugggaaucacuuccagaggacccccgucgcuaaccagucaagcaaucucacagccacucaaaugucuuuuccuguucagggagugcacaccguggcacagacaguaucccguaucccacagaaccccaguccgcauacucaccaacagcagaaugcgccugucaccgugauccaaagcaaagcuccaauucccugcgaaguugugaaggccacagucauacagaacucuaucccucagaccggugugcccguuuccauugcagugggcgggggaccaccucagucaaguguaguccaaaaucauagcacuggcccccagccagugacgguggucaacucgcagacacuguuacaccauccguccguuaucccucagcaaucuccccugcacaccgugguaccaggucagauucccagcgggacuccugugaccgucauccagcaggccgugccacaaucacacauguucggccggguucagaacauacccgcuuguacaaguaccgugucccagggacaacagcuuaucacuacaucuccucagccgguccagacgagcucccaacagaccucagccggcagccagagucaggacacugugauuaucgcaccaccccaauacguuacaaccucugcuuccaauauugugagcgccacaucgguccagaacuuccagguagcgacugggcagauggugaccaucgccggaguuccuucaccacaggcuucucgaguggguuuucagaauauagcacccaagccuuugccgagucagcaggucuccagcacggugguacaacagcccauucagcaaccacagcagccuacccagcaaucuguggucaucguuagccagcccgcccagcagggccaaacauaugcuccagccauucaucagaucgugcucgcaaacccugcggcccugcccgcugggcagacugugcagcuaaccggacaaccaaauauaacaccguccucaaguccuagccccgucccagccacuaacaaucaggugcccaccgcaaugucuuccucaaguacgccucagagccaaggcccacccccuacaguuucccagaugcugucuguaaaaagacagcagcaacagcagcacucgccggcuccacccccucagcaagugcagguccaggugcagcaaccccagcagguucagaugcaagugcagccacagcaaagcaacgccggugucgggcagccugcaucaggcgaguccagucucaucaagcagcugcuuuugcccaaaaggggaccaucuaccccuggcgggaagcugauuuuaccggcaccccaaaucccaccucccaauaacgcucgcgcgccaagcccucaagugguauaccaggucgccuccaaucaggcagcuggauucggcgugcagggucaaacucccgcccagcagcuccugguugggcagcaaaacgugcagcuugucccgucagccaugccaccuucuggaggcgugcagacaguucccauuagcaaucugcaaaucuugccagguccccucauaaguaacuccccugcuaccauuuuucagggcacuagcgggaaucaggugaccaucacagucgugccgaacacgucuuucgcacccgccaccguaucacagggaaacgcgacucaacugaucgcuccagccggcauuacaauguccgggacccagacaggagugggccuaccuguucagacucugcccgcaacccaggccaguccugcuggucaaagcucgugcacgacagcaaccccacccuuuaaaggggauaagaucauuugucagaaggaagaggaggccaaagaagcgacuggacuccauguccacgagcggaagauagaagugauggagaauccuucuugcagaaggggcgcuaccaacacauccaauggugacacuaaagaaaacgagaugcaugugggcagccugcuuaaugggcgcaaguauucagauaguucuuugccacccuccaacagcggaaaaauccagucagagaccaaucaguguagucugauuagcaacggcccguccuuagaacucggggagaauggagccucuggcaagcaaaacagcgaacagaucgacaugcaggacauuaaauccgaucugcgaaagccucuugucaaugguaucugcgacuucgauaagggggacggaucacaccugucuaaaaacauaccaaaucacaagacaaguaaccauguaggcaauggugagaucucgcccauggaaccucaaggcacgcuagauauuacccagcaggacacugcaaaaggggaucagcucgagcggaucagcaacggaccagugcugacauugggcggguccucuguuucaagcauucaagaggccuccaacgcugccacccagcaguuuaguggaacugaccuguuaaauggcccccucgcaucuagccugaacucagaugugccgcagcaacguccuuccgucgugguuaguccccacagcacaaccucugugauccagggucaucagauaauugcugucccagacuccgggucaaaggugagccacucgccugcccuuucuagugauguaagauccacgaauggaacugcggaauguaaaaccgugaagaggcccgccgaggacacagaucgcgaaaccguugcaggcaucccaaacaaggucggcgugcggaucgugacuauuagcgaccccaauaacgcugggugcucagccacaauggucgcuguuccugcaggagccgacccauccaccguggccaaaguagcuauagagucugcggugcagcaaaagcagcagcacccgcccacauacguccagaaugugguuccucaaaacacuccaaugcccccuagcccagcagugcagguccagggucaacccaauaguucccagccuagcccguucucuggcucaagucagccaggggaucccaugagaaaaccuggacagaacuuuaugugucuguggcaauccugcaagaaaugguuccagacccccagccagguauuuuaucaugccgcuacggagcacggcgguaaggacguguacccagggcaguguuugugggaaggaugcgagccuuuccaaaggcagcgauuuucuuucaucacacaucuccaggauaagcacugcucgaaagacgcccugcuagcaggccugaagcaggaugaacccggccaagccgggucacagaaaagcuccaccaagcagccaacuguuggagguaccaguucuacaccgcgcgcucaaaaagcgauugugaaucauccuagcgccgcacuuauggcucuccggagaggcuccaggaaccuggucuuccgugacuuuacugaugagaaggaagggcccaucaccaagcacauucgcuugacggccgcacugauccucaaaaauauaggaaaguauucagaguguggccggagacuacugaaaaggcacgagaacaaucuuagugugcuggccaucucuaacauggaagcuagcuccacauuggccaagugccucuacgagcugaauuucaccguccagucaaaagaacaggagaaggacagcgaaaugcuacaguga

SEQ ID NO: 52981 - RNA, 1782 nt, Artificial Sequence
  derived and/or modified sequence opt3 from ARID3A__Homo_sapiens__NP_005215
augaagcugcaggccgugauggagacccuccuucaaagacagcagagggcucggcaggaacuggaggcacgccaacaguugcccccugacccaccggccgcgcccccuggccgagcucgugccgcaccagaugaagacagagagcccgaaagcgccaggaugcagcgggcucagauggcagccuuagcugccaugcgcgcggcagccgcugggcugggacacccugccuccccagguggcucugaggaugggcccccuggaucagaggaagaggacgcagcuagagaaggcacaccagguaguccggggaggggacgggagggccccggcgaggaacauuucgaggauauggccagcgacgaagauaugaaaccuaagugggaggaagaggagauggaagaggaccuaggggaagaugaggaagaggaggaagaggacuacgaagaugaggaagaggaggaagacgaggaaggacucgguccacccggcccugcgucccuggggacuacggcccuuuuuccacgcaaagcacaacccccgcaggcuuuccgaggagauggcgucccuagaguucugggugggcaggagaggcccggaccaggcccugcccaccccggcggggcugcccauguggcaccacaguugcaacccccugaccacggagacuggaccuaugaggaacaguuuaagcagcucuacgagcuggauggugacccaaaacggaaggaauuucuggaugaccucuuuucuuucaugcaaaagcguggcacaccgguaaaccgcauccccauuauggccaaacagguguuagaucuguuuaugcuuuaugucuuggugacugagaaagggggacugguugaagugauaaauaagaagcuauggagagagaucaccaaaggccucaaccugccuacaucgauuaccucagcugcguucacucuuaggacacaguacaugaaguaucuguacccauaugagugcgaaaagcgggguuugagcaaucccaacgagcuccaggcagccaucgacaguaaucgacgcgaagggagaaggcaauccuuuggcggaucucuguucgcuuacagcccuggcggggcccauggaauguuauccucaccaaaacugcccgucaguagccucggucuugcagccucuaccaacggcuccucaauuacgccggcuccuaagaucaaaaaggaggaagauagcgccauaccaaucacugugcccgggcggcugccuguaaguuuggcaggacaccccguuguggcggcucaggccgcagccguccaggcugccgcagcucaggccgcgguggccgcucaagcagccgcucuagagcagcugcgcgagaaacucgaaucugccgagccaccugaaaagaaaauggcacugguggcggacgagcagcagagacuuaugcaaagggcccugcagcagaauuucuuggcuauggccgcacagcuccccauguccauucguaucaacagccaggcuucggaaucucggcaagauuccgccgucaaucugaccggcacaaacgguucaaauaguauuagcauguccguugagaucaacgggauaauguacacuggcguguuauucgcacagccaccggccccuacccccacaucugcuccaaauaagggaggcgggggagguggcgggagcucaaguaacgcgggaggccgaggugggaauaccggcacguccggaggccaagccgggcccgcaggacugagcacuccuucuacaucaaccaguaacaacagccuaccauga

SEQ ID NO: 52982 - RNA, 1683 nt, Artificial Sequence
  derived and/or modified sequence opt3 from ARID3B__Homo_sapiens__NP_006456
auggagccccugcagcaacagcagcagcaacagcagcagcaacagaagcagccucaccucgccccacuucagauggacgcuagagaaaaacaaggccagcagaugagggaggcacaauuccuguacgcccagaaguuggugacccagccgacauuacugagcgcgacugcugggcggcccuccggaucuacgccucuagguccacucgcccgcguucccccuaccgcagccgucgcucagguguuugaacgaggcaacaugaacucagagccagaagaggaggaugggggacuggaagacgaggauggcgacgaugaaguagcagagguggccgagaaagaaacacaagcugccaguaaguauuuccauguccagaaaguggcgcgucaggaccccagaguugcaccuaugagcaaucuucugccagccccggguuugcccccucacgggcagcaagcuaaggaggaucauacuaaggacgccuccaaagcaucuccaucggugucaaccgcuggacagcccaauuggaaccucgaugaacagcugaagcagaauggcggccuggccuggagcgacgaugcggacgggggaaggggucgggagaucagucgcgauuuugccaaacucuacgaauuagacggcgacccugagagaaaggaguuccuggaugaccuuuuugucuucaugcagaaaagggggacaccaauuaaccggauacccaucauggcaaagcaaauuuuggaucuguauaugcuauacaagcucgugaccgaaaaaggaggccugguagagaucauuaauaagaaaaucuggcgcgaaauaacuaagggucuuaaccugccgacauccaucaccucugcugccuuuacguugcgaacucaguauaugaaauaccucuaugcuuacgagugcgaaaagaaagcccugagcuccccugcagaguuacaggccgcuauugacgggaauagaagggagggacggcgucccucauacaguagcucucuguucggcuauuccccagcggcagccaccgcugccgcagccgcuggcgccccugcacuccuuucacccccaaagauccgcuuucccauucugggguugggaagcaguucugguacaaacacuuccagcccuagaaucucgccagcgaccacacuaaggaagggcgauggggcuccgguuaccacggugcccgucccuaaucggcuggccgugccagugacucucgcaucucaacaggccggaacacgaaccgcugcccuggaacagcuucgcgagagacuggaauccggcgagcccgcagagaaaaaggcuucaagguugagugaagaggaacaacggcucguccagcaggccuuccagcgcaacuuuuucagcauggcgagacaacugccuaugaaaauaaggauuaauggucgugaggaccgggccgaggcuuccgcagccgcuuuaaaccugacuacaucuagcaucgggucaauuaauaugaguguugauaucgacggcaccacguacgccggagugcuauuugcacagaagccaguagugcaccucaucaccggcuccgcgccccagagccuggggucuucagccaguagcuccucuucgagccauuguuccccgucaccuacaaguucucgaggaacuccaagcgcugaacccuccaccucauggagccuuuga

SEQ ID NO: 52983 - RNA, 3774 nt, Artificial Sequence
  derived and/or modified sequence opt3 from ARID4A__Homo_sapiens__NP_002883
augaaggccgcugacgagcccgcauaccugaccgugggcacagaugucagcgccaaauauagaggggcguucugcgaagcuaagaucaaaacuguuaagaggcucgugaaaguaaaggugcuucugaagcaggacaacacgacccaauugguccaggaugaccaggugaaaggaccuuuacggguuggugccauuguggagacacgcacuuccgauggcucuuuucaggaagcaauaaucucaaagcugaccgacgccaguugguacacagucguguucgaugacggggaugagcgaacccuacguagaacuagccucugucugaaaggagaaaggcacuuugcugaguccgagacacuugaccaacugccauugaccaauccggaacauuucggcacgcccguaauugcaaagaaaacuaaccggggucgcagaucuucgcucccuguuaccgaggaugaaaaggaggaggaaucaagcgaggaagaggacgaagauaagaggcggcugaaugacgagcugcucgggaaaguggucagugugguguccgccacagagcgcacugaaugguauccagcuuuagucaucucucccagcugcaacgacgauauuaccguuaagaaagaccagugucuggugcgauccuuuaucgauucaaaguucuacaguauagccagaaaagacaucaaggagguagauauucuuaauuugccugaaagcgagcugucuacaaaaccaggacuacagaaggcguccaucuuucucaagaccagggugguccccgacaacuggaaaauggauauuucagaaauccuggagagcaguucuuccgacgaugaggacggcccugcagaagagaaugaugaagagaaggaaaaagaggccaagaaaacggaggaagaggugccagaagaggagcuugacccggaagagagagacaacuuccugcagcaauuguauaaguuuauggaagaucguggcacucccauaaauaagccuccaguucucggguacaaagaccugaacuuauucaagcuguuucgccucguguaucaccagggagguugcgauaauauugacagcggcgcugucuggaaacagaucuacauggaucuugggauucccauccugaacucggccgcaucuuacaaugugaagacagcuuauagaaaauacuuguauggauucgaggaauacuguagguccgccaacauccaguuucggaccguacaucaccaugagccuaagguuaaggaggagaaaaaggaccuagaggaaucaauggaggaagcgcugaaacucgaucaagagaugccacugacugaggugaagagugaacccgaggaaaauauugacagcaacuccgagucugaacgagaggagauagaacuuaaaagcccgcgcggcagaaggcggaucgcccgcgaugucaacucaauuaagaaggagaucgaagaggagaaaacagaagacaagcugaaagauaaugacaccgagaacaaggauguggacgacgauuaugaaacggcagagaaaaaggaaaaugaguugcuccugggucggaaaaacaccccuaagcagaaggagaaaaagauuaaaaagcaggaagacagugauaaagacuccgaugaggaagaggaaaagagccaagagagggaggaaacagagucuaagugcgacucagaaggggaggaagaugaggaggacauggaacccuguuuaacuggaaccaaagucaaggugaaauacggccguggcaagacacagaaaauauaugaggcuaguaucaagagcacugaaaucgaugacggggagguucuguaccuagugcacuacuauggauggaauguacgguacgaugagugggucaaggccgaccgaauuaucuggccacucgauaaagguggcccuaagaaaaagcagaaaaagaaggcuaaaaacaaggaagacuccgagaaagacgaaaagagagaugaggaaaggcagaaaucuaagcgcgggcggcccccacugaaaucgacccuuagcuccaauaugcccuauggauugucaaagacagccaacagugagggcaagucugacagcugcuccucagauagcgagaccgaagacgcacuggagaaaaaucucauuaacgaagaacugucucuuaaggaugaacuggagaaaaaugagaacuugaaugacgauaagcucgacgaagagaacccuaaaauauccgcccacauccugaaggaaaaugauagaacucaaaugcagccauuagagacgcugaagcuagaagugggugagaacgagcagauuguucagaucuucgggaacaaaauggaaaagacagaggaagugaaaaaggaggcugagaaaaguccgaagggcaagggaaggcgcagcaaaaccaaggaccucucucuggaaaucauuaaaauauccucauucggccaaaaugaggcggggagugaaccccauaucgaggcacacagccuugaauugucgucccuggauaacaagaauuuuucuagcgccacugaggacgagauugaccagugugucaaagaaaagaagcucaaacgaaagauccugggacagucaaguccugagaaaaagauucggaucgaaaacgguauggagaugaccaauacagugucccaggaacguaccucugauugcauaggcagcgaggggaugaaaaacuuaaauuucgagcaacauuuugaaagagagaacgaaggaaugccaucccugaucgcugagucaaaucaguguauucagcagcuuacuagcgaaagguucgacagucccgccgaggagacaguaaacaucccuuugaaggaagaugaggacgcaaugccacucauuggccccgaaacgcuggugugccacgagguugaucuagacgaucuggacgagaaggauaaaaccucuaucgaagacgucgccguggaguccagcgaaucaaauucgcucgugucuauaccgccugcucugccacccgucguucaacacaacuuuaguguggccuccccucuuacuuugagccaggaugagucucgcagcgugaaguccgaaucagacauuacaaucgagguagauaguauugcagaggaaagccaggagggucugugcgaacgggagucugcgaauggguucgaaaccaacgucgcuuccggcacauguucaaucauagugcaagagagagagaguagggaaaaaggacagaagcgacccagcgacggcaauuccggguuaauggccaaaaagcagaaacgcacuccaaagcggaccucugcagccgcuaagaacgagaaaaacggaacgggucagucgagcgacucagaagaucucccuguucuggacaauuccaguaagugcacccccgugaaacaucuuaacgucucuaagccacaaaaacuggccagaagcccggcaaggaucuccccucacauuaaggauggcgagaaggacaaacaucgugaaaagcaccccaauucaucuccacgcacauacaaauggagcuuucaguugaacgagcucgauaauaugaacaguacugagcggaucuccuuccugcaggaaaagcuacaggagauuagaaaauauuacaugagccugaagucugaaguggcuaccaucgacaggcgacggaagcgccucaaaaagaaagauagagagguuucacaugccggggcguccaugaguagcgccucgucugacacaggaaugucccccagcucaaguucuccuccacaaaaugugcuggcuguagaguguagguga

SEQ ID NO: 52984 - RNA, 3939 nt, Artificial Sequence
  derived and/or modified sequence opt3 from ARID4B__Homo_sapiens__NP_057458
augaaggcccuggacgagcccccuuaccucaccgugggcacagaugucagcgcuaaauauagaggggcauucugcgaagccaagaucaaaacugcgaagaggcuuguuaaagugaagguaacguuucggcacgacuccucuaccguggagguccaggaugaccauauuaagggaccacugaaagugggugcuauaguugaagugaagaacuuggauggcgccuaccaagaggcagucaucaauaaauuaacagacgccucaugguauacugugguauucgaugacggggaugaaaagacccugcgccgaaguagccuaugucucaaaggagagcgucacuuugcugaguccgaaacacuggaccagcuuccgcugaccaaccccgagcauuucggcacuccuguuauugguaagaagacaaauagagggaggcggucuaaccacaucccagaagaggagucgucaagcaguuccucugaugaagacgaggaugaccgcaaacagauugacgaauugcucggaaagguggucugcguggauuacaucagccuggacaaaaagaaagcacugugguuucccgcccucguggucuguccugauugcuccgacgagauagcuguuaagaaagauaauaucuuagugagaucauucaaggacggcaaguuuaccaguguaccaaggaaagaugugcaugaaauuacgagcgacacugcccccaagccugaugcgguccugaaacaggcauucgagcaagcccuugaguuucacaagucucggaccaucccagcuaacuggaaaacagaauugaaggaggacuccucaagcagugaagccgaggaagaggaggaagaggaagaugacgagaaggaaaaagaggacaauucuuccgaggaagaggaagagauugagccguuccccgaggagcgcgaaaacuuucugcagcagcuauauaaguucauggaggaucgaggcacuccuaucaauaaaagaccagugcucggguacaggaaccugaaucuuuuuaagcuguuccgguugguucacaaacucggagguuucgacaacauagaaagcggcgcaguguggaagcaggucuaucaagaucuggggauucccguguuaaauucggcugccggauacaacguaaagugugcguacaaaaaguaucuguacggcuuugaggaguauugccguucugccaauaucgaguuccagauggcacucccugaaaaaguugugaacaagcaguguaaagaaugcgagaacgucaaggaaauuaaggugaaagaggagaaugaaaccgagaucaaggaaaucaaaauggaggaggaacgcaacauuauaccaagagaggaaaagcccaucgaggacgaaauugagaggaaagagaauaucaagccgucccuugguucaaagaagaaccuguuggaaaguauaccuacacauagcgaucaggagaaggaagucaauauuaaaaagcccgaggacaacgaaaaucuagaugacaaagaugacgauaccacgcggguggacgagucccugaacaucaagguugaggcugaagaggaaaaagccaagucuggggaugagacuaauaaggaagaggacgaggacgaugaagaggcugaagaggaagaggaggaagaggaagaggaggaagacgaggaugacgaugacaacaaugaagaggaagaguuugaguguuacccaccuggaaugaaagugcaaguacgauauggccgcggcaagaaccagaaaauguacgaagccagcaucaaggauucagacgucgaagggggagaagugcucuaucugguucacuacugcgguuggaaugugagauacgaugaguggauuaaagcagacaagaucgucaggcccgccgauaagaacgugccaaaaauuaagcaucggaaaaagauaaagaauaaacuugacaaggaaaaagauaaggacgagaaauauagucccaagaacuguaaacugcgcagauuguccaagccuccauuccagacaaacccgagccccgagaugguaucuaaacucgaccugaccgaugcuaaaaauucagacacugcgcacaucaagaguauugaaaucacaagcaucuuaaacggccugcaagcauccgagucuucggccgaagauagcgagcaggaagacgagcguggggcucaggauauggacaauaacggaaaagaggaauccaagauugaucaccuaaccaauaacaggaaugaccucauaucaaaagaggaacagaacaguucuagccugcuugaggagaauaaggugcaugccgauuugguuaucuccaaaccugucucaaagagcccagaacggcugcgaaaggacauugaggugcucucugaagauacggacuacgaggaagacgaggugaccaaaaagagaaaagaugucaagaaagacacaacugauaaguccaguaagccccaaaucaaaaggggcaagcgccgguauugcaacaccgaggaaugccugaaaacagguagcccugggaagaaagaggaaaaggcaaagaauaaagagucucuuuguauggaaaacuccucaaauaguagcucggacgaggaugaggaagagacuaaggccaaaaugaccccaacaaagaaauacaacggccuggaagagaagagaaaguccuugaggaccacuggauuuuauucuggcuucagcgaaguugcugagaaacgcauuaagcuccugaauaacucagacgagcgauuacagaacagucgggccaaagaucguaaggacgugugguccucuauccaggggcaguggcccaaaaagacgcugaaagaacuauuuagcgauuccgacacagaggcagcggcuucaccgccucacccagcccccgaagagggaguggcagaggaaagccuccaaaccguagccgaggaagagaguugcucuccuuccgucgaacuggagaagcccccaccugugaauguugauagcaagcccauagaggagaaaacuguggaagucaacgacagaaaggcugaguucccaucgucagguucuaauagugugcuuaacaccccgccuacaacccccgaauccccaagcucuguuacugugacagaaggcagcaggcagcaguccucaguaacggucagugagcccuuggccccuaaucaggaggaagugcgcagcaucaaaucugagaccgauuccacuauugaaguggacucagucgcaggggagcugcaagaccuccagagugaaggaaacagcuccccagcuggcuuugaugccucuguuucgagcucauccaguaaucagcccgagccugagcauccggaaaaggcguguacaggucagaaacgggugaaggacgcccaagggggcggaucuagcuccaagaaacagaagagaucacacaaagcuaccguagugaacaauaagaaaaagggcaaggggacaaacucuagcgauagugaggaacuguccgcaggagagagcaucacuaaaucucagccagucaagucaguguccaccgguaugaaaagucauagcacgaagucgcccgccaggacccaaucuccuggcaaaugcgggaagaauggagacaaggauccagacuuaaaagagcccuccaaccgacugccuaagguuuacaaauggagcuuccagaugucagaucuugaaaauaugacaagugcugagcgcauuacuaucuugcaggaaaagcuccaggagauacggaaacacuaucugucucuaaaguccgaaguggccagcauugacagaaggcguaaacgccugaagaagaaagagcgggagucagcagcgaccaguagcuccucuagcuccccgucaucuaguucgaucacagccgcugucaugcucacucuggccgaacccagcauguccucugcaucacaaaacggcaugagcguggaguguagauga

SEQ ID NO: 52985 - RNA, 2838 nt, Artificial Sequence
  derived and/or modified sequence opt3 from ARID5B__Homo_sapiens__NP_001231567
auggcccccaaccugaagggcagaccuaggaaaaagaaaccaugcccgcagcggcgcgacagcuucuccggggugaaggauucuaauaacaauucagacggaaaagcugucgcaaagguuaagugugaggcccgaagugcgcucaccaaacccaagaacaaucacaacugcaaaaaggugagcaaugaagagaaaccuaagguagcuaucggugaagagugucgugccgaugaacaagcauuucuuguggcccuguacaaguauaugaaagagagaaagacaccaauugagaggauacccuacuugggcuucaaacagaucaacuuauggacuauguuucaggcugcacagaagcuagggggauaugaaacgauuaccgcccggcgccaauggaaacauaucuacgacgagcugggcgguaauccuggguccacaucugcugccacuugcaccagaaggcacuaugaacggcucauucugccauacgagcgcuucaucaagggagaggaagauaaaccccuuccuccaauaaagccgcgaaagcaggagaacucgucacaggaaaaugagaacaaaacaaaggucagcggcaccaaaagaaucaagcaugaaauucccaaaaguaagaaggagaaagagaaugcgccuaagccacaggacgcagccgaaguguccucugagcaagaaaaagagcaggaaacucugaucagccagaaguccauucccgagccuuugccagcugccgauaugaaaaagaagaucgagggcuaucaggaauuuucagcaaaaccccucgcuaguaggguugacccggagaaggauaacgaaacagaccaagggagcaauucugagaaaguggccgaagaggcgggagagaaggguccuacgcccccacugccuuccgcaccccuggccccagaaaaagauucagcucucguccccggcgccagcaagcagccuuuaaccaguccaucugcucugguggacuccaagcaggagagcaaacuuuguugcuucacugaaucgccggagucugagccccaagaagccuccuuuccuucauucccaaccacacagcccccuuuggcaaaccagaacgagacugaagaugacaagcugccagccauggcugacuacauagcgaauuguaccguaaaaguugaucagcuagggagugacgauauucacaacgcacucaagcaaacacccaaagugcuggucgugcagagcuuugacauguucaaggauaaagaccuuaccggaccgaugaaugagaaccauggccugaauuacacgccuuugcucuauucccgggguaacccagggaucaugucuccccuggccaagaagaaauuacugagccaggugucaggagcuagucucuccagcucuuacccuuauggcucacccccaccucuuauuaguaagaaaaagcugaucgcccgugaugacuugugcagcucccuaucucagacucaccacggccaaucgacagaucauauggcagucagccgccccuccguuauccagcacgugcagucauuuagaaguaaaccaucugaagagaggaagaccauuaaugacauauucaagcaugagaaacugagccgguccgauccgcaccgauguucauuuagcaagcaccaucucaacccucuggccgacucuuacguacuuaaacaggaaauccaagaggggaaggacaaacuguuggaaaagcgcgcucucccccacucccauaugccaaguuuccuggccgauuucuauagcucuccccacuuacauucccuguacagacacacugagcaccaucuacacaaugaacagacaucaaaguauccuaguagggacauguaccgggagagcgagaacucguccuuuccaucucaucgccaccaggaaaaacuccacgugaauuaccugaccagccuucauuugcaggauaagaaaucagcagcggcugaggcccccacggacgaucaaccuaccgaccugagucucccgaagaacccacacaaacccacaggaaagguccugggucuugcacauuccacuaccggcccucaggaaucuaaggggauuagccaguuccaagugcugggaucccagucaagagauugccacccaaaagccuguaggguuagccccaugacaaugaguggcccuaagaaauauccggagucuuugucccguagcgguaagccccaucacgugcggcucgaaaauuuucgaaaaauggaggggaugguccacccaauccugcauagaaagaugucgccucagaacauaggcgcugccaggcccauuaaacgcucauuagaggaccuggaucuagugaucgcaggaaagaaggcucgggccguaucuccacucgacccuaguaaagaaguuuccggcaaggagaaagcgagcgaacaggagucugaggggagcaaggccgcucacggaggucauuccggcgggggaucagaaggccacaaacugccccuuaguagcccaaucuucccggguuuguacucugggucccugugcaauucaggccucaacaguagacugccugcaggauauagccauuccuuacaauaccugaagaaccagacugugcuuucucccuugaugcagccacucgccuuucacucgcuggucaugcagaggggcauuuucaccagccccacaaauucacaacagcuauaucgccaccuggcugccgcaaccccugugggguccaguuacggagaucuccugcauaacucuaucuauccacuugcggccauuaauccccaggcugccuuuccuagcucccaguugucaucuguccacccgagcacuaagcuguga

SEQ ID NO: 52986 - RNA, 1674 nt, Artificial Sequence
  derived and/or modified sequence opt3 from ARIH1__Homo_sapiens__NP_005735
auggacagcgaugagggcuacaacuaugaguucgacgaagaugaagagugcuccgaagaggacucuggggccgaggaagaggaagaugaggacgaugacgagcccgaugacgauacccuggaccucggagaaguggagcuugucgaaccuggucugggcguugggggagagagagauggcuuguuauguggugaaacagggggaggcggcgggucagcucugggaccagguggcgggggaggcggugggggaggcggcgggggagguggcccggggcacgagcaggaggaagacuacagguaugaggugcuaacugcagaacaaauccuccagcauaugguagagugcauucgggaagugaaugaggucauacagaaccccgccacgaucacccgcauucugcuuagucacuuuaauugggacaaggagaaacugauggaacgauacuucgauggaaacuuggagaagcucuuugcggaaugucaugugaucaauccuagcaaaaagucccguacaagacagaugaacacuaggucuucggcucaagacaugccaugccagauuuguuaucugaauuaccccaacucauauuucaccggccuggagugcggucacaaauuuuguaugcagugcuggagcgaauaccucacaaccaagaucauggaggaggggaugggccagacuauaaguuguccugcccauggaugcgauaucuuaguugacgauaauacagugaugcggcugauuaccgacuccaaggucaaacuuaaguaccaacacuugaucacgaacucuuucguggaauguaaucgccugcuaaaauggugcccagcacccgauugccaccauguaguuaaggugcaguauccugacgccaaaccagucagauguaagugcggcaggcaguuuuguuucaacugcggggagaauuggcacgauccggugaaguguaaauggcucaagaaauggauuaagaaaugcgacgaugacagcgaaacuuccaacuggaucgcugcaaauaccaaggagugucccaaaugccaugugacaauagagaaggacggagguuguaaccacauggucugccggaaccagaauuguaaggccgaauuuugcuggguuugccugggcccuugggagccacacgggucagcuugguacaacuguaaucgcuauaacgaagaugacgccaaagcggcacgagaugcccaagagagaaguagggcugcccuucagcgguaccuguucuauugcaaucguuacaugaaccauaugcagagcuugcgcuuugaacacaagcucuaugcacaagugaaacagaagauggaggagaugcagcagcauaauaugucuuggauugaaguacaauuccugaaaaaggcuguggacgucuuaugucagugcagagccacucugauguacaccuacguguuugcguucuaucucaagaaaaacaaucaguccaucauuuucgagaacaaucaggccgaucuugaaaacgcaacagagguucugucaggauacuuggaaagggacaucagccaagauagucuacaggacaucaagcagaaagugcaggauaaguaucgguacugugagucucgacgcagaguccugcuccaacacgugcaugagggcuaugaaaaagaccugugggaguacauugaagauuga

SEQ ID NO: 52987 - RNA, 591 nt, Artificial Sequence
  derived and/or modified sequence opt3 from ARL11__Homo_sapiens__NP_612459
augggcagcgugaacuccagagggcacaaggccgaggcucaggucguuaugaugggacuggacucugcagguaaaaccacacuccuuuacaagcugaaaggccaucaauugguggaaacuuuacccacgguaggguucaauguggagccucugaaggccccaggacacgucucacuaacccucugggaugugggcggucaggcgccgcugagggcuaguuggaaagacuaucuugaagggacagauauccugguuuacguguuggacagcacugaugaggcccggcuccccgaauccgcagccgagcugaccgagguccugaacgacccuaauauggcuggagugccauuucucguauuagcaaacaagcaggaagcccccgaugcucugccucuuuugaagauucgcaaucgacugucucuagagcguuuccaggaccauugcugggaacucagaggcuguucggcccugacaggcgaggggcuuccagaggcgcugcaaucauuguggagccuccugaaaaguagguccugcauguguuuacaggcacgggcccacggagcugaacgcggugauucuaagagaagcuga

SEQ ID NO: 52988 - RNA, 771 nt, Artificial Sequence
  derived and/or modified sequence opt3 from ARL13A__Homo_sapiens__NP_001155963
auguucagacugcucagcuccugcuguucuugccuuaggaccacagaggaaacucggcgcaacgugacgauccccauuauaggccugaauaacucagggaagaccgucuugguugaggccuuucagaaauuacugccuaguaagacagaccacuguaugaaaagcgaacuaacuacccuccugcuugaugaguacgaacuguccaucuaugacuugaauggagaucucaagggucgagaggcuuggccaaacuacuaugcacaagcccauggccugguguucguacuggacucuucggauauucguagaaugcaggaggugaaaaucauucucacacacuuacugucagacaagagggucgcggggaagccgauccuuauauuggcuaauaaacaggauaagaaaaaggcccugaugcccugcgacaucauugauuaccuacuccugaaaaagcuggugaaggaaaacaaauguccuugccggguugagccauguagcgcaauccgcaaucuugaaagaaggaaccaucagcccauuguggagggauugcgguggcuccuggccgucaucgacacuugccaauuaccuccaaccaguuccauaucuauuagcaagaauaacacaggcuccggugagcgcuguucaagucacagcuuuucuacccgaacggggauguccaaagaaaagagacagcaucuggagcagugcucaaucgaagcuaaaccccucaagagcauucuucagccuaguaaucaaucuuauacucacuga

SEQ ID NO: 52989 - RNA, 1287 nt, Artificial Sequence
  derived and/or modified sequence opt3 from ARL13B__Homo_sapiens__NP_001167621
auguucagccugauggccuccugcuguggcugguuuaagagauggagggagcccgugcggaaagucacccuccuuaugguugggcuggacaacgcuggaaagacagcaacugccaaagguauccagggcgaauacccugaggauguggcgccaacgguaggguucucuaagauuaauuugcgccaaggaaaauuugaagugaccauauucgacuuaggcggugggauccgaauuagaggaaucuggaagaacuauuacgcugagucauauggcgucauuuuugugguugauaguagcgacgaagagagaauggaggaaacaaaggaggccauguccgaaaugcugaggcacccgcggaucucuggcaaacccauacuugugcucgcaaauaagcaggauaaagagggggcccugggagaggcugacgucaucgaaugccuuucgcuggagaaguuggugaacgaacauaaaugucucugccagauugagccuuguucagcaaucagcgguuacggcaagaagauugauaaaaguaucaagaaagggcuguauuggcugcuccacguaauagcccgcgacuucgaugcuuuaaaugaacguauucagaaggagacuaccgagcaaagggcccuggaggaacaggaaaaacaggagcgggcggaacgcguucgaaagcuaagagaggagaggaaacagaacgaacaagagcaggcagaauuggacggaacauccggccuggccgagcuagauccagaacccaccaauccuuuucagccaaucgcuucugugauuaucgagaacgaggguaagcucgaacgggagaagaaaaaucagaagauggaaaaagacagcgaugggugccaucugaagcacaaaauggagcaugagcaaaucgaaacucagggacaggucaaccacaauggccaaaagaacaaugaguucggccuuguggaaaacuacaaggaggcccugacacagcaguugaaaaaugaagacgagaccgaccgucccucccucgagucagcaaacgggaagaaaaagacgaaaaagcugcgcaugaagagaaaccacaggguggaaccuuuaaauauugaugacugugcuccagagaguccgacucccccuccacccccuccacccgucggaugggguaccccgaaaguuacacggcugccuaagcucgaaccccuuggcgagacucaucacaacgauuuuuaucgaaaaccacugccucccuuggccgugccacagcgccccaauagcgacgcgcaugauguaauaucuuga

SEQ ID NO: 52990 - RNA, 783 nt, Artificial Sequence
  derived and/or modified sequence opt3 from ARL14EP__Homo_sapiens__NP_689529
augauggaccccugcagcgugggcguccagcugagaaccacaaacgagugucacaagacuuacuauacgaggcauaccggguucaaaacacuccaagaacuuuccucuaaugauaugcuguuguuacagcugcggacuggaaugacccuaucagguaacaauacaaucugcuuucaccauguuaagauuuacauagaccgcuucgaggaucuccagaaaaguuguugcgacccuuuuaacauccacaagaaacuggccaagaagaaucuucaugugauugaucuggacgaugcuaccuucuugagcgcaaaauuuggccgacagcucguaccaggguggaagcuguguccgaaaugcacucaaaucauuaacggauccguggacgucgauacagaagaccgucagaagagaaaacccgagucugauggcaggaccgccaaggcgcugcggucgcuccaguucacgaauccuggucgccagacugaauuugcuccagagaccgggaagagagagaaaaggcgguuaacaaagaacgccacugcaggaucagaccgccaagugauccccgccaaaagcaagguuuaugauagucagggccugcuuauauucuccggcauggacuugugugacugccuggaugaagacugucuagggugcuuuuacgcuuguccugcaugcggaucuaccaaaugcggugccgagugucgaugcgauagaaaguggcucuaugaacagaucgagauugagggcggggaaaucauucacaauaaacacgcuggauga

SEQ ID NO: 52991 - RNA, 579 nt, Artificial Sequence
  derived and/or modified sequence opt3 from ARL14__Homo_sapiens__NP_079323
augggcagccugggguccaagaacccccagaccaaacaagcccaggugcuccuucugggauuggacucugcugguaagucaacauuacuguacaaacuaaagcucgcaaaagauaucacuacgauuccuaccauaggcuucaaugucgagaugaucgaacuggagagaaaccuuagucugacaguuugggacguagggggacaggaaaagaugaggacuguguggggcugcuauugugagaauaccgaugguuugguguacgucguggacagcacagauaagcagcggcucgaagagucccaacgccaguuugagcacauucugaaaaacgaacauaucaagaauguuccagugguccugcucgccaacaaacaggacaugccgggggcguuaaccgcugaggauauuacucgaauguucaaggugaaaaagcugugcucugaccguaauugguauguacagcccuguugcgcccuuacaggagaaggcuuggcacaaggcuuuagaaagcugaccggguucguuaaaucgcacaugaagucaaggggagauacgcuagccuuuuucaaacagaacuga

SEQ ID NO: 52992 - RNA, 615 nt, Artificial Sequence
  derived and/or modified sequence opt3 from ARL15__Homo_sapiens__NP_061960
augagcgaccugagaaucaccgaggccuuccucuacauggauuaucuuugcuuuagggcucuguguugcaaggggcccccuccagcacggccggaauacgacuugguguguauuggcuuaacaggauccgguaaaacuucucugcuaucaaagcucugcagugagagccccgauaacgucguuuccacgaccggcuucucuauaaaagccgugccuuuucagaaugcgauccugaacguaaaggaacuugggggagcugacaauauucgcaaauauuggucgcgauacuaucaaggcucacagggugugaucuucguccuggauagcgccaguuccgaggacgauuuggaagcagcccguaacgagcuccacucugcucugcagcauccacagcuguguacacuccccuuuuuaauucuggcaaaucaccaagacaagccugccgcuagaagcgugcaggagaucaagaaauacuucgaacuugagccauuggccagggggaagcgguggauacugcagcccugcucccuagaugacauggaugcgcucaaagacucauuuagucagcugaucaaccuucuggaagagaaggaucaugaggcaguucgcauguga

SEQ ID NO: 52993 - RNA, 546 nt, Artificial Sequence
  derived and/or modified sequence opt3 from ARL1__Homo_sapiens__NP_001168
augggcggguucuuuagcuccaucuucucuucacuguuuggaaccagagagaugaggauucucauacuuggucuggacggcgccgggaagacaacuaucuuguaccgguuacaggugggagaagucguuacgaccauucccacaaucggcuucaacguggagacuguaaccuauaaaaaucugaaguuucaagugugggaucuaggugggcagacaaguauucgcccuuacuggcgaugcuauuacagcaacaccgacgcugucaucuaugugguugauuccugugaccgugauagaauaggaaucucuaaaucggaacucguggcaaugcuggaggaagaggagcuuaggaaggccauucuggucguguucgcgaauaaacaggacauggaacaggcuaugacuucaagcgagauggccaacaguuugggccucccagcacugaaggaucggaaguggcaaaucuuuaaaacauccgccaccaagggcacggggcuggacgaagcuauggaguggcucguagagacuuuaaaaucucgccaguga

SEQ ID NO: 52994 - RNA, 492 nt, Artificial Sequence
  derived and/or modified sequence opt3 from ARL2BP__Homo_sapiens__NP_036238
auggacgcccuggagggcgaauccuucgcucucagcuuuucuucagcaagugaugccgaguucgacgcgguggucggguaccuugaagauaucauuauggacgaugaguuucagcuguugcaaagaaacuucauggacaaguauuacuuagaauuugaggauaccgaggaaaauaaacugauauauacacccaucuucaacgaguacauuagccuaguugaaaaguauaucgaggagcagcuccugcagaggauuccugaauuuaauauggcugccuucacuacgacccuucagcaccauaaagacgagguggcaggagauaucuuugacaugcuguugacauucacugauuuucucgccuucaaggaaauguuucuggacuaccgggcugagaaagaaggucgcggccuggaucucuccucuggguuaguagugaccucgcugugcaagucaagcagucuuccagcaucccaaaacaauuugcgacacuga

SEQ ID NO: 52995 - RNA, 474 nt, Artificial Sequence
  derived and/or modified sequence opt3 from ARL2__Homo_sapiens__NP_001186674
augggccugcucaccauccuuaagaaaaugaagcagaaagagagagaacugagguuguuaaugcuggggcuagacaacgccggaaagacaacuauucucaaaaaguucaauggugaggauauagacacgaucagccccacccugggcuuuaacauuaagacacuugaacaccggggguucaaacugaauaucugggaugugggaggccaaaaguccuugcgcucuuacuggcgaaacuauuuugagucaacugacggucucauuugggucguugauagugcugaccgucagagaaugcaggauugccagagggaacugcaaagccugcucguggaggagguauuagaacuggacuccauccggucucaucacugguguauacaggggugcucggcagugaccggagagaaucuuuugccuggcaucgauuggcugcuagacgauauuucaagccgcaucuucacagccgacuga

SEQ ID NO: 52996 - RNA, 549 nt, Artificial Sequence
  derived and/or modified sequence opt3 from ARL3__Homo_sapiens__NP_004302
augggccugcucagcauccuuagaaagcugaaauccgcccccgaccaggaggugaggauuuuguuacuggggcuagauaacgcuggaaagaccacacuccugaaacaacuugcaucugaagacauaucacacaucacuccuacgcaggguuucaauauuaagaguguccagagccagggcuuuaaacugaacguuugggauaucgggggacaacggaagauucgcccauacuggaagaauuauuucgagaacaccgacaucuugauauacgugaucgauuccgccgaccgaaaacguuuugaagagacaggccaggaacucgcggagcugcuggaggaagagaagcucucuugcguaccgguguuaauuuucgcuaauaaacaggaucugcuuacugccgcacccgccucggaaaucgcugaggguuugaaccugcauaccauuagagacagggucuggcagauccaaucauguagcgcacuaacaggggagggagugcaggauggcaugaauuggguuugcaagaacgugaaugccaaaaagaaguga

SEQ ID NO: 52997 - RNA, 603 nt, Artificial Sequence
  derived and/or modified sequence opt3 from ARL4A__Homo_sapiens__NP_001182325
augggcaacgggcugagcgaccagaccuccauccucucuaaucuucccucauuccaaaguuuucacauugugauacugggauuggauugcgccgguaagacaacugucuuauacagacugcaguucaacgaguuuguuaauacggugccuaccaaaggcuucaacacagaaaagaucaaaguaacucuagggaauagcaagaccgugacauuucauuucugggacgucggaggccaggagaaacucaggccacuguggaaguccuauacccgguguacugaugguauuguguuuguuguggacucugucgauguggaacgcauggaggaagcuaagacagagcuucacaaaaucacccgaauuucggagaaccaggggguaccgguucugaucguggcaaauaagcaagacuugcguaacucacucagccugagugaaauagagaaacugcucgccaugggagaauuauccucuagcacgcccuggcaucugcagccuacuugcgcgaucauuggcgauggccuuaaggagggguuggagaaacugcacgacaugaucauuaagagaaggaagaugcuacggcagcagaaaaagaaacgcuga

SEQ ID NO: 52998 - RNA, 606 nt, Artificial Sequence
  derived and/or modified sequence opt3 from ARL4C__Homo_sapiens__NP_001269360
augggcaacaucagcuccaauauuucugccuuccagucacugcacauagugaugcucgggcuugacagugcuggaaagaccacaguccuguacagauugaaauuuaacgaguucguuaauacugugcccacgaucgguuuuaacaccgaaaagauuaaauuaagcaauggcacagcaaaggggaucuccugccauuucugggauguaggaggccaagagaaacugaggccucuauggaagucuuauucgcgguguacugacgguauuaucuacguggucgauucaguggacguugaucgccucgaagaggccaagaccgaacugcacaaagugacaaaguuugcggagaaccaggggaccccacuucuggucauagcuaauaaacaggacuugcccaagagccucccgguggccgagaucgaaaaacagcuggcacugcaugagcucauuccugccacuacauaucacguacaaccagcuugcgcaaucauuggagaaggcuuaaccgagggcauggauaagcuguacgagaugauccuuaagcgacguaaaaguuugaagcagaaaaagaaaagaacgggggaccugagguccugugaaguuuga

SEQ ID NO: 52999 - RNA, 606 nt, Artificial Sequence
  derived and/or modified sequence opt3 from ARL4D__Homo_sapiens__NP_001652
augggcaaccaccugaccgagauggcccccacagcuagcuccuuccucccucauuuucaggcacuucacguggucguuaucgggcuggacucugccggaaagacuucauuguuauacagacugaaauucaaggaauuugugcaaaguguaccaacgaaagguuucaauaccgagaagauuagggugccgcuaggcgggagccggggaauaacauuucaggucugggaugugggcggucaggaaaaacuccgcccccuguggcgauccuauacucguagaaccgacgggcuuguuuucguggucgaugcggcugaggccgaaaggcuggaggaggcaaagguggaauugcaucggaucucucgcgccucggacaaccagggaguaccuguucucgugcuggcuaauaagcaagaucagccaggcgcacugucagccgcugaggucgagaaaagacucgccgugagggaauuagcggcagccacacugacccacgugcagggcugcagcgcugucgacgggcuuggauugcagcaaggucuggagcggcuauacgaaaugauucucaagcgcaaaaaggccgcacgaggcgggaaaaagagaagguga

SEQ ID NO: 53000 - RNA, 429 nt, Artificial Sequence
  derived and/or modified sequence opt3 from ARL5A__Homo_sapiens__NP_001032251
augaacgaggugguccacaccagccccacaaucggcuccaauguugaagagauugugauaaacaauacuagauuccugaugugggacaucgggggacaggaaucucucaggucaaguuggaacacguacuauaccaauacagaguuuguaauuguggucguggauagcacugaccgggaacgcaucuccguuacccgagaggagcuuuacaagaugcuggcccaugaagauuugcguaaagcugguuuacugauuuucgcaaacaagcaagacgugaaagagugcaugacagucgccgaaaucucucaguuucuaaagcucaccucgauaaaagaucaccaguggcauauccaggcguguugcgcucugacuggcgaggggcuuugucaaggacuggaguggaugaugucaagauugaagauuagguga

SEQ ID NO: 53001 - RNA, 540 nt, Artificial Sequence
  derived and/or modified sequence opt3 from ARL5B__Homo_sapiens__NP_848930
augggccugaucuucgccaagcucuggagccuuuucugcaaccaggagcacaaagugauuauagucgggcuggacaaugcuggaaagaccacaaucuuguaccaauucuuaaugaacgaaguugugcauacuucccccacgauugguucuaauguagaggaaaucguggucaaaaacacccacuuucugaugugggauauuggcgggcaggagucacuaagaaguagcuggaauacauauuacuccaacacugaauuuaucauacucgugguugacucuaucgauagggagcggcuggcaauuaccaaggaggaacuuuaucgcaugcuggcccaugaggacuugcgaaaagcggcugugcucaucuuugccaauaagcaggauaugaagggauguaugacagcagccgaaauuucgaaauaccugacccugucaagcaucaaggaccacccuuggcauauacagaguugcugugcucucacuggcgaggguuuaugccaagggcuggaguggaugacaucccguauuggagucagauga

SEQ ID NO: 53002 - RNA, 561 nt, Artificial Sequence
  derived and/or modified sequence opt3 from ARL6__Homo_sapiens__NP_816931
augggccugcucgacagacuuagcgugcuguugggguuaaagaaaaaggagguccacguucugugccuaggacucgauaacuccgguaaaaccacaaucauuaauaagcugaaacccucuaacgcccagucacaaaauauacuuccuacuaucggcuucaguauugaaaaguuuaagagcuccucucugucguucacgguguuugacaugucagggcagggaagguaccggaacuugugggagcauuauuacaaagaaggccaggcuaucauuuucguaaucgauagcagugaccgccuccgaaugguggucgcaaaggaggaacuggauacccugcucaaucacccagacauaaaacaucguagaaucccgauuuuauuuuucgccaacaagauggaucugagggacgcggugacauccguuaaagugucucagcuuuugugucuggagaauaucaaggauaagcccuggcacauuugcgcuagcgacgccaucaaaggugaggggcuacaagaaggagucgauuggcuccaggaccagauacagacugugaagaccuga

SEQ ID NO: 53003 - RNA, 612 nt, Artificial Sequence
  derived and/or modified sequence opt3 from ARL6IP1__Homo_sapiens__NP_055976
auggccgagggcgacaacagaagcaccaaucugcucgcugcagaaacagccucccuugaggaacagcugcaaggguggggagaggugauguugauggcggauaaggucuuaaggugggaacgggcuugguuucccccugccaucauggguguugugucucugguauuccuaauuauauacuaucucgacccaucagugcugaguggcgucagcugcuucgugauguuucuuugucuggcagauuacuugguuccgauccucgcuccccgcauuuucggguccaacaaauggacuacggagcagcagcagcgauuucacgagaucugcucuaaucuggugaagacccguagaagggccgucggaugguggaaacggcuguucacacucaaggaagagaaaccuaagauguauuuuaugacuaugauugugucguuagcagccguagcuuggguuggccaacaggugcauaaccugcuuuugaccuaccugaucgucacaucacuacuccugcuuccaggucugaaucagcacgggauaaucuugaaguauauuggaauggccaaacgcgaaaucaacaagcuccugaaacagaaggagaaaaagaaugaguga

SEQ ID NO: 53004 - RNA, 567 nt, Artificial Sequence
  derived and/or modified sequence opt3 from ARL6IP5__Homo_sapiens__NP_006398
auggacgugaacaucgcuccccugagagccugggaugacuucuuuccuggcagcgauagguucgcacggccagacuuucgcgauauuuccaaguggaauaaccgagucguuucuaaucuccuuuacuaucagaccaacuaccuggugguagccgcgaugaugauaucaaucgugggguucuugaguccguuuaauaugauuuuaggagguaucgucgugguucugguguucacaggcuuugucugggcugcccacaacaaagacgugcuacguagaaugaagaaaagguaucccacuacguucguaaugguugugaugcucgcaagcuacuuucugauuuccauguucgggggagucaugguguuuguguucggcaucaccuuuccucuucuguugauguucauacaugccucucuccggcugcgcaaucugaagaacaaacucgagaauaagauggaagguaucggguuaaagagaacaccaaugggaauuguccuggaugcucuugagcaacaggaagagggcaucaacagguugacugacuauauuucgaaaguuaaggaauga

SEQ ID NO: 53005 - RNA, 927 nt, Artificial Sequence
  derived and/or modified sequence opt3 from ARMC10__Homo_sapiens__NP_001154481
augggcgggcccagaggagccgguuggguggcugcaggccugcuccuuggggccggagcgugcuacuguaucuauaggcugacccggggccgccgacguggugacagagaguuggggauuaggagcuccaagucugcugaagauuuaacagacggaucauacgaugacguccugaacgccgagcaacuacaaaaacuccuguaucuucuggaaaguacugaggauccuguuauaaucgaacgggcauugauuacgcucggcaauaacgccgcuuucagcgugaaucaggcaaucauucgcgagcugggcgggaucccaauaguagccaacaagaucaaucacuccaaccagucuauuaaagagaaggcucugaaugcccucaacaauuuaucggugaacgucgaaaaucagaucaaaauuaagaucuacauaucacaagugugcgaggacguuuuuagcggaccgcugaacagugcggugcagcuugcagguuugacccugcuaacaaauaugacugucaccaacgaucaucagcacaugcuccauuccuauauuacagaccuguuccaggugcuucugaccggcaaugggaacacuaagguacaaguuuugaaacuccuguuaaaccugucugaaaaucccgccaugacagagggacuccuuagagcucagguggauagcuccuuucugucauuguacgacagucacgucgccaaggagauccuacugagggugcucacccuguuccagaacauuaaaaauugucuuaagaucgaaggccaucuggcagugcagccuacguuuacugaggguagcuuguucuuucuccugcacggggaagagugcgcucagaaaauccgggccuuagucgaucaccaugacgcggaaguuaaggagaaggugguaaccauuauaccaaaaaucuga

SEQ ID NO: 53006 - RNA, 543 nt, Artificial Sequence
  derived and/or modified sequence opt3 from ARMC1__Homo_sapiens__NP_001273631
augagcgccuggcccuacuucaucuauggcccuucccagccaucuucaagaccgcugagguuugcuugcaguagcauucucgggcggaugcccuguaagcaacgcaaagacgagcgacguaccggauacgauguggaacuuacaaagugcuauacugaguccagaaggaaccugugugaagaggcauuguuaaaaauaaagggugucaucucuuucacguuucagauggccguucagcggugcgugguacgcauuagaucggaccugaaagcggaagcucuagccucagcaaucgccagcaccaaggugaugaaggcucagcaagucgugaaaagugaguccggcgaggaaaugcucguuccuuuccaggauacaccaguggaggucgaacagaauacugagcugcccgacuaccuuccugaggaugaaucuccaaccaaggagcaggacaaagcagugagcaggguagggucccaccccgaaggaggcgccucauggcugaguacagcugccaacuuuuugagccggucuuucuauugguga

SEQ ID NO: 53007 - RNA, 2604 nt, Artificial Sequence
  derived and/or modified sequence opt3 from ARMC2__Homo_sapiens__NP_115507
augcugagccccaacgacaagaugcucggcaaacuugauccuuucuaccagccauccgugucuaagcagaaaaccucagccgagaucauuagugaagcuagaaaugcacugaggacaguccggacucaacgcccguuuacgccccaggaggcccagcgaaaguuguucgggccugcgagcucccguaccucugaaaacagaccacccucgucauuuagcuuacacgcuaguuccuucgagucuagcgacuccaggccuauaucaggaacacggcugaguccacuagaacucaaacccaagguuccugccagcccaacucgcgaggaggauucuugcuuuuccuucccgaagcccccuguggacccagcaaaaaucagaaggguaucaaaugcccgggcucgccuguuucgagcagccagccaaagagcacuucugcccgauaggaguuugccuccaucugacuccaagaaaaccguggaaagcaaggagacagucaugaugggugauucgauggugaaaauuaacggcaucuaucucaccaagucuaaugccauuugucaucugaagucccacccccugcagcucacugacgaugggggauucucagaaaucaaagagcaggagauguuuaagggcacaaccaguuuaccgagccaucugaaaaacgguggggaccagggaaagcggcacgcgcgugcauccucuugcccuagcucaagugaucuuucccgcuugcaaacgaaagccguucccaaggcugaccugcaggaagaggaugccgaaauagagguggacgaagucuucuggaauacuagaaucgugccaauucuaagggagcucgagaaagaagagaacaucgaaaccguaugugcagcuugcacacagcugcaucacgcccuugaggaaggcaauaugcugggcaacaaguuuaaggggcggagcauuuugcucaaaacucuguguaaguuaguugacgugggaucugauucacugagucucaaacuugcgaagaucauacuggccuugaaagucagccgaaagaaucuacugaacgugugcaagcucauuuucaaaaucucccgcaaugagaagaacgacucucugauucagaaugauucgauccuugagagccuguuggaagugcucagauccgaggaccugcaaaccaacauggaagcauuuuuauacuguauggguucaaucaaauucauuaguggcaaccugggguuccuaaaugagaugauaucuaagggagcugucgaaauccucauuaaccugaucaaacagauaaaugagaacauuaagaagugcggcacauuucuuccuaauagcggucacuugcugguucaggugaccgccacgcucaggaaccugguagauuccucacuugugcggagcaaauuccugaauaucucugcuuugccccaacucuguacugccauggagcaguauaagggggacaaagaugucugcacaaacaucgcacgcauuuuuagcaagcugaccaguuacagagacuguugcacugccuuagcuagcuauucuaggugcuacgcgcuguuccuaaaucucaucaacaaauaucagaagaagcaggaucuggugguucguguggucuuuauucuuggaaauuugacagcuaaaaacaaucaagcccgggaacaguucuccaaggagaaaggcucaauacagacccugcucagucuguuucagacguuccaucaauuagaccugcacagccagaagccagugggccagcgaggggaacagcauagagcucaaaggcccccuucggaggccgaggauguacuuaucaaauugacccgcguucucgcaaacauugccauccacccaggaguggguccgguccuggcugccaaucccggcaucguggggcuacugcucacaacucuggaauacaagucccuugacgacugugaggaauuggucauuaacgcaaccgcgacaauaaacaaucugucuuacuaucaggugaaaaacagcaucauucaggauaagaaguuauacaucgcugagcuccugcuuaaacuguugguuucaaauaacauggacggcauucucgaagccgugcggguauuuggaaaucugagucaggaucacgacgucugcgauuucaucgugcaaaacaauguucauagauuuaugauggcacuacuggacgcccagcaccaggauauauguuucuccgcuugcggugugcuccugaaccuuacugucgacaaggauaaaagggugaucuugaaggaagggggcggaauuaaaaagcugguagacuguuuacgcgaucucggcccuaccgacuggcaacuggccugccuuguguguaagacacuguggaauuuuucugagaacaucaccaaugcaagcuccugcuucgggaacgaagauacuaauacgcuacuccuguugcugucauccuucuuagacgaggaacucgcucuggacggaaguuuugauccagaccuuaaaaacuaucauaagcugcacugggagacagaguucaaacccguugcccagcaguugcucaaucggauucagcgacaucacaccuuucuggagccucuaccaauccccucuuucuga

SEQ ID NO: 53008 - RNA, 2598 nt, Artificial Sequence
  derived and/or modified sequence opt3 from ARMC3__Homo_sapiens__NP_001269674
augggcaagaaaaucaagaaagagguggaacccccuccaaaggacgucuucgauccgcugaugauugagagcaaaaaggccgcuaccguugugcucaugcuuaacucccccgaagaggaaauacuggcaaaggccugcgaggcgaucuacaaauuugcuuugaagggggaggaaaauaaaacaacuuuacuggagcuaggagccguagaaccucucacgaagcugcuuacccacgaggacaaaauugugagaaggaacgcaacaaugaucuucgguauucuggccucuaauaacgaugucaagaaguugcuccgggagcuggacgugaugaacucaguuaucgcucagcuggcaccagaagaggaaguggucauacaugaguuugccagucucuguuuagcuaauaugagcgccgaauauacuuccaaagugcaaaucuucgagcacggcgggcuggagccccuuauucgcuugcugucuucgccugauccagacguaaagaaaaauucaauggaaugcaucuacaaccuaguucaggauuuucagugucgagcgaagcuccaggagcugaaugcaauucccccuauccuugaccuguugaaaagcgaauauccagugauacaacuccuggccuuaaagacccugggagucauugcuaacgauaaagagagucguacaaugcucagagacaaucagggccuugaucaucugaucaagauuuuggaaaccaaggagcuaaacgaccugcacaucgaggcccucgcagugaucgcuaauugccuggaagauauggacacuauggugcagauucagcaaacaggugggcuuaaaaagcuguuguccuucgccgagaacucuaccauaccggacauccagaaaaaugcggccaaggcaauuacgaaagcugccuacgaucccgaaaacaggaagcucuuucaugagcaggaagucgagaagugucugguugcuuuacugggaagcgagaacgacggcacuaaaaucgccgcaucccaggccauaucagcuaugugcgaaaauaguggcagcaaggauuucuuuaacaaucaagggauuccucagcuaauccagcuccugaaaucugacaacgaggaagugcgggaggcggcagcccuugcuuuggccaaucugaccacauguaacccagcaaaugccaacgcugccgcagaggcggauggaaucgacccccucauuaaucugcuuuccucaaagcgcgauggugcuaucgccaacgcagccacuguacugaccaauauggcuaugcaagaaccuuugagacucaacauucagaaucacgacauaaugcacgccaucauuagcccacugaggagugcaaacacagugguccagucuaaagcugccuuagcggugaccgccacggcuugcgauguugaggcacggacugaacugcgcaauuccggcgggcuagagccccucguggaacugcuucgaagcaagaacgacgaggucagaaagcaugccucgugggcugugaugguaugugccggagaugaguugacagcaaacgaacugugcaggcucggcgcgcuggacaucuuagaggaaguuaaugugucugguacccggaaaaacaaguucuccgaggccgcuuauaauaaacugcuuaacaauaacuugucacucaaguacagucagacuggguaucugagcuccucuaauaucauuaacgacggauuuuacgauuacggccguauaaauccgggcacaaaacuacugccucucaaggaacugugucuucaagagcccagcgacuugcgcgccguccuguuaaucaacucaaagaguuauguguccccaccuagcucuauggaggauaaaucagacgucggguacggaagaaguauuagcuccucuucgagccucaggcgguccucaaaggagaaaaauaacgcagguuucggcagucccaucgaagauaagucugaaccagcuagcgggcgaaauaccgugcuguccaaaucagccacgaaggagaaaggauggcgcaagagcaagggcaaaaaggaagaggagaaaguuaaggaagaggaagaggugaugguaguccccaaauuugugggugaggggucuuccgacaaggaauggugcccuccaagugauccggacuucagcauguauguuuacgaggugaccaagucuauucuucccaucacaaacauaaaagaacagaucgaggaucuggcaaaguaugucgccgagaaaaugggcggaaagauuccuaaagaaaaguugccagacuucuccugggagcuccacaucucagaacugaaguuucagcuaaaaaguaaugugauucccaucggccauguaaagaaagggauauucuaccacagagcucugcucuuuaaggcgcuggccgauaggauuggaaucgguugcagccuugugcggggcgaguaugggcgcgcauggaacgaaguuauguugcagaacgacucgagaaaaggagucauuggcggucugccugcuccagagauguacgugaucgauuuaauguuccaccccgggggccucaugaagcugaggucccgugaagccgaccuuuaccgguuuauauga

SEQ ID NO: 53009 - RNA, 1839 nt, Artificial Sequence
  derived and/or modified sequence opt3 from ARMC4__Homo_sapiens__NP_001276950
augagagacuucagccuggcccaggagaccugccaacucgcuaucagggaugugggcgggcuugaaguccugauuaacuuguuagagacagacgaaguuaaguguaaaauaggaucccugaagauccuaaaagagauuucucacaauccccagauccggcagaacauuguggaucucgguggccugccuaucaugguaaauauacuugacucaccacauaagagucugaaaugcuuggcagccgaaacuaucgcgaacguggcuaaguuuaagcgcgcccgacgugucgugagacagcacgggggaauuacgaaacucguugcacugcuggauugugcccaugacagcaccaagccggcucaauccucucucuacgaggcaagggauguggaggucgcccggugcggcgcuuuagcccuguggucguguucaaaaagccacacaaauaaggaagcgauccgcaaagccggugggauuccccuuuuggcaagacugcuaaagaccagucaugagaacaugcucaucccugugguaggaacucugcaggaaugcgcuuccgaggagaauuauagggccgcaauaaaggcugaacggauuaucgagaaccuuguuaaaaaucugaacucugaaaaugagcaguugcaggaacacugugccauggcgauuuaccaaugcgccgaggacaaggagacacgcgaucucgugcgacugcacggcggcuuaaaaccacuggcaagccuccuuaacaauaccgacaacaaggaaagacuggcugccgucacuggggcuaucuggaaauguuccaucucaaaggagaaugugacaaaauucagggaauauaaggccauugagaccuuggugggacuacugacggaucagcccgaagagguccucguuaacgugguaggugcacugggcgagugcugucaggaacgggagaaccgugugauaguccgcaagugcgggggaauccagccucuugugaaucuguugguuggcauuaaccaagcccuccuggugaaugucacuaaagcugugggugcgugcgcaguagaaccagagaguaugaugaucauagacagauuagaugggguuaggcugcuauggagccuccugaagaacccccauccugacgugaaagccucugcugccugggcacuuuguccaugcauuaagaaugccaaagacgcuggagaaaugguccgguccuuugugggcggcuuggagcugaucgucaaccuccugaagucagauaauaaggaggugcuugccagcguuugugcagcgaucaccaacauugcuaaagaccaggaaaaucuggccgugaucacagaucacgggguagucccguugcucaguaagcuggcaaacacuaauaacaauaaauuacgacaucaccuggccgaggcuauuucucgcugcuguauguggggaagaaacaggguggccuucggugaacacaaggcaguugcuccccuagugcgguaccucaaauccaaugacaccaacguccaucgcgccacagcgcaggcccuguaucaacuuagcgaggaugcugacaacugcauaaccaugcacgagaauggcgcagugaagacggaaucgagacauguagccagguuggaguguucugauaacgaccuggggucccuccagccuccacccccuggauuuaagcguuucucaugccugaguuuacugagcuccugggauuacucuuuuuauuggaucuggcuuggcccauugacucggauuagccgaaaacuccagcuggugguuuaccccaucucagcugguuggcuacugcuccagagaaggcaagacacacuggaaaucuga

SEQ ID NO: 53010 - RNA, 2808 nt, Artificial Sequence
  derived and/or modified sequence opt3 from ARMC5__Homo_sapiens__NP_001098717
auggccgcugcaaagcccacccugacagacagccucuccuucugccuugcccagcuggcggcugccgcaggcgaggcccucgggggagaaaaagauccugcuacuaacgagacgccauuaucuagagcacugcuagcccucaggacccggcacaucaaggcugccgguggcauugaacgcuuucgagcgcgugggggacugagaccgcuucuggcauugcucaggcgggccgcugccgcaggcucagcucccagucaagccgguccugggagcgcgccauccucugccgcaucgggagcuucaagccccgccccugcuaguggcccagcccccuccgcagugucuagcuccucaccuacaccaccgguccgccugagaaaaacucuggaccucgccuuaaguauacuggcugauuguugcaccgagggcgcguguaggacagaaguucggcgccuugggggaaucuugccccuggugaccauucuacagugcaugaagacugacagcauccagaaucgaacagcaagagcccucgguaaccuggcuauggagccugagucuuguggcgauauucauugcgccggggcaguaccacuucugguggaauccuugaccgccugucaggacucacaaugccuccagagcgucgugagggcucugcggaauuuagccgauaguccccagcaccgucuggcacucgcgcagcaaggagcuguucgcccucuugccgagcuguuggcaacggccccagacgcugcccuaacucuggcacucgugagagcucugcuugaacugucuaggggcuguucccgggccugcgcggagcaguugagccucggugggggacugggccccuuagucucgcuggccucucauccgaaacgagcugugcgcgagggcaccauccuaauacucgcaaaccugugugcccaggggcuuaucagaccugcuuugggaaaugccgguggcguagaaguucugguggaugagcucaggcagcggcgcgaccccaacggggcauccccaacaucacaacagccucuggucagagcggugugccuucugugcagggaagccauuaaucgugcucgguugcgagaugccggaggccucgaccuguuaaugggucugcuaagagaucccagggcaagugcuuggcacccacgcaucguggccgcacucgucggguuccuguacgacacuggcgcccuuggacgguugcaggcucugggccucguuccccuguuagcggggcaacuguguggagaggccggugaagaggaggaagagggcagagaagcagcuagcugggacuuuccugaggaaaggaccccagagcgcgcccaagggggauccuuccgaucucuucggagcugguugauuucagagggcuaugccacagguccggaugacaucagucccgauugguccccugaacagugcccacccgagccuauggaaccagcuagccccgcaccgaccccuacgucucuccgugccccaagaacucagaggacacccgggcgcaguccugcggcugccauagaggaacccuggggccgggagggaccagcacugcuacugcucucaagauuuagccaggccccugaccccuccggcgcucuggugaccgggccagcacuuuacggauugcugacuuauguaacaggugccccgggcccucccucuccaagggcguuacgaauuuugucgcgccugaccuguaaccccgcuugccuugaggccuucgugcggagcuacggggcagcccuguugagagcuuggcucguccugggaguggccccugaugacuggccagcacccagggcucguccuacgcuacauucccgccaccgggaacugggcgagagacuccugcagaaucuuaccguucaggccgaaucaccguuuggugugggggcguugacacaccuguuacucaguggcucuccagaggauagggucgccugugcacugacucuucccuucaucugccgaaagccuagccuguggcggcgccuacuccuggagcagggaggcuugagacuguuacucgcugcccugaccaggccagcuccccauccucuuuuucuguucuuugcagccgacuccuugucaugucuccaagaucuggugagcccgacaguaucucccgccguuccacaggcugugccuauggaccuagauucccccaguccaugccuguaugaaccucuucucgggcccgcgccagucccggcaccugaccugcacuucuugcuggacagcggauuacagcuccccgcccagcgggcugccucugcaacugccuccccauuuuuccgagcucugcuuucaggcaguuucgcggaggcccaaauggaucuggugcccuugagaggucucagcccuggggcagcuuggccaguccugcaucaccuacacggaugucgcggcugcggugccgcacugggccccgugccuccgccagggcagccccuucucggaucggaagccgaggaagcucuggaggccgcgggcagguuuuuguuaccugggcuggaggaggaacucgaagaggcaguuggacguauucaucugggcccccagggugggccagaauccgugggagagguauuccggcuuggcagaccuaggcuggccgcucacugugcccgcuggaccuuggguucugagcagugcccccgaaagagaggccuagcucuggucgggcucguggaagcagccggagaggaagcuggcccacugacagaggcccuuuuagcaguugugauggggaucgaacugggagcgcgggucccugccuga

SEQ ID NO: 53011 - RNA, 1929 nt, Artificial Sequence
  derived and/or modified sequence opt3 from ARMC8__Homo_sapiens__NP_001253970
auggccugccugcucgagacccccaucagaaugagcgugcuuuccgaagucacagcuucuucaaggcacuacguugaccggcuguucgauccugacccacagaagguguugcaaggcguaauugauaugaaaaacgcagugauagggaauaacaagcagaaagccaauuuaaucguccugggagcggugccgcgccuacucuaucugcuucagcaggagacgaguagcacugaacugaagaccgagugugcuguuguguuggguucccucgccaugggcacagaaaacaaugucaaaucucugcuggacugccauauuauccccgcacucuuacaagggcugcuuucgccugauuugaaguuuauugaggccugucugcgaugccuacguacuaucuucaccucaccagugacacccgaggaacuccuguacaccggaccugaccaccagacuauacuuuuuaaccauggcgcuguacagaauaucgcacaccuguugacaagccucaguuauaagguuagaaugcaggcccugaaauguuucuccguguuagcuuuugagaacccacaagucucuaugacccuggugaaugugcucgucgauggugaacuucugccccagauuuucguuaagauguugcagagggacaaaccuaucgagaugcagcuaacgagcgccaagugccugacuuacaugugucgggcgggggcaauucgcaccgaugacaacugcaucgugcucaaaacacugccaugucuuguaagaaugugcuccaaggagaggcuguuggaggaacggguggaaggagccgagacucucgcuuaucugauagaaccggaugucgaguuacaacgcauugccucaaucaccgaccaucugauugcaaugcuagcugauuacuuuaaguaucccaguagcgugucugccaucacagacaucaaacgacucgaccacgaucugaagcacgcgcaugagcuuagacaggccgcauucaaauuguacgcuucccugggcgccaaugacgaagauauuaggaagaaaauaaucgagaccgaaaacaugauggaccggauuguuacgggccucucagagagcagugugaagguccgucuggcugccgugcgcugucuucacucucuguccagaagcguacagcaauugaggacuucguuucaggaucaugcaguuuggaaaccucucaugaaggugcugcagaaugccccagacgaaaucuuagucguggcuucuuccaugcugugcaaccuacuccuggaguucucacccaguaaggagccuauacuugaaagcggggcggucgaguugcugugcggacucacacaguccgaaaauccagcacugcgggugaacgguauuugggccuuaaugaacauggcuuuucaagccgagcagaaaaucaaggcagauauccugcgaucucuuagcaccgaacaguuguuccgccuccugucagacagugaucuaaauguucugaugaaaacucucggccugcuuagaaacuugcuguccacaaggccccacauugacaagaucaugagcacccacgggaaacagauuaugcaagccgugacguuaauacucgagggagagcauaauaucgaaguaaaggagcagacccuguguauucuugcuaacaucgccgauggcacaacugcaaaggaccugaucaugaccaaugacgauauuuugcagaaaauaaaguacuauaugggucacucucaugucaaacuccagcuggcggcuauguuuugcaucucaaaccuaauuuggaaugaagaggaggggagucaagaacggcaggacaagcugcgcgauaugggaaucguggacauucuccacaaacugagccaguccccggauucuaaccuuugugacaaggccaagauggcauugcagcaauaccuggccuga

SEQ ID NO: 53012 - RNA, 2457 nt, Artificial Sequence
  derived and/or modified sequence opt3 from ARMC9__Homo_sapiens__NP_001258395
augggcgacauccuggcccacgagagcgaacuccuugggcuggugaaggaguacuuggauuucgcugaauuugaggacaccuuaaaaacauucuccaaggaaugcaaaauuaagggaaaaccccuguguaagacugucgguggcucuuuuagagauucaaagagucuaacgauacagaaagaccucguugcagccuucgauaacggggaccaaaagguguuuuucgaucugugggaggagcauaucagcuccucuauuagggacggagauucguuugcgcagaaacuugaauuuuaucugcacauccauuuugcuauuuacuugcucaaguauucaguaggccggccugacaaagaggaacuggaugagaagaucagcuacuucaagaccuaucuggagacaaaaggugccgcacucagucagacuaccgaauuuuuaccauucuacgcccugccguuugugcccaauccuaugguccacccauccuucaaggagcuuuuccaggacucuuggacacccgaauugaaacugaagcuagagaaauuucucgcucugauaagcaaggcauccaacaccccuaaacuucugacuaucuauaaggaaaaugggcaaucaaacaaggagauuuugcagcagcuccaucagcaacugguggaggccgaacgccgaaguguuacauacuuaaaacguuacaauaagauccaggcugauuaucacaaccugauuggagugaccgccgagcucgucgacagccuugaagcgacggugucuggcaaaaugaucacuccagaguaccugcaguccguaugcguuagauuguucucaaaucagaugaggcaaagccuagcacacaguguggacuuuacccggcccggcacagccucuacuaugcugcgcgcuucccucgccccugucaagcugaaagaugugccacuucugccgagcuuggacuaugaaaagcucaagaaagaucugauauuagggucggacagacugaaggcauuccuacuccaggcucugagguggcggcuuaccacaucucaucccggagagcagcgcgagaccguguugcaagccuacauuuccaacgaucugcucgacuguuauucacacaaucagcgaaguguccugcagcuucugcauagcacguccgauguugugagacaguacauggcgagguugaucaacgccuuugcaucucucgcugaaggucggcuguauuuagcccaaaauacuaaaguacugcagaugcuagagggccgucucaaggaagaggacaaagauauuaucacacgcgaaaacgugcugggggcccuucagaaguucagcuugagaaggccucugcagaccgcuaugauccaagacggacucauuuucuggcuggucgauguguuaaaggacccagacugccugucagauuacacucuugaguacaguguugcauugcucaugaaucugugucuacgguccacaggcaaaaacaugugcgccaagguggcuggucugguccucaaagugcugagcgaccuuuuggggcacgagaaucacgaaauacagcccuauguaaacggagcgcuguacucuaucuuaucaguuccuaguauucgagaggaagcacgcgccaugggcauggaggauauccucagauguuucauaaaggagggcaacgcugaaaugauuaggcagaucgaguuuaucauuaaacagcugaauagcgaggaacuuccagacggggugcuggaauccgaugacgaugaggacgaggaugacgaagaggaucaugacaucauggaagccgauuuggacaaggacgagcucauucaaccccagcugggagaacuaucuggugagaagcugcucaccacggaguaucugggcauaaugaccaacacagggaaaacucggcgcaagggacuugcaaauguccaguggucgggcgaugaaccguugcagagaccugugacccccggugggcacaggaacggcuacccagucguggaggaccaacauacaccuccccagacugcccagcacgcucguaauggacauccacaagcccugcccgcagcgcacgaagcuguuuaucgggagggcaaaccuagcaccccagaauccugcgugucaaguucuagcgccaucauugcaaagccgggggagugguuaccccgaggaagacaggaggaaccuaggccagcccccacagguaccccucgccagccacgggaggcuccccaggauccgggcaacgggguaacuacgagagaaugugccuccgcauucacaugcaaaccuagggcuccauguacccccgagaugcucgacuggaauccucccaaggccaaagcgucaguccuggccccacuuuuuagcucuugcggaccucaacaggcuucccgccccggcaguacugcaagcucuacccgaggucugccauccucacagagucaccggaaguga

SEQ ID NO: 53013 - RNA, 1362 nt, Artificial Sequence
  derived and/or modified sequence opt3 from ARMCX1__Homo_sapiens__NP_057692
augggcagaaccagggaggccgggugcguggcugcaggagucguuaucggugccggcgcguguuacugcguguaucggcuggcuugggggcgcgacgaaaacgagaagauuugggaugaagacgaggaaagcacagauacuuccgagauaggaguagagacggugaaaggcgccaagaccaaugccggugcagggucuggagcuaaacuccagggcgacucagaagucaagcccgaggugagucuuggccuggaagauuguccugggguuaaagagaaggcacacagcggaucccauucugguggcggguuggaggccaaggcuaaagccuuauucaacacacugaaggaacaagcgucggcaaaagccggaaagggcgcucgaguggguacuaucucagggaaucguacccuagccccaagccucccgugccccggaggcagaggcgggggaugucacccuacaaggagugguucccgggcaggcgggcgcgcuucuggaaaaagcaagggcaaggccagauccaaaucaaccagggcgccagccacuacauggcccguccggcgcgguaaguuuaacuucccuuacaaaauugacgauauccugagugcaccagaccuucagaaggugcugaauauuuuggagcgaaccaacgaucccuuuauccaggaaguagcucucguuacgcuggggaauaacgccgcuuauagcuucaaucagaacgccauaagagagcugggcggagugccuaucauugcaaaacucaucaagacuaaagacccaauuaucagggaaaagaccuacaaugccuuaaacaaucugucugucaacgcugagaaucaaggcaagauaaaaacauauauuucccaggugugcgaugacacuauggugugucggcuugauucagcgguccagauggcaggguugcgucugcuaaccaacaugacaguuaccaaccauuaccagcaccuccugagcuauaguuuuccggacuucuuugcccuucuguucuugggaaaucauuuuacgaagauccaaauuaugaaacucaucaucaacuucacugagaaucccgcuaugacacgcgaacuggugucuugcaagguaccuuccgaguuaauuagccuguuuaacaaagaaugggacagagagauacuccuuaauauccugaccuuguucgaaaacauuaaugauaacaucaagaaugagggucuagccucgucuaggaaggaguuuucccggucaagucuguucuuccucuuuaaagaaagcggcgugugugucaagaaaauaaaggcacuggccaaccacaaugaccuugugguuaaagugaagguccugaagguguugacuaaacucuga

SEQ ID NO: 53014 - RNA, 324 nt, Artificial Sequence
  derived and/or modified sequence opt3 from ARMS2__Homo_sapiens__NP_001093137
augcugagacucuaccccggcccuauggugaccgaggccgaagggaagggagguccagagauggcuagccuuuccucuucagugguuccggugaguuucaucagcacacugagggaauccguauuggaccccggcgucgggggagagggcgcaucugauaaacagcggucgaaguuaucacugagccacaguaugauuccugccgcgaaaauacauacugaacuaugccucccagccuuuuucucccccgcugguacgcaacgccgauuucagcagccucagcaccaucugacccuuucuaucauucacacagcagcccguuga

SEQ ID NO: 53015 - RNA, 969 nt, Artificial Sequence
  derived and/or modified sequence opt3 from ARMT1__Homo_sapiens__NP_001273491
auguacagaaggauccacgaggccauuauacagagcccucccaucgacuauuucgauguguuuaaggaauccaaagagcaaaacuucuacggcucucaggaaucaauuaucgcucugugcacccaucuccagcagcuuauucggacaaucgaggaccuggaugaaaaucaauugaaggacgaguuuuucaaauuacugcagauaagucuaugggggaacaagugugaucucagccuguccggaggugagucuucgucacagaauacuaacguccuuaauagccuggaagacuugaaaccauuuauccuccugaacgauauggagcaccuguggagucucuuauccaauugcaagaagacgcgcgaaaaagcaucugccacccgaguuuauauugugcuggacaacagcggcuucgagcuuguaacagauuugauccuggcggacuuucuacucuccucagagcuggcuacugaagugcauuucuacgggaagaccauuccgugguuugucagugauacaaccauccacgacuucaauuggcuuauagaacaggugaaacauagcaaccacaaguggaugucuaaauguggagccgauugggaggaguauauuaagaugggcaaguggguuuaccacaaucauaucuuuuggacucugccccacgaauauugcgcaaugccucaaguggccccagacuuguacgcugagcuccagaaagcacaucugauuuuauucaagggugaccugaacuaccguaaacucacaggggauagaaagugggaguuuuccguccccuuccaccaggcccuuaauggauuccacccugcuccacuguguaccaucaggacguugaaagccgaaauccaggugggccuacaacccggccagggggagcagcugcucgcgucagaaccuagcugguggacuaccggaaaguaugguauuuuucaauacgacggcccacuguga

SEQ ID NO: 53016 - RNA, 2154 nt, Artificial Sequence
  derived and/or modified sequence opt3 from ARNT2__Homo_sapiens__NP_055677
auggccacccccgcugcagugaacccuccagagauggccagcgacaucccgggcuccgucacacugcccguugcgccuauggcugccacuggacaggugagaauggcaggggccaugccagcuagggguggcaagcggcgcucugggauggauuucgacgaugaagacggagagggccccucaaaauuuagucgagaaaaucacagcgagauugaacguagaaggcggaacaagaugacgcaauacauaaccgagcucuccgauaugguaccuacaugcucugcacuugcccgcaaaccagacaagcugacuaucuugagaauggcugugucgcauaugaaaucaaugagggguaccgggaauaagagcacagauggagccuauaagcccaguuucuuaaccgagcaggaacugaaacaccuaauucucgaggcggcagacggcuuucuguucgucguggccgcugaaacuggccggguuaucuacguguccgauucugucacaccugugcuuaaccagccacagagcgagugguuuggguccacccuguaugagcaaguacauccggacgauguugaaaaguugcgcgagcagcucuguacgucagaaaauaguaugacuggacgaauccuggaccugaaaaccgguacagugaagaaagagggccagcagagcucuaugagaaugugcaugggguccaggcggucauucauuugucguaugcgcugcggaaacgcaccccucgaucacuuaccucugaauagaauaacuaccaugaggaagcgguuucgaaacggccuugguccagucaaggaaggggaggcccaauacgcuguggugcauuguacaggauauaucaaagccuggcccccugcgggcaugaccauuccagaggaagacgccgacgucggccaggggagcaaguacugcuugguugcaaucggacgccuacaggugacgaguucucccguauguauggauaugaaugguauguccgugccgacugaguuccugagcagacacaacucggacggcauuaucacauuugucgauccuaggugcauaucugugauuggguaucagccccaagaccuccugggaaaagauauccuugaguucugucacccagaagaccagucccaucugcgggaaucauuucagcaaguugugaaguugaaaggccagguccucagugugauguaccgcuucagaaccaagaauagggaguggaugcugauucguacuagcuccuuuacauuccagaacccuuacucugaugagaucgaauauaucauuugcaccaauacgaacguaaaacaguuacaacagcagcaggcugagcuggaaguucaccaacgggacggucucagcucauacgaucuuagucaggugcccgucccaaaucugcccgccggggugcaugaggcuggcaaguccgucgaaaaggccgacgcaauauucagccaggagcgagauccuagauuugccgagauguucgcuggaaucucugcgucagagaaaaagaugaugaguagcgcauccgccgcuggcacccagcaaauuuauucucaggggucgccauuuccgagcggacacuccgguaaagccuucucaaguucugugguucacgugcccggcguaaacgacauccagagcuccucaagcacagggcagaacaugucucaaauauccaggcaguugaaucagagucaagucgcauggacuggaagccgcccuccauuucccggccagcagauuccuucucaguccucaaagacccaaaguagcccauucgguaucgggacaucgcauacuuaccccgccgacccguccucuuauagcccucuaucaaguccagcuaccuccucucccagcggcaacgccuacuccucacuggcaaaucggacaccuggauuugcggaaagcggccagaguucugggcaguuccagggaagacccuccgaaguguggagccaauggcagucgcagcaccauggucagcaaucaggcgagcagcacucucaucagcaaccagggcagaccgagguuuuucaggauaugcucccuaugcccggagacccaacucagggcacggguaacuauaauaucgaagauuucgcugaccuggggauguuuccgccuuucagugaguga

SEQ ID NO: 53017 - RNA, 2319 nt, Artificial Sequence
  derived and/or modified sequence opt3 from ARNT__Homo_sapiens__XP_011507849
auguaccaccauugggugcagccccugccucucgagacccuugaccuggaguucaaggucgaagaaccauugagcagaggcuuacuguccggggaucaagccggacuaaaauaucuccugcuugcuuuucugagguuggacuucgaugacgauggugagggcaacucuaaguuucuccggugcgacgaugaccagaugucaaaugauaaagaacgcuucgcacgagagaaccacagugagaucgaacguagaaggcggaauaagaugacagccuacauuacugagcugagcgacaugguuccgacguguuccgcgcuggcucgcaaacccgauaagcucaccauauuaagaauggccgugucucauaugaagucgcugagggggacaggaaacacuucaaccgacggcagcuauaaaccuaguuuucuuacagaucaggaauugaagcaccugauccuagaggcagccgacgguuuccucuuuauuguauccugcgagaccgggcggguggucuacgugucugacagcguuacuccagugcugaaucagccccaauccgaaugguucggaucaacacuuuaugaucagguccauccugacgauguggacaaacugcgcgagcaguugaguaccagcgaaaacgcucucacgggccgaauccuggauuuaaagacuggcaccguaaagaaggaggggcagcaaucuuccaugagaauguguaugggaucaaggcggagcuuuauuugccguaugcgcugugguaguucuuccguugacccagugagcgucaauagacugucguucgugaggaaccggugccgaaauggccucgggucugugaaggauggagaaccccacuuugucguugugcacuguacaggcuacaucaaagcauggccuccagccgguguaucccuuccggacgaugaccccgaggcugggcagggaucaaaguucugccugguggccauaggccgcuugcaggucacuucgagcccuaacuguaccgauauguccaaugugugccagccaacagaguuuaucucuagacauaacauugaaggcaucuucaccuucguugaccacagguguguggcgacggucggguaucaaccccaggagcuacuggguaaaaauauuguggaauuuugccauccugaggaccagcaacuccugcgggauagcuuccagcagguaguuaaacuuaaaggacaggugcugucagucauguuucgcuucagaaguaagaaccaagaaugguuguggaugaggacuuccagcuuuacauuccagaauccauacucugacgagaucgaguacauaauuugcaccaacacuaacgugaaaaauucaagucaggaaccccguccgacacucagcaacaccauccagcggccucaacugggccccacggcaaauuuaccacuggagaugggguccggacagcuagccccucgacagcagcaacagcagaccgaacucgauaugguccccggcagagacggucuggcuucuuauaaccacagucaggugguucaaccagugacaacuaccgggcccgagcacagcaagccucuugaaaaguccgauggcuuguuugcccaggacagggauccacgcuucucagagauuuaccauaauaucaacgcagaccagaguaaaggaaucucuagcuccacaguaccggcuacucaacagcuguuuucacagggcaauaccuuucccccuacaccacggcccgccgagaacuucagaaauagcgggcucgcgccuccagucaccauugugcagcccucugccuccgcaggacaaaugcuggcucagauaaguaggcacagcaacccgacucagggugccacgccuacauggaccccaacuacccgcucuggcuucuccgcucagguugccacacaagcaaccgccaagacucgaacaucacaguuuggggugggaaguuuccagacgcccagcucguucuccucuaugagccuuccuggcgcucccaccgcgucaccaggugcagccgcuuauccuagucugacuaaucggggguccaacuuugcccccgaaacaggccagaccgcaggacaauuccagacacguacugccgagggcgucgggguguggccacaguggcaaggacagcagccgcaucacagaucuagcuccucagaacagcauguacaacagccucccgcucagcagccaggucaacccgagguguuucaggagauguugagcaugcucggcgaucagaguaauucuuacaacaaugaagaguucccugaccugaccauguuuccacccuucuccgaauga

SEQ ID NO: 53018 - RNA, 1869 nt, Artificial Sequence
  derived and/or modified sequence opt3 from ARNTL2__Homo_sapiens__NP_001234931
auggccgcugaggaagaggcagccgcgggcgggaaggugcugagagaagagaaccagugcaucgcucccgucguuagcuccagggugucuccuggaacccggccaacagccauggguucauucaguagccacaugacugaauuuccgcgcaaacgaaagggcuccgacucugaucccucgcaaucagggauuaugacggagaaaguaguggagaagcucagccagaauccucuuaccuaccuguugaguacacguauagaaaucuccgcaucuagcggauccagagaggcccauucacagacugagaaaaggcggcgcgacaagaugaacaauuuaauugaggagcugagugcuaugaucccacaguguaaccccauggcaagaaagcuagauaaacucaccguccugaggauggccgugcaacaccuucggagccugaagggcuugacaaauucuuauguugguuccaacuaccgcccuucauuccuccaggacaaugaacugcgacaucugauucucaaaaccgcugagggguuuuuauucguggucggaugcgaaagaggcaagauccuguuugugagcaaaaguguaucuaagauacuuaacuaugaucaggccuccuugacuggccagagccuguucgacuuucuacacccaaaggauguugcgaaagugaaggagcaacucucgucuuucgacaucucccccagggaaaaacugauugaugcaaagacagggcuucagguccauucaaaucugcacgccggacggacccguguguacagugguagccgcagauccuuuuucuguaggaucaaaucuugcaagauuagcgugaaagaggagcacggcuguuugccuaacucaaagaagaaagaacaucggaaguuuuauacgauccacugcacuggguaccuccgaaguuggccaccgaauauagucggaauggaggaagaacgcaacuccaaaaaggacaauagcaacuucaccugucugguugcuauuggcagauuacagcccuauaucgugccucaaaauucuggugaaauuaacguaaaaccaacagaguuuaucacuagguucgccgugaacgggaaguucgucuacguggaucagcgggcaaccgcuauccugggauaccucccccaggagcuucugggcacaucaugcuaugaauacuuucaucaggacgaucacaauaacuugaccgacaagcacaaagccguucuacaaaguaaggagaaaauucugacggacagcuauaaguuccgcgcgaaagauggcuccuuugugacucucaagucucagugguucucguuuacaaauccuuggaccaaggaacuggaguacauagucagcgugaacacucuuguacuggggcauuccgaaccaggagaggccucauucuugcccuguaguucucagagcuccgaggaaucaagcagacagucuugcauguccguuccggguaugaguacaggcaccgugcucggggcaggaagcaucggcacggacauugcuaaugagauccuggauuuacaaaggcugcagucuuccucauaucuagacgauaguagcccuaccggucucaugaaagacacacacacugucaacugucguucgauguccaauaaggaacuguuucccccaucuccuagcgagaugggggagcuugaagccacccggcagaaccagucaacaguggcuguccauagucacgagcccuugcuguccgauggcgcccaacucgacuucgaugcacugugcgacaaugaugacacugccauggcugcguuuaugaacuaccuugaagcagagggaggccugggggacccaggagauuucucugacauacaguggaccuuguga

SEQ ID NO: 53019 - RNA, 1878 nt, Artificial Sequence
  derived and/or modified sequence opt3 from ARNTL__Homo_sapiens__NP_001025443
auggccgaccagagaauggauaucagcuccaccauuucugacuucaugucacccggcccuacagaucugcucaguagcucccuugggacuucuggaguggacugcaacaggaagcggaaagguucgucaacggauuaccaagagagcauggacaccgauaaggacgauccacacggccgccuggaauauacagagcaucaggggcgaaucaaaaaugcucgugaagcacacagucagauagagaagagaaggcgggacaaaaugaacuccuuuauugaugaauuggccucuuuagucccgacuuguaaugcgaugagccgcaagcuggacaagcuaaccguucucagaauggcugugcagcauaugaaaacacugaggggagccaccaaccccuacacugaggcaaauuauaagccuacauuccuuuccgaugacgagcugaaacacuugauccuccgggccgcugacggcuuucuguucguaguggguugcgaucgcgggaagauucuguuugucucagaaaguguguucaaaauccucaacuacagccaaaaugacuuaauaggacagucucuguuugauuaucuucauccaaaggacaucgcaaagguuaaagagcaguuguccucaagcgauaccgcccccagggaaagacugauugacgcuaagacgggccuaccugugaaaacugauaucaccccaggccccaguaggcucuguucuggggcccggcguuccuucuuuugccgcaugaaguguaacagaccuagcgucaaaguggaggacaaggauuucccaucgacaugcucuaaaaagaaggacaggaaauccuuuuguacuauucacucaaccggauaccugaagaguuggccgcccacaaaaaugggucuugaugaggacaaugaaccugacaacgagggcugcaaucugagcuguuugguagcgaucgggcggcuccacucccauguugugccacagcccgucaacggagaaauacgagugaagucuauggaguaugugagccgccacgcaauugauggcaaauucgucuuuguugaccaaagagccaccgcuauccuggccuacuuaccucaggaacugcucgguacgucaugcuacgaguauuuccaucaggaugacauugggcaccuugcagagugucaccgacaggugcugcaaacucgggaaaagaucacaaccaauugcuacaaguucaaaaucaaggauggaaguuuuauuacuuugcgcuccagaugguucagcuuuaugaacccauggacaaaagagguagaauauauagugucuaccaauacggucgugcuagcuaacguucuggagggcggcgaccccaccuucccgcagcucacagccucaccucauaguauggauagcaugcugcccuccggggaaggagguccaaagaggacucacccuaccgugcccggcaucccagggggaacacgugcgggcgccgguaaaauugggcggaugaucgcagaggagauaauggaaauucaucgaaucagaggaucuucgcccagcuccugcggcucaaguccucuuaacaucacuucuaccccaccgcccgacgcuagcuccccuggcgggaagaagauucugaauggagguacaccagauauccccucaagcggcuugcucucugggcaggcccaagagaacccuggauacccauauuccgacaguagcucuauucugggcgaaaauccccacauagguaucgauaugauugacaacgaucagggguccucaaguccgagcaaugacgaggcugccauggcagucaucaugucguuacuggaagccgacgcuggccuaggaggcccuguggauuuuuccgaccucccauggccccuguga

SEQ ID NO: 53020 - RNA, 1071 nt, Artificial Sequence
  derived and/or modified sequence opt3 from ARPC1A__Homo_sapiens__NP_001177925
augcccggcaccgggaucgugcugauugcccucagcccuaacaaucacgagguccauauauacaagaaaaacggaucccaguggguuaaggcucacgaacuuaaagagcauaauggucacaucacaggcauugacugggcaccaaagucugauagaaucgugacuugcggggccgacaggaacgcguauguauggucacaaaaagauggaguguggaagccgacgcuggucauuuugcggaucaaucgcgcugccaccuucgugaaguggagucccuuagaaaacaaauuugcaguuggcagcggugcccgacugauauccguguguuacuucgagucugaaaaugacuggugggucucgaagcauaucaaaaagccuauucguucaacagugcuaagccucgauuggcacccaaacaauguacugcuugcugcagggaguugcgacuuuaaauguagaguuuucuccgccuauaucaaggagguggaugagaagcccgcuucuacuccuuggggaagcaaaaugccauuuggccagcugauguccgaauuuggcgggucaggaaccgguggcuggguccacggggugaguuucagcgccucuggauccagguuggcgugggugucacaugacagcacagucaguguugcagaugccucuaaguccgugcagguaagcacccucaaaacugaguuccugccccugcucucggugucuuuugucuccgaaaacucagugguugcugccggccacgacugcuguccuauguuauucaauuacgaugaccgggguugccugacauuugugaguaaacuugauauuccaaagcagagcauccaacgcaacauguccgcaauggagagauucaggaauauggacaagcgggcuaccacggaggaccgcaacacugccuuggaaacccugcaucaaaauucuauaacacaggucagcauuuaugagguggauaaacaggacugucgaaaguuuugcacuaccgggaucgauggagcgaugacaauuugggacuucaagacccuagaaucaaguauccagggccucagaaucauguga

SEQ ID NO: 53021 - RNA, 1119 nt, Artificial Sequence
  derived and/or modified sequence opt3 from ARPC1B__Homo_sapiens__NP_005711
auggccuaccacagcuuccugguggagcccaucuccugccaugcuuggaacaaggacagaacccagauugcaauauguccuaauaaccacgaaguccauaucuaugagaaaucuggcgccaaguggacaaaaguucacgaacucaaggagcauaaugggcaagugacuggaauugauugggcgccagaaucaaacaggaucguaacgugcgguaccgaccggaaugcuuacguguggacacuuaaaggccgcacuuggaagccgacccuggucauuuugcgaaucaaccgugccgcaagaugugugaggugggcccccaaugagaacaaguuugcuguugggaguggaagccgggugauauccaucugcuauuucgagcaggaaaaugauuggugggucuguaaacacauuaagaaaccuauccgcucuacaguguuaucgcuggacuggcacccaaacaauguacuacucgcagccggcucaugcgauuuuaaguguagaauuuucagcgcuuacaucaaagagguugaagagaggcccgccccuaccccaugggguaguaagaugcccuuuggggagcugauguucgaauccucuagcuccugcggaugggugcauggcgucuguuuuucagcgaguggcagccggguggcaugggugucucacgacuccacugucugccuugccgaugcugacaagaaaauggccguugcaacacuggcuucagagaccuugccucuccuggcccugacguucauaacugauaacagccucguggcggccgggcaugacuguuuuccaguauuauucaccuaugaugcagcugccggaaugcugaguuuugguggccgccuugacgugccgaagcagucuucccagcgaggguugacagcuagagaaagguuccaaaaucuggauaaaaaggccagcucggagggaggcacugcagccggugcugggcuagacucucuccacaaaaacuccgucucacagauuagugugcugagcggaggcaaggcgaaaugcucccaguuuugcaccacaggcauggacgggggaaugucuaucugggauguuaagagccuugaaucagcacugaaggacuugaaaauuaaguga

SEQ ID NO: 53022 - RNA, 903 nt, Artificial Sequence
  derived and/or modified sequence opt3 from ARPC2__Homo_sapiens__NP_005722
augauccugcucgaggugaacaauagaauuauagaagagacccuugcccugaaguucgaaaacgcugcagccggcaauaaacccgaggcggucgaaguuacauuugcugacuucgaugggguguuguaccacaucagcaacccuaauggagacaagacuaaaguaaugguguccauuucuuuaaaguuuuauaaagagcugcaggcccauggugcagaugagcuacucaagagggucuacggcucauuccuggugaacccagaaaguggguauaauguuagccuucuguacgacuuggagaaccucccggccuccaaggauucuaucgugcaccaagcuggaaugcugaaacggaauugcuuugcaucggucuucgaaaaguauuuucaguuccaggaggagggcaaagaaggugagaaccgcgccgugauucauuaccgagacgaugaaacgauguauguagagucaaagaaagaccguguuaccguggucuuuagcacaguguucaaggaugacgaugacguggucaucgggaagguuuuuaugcaggaguucaaagaaggaagaagggcuagucacacugcgccccaagugcuguuuucccaucgggagccuccacucgaauuaaaggauaccgacgccgcaguaggcgacaauauaggcuacaucacauucgugcuguucccccgccacaccaacgccucugcuagagauaauacuauuaaccuuauccacacauuuagggacuacuugcauuaucacauuaaauguagcaaggccuacauccauacccggaugcgcgcaaaaacguccgauuuccugaagguccuaaaucgagcuagaccugacgccgagaaaaaggaaaugaagacuauaaccgggaaaacauuuucaaguagguga

SEQ ID NO: 53023 - RNA, 537 nt, Artificial Sequence
  derived and/or modified sequence opt3 from ARPC3__Homo_sapiens__NP_001265485
augcccgccuaccacagcucccugauggacccugauaccaagcucaucggcaacauggcacuucugccaauuagaucucaguucaaagggccggcucccagggagacaaaggacacugauauaguggacgaagccaucuauuacuuuaaagcgaaugucuucuuuaagaacuaugagauuaaaaaugaagcugaucggacguugaucuacauuaccuuauauaucucagagugccugaagaagcuacaaaaauguaacaguaagagccagggagaaaaagagauguacacacucgguauaacuaauuucccuaucccaggcgagcccggguuuccucugaacgccauuuaugcaaagccagccaauaaacaggaagacgagguuaugcgcgcuuaccuucagcaacugcgacaggaaaccggauugcgucucugcgagaagguguucgauccccagaacgacaagccuuccaaaugguggacauguuuuguaaagagacaguucaugaauaaaucucugucgggcccaggucaauga

SEQ ID NO: 53024 - RNA, 465 nt, Artificial Sequence
  derived and/or modified sequence opt3 from ARPC5__Homo_sapiens__NP_001257368
augagcaagaacaccguguccucugccagauucaggaaagucgacguugaugaguacgacgaaaauaaguuuguggaugaggaagacggcggggauggacaggcuggucccgacgagggcgaaguagauucaugccugcggcacaguaucacagggaacaugacugcagcccuccaagcggcucuuaaaaauccuccaauuaacaccaagagccaggccgugaaagaccgcgcaggauccauaguccugaagguguugaucucuuucaaggccaaugauauugagaaagcuguucagucguuagacaagaacggcguggaucugcuaaugaaauauaucuacaaggguuuugagucaccgagcgacaauaguuccgcaaugcuccugcaguggcaugaaaaagcccuugcugccgggggagucggcucuauugugcgaguacugacggcgcguaagacaguuuga

SEQ ID NO: 53025 - RNA, 681 nt, Artificial Sequence
  derived and/or modified sequence opt3 from ARPIN__Homo_sapiens__NP_872422
augagcagaaucuaccacgacggcgcccugaggaacaaggcugugcaguccguccggcuccccggggcaugggauccugccgcgcaucaaggagguaauggcguucuucuggagggggaauugauugacgugucucgccacucaauauuagauacccauggacgaaaagagcguuauuacguacuguauaucagaccaagucacauucauaggcggaaguucgacgcuaaaggcaacgaaaucgagccgaauuuuagcgccacacgcaaggugaacacugguuuccuaauguccucuuacaaagucgaagcaaagggggauacggacagacucacccccgaggcccugaagggacuugugaauaaaccugagcuguuggcucucacagaaucgcugacuccagaucacaccguugcauuuuggaugcccgagucagaaauggaggugauggagcuggaacucggcgccggcgucagguuaaagacacgcggggacggaccuuuccuggauagccuugcuaaauuggaggccgguaccgugacuaagugcaacuuuacaggcgacgggaaaaccggagcgaguuggacggauaauauuauggcacagaaguguuccaagggcgccgcugccgaaauccgggagcagggugacggggcagaagaugaggagugggacgacuga

SEQ ID NO: 53026 - RNA, 270 nt, Artificial Sequence
  derived and/or modified sequence opt3 from ARPP21__Homo_sapiens__NP_001020240
augagcgagcagggcgaccugaaccaagccaucgcugaagaagggggaaccgagcaggagacagcaacucccgaaaaugguauugugaaguccgagucucucgaugaggaagagaaacuugaacugcagagaagguuggaggcccagaaccaagagcggcgcaagucaaaaaguggcgcggggaagggaaaauuaacgcgaagccuggcugucugcgaagaguccucugcccguccuggcggugaaucgcuacaggaccagacccucuga

SEQ ID NO: 53027 - RNA, 1167 nt, Artificial Sequence
  derived and/or modified sequence opt3 from ARR3__Homo_sapiens__NP_004303
augagcaagguguucaaaaagaccuccucuaacggcaaacugucaaucuaccucgggaagagagacuuugucgaucacguugacacaguggagcccauugauggaguagugcuugucgacccugaauaucugaaaugcaggaaguuguucgugauguuaacuugugccuuucgguacggucgcgaugaccuggagguuauaggccuaacguuccgaaaggaucucuaugugcagacccugcaagucgugccagcugaaaguagcuccccgcaggggccccuuacaguacugcaggagcguuugcuccauaaacugggagacaaugcauacccuuuuacucugcagaugguuaccaaccucccaugcucugugacauuacaacccggcccugaagaugccgguaagccaugugggaucgacuucgaggucaaaucguuuugcgcggagaaucccgaagagaccgugucaaagagagauuaugugaggcuggucguucggaaagugcaguucgcuccuccagaagccggaccgggccccagcgcacagacuauucgcagauuucuuuugagugcccagccucugcaacuacaggcuuggauggacagggagguacacuaccauggcgagccaaucuccgugaacgucucuauuaauaacuguacaaauaaggugaucaagaaaauaaagaucagcguugaucagauuaccgacgugguccucuauucccuggacaaauacacgaagacuguguucauccaggaauuuaccgagacaguagcagccaacucaaguuucagccaaucuuuugcuguuacucccauucuugccgcguccugccagaaacgggggcuggcauuggauggaaagcucaaacacgaagacaccaaucuggccucaagcacaaucauacgcccugguauggauaaggaguuacugggcauucucgugaguuacaagguccgagugaaccuuauggucucuugugggggaauccugggcgacuugaccgcuuccgauguggguguugaacuaccacuggugcucauucaucccaaaccgagccacgaggccgcaucgucugaggacaucguaaucgaagaguucacgagaaagggggaagaggaaucccagaaagcugucgaggccgagggagaugaaggcucauga

SEQ ID NO: 53028 - RNA, 1257 nt, Artificial Sequence
  derived and/or modified sequence opt3 from ARRB1__Homo_sapiens__NP_004032
augggcgacaaggggaccagaguguucaaaaaggccagccccaacggaaaacugacagucuaccucgguaagagggauuuuguugaccacaucgaucuuguggacccuguagauggcgugguccugguggacccagaguauuugaaagaacggcgcguuuacgugacuuuaacgugcgcuuuccgauaugggcgugaggaucuggacguccuaggacucaccuuuagaaaggaucuguucguggcaaauguacaguccuuuccgcccgccccugaagacaagaaaccacuuacaaggcugcaagagcgguugauuaagaaacucggcgaacaugcguaccccuucacuuuugagauaccuccaaaccugcccuguucuguuacccugcagccugguccagaggauacagggaaggcuugcggaguggacuaugaagucaaagccuucugugcagagaaucucgaagagaagauccacaagcgcaacucagugagauuagugauuaggaaaguccaguacgccccggagcggcccggcccucagccaaccgcugaaacuacacgccaauuucugaugagugauaagccccuucauuuggaggcaagccuggacaaagaaaucuauuaccacggcgagccuauuuccguuaaugugcauguaaccaacaauacgaacaagacugugaaaaagaucaaaauaucuguccgacaguacgccgacaucugccuauucaauaccgcucaguauaaguguccaguggccauggaagaggcggaugacacaguugcacccucgucaacuuuuugcaagguguacacccucacaccguuccuggccaacaauagagagaaaagggggcuugcucuggauggaaaguugaaacacgaagacaccaaccucgccagcaguacgcuguuacgggagggugcaaaucgugaaauucugggcaucauugucuccuauaaggugaaaguaaagcucguugugucucgcgggggacuucugggcgauuuggcuagcuccgacgucgccguggagcuaccuuuuacucugaugcaccccaagccaaaagaggaaccuccccauagagaggucccagaaaacgagacacccguggauaccaaucucaucgaacuggacacuaacgaugacgauauaguuuucgaggacuucgcgaggcagcggcuuaaggguaugaaagacgauaaggaagaggaggaagacgggacaggaucaccucaacugaacaaucgauga

SEQ ID NO: 53029 - RNA, 993 nt, Artificial Sequence
  derived and/or modified sequence opt3 from ARRB2__Homo_sapiens__NP_001244258
augggcgagaagcccgggaccagaguguucaaaaagagcuccccuaacugcaaacugacagucuaccucggaaagagggacuuuguugaucaccuugacaaaguggauccaguagacggugugguccugguggauccggacuauuugaaggaucggaagguuuucgugacuuuaacgugugccuuucgcuacggccgagaagaccuggauguccuagggcucucuuuccguaaagaccuguuuaucgcuaccuaucaggcauucccuccugugccaaaucccccuagaccacccacaaggcuucaagaucggcuguugcgcaagcucggacagcaugcccaccccuuuuucuuuacuauuccacagaaccugccgugcucaguaacccugcagcccggcccugaggacacagguaaagcgugugggguugauuucgaaauaagagcuuuuugcgccaagagucucgaggaaaaaucccauaagaggaauagcgugcgguuagucauccgcaaggugcaauucgcaccagagaaacccggaccucagccaucugccgagaccacucgacacuuucugaugucggacagaucacuucauuuggaagcuagccuggacaaggagcuauacuaucacggcgaaccccucaacgugaauguccacguuacaaacaauaguaccaaaacggugaagaaaauuaagguauccgugaggcaguacgcagauaucugucuguucucuacugcccaguauaaaugcccggucgcucaacuugagcaggacgaucagcgggagggcgggugucagcaaggaggugccggcaacccuggggugcugcagggacagggcgaagcgggugggguuagccgucgcggaugcuuguguggcgcagccuucugcuccuacgcuccccaagccccaagaccucaucccccaccccagaccccugugucaaggaguggcgaccgguguccaugcgggcaccagccgcauuga

SEQ ID NO: 53030 - RNA, 1209 nt, Artificial Sequence
  derived and/or modified sequence opt3 from ARRDC2__Homo_sapiens__NP_001020775
augagaagcggcggggugagguccuucgcccuggagcucgcucggggacccgguggcgcauaccgcgggggagaacgacuuugcggccguguccuguuggaggccgcggcuccuuuaagaguuagggcccuggaagugaaggcacgggguggggccgcuacccacuggcuagagggacgcucuguaggcgugaacgcagucucaagugacuaugccgcugccgaaacauaccucagaaggcggcagcugcuucugcgcgauacuggcgagacgaccacauugccaccggggcgacaugaguuucucuucagcuuucaacugcccccuacucuggugaccuccuucgaaggaaaacacgguucuguuagauauuguaucaaggcgacacuccauaggccaugggugcccgcacggcgugcccgcaaagucuuuaccgugauugagccuguagacauaaauacuccagcuuuacuggcaccccaggccggcgcuagagaaaagguugccaggucgugguacugcaaccgggggcuugugucauugagcgcgaaaaucgaucgaaagggauauacaccuggcgaggucauuccaguguucgccgagaucgacaaugguaguacccgcccggugcugcccagagcagcugucguucagacgcagacuuuuauggccaggggagcucggaagcaaaaacgcgccgugguagcaucccuagccggggaaccugugggcccaggccagagagcucucuggcaggggagggcgcugcguauucccccugucggaccaucuauccuucacugucgggugcugcauguugauuacgcauugaaggugugcgucgacauacccgguaccagcaaacuccuguuagagcugccgcucgugaucggcacaauuccucuucaccccuucgggucccgaucaaguagcguaggaucucacgccuccuuucuguuggauuggagacuaggcgcucugccagaaaggccugaggcacccccagaauauucagagguuguggccgacacugaggaagccgcucucggucagagccccuucccucugccacaagauccggacaugagucuugaggggcccuuuuucgccuacauccaggaauuucgcuaccggccuccaccccuguauucugaggaagauccuaacccauugcucggcgacaugagacccagguguaugaccugcuga

SEQ ID NO: 53031 - RNA, 1245 nt, Artificial Sequence
  derived and/or modified sequence opt3 from ARRDC3__Homo_sapiens__NP_065852
auggugcugggcaaggucaaaagccucaccaucuccuucgacugccuuaacgauucuaauguucccguguacucaaguggggacacaguaagcggaagagugaaccuggaggucacuggugaaauuagggugaaguccuugaaaauacacgcccggggccaugcuaagguucgcuggacggagucucgaaaugcagggucgaacaccgccuauacacagaauuacacugaagagguggaauauuuuaaccacaaagauaucuuaauuggacaugagcgugacgaugacaauucagaggaaggcuuccacaccauccauagcgguagacacgaguacgcguuuaguuucgaacugccucaaacaccacuagcuaccuccuuugaggggaggcacggaucuguccgguauugggugaaggccgagcuccaucgcccguggcugcuucccguaaagcugaaaaaggaguucacuguuuuugagcacauugauaucaacacaccuagcuugcucuccccacaggcaggcaccaaagaaaagacgcuguguugcugguucuguacuucaggccccauaagucugagcgccaaaaucgagagaaagggguacaccccuggagaaucuauucagaucuuugcugagauugagaauugcuccucaaggaugguggucccaaaggcagccaucuaucagacacaggcuuucuacgccaaagguaagaugaaagaagugaagcaacucguggcgaacuuacggggcgagagccugaguucugggaaaacugaaaccuggaauggaaaacuuuugaagauacccccugucuccccaagcauucuggacuguucgaucauucgcguugaguacucucuaaugguguauguagauaucccgggcgcaauggaccucuuucugaaccuuccccuggugaucgguacaauuccuuugcauccauucgggucccgaaccucaagugucagcucccagugcucuaugaauaugaacuggcucagccugucauuacccgaaagaccugaggccccacccaguuacgcugaggugguuacggaagaacagaggcggaauaaccuggccccgguguccgcaugugaugacuuugaacgugcucuccaaggaccucuuuucgccuauauacaggaguuccgcuuucugcccccaccuuuguacagcgaaaucgaucccaacccagaccagucugcggacgauagacccucaugcccuaguagguga
